United States Patent 9,782,462 (MODIFIED POLYNUCLEOTIDES FOR THE PRODUCTION OF PROTEINS ASSOCIATED WITH HUMAN DISEASE) - sequence listing, part 61

SEQ ID NO: 116711 - DNA, 13770 bp, Artificial Sequence
  Description of Artificial Sequence: Synthetic coding sequence
atggacattattatgggccactgcgtgggaaccagaccacccgcatgctgcctcatactactgttatttaagctgcttgcgactgtgagccagggtttacctggcacagggcctctgggctttcactttacacattcaatttacaatgcaaccgtttacgagaatagcgcggcccgcacttacgttaactctcaatcgcgaatgggcataactctgatagatcttagttgggacatcaagtacaggatcgttagtggcgatgaggaagggttcttcaaagcggaggaggtgatcatcgccgatttctgttttcttagaatccgaactaagggaggcaactcagcaattttgaatcgggaaattcaggacaattacctgcttattgttaagggttctgtgcgcggagaggatctggaagcctggacgaaagtcaatatacaggtgctcgacatgaatgatctgagacctctgttcagcccaacaacatattccgtcacaattgccgaaagcactccactgcgtacatcagtcgcacaggtgactgccacggacgctgatataggctcaaatggggaattctattattatttcaaaaataaggtggacctgttctctgtccatcctaccagcggcgttataagtctttcaggtaggctgaactacgacgagaagaatagatacgatttagagattcttgccgtcgaccgcggtatgaagctctatgggaataacggtgtctcctcaacggctaagctctatgtgcacattgaaaggataaacgaacacgctccgactattcacgtcgtcacccatgtgccattctctcttgagaaggaacctacatacgctgtagtcacggtcgacgacctcgacgacggcgccaacggggagatcgaaagtgtttctatcgtcgcaggtgaccccctggaccagttcttcctggccaaggaaggcaagtggctgaacgagtataaaattaaagaacgcaagcagatagattgggaaagtttcccttatggctacaacctcaccctgcaagcaaaagacaagggcagtccacagaagtgctccgcactgaaggctgtgtacatagggaacccgacccgggatacagtacccatccgctttgagaaagaggtatatgacgtttctatctccgagttttcacctccaggtgtggtggtagccattgtgaaactcagtcctgagcccatcgacgtcgaatataagctgtcacctggagaagatgctgtgtatttcaaaattaatcctcggtcaggtctgatcgtaacagcaaggcctctcaataccgtcaagaaggaagtttacaagctcgaggtaaccaataaagaaggggacctcaaggctcaggtgactattagtattgaggatgccaatgaccatacgccagagtttcagcagccactctacgatgcttacgtaaatgaatcagtgcccgtggggacatcagtattgacagttagtgcttccgacaaggataaaggggaaaatgggtacataacttatagtatcgccagcctcaacctgctcccttttgtaattaatcaattcactggggtgattagtacaaccgaggagcttgatttcgagtcctcccctgagatctaccggttcattgtgagagcttcagactggggttccccttaccgtcacgagagtgaggtcaatgtgacaatcagaattggtaacgtgaatgataattccccactattcgagaaggtggcctgccagggagtgatttcatacgactttccagtcggcggtcacatcaccgccgtgtctgccattgacatcgacgagctggagctggtgaaatacaagatcatcagtgggaacgagctcggatttttttatttgaacccagattctggcgtgttacagctgaagaagagcctgactaactcaggaattaagaatgggaatttcgctttgagaattacagctacagacggcgagaatttggctgaccctatgagcatcaatataagtgtactgcatgggaaggtgtccagtaagtccttctcttgccgggagacgagggtcgcccaaaaacttgcagagaaactgctgatcaaagccaaggctaatggtaaactgaacctggaagatggcttcctggacttttattccatcaacaggcaagggccgtactttgataaaagttttccctctgatgtcgctgtgaaggaagacctgcctgttggagctaacatcctgaagatcaaagcctacgacgcggacagcggctttaacgggaaagtgctcttcactataagcgacggaaatacggatagttgttttaatattgacatggagacaggtcagctgaaagtcttaatgccaatggaccgcgaacatactgatctataccttcttaacatcactatttatgatctcggaaacccccagaagagtagctggaggttgttgacaatcaatgtggaagacgccaatgacaacagcccggttttcattcaggattcttactctgtgaacattctagagagttccggtatcgggaccgagatcatacaagtggaagcgagggacaaggacttgggatctaatggggaggttacttattcagtgttgacagacactcagcagtttgcaatcaatagttccactggcattgtgtatgtagccgatcagctggacagggagagcaaggcaaattacagtcttaagatcgaagccagagataaggctgaaagcggacagcaactgttcagtgtcgtcacgttgaaggtcttcctggatgacgtaaacgattgttcgcctgcatttatcccatcgtcttactctgtgaaagtgttagaggatcttcctgtggggacagtaatagcctggttggagacccatgacccagatctcggcttgggcgggcaggtgaggtactccctggtgaacgattataacggcaggttcgagatagataaagcgtccggggctattaggctgtccaaagagttagactacgaaaagcagcagttctacaacttaaccgtgagagctaaagacaaagggcgcccagtttctttgtcaagcgtcagcttcgtcgaagtagaagtggtggatgttaacgagaatctccacacaccatactttcctgactttgctgttgttgggtctgtcaaggaaaacagccgcataggcacaagtgtgctgcaggtgactgcaagggacgaggattcgggtcgagacggtgaaatccagtacagcattagagacggctccgggctgggcagattctcaatcgatgacgagagtggggtcatcaccgccgcagatatattagatagggagaccatgggcagttattggctcactgtctatgccacggacagaggagtcgtccccctttatagtactatcgaggtgtacattgaagtggaagacgtaaacgacaatgcgccactgacctcagagccaatttattaccccgtggtcatggaaaactcaccgaaagatgtatccgttattcaaatacaggcagaagatcccgactcttcaagcaacgagaagcttacataccggataacttctggcaacccccagaatttcttcgcaatcaacatcaaaacaggccttataactactacaagtcgcaaactggatagggagcaacaagccgaacacttcctagaagtgactgtgaccgacggagggccatcacctaaacagtccacaatatgggttgtagtccaggtgctggacgagaatgataacaaaccacagtttccagagaaggtgtatcaaatcaaactccctgaaagggatcgaaaaaagcggggagagcctatctaccgggcgttcgcattcgacagagacgaaggaccaaatgcagaaatttcttacagcatcgtggacggaaatgatgacggaaagttctttatcgatccaaagaccggcatggtgtcaagcaggaaacagtttacagcggggtcctacgacatcctgactattaaagccgtggacaatggaaggccccagaagagttccacagccagactgcacatcgagtggatcaagaaaccaccccctagccccatccccttgactttcgacgagccattttacaacttcacagtgatggagtctgatagggttactgagatcgtgggagtggtctccgtgcagccagccaacactcctctgtggttcgatatagtgggaggtaacttcgactctgcttttgatgctgagaaaggagttggaaccattgtcatcgcaaaacctctcgatgcagagcagcgctctatctacaacatgagtgtcgaggtgaccgatggcacgaacgtggccgtcacccaggttttcatcaaggtgttggacaacaatgacaatgggccggagttctcacagccaaattatgacgtcacaatctccgaagatgtgctccccgataccgagatcctacagatcgaggcaactgaccgcgacgaaaaacataagctctcctataccgtccacagcagtatcgatagtatcagcatgaggaagttccggatcgacccctctacaggtgtcttgtacaccgctgagcgactagaccacgaggcacaagacaaacatattttgaacataatggtgagggatcaagagtttccttatagaaggaatcttgcacgggtcatcgtgaatgttgaagatgctaatgaccatagcccatactttaccaatcccctgtatgaggcatctgtttttgagtccgctgctctgggaagtgcggtgctgcaggtcactgccttggacaaggataagggggaaaatgccgaattaatttatacaatcgaggccggcaataccggaaatatgttcaagatcgaaccagtcttgggtattattaccatctgcaaggagccagacatgacaaccatgggccaattcgttctgtccattaaagttaccgaccaggggtccccccccatgtctgctaccgcaatcgtgcgcatttccgtcaccatgtccgataactcccatccaaaattcatccacaaagattaccaggcggaggtgaatgagaatgtcgacattggtacttctgtaattctgataagtgcaatatcacagtccacactcatatacgaagtgaaagatggagacatcaatggcatatttaccatcaacccttacagtggggtaatcactacacagaaagccctggattacgagagaacttcatcttaccagctgatcatacaggcgacaaacatggctggcatggcttccaatgccaccgttaatatccagatcgtcgatgagaatgataatgcacccgtcttcctatttagccagtacagtggttccctcagcgaagccgcaccaataaattcaatagtcaggtccttggataactcccccctggtgatcagagccactgatgctgattcaaacagaaacgcccttttggtatatcagatcgtagaaagtaccgctaaaaagtttttcactgtggacagctcaactggcgctatccggaccatcgcaaatctggatcacgaaaccatcgcgcatttccattttcacgtgcatgtccgggattccggttctccccagctcactgccgagagcccagttgaggtgaatattgaagttaccgacgtaaacgataaccctcctgtctttacccaggcagtttttgagaccatcctgctcttgcccacatacgtcggggttgaagtactgaaagtgtctgctactgatcccgattctgaagtgcctccggagcttacctattcactgatggaaggcagtctggatcacttcctcatcgactcaaactcaggggtgctcacaattaaaaacaataatctcagtaaggaccactacatgctaattgtaaaagtctctgacgggaagttctatagtacatcaatggtgacgatcatggttaaagaggcgatggattccggactgcattttactcaatcattctatagcacaagtatcagcgaaaataacaccaacatcacaaaagtggcaattgtgaatgcagtcgggaaccgcctcaacgagcctctcaagtacagcatcctcaatcctggaaataagtttaagatcaagagcactagtggcgttattcagacaaccggcgtgcctttcgacagagaggagcaggagctgtatgaactagttgttgaggcgagcagagaactggatcatttgagggtcgcaagggtggtggtcagagtgaatatagaggacatcaatgataatagccccgttttcgtcggactcccatactatgcagccgtgcaggtggacgccgaacccggcacgttaatttaccaagtcactgctatcgacaaagacaaaggccccaacggtgaggttacatacgtcctccaagatgactacggacattttgagatcaatccaaattctggcaatgtcatattgaaggaggcctttaactctgatttgagcaatatagaatacggcgtgaccattctggctaaagatggcggcaaaccttcgctatctacctctgttgaactgcccatcaccatcgtgaacaaagccatgccagttttcgacaagccattttacacggcctcggtgaacgaggatatacggatgaatacgcctatcctctctatcaatgcaacatccccggagggccagggcatcatctacatcataatcgacggcgaccccttcaaacagttcaatatcgactttgacacgggagtgcttaaggtggtctctcctctggattacgaggttacttccgcttataaacttacaatacgagcctccgacgccctgaccggagcacgggcagaagtgacggtggacctgctggttaacgacgtcaatgacaacccccctatttttgaccagcccacctataacaccacactgtccgaagctagcttgattgggacacctgtgcttcaggtggtgtctatcgacgctgacagcgagaataataagatggtgcactatcaaatcgtccaggatacttataactccaccgattacttccatattgatagctcctcaggactgatactgaccgcaaggatgctggatcacgagctggtgcagcactgcactctgaaagtgaggtctatcgactcgggttttccgtccctgtcctccgaagtgctggttcacatctatataagcgacgtcaatgataacccaccagtcttcaaccagcttatttacgaatcttacgtctccgaacttgcaccgcgcggacattttgtcacctgcgtgcaagcctctgatgctgattcttccgacttcgaccgactcgagtacagcatcctaagtgggaacgacaggacatccttcctgatggactcaaagtctggcgtcataacattaagcaatcacaggaagcagagaatggagcccctgtattccctcaacgtcagtgtctctgacggcctgttcacaagtactgcccaagttcacatccgcgtgttgggcgccaatctgtattcccccgctttttcccagagcacctatgtggccgaagtacgcgaaaatgtggctgccgggacaaaggtcattcacgtgcgagccactgatggcgaccccgggacctacggtcagatctcttatgcgattatcaacgactttgccaaagataggttcctgatcgatagcaatggacaagtgataactaccgagcgacttgaccgggaaaatcctctcgagggcgatgtgagcatatttgtgagagccctcgacggaggtggccgaacaacgttttgcactgtcagagtgatcgttgtggacgagaatgacaatgctccacagttcatgactgtggagtatagggcttcggtgcgcgcagatgtgggccggggacatctggtaacacaggtgcaggcaatagatcccgacgacggtgcaaacagccggatcacttacagcctctatagcgaggcctctgtaagcgtggccgatctcttggagattgatcccgacaacggctggatggtgaccaagggaaattttaatcagcttaaaaacacggtgctgtcttttttcgtcaaagcggtggacggggggatcccagtcaagcatagcctgattccagtctatatacacgtgttaccccccgaaacgttcctcccctccttcacacaatcccagtacagctttacaattgctgaggatacggctatcgggtcaactgttgacacattgcgaatcttgccatctcagaatgtgtggttttctaccgtgaacggcgagagaccagagaataacaaagggggcattttcgttatagagcaggagacaggcacgatcaaactggacaaaagacttgaccgggaaacctctcccgcatttcactttaaggtggcggccacaatccctctggataaagtggatatagtgtttacggtggatgtcgacattaaggtgttggatctgaatgacaacaagccggtgtttgagacatcaagttatgacacaatcatcatggaggggatgcccgtcggcaccaaactcacccaggtgcgggctatcgatatggattggggagctaacgggcaggtgacttattccctccactccgatagtcaaccggaaaaagtcatggaagcattcaatattgattctaacactggctggattagtacactcaaggatctggatcatgaaactgacccaacctttaccttctctgtggtggcgtcggacctgggggaagcatttagcctgagctctacagctttagtctccgtacgcgtgacagacattaacgacaatgcccctgttttcgcacaggaggtttaccgagggaatgtcaaagagtctgacccacccggggaggtcgtggccgtgctcagtacttgggaccgcgacacctcagacgtcaatcgccaggtcagttaccacataacagggggaaatccccgggggaggtttgccctgggcttagtccagtctgaatggaaagtgtacgttaagcggccactggatagggaggaacaggacatctacttcctgaacattacagctaccgatgggttgtttgttacacaagcaatggtggaggtttcagtgagtgacgtgaatgacaattcccccgtgtgcgaccaggtcgcatacactgccttgttgccggaggacataccctcaaataagatcatccttaaggtgtccgcaaaagacgccgatataggctccaatggctacattaggtacagtctgtacggtagcgggaacagcgaattctttcttgatcctgaatctggggagttgaaaaccttggccctactcgatagagagagaattcctgtgtatagtctgatggccaaggccacagatgggggtggccgtttttgccagagcaatattcatttgattctggaagacgtcaatgacaaccctcctgtctttagctcagatcattacaacacctgcgtttatgaaaatactgccactaaggcgctgctgacccgcgtccaagcggttgaccccgatatcggcattaacaggaaagtggtttactctctcgccgattccgccggtggagtttttagtatcgactcaagcagcggcatcattatcttggaacagcctctcgatcgggagcagcagtcgtcctataacatcagtgtgagggcaaccgatcagagtccaggccagagcctgtcctccctcaccactgtgaccatcacagtgctggacattaatgacaatccccccgttttcgaacggcgcgactatctggtgaccgtccccgaggacactagtcctgggactcaggtactggctgttttcgccacttccaaggatattggtaccaacgccgagatcacttatctgattcggagcggtaatgaacagggcaagtttaaaattaatcccaaaacaggcggcatctctgtgtcggaggttctggattatgaactgtgcaagagattctacctggtggtggaggcgaaagatggtggcacacccgccctgagtgccgtggccaccgtgaacatcaacctgaccgatgtgaacgacaacccacccaaatttagtcaagatgtctacagcgccgtaatatccgaagacgcccttgtgggcgactctgtcattctgctgatcgcagaagatgtggactcgcaacccaatggtcaaattcatttcagtattgtgaacggcgatagagacaatgaatttaccgtggatcccgtgttgggattggtgaaggttaaaaaaaaactagatagagagcgggtctctggttatagtctgctggtgcaagctgtcgattccggaatccccgccatgagctccacagcaactgtcaatattgatataagtgacgttaacgataactctcccgtgttcacacctgctaactatactgcggtgatccaggagaataagcccgttgggacaagcatcctgcaactcgtggtgacggacagagactctttccacaatgggcccccattttctttttccatcctgagcggtaacgaagaggaagagttcgtactggaccctcatggaattctccgtagtgctgtcgtgttccagcacacggaatccctggagtatgtgttgtgtgtgcaggccaaagactccgggaaaccccagcaggtttcgcatacatatatccgagtgagagtgatcgaggaaagcacccataagccgactgcaatacccctggaaatcttcatagtgacaatggaagatgactttcccggaggcgtgatagggaagatccacgcaaccgatcaagatatgtacgacgtgcttacgtttgccttaaagtccgagcagaagagtctgtttaaggtcaatagccacgatggcaagatcattgcactgggtggacttgattctggaaagtacgtgctaaacgtgagtgtgtccgacgggagatttcaggtgcccatcgacgtcgtggtccacgtggagcagctcgtccatgaaatgctgcagaataccgttactatccgcttcgaaaacgtctcccccgaagactttgtcgggctgcacatgcacggcttcaggcgcacactccggaacgcggtgttaacccagaaacaggactcgttgcgtattatctctatccagccggtcgccgggaccaaccagctggatatgttgtttgcagtcgaaatgcactcgtctgaattttacaaacccgcgtacctaatccagaagctgtcaaatgccaggaggcatcttgagaatataatgcggatatcagctatcttagaaaagaactgtagcggtctggactgtcaggaacagcactgcgagcagggcctgagtctggattcgcacgcacttatgacatattccacagctagaatcagctttgtctgtcctcggttttatagaaacgttcggtgtacctgcaacggcggcctgtgtccaggttccaacgatccctgtgtcgagaagccctgccctggggacatgcagtgtgtatcttatgaggcatcccgtagacctttcctctgccagtgccctcctgggaaattgggcgagtgttcgggtcatacttctctgtcctttgccggtaattcctatataaaatataggctctccgaaaacagtaaggaggaggattttaaactggcactcaggctgcgcaccctgcagtcaaacggcatcattatgtacacaagggctaacccctgcattatcctcaaaatagtggacggaaaactgtggtttcagctggactgcggctcgggccccgggattctgggtatttcaggccgcgctgtgaacgacggatcctggcattcagtctttttggagctaaaccggaactttacatccctcagcctagatgactcttatgtggagcgtcgtagagcccccctctattttcaaaccctgtcaactgagtcttctatttattttggcgccctggtgcaggctgacaatattcgctccctcacagacactagagtcacacaggtattgtcaggtttccagggctgtctggacagcgtaattttaaacaacaacgagctgccccttcagaacaagagatcttcattcgctgaggttgtgggtctcacggagctcaagttaggatgtgtgctgtacccagacgcttgtaagcggagcccgtgtcagcatggaggctcctgcaccggtctgccatccggcgggtaccagtgtacatgtctaagtcagttcactgggcggaattgcgagtccgaaatcaccgcatgcttccctaacccctgccggaatggcggctcatgcgacccgatcggaaacacgttcatatgtaattgcaaggccggtttgaccggcgtgacatgcgaagaagatattaatgagtgtgaacgggaggagtgtgaaaatggaggctcttgtgtgaacgtgttcggtagcttcttgtgcaactgcaccccggggtacgtgggccaatactgcggtctgcggcccgtggtggttcccaacatccaagccggacactcgtatgttgggaaggaggaattgatcggaatcgctgtggtcttattcgttatatttatcctggtagtgctgttcattgttttccgaaagaaggtgtttcggaagaactacagtcgaaataatatcacgctggtgcaggatccagccaccgcagcccttctgaacaagtccaacggaatcccctttaggaacttgcgcggttctggagatgggaggaacgtgtaccaggaagtggggccgccccaagtacctgtgcgacccatggcatacacgccgtgcttccagagtgattcaaggtccaatcttgataagattgtggacggcctcggaggggaacatcaggaaatgaccacttttcacccagaatccccacgtatactgacagcacgacggggagtggtggtctgttcagtggcacccaatctgccagccgtgtcgccttgtaggtctgactgcgactccatcagaaagaacggctgggatgccggaacagaaaacaaaggcgtggatgatccaggagaggttacgtgtttcgccggttctaataaaggcagcaattctgaggtccagtctctgtcttcctttcagagtgactcaggagatgataacgcatcaatcgtgacggtcattcaactggtgaataatgtcgtggacaccatcgagaatgaagtctcggtgatggaccagggacagaattataaccgtgcctaccactgggatacctccgattggatgcccggtgcacgcctttctgacattgaggaggttcccaactatgagaaccaggatggtgggtcggcacaccagggttctactagggaactggagtccgattactatcttggaggttacgacatagatagtgagtaccccccgcctcatgaagaggaattcctgagtcaggatcagctcccaccaccgctgcccgaagactttcccgaccaatacgaggcgctgccccccagccagcccgtgagcctcgcttccaccctgagccctgactgtcgaagaaggccccagtttcatccttcccagtatctaccaccacaccctttccctaacgaaacagatttagtcggccctccagcctcttgcgagttttcgacctttgccgtctcgatgaaccagggcaccgaacccacaggccctgccgactccgtgtcattatccctgcacaactcccgcggtaccagttcctctgacgtgtcagccaattgtgggtttgacgattctgaagttgctatgagtgactacgagtctgtcggtgaactatcacttgcctctctccatattccgtttgttgaaacccagcaccagacccaggtctag

SEQ ID NO: 116712 - DNA, 13674 bp, Artificial Sequence
  Description of Artificial Sequence: Synthetic coding sequence
atggacatcattatggggcattgtgtggggactcgtccccctgcttgctgcctcatactgctactgttcaaactgttggctaccgtctcccagggcttgcctggtacgggaccgcttgggttccatttcacacactctatctacaacgccaccgtgtatgaaaactctgccgcaaggacctacgtcaacagccagtcccgcatgggaatcaccctgatcgacttaagttgggatattaagtatcgaatcgttagcggagacgaggaaggattctttaaagcggaagaggtaattatcgccgacttctgctttctgcggatccgaacaaaaggcgggaattcagcaatcctcaatcgcgagatccaggacaattatctgttgatcgtcaaggggagcgtgcgaggcgaggatctggaagcctggaccaaagttaatatacaggttctggacatgaacgacctgcgccccctgttcagcccaaccacctatagtgttactattgccgaatcgacacctctccggacttccgtggctcaggtaacagccaccgatgccgatatcgggagcaatggggagttttactactattttaaaaacaaagtggacctgttttcggttcatccaacttccggagtcataagcctgagcgggcgtctgaattacgacgagaaaaatagatatgaccttgaaatactcgcggtcgatcgcggtatgaagttatatgggaacaatggagtcagcagtacagctaagctgtatgtccatatagaaaggattaatgaacatgcaccaacgattcacgtcgtgacacacgtgccatttagcttggaaaaagagcctacctacgcggtcgtcaccgttgacgacctagacgacggtgcaaatggcgagatcgaatcggtgtcaattgtggcgggagatcccctagatcagttcttcctcgccaaagagggtaagtggctcaacgagtataaaatcaaggaaaggaagcagatcgactgggaaagttttccctatggttacaatctaactttacaagccaaagacaaaggcagcccacaaaaatgcagtgccctgaaggctgtgtacatcgggaacccaaccagagatacagtgcctatacgtttcgagaaagaagtgtatgacgttagcatatctgagttctcgccaccaggcgtcgtggtggccatagtaaagctgtcccctgagcccattgacgtggaatacaaattgagccccggagaagacgccgtctacttcaaaataaaccctcgtagcgggctgatcgtgacggcgcgccctctgaacaccgtgaagaaagaggtgtataagctcgaggtcacaaacaaagaaggagatctaaaggcccaagttaccatcagcatcgaagatgccaatgatcacactcctgaatttcaacaacccctgtacgacgcctatgtgaacgagtcggtaccagtcggaacttcagtgctgaccgtatctgcttcagacaaagataagggagaaaacggttatattacctactcaattgccagcctgaatctcctgcctttcgtcattaatcagttcaccggcgtgatatctacaacagaagaactggacttcgaaagtagcccagagatatatcgatttatcgtccgcgcttccgattggggtagtccttatcgacacgaaagtgaggtcaacgttaccatccggattggcaacgtgaatgacaacagtcccttgtttgagaaggtagcatgtcagggagtgattagctacgactttcctgtgggagggcacatcaccgctgtgagcgctattgacatcgatgagctcgagttggtgaaatataaaattattagtgggaatgaactcggctttttctatttgaatcccgactccggggtgcttcaactgaaaaagagtctcacaaactctggtattaagaacggtaactttgctttacgaataaccgctaccgatggggaaaaccttgctgatccaatgtcgatcaacatttccgtcctgcacggtaaggtgagttctaaatcattcagttgtcgagagactagagtcgcccaaaaactggcagagaagttacttattaaggcgaaggcaaacgggaagctcaacctggaagatggatttctggacttttatagcatcaaccgccaggggccgtatttcgacaagagcttcccatcagatgtggccgtgaaagaagacctgcctgtaggcgcaaacatcctgaagatcaaagcgtacgatgccgacagtggattcaacggcaaagtactgttcacaatctcagacgggaataccgattcatgcttcaacatcgatatggagacagggcagctgaaagtcttgatgccgatggatagagagcacaccgatctgtacctgctaaacatcacgatttatgacctgggaaatccacagaaatccagctggcgcttactcacaattaacgtagaggatgcaaacgacaatagccctgtatttatacaggacagctactcagtgaacattctcgaaagttcaggaattgggaccgaaataatccaggtagaagcaagagacaaggatcttggcagtaatggcgaagtgacttactccgtgttaactgatacacagcagtttgccatcaacagtagcaccgggattgtttacgtggccgaccagctggatagagaatctaaagcaaactactccctcaaaattgaggcccgcgataaagccgagtcaggacagcagctctttagcgtcgtaacgcttaaggtgtttcttgatgatgtgaacgactgctcccccgctttcataccctcatcttactcagtaaaagtgctggaggatctccccgtgggtaccgtcatcgcttggctcgaaacgcatgaccctgatctaggcttgggcggccaggtgcgctacagcctggtcaatgactacaacggcaggttcgagatcgacaaagcctcaggagccatccgcctcagtaaagagctggattacgagaaacagcagttttataacctaactgtgagagccaaagataagggccgcccggtaagcttgtcttccgtttccttcgtggaagtggaggtggtcgacgtcaacgagaacctgcataccccttacttccccgactttgccgtcgtggggagcgtgaaagagaacagccgaatcggcacatcggtattacaagtaacggcgcgcgacgaggacagcggcagagacggtgaaatacagtacagcatacgcgacggcagcggcctgggcaggttttccatcgacgatgagagcggtgtcattaccgccgctgacatcctggatcgggaaacaatgggctcttattggctcactgtctatgccaccgatcggggcgtggtgcccctctactccacaattgaggtgtatatcgaggttgaggatgtgaatgataacgccccgctcacgtcggaacccatctactatcccgttgtgatggagaatagtcccaaggacgtctccgttattcagattcaggcagaggacccagacagttcgagcaacgagaaactcacctatcggatcacatccggcaatccacagaactttttcgccatcaacatcaaaaccggattaatcaccaccaccagcagaaaactagatcgcgaacaacaggccgaacatttcctggaagtcaccgtgaccgatgggggcccaagcccgaagcagtcaaccatttgggtggtggtgcaagtgctggatgagaatgacaataaaccccagtttcccgaaaaggtctatcagattaagctacctgagcgagatcggaagaaaagaggggaaccaatttacagagctttcgctttcgatcgcgacgaaggccctaacgcagagattagttatagtatcgtcgacggaaacgatgacggcaaattctttatcgacccaaagacgggtatggtgtcatctaggaagcagttcacagccggctcttacgatatcttgacaatcaaggccgtagacaatggccggcctcagaaatctagtaccgctcgacttcacatcgaatggattaagaaaccaccgccaagtcctatcccactcacattcgacgagccattctataacttcacagtcatggaaagtgaccgagtgacggagatcgtgggggtcgtctccgtgcagcccgcaaatacacctttgtggttcgatatagttggaggcaacttcgactccgccttcgacgcagaaaagggagtggggacaattgtgatcgctaaaccactggacgcggagcagcggtccatttataatatgagtgtggaagtcacagacggtactaacgtcgccgtgactcaggtctttattaaggtgttggataacaacgacaatggcccagaattttcccagcccaattatgacgttacaatcagcgaggacgtgcttcctgacactgagatactgcagatcgaagccactgatcgggacgagaaacacaagctgagttacacagttcactcttccatagatagtatcagcatgcgcaaattccgaattgatcccagcacaggggtcctttacacagcagaacgactagaccacgaagcccaggataaacatatcctgaacataatggtgcgggatcaagagttcccttaccgccgcaacttggctcgggtaatcgtaaacgtcgaagatgccaacgaccattccccttactttacaaatcctctttacgaagcatcagtgtttgagtccgctgccctgggatcagcggtgctacaggtgaccgccctggataaggataaaggggaaaacgcagaactgatttatacgattgaggccggcaatactggcaatatgtttaaaatcgagccagtcctgggaattatcactatttgtaaggagcccgatatgacgaccatgggccagttcgtactctcgatcaaggtgacagatcagggtagtcctccgatgagtgccactgccatcgtcagaatctccgtgaccatgtcagataactcacatcctaaattcattcacaaggactatcaagcagaggtgaatgaaaatgtggacattgggaccagtgtgattctgatttcagctatctctcagagtacgctaatttacgaagtgaaagatggtgatattaatgggatttttaccataaatccatactcaggggttattacaacccagaaggctctcgactacgagagaaccagctcctaccagctcattattcaggctaccaacatggctggcatggcctccaacgcaactgtgaatatacagatcgttgacgaaaacgataacgcccctgtctttttattctctcagtactcgggaagtctgagcgaagctgctccgattaatagcatcgtgagaagccttgacaattccccacttgttatccgcgccaccgatgccgattccaatcgtaacgctttgttagtctaccagattgtcgagagcactgcaaaaaagttcttcaccgtggactcttctaccggggccatccgcactatcgccaacttggatcacgaaacgattgcccacttccactttcatgtgcatgtcagggactctggatctccacagctgaccgccgaaagcccagtcgaagtgaatatcgaggtgactgatgtcaacgacaacccaccagtttttacgcaagccgtgtttgagaccatcctcctgctgccaacttacgtaggagtggaagttttgaaggtgagcgcgacagatcccgactctgaggtgcccccagaacttacatatagtctgatggaaggatccttagaccacttcctcatcgatagcaattccggcgtcctcaccatcaagaacaacaacttaagtaaggaccactacatgctgatcgtcaaggtgtccgatggtaagttctacagcaccagcatggtgactatcatggtgaaagaagccatggatagtggactccacttcacccagtctttttactcaacttccatttctgagaacaacacaaatatcacaaaggtggctattgtcaacgcagtcggtaatcgcttaaacgagccactgaaatattcgatcctgaacccaggcaataagtttaagatcaaatcaacttccggggtcatccagaccacaggagttccctttgatcgggaagagcaggagctgtatgaactcgtggtcgaagcctccagggagctcgatcacctacgcgttgcccgggtagtcgtaagggtaaacattgaagatatcaatgacaatagtcccgtctttgtagggcttccctattacgcagccgttcaggtggatgcggagcccggcactcttatctatcaggtgactgcaatcgacaaggacaagggccctaacggcgaggtgacgtacgtgttgcaggatgattacggacactttgagattaaccctaattctgggaatgtcatactgaaagaggcgttcaattctgatttaagcaacatcgagtatggtgtcacaattcttgctaaagatgggggcaaaccctctctgagcacttccgtggaactaccaatcaccatcgttaataaagctatgccagtctttgacaaaccattttatactgcaagtgttaatgaggacattcgaatgaatacacccatcctctccataaacgcaacaagccccgaaggacaggggattatctacattataatcgacggggatccctttaagcaattcaacatagacttcgacaccggcgtcctgaaggtagtgtcgccacttgactatgaagttacttccgcatataaattgaccatcagagcatccgacgcgcttacaggggccagagctgaagtcactgtggatctcctcgtcaacgatgtgaacgataaccccccaatatttgatcagccgacatataacaccaccctgagtgaggcttcccttattggaacccccgtcctgcaggtagtgagtatcgacgccgactccgagaacaataaaatggtacattaccagatagtccaggacacatataattccactgattattttcacattgacagtagctcagggctgattctcacagcccggatgctggatcatgaactagtacaacactgcaccctgaaggtgaggtcgatagactctggctttccatccctctcctccgaagtcctggtgcatatatatataagcgacgtgaatgataacccgccggtttttaatcagctcatttatgagtcttatgtgagcgagctggcaccacggggccatttcgtgacttgcgtacaagcctccgatgccgactcctccgactttgatcgcctggagtactctatcttgtcaggaaatgacagaacaagtttccttatggactcgaaatcgggagtgataaccctgtctaaccacaggaagcagcgcatggagccgttgtactcgctaaacgtttctgttagtgatggtctgttcaccagtacagcacaggtccacatcagagttctgggagcgaacttatattctccagccttcagtcagagtacttacgttgccgaagtaagggagaatgtcgccgccggaaccaaggtgatccacgtcagagcaactgacggagaccccgggacatacggacaaatctcgtacgctataattaacgattttgctaaggatcgctttttgatcgatagtaacggtcaggtgataacaactgagagactggatagggagaaccctctagaaggtgatgtgagcatattcgtgcgggctttagatggaggcgggaggaccactttctgcaccgtaagggttatcgtcgtggacgaaaacgacaacgcgccacagttcatgacagtggaatacagggcctccgttcgggcagatgtaggtcggggacatctagttacacaagtgcaggctattgatcctgacgatggggcaaacagtcgcataacgtatagcttatactccgaagcctctgtttctgtggccgatcttctggagattgatcctgataacggttggatggtaacaaagggcaatttcaaccagctgaagaataccgtactgtctttttttgttaaagcagtagatggcggaattccagtaaaacattctctgatcccagtttacattcatgttctgcctccagaaacctttctgccttcttttacacagagtcagtatagtttcaccatcgctgaggatactgctataggttctacggtagacacgttgcggattctcccaagccagaatgtgtggtttagcaccgtgaacggtgagcgccccgagaacaataagggcggcatcttcgtcattgaacaggagactggaacaattaagctggacaaacgtctggaccgcgagacatcccctgcttttcacttcaaagtggctgccactataccactggacaaggttgacatagtgttcacagtggatgttgatatcaaggtcctcgacctcaatgataacaagcccgtttttgagacctccagttacgatacgatcattatggaaggaatgcctgtaggcaccaagcttacccaggttcgcgccatcgacatggactggggcgctaatgggcaggtcacctattcactccactccgacagtcaacctgagaaagtgatggaggcttttaatatcgactcaaatacaggatggattagtaccctcaaggacctggaccacgagacggatccaacattcacgtttagtgtggtcgcgagtgacctgggagaggccttctcattgagctcaactgctctcgtgtctgtgcgcgttacagatatcaacgataacgcccctgttttcgcccaggaagtgtaccggggtaacgtgaaagaaagcgatcctccaggggaggtcgttgcggtactatctacttgggatcgggatacaagcgacgttaatcggcaggtttcgtaccatattaccgggggaaatccacgcggcagattcgcacttggactggtgcagtccgaatggaaggtttatgtgaaacggcctctggatcgcgaggagcaagacatatactttctaaacatcactgcaactgatggcctgtttgtgactcaggcaatggtggaggtgagcgtaagtgatgtcaacgataacagcccagtttgtgatcaggtggcttacaccgccttgttgcccgaagatatacccagcaataagatcattctgaaggtgtccgcgaaggacgccgatatcgggagcaacgggtacatcagatacagcctctatggaagcggtaattcagaatttttcctcgatcccgagtcgggtgaacttaagacattggccttgctggatagggagcgtatacccgtgtactccctgatggctaaagccacagacggagggggacgtttttgccaatctaatattcatctgatcctcgaggatgtaaatgacaaccctcccgtgttcagctctgatcattacaatacttgtgtgtacgagaacaccgccaccaaggcactgctgacccgcgtgcaagcagtagatccggatattggaattaatcggaaagtagtatactccctggctgattccgccggaggcgtattcagcatcgacagctccagcgggatcatcatactggaacaacccctggacagagagcagcagagcagttataacattagcgtaagggcaaccgatcaaagtcctggtcaaagtctctccagtttgacaacagtcacaatcaccgttcttgatatcaacgataaccctcctgtgtttgaacgtagggattacttggtgaccgtccccgaagacaccagtcccgggacccaggttttagcagttttcgctacctccaaggacattggaacaaatgccgagatcacttacctcattcgttccgggaacgaacaggggaaattcaaaatcaaccccaagaccggagggatatctgtctctgaagtgctggactatgaactctgcaaaaggttttatctggtcgtagaggctaaggacgggggaactccagccctcagcgccgtcgcaaccgttaacatcaacctgacagacgtcaacgacaatccccccaagttcagtcaagacgtgtatagtgccgttatcagcgaggatgccctagtgggcgattccgtgattctgctgattgccgaggatgtcgactcccaacccaacggtcagattcactttagcattgtcaatggtgatcgcgataatgagttcaccgttgaccccgtcttaggacttgtaaaggtcaagaaaaagctcgatcgggagagagtctccggttacagcctcctcgtgcaagcggtagattccggaattccggccatgtcctctaccgctaccgtgaatattgacatctccgacgtgaacgacaattcacctgtgttcacccccgcaaactatactgctgttatccaggaaaataaacctgtgggcacttcgatactgcaattggtggtgacggatcgggattctttccacaatggcccgcccttttccttcagtatactgagtggtaatgaagaagaagagtttgtgctggacccacacggtatcctgagaagcgctgtggtcttccaacatacggagagtctcgagtatgtcctctgtgtgcaggccaaagactcaggtaaaccacagcaggtctcacacacgtatatcagggtcagggtcatagaggagtccacccataaacctactgcgatacctttggagatcttcattgtgaccatggaggacgacttcccgggcggagtgatcggaaagatccacgccaccgatcaggatatgtacgacgtgcttacatttgcattgaagagcgagcagaagtctctgttcaaggttaatagccacgacgggaagatcatagccctcggtggtttggatagtggtaaatacgtcctgaacgtgagcgtctctgacggccgcttccaagtgcccattgacgtagtagtccacgtggagcagcttgtgcacgaaatgctgcagaacactgtcactataaggtttgagaacgtctctccagaagatttcgtaggtcttcacatgcacggctttcgtagaaccctaagaaatgccgtgctgacacagaaacaggattctctgaggattatctctattcagccagtggctggcactaaccagctggacatgctgtttgcagtggagatgcacagcagtgagttctataaaccagcatacctgatccaaaaactgtctaatgcaaggagacatctggagaacatcatgcgtattagcgccattctggagaagaactgctctggccttgattgccaggagcagcattgcgagcagggcctctcccttgacagccacgctctcatgacatactctactgctaggattagcttcgtctgccccagattctatcggaatgtgcgctgtacctgtaatggcggcctgtgtccaggaagtaatgacccctgcgtggagaagccatgtcccggtgacatgcagtgtgtgagctacgaggcgtcaagaagaccttttctctgccagtgcccccctggtaaacttggggagtgtagcggacacacttcactgtccttcgctggcaatagctacattaaataccgtttgtcagaaaactctaaagaagaggattttaagctggccctgagactcaggacccttcagagcaacggcattattatgtacacgagggcaaacccatgcattatactgaagatcgtcgacgggaagctgtggtttcagctggactgtggctccggacctggtatactgggaatctccggaagggccgtcaatgatgggtcctggcatagtgtatttctagagctgaatcgtaacttcacctccctgagcctggatgacagttacgtggaaaggcgccgagccccactctactttcagaccctttctactgagtcctccatctactttggagctctcgtacaggcggataatataaggagtcttaccgacactagggttactcaggtgctcagcggctttcagggctgtcttgatagcgtgatcctcaacaataatgagctcccactccagaacaaacggagctccttcgctgaagtggtaggccttacagagctaaaactagggtgtgtcctttatcctgatgcctgtaaaagaagtccctgccagcatgggggcagttgtacaggccttccaagtgggggctatcagtgcacgtgtttgtctcagtttactggcaggaactgcgagtctgagatcaccgcctgtttccccaatccctgccgaaatggcggctcttgcgatcctatcgggaacactttcatctgtaactgtaaggccgggctcacaggcgtcacttgcgaggaagatattaacgagtgtgaaagagaggagtgcgagaatgggggatcatgcgtgaatgtgtttggcagttttctgtgtaactgtactcccgggtacgtgggtcaatactgcggcttgagacctgtggtggtacccaacatccaagccgggcacagctacgttggcaaggaagagttgatcggaatcgcggtcgtgctctttgttatcttcatcctcgtggtgttgttcatagtgttccggaaaaaggtgtttcggaagaactatagtaggaataacataacactggttcaggatccagccacagctgctctgctgaacaaatctaatggtattcctttccgcaatctcagaggatcaggtgatggcaggaacgtgtaccaggaggtaggccccccccaggtgcctgtccgacctatggcttatacaccctgctttcaaagcgacagcagatccaacctcgacaaaatcgttgacggtctgggaggagagcatcaggaaatgaccacattccatcctgagtcaccaaggattcttaccgcccgacgaggcgtggtagtttgcagtgtcgcccccaatctgccagccgtcagtccctgtcgatccgattgtgacagcatccgtaagaatggatgggatgccggaacagaaaacaagggcgtggacgaccctggcgaggtgacttgctttgcaggatcaaataagggctctaacagcgaggtccagagtctgtcctcattccaatcagactctggcgatgataacgcctaccattgggacacaagtgattggatgcccggggctagactgagcgatatcgaagaggtgcccaattacgaaaatcaggacggaggatcagcccatcaggggtcaacccgggaactcgagtcagattactacttgggagggtacgacatcgactctgagtacccacccccgcacgaggaggagtttctgtctcaggaccagttgcctccacctctgcctgaggatttcccagatcagtacgaagcactgccacctagccagcccgtatcattggctagtaccctatcgcccgactgcaggaggcgtcctcagttccacccgagtcagtacctcccccctcacccattcccgaacgagacagacctcgtaggaccacctgcctcttgtgagttcagtacctttgcggtctccatgaaccagggcacagagcctaccggcccagccgatagcgttagtctgtcattgcacaattctcggggaacatcctcctcagacgtttctgcgaattgcgggtttgatgacagcgaggttgccatgagtgattacgagtcggtgggagagctctcccttgcatccttgcacatccccttcgttgaaacacagcaccagacccaggtatag

SEQ ID NO: 116713 - DNA, 3765 bp, Artificial Sequence
  Description of Artificial Sequence: Synthetic coding sequence
atggatattatcatggggcactgtgtgggcactcggccacctgcctgctgcttgattttgctgctgtttaagttgttagctaccgtgagccagggattaccagggaccggtcctctgggatttcactttacacacagtatatataacgccaccgtttatgagaattctgcagctagaacatacgtcaactctcagtctaggatggggattacattgattgacctaagctgggatatcaagtataggattgtgagcggagatgaagaaggattctttaaagccgaggaggtgattatcgccgacttctgcttcctgagaattcgcaccaaaggtggcaacagcgccattctgaacagagagattcaggacaattatctcctgatcgttaaaggttcagtgaggggggaggatctcgaggcttggactaaagtgaatatccaggtcctggacatgaacgatctaagacccctattctctccgaccacatacagcgtcaccattgcagagagcacgccacttcggaccagcgttgcacaggttactgcgaccgacgccgacatcgggagcaatggcgaattctactactacttcaaaaataaggttgatttgtttagtgttcatcctacgtctggagtaatatccttgagcgggcgtctgaattatgacgaaaaaaaccgctacgaccttgagatactggccgtagatcggggtatgaagctttatggtaataatggagtctctagtacagccaagttgtatgtgcacattgaacggataaatgagcatgccccaaccattcacgttgtgacacatgttccattctcgttggaaaaggagcccacctacgcggtggtcacagtcgatgacctggacgatggagccaatggagaaatagaaagcgtaagcatagtggccggggatcctctggatcagtttttcctcgcgaaagagggtaagtggttgaatgagtacaagatcaaagaaaggaaacagattgattgggagagcttcccctacgggtataacttaactctccaggctaaggacaaggggagcccacagaaatgctctgctctcaaggcagtatatattggcaatcccacaagggacacagttccgatccgtttcgagaaggaggtgtacgatgtaagtatctccgaattttccccccctggcgtggtggtggcaattgtcaaactgagcccggagcccattgatgtcgagtacaagctgtcaccaggtgaggacgcggtatactttaaaatcaaccctcgcagcggtctgatagtgacagctcgacccctcaacacagtaaagaaggaagtgtacaaactggaggtcactaataaagaaggcgacttaaaggcccaagtaaccatctccattgaagacgctaacgaccatacacccgaattccagcagcctctgtacgatgcatatgtgaacgaaagcgtccctgtgggcactagcgttctaactgtatctgctagtgacaaagacaaaggggaaaatgggtatattacttatagcatcgcttctcttaatctgcttccttttgtgatcaatcagtttaccggagtgatctcaacaaccgaggagctggattttgagagcagtcccgagatatatagattcattgtgcgcgcttccgattggggcagtccttataggcacgagtctgaggtgaatgtgacaatccggatcgggaacgtgaatgacaacagtccgctttttgagaaggtcgcctgccagggcgttattagttacgacttccctgttggaggacatatcactgccgtgtccgcaatcgacattgacgaattggagctcgtgaagtataagataatttcaggcaatgaactggggttcttttaccttaacccggatagtggcgtgctgcagctgaagaaaagtctgacaaattcgggcataaagaacgggaattttgctctccgaataaccgcaaccgacggggagaacttagccgatccaatgagcattaatatctcggtcttacatggtaaagtgtcatccaagtctttctcttgtagggagacaagagtcgcccagaagctcgctgaaaagctgttgatcaaggcaaaagcgaatggtaaattgaacctcgaggatggctttctggacttttattccattaaccgtcagggaccttattttgacaaatccttcccctccgacgtggcggtaaaagaagacctgccagtcggggccaacattcttaagattaaggcctacgatgcagacagtggctttaacggcaaagtactgtttactatttccgacgggaacactgactcgtgctttaatatagacatggagacaggccagttgaaggtccttatgcccatggatcgcgaacacaccgacctgtacctactgaacatcacaatctacgatcttggcaacccccagaaaagctcctggcgtctcctgacaataaacgtcgaggacgctaatgataactccccggtattcattcaggattcttatagcgtgaacatcctagagtctagcggcatcggaaccgaaatcatccaggtggaagcccgagataaagatcttgggtctaatggagaagttacgtactccgtcctgacagacacacagcagtttgctatcaattcctcaaccggaatcgtgtatgtggccgatcaactggaccgggaaagtaaggcgaactacagcctgaaaatcgaagcacgggataaggcagaatcaggccagcaactgttttccgtggtgaccctgaaggtcttcttagatgatgtgaacgactgctcccccgccttcatccccagtagttatagcgtgaaagttctggaagacctgcctgtgggcacggtcattgcgtggttagaaacgcacgaccctgacctcggccttggagggcaggtgcgctactctctcgtcaacgattacaacggccgctttgagattgacaaagctagcggagccattcgactgagtaaagagctggactacgagaagcagcagttctacaacctcacagtcagggcaaaagacaaagggagaccggtgagcctctcatccgtatcctttgtggaggtcgaggtcgttgatgttaacgagaatctgcatacaccctatttccctgactttgccgtggtaggttcagtgaaagagaactcccggattggtacgagtgtcctgcaagtgactgcccgcgatgaggacagtgggagggatggagagattcagtactccatccgcgacggctccggactgggtcgcttctcaatcgacgatgaatccggagtgattaccgccgctgacatcctggacagagagacaatgggtagctattggttaactgtctacgcaaccgataggggagtcgtgccgctttactccaccattgaggtttatatcgaggtggaagacgtcaacgacaacgctcctctgactagcgagccgatctattaccctgtggtgatggaaaactcacctaaggatgtgtcagtgattcaaattcaggccgaagacccagactccagcagtaatgaaaagctgacatataggatcacgtcgggcaaccctcagaactttttcgccattaacataaagacaggctcttgtagtgtggcccaggccgggatgcagtggcacgatcactcgagtttacagtcaaggacccctgggttcaagggctatccttgcctgtcacttctctctagctgggactaccgacatgccccaccttgccccgcaacattcctcaacagttag

SEQ ID NO: 116714 - DNA, 9669 bp, Artificial Sequence
  Description of Artificial Sequence: Synthetic coding sequence
atggtcaccaccgtcgtggctgttggggacaccttagcacagcccttagcggcagcagaggtatttatcgtggagattaccctgcaggatatcaatgacaatcctccggtcttccctacagacatgctggatctgacagtggaggagaacatcggagacggcagcaagataatgcagctgacagcaatggatgccgacgagggcgccaatgcacttgtgacttatacgataatatctggagcggatgactctttcaggatcgaccctgagtctggagacctgatcgcaacacgcagactggaccgcgagaggcgtagtaagtactccctgctcgtgcgcgctgacgacggtcttcagagctctgacatgagaattaatatcacggtgtccgacgttaatgaccacacgcccaagtttagtcggcccgtgtactccttcgacattccagaggacacaatccccggtagcttggttgccgcaatcttggcaaccgacgacgactctggggtaaacggagagataacatatatcgtgaatgaggacgacgaggatggtatttttttcctgaacccaatcacaggagttttcaacctgacccgtctgctggattatgaggtgcagcaatactacattctgactgtgcgagccgaagatggcggtggacaattcacaactatccgcgtctattttaacatcctggatgtcaacgacaacccgccaatctttagtctgaatagttactctacatcgttaatggagaatctgcctgtcggctcaaccgttctggtgttcaatgtgacagacgcagacgacggcatcaattctcagctcacttactccatagcttctggtgacagcctgggccagtttactgtcgataagaacggagttctcaaagttctaaaagccctggacagagagtcccaatccttctacaatctcgtcgtacaggtgcacgatctcccccagatccctgcctctagattcactagtactgcccaagtgtctattatcctgctcgacgttaacgacaacccccccacattcctgagtccaaagctcacctacatcccagaaaacacccctatcgacactgtggtgtttaaggcccaggctactgaccccgattccgggcccaacagctacatcgaatacacccttctgaatcctctcggtaacaaattttctattggtactatcgatggtgaggtgagattgaccggagaactggaccgagaggaggtcagcaactacacactgactgtggttgctaccgataaggggcaaccaagtttgagcagctctacagaggtcgtggtcatggttttagatattaacgacaataaccccatttttgctcaggccctgtacaaggtggagattaatgagaacacgctgaccggtacggatattatccaggtgttcgcagccgatggtgacgaaggtactaatggccaggtgagatacggcattgtgaatggcaacacaaatcaggaattccggatcgattctgtgactggagcaattacagttgcaaagcctctggaccgagaaaagacacccacctatcacctgacagttcaagccaccgatagggggtcaaccccaaggacagacaccagcaccgtgtctatagtgctattagatatcaacgattttgtgcccgtctttgagctcagtccctacagcgtcaatgttccagaaaatctgggaactcttccccggacaattctgcaggtcgtggcacgagacgatgatcgtggctcgaatagcaaattatcatacgtgttgtttggtggcaatgaagacaacgccttcactctgtctgcctctggagaattaggcgtgacacaaagcctcgatagagagaccaaggagagattcgtcctcatgatcaccgccaccgactccggctctcccgctctcactggcactggaacaataaatgtcatagtcgacgacgtgaacgacaacgtgcctacgtttgctagcaaagcctactttaccacaattcccgaggacgcccccaccggaaccgacgttttactggtcaacgcgtctgacgctgacgcgagtaaaaatgcagttatcaggattatcggcggtaattctcagttcaccattaacccatccaccgggcagatcattacgagtgccttgctggaccgagaaactaaagataactacactctggtggtggtgtgcagtgatgcaggttctcccgaaccactcagcagtagcactagtgttctcgtaaccgtgacggatgtcaatgacaaccccccacggtttcagcaccacccctacgtgactcacataccctcccctaccttgcctggttcctttgtgttcgctgttactgtgaccgacgccgacatcgggcccaacagcgagctccattattctctcagcgggcgcaacagcgaaaagtttcacatagacccattaagaggtgccatcatggcagctggccccctgaacggggcatccgaagtgaccttttcggtacacgtcaaggacggaggatcatttccgaagacagattcaaccaccgtcacggtgcggtttgttaataaagccgacttccctaaagtgagggccaaggaacaaacatttatgttccccgaaaaccaacctgtttcatccctcgttaccaccataactgggagctcactgcggggagaacccatgagttattacatcgcgtccgggaacctcggtaatacattccagatcgaccagttgaccggccaggtgtcaatttctcaacctctcgattttgaaaagatccagaaatatgtggtttggattgaggccagagacggaggatttccccctttctcaagttatgagaaactggatatcactgtccttgacgtcaacgacaacgcccctatctttaaggaggacccctttatttccgagatactcgagaatctgagcccaagaaagattctgaccgtctcagctatggataaggattcaggtcccaatgggcagctggattatgagatcgtgaacggtaatatggaaaatagctttagcattaaccacgccaccggagagataagaagcgtgcgccccttggatcgcgaaaaagtgtcacactacgttctgaccattaagagctctgataaaggttctccctcccagagtaccagtgtgaaagtcatgatcaatattctagacgaaaacgacaatgcgcccagattcagccaaattttctccgctcacgttccagaaaattctccattgggttacacagtgactcgcgtcacaacttctgatgaggacatcggaatcaatgccattagccgctactctataatggatgccagtctgcccttcaccatcaatccctcaaccggtgatatcgttatatcacgcccactgaacagagaggacaccgatcgttataggatcagagtcagcgctcatgattccggctggaccgtgagcaccgatgtaacaattttcgtgactgatatcaacgataatgcccctcgcttcagcaggactagctactacctggactgtccagagctgaccgaaatagggtcaaaagtcacgcaggtcttcgccaccgatccagatgagggcagtaatggtcaagtgttctacttcatcaaaagccaatccgaatattttcgcataaatgccaccaccggagaaatcttcaacaagcagatcctgaagtatcagaacgtcaccggcttttcaaatgtgaacatcaatcgtcactcttttatcgttacaagctccgaccgggggaaacctagcctgatcagcgagacaaccgtaaccataaatattgtggattctaatgataacgcaccgcagttcctgaagtccaagtatttcaccccggtgaccaaaaacgtcaaagtgggcactaagctgatacgcgtgactgcaatagacgacaaagactttggcctaaattccgaggtcgaatatttcatcagtaacgacaatcatctcggcaaatttaaacttgataatgacacggggtggatcagcgttgcgtcctccctgatctccgacctcaaccagaacttttttattacggtgacagctaaggacaagggtaatccaccattgagttctcaggctacagtccacattactgttactgaggaaaattaccacaccccagagttttctcagtctcatatgtctgctacaatcccagaatcacacagcatcggctcaatcgtgaggaccgtgagcgcccgggacagagacgctgctatgaatggactgattaaatactctattagttcaggcaatgaggaaggcatcttcgcaattaactcctccactgggattttgacactggccaaggccctggactatgaactttgtcagaagcatgaaatgaccatttctgccatagacggtgggtgggtcgccaggactggttattgcagtgtaacagtaaatgttatagatgtcaacgataacagtcccgtattcttgtccgacgactacttccccaccgtgctcgagaatgccccttccggcacaactgtaatccatctgaatgccacagatgctgactctggcacgaatgcagtcatcgcctatacagtccagagcagcgacagcgacctgtttgtaatcgatccgaacactggggtgattacgacacagggcttcttggattttgagactaagcagagctaccacctcaccgtgaaagccttcaacgtaccagacgaagagcggtgctcattcgccaccgtcaatattcagctaaaaggtaccaatgaatatgtgccccggttcgttagtaaactttattacttcgagatcagcgaggctgctccaaagggtacgatcgttggtgaggtttttgcatcagacagggacctggggactgatggtgaagttcattaccttattttcggcaattctcgcaagaagggctttcaaataaacaaaaagactggccaaatctacgtgtctggtatactcgacagggagaaggaagagcgcgtgtcattgaaggtgcttgccaagaactttggtagcatccgtggcgccgacatcgatgaggtgaccgtaaatgtcaccgtcctcgatgccaatgacccccctatctttaccctgaacatatactcagtgcaaatcagtgagggcgtgcctataggaacacatgttactttcgtgagcgcttttgatagcgacagcataccctcttggtcacggttctcatatttcatcggatctgggaacgaaaacggcgctttttctataaacccccaaactgggcagattaccgtgaccgctgaactagatagagagactctcccaatttataacctgtccgtcttggcggttgactccgggaccccatctgccaccggctctgcttccctactagttacactggaagatattaacgacaatggacccatgctaacagtaagcgagggcgaagtcatggaaaataaaaggccgggcacactggtcatgactcttcagtcaaccgatcctgatctgcctcccaatcagggccctttcacttattatctgttgagtacaggcccagccacttcctactttagcctgagcaccgctggtgtgctgtctactacacgggaaatcgacagggagcagattgctgacttttacctgtctgtcgtgactaaagacagtggagtgccccagatgtcgtcaacaggcaccgtccatataaccgtaatcgatcagaatgataatcctagccagtctcgcactgtggaaatcttcgtgaattattacgggaacttatttccaggcggtatcctgggatctgtgaagccacaagatccagatgtgctggactcattccactgtagcctgacatctggagtcacctctctctttagtatcccaggcggcacatgcgacttaaactctcaacctcgctccacggatggcactttcgacctcaccgttctctctaatgacggtgtgcattcaaccgttacaagcaatatcagagtatttttcgctgggttcagcaatgccacagtcgacaacagcatcctgctcaggttgggcgtgcccacagtgaaagactttctcaccaaccactatctccacttcctgagaatagcctcttcccagctgacaggcctcggtacagctgttcagctttattctgcttatgaggaaaataatcggacattccttttggctgctgtgaaacggaatcataaccagtacgtgaacccaagcggcgtggctactttctttgagtccatcaaagagatccttctcagacaatctggagtgaaggtggagtctgtggatcatgactcctgcgtccatggcccttgtcagaacggcggctcttgtttgcgaaggctcgccgtcagttcagttctaaagagcagagaatcactcccagtgatcatcgtggctaacgaacccctgcagccgttcctttgtaaatgtctgccaggatacgccggatcttggtgcgagatcgatatcgatgaatgtctccctagcccttgccactctggaggcacctgtcacaacttggtcgggggcttttcatgcagctgtcccgatgggtttactgggcgggcttgcgagcgcgacatcaacgagtgtctgcagtccccttgcaagaatggcgccatctgtcagaactttcccggctccttcaactgcgtgtgcaagaccggttacactggcgtctttggtaaacattgtgagttgaacagctatgggtttgaggagctgtcatacatggagtttccctctttagatcctaacaataattacatttacgtgaaattcgccacaattaagtctcacgctctgcttctctataactacgataaccagacaggagaccgggcagagttcttggcattggaaatcgcggaggaacgcttacgatttagctacaacctgggcagtggaacctataaactcacgacgatgaagaaggttagtgacggtcactttcacaccgtgatcgcccggcgggctggaatggctgcctctctgaccgtcgacagctgtagcgaaaaccaggaacccggctactgcacagtttcaaacgtggcagtttccgatgactggacgctggacgtccaaccaaatcgcgtgaccgttggtggcatacgaagcctagaaccaatcctgcagcgccgaggtcatgtggagtcccacgactttgtcgggtgcatcatggagtttgctgtgaatggacggcccctggagccgtcacaggcccttgccgcccaggggatcttggatcaatatggagatttcatatcttattgctttaaagaaaagaaatgtaaaaaggtgtgctttaccgttacccctgataccgctctctccttggaaggtaaaggacggttggactatcacatgtcacagaacgaaaagagggagtatctgcttaggcagtctcttcggggagccatgttggagccgttcggggtcaactccttagaggtgaagtttcggaccagatccgagaacggcgtgctgatccatattcaggagtcatctaattatactacagtgaagatcaaaaatgggaaggtgtacttcacatctgatgccggtattgcaggcaaggtggagaggaacatccctgaggtctatgtagcagatggccattggcatacctttctcattggtaagaacggcacagctacggtgctctccgtggatcggatttataacagggacatcatccatcctacacaagatttcggggggctcgacgtactgaccatctcactgggtgggattcccccaaatcaggcccaccgagatgcccagacagccggcttcgatggatgtatagcttctatgtggtatgggggtgagtctttacctttcagcggaaaacatagtctggcctccatttctaagaccgacccaagtgtgaaaataggctgtcggggccccaatatctgtgcttcaaacccttgttggggtgatctcctctgtattaaccagtggtatgcataccgctgtgtcccgcctggagactgtgccagccacccttgtcaaaacggtgggtcttgcgagcctggactacacagcggtttcacttgctcctgcccagacagccataccggacgcacctgcgagatggtcgtggcctgcctcggggtgctgtgtcctcagggaaaagtgtgtaaagccggcagcccagccggccacgtgtgtgtgctctcccaaggacctgaagaaatttcactgccgctgtgggccgtacctgctattgtgggatcttgtgcgactgttcttgcgctgttggtgctttctctgatcctctgtaaccagtgtaggggcaaaaaggcaaaaaacccaaaggaagagaaaaagccaaaagagaagaagaagaaaggcagtgagaacgtggccttcgatgatcccgacaacatcccgccttatggcgatgacatgacggttagaaaacagcctgagggcaatcctaagccggacattattgaacgggagaatccctatctgatctacgacgagactgatattcctcataacagcgagacaatcccctcagccccactggcctcacccgagcaggagatcgaacactacgacattgataatgctagctcaatagccccatctgacgcggacattatccaacattataaacaattcagaagccacactccaaaattctccatccagcgccactctcccttgggcttcgctagacaaagccctatgcccttgggcgcttcgtctttgacctatcagcctagttacggacagggtctaagaacctcttctctgtcccactcggcttgtcccacgcctaacccgctctcccgacatagccctgctccatttagcaagagtagcactttctacaggaactcccccgcgcgtgagctacatctgccgatcagagatgggaatacgttagagatgcacggggatacgtgccagcccgggatcttcaactacgctacccggctgggaagaagatcaaaatcgccacaggcaatggcctctcatggatctcgcccaggttcacgcctcaaacagcctataggtcagattcctctggaatcctccccccctgtcgggctgtccatcgaggaggtggaacgcctgaatactccacgccccaggaacccatccatttgcagtgccgaccatggacggtccagcagcgaggaagactgccgcagacccctgtctcggaccagaaatcccgcagatggcataccggcccccgaatcctcctcggatagcgatagccatgagtcattcacatgctccgagatggaatacgatagggaaaagcccatggtctatacatctcgtatgcccaagctatcccaggttaacgagagtgacgcagatgatgaagacaattacggtgctagattaaaaccccgcaggtatcacggcaggagagccgagggggggccagtcggtacccaggcggcagccccaggaacagccgacaacactctgcctatgaagctaggacagcaggcggggacattcaattgggataacctcctgaactggggccccggttttggccactatgtagacgtttttaaagacctcgcctctttaccagaaaaagccgccgccaacgaagaggggaaggcgggcactacgaagccagttcctaaagacggtgaggctgaacagtacgtttag

SEQ ID NO: 116715 - DNA, 14946 bp, Artificial Sequence
  Description of Artificial Sequence: Synthetic coding sequence
atggacttagctcccgatcgggccaccggaaggccatggctccctctccacacactgtcagtcagccagctactccgcgtgttttggttattatcactactgcccgggcaggcgtgggtgcatggagcagaaccccggcaagtgttccaggtgctggaagaacagcctcctggtactctggtcggaaccatacagacgcgaccaggtttcacctatcggctttctgaatctcacgctttgtttgctataaatagctcgactggcgctctgtatacaacatctactattgaccgcgagtccctcccatctgatgtgatcaatcttgttgtcttatctagtgcacccacataccccacagaggtgagggtactcgtcagagatctgaacgataatgccccagtgtttccggacccctcgatagttgtcacttttaaagaagattcaagttctggcaggcaggtgattctggacaccgcgaccgactccgatatcggcagcaacggggtcgatcacaggtcatatcgaatcattcgaggaaacgaagccggccggttcaggttggatattaccctgaatccctccggtgagggtgctttcctgcatctcgtgtcaaagggggggttggatcgggaagtcacacctcagtatcagctcctggtggaggtggaggataaaggcgaaccaaaaagacgcggatacctccaagtaaacgtaaccgtccaggatattaacgataatccaccagtgttcggctccagtcattaccaggctggagttccggaggacgccgtggtcggtagtagcgtcctacaagtcgcagcggccgatgcagatgaagggaccaacgcagatatcagatacaggctgcaagacgaaggaacacctttccagatggatcccgaaactggcttgattactgtcagggagcccctcgattttgaggctcggcgtcagtactctctcactgttcaggccatggacaggggcgtgcctagcctgactgggagagcagaagcattgattcaattgttggacgtaaacgacaacgacccagtggtgaaatttagatactttcctgcaacgtccaggtacgctagtgtggacgagaatgcgcaggtggggacggtggtggctttattgaccgtaactgacgccgactcccccgccgccaatggcaacatttcagtgcaaatactgggcgggaacgagcagcgtcactttgaagtacaaagctccaaagtccctaatctgtccctgatcaaggtagccagtgccctggatagagagcgcataccctcttacaatctcacggtgtctgtctctgataattacggagcgccgcccggtgcagcagtgcaggctaggtcatcggttgcttcgctggttatatttgtaaatgatataaacgaccaccctcctgtattctctcaacaggtgtaccgcgtaaacctgtccgaagaggcaccacctggttcctatgtgagcggaattagtgctacggatggagactccggtctgaatgccaatttacgctactcaatcgtttcgggaaacggtcttggttggttccacattagcgagcatagtggtctggttacaaccggtagtagcggcggtcttgatcgggaactggctagccaaatcgtgctcaacattagtgcccgagaccagggcgtgcatcctaaagtaagctatgcccagctggttgttaccctactggacgtcaacgatgagaaacccgtgttcagtcaaccagagggctatgatgtgtccgttgtagaaaacgctcccactgggactgagctcctgatgctgcgggccacagacggcgacctcggcgataatggaaccgtgaggttttccctgcaggaggccgagaccgacaggcgcagttttcgcctcgacccagtgagcggtcgcctttcaacaataagctctttggatagggaagagcaggcattctacagtctcctggtcctagcgactgacctcggaagtccaccccaatcatctatggctagaatcaacgtctctctgctggacatcaatgacaactcccctgtgttctaccccgtccagtattttgcacacataaaagagaacgaacctggaggtagctatatcaccaccgtgtccgcaacagatccagacctggggaccaacggaacggtaaagtattccatcagtgccggcgacaggagcaggtttcaggtgaacgcacaatctggagtgatttcgactcggatggccctggaccgtgaggagaagactgcctaccagctccaaatagtggcaactgatggcggaaacctgcaaagtccgaaccaagccatcgtcacaataactgtactggatacgcaggataatccaccggtgttttcgcaagtcgcctactcctttgtggtgtttgaaaacgtggccctggggtatcacgttggcagtgtgtcagccagcaccatggacctaaattcaaacatctcctacctcattacaacaggggatcagaaagggatgttcgcaataaaccaagtgaccggccagcttacaaccgccaatgttattgaccgggaagaacagtccttctatcaactgaaggtggtggcatccgggggcacagttaccggcgataccatggttaacattaccgtcaaggatctgaatgacaacagtccccattttctacaggccatcgagagcgttaatgtcgtcgaaaactggcaggctggccactctatctttcaggcaaaggccgtcgatcctgacgaaggggtgaacggtatggtgctgtactcactgaagcagaatcctaagaatctgttcgccatcaatgagaaaaatggcaccatcagcctgctaggccctcttgatgtgcatgccggaagctatcagatcgagattctggctagtgacatgggggtgccgcaactatcatcaagcgtcattctgacagtttacgtgcatgacgtgaatgacaacagccctgtattcgatcagctgtcatacgaggtgactctgtccgagagcgaaccagtgaactcgaggttcttcaaagtgcaggcctctgacaaggatagcggcgctaacggggaaattgcctatactatcgcggaagggaatactggcgacgctttcggaatttttccagacggacagctgtacattaagagcgaacttgacagagagctgcaggataggtacgtgcttatggtggttgcttccgatagagccgtggagccactcagcgctactgtaaacgtgaccgttattttagaagacgtgaatgataaccgccctctttttaacagcacaaactatactttctatttcgaagaggagcaacgggctggttccttcgtggggaaggtgtcagctgtcgataaagactttggacccaacggcgaggtacggtacagtttcgaaatggttcaacccgacttcgagttacacgcaatttccggcgagatcacaaatacacaccagtttgatagggagagtctgatgagacgcaggggcaccgctgtctttagcttcaccgtgatcgctactgatcagggaattcctcaacccctgaaagatcaggccacagttcacgtctatatgaaagacataaacgataacgcccctaaatttttaaaggacttttatcaggccaccatatctgaaagtgctgcaaatctgacccaggtactccgcgtgtccgctagcgacgtggacgagggcaacaatggcctgatccactactccataatcaaggggaacgaagagaggcaatttgccatcgattcaacctctggccaagtgaccctcatcggcaaactggactatgaggccactcccgcatatagcctggtcattcaggccgtggacagcggcacaatccctctaaatagtacatgcacgctgaatattgatattctggatgagaatgataatacaccctccttccctaaatccacactgttcgtcgacgtcttggaaaatatgcgtattggcgagctggtctcatctgtgaccgcaacggactctgattctggagacaacgccgacctttactatagtataacaggcaccaacaaccacggtaccttttctatcagtccaaacacaggtagtatcttcctcgcaaaaaaattagactttgagactcagtcactgtataagctgaacataacagcgaaggaccaggggcggcctccccggtctagcaccatgtcggtcgtaatacacgtgagagatttcaacgataacccacctagcttccccccaggcgacatattcaaatccattgtagagaatatcccgatcgggacttctgtcatcagtgtaacagcacatgaccctgacgccgatatcaatggacagctatcctatactatcattcagcagatgccacggggcaaccattttacaatcgatgaggtgaagggaaccatttataccaacgccgaaatagatagagagtttgccaacttgttcgagcttacagttaaagctaatgaccaagccgtgcccatagagacaaggcgttacgcgctgaagaacgtgacgatactggtaaccgacttgaatgataatgtccccatgtttattagtcagaatgcgctggccgctgatcctagcgcagtgattgggtccgtcctaaccaccatcatggccgctgaccctgatgaaggggccaacggcgagatcgaatacgagatcattaacggtgacacggacacattcatcgtcgatcggtatagtggcgatttacgcgtcgctagcgcactggtgccttcacagctgatttacaatctaattgtgtctgctactgaccttggaccagagaggcggaagtctactacagagcttaccatcattctccaagggctggacggacctgtgttcactcagcccaaatacatcactatcctgaaggagggtgagcctatcggcaccaatgtgatctctattgaggcggctagtccccgagggtcagaggcacccgtcgaatactacattgtcagcgtcagatgtgaagaaaagaccgtggggaggcttttcaccatcgggcggcataccgggattattcagaccgccgcaattctcgatagagagcagggtgcctgtctttatctggttgacgtatacgcgatagaaaagtccactgccttcccccggacccagagagctgaagtggagatcaccctgcaggatattaatgacaacccccccgttttccctacagatatgctcgacctaaccgtcgaagagaatattggagacggcagtaagatcatgcagcttacagcaatggacgctgacgaaggggctaacgcacttgtgacttatactattatctctggcgcagacgacagttttcggatcgatcctgagtcaggagatctgattgccacccgaagactcgaccgggagcgccggagtaaatactcactcctagtgagagctgacgacggacttcaatcttcggatatgcggatcaacatcacagtaagcgatgttaacgatcacactcccaagttctcccgtccagtctactctttcgatattcctgaagacactattcctgggagcttggtggctgctatccttgccacagatgatgatagcggagtgaacggggaaatcacctatatagtgaacgaagatgacgaggacggcatcttctttcttaacccaatcaccggcgtgttcaacctgaccaggctgctggattacgaggtgcagcagtactatatcctgacggtgcgcgccgaggacgggggcggacagttcacaacgatccgggtctacttcaacatcttagacgtgaacgataatccgccgatcttcagtcttaattcatacagcaccagtctcatggaaaaccttccagtgggcagtacggtactggtatttaatgtgaccgatgcagacgatgggataaatagtcaactcacttacagcatcgcttcaggggatagtctggggcagtttaccgtggataagaacggtgtactaaaggtgctcaaagctctggacagggagagccaatcattttacaacttggtggtgcaggtgcatgacctgccccaaatccctgcatcacgttttacgtcaaccgctcaggtgagtatcattctgcttgatgttaatgataacccccctacctttctatcgcccaaacttacttatatcccagagaatactcctatagacactgtggtgtttaaggctcaggccaccgatcctgatagtgggccaaacagctatatcgaatacacactcctcaacccgctgggcaacaaattttccattggaacgatcgatggagaggtgaggctgaccggggagctggatcgggaagaagtctctaattacactctaacagtggttgcaactgacaagggtcagccctctttgtcttcctctacagaagttgtggtgatggtgctagatattaacgataataaccctattttcgcccaggctttgtacaaggtcgagattaatgagaacacactgacagggaccgacatcatccaggtgtttgccgcagatggagacgagggaaccaatggccaggtgcgttacggaatcgtgaatggcaataccaaccaggaattccgcattgattcagtgaccggagccatcaccgtcgccaaaccactggatagggaaaaaacgcccacttatcacctcacagtgcaagcaactgatagaggctctactcctcgcactgataccagtaccgtctccattgtccttttggacattaatgattttgtgcctgtctttgaactgtcaccgtatagcgtgaacgttccagagaacctggggaccctcccccggacaatcctacaggtcgtggcaagggatgacgataggggctccaattccaagctgtcctatgtgctgttcggtggcaacgaggacaacgccttcacgctgagcgcctctggggaattgggcgtaacacagtccctcgatagggaaacaaaggagcggtttgtcttaatgatcaccgccacagattcaggcagtcctgctctgacaggtactgggactatcaatgtgatcgtagacgatgtgaacgataacgtgcctaccttcgcatcaaaggcttattttaccacgatcccggaggacgctcctacgggcacagatgtccttctggtcaacgcctctgatgcggacgcctcaaagaacgccgtgatccggattattgggggaaatagccagtttaccataaaccctagtaccggccagatcatcacctcggccctattggacagggagacaaaagacaattatactctggtcgtcgtgtgctctgatgcaggctctccagagcccttatcatcaagcacctcggtgctggtaactgtcactgacgtcaatgataaccccccccgattccaacatcacccctacgttacccatattcctagtcccacccttccaggatcttttgtatttgccgtgaccgttacagatgcggacatcggtccgaactccgaactgcactattcactgagcgggaggaatagtgagaagtttcacattgaccctctacggggtgccattatggccgccggtcccctgaatggagcaagcgaagttaccttctctgtgcacgtcaaggatggaggctcattcccaaagactgatagtaccacagttacggttcgctttgtcaataaagctgactttccaaaagtcagggctaaggaacaaacattcatgtttcccgagaaccaacctgtgagttcgctggtcaccaccatcacgggatcgagccttagaggcgaaccaatgtcttactacatcgccagtgggaacctggggaataccttccagattgatcagctcacaggccaggtttcaatcagtcagccactggacttcgaaaaaatccagaaatacgtggtctggatcgaagcacgagatgggggctttccacctttttcaagctacgaaaagctggatattaccgtgctggacgttaacgataacgcccccatctttaaagaggacccctttatttccgaaatcttggagaacctcagtcccagaaaaattctgactgtgtctgctatggacaaggattctggtccaaatggccagttggattacgagatagtgaacggtaatatggaaaacagcttctcaatcaatcatgcaaccggggagatccgttccgtcagaccattggaccgcgagaaggtgtcgcattacgtgttgacaatcaaaagctccgacaagggatcaccttcacagtcaaccagcgttaaagtcatgatcaacattctcgacgagaatgacaatgccccccgctttagccagattttctccgcccatgtccccgagaacagccctttggggtacactgtgaccagagtcaccacatctgatgaagacattggcatcaatgccatctcccggtactcgatcatggatgcctcgcttcccttcacgatcaatccttcaacgggcgatatagtgatctcaagacctctcaaccgtgaggacaccgaccggtatcggattagagtcagcgcgcacgactccggatggactgtgtcgaccgacgtaactatcttcgtgacggatatcaacgataacgctccacgcttttcacggacaagctactacctggattgccctgagttaaccgagattggctccaaggtgacacaagtattcgctactgaccctgacgagggcagtaacggccaagtgttttactttattaagtctcagtctgagtatttcaggatcaatgctactactggtgagatcttcaataagcagatactgaagtaccagaatgtgactggctttagcaatgtgaatatcaacaggcacagttttattgtaacatcttctgatcgcgggaaaccgtccctgataagtgagactaccgtgactataaatattgtcgattcgaacgacaacgctccacagtttctaaaaagcaagtatttcacaccagttactaaaaacgttaaggtagggactaagctcatcagggtgaccgccatcgacgacaaggatttcggcctcaattccgaggtggagtactttatttcaaatgataaccacctggggaaattcaagcttgataatgacaccggatggatcagcgttgcctcttcgttaatcagcgacctgaatcagaacttttttatcaccgttacagccaaagataagggcaatcccccgctgtcgtctcaggccactgtccacatcactgtcacagaggaaaattaccacaccccggagttctcgcaatcccacatgtctgccacgattccagagtcccatagtataggaagtatcgtgcgcaccgtttctgccagagaccgtgatgcggcaatgaatgggttaatcaaatactccatctcctccggcaatgaggaggggatttttgcgattaattccagcactgggattctcacacttgcaaaagcactggattatgagttgtgtcagaagcacgagatgacgattagtgccatagatggaggctgggtcgctagaaccggttattgtagcgtgactgtcaacgtgatcgacgttaacgacaactctcccgtgtttctgtccgacgattactttccaacggttctggagaatgctccatcagggacaactgtgatccacttgaacgccaccgatgccgattctggcacaaacgctgtgattgcctacacagttcaaagttctgacagcgacctgtttgtgattgatccaaatactggcgtgataacaacccagggattcctggattttgaaaccaaacaaagttaccatcttaccgtgaaggcattcaacgtcccagacgaagagcgctgtagcttcgctaccgtgaacatccagttgaaagggaccaatgagtatgttccaaggtttgtgtccaaactgtactacttcgagatctcagaagctgcccccaaaggcaccattgtcggtgaggtgtttgcatcggaccgcgatctgggcaccgacggagaggtacactatctgatcttcgggaactcaaggaagaagggattccagatcaataagaagacaggccagatatatgtgagcggaattttggatagggaaaaggaagagcgcgtgtcactgaaagttctcgccaagaattttggaagcatccgaggggccgacatcgacgaggtgacagtcaacgtcacggtgctggatgcgaacgaccctccaatttttaccctgaacatctattcagtccagatctccgaaggtgtgcctattggtacccatgtgacattcgtgtcagccttcgattccgactctattccctcttggtctcgtttcagttactttatagggtccggaaatgagaacggcgcctttagcataaacccccagaccgggcagattacagtcaccgccgagttggatcgtgagaccctgcccatatacaacctaagcgtgttggctgtagacagtggtactccatcagcaactgggagtgcttcccttttggtgacacttgaggacatcaacgacaatggtccaatgcttaccgtaagtgaaggagaggtgatggaaaataagaggcctgggacattggttatgacccttcagagcacagatccagaccttcctcctaatcaggggccatttacatattatcttttaagcaccgggcctgcaaccagctatttctccctgtcaactgcaggcgtactgtctaccacgcgtgaaatcgatcgggaacagatagccgatttctacctgtctgtggtaaccaaagattctggagtgccccagatgtcgagcactggcactgtgcatatcacagtgatcgaccagaacgacaaccccagtcagtctagaaccgtggaaattttcgtcaactactacggcaacctgtttcccggtggcatcctcggctctgttaaaccacaggaccctgacgtgcttgactctttccattgttctctgaccagcggggtgacctcacttttctctattcccggtggcacctgcgacctaaattctcagccccgaagcactgatggtacatttgacctgactgtcctttccaacgatggtgtccatagcacagtgacctccaacattcgcgtgttctttgccggcttctctaacgctacagtggacaacagcatcctgcttcgattgggggtgcccacagtgaaagacttcttaactaatcattacctgcacttcctgagaatcgcaagcagtcagctaacaggcctggggaccgcagtacagctgtacagtgcctatgaggaaaataaccgaacctttttgctggcggcagttaaacgaaaccataaccagtacgtgaaccccagtggcgtggccacttttttcgagagtattaaagaaatcctcctcaggcaatccggcgtcaaggtcgagagtgtcgatcatgattcctgtgtccacggtccgtgtcagaatgggggaagctgtcttcgaagactagccgtctctagcgtgctgaaatctagggagtctttacctgtgattattgtggctaatgagcccttgcagcccttcttatgcaagtgccttcccggttatgctgggtcctggtgtgaaatagatatcgatgaatgcctgccctccccttgtcactcagggggcacgtgtcacaatttagttggcggtttcagttgttcgtgtcctgacgggttcaccgggcgggcttgcgaaagggatattaatgaatgtcttcaatctccttgcaagaatggcgccatctgccagaacttccccgggtcattcaattgtgtttgcaaaaccggctatacaggcaagatgtgcgaatcgtctgtgaactactgcgagtgcaatccttgctttaacggcgggagttgccagtccggagttgatagttactattgccattgtccatttggcgtgtttgggaagcactgtgaactgaactcctatggcttcgaagaattgtcttacatggaattcccttctttggatcctaacaataattatatctacgttaaattcgctactatcaaatcacatgccctgctgctgtataattacgacaatcaaacaggcgaccgcgctgaatttctggccttggagattgcggaggaaagactccgttttagctacaacctgggcagcggcacatacaagctcaccactatgaagaaggtcagcgatggacattttcacaccgtgatcgcgagacgtgctggaatggctgcttccctgactgtggattcttgtagcgagaaccaggagcctggctactgcaccgtgagtaacgtcgcagttagcgacgattggacactcgacgtgcagccaaatcgcgtaacagtgggcggcatccgaagcctcgaacctattctacaaagaagaggccacgtagagagccatgactttgtaggatgtattatggaatttgccgttaatgggcggcccctggagccaagtcaggctctagcagcgcaggggatcctggaccagtgtcctcgccttgaaggggcctgtaccaggagcccttgccaacacggcggaacgtgtatggactactggtcatggcagcagtgtcactgcaaggagggtcttacagggaaatattgtgaaaaatccgtgactcccgatactgccctgtccctggagggcaagggccgcctggactatcacatgtcccagaatgagaagcgcgaatacctgcttcgacagtccctgcggggagcgatgctggaaccatttggagtcaactcactcgaagtgaaatttaggacaagaagtgagaacggtgttctcatacatatacaggagtcatcaaattatactaccgtcaagattaaaaatggtaaagtgtactttacatcggacgccggcatcgctggcaaagtggagcggaatattcctgaggtgtatgtggctgacggtcactggcatacctttctaattgggaagaatggcaccgccactgtcctgtccgtggaccgaatctacaatcgggatataatccacccaactcaggattttggaggtctcgacgtgctgactattagcttgggtggaatcccacccaaccaggcacaccgcgacgcccaaacagccggcttcgatggatgcatcgcaagcatgtggtatggtggcgaatccctgcccttctctggaaaacactctctcgcgtcaatatctaaaacggatccgtcagtgaagatcggttgccggggtccaaacatttgcgcatctaatccttgttggggggatttgctgtgcatcaatcagtggtacgcttaccggtgcgtccctccgggagactgcgccagccacccgtgccagaacggcgggtcttgcgagcctggactacacagcgggtttacctgctcatgtcctgacagccacaccgggagaacctgcgaaatggtcgtggcttgtctgggggtcctctgtccacaaggcaaggtgtgcaaggctgggagcccagctgggcacgtgtgcgtcttaagccagggtccagaggagatctcactcccactatgggccgttcccgctatagtgggttcatgcgccacagtgctggccctcctggtactgagtctgatactctgcaatcagtgccggggtaagaaggccaaaaatcctaaggaggagaaaaagccgaaggagaagaaaaaaaaggggtctgagaacgtcgcgttcgacgatcctgataatatccccccctacggtgacgatatgaccgttcggaagcagccagaagggaaccccaagccagatattattgaacgggagaatccttacttaatctatgacgaaacagacatccctcataacagcgaaacaatccccagcgcccctttagcgagcccagaacaagagatcgagcactacgacatcgacaatgcgtcgagtatcgcaccttccgacgccgatattatccagcactataaacaatttaggtctcatactccaaaattcagcattcaacggcattctcctctgggcttcgctaggcaatctccaatgcccctcggagccagtagcctgacataccaaccctcctatggacaaggactaaggacaagcagcctcagccattcagcgtgcccaacacctaatccactatctagacattctccagcacctttttccaagagcagcactttttaccgaaattcccctgctcgcgagctgcaccttcccattagagatggcaatactttggaaatgcacggtgacacatgccagcctgggatattcaattacgctacccgcctggggcgtcggagcaagagtccacaggctatggcatcccacgggagccggcctggaagtcgactcaagcagcctatcggacaaataccactcgaatcgtccccaccggtgggcttatccatcgaagaagtggaacggctgaatactcccagacctagaaatccctctatttgttccgcagatcatgggaggtctagctcagaagaagactgtcgaagacctctgtctagaacccggaatccagccgacggtattccagctccagaatctagcagcgatagcgactcgcacgagtctttcacctgctctgagatggaatacgaccgagagaagccaatggtatacacatcccggatgcccaagctgagccaggttaatgaatccgacgctgatgatgaagacaactacggggctagactaaagcctcggcgctaccatggcagaagagcggagggaggccccgtcggcactcaggcagctgcacctggcacagctgacaacacactgccaatgaaactcggccagcaggccggcacattcaactgggataatttgctgaactggggaccaggtttcggtcattacgtggacgtgtttaaggacctagccagtctgccagagaaagctgctgccaacgaagaaggcaaagccggcactacaaaaccggtccccaaggatggtgaagccgagcagtatgtgtag

SEQ ID NO: 116716 - DNA, 1239 bp, Artificial Sequence
  Description of Artificial Sequence: Synthetic coding sequence
atgggcctgcacctgcgcccctacagagtgggcttgctgccagatggcttgctctttctactgctgctccttatgctcctggctgaccccgctctgccagctggccggcaccctccagtagtcctggttcctggagatctgggcaaccaactggaggccaaactggacaagcctacggtggtacattatttgtgcagcaagaagactgagagttacttcacaatctggctgaaccttgagctgctgcttcccgtaataattgattgttggatcgacaacatacggcttgtgtacaataaaacctccagggctacacagttccctgacggggttgatgtaagagtccccggttttgggaaaaccttctctctggagtttctggacccaagcaaaagcagcgtgggctcttactttcacacaatggtcgagtctctggtcggttggggttacacacggggcgaagacgtgagaggagcaccctacgactggaggcgggccccgaatgagaatggcccatacttcttagccctaagagaaatgatcgaagaaatgtatcaactgtacggggggcctgtggtcctcgtggctcacagtatgggaaacatgtatacactgtactttctgcagcgacagcctcaggcttggaaggacaagtatattcgggctttcgtgagcctcggagctccttggggcggagtggccaagactctgcgggttttggccagtggagataacaatcgcatacccgtaatcggacccttgaagattcgagagcagcagcggtctgctgttagcacaagctggctgttgccgtacaattacacatggtcaccggagaaggtattcgttcagacaccaaccattaactacactctgagagactataggaagttctttcaagacatcggtttcgaagatggatggttaatgcgacaagatactgaggggctggttgaggctaccatgcctcccggagtgcagctacattgcttgtatggtacaggcgtcccaaccccagattccttctattatgagtcattcccagacagggaccctaagatctgtttcggggacggtgatggaacagtgaatctaaaatccgcactgcaatgccaggcgtggcagtcacggcaggagcatcaggtgctattgcaagagttgcccggaagtgaacacattgaaatgctggctaatgcaactactttagcatatttaaagcgcgtgttgttagggccttag

SEQ ID NO: 116717 - DNA, 480 bp, Artificial Sequence
  Description of Artificial Sequence: Synthetic coding sequence
atgtttcccggactgtttatgcttggcacttttctatggagcttaattgagtacctgatccaccgcttcctgtttcacatgaaacctccaagcgacagctattacctgatcatgctgcacttcgtcatgcatggacagcatcataaggcaccctttgacggttcaaggcttgtgtttcctccggtgcccgcatctctggtgattggcgtgttttacttgtgtatgcaattgattctgcccgaagccgtgggaggtacagtcttcgctggcggcctcctgggttatgttctatacgatatgacccactactatctccactttggatcccctcacaagggatcttacctttattcactgaaggctcatcatgtgaagcaccacttcgcccatcagaagagcggctttggcatatcaactaaattgtgggactactgcttccacaccttgacccccgagaagccacatctcaaaacacagtag

SEQ ID NO: 116718 - DNA, 1740 bp, Artificial Sequence
  Description of Artificial Sequence: Synthetic coding sequence
atggtccagtatgagttatgggcagctctgcctggagcaagcggtgtggctcttgcttgctgctttgtcgccgcagctgtggcactgcggtggtccggacgccgcacagccaggggggcagtggtgcgcgcacggcaaagacagagagccggtctcgagaacatggatcgggcagcccaacgctttcggctccaaaatcccgatttggatagtgaggcccttcttgcgcttccactgccgcagctggtgcaaaagttgcattcacgcgagctggcaccggaagcagtcctgtttacctatgtcggcaaggcctgggaagtgaataaaggaactaattgtgttacctcatacttagccgattgtgaaacacagctctctcaggcaccaaggcagggcctgctatacggggtccctgttagcctgaaggagtgcttcacctacaaaggacaggattctactctcggtcttagcctgaatgagggggtgccagccgagtgtgattccgtagtggtacacgtactgaaactacaaggggcagtgccgtttgttcacactaacgtgcctcaaagtatgttcagctatgattgcagtaaccccctcttcgggcaaaccgtgaatccttggaaatcttctaaatcacctggcgggagcagtggcggagagggagcattgatcggatcaggtggcagccccctcgggctggggaccgacattggcgggagcatccgctttccctcatcattctgcggcatatgcgggctgaagcctactggaaaccggctgtctaagtccggccttaagggctgcgtgtatggccaggaggccgtcagactgtcagtcggccctatggctcgggatgtagaatctcttgccctttgcctcagagctctactgtgcgaggatatgtttcgcctggacccgacggtgcccccgctgcccttcagggaagaggtttacaccagctctcagccccttagggtgggttattacgaaactgataattacaccatgcccagccccgcaatgaggcgagctgtgctagaaacaaagcagagcctggaggcggctggacatacacttgtaccattcctcccctctaatataccacatgccctggagacactgagcactggaggcttgttcagtgatggcgggcacaccttcctgcagaactttaagggcgacttcgtagacccatgcctaggtgacctggtgtccattcttaaactccctcagtggctcaagggtctgcttgcattcctcgtgaaaccccttttacctagactgtccgcttttctgtctaacatgaagtccaggtctgctggcaaactttgggaattgcagcatgagattgaagtctatcgcaaaactgtgattgctcagtggagagcactcgacctcgacgtcgtgctgacccccatgttagcacccgctctcgatctcaatgcccctgggagggcaacaggagcagtcagttacactatgctttacaactgtctggatttccccgccggcgtggtgccagtcacaacagtgacagccgaggatgaagcacaaatggaacattatcgggggtacttcggcgatatatgggacaaaatgctccagaagggcatgaagaagtctgtgggtctgcccgtagctgtgcagtgtgtggccctcccttggcaggaagagctttgtctccgctttatgagggaggtggaaaggcttatgacgcctgagaagcagtcaagctag

SEQ ID NO: 116719 - DNA, 456 bp, Artificial Sequence
  Description of Artificial Sequence: Synthetic coding sequence
agaaggcagcaccccctgccgctgctgctcctgaggcacttgagaccccaggcccaccgggagcccccccaggtctacacctctagccagccactgagggtaggctactacgagacggataattatacaatgccctcacctgccatgcggcgggccgtactggaaacgaagcaatctttggaggccgctggccatacattggtgccgtttcttcctagcaacatacctcacgccctggaaaccctcagcaccggggggttgttctccgacgggggacatactttcctgcagaacttcaagggggactttgttgacccatgtctaggtgacctagtgtcaatactgaaactgcctcagtggctgaaaggtctgctggcattcctggtgaaacctctactgcctaggctgagtgcattcctatccaacatgaagtctagatgcagaccactcccctag

SEQ ID NO: 116720 - DNA, 1599 bp, Artificial Sequence
  Description of Artificial Sequence: Synthetic coding sequence
atggcccccagctttacggccagaatccagctgtttctgctgagagctctggggttcctgattgggcttgttggtcgggctgccctggtgctgggcggtcccaaatttgcaagcaagacccctcgtccagtaacggagcctttacttctattatctggaatgcagttggcaaaactcattaggcaacgtaaagtgaagtgcatcgacgttgtgcaggcatatatcaatcggatcaaagacgtgaacccgatgattaacggcattgtcaaatacagattcgaggaggctatgaaggaagcacacgccgtggaccagaagctggccgaaaagcaggaggacgaagcgacgttagagaacaaatggcccttcctgggtgttccactcacagttaaggaagctttccagttgcagggcatgccgaattcaagcgggcttatgaaccgacgggatgccattgcgaaaactgacgccacagtggtagcacttcttaaaggtgccggcgctatcccattgggtataactaattgctccgagctgtgtatgtggtatgagtctagtaataaaatatacggaaggagcaacaatccttatgatctccagcatatagtgggcgggtcatctgggggcgaggggtgcaccttggcggccgcttgctccgttataggcgtgggctccgacatcggagggtcaattcgcatgccagcctttttcaatggcatttttggccacaagccgtccccaggcgtcgtaccgaataaaggccagtttccccttgccgtgggcgctcaggagctcttcctatgcaccgggcctatgtgtcggtatgccgaagatctggccccaatgttgaaggtgatggccggacccggaatcaaaaggctaaaattggacactaaggttcacctgaaggatctgaaattttattggatggagcacgacggcggctcctttctgatgagcaaggttgaccaggatctcatcatgactcagaagaaagtggtggttcacttagagaccatcttgggggcaagtgtacagcacgtcaagcttaaaaagatgaagtacagttttcaactgtggatcgccatgatgtcagccaagggccatgacgggaaggagcctgtgaagtttgtggatttgctcggcgaccatggcaaacacgtctctcctttgtgggagctgatcaagtggtgtttaggcttaagcgtttacactattccttccatcggtctggcgctgctagaggaaaagctgaggtactcaaatgagaaataccagaagtttaaagctgtcgaagaatctttgaggaaggagttggttgatatgctgggcgacgatggggtcttcctgtaccctagtcatcccaccgtggcacccaaacaccacgtgcccttaactcggccgtttaacttcgcttataccggcgttttttccgccctgggcttgcccgtgacacaatgcccgctgggcctcaacgccaaggggctgccactgggcatccaggtcgtcgccgggcccttcaacgatcacctaacactcgctgtggctcagtacctggagaagacctttggcggctgggtgtgccccggtaagttctag

SEQ ID NO: 116721 - DNA, 384 bp, Artificial Sequence
  Description of Artificial Sequence: Synthetic coding sequence
atgagcttttcaggtaaataccagttacagtctcaagagaactttgaggcctttatgaaggctatcggcctgccagaagaactcatacaaaagggaaaggatatcaaaggagtctccgaaatcgtccagaatggcaagcactttaagtttacaattacagccggatctaaggtcatacagaatgagtttacagtgggcgaagaatgcgagcttgagacgatgactggggagaaagtgaaaactgtggtccagctggaaggggataataagttggtgacaactttcaaaaatatcaaaagtgtgacagagctgaatggagatatcattaccaacaccatgactttaggtgacattgtgtttaagcggatatctaagcgcatttag

SEQ ID NO: 116722 - DNA, 399 bp, Artificial Sequence
  Description of Artificial Sequence: Synthetic coding sequence
atggcctttgattccacctggaaggtggacaggagcgaaaattacgataaattcatggagaaaatgggcgttaacatagtgaagcggaagctggcagctcacgataatctgaaactgacaattacgcaagagggtaacaagtttactgttaaagagagtagcacttttaggaatattgaggtcgtgtttgaactgggagtgacattcaattacaacctggccgatgggactgagctccggggcacctggagtttggaaggcaacaaactcatcggcaagttcaagcggaccgataatggaaacgagttaaacactgtgcgggagatcataggtgacgagctggtgcagacttacgtctacgaaggagttgaggcgaagagaatatttaaaaaggattag

SEQ ID NO: 116723 - DNA, 402 bp, Artificial Sequence
  Description of Artificial Sequence: Synthetic coding sequence
atggtcgatgcattcctggggacatggaagctggtcgacagcaaaaacttcgacgactacatgaaaagccttggggtcgggtttgcaactcgtcaggtagcctctatgactaagcctaccaccataatcgagaagaacggggacatcctcacccttaaaactcacagtactttcaagaatacggaaattagctttaaactgggagtggaatttgacgagacgactgccgatgatcgcaaagtcaaaagtatcgttactctagacggaggaaaactcgtgcacctccagaaatgggacggacaggagactacactggtgcgcgaactcatcgacgggaagcttattctgaccctcacacacggaactgcggtgtgtactaggacctatgagaaagaagcatag

SEQ ID NO: 116724 - DNA, 408 bp, Artificial Sequence
  Description of Artificial Sequence: Synthetic coding sequence
atggcgaccgtccaacagctggaaggaaggtggcgtctggtggactctaagggcttcgatgaatacatgaaagagttgggagtgggaattgcccttagaaagatgggcgccatggccaaacccgattgcattattacttgtgacggtaaaaatctcacaataaaaactgaatctacgctgaagaccacccaattttcctgcacacttggcgagaagttcgaagagaccactgccgacggcagaaaaactcagaccgtgtgcaactttacggatggcgcccttgttcagcatcaggagtgggacgggaaggagagcacgatcactcgcaagctgaaagatgggaagctcgtggttgagtgtgtgatgaacaacgtgacctgtacccgaatatatgaaaaagttgagtag

SEQ ID NO: 116725 - DNA, 534 bp, Artificial Sequence
  Description of Artificial Sequence: Synthetic coding sequence
atgaaaaccgttacaatgatgatggtggtggaaatgcaggccctgacgcaggtgttgcgcgcagttctgagtgcatgcacgtgggtctctcgaaaaggagacctgcaaaggatgaagcagactcacaaaggaaagcctccgagcagcatggccttcaccggtaagtttgaaatggagtcagaaaagaattatgacgagtttatgaaattactggggatatcctctgatgtcatcgaaaaagcccggaatttcaaaattgtgaccgaagtccaacaagacggccaggattttacatggagccagcactacagcggcgggcacacgatgacgaacaagttcacagtggggaaggagtccaacattcagactatgggcggaaaaacctttaaagcaacagtccagatggaggggggtaagctggtcgtgaattttcctaactaccaccaaacctcagagattgtcggcgataaactggtcgaggtcagcactataggtggcgttacgtatgagagggtcagcaagcggctggcttag

SEQ ID NO: 116726 - DNA, 534 bp, Artificial Sequence
  Description of Artificial Sequence: Synthetic coding sequence
atgaagactgtaaccatgatgatggtggtcgaaatgcaggcacttacgcaggtgctgcgcgccgtcttgtctgcctgcacttgggtgagccgcaaaggcgacttgcaacggatgaagcagactcataagggcaagccaccctccagtatggctttcaccggcaagttcgaaatggagtctgagaagaattatgacgaattcatgaaactgcttggaatttcctcagatgtcatcgaaaaggcaaggaacttcaaaatagtcaccgaggtccagcaggatgggcaggactttacttggtcgcagcactattctggagggcacacaatgaccaataagttcaccgtcgggaaagagagcaacatccagaccatgggtggaaaaacttttaaggccactgtgcaaatggaagggggaaagctggtggttaactttccaaactatcatcagactagtgaaatcgtaggggacaaactggtggaggtgtctacaataggcggtgtgacctacgagagagtttccaagcgactggcatag

SEQ ID NO: 116727 - DNA, 387 bp, Artificial Sequence
  Description of Artificial Sequence: Synthetic coding sequence
atggcctttactggaaaattcgaaatggaatcagaaaaaaattacgatgagtttatgaagcttttagggatctctagcgacgtgatcgagaaagctcggaacttcaaaattgtgactgaggtgcagcaagatggtcaggatttcacttggagtcaacattacagcggaggccatactatgacaaacaagtttactgtcggcaaggagtcaaacatccagactatgggaggcaaaaccttcaaggcaactgtgcaaatggagggaggcaagcttgtggttaatttcccaaattaccatcaaactagcgagattgtgggagacaaattggttgaagtcagcacaattggcggggttacgtatgaacgggtaagcaagagactcgcgtag

SEQ ID NO: 116728 - DNA, 501 bp, Artificial Sequence
  Description of Artificial Sequence: Synthetic coding sequence
atggtagaggccttctgcgccacctggaagctaaccaattcccaaaacttcgacgagtacatgaaggcgttgggggtgggctttgcaactaggcaggtgggcaacgtaactaaaccgactgtaataatatctcaggaaggcgacaaggtggttattaggaccctgtcaaccttcaagaatactgagatctccttccaactgggcgaggagtttgatgagaccaccgccgacgacaggaattgtaagtccgtcgtctcccttgatggcgacaagctcgtccacatccagaagtgggatggaaaggaaaccaattttgtccgcgagattaaagacggaaaaatggtgatggtgtctaacgacaacagtcccttcttcttagtcttcttctcctcaccgcatactagccatctcctgccaagtagctcacttctgctgccctttttcttgctaccgtcatttttcaacaacaccagtctggccaggttttttaattacatgtag

SEQ ID NO: 116729 - DNA, 399 bp, Artificial Sequence
  Description of Artificial Sequence: Synthetic coding sequence
atggtggaagcattttgcgccacctggaaactgaccaacagccagaacttcgacgagtatatgaaggcactaggagtcggctttgccactcgccaggtgggcaatgtgactaagccgaccgtgataatcagtcaggagggtgacaaagtggtcattagaacactgtccacctttaagaatactgagatttcctttcagctgggcgaagagttcgacgagacaactgcagacgaccgaaattgcaaaagtgtcgtgagcctggatggggacaaactggtgcatatccagaagtgggatggcaaggaaactaacttcgtccgagagatcaaggatggcaagatggtcatgacattaacttttggagatgtggtggcagtccgtcactatgaaaaggcctag

SEQ ID NO: 116730 - DNA, 1506 bp, Artificial Sequence
  Description of Artificial Sequence: Synthetic coding sequence
atgggaacacgtgctgccagaccggcaggcctgccatgcggcgctgagaatcctgcacgccgtcggctggctcttggcgctcggcagcagattcattcctggtctccccggaccccatctactcgcctgactgctcccgccggtccagccagaggggttgctcgccctgccatggcccccgatcctgttgccgcagaaacggctgctcagggccccactccacgctacttcacctgggatgaagttgcgcagagaagtggatgcgaggaacggtggctcgttattgatcgaaaggtgtacaatatctctgagtttacccgccggcacccgggcgggtcacgggttattagccattacgccggacaagacgcaacagatccattcgtcgcatttcatatcaacaaagggctcgtcaagaaatacatgaactctctcctaatcggagagctgagccctgaacagcccagctttgaacccactaaaaataaggaactaaccgatgagttccgagaacttagggcaaccgtggaacgaatgggcctcatgaaagccaatcacgtcttctttctcctttacttgcttcacattctgttgctcgacggtgccgcgtggctcactctgtgggtctttggcacttcattcttgccttttctgctttgtgccgtactgctatctgcagtacaggcacaggccggctggttgcagcacgatttcggccacctctccgtgtttagtacaagtaagtggaaccatctgctgcaccacttcgtaatcggccatctgaaaggagcaccagctagctggtggaatcacatgcactttcagcaccatgcaaagcccaactgcttccgtaaagatcctgatatcaatatgcatcctttcttcttcgcactggggaaaattctttccgtagaattgggcaagcagaaaaagaagtacatgccttataatcaccagcataaatactttttcctaatcggccccccagccctccttcccctgtattttcagtggtacatcttctatttcgtcatccagcggaagaagtgggtggatttagcatggatgattacattttatgtccgcttctttctgacgtatgtcccactcttaggattgaaggcctttctgggcttatttttcatagtccgatttctcgagtcaaactggtttgtttgggtgacacagatgaaccacattccaatgcatatcgaccacgacagaaacatggattgggtgtcaacccagctgcaagccacctgtaacgttcataaatctgccttcaacgattggtttagcggccatcttaacttccaaatcgaacaccacctgtttcccaccatgccaagacacaactatcataaggttgccccgctggttcagagcctctgcgcaaaacacggcatcgaatatcagagcaagccattgctttcagcctttgccgacatcatccacagcttaaaagaatcgggtcagctctggctggacgcttatctgcatcagtag

SEQ ID NO: 116731 - DNA, 1083 bp, Artificial Sequence
  Description of Artificial Sequence: Synthetic coding sequence
atgaatagtctcctgattggggaattgtccccggagcagccttcctttgaacccactaaaaacaaggagctaaccgatgaatttagagagctccgtgcgaccgtggagcggatgggcttaatgaaggccaaccacgtgttctttctgctatacttgctgcacatccttctcttagacggcgcggcttggttgaccctgtgggtgtttggcactagctttctgcccttccttctgtgtgccgtcctcttgagtgcagttcaggcacaagcaggctggctgcagcatgatttcggtcacttatccgttttttctacaagtaagtggaaccacctgctgcaccacttcgtgatcgggcatcttaagggggcacccgcgtcttggtggaatcacatgcacttccaacaccacgccaaacccaattgtttccgtaaggacccagacattaatatgcacccctttttcttcgccctgggtaagatcctatccgtggaactaggtaagcagaaaaaaaagtatatgccctacaaccatcagcacaaatactttttcctcatcggcccacccgccctgctaccgctgtacttccagtggtacatattctattttgtcatacaacgtaagaagtgggtagacttggcgtggatgatcactttttacgtgaggttcttcttgacttatgtacctttgctgggcctcaaggccttcttgggattgttcttcatcgtgcgcttcctcgaaagcaactggtttgtgtgggttacgcagatgaaccatatccctatgcacatcgatcatgatagaaacatggattgggtcagtacacagctgcaggctacatgtaacgtgcacaagagtgcatttaatgactggttctccggtcatttaaacttccaaattgagcaccatctattccccacgatgccccggcataactaccacaaggttgcgccactggtgcaaagcctgtgcgcaaagcacggcattgaatatcagtcaaagcccctcctctccgcctttgctgacatcattcattccctcaaggagagcggccaattatggttggatgcctacctgcatcagtag

SEQ ID NO: 116732 - DNA, 1083 bp, Artificial Sequence
  Description of Artificial Sequence: Synthetic coding sequence
atgaattccctgcttattggtgaattatccccggagcagccgtccttcgagcctaccaagaataaggaactgacggacgagttcagagaactgagagccacagttgagcgtatgggattaatgaaggcgaaccacgtgttcttcctactctaccttctccatatcctactcctggacggtgccgcgtggctgactctgtgggtgtttggcacatcctttctgccttttcttctgtgtgcggtactgttatccgccgtgcaggctcaagccggctggcttcagcacgactttggacatctttccgtgtttagcacttccaaatggaatcaccttctacatcatttcgtcattggacatctgaagggcgcccctgcttcttggtggaaccacatgcacttccagcatcacgcgaagcctaactgcttcaggaaggatcctgacatcaacatgcacccatttttcttcgccctggggaagattctttctgtggagctgggaaagcagaagaaaaagtatatgccctacaatcatcaacacaagtacttctttcttatcgggccccccgcactgctgccactgtattttcagtggtatattttttattttgtgatccagcggaaaaaatgggtggacctggcttggatgattacattctatgtaaggttctttctgacatatgttccacttctggggctcaaagcctttctcgggctgttctttatagtgcgctttcttgagagtaattggtttgtgtgggtaacgcagatgaatcatatcccaatgcacatagatcacgatcgcaacatggattgggtgtcaacccagctgcaggcgacatgtaatgtacacaagagcgcgttcaacgactggtttagcggccacttaaacttccaaatcgagcaccacctctttccgacgatgccacgtcacaactatcacaaagttgcgccactagtgcagagtctctgcgcgaagcacggtattgaatatcagagcaagccattgctctctgctttcgcagacatcatccactctctgaaggaaagtgggcagctgtggctggacgcatatctgcaccagtag

SEQ ID NO: 116733 - DNA, 1083 bp, Artificial Sequence
  Description of Artificial Sequence: Synthetic coding sequence
atgaacagcctactgattggtgagctgtcaccggagcagccaagcttcgaacctactaagaacaaggagttaacggatgagtttcgtgagcttcgggccacagtggagcgaatggggctgatgaaggcaaaccacgtgtttttcttgctgtatctgctgcatatcctgctccttgatggcgccgcatggctgacgctatgggttttcggcacctcctttctcccgtttttgctctgtgctgtgctcctgtcagccgtccaggcacaagctggctggctgcagcatgatttcggtcacctgtctgtgttcagcactagtaagtggaaccacttactgcatcacttcgtgatagggcacctgaaaggtgctcctgcttcttggtggaatcacatgcacttccagcaccacgccaagccgaattgcttccggaaagacccggacattaacatgcatcccttcttcttcgctttgggcaagattctaagcgtggaattaggaaagcaaaagaaaaagtatatgccctacaaccatcagcataagtacttttttctgattggtcctcccgcgttgctcccattatactttcagtggtatatcttctactttgtgatacagcggaagaaatgggtggacctggcttggatgattactttttacgtgaggtttttcctgacctacgtgcctctgctggggctcaaggcattcttaggtctattcttcatcgtccgcttcctagagtctaattggtttgtttgggtgactcaaatgaaccacatacccatgcatattgaccatgacagaaatatggactgggtttccacccagctgcaggcaacctgcaatgtccataaaagtgcattcaacgattggttctctggacacctcaacttccagatcgaacaccatttgtttcctactatgcccaggcacaactaccataaggtagcacctctggtgcaatccctgtgcgctaaacatggaatagagtatcaatctaaaccactgttgagcgcgtttgctgatatcattcatagcctaaaggagagtggtcagctatggctcgatgcgtacctccaccagtag

SEQ ID NO: 116734 - DNA, 1131 bp, Artificial Sequence
  Description of Artificial Sequence: Synthetic coding sequence
caagacgccttcagggccttccaccaggaccttaactttgttaggaaatttttacagccgctgctcatcggtgaactggctccagaagagcccagccaggacgggcctttgaacgcccaactggtggaggattttcgcgccctccatcaggccgcagaggacatgaagttatttgatgcttcccctaccttttttgcttttctcctggggcacatcttggccatggaggtcctggcctggttactgatctacctgctgggacccggatgggtgccttcggcgctcgctgcctttatattggcaattagccaagcccaagcaggctggctccagcacgacttcggccacctgagtgtgttctccacatcaaagtggaaccacctccttcaccacttcgtaatcggacatttaaaaggggcaccagcaagctggtggaaccacatgcacttccagcaccacgccaagcctaattgctttcggaaagatcccgacattaatatgcatccattctttttcgccttgggaaaaatcttaagtgtggagctgggcaagcagaagaagaagtacatgccctataaccatcaacacaaatacttctttctgattgggccccccgcgttacttcccctgtacttccaatggtatatcttctatttcgtcatacagcgcaagaagtgggtcgatcttgcatggatgattaccttttacgtaagattcttcctgacctatgtgcccttgctgggattgaaagcattccttggtctgttttttattcgatttctggaaagtaattggttcgtgtgggtcacacagatgaatcatatccccatgcacatcgatcacgaccgaaatatggactgggtgtctacccagctccaagctacgtgcaatgtacacaaatctgcattcaatgactggttttcaggccatcttaacttccagatcgaacatcacctgttccctaccatgcccagacataactaccataaggtggccccactcgtgcagtcattgtgcgccaaacatggtatcgaataccagtcaaagccccttctgtccgcattcgctgatatcattcactccctgaaggagtctgggcagctttggctggatgcttatctgcaccagtag

SEQ ID NO: 116735 - DNA, 1269 bp, Artificial Sequence
  Description of Artificial Sequence: Synthetic coding sequence
atgcatggaagggaggcgggcccattcgtgtgcgtgtgcgtccttcttgcctctatccccacaccccaaacccccctactacaggcctcgctcccaccatttcaccctgcaagcgccggccacccgattacgggtcagcaggacgccttcagagcctttcatcccgatctcgagttcgtcggaaaatttctcaagcccctgctcattggagagctggcccccgaagagccttctcaagatcatggtaaaaattccaaaattacggaagacttccgggctctgagaaagaccgccgaagatatgaatttgttcaagactaaccatgttttctttctgctgctgctcgcccacatcatagctctcgaatctatagcatggtttacagttttctatttcggcaacggctggatccctactctgattacggctttcgtccttgctaccagtcaggcgcaggccggctggttgcagcatgactacggtcatttatcagtatacaggaaacctaagtggaatcacttggtccacaagttcgtgatcggccacctcaagggtgcgagtgccaactggtggaaccacagacattttcagcaccacgcgaagccaaacatctttcacaaggatcccgatgtcaatatgctgcatgtctttgttttgggcgagtggcagcccatcgaatatggaaagaaaaagctgaagtatcttccctacaatcaccagcacgagtattttttcctcatcggacctcccctcctgatacccatgtatttccagtatcagatcatcatgacaatgatcgtgcacaagaattgggtagacctagcatgggccgtcagttactatataaggttctttataacatatatacccttctacggtatactgggcgccctgctgtttctgaacttcatacgatttcttgaatcccactggttcgtttgggtcacacagatgaatcacatcgttatggaaatcgaccaggaggcatatagggactggtttagctctcagctgacagccacatgcaatgtcgagcaaagcttttttaacgactggttttctggacacctcaactttcaaatagaacaccatctcttcccaactatgcctcgccacaatctgcacaagatagcccctcttgtgaagagcttgtgtgctaaacacgggatagagtaccaggagaagcccctgttgagagctcttctcgacatcataaggagtttaaagaagtcaggaaagctttggctggacgcatatcttcataaatag

SEQ ID NO: 116736 - DNA, 1335 bp, Artificial Sequence
  Description of Artificial Sequence: Synthetic coding sequence
atgggcaaaggaggaaatcagggcgaaggcgccgccgagcgggaggtgagcgtgccaactttttcatgggaagagatccagaagcacaacctgagaaccgatcgctggctcgtcattgatcgaaaggtatataatatcaccaaatggagtattcaacatcccggcggacagagggtcatcggacactacgccggtgaggacgccaccgatgctttccgagcttttcatcccgatctggagtttgtggggaagttcctcaaacctctgcttattggcgagctagcccctgaggagccttcacaagaccatggaaaaaattcgaaaataactgaggacttccgggccttacgtaaaacggccgaagatatgaatctttttaagacaaatcacgtgtttttcttattgcttctcgcccacatcatagccctggagtcaatcgcgtggtttactgtgttctactttgggaacggatggatcccgacactcattactgcattcgtcttagccaccagccaggcacaggccgggtggcttcaacacgattatggacatctgtccgtctaccgcaaaccaaagtggaaccatctcgtccacaagttcgttatcggtcacctaaagggggcatcagctaattggtggaatcacaggcactttcagcaccatgccaagcccaatatcttccataaggacccagacgtgaacatgttacacgtctttgtgctgggcgagtggcagccaatcgagtacggtaagaaaaaattgaagtacctcccctataatcatcaacatgagtatttcttccttatcgggccacccctattgattcccatgtattttcagtaccagatcattatgactatgattgtccacaaaaattgggtcgatctcgcatgggctgtatcatactatatccggttcttcattacatacatccccttttacggtatacttggtgcgcttctgtttctcaacttcataagatttctggaatcgcactggtttgtgtgggtgactcagatgaatcatattgtgatggagatcgatcaggaagcgtaccgggattggttttcgtcccagctgacagcaacttgtaatgtggaacagagcttcttcaacgactggttcagcggacacctcaacttccagattgaacatcacctttttcctaccatgccccggcataacttgcacaagatcgcacctctggttaagagcctctgcgctaagcacggaatcgagtaccaggaaaagcccttgctccgcgcattgctagacattattcgtagtctcaaaaaaagtggcaagctgtggttggacgcttatcttcacaagtag

SEQ ID NO: 116737 - DNA, 1161 bp, Artificial Sequence
  Description of Artificial Sequence: Synthetic coding sequence
atggggaaggggggaaatcagggtgaaggggcagccgaacgggaggtgtccgtgcccacattttcttgggaggaaatacagaaacacaatttaagaaccgatcgatggctggtcattgaccggaaggtctacaacatcaccaagtggtcaattcagcaccccggagggcaacgcgtgatcggacattatgcgggtgaagatgcaaccgatgcgttcagagctttccatcctgatctcgagttcgtcggcaaatttttgaagcctcttttgataggcgagctcgctcccgaggaaccatcccaagatcacggaaagaactcgaagatcacagaggatttccgggcacttcgcaagactgcagaagatatgaatctgttcaaaaccaatcatgtgttcttcctcctgctgctcgcacatataattgcgttagaaagcatcgcctggtttactgtcttctacttcggcaacgggtggataccaaccctaataaccgcttttgttttggccacatctcaggcacaagccggttggctccagcacgactacggacatctgtctgtgtaccggaaaccgaagtggaaccacctggtccacaaatttgtcattgggcatctgaagggagccagcgccaactggtggaaccaccgccattttcagcatcatgcgaaacctaacatcttccacaaagatccagacgtgaatatgcttcacgtattcgtgctgggagaatggcagccaatcgagtacggcaagaagaaactcaagtacttaccgtacaaccaccagcacgagtactttttcctgatcgggccccccctgctgatcccaatgtacttccaatatcagattattatgaccatgatagtacacaagaactgggtggatttggcctgggctgttagctactatatccggttttttattacatacatccccttttacggcatactgggggctctgctcttcctcaactttattcgatttttggagagtcactggtttgtctgggttactcagatgaatcatatcgtgatggagatcgaccaggaagcctacagggactggtttagttcacaactcaccgcaacctgtaatgtcgagcaatcttttttcaatgattggttcagtgggcatctgaactttcaaatcgaacaccagtag

SEQ ID NO: 116738 - DNA, 1338 bp, Artificial Sequence
  Description of Artificial Sequence: Synthetic coding sequence
atgggcggcgtcggggagccaggtccgagagagggacccgcacaacccggcgcccctttgcccactttttgttgggaacagatcagggcccacgaccagcccggcgataaatggctggtgatcgagagacgcgtgtacgacatctctcgctgggcacagcgtcaccctggcggttcacgcctcattgggcaccacggggccgaagatgcaactgacgcattcagggcattccatcaggacttgaacttcgtgcgcaagttcctgcaaccgctcctcatcggcgaactggcccccgaagaaccctcccaggacggaccactgaacgcccaactggtggaagacttccgggctctgcatcaagccgctgaggacatgaagcttttcgacgccagcccaacatttttcgcatttctactcggacacatactcgcaatggaggtcttagcctggttgctaatctatctgctcgggccgggttgggtgccatctgcgctggccgcattcatcctggcaatttcccaagctcaaagctggtgtttacagcacgacttggggcacgcctcaatctttaagaaatcttggtggaaccacgtggctcaaaaattcgtaatgggccaacttaaaggattctccgctcactggtggaacttccgtcactttcaacatcacgccaaacccaatattttccacaaagatccggatgtgaccgttgcgcccgttttcctccttggcgaatcatcagttgagtacggtaaaaagaagcgaaggtacctgccttataaccaacaacatctatatttctttctgatcgggcccccattgctgacgctggtcaacttcgaggtagaaaacttggcctatatgcttgtgtgcatgcagtgggccgacctactttgggccgctagtttctatgcacggttcttcttgagttacttgcccttttatggcgttccaggagtcctcctgttctttgttgcggttagggtgctcgagtcccattggttcgtatggatcactcagatgaaccatataccaaaggaaatcggtcatgagaagcacagagattgggtctctagccaactggccgctacgtgcaacgtggagcccagtctctttacaaattggttctcagggcacctgaattttcaaatagaacatcacctatttcccaggatgcctaggcacaattattctagggtggcccctctcgtcaaaagcctatgtgccaaacatggcctgtcctacgaagttaagcccttcctgacagctctcgtggatattgtccgctccttaaagaagtcaggagacatctggctggatgcctacctccaccagtag

SEQ ID NO: 116739 - DNA, 1158 bp, Artificial Sequence
  Description of Artificial Sequence: Synthetic coding sequence
atgggtggcgtcggtgaacccggaccacgggaaggccccgctcagcccggagcgccattgccaactttttgttgggagcagatccgcgcccatgatcagcctggagacaagtggctggtgatagaaaggagagtgtacgacatatccagatgggcccagcgtcaccctggcggatcaaggttgattgggcaccatggggcggaagacgccactgacgcttttcgggcctttcatcaagacctgaacttcgtccgtaagtttctgcaacctcttcttattggggaactcgcacccgaggaaccctcccaggatggtccactgaacgctcaattggtggaggacttcagagccctgcaccaggccgccgaagacatgaaacttttcgacgcatcgcctacatttttcgctttcctgctgggccacattctggccatggaagtgctggcatggctgctgatctatcttctggggccaggctgggtaccttctgctctggctgccttcattctggctatatcccaagcccagagctggtgtctgcagcacgatctcggccacgcttcaattttcaagaagagctggtggaaccacgtagcccagaaattcgtaatggggcaattaaagggcttcagcgcccactggtggaactttcgccactttcagcaccacgcaaagcctaacatattccacaaggaccccgacgtcacagttgccccagtgtttctacttggcgaatcttcagttgagtatggaaagaagaagcggcgctacttgccttacaatcagcagcatctctactttttcctcataggtcctcctctgctcacactggttaattttgaggtcgagaacctggcttacatgctcgtgtgcatgcagtgggccgatctgttgtgggcagcaagcttttatgcccgtttttttctgtcatatctgccattctacggcgtgcccggtgttctgctgtttttcgtagcagtcaggtacggacgcgaatggagaggtcatacccaggctaccggggatccccattgtagccccccacccgaattgccctttagtaggctccagaacggagcctccggcaccgcttctttggcatgctggtggaatcacattaacacatccgttgccggcgctcagggacgttgggtctag

SEQ ID NO: 116740 - DNA, 1017 bp, Artificial Sequence
  Description of Artificial Sequence: Synthetic coding sequence
atgttccaggcttttccaggagactacgatagcgggtcccgatgtagttcttccccatcagcagaatcacagtacctatcttccgtcgacagctttgggtctccccctaccgccgccgcctcccaggaatgcgccggcctgggagagatgccaggttctttcgtgcccacagtaacagccattaccacctcccaggacctgcagtggctggtacagcccactctgataagctccatggctcagagccaggggcaaccacttgctagccaaccacccgtggtggacccctacgatatgccaggtacctcatatagcactccgggcatgagcgggtattctagtggcggcgctagtgggagtggaggcccatctacctccgggacaacgagtggacccgggccggcccgccctgctagagcacgccctcggcggccaagggaggagacactgacacccgaagaggaagagaaaaggcgcgtcaggagagaaaggaacaagctggccgcagccaagtgccggaatagaagaagagagcttaccgacagactccaggccgagactgatcagcttgaggaggagaaggctgaactggaaagcgagattgccgaattacaaaaggaaaaggagcgattagaatttgtactggtggcacacaaacccgggtgcaaaatcccttacgaggagggtcccggtcccgggccgctggctgaggtgcgcgacctgcccggcagcgcccccgccaaggaggacggattctcgtggctgttgccgcctcccccaccacctcctctgcccttccagacgtcacaggacgctccaccaaacctgaccgcaagcctttttacccactccgaggtccaggtacttggagaccccttcccagtggtcaatccgtcatacacgtcctccttcgtgctcacctgccccgaagtttctgctttcgccggggcccagcggacttccggctctgaccaaccaagtgatccactgaactccccgtcactgcttgccttgtag

SEQ ID NO: 116741 - DNA, 909 bp, Artificial Sequence
  Description of Artificial Sequence: Synthetic coding sequence
atgttccaagcgttcccaggggactacgacagtgggtctagatgttctagcagtcctagcgccgagtcccagtatcttagcagtgttgactcttttgggagcccgcccaccgcggccgcatcacaggagtgcgccggcctcggagaaatgccgggttcctttgtgcctacagtgacagccattaccacatcacaggatctgcagtggcttgttcaaccaaccctaatctccagtatggcacaatcccaaggacaaccgctggcctcccagcctcccgttgtagatccttatgacatgcctggaaccagctactccactcctggtatgagtggctatagctcagggggcgcatctggatctggcggtcccagcacaagcggtaccacatctggaccgggtcccgcccgcccagctcgcgcaaggcccaggaggcctcgagaggaaacagaaactgaccagctggaggaggagaaagccgagctggaatctgaaattgccgagcttcaaaaagagaaggagcggttagaatttgtcctcgttgcacataaaccaggttgtaagattccctatgaagagggcccaggaccagggccccttgctgaggtacgtgaccttccagggagtgcaccagcaaaagaggacggattcagctggcttttgcctcccccgcccccaccccccctacccttccagactagtcaggacgctccacctaatctaaccgcatctctgtttacgcatagtgaagtacaggtgctcggggatccctttccagtcgtcaatccgtcttataccagctcctttgtattgacatgccccgaggtgtcggcctttgccggcgctcagcgcacttctgggtcggatcaaccatccgacccgctgaacagcccatctctccttgccttatag

SEQ ID NO: 116742 - DNA, 588 bp, Artificial Sequence
  Description of Artificial Sequence: Synthetic coding sequence
atgtttcaggcatttcccggagactacgactccggctcacggtgctccagctctccatccgccgaatctcaatacctcagcagcgtggactcttttggctcccctcctaccgctgccgcgtcacaagaaacagaccagcttgaggaagaaaaagcagaactggaaagtgagatcgccgagctccaaaaagaaaaggagcggctggaattcgtcctggtggcccacaagcctggttgtaaaattccatatgaggagggacccgggccaggccccctggcagaggtgagagatctgcccggcagcgctcctgcaaaggaggacggatttagttggcttctgcccccacctccaccaccaccactgcccttccagaccagccaggacgcccctcctaacctaaccgcctctctttttacccattcagaagtgcaggtgttaggcgaccctttccctgtggtaaaccccagctatacttcttctttcgtgctaacatgtcccgaagtgtctgccttcgccggagcacagaggactagcggatcagaccagccgagcgatcccctgaattctccgtctttactggcactgtag

SEQ ID NO: 116743 - DNA, 876 bp, Artificial Sequence
  Description of Artificial Sequence: Synthetic coding sequence
atgttccaggcctttcctggcgactacgatagtggttcaaggtgttctagctccccttcagcggagtcccagtacctgtccagcgttgattctttcgggtctccaccgacagcagctgcttcccaagaatgcgctggacttggcgagatgccagggtcatttgtgcctactgttaccgccataactacttcacaggatcttcagtggcttgttcagcctactcttatcagttctatggcgcagtctcagggtcaacccctcgcctcgcagccacccgtggtggatccctatgacatgccggggactagctattccacccccggaatgtccggttactcgtccggtggagcgtcaggctctgggggaccaagcacctcaggaactacttctggccccgggcctgcccgtccggctagagcccggcccaggagacccagggaggaaaccctgactcctgaagaggaagagaagaggcgcgtgcgacgagagcgaaacaaattggccgccgctaagtgcagaaacagacggagggagctaactgatcgccttcaggcagagacagaccagctggaagaagaaaaagcagagctggaatccgaaattgctgaactgcagaaagagaaggaacggctggaattcgtgctcgtagcacataaacctggttgtaaaattccctacgaggagggccctggccccggcccgctagctgaggaagtgcaggttctgggggatcccttccctgtggtgaacccaagctacaccagctcctttgtgcttacttgtcctgaagtgagcgcctttgctggcgctcagcgaactagcggttccgatcaaccctctgatcctctgaattcccccagcttgctcgccctatag

SEQ ID NO: 116744 - DNA, 912 bp, Artificial Sequence
  Description of Artificial Sequence: Synthetic coding sequence
atgagtgacaatggcgtgtgtgttctggcatttaagtgtccaggtctgctgcgttatacagcatatcgatgtaagcagctgtcagatacgtcaataattgcggtagcctctcattgcccactgctgcagaaagtccacgtgggcaatcaggacaagctgaccgatgaaggcctgaagcagttaggctcaaaatgcagggagctgaaggatatacactttggacagtgctacaagatctccgatgaagggatgatcgtgatcgctaaaggttgcctgaagctccagcgcatctatatgcaggagaataagctcgtcaccgaccagagtgttaaggcttttgctgaacactgtcccgaactgcaatatgtaggttttatgggttgctctgttacttccaaaggcgtcattcatttgacaaaactgcgtaatttgtcctccctagacctgcgccacatcacagaactggataatgaaactgtcatggagatcgtgaaacggtgtaagaatctttcctcattaaatctctgcttgaactggattatcaatgacaggtgcgttgaggttattgccaaggagggacagaacttaaaggaactgtacctggtctcttgcaagatcaccgattatgcacttatcgccatcggccgatactccatgaccattgagaccgttgacgtcgggtggtgtaaagaaatcaccgaccagggtgccacactgatcgcccagagctccaagtcattgagatacctaggacttatgcgatgtgacaaagtgaatgaggtgacagtcgagcagctggtgcagcagtatccacacataacattcagtaccgtcctgcaggactgtaaaagaacgttggaacgagcttatcagatgggctggaccccgaatatgtctgccgccagttcatag

SEQ ID NO: 116745 - DNA, 945 bp, Artificial Sequence
  Description of Artificial Sequence: Synthetic coding sequence
atgtcagacaatggggtgtgtgtgttggcctttaaatgtcctggtctgctgaggtatactgcatatcgatgcaaacagctgtctgacaccagtattatcgctgttgcatcccattgccctttactgcagaaggtacacgttgggaaccaggataagcttaccgatgaagggctcaaacaactcggctccaaatgtcgggaattaaaggacatccattttggccagtgctataagatctccgatgaggggatgatagtgattgctaaggggtgtctgaagctgcagcggatatatatgcaggagaacaaactggtgacggatcagtccgtgaaggctttcgcagagcactgccccgaactccagtacgtgggattcatgggttgtagcgttacgtcaaagggggttattcatctcacaaagctgcggaacttgtcgtcgctcgacctccggcacatcactgagctggataacgagacagtcatggaaatcgtgaagagatgtaagaacctcagtagcctcaacctgtgcttgaactggattattaatgaccgctgtgtcgaggttattgctaaagaaggccagaatctgaaggagctttaccttgtgagctgtaaaattacagattatgcccttatcgctattggcaggtattctatgacgatagagacagttgatgtgggttggtgcaaggaaatcactgaccagggcgccacactcattgcgcaatctagtaaatctctgagatatctggggctgatgcggtgcgacaaagttagggtcgattatcaggtggtctgctttctacacattagcattgttaattcactaatgagttaccctcttagcttctcaatttcaacccctgtgtactacattttatacatccacttcatctgcatatacgcgattatagccatgcattgccttcctgcttttgtgaactag

SEQ ID NO: 116746 - DNA, 2106 bp, Artificial Sequence
  Description of Artificial Sequence: Synthetic coding sequence
atgggccatttgctgagcaaggagccgagaaatagaccctcccagaagcgtccgagatgctgttcctggtgcaggcggaggcgccctctgcttaggttgccccgcagaactccagccaaggttccacctcagcccgccgcccctagatctagggactgcttttttcgaggcccgtgtatgctctgcttcatagtgcactctcccggcgcgcctgctcctgcaggccctgaagaagagcccccattgagtccacccccccgagatggcgcttacgccgctgcctcttccagccagcacctcgccaggcggtacgccgccctagccgcagaagattgcgcggctgctgcgcggaggttcctccttagtagcgcagcagccgccgctgccgctgcagctagtgccagctcccctgctagctgctgcaaggaactggggctcgccgctgccgcagcatgggaacagcagggtcgcagcctctttctcgcaagtctagggcctgtgcgatttctaggacctcctgcagccgtccagttatttagaggccccacaccttctcctgcggaactaccaaccccccctgagatggtgtgtaaaaggaaaggggctggggttccagcctgtactccctgcaaacagccccggtgcggtggcggcggttgcgggggcggaggaggaggaggaggtggtggcggcccagcggggggaggagcatctcctccaaggccgcccgacgctggctgttgccaggcgcctgaacagccacctcagcccctttgcccacccccatcatcccctactagtgagggggcccctactgaggctggcggcgatgcagtgcgggcaggcgggacagcaccactgagcgcccagcaacagcacgagtgcggagacgcagattgtagggaaagcccagagaatccttgcgattgccatcgggagcctccacctgagacccccgacatcaatcagctcccccccagtatactgttaaagatcttttccaacctgagtctggatgagcgctgcttgagtgcgtccctggtgtgtaaatactggcgggatctgtgtcttgattttcagttttggaagcaactcgatttgtcgtcaaggcaacaggtgaccgatgagcttctcgaaaaaatcgccagtcgctctcagaacataattgaaataaatatcagcgactgccgcagtatgtctgacaatggggtctgtgttttagcctttaagtgcccaggtctgcttaggtacactgcctaccgctgtaaacaactcagcgacactagcatcattgctgtcgctagtcattgtcccttgcttcaaaaggtacacgttgggaaccaggacaaattaaccgacgaaggcctcaagcagctgggcagcaaatgccgggaattaaaagacatccatttcggacagtgctataaaatcagtgatgaaggaatgatagtaattgcaaaaggctgcctgaagctccagcgtatctacatgcaggagaacaagcttgttacagaccagtctgtaaaggcattcgccgagcactgcccagagctgcagtatgtggggttcatgggatgctctgtcacctctaagggcgtgatccacctgaccaaactccgaaatctgagtagcctcgatctgagacatatcaccgagctcgacaacgagacagtgatggagatcgtgaaaagatgcaaaaatctgtcgtccctaaacttatgtctgaattggattataaatgatcggtgcgtcgaagttatcgcgaaggagggtcagaatctgaaggagctttaccttgttagctgcaagatcacagactacgccctgattgcaataggccggtactccatgacaatcgaaaccgtggatgtaggttggtgcaaggaaatcaccgaccagggtgcaaccttgatagcccagtcttctaaatcattacgctacctgggcctgatgcgttgcgacaaggtgaatgaagtgacggttgagcagctggttcagcagtatcctcacatcacattttctaccgtactacaggattgtaagcggacactcgaacgagcataccagatgggttggacacccaatatgtctgccgctagctcatag

SEQ ID NO: 116747 - DNA, 2025 bp, Artificial Sequence
  Description of Artificial Sequence: Synthetic coding sequence
atgtcgtcttcaagtcgaggccccggcgccggggcaaggcggcgcagaactcgttgcagacgctgtcgcgcatgcgtgaggactgagtgcggcgattgccacttttgcagggacatgaagaagtttggcggtccaggccgcatgaaacaaagttgcttgttgagacagtgcactgcgccagttcttcctcacaccgcagtttgtttactgtgtggcgaggcgggcaaggaggacactgttgaaggagaggaggaaaaattcggcctgtcactgatggagtgtactatctgcaacgagattgtgcatccaggctgcctcaagatggggaaagccgagggggtaattaatgctgagatacccaactgctgggaatgtccccggtgtacccaggagggaagaactagtaaggattccggagagggtccgggtagacgcagagcagataatggagaagagggtgcctctcttgggtcgggttggaaactcaccgaagaacctccacttcctccacctccgccaagacggaaaggccccctgccagctggacccccaccagaggacgtgcctggtccacccaagagaaaggaacgcgaagccggcaacgagcctcccacaccccgcaaaaaggtgaagggcgggcgtgaaaggcacctcaagaaggtggggggggatgcttgcctactcagggggtctgacccaggcggacccggattgctgccaccccgcgttctcaacccgtcacaggccttttcctcttgccaccccggactgcctccggagaactgggagaaacccaaaccaccactcgcatccgccgagggccccgcagtgcctagcccttccccccagcgcgagaaattggaacggtttaaaagaatgtgtcagctcctggaaagagttcccgacactagcagctcaagctcagactcagacagcgactccgattccagcggcacttccctgtctgaagatgaggccccgggggaagccaggaacgggcggaggcctgcccggggaagcagtggggagaaggagaaccgtggtggcagacgcgcggttaggcctgggagtggagggccccttttatcctggccactcggccccgcacctccaccacggccacctcagctggagcggcatgtggttcgccccccaccgcgtagccctgagccggacactctgcctctggctgctggctccgaccatcccctgcctagagctgcatggcttcgggtgttccagcatctgggacccagggaactgtgtatctgtatgcgcgtttgtaggacctggtctcggtggtgctacgacaagcgactctggcctagaatggacctctcgcggcgcaagtccctgacgccgcccatgctgagtggcgtcgtgcggcggcagccacgggctctggatctttcgtggactggagtttccaaaaagcagttgatgtggctcctcaatcggttgcaaggcttgcaggaattagtcctcagcggttgctcgtggcttagcgtcagcgccctgggatccgcacctctaccagcactccgcctcctggacctgcggtggattgaagatgttaaagactcacaacttcgagaactcctgcttcctcctcccgacaccaaacccggccaaacggaatcacggggcagactccaaggagtcgcagagcttcggctcgccgggctcgaacttactgatgccagcctgcggctactgttgcgccatgccccccaactttctgccctggacctatcccattgtgcacacgttggcgacccatctgtacatcttctgaccgctcctactagcccgctgagagaaacactcgtgcatttaaatttggcaggctgccatagattgaccgaccactgcttacccctgttccggcggtgtcctcgcctgcgtcgccttgacctgcgctcttgtcgccagttaagtcccgaggcatgcgcaaggctcgccgccgcaggcccacctggtccctttcgctgtcccgaggaaaagttgcttttgaaggacagttag

SEQ ID NO: 116748 - DNA, 2085 bp, Artificial Sequence
  Description of Artificial Sequence: Synthetic coding sequence
atgggtatgaaagttccgggaaaaggggaatccgggccctcggctttactaacgccccctatgtcttccagctccaggggccccggggcaggagcacgcaggaggagaacccgctgcagaagatgccgggcctgtgttagaacagaatgtggggactgccacttttgcagagacatgaaaaagttcggcggacccggccgcatgaagcaatcctgtctcctgcggcagtgcaccgcccctgttctgcctcacacagcggtatgcctactgtgtggagaggccggaaaagaggataccgtggagggtgaagaagagaagtttggcttatctttaatggagtgcaccatctgcaatgagatcgttcatccaggatgtctcaagatgggaaaggcggagggggtgatcaacgccgagatcccaaattgttgggagtgcccccgctgtactcaggagggccggacaagcaaggacagtggggagggaccaggacgcagacgtgctgacaacggagaggaaggggccagtcttggttctggctggaagctaacggaagagccccctttgcccccacctccacctcgacggaaaggacccttgcccgcaggtcccccgcctgaggacgtgcctggaccgccaaaacggaaggagcgggaagctggcaatgaacccccaacccccagaaagaaggtgaaagggggtagagaacggcacctgaagaaggtgggtggtgacgcatgtctgctccgcggtagtgatcccggtggccccggcctgttgcctcctagagtgcttaatccctctcaggcattttcttcctgccatcccggcctgcctccagaaaattgggagaagccaaagcccccactggccagcgccgagggtcccgccgtgccttcaccatccccacagcgagaaaaactggagcgttttaagcgtatgtgccagttattggaacgggtgccggataccagtagctcatcatccgatagcgattcagatagcgacagttccggaacatccctctctgaggacgaagctcctggcgaggcaagaaacggcagacgtcctgccagaggatcttcaggagaaaaagaaaaccgcgggggcagacgggcagtgaggcccgggagtgggggaccgcttctcagctggccactgggccctgcccctcctccccggccccctcagctggagcgccacgtggttaggccccccccacgctcccccgagcctgacactctccctctggccgcaggatctgaccaccctctccctagagcagcatggctgcgggtattccaacacttaggccctcgagagctttgcatctgtatgcgagtttgtcggacctggtctaggtggtgttatgacaagcgcctctggcctagaatggacctgtctcgaaggaagagtctgacgcctcccatgttatcaggggtcgtccgtcgccaaccaagagcacttgacctgtcatggaccggggtatcaaagaagcagctgatgtggctcctgaaccgcctgcagggccttcaggaactggtgctgtctggttgttcttggctttccgtgtccgcgctcgggagcgctccgttgccggccttgcgcctgctggacctgcggtggatcgaagacgtgaaagacagccagttgcgcgagctgcttctgcctcccccagatacaaagccaggacagactgaatctagagggcggctgcaaggcgtcgctgaattgcgccttgccgggcttgagctgactgatgcctctctgcgcctgctgttacgccatgccccgcagctttccgccttggatctgtcgcactgtgcccacgtgggcgatccatccgtgcatctcctgaccgccccaaccagccccttgagggaaactctagtgcatctgaacttggccggatgtcaccgactcaccgatcactgtctccccctcttccgtaggtgcccacgcctgcgcagactggacctgaggtcttgtcgtcagctatcccccgaagcctgtgctcggctggcagctgcagggccgcccggtccattccggtgtccggaagagaaactcctgctcaaggactcctag

SEQ ID NO: 116749 - DNA, 1761 bp, Artificial Sequence
  Description of Artificial Sequence: Synthetic coding sequence
taaagaatgaagcagtcctgtctgttgcgccaatgtacagctcccgtgctgcctcacacggctgtctgtctcctatgcggtgaagccgggaaggaagatacagtagagggcgaagaagagaaatttggcctttccctgatggaatgcaccatctgcaacgagatcgtgcatccagggtgcctcaagatgggtaaggctgaaggggtaataaacgccgagatccccaattgctgggagtgtcctagatgcacccaggaaggaaggaccagcaaagatagcggagagggaccaggaaggagacgggccgacaacggggaggaaggtgctagccttggcagcggctggaagcttacggaagagccaccgctccctcctccaccccctagacgcaagggcccgctcccggccgggcccccccctgaggacgtcccaggcccacctaaacggaaagaacgagaagctggcaacgagcctcctaccccacgcaagaaggtgaagggagggagagagaggcatctgaagaaaaagccaaaacctcctctggcaagcgccgagggccctgccgttccctcgcccagtccacagcgcgaaaagctggagcgattcaaaaggatgtgtcaactgctggagcgagttcctgacaccagctcaagctcttcggactccgactcggatagtgatagctcaggcacttccctctcggaggacgaagcccctggggaggcccgaaacgggcggcgcccagcacgtggtagcagcggagagaaggagaatagagggggtcgcagagcagtgcgccccggctctggaggtccactcctgtcttggccactggggcctgccccgccgcccagaccaccccaactggaacgtcacgtcgtccggcccccccctcgatcccctgaaccagacacccttccattggctgctggctcagatcatccactcccccgagctgcctggctacgggtttttcagcacctaggtccgcgcgaactgtgcatctgtatgcgcgtctgtcgcacttggtcccgatggtgctacgacaagcgcctatggccgaggatggacctctcacgtaggaagtcattaacaccacctatgctctccggagtggtaagaaggcagcctcgagctttggacttgagctggaccggagtttccaaaaaacagctgatgtggctcctgaaccgcctccaggggctacaggagttggtgctttctggatgttcctggctttccgttagcgccttagggtcagcacccttaccagccctacggctgctggacctcagatggattgaagacgtgaaagacagtcagttgcgcgagctgctgctcccaccgcccgacacaaaaccagggcagaccgaaagtagagggcgcctgcagggagttgcggagctccgcctagctggcttggaactgaccgacgcttccctgcgccttctgctgcggcacgcacctcagctttctgctctggacctgagccactgcgcacacgtcggcgaccccagtgttcacctgctgaccgcgcccacctcccccttgagagagactctggtccacctcaatctggccggctgccaccgcctcaccgaccactgtctgcccctgttccggagatgtcctaggttgcgaagattggatctaagatcatgtcgccagttatcccccgaagcatgcgcacgtttggctgctgcggggcctcctgggccatttcgctgcccggaggagaaactgctgctgaaagactcttag

SEQ ID NO: 116750 - DNA, 495 bp, Artificial Sequence
  Description of Artificial Sequence: Synthetic coding sequence
atggatctggaggaatgcatcctgattaccgattccaccctaatccagctgtcgattcattgccctaaactccaggctctggtttccttaagcttcagcgacatcattcacttactgaaaatgaaggagccaagccatcacaacaagaagctctttggctttagtttttgcaagtcactgtcccactgcgagcttattactgacgatgggatccttcacttatctaactctacctgtgggcacgaaagacttagagtgctggaactggacaactgtcttctcattactgatgtggcgctggagcatcttgagaactgccgcgggttagagcgacttgaactctacgattgtcagcaggtgactagggcaggcatcaaaaggatgcgtgcacaactcccccatgtgaaagttcacgcatattttgcccctgtaacgcccccgaccgccgtggccggcagcggccagcgcctctgtaggtgttgcgtgatcttgtag

SEQ ID NO: 116751 - DNA, 1272 bp, Artificial Sequence
  Description of Artificial Sequence: Synthetic coding sequence
atggtcttttccaacaacgacgagggtctaatcaacaagaaactccctaaggaactccttctgagaatcttctcatttctggatatcgtaaccctttgtaggtgcgcccagatatctaaggcatggaatattctggccttagacgggagcaactggcaacgcatcgacctgtttaattttcagacagacgtggaaggtcgtgtcgtggaaaacatcagcaaaaggtgcggaggtttcctgagaaagcttagcctgcgaggttgtatcggcgtgggagatagctctttaaaaacctttgcccagaattgtcgtaacattgaacatctgaacttgaatggatgtacgaaaatcaccgacagcacctgttatagcttgtcacgattttgtagcaagcttaagcacctcgacctgacctcttgtgtatccatcacaaactcctcgctgaagggtatatcagagggttgccggaatcttgaataccttaatctgagctggtgcgaccaaattactaaggatggcattgaggctctggtcagggggtgcagaggtctgaaggccctcctgcttcgaggatgtacccagctagaagatgaagccctaaagcacatccaaaattactgtcacgagctcgttagtctcaatctgcaatcgtgctcacggatcactgatgagggggtggtgcagatctgccgcggctgccatcgcctccaagcactgtgcctctccggttgttctaatctgacggatgcctcactgaccgcgctggggctgaattgccctcggctgcaaatcctggaagcagcccgatgctctcacttgactgatgctgggtttacactgttagccaggaactgtcacgaactcgaaaagatggacctggaggagtgtatcttaataaccgatagcacactgatacagttgtcaatccactgccccaaactgcaagcgcttagtcttagtcattgcgagctcattaccgacgatggtatcctgcatcttagcaactcaacttgtggccacgaacggctcagagtgctggaacttgataattgtctcctcatcaccgatgtagcgttggagcacctcgagaattgtaggggcctggaaaggttggagctctatgactgccaacaggtgacgagagccgggattaaaagaatgcgagctcagttaccccacgtcaaagtgcacgcatattttgctcctgtgaccccgcccacggctgtagccgggtccggacagcgactgtgtagatgttgcgtgatcttgtag

SEQ ID NO: 116752 - DNA, 1020 bp, Artificial Sequence
  Description of Artificial Sequence: Synthetic coding sequence
atgtacattgccttggtgtggatcttgtttgtgatgtggacatttgcccagaattgtagaaatatcgagcatctgaatctaaacgggtgtaccaaaattacagactctacatgttacagtctgtcccgcttttgttccaaattgaagcatctggatctcactagttgcgtgtccataaccaactcttcactgaaaggcatttccgagggttgtaggaatctggagtacctcaacttgtcttggtgtgaccagattacaaaagacggaatcgaggccctggttcggggctgtagagggctgaaggcattgttacttcggggctgcactcagctggaggatgaggctctgaaacacatccaaaactattgtcacgaactcgtgtcattgaatctgcagtcatgttctcggatcacagatgagggggtggtccagatctgtcgggggtgccacaggctgcaggcactgtgcctaagcgggtgtagtaatctgacagacgcatcactgacggcactcggcctgaactgtccgcgcctccagattttagaggccgcgaggtgttcgcacttgactgatgcaggcttcacccttctggcgagaaactgtcatgaactggaaaagatggatctcgaggaatgcatcctaattaccgacagcactttgattcagctgtccattcactgtccaaagctgcaggctctgagcctatcccattgcgaacttattaccgacgatggcatcctacaccttagcaattcaacatgcggccacgaacgtctcagggtactggagctggacaactgtctcttgattaccgacgtggctctggagcatttggaaaactgcaggggcctggaacgcttagagctttatgactgccaacaagtgaccagggccggaatcaagcggatgagggcacagctgcctcacgttaaggtccatgcctactttgccccggtgacgcctcccaccgctgtggcgggctccggccagcggctctgccgctgttgcgtaatactctag

SEQ ID NO: 116753 - DNA, 1068 bp, Artificial Sequence
  Description of Artificial Sequence: Synthetic coding sequence
atggtcttctccaacaatgacgagggcctgataaataagaagctgccaaaggagttgctgctgaggatattttcgttcctcgatattgtgacgctgtgtcgttgtgcacagatttccaaagcatggaacatattagcactggacgggagtaactggcagagaatcgacctgtttaatttccagacagatgtagaaggaagggttgtggagaatattagcaagagatgtgggggattcctaaggaagctgtcccttagaggatgcatcggtgttggcgactcttctctgaagaccttcgcgcaaaactgtaggaatattgagcacctaaatctgaatggctgtacgaagatcaccgactctacctgttatagtctttctcgcttttgttccaagttaaagcatatccagaattactgtcatgaattagtgagtctaaacctgcagagttgttcccggattacagatgaaggcgttgtgcagatctgccgggggtgtcaccgcctgcaggccctgtgtctgtccgggtgctctaatctgactgatgccagcctcacagcacttggcctgaattgcccacggctgcagatcctggaagccgccaggtgcagtcatctgactgacgctggattcacccttctggcacgcaattgccatgaactggaaaagatggatctggaggagtgcattcttatcacagattcaactctgatccaattgtcaatccattgccccaaactgcaagcactgtctttgtcacattgtgaacttatcacagacgatggaatactgcacctctcaaactcgacatgtggccacgagcgattaagggtgctagagctcgataactgcttgctgataacggatgtggccctggagcacctggaaaactgtcgagggcttgagcgcttggagctctatgattgtcagcaagtaaccagggcgggcataaagagaatgcgggctcagctacctcatgtgaaggtccatgcctattttgcacctgttacccctcccactgccgtggccggatcagggcagagattgtgtagatgctgcgtgatcctgtag

SEQ ID NO: 116754 - DNA, 402 bp, Artificial Sequence
  Description of Artificial Sequence: Synthetic coding sequence
atggacttggaggaatgtatattaattacggactccaccctcatccagctgagcatccactgtcccaagctccaggctttatcactaagccactgcgagctgataacagacgacggaattctgcatctcagcaacagcacctgcggccacgaacggttaagggtccttgaattggataactgtctgctcataaccgatgttgcccttgagcacctggagaattgtcgggggcttgaacgattggaactgtacgattgtcagcaggtgacaagagctggcatcaaacggatgcgtgctcagctgccacacgtaaaagtccacgcatactttgcgccggtgacacctccgacagctgtggcaggcagtggtcaacggctgtgccgctgttgtgtcatcctgtag

SEQ ID NO: 116755 - DNA, 1068 bp, Artificial Sequence
  Description of Artificial Sequence: Synthetic coding sequence
atggtcttcagcaataacgatgagggcctgattaataagaaactgcctaaagagctgctcctacgtatcttcagcttcctggacatcgttacgctgtgccggtgcgcgcaaatatcaaaagcttggaacatccttgctctggatggctccaactggcagcgcatagacctatttaatttccagacggacgtcgagggcagagtcgtagagaacatctcaaagcgctgcggaggatttctcaggaagttgtctctgagaggctgtattggggttggagacagcagcctgaaaacattcgcccagaactgtcggaacattgagcatctcaacctgaacggatgcacgaaaattacagatagtacatgctatagcctgagccggttctgttctaagctcaagcatatccagaactactgccacgagctcgtgagtctcaacctgcagagttgtagtcggatcactgatgagggcgtggtgcaaatctgtcgcgggtgccataggctgcaggcactatgcctgagcggctgctccaatttgacggacgcttccctgaccgccctggggttgaattgcccgcggctccagatactggaagctgcccgctgttcccacctgaccgatgcagggttcacgcttctggcccggaactgccacgaacttgaaaaaatggatctggaagagtgtatacttattactgatagtacgctgatccagctgtccatccattgcccaaagctccaggccttgtctctgagccactgcgagctgatcacagacgacggaatcctgcacttgtctaattctacttgcggtcacgagaggctgcgggtcctggagcttgacaattgtctgctcatcacagatgttgctctggagcatttggagaactgcagaggcctcgagaggctggaactttacgactgtcaacaggtgactcgagccggcattaagcggatgcgggctcagctaccacatgtcaaagtgcacgcgtactttgctcctgtcacaccccccaccgccgttgcagggtctggtcagcgcctttgtcggtgttgcgtgatcctctag

SEQ ID NO: 116756 - DNA, 1260 bp, Artificial Sequence
  Description of Artificial Sequence: Synthetic coding sequence
atggtattctccgctgtactaacagcctttcacacgggcacttccaacacgaccttcgtggtctatgagaatacgtatatgaacattactctgccacctccttttcagcatcctgacctgtcacccctgctgcgatattcatttgagacaatggcccctacaggcctgagttccttgaccgttaactctacagccgtccccactacgccagctgccttcaagagcttaaatctgccactgcagataaccctgtccgcaattatgatatttattctgtttgtaagcttcttagggaatctggtcgtgtgcctgatggtgtaccagaaggctgctatgaggagtgcaatcaatatactgcttgcctctttggcgttcgccgacatgttgctagccgtattaaacatgccattcgcactcgtcaccatcctgactaccagatggattttcggtaaatttttttgcagagtaagcgccatgtttttttggctgttcgtcatcgagggtgtggccatccttttgatcatttctattgatagatttctgataattgtccagcgccaggataaactgaacccctaccgggctaaggtgctaatcgctgtgagctgggccacgagcttctgtgtagccttcccactagccgttgggaacccagatttgcagattcctagtcgagccccccagtgtgtattcgggtacaccacaaatccaggctatcaagcttacgtgatcctgatttcccttatctcattttttattccattcctcgtgatcctatatagctttatgggcatcctgaacactttacgccacaatgccctccggatccactcctatccagagggaatctgtctctctcaggcatcaaagctcgggctgatgagtctccagcgcccattccaaatgtctatcgatatgggcttcaaaactcgcgctttcactaccattctcattctctttgccgtgttcattgtgtgttgggccccctttaccacatacagtctcgtcgcaacgtttagcaagcacttttattatcagcacaattttttcgagatcagtacctggctactgtggttgtgctacttgaagtctgcattaaaccccctaatttactattggcggatcaaaaaattccacgatgcgtgcttagacatgatgcccaagtcctttaagtttcttccccagctgccaggccatactaaacggcgcatccgaccatccgccgtgtatgtttgcggggagcaccgaaccgtcgtctag

SEQ ID NO: 116757 - DNA, 1866 bp, Artificial Sequence
  Description of Artificial Sequence: Synthetic coding sequence
atgtcacccgtgttcccaatgctcacggtgctgacaatgttctactacatctgtctcaggagaagggctcgaacagccacacggggagaaatgatgaatactcaccgagctattgagtccaacagccagacctcacctcttaatgctgaggtggtccaatatgccaaggaggtggtggacttcagtagccactacgggtctgaaaactctatgagttataccatgtggaatctggcaggcgtccccaacgtgttcccttcctctggagattttacacaaacagccgtgttcagaacctacggcacctggtgggaccagtgccccagtgccagcctgcctttcaagcggacgccgcccaacttccaaagccaggactacgtggagctcacgttcgagcagcaagtgtaccccactgccgtccatgtgttggaaacgtatcacccgggtgctgttatcagaatactggcgtgttctgctaatccctattctccaaatcccccggctgaggtgcgatgggaaatcctctggagcgaacgaccaacaaaggttaatgcctcccaggcacgccagtttaaaccatgtattaaacaaatcaatttcccgacaaatcttatccggcttgaagttaattctagcttgcttgagtactacacagagcttgacgcagtggtgttacacggcgtgaaagataagccggttctgtccctgaaaaccagcttgatagacatgaatgacatagaggatgacgcatacgccgagaaagatggttgcgggatggactctcttaataaaaagttcagctctgcagtgctcggcgaaggcccaaacaacgggtacttcgacaagctgccttacgaactgatccagctcatcctcaaccacctaacgctccctgacctgtgtcgcctcgctcagacctgcaagctgctcagtcagcattgctgtgatccattacagtacatccatctcaatctgcagccttactgggctaagctggacgacacttccctggagtttctccagagcaggtgtactttggtgcaatggctgaatttgagctggaccgggaaccgtggtttcatttccgtagcaggattttcgcggtttctgaaagtgtgcgggtctgaactggtacgattagagctttcatgctcccatttcctaaatgaaacctgtcttgaggtgatctcagaaatgtgtcccaatctccaagccctgaacctgtcatcttgtgataagcttcccccacaggcttttaatcacatcgccaagctgtgcagtctaaagaggctagtactgtatcggaccaaggtggagcaaacagcattactgtctatcctaaacttttgtagcgagctgcaacacctgagccttgggagctgcgtgatgatagaggactacgacgtgatcgcctctatgattggtgccaagtgtaagaagctccggaccctggacctctggcgctgcaagaatattacagaaaatggtatcgcggaactggcgtctgggtgccccctcctggaagagctcgacctggggtggtgcccaaccctacagtcctcgaccggctgttttaccaggctggctcatcagctccccaatctgcagaaactgttcctaacggccaaccgttccgtttgcgacactgatatcgacgaactcgcctgcaattgcacgaggttacagcagctggacatcttgggaaccaggatggtcagtccagcttccttacgcaaactgctggagagctgtaaggacctatcccttcttgacgtttccttctgctcccagattgataatcgggctgttttggagctcaatgcaagtttccctaaggtctttatcaaaaagagcttcacacagtag

SEQ ID NO: 116758 - DNA, 2076 bp, Artificial Sequence
  Description of Artificial Sequence: Synthetic coding sequence
atggccccctttcccgaagaagttgatgtgttcaccgctcctcactggcggatgaaacagctggttggactatactgtgacaaactatccaaaactaatttttccaacaataacgacttcagggccctcctgcaatcattgtacgccacatttaaagagtttaagatgcacgagcagatcgaaaatgagtatatcattgggctgctgcagcaacggagtcagacgatttacaacgttcatagtgacaacaaactttcagagatgttgtctttattcgagaaaggtcttaaaaacgtgaaaaatgaatatgagcagctgaattacgccaagcaactcaaagaaaggctggaagcttttaccagagacttcctgccgcacatgaaagaggaggaggaagtgtttcaacccatgcttatggaatactttacttacgaagagctaaaagatatcaaaaagaaagtgatcgcacagcactgtagccaaaaggatacggctgagcttctgcgcggtctgagcttgtggaaccacgccgaggagcgccagaagtttttcaaatactcagtggatgaaaagtctgataaagaggccgaggttagcgagcacagcacggggattacgcatttgcctccagaagtgatgttatcaattttttcttatctgaacccccaggagttgtgtaggtgttcacaggtcagtatgaaatggtcacagctcactaaaactggctcactatggaagcatctataccctgttcattgggctaggggtgactggtactccgggcctgccaccgagctggacaccgagcccgatgatgaatgggtgaagaacaggaaggatgagtctcgtgcattccacgagtgggatgaggatgcagacatcgatgagtcagaggagagtgctgaggaaagcattgccattagtattgctcagatggaaaaacgcctactgcacgggctgatacacaatgtgctgccctacgtcggtacctcagtgaagacgttggtcttggcttacagcagcgcggtgtccagcaagatggtacgccagattcttgaactttgtcctaacctagaacatctggacctgacccagacggatatcagcgacagcgccttcgactcttggtcctggcttggctgctgccagagcttacggcatttagatttgtcgggctgcgagaaaattaccgatgtggctctggaaaagattagtagggcccttggcatcctcacgagtcatcagtcagggttcttaaagaccagcactagcaagatcacctccactgcttggaagaacaaagatatcacgatgcagagcaccaagcaatacgcctgccttcacgacctgaccaataagggcattggtgaggagattgataatgaacatccatggaccaagcccgtgagttccgagaatttcaccagtccctacgtctggatgttagacgccgaagacctggccgatatcgaggacacggtggagtggcgacaccgaaatgtcgagtcattgtgtgtgatggagactgcttctaatttctcatgttcaacttcaggctgttttagcaaagatattgtgggcctgcgcaccagtgtgtgttggcagcagcactgtgcaagcccagctttcgcgtactgcggacattccttctgctgtacaggaacggccctgcggacaatgagctccctgcctgagtccagtgcaatgtgcaggaaagccgccaggaccaggcttccacgaggaaaggacctgatttacttcgggagtgagaagtccgatcaggaaaccggcagggttctcttgttccttagcttgagtggctgctatcagattacggaccacggattacgagtgttaacccttggcggtggcctgccttacctcgagcacctgaacctgtcaggatgcctgactatcactggcgccggtctgcaggacctcgtatccgcttgcccatccctgaacgacgaatatttctattattgcgacaacatcaacggaccccatgctgataccgcatctggatgtcagaatctgcaatgcgggttcagggcctgttgccgcagtggcgaatag

SEQ ID NO: 116759 - DNA, 1698 bp, Artificial Sequence
  Description of Artificial Sequence: Synthetic coding sequence
atgaaggaggaagaggaggtcttccagcccatgcttatggaatactttacttacgaggaattaaaggacatcaaaaaaaaggtgatagcccagcattgctcacagaaagacacagctgagctgctgcggggactgtcattgtggaatcacgctgaggaacgccaaaagttcttcaaatattccgtcgacgaaaagagcgataaagaggctgaggtatctgagcacagcactgggataacccaccttccacccgaggttatgttatcaatctttagctacctcaacccccaggagctgtgcagatgttctcaagtgtccatgaaatggagccagctgaccaagactgggagcctctggaaacatctctaccctgtgcattgggcccgtggggactggtactccgggccagccaccgagctcgatactgaaccagatgacgaatgggtcaaaaaccgcaaggatgagtctagagcatttcacgagtgggatgaagatgcggacatagatgaatccgaggagagtgctgaggagtcaatagccatctcgatagcccaaatggagaaacgtcttctgcatggactgatacacaatgtgttaccttacgtggggacgtctgtgaagaccctcgttctggcctactcctcggcagtatctagcaaaatggtaaggcagattctggaactttgccccaacttggagcacctggacctcacacagacagacataagcgactctgcattcgattcctggtcatggcttggatgctgtcagagcctcagacacttagacctgtcagggtgcgaaaagattacagatgtcgcgttggagaaaatttctagagccttgggtattctgacttcccatcagtctggctttttgaagactagcacctctaagattacaagcactgcttggaagaacaaggatattaccatgcaatcaacaaagcagtatgcttgccttcatgatttgacaaataaaggcataggcgaagagatagacaacgagcacccatggaccaaacccgtgagctccgaaaatttcacgtctccctatgtgtggatgctggatgcggaagacctggcggacatcgaagataccgttgagtggaggcatcggaatgttgagtccctttgtgtcatggagacagcttccaacttttcttgctccacctcgggatgtttttccaaggacatagttggactgcgtacaagtgtatgttggcaacaacactgcgcatctcccgcgtttgcatattgcggccactccttctgctgcactggtactgcccttcgcaccatgagctcacttcctgaatcctccgccatgtgcaggaaggccgcgcggacacgcctcccacgagggaaagacttaatttatttcggatctgagaaaagcgatcaggaaacgggcagagtgctcctttttctctccctgtcaggctgctaccagattaccgatcacggcctgcgagtcctgactctgggcgggggtctgccgtacctagaacacctcaatctcagcggttgcctaaccatcactggcgcagggcttcaggatctcgtgtctgcctgccctagtcttaacgatgagtacttttactactgcgacaatattaacggaccccacgccgatacggctagcggatgccagaaccttcaatgcggatttcgggcttgctgcaggtccggcgagtag

SEQ ID NO: 116760 - DNA, 2025 bp, Artificial Sequence
  Description of Artificial Sequence: Synthetic coding sequence
atggctccgttccccgaagaggtggatgtcttcactgcgcctcattggcggatgaagcaattggttggattgtactgcgacaagtcgttgtatgcgaccttcaaagaatttaagatgcacgaacagattgagaacgagtatattatcggactgcttcagcagcgctcccagactatttataacgtgcacagcgataataaactgagcgaaatgctgagcctctttgaaaaaggactgaaaaacgtgaaaaatgagtacgagcaacttaattatgccaaacaactgaaagagcgactggaggcatttactcgtgatttcctgccacacatgaaggaagaggaggaagtattccagccaatgttgatggaatattttacatacgaggaactaaaagatattaaaaaaaaagtgatcgcccaacactgctcacagaaggacaccgcggagctactgagagggctatcactctggaatcatgctgaagagagacagaaattttttaagtacagcgtcgatgaaaaaagtgacaaagaggctgaggttagcgagcactccacaggtattacacacctgccaccagaggtcatgctaagcatcttcagttatctaaacccccaagagctgtgcagatgctcccaggtctctatgaaatggagccagcttaccaaaactgggtcactttggaaacacctctatccagtgcactgggcgcgcggagattggtactccggccccgccaccgagttagacacagagccagacgatgagtgggttaagaatagaaaggatgaatcccgggcctttcatgagtgggacgaagatgctgatattgatgagtccgaggagtccgccgaagagtccatcgcaatttccattgcccagatggaaaagcgactgttgcacgggttgatccataatgtcctgccctacgtgggcacgagcgttaagaccttagtgctggcttactcgtcagctgtgtctagtaaaatggtgagacagatactggagctgtgtccaaacctcgagcacttggatctgacccagactgacattagcgactctgcctttgattcctggtcttggctcggctgctgccagtcactgcggcacctcgacctctctggatgcgagaagatcactgacgtagctctcgaaaagataagccgagccctgggcatccttaccagtcaccagtcaggattcttgaaaacaagcacgtctaaaatcacttctaccgcctggaagaacaaggacataacgatgcagtccaccaaacagtacgcctgcctgcatgatctaacaaataaggggattggtgaagagatagataacgagcatccttggactaagcccgtgtcaagcgaaaatttcaccagcccctatgtgtggatgcttgatgcagaggaccttgccgacatcgaagacactgtagagtggaggcatagaaacgtggagtccctgtgtgtgatggagacggcctctaatttcagctgttccacgtctggatgtttcagcaaagacatcgtaggccttagaacttccgtgtgttggcagcagcactgcgcttcgcccgccttcgcttactgcggccactccttttgttgcaccgggacggccttacgcaccatgtcctctttgcccgaaagtagcgctatgtgtaggaaggcagccaggacccgcctgcccagaggcaaagacctgatctacttcggtagtgaaaaaagcgaccaagagaccggtagggttctactgttcctgtccctctcagggtgttaccagatcacagaccatggcctcagagtgctgaccctgggtggcggcctgccatacctggaacatctgaatctgagcggctgtcttaccatcacaggtgctggattgcaggatctggtttccgcctgtccgagcctgaatgacgagtacttctattactgtgacaatattaacggcccacacgctgataccgccagcggctgtcaaaaccttcagtgcggatttcgcgcttgttgcaggagtggtgaatag

SEQ ID NO: 116761 - DNA, 1440 bp, Artificial Sequence
  Description of Artificial Sequence: Synthetic coding sequence
ggaaaggggtcctccagcatttcgagtgacgtcagctcttccaccgaccacacgccaactaaggcccaaaaaaacgtcgcaaccagcgaggacagcgacttatccatgcgtactctctctacaccctcgcccgcactcatttgcccaccgaatctgcccgggtttcagaacggcaggggctcctcaacttcaagctcatccatcaccggggagacagtggctatggtgcacagccctccacccactagattgacacacccactcattcggctcgcttcccgtcctcaaaaagaacaagctagcatcgaccgtctccctgaccactccatggtccagatattctccttcttaccaacaaatcagctgtgtcggtgcgctagggtctgtagaaggtggtacaatctggcttgggatcctagactctggaggacaatcagactcactggcgagaccatcaatgttgatcgcgcccttaaggtcctgacccggagactctgccaggatacacccaatgtctgcctcatgctggagactgtcaccgtcagcggatgtaggagattaactgaccgaggcctgtataccatagcacagtgctgccctgaactgaggaggctcgaagttagtggatgttataacatatcaaacgaggctgtattcgacgtggtttctctgtgccctaatctcgagcacctggatgtctcaggttgctctaaggtgacatgcatctctctgacacgcgaagcttccataaagcttagccccctgcatggaaagcagatatcaatccggtatctggatatgaccgattgtttcgtgttggaggacgaagggctgcatacgatcgccgctcattgtacccaactgacacatctgtatctacgtcgttgcgtccgcctgacagatgagggcctcagatacctggtgatttattgcgcaagtatcaaagagctgagtgtgtcagattgcagatttgtgtcggactttggcttgcgggagatcgccaaactggagtctcggttacggtacctgtctatcgcccattgcgggcgcgtcactgacgtgggcatccggtacgtggccaaatattgctcaaagcttcgctaccttaatgcccgcggttgtgaaggcattactgatcacggggttgagtaccttgcaaagaattgcacaaagctgaagagtcttgacattgggaagtgcccactggtgagtgacactggcctggagtgcctagccctcaattgcttcaacctcaagcggcttagtctgaaaagctgcgaatccattaccggacaaggattgcaaatcgtggctgcaaattgttttgatctccagaccttgaacgtgcaggactgtgaagtatcggtggaagccctaagattcgtgaagcgacattgcaaacgttgtgtcattgaacacacaaatccagcgttcttttag

SEQ ID NO: 116762 - DNA, 1476 bp, Artificial Sequence
  Description of Artificial Sequence: Synthetic coding sequence
atgggcgctaacaatgggaagcagtatgggtctgaaggaaaaggatcatcaagcattagcagtgacgtctcctcgtctacagaccatacacccaccaaggctcagaagaacgtagcaacttccgaagactcggacctgtcgatgcgaacgctctccacacccagccccgccctgatctgtccgcccaacctgccgggttttcagaacggacgcggatcctccactagttcgtcttctattacaggcgaaaccgtagcgatggtgcactccccgcctcccaccaggttaacgcaccccctcatccggctggcaagccgacctcagaaggagcaggctagtattgaccgtttacccgaccactccatggttcaaatcttctccttcttacccacaaatcagctgtgcagatgtgccagagtgtgtaggagatggtacaatctcgcatgggacccacggctgtggcgcacaattagactcaccggggaaactattaatgttgacagagctctgaaggtgctgactagacggctctgccaggacactcctaacgtctgtctgatgctggagaccgttaccgtttccggatgccgcaggttgacagatagagggttgtacacaatagctcagtgttgtcccgagttgaggagactggaggtttcaggctgctataatattagtaacgaagctgtgtttgacgtcgtttctctctgccccaatctcgagcacttggatgtgagcgggtgttccaaagtcacatgcatctctctgacccgggaggcttccattaaacttagcccactgcatgggaaacaaatcagtattcgatatttagacatgaccgattgtttcgttctggaagacgagggcttacacactattgctgcacactgtacccagctgacgcacctatatttaaggagatgcgttcgcctgactgacgaggggctgaggtatctcgtgatctattgcgcctctataaaagaactaagtgtgtccgattgtagattcgtatccgatttcggtctgcgggaaattgctaagctggagagtcgccttcgctatctgtcaatagcccactgtggtagggtgacagatgtgggaattcggtacgtcgcgaaatactgcagcaagctcaggtatctgaacgcccgagggtgtgagggaatcaccgatcacggcgtggagtacctggccaaaaattgcactaaactcaaaagcctggatattggcaagtgccctctcgtaagcgacacaggtttagaatgtctggccttgaactgtttcaacttgaagcggttgagcttgaagtcttgtgaatctattaccggccagggattacaaatagtcgctgctaactgtttcgacctgcagactctcaatgtacaggattgtgaagttagcgtggaggcgttgaggtttgtcaagcgccactgcaagcgctgcgtgattgagcataccaatcccgcctttttttag

SEQ ID NO: 116763 - DNA, 3000 bp, Artificial Sequence
  Description of Artificial Sequence: Synthetic coding sequence
atggaaaacctggaatctaggttgaagaatgctccctatttccgctgtgagaagggaactgacagcattcctctgtgccgcaaatgtgagacatgcgtccttgcttggaaaatattcagcaccaaggaatggttttgtcgcattaatgatatctcccaaaggcggtttcttgtcggaatcttaaagcagctcaattcattgtatcttctgcactatttccaaaacatcctgcagacaacacagggaaaggactttatttacaatcgttctcgaataaatctgtctaaaaaagagggcaaggttgtgaagagctctctgaatcaaatgctggacaagaccgtcgaacagaagatgaaggagattttatactggttcgcaaacagcacccaatggaccaaagccaactataccttactgcttcttcaaatgtgcaatcccaaactgctccttacggcagcgaacgtgattagagtgctcttcctgcgcgaggaaaataacatcagcgggctgaatcaagacattaccgacgtatgtttcagcccagaaaaagatcatagtagtaagagcgcaacttctcaagtctattggactgctaagacccagcacacctcactgccattatccaaggcccctgagaatgagcacttgctcggagcagcgtccaatcccgaggagccttggagaaacagtctgcgatgtatatcggaaatgaatcgcctgttctctggcaaaggcgacattaccaagcctgggtacgatccctgcaatctgctcgttgatctggacgatatccgcgatctcagttccggctttagcaaatatcgggactttattagatacttgcctatccacttgtctaagtatatcctgcgcatgctggaccgccacaccctcaataaatgtgcatcagtcagtcagcattgggcagctatggcccaacaggtaaaaatggatctatctgcgcacgggttcatacagaaccaaatcacattcctccagggcagttacacgcgtggcatagaccctaattatgcaaacaaagtgtctattccagtgcccaaaatggtggatgatgggaagtctatgagagtgaagcatcccaagtggaaactgcggaccaagaatgaatacaacctgtggaccgcctatcagaatgaggagacccagcaggtgctcatcgaagagcggaatgtgttttgcggtacgtataatgtccgtattttatctgatacctgggatcagaaccgggtaattcactactctggcggggacctgatcgctgtctcaagcaaccgcaagatccatttgctggatattatccaagtaaaagctatccctgtagaatttcggggccacgccgggagtgtgagggcactgttcctctgtgaggaggagaatttcctcctgagcgggtcctacgatctgtcaattcggtattgggatctgaaatctggcgtatgtactaggatttttgggggtcaccagggaacaatcacatgcatggatctctgtaagaacaggctcgtatccggggggcgagattgtcaggtgaaagtatgggatgttgacaccggcaaatgcctgaaaacgtttaggcacaaggacccgatactcgctacacgtatcaacgacacatatatcgtgagttcttgcgagcgagggctggtcaaagtttggcatatcgccatggcccagctggtcaaaacactcagtggccatgagggtgctgtcaagtgtctgttctttgaccaatggcatcttctctccgggtcaaccgatggacttgttatggcgtggtcgatggtgggtaagtacgagcgttgcctgatggcattcaaacatcccaaaatggtggtaaacacggagagcaacgtgttaatgtttcagtttgagcacatcaagtggcaatacgccgtggaaaagactaaacagaagaagaacaaggagaaggaggaagagaaggaagaaaactctcttatggagatcttgtccaaatgtaacattcaagttcacagccctagggaatcagtttctagcaaacaaacagtgatacaagagctcctgccagggaaacccccgaagtctagggtgctcttgaaaccagctaagttctcttcagccgtgttgattgaagagcttcaaagccagggtaagtctaaaagcccaagaagagatgcggatgatgtagaaaaggcacagaaacaggggcaactcgagacaccaggaaaactcccaagtcacccaaagaaaaagtcctggaagatacctatgagcccagatcagtttctgcttacagtctctgccctccagcatgcccacaactccggggagtttgcctacccctgtcggccacagactgaaatcaccgacgtgtggggcccttccatttcttacccccgtaaggtgctcaactttaaggggaaatccattcagcgggcagtggataggctaagactgtctaacccccctatcgacgtgaagcggacttccatccctctggagattcagaaattgcagccaaatctcaagatctcccttcactccccaagggtgcaaagtaccataccgcaaccaatgattatccggagtcggttttccggttcgctgaagggaggcgaccaggtgacgtcctcaatcgagagggccgtgtgttctactggaccactcacatcaatgcaggttatcaagccgaatcgtatgttggcaccacaggtgggcactgctactctttcccttaagaaggagaggccccgaatctataccgctctcgacccatttagagtcaacactgagttcgttctgctgaccgttaaggaagagaaagagcaccaggaggcgaaaatgaaggagtatcaggcccgggagtctaccggcgtggtggatcccgggaaggtctctaaggccgcatggattcgaaaaatcaagggcctacccattgacaactttactaagcaggggaaaactgctgcccctgaattaggtcagaacgtgttcatatag

SEQ ID NO: 116764 - DNA, 3186 bp, Artificial Sequence
  Description of Artificial Sequence: Synthetic coding sequence
atggaaaatctcgaatcccggttgaaaaatgcaccgtattttagatgcgaaaaaggcacagatagcattccgctgtgcagaaagtgtgaaacctgcgttctggcctggaagatattttccaccaaagaatggttctgtaggattaacgacatcagtcagcgccggtttctcgttggtatcctcaagcagctgaactctctgtacttgctgcactatttccagaacattctgcagaccacgcaggggaaggacttcatatacaatcggtcccgaattaatctgagtaaaaaggagggtaaggtcgtcaaatcttctctgaaccagatgctggacaagaccgttgaacagaagatgaaagaaattttgtactggttcgcgaattcaacccagtggacaaaagctaattacacgctactcctgctgcagatgtgtaaccctaagctcctgctgacagccgcaaacgttattagggtgctgttcctcagagaagagaataatatctctggcctgaaccaggatataaccgatgtgtgtttctctccggaaaaggatcactcctccaagtctgcaaccagccaggtatactggacggccaagacccagcacacttccctcccgttatccaaggcgcccgaaaatgagcacctgctcggggctgcttccaaccccgaggagccatggagaaacagcttgagatgtatttctgaaatgaacaggcttttctctgggaaaggggatataactaaacccggctacgatccctgcaacctccttgtcgatctggacgacatcagagacctgagttccgggtttagtaagtacagggactttatacgttatcttcctatccacttgtctaaatacatcctgtctatgctgggctgtatgaggggcttccctcgccatctgcctagttggccctcttctggggtttcagggtctatcttcttcttccctggcatgctcgaccgtcacacacttaacaaatgcgcatcagtctcacagcattgggccgcaatggctcagcaggtcaagatggacctgtccgcacacggcttcatccagaatcaaatcacatttctgcaaggctcttatacccgggggatagaccctaactacgctaataaggtgagcatccccgtgcccaagatggtagatgacggcaagtcaatgagagttaaacaccccaaatggaagctccggactaaaaatgaatacaatttatggactgcctatcagaatgaggagactcaacaggttcttattgaagaacggaatgtcttctgcggtacttacaacgtgagaatcctttccgacacctgggaccaaaaccgtgttattcactatagtggcggggatcttatcgccgtgagctccaatcgcaaaatccatctgctggacatcattcaagtgaaagccataccagtggaatttcgtggccacgccggatctgtcagagccctttttctctgcgaagaagagaacttccttctgagtggcagctacgacctgtccattcggtattgggatctcaagtcaggggtttgtacacgtatcttcggcggacaccagggcacgatcacttgcatggacttatgcaaaaatagactcgtgagcggcgggcgagattgccaggtgaaggtgtgggacgtcgacactggcaagtgcctgaaaaccttccgacataaggacccaatcctcgcaacccgcatcaatgacacttacattgtgagctcgtgtgaaagggggttagtcaaagtctggcatatcgccatggcacagcttgtcaagaccctttctgggcatgagggcgctgtgaaatgcttattcttcgaccagtggcacctcctcagcggctctactgatggcttagtgatggcctggagtatggtgggtaagtatgaaagatgtctgatggcttttaaacacccaaaagaggtcctggacgtaagcttgttgtttctgagagtgatcagcgcctgtgccgacggcaaaatcaggatatataacttcctcaacggcaattgcatgaaggtgttgaaagcaaatggcagaggcgatccggtcctttcgttttttattcagggaaataggatggttgtgaacactgaatccaacgtgttaatgttccagttcgagcacatcaaatggcagtatgccgttgaaaaaactaagcagaaaaagaacaaagagaaggaagaagaaaaggaagagaatagtctcatggaaattctgagtaaatgtaatatccaggttcattccccacgcgaatctgtctcgagcaagcagacagttatacaagaactactccccggaaaacctcctaaatcacgcgttctcctgaaaccagccaaatttagctccgacgacgttgaaaaagctcaaaagcagggacaactggaaacaccaggtaagctccccagtcatcctaagaaaaagtcctggaaaatccccatgtcccccgaccagtttttattaaccgtgtcagccctgcaacatgcccacaattccggcgagttcgcatatccctgccggccacaaacagaaattacagacgtctgggggccaagcatcagctaccctagaaaggttttgaacttcaaagggaagtccatccaaagagccgtggatcgactgagactgagcaaccctcccatcgacgtgaaaagaacctcaatccccctagaaatccagaagttgcaacctaatttgaagatctcccttcattctccaagggtccaatccactatccctcagcctatgatcattcggagcaggttttctggatcgttaaaagggggcgaccaagtcacaagcagcattgaacgagctgtgtgtagcactggtcctcttacttccatgcaggtgattaaaccaaaccgaatgttagcaccacaggtggggacggcaacattgagtctgaaaaaagagcgccctaggatctatactgccctggacccgtttcgagttaacaccgaattcgtcctcttgacagtcaaagaggagaaagaacatcaggaggctaagatgaaagaataccaggcaagggagagcactggtgttgtcgacccaggtaaagtctctaaagctgcttggatccgcaaaatcaagggactccctattgacaattttacaaagcagggaaagaccgccgccccagaactcggtcaaaatgtgttcatctag

SEQ ID NO: 116765 - DNA, 3159 bp, Artificial Sequence
  Description of Artificial Sequence: Synthetic coding sequence
atggagaacttggaatctaggctgaagaacgctccttatttcaggtgcgaaaaaggaaccgattctatcccattgtgcaggaaatgcgaaacatgtgttctcgcctggaaaatattcagcactaaggagtggttttgtcgaatcaatgatatcagccaacggcggttcttggtaggcatcctcaaacagttaaacagtctttacctgctgcactacttccaaaatatactgcagaccacacagggcaaggatttcatttacaaccgatcccgcattaacctgtctaagaaggaagggaaagtagtcaagagctcacttaaccaaatgctggataaaaccgtagaacagaagatgaaagagattctgtactggtttgctaacagcacccagtggaccaaagcgaattatacactactgctgctgcagatgtgcaaccctaaactgctgcttacagcagcaaatgtcattcgggtcctctttctgagagaggagaataacatttccggtctaaatcaggacataacggatgtgtgcttctcacctgagaaggatcacagtagcaaaagcgcgacctctcaggtgtattggacggctaaaacgcagcacacaagcctgccgctatctaaagcacctgagaacgagcatctcctcggcgccgcctcaaacccagaggagccttggagaaactccctgcggtgcatctctgaaatgaacagattattctccggcaagggggacattaccaagcctgggtacgatccctgcaatctgctggtggatctggacgatatccgagacctcagctctggattttcaaaataccgggattttatacggtatctccccatccatctgtcgaagtacatcttgcgtatgctcgatcgtcatacacttaataagtgcgctagcgtctcccagcattgggcagccatggctcagcaggtgaaaatggacctctccgctcatggattcatccagaaccagatcacctttcttcagggatcctatacaagaggcattgaccccaattacgcaaataaggtctcgattccagtcccgaagatggtggacgacggcaagtccatgagggtgaaacatcccaagtggaagcttaggaccaaaaacgagtacaacttgtggacggcataccaaaacgaagagacccagcaggtactcatcgaagaaagaaacgtcttttgcggaacatacaacgtacggattttgtctgacacatgggaccagaatagagtcatccattacagtggaggagatctgattgccgtctcctctaatcggaaaatacatctactggatattatccaggtcaaggctatccccgtggagttccgaggccacgccggcagcgtcagggcgttgttcctctgcgaggaggagaattttctcctgagtggcagctatgatcttagcattagatattgggatctgaagtcgggagtctgcactaggatcttcggcggtcatcaggggacgatcacgtgcatggacttatgcaaaaaccgcttagtcagcggagggagggattgtcaagtcaaggtctgggacgtggatactgggaagtgccttaagacctttagacataaagatcccattctcgccacacgcatcaatgacacatacatagtttcatcctgtgaaaggggcctggtaaaagtgtggcatatagctatggcacagctagtgaagaccttaagcggtcacgagggcgctgtgaagtgtctcttttttgaccagtggcatttgctaagcgggagcactgacggactcgttatggcatggtctatggtgggcaagtatgagaggtgcttgatggcattcaaacaccctaaggaggttctggacgtaagtcttttatttttgagggtcatttcagcttgtgccgacggaaagatcaggatctacaatttcctgaatggaaattgcatgaaggttttgaaagctaatggaagaggcgatcccgtactgtcgttcttcatccagggtaataggatggtggttaatacagaatccaatgtgctgatgtttcagtttgagcacattaagtggcaatatgctgtggagaagaccaagcagaagaagaacaaagagaaagaggaggaaaaagaagaaaactcactgatggagattctgtcaaagtgtaacattcaggtgcatagccccagagaatccgtgagctccaaacagactgttattcaggagctcctgcccggaaaacctccaaagtctcgagtgctgctcaaacctgccaaattttcttctgccgtgcttatcgaagaattgcagtcacagggcaaaagcaaatccccccgaagggacgccgatgatgtggagaaggcacagaagcaggggcagctggaaacccccggtaagctaccctctcaccctaaaaagaagtcctggaaaataccaatgtcgccagatcaatttctcctgacggtaagcgcactgcagcacgcacataactccggcgagttcgcatatccttgtagacctcagacagagattacagacgtctggggacctagcatcagctacccaaggaaggtgcttaactttaaaggaaagagtatacaaagagcggtcgaccggctaaggctctcgaacccaccgatagacgtgaaacgcacttctatacctctcgagatccaaaaactgcaacccaacctcaaaatctctctgcactccccccgcgtccagtccaccattccccagcctatgatcattagatctcggttcagcggttccttgaaagggggcgaccaggttacttcctccatcgagagggctgtatgttcaacaggtcccctgacttctatgcaggttatcaagcccaaccgtatgttagctccacaagtgggaaccgcaaccttgagtctgaaaaaggagagaccgcgcatatataccgcacttgatcctttccgagtgaacactgaatttgtgctcttgacagttaaggaagaaaaagagcaccaggaagctaaaatgaaggaataccaggcccgcgagagcaccggggtagtggacccaggcaaggttagcaaggctgcgtggatcagaaaaattaagggtctgcccatcgataatttcacaaagcagggaaagaccgcggcccctgagcttgggcagaatgttttcatttag

SEQ ID NO: 116766 - DNA, 3156 bp, Artificial Sequence
  Description of Artificial Sequence: Synthetic coding sequence
atggagaatctggaatcacgactgaagaacgccccatattttcgctgcgagaaaggcaccgattcaatccctctctgccggaaatgtgagacttgcgtgctggcttggaagattttcagcacaaaagagtggttttgccgcattaatgacatttctcagcggcgattcctggtgggcatccttaaacagctgaatagtctctacctccttcactacttccaaaatattttgcagaccactcagggaaaagatttcatttataaccgcagcaggatcaatctctctaaaaaggaaggcaaggtcgttaaatcctcgcttaatcagatgcttgacaagaccgtagagcagaagatgaaagaaatcttatactggtttgcgaatagtactcaatggacgaaagccaactacacgttgcttctactgcaaatgtgcaaccctaaactgctgctgaccgctgccaacgtgatcagagtgctgtttctgagagaggaaaacaatatcagcggactgaaccaggatatcacagacgtttgtttttcacctgagaaagatcactcatcaaagtcggcaacaagtcaggtctattggaccgctaaaacacaacatactagcctgccattgtcaaaagcgccggaaaacgagcatttactgggggctgctagcaatccggaggagccgtggcgtaattctctcagatgcatctcagaaatgaacagactattttccggcaagggcgacatcacaaaaccgggctacgatccctgtaatctcttggtggacttagatgatattagggacttgtcgagcgggtttagcaaataccgggactttataaggtacttgcctatccatctaagcaaatatattcttagaatgttggacaggcacactctcaacaagtgtgcaagcgtatcgcaacactgggcagctatggcccagcaggtcaaaatggacctgtcggctcatggcttcatccagaaccagattaccttcctccaaggttcttacacacgcggtatcgaccctaactatgcaaataaggtgtccatccccgtgcccaaaatggttgacgacgggaaaagcatgcgtgttaagcatccgaaatggaaacttaggacgaagaacgagtacaacctgtggaccgcttaccaaaatgaggagacacaacaggtcttgatagaggagagaaacgttttttgtggcacttacaatgtgcggattttgagcgatacctgggaccagaatagggtgatacactactctggcggagatctgatcgctgtgagcagcaataggaaaattcacctgcttgacattatccaagttaaagccatcccagtggaatttcggggccatgcagggtctgtgcgagctttatttttgtgtgaggaggaaaactttcttctttcaggctcctacgacctgtcaataaggtactgggatctgaagagcggggtttgcacccggatattcggcgggcatcagggcacgatcacatgcatggacctgtgtaaaaatcgtcttgtctcaggtggccgcgattgtcaggtcaaagtttgggacgtcgacacaggcaaatgcctgaagaccttcaggcataaggaccctatcctggccacgcgtattaacgatacttacatagtgagctcctgcgaaagaggactggtgaaagtctggcacatagcaatggcgcagctcgtgaaaaccttgtccggccacgagggggccgtcaagtgtctattctttgatcagtggcaccttctctccgggtctacagatggtctggtgatggcttggtctatggtgggcaaatacgagagatgcctgatggcgtttaagcacccaaaagaggtcctggacgtgagtctcctgttcctgagagtcatatctgcctgtgccgacggcaaaatcaggatctacaacttccttaatggcaattgtatgaaggtgctgaaggcaaacggtaggggggaccccgtgttgtctttcttcatccaaggtaatcgaatggtggtgaacactgagtccaacgttctgatgttccaattcgagcacataaagtggcagtacgctgtggagaaaacaaagcagaagaagaacaaggagaaggaggaagagaaagaggagaacagtctgatggagatactgtccaaatgcaatatacaggtgcatagccccagagagtctgtgtcaagcaagcaaaccgtaattcaggagctgctgcccggtaagccccccaaaagtcgtgtgctactaaagccagcaaaattttcaagtgcagtgttaatagaagaactgcagtcacagggaaaatccaaatcacccagacgtgacgacgacgtggagaaggcgcagaagcaagggcagttggaaacgcctggcaagctgccgtctcatcctaagaaaaaaagctggaagatccccatgtcacccgaccagttcctgctgaccgtgtcggccttacaacacgcgcacaatagtggggagttcgcctacccttgccgcccacaaaccgagatcacagacgtatggggaccatccatttcctacccgagaaaggtgctaaatttcaagggcaagagcattcaacgtgcagttgatagattaagactctctaacccaccaattgacgtgaaacgtacatcaatccccctagagattcagaagctccagcccaatctcaagatctccctgcattctcccagggtgcaatctactatcccacagcccatgattattcgatctcgattctccggaagcctcaagggtggggaccaggtgacgtcttctatcgaaagggctgtgtgctccacaggacccctgacctctatgcaggtgatcaaacctaatcgcatgcttgctccgcaggtgggaaccgcgactttatctctgaaaaaagagaggccacggatatacactgctcttgatcccttccgagttaataccgagtttgtgctgcttactgtgaaggaagagaaggaacaccaggaagccaagatgaaagagtatcaagcccgggaatctactggagttgtcgaccctggaaaagtcagtaaagcagcctggatcagaaaaataaaaggcctccccattgataattttacgaagcaggggaaaacggctgcccctgagctgggccagaacgtttttatctag

SEQ ID NO: 116767 - DNA, 1629 bp, Artificial Sequence
  Description of Artificial Sequence: Synthetic coding sequence
atggaacctgatagcgttatcgaagacaagacaatagagctgatgtgttccgtgccgaggtcactgtggctgggctgcgctaacctcgttgagagcatgtgcgctctgtcctgtctccagagtatgccgagcgtgcggtgcctacagatctcaaatggcacatccagtgtcatcgtttctagaaaaagaccctcagaaggcaattatcagaaagagaaagatctgtgcatcaagtactttgatcagtggtccgaatcagatcaggtggagtttgtggagcatcttattagtcgcatgtgccactatcaacatggtcatattaacagctatctaaagcctatgctgcagagggactttattaccgcccttccagaacagggactggatcacatagcagagaacatcttgtcgtatctggacgctcgctcactgtgtgcagccgagctggtgtgtaaagagtggcagagggtgatctccgagggtatgctgtggaagaagctgattgagcggatggtgcgaacagacccactgtggaaaggacttagcgagcgccgtggatgggatcagtacttgtttaaaaatagaccaaccgatggcccccctaatagcttctaccgtagtttgtatcccaaaattattcaagacattgagacgattgagtcgaattggcggtgtggccggcacaacttgcagcgcatccagtgtaggtctgagaattcgaagggcgtctactgtctgcagtacgacgatgagaagataattagtggactgagagataactccataaagatttgggacaaaacttctttagaatgtctcaaagtgcttaccgggcatacaggaagcgtcctgtgtcttcaatacgacgagagggtcatcgtgacagggagctcggacagcactgtccgggtctgggatgtgaataccggggaggtgctgaacactcttattcatcacaacgaggcagtgctgcacctgcgtttcagtaacggactcatggtgacgtgctctaaagatcgcagcatcgcggtctgggatatggcaagcgcaacagatatcacactgaggcgcgttctagtgggtcatcgagcagcagtcaatgtcgtagatttcgacgataaatatatcgtctctgcgtcaggagatcggaccatcaaagtgtggtccacctctacctgcgagttcgtgcgcaccctcaacggccacaagcgcgggatcgcctgtctgcaatatagggaccggctggttgtctctggctctagcgataacactattaggctgtgggacattgaatgtggtgcctgcctgagagtcctcgagggacacgaagaactggtgaggtgtatccggttcgacaacaagcgcatcgtatcaggcgcctatgatggcaagatcaaggtatgggacctgcaggcggcgctggatccgagggccccagcctctacactgtgcctgagaaccctggtcgaacactcggggagagttttcagattgcaattcgatgagtttcagatcatctcttccagtcacgatgacactatcttgatatgggacttcctgaatgtgcccccttcggcacaaaatgagactaggagtccgagccggacttacacatatatctctagatag

SEQ ID NO: 116768 - DNA, 1590 bp, Artificial Sequence
  Description of Artificial Sequence: Synthetic coding sequence
atggagcccgacagtgtgatcgaagacaaaactattgagctgatgaatactagcgtgatggaagatcagaacgaggatgagtcacccaagaagaacaccctttggcaaatctctaacgggacatcctccgtaatcgtgtccagaaaacgcccctcggaaggcaattaccagaaagagaaggatctctgtatcaaatattttgaccagtggagcgagagcgatcaagttgaattcgtggagcatttgatatcgcgtatgtgtcactaccagcacgggcacataaactcctacttgaaacctatgctgcaaagagattttattaccgcgctacccgaacaaggccttgatcatattgccgaaaatatactgtcgtatctggatgcccgatctctgtgtgctgcggagctggtctgtaaagagtggcagagagtgatcagcgagggcatgctgtggaaaaagttaatcgaaagaatggttagaacagatcctttatggaaggggctgagtgagcgcaggggctgggaccagtacctcttcaagaatcggcctactgacggcccacctaattcgttctatcgctcgttgtatcctaaaatcatccaggacattgagacaattgagagcaactggagatgcggcaggcataacctgcagagaattcagtgcagaagtgaaaactccaaaggggtttactgcctgcagtatgacgatgagaagatcatcagcggcctgcgcgataacagcatcaagatttgggataaaacaagcttagaatgtctgaaagtcctgacgggccatactgggtctgtgctgtgtctgcaatacgatgaacgcgtgatcgtcacaggatcaagtgattccaccgtgcgagtgtgggatgtgaatacaggagaggtgctaaataccctgatccaccataacgaggctgttctgcacttacggttttcgaatgggttaatggtaacctgctccaaggataggagtatcgccgtgtgggatatggcctccgctacagacatcacactgagaagggttctggtcggacacagagcagccgttaatgtagttgatttcgatgataagtacatcgtgtcagccagcggggacaggactatcaaggtgtggagcacttccacgtgcgagtttgtgaggacgcttaatggccataagagaggtatcgcatgcctccagtacagggaccgtctcgtggtcagcggtagctcagacaacaccataagactctgggatatcgagtgcggagcctgcctcagagtgttggagggccacgaggagctggttcgctgcattcgcttcgataacaagcggatcgtgagcggcgcctacgacggtaagatcaaggtctgggacctgcaggccgccctcgaccctcgcgctcctgcatcgacattgtgtttaagaaccctggtggaacactccggacgcgtttttcggctccaattcgatgaatttcagatcatatccagcagtcacgacgatactattctcatctgggacttcctcaacgttccaccaagcgctcagaatgagacccggtccccgagccgaacgtatacgtacatcagtcggtag

SEQ ID NO: 116769 - DNA, 1527 bp, Artificial Sequence
  Description of Artificial Sequence: Synthetic coding sequence
atggaacccgacagcgtgatagaggacaaaacgatagagttgatgattagcaacggaacatcctctgtgatcgtgtcacgcaaaagaccatcagaggggaactatcagaaagaaaaggacctttgtattaagtatttcgatcagtggagcgaaagcgaccaggttgagttcgtggagcaccttatctctaggatgtgtcattaccaacatggccacattaacagctatttgaagccaatgttgcagcgggactttatcacagccctgccagagcagggacttgaccatatagccgagaatatattgtcttacctggacgcccggtctctttgtgcagctgaactggtctgcaaagaatggcagcgggtgattagcgagggtatgctgtggaaaaagctgatcgagaggatggtgcggacagatcccttgtggaaggggcttagcgagaggcgaggctgggaccagtacctgtttaagaatcgaccgactgatggcccccccaattctttttaccgctctttgtaccctaagataattcaggatatcgaaacaatagaaagcaattggcgctgcggtaggcacaatctgcagaggatccaatgtaggtcagaaaatagtaagggggtgtattgtctccagtatgatgacgagaaaattataagcggcctgcgagataacagcattaagatctgggacaagaccagtctggaatgcctgaaggttttaaccggtcacacaggctctgtactatgtttacagtacgacgagcgtgtcatcgttaccggatcttcagatagcacggttagggtatgggatgtgaacaccggagaagttttgaacacactgatccatcataatgaagcggtacttcatcttaggttttcgaacggcctgatggtcacttgtagtaaggacagatcaattgccgtgtgggatatggcctccgctaccgacatcaccctccgaagggtgctcgtgggacatcgcgctgctgttaacgttgtggacttcgatgacaagtacattgtgtccgccagcggagaccgcacaattaaagtgtggtcgacatctacgtgtgaatttgtacggacgctaaacgggcataaaagaggcattgcatgtttacagtatcgggacagactggtggtttctggcagttccgataacactatacggctgtgggatattgagtgtggggcatgcctccgggttttggaggggcatgaagagctagtccggtgcatcagatttgacaacaagcgcatcgtctcaggcgcttacgatggaaaaatcaaggtgtgggaccttcaggcagctctggacccccgcgcccctgcttctacattgtgtctccggaccctcgtggaacattcaggcagagtatttagactgcagtttgacgagttccagatcatttcaagctcccatgacgataccattctgatttgggacttcctgaatgtgccaccctctgctcagaatgaaacgcggtccccttcacgcacctacacgtacatcagcaggtag

SEQ ID NO: 116770 - DNA, 1533 bp, Artificial Sequence
  Description of Artificial Sequence: Synthetic coding sequence
atggaggatcagaacgaggacgagagcccgaagaagaacaccttatggcaaatatctaacgggacaagctctgtgatagtgtcaagaaaacggccaagtgaaggaaactaccagaaggagaaggatctgtgcataaaatacttcgaccagtggtcagaatccgaccaggttgagttcgttgaacatctgattagtaggatgtgtcactaccagcatgggcacataaacagctacttgaaacccatgctgcaacgtgacttcatcacggccctccccgaacagggcctagatcatatagcagagaacattctgagttatctggacgctagatctctgtgcgccgcagagctggtttgtaaggagtggcagcgcgtgatctctgaaggtatgttatggaagaaactcatcgaacgcatggtgcgaaccgaccctctgtggaagggcttgtctgagcgcagaggctgggatcagtacctcttcaaaaatcgcccaacagatgggcctcctaattcgttttataggtccctgtacccaaaaatcatccaggatattgagacgatcgagtcaaattggcgctgcgggaggcacaatcttcaaaggattcaatgcaggtccgaaaactcgaagggtgtttactgcctccagtatgacgacgaaaaaattattagtgggttgagggataattcgatcaagatttgggataaaacgtctctggaatgcctgaaagttctaacaggacatactggcagcgtcctctgcctgcaatatgacgagagagtgattgtcactggatcatccgacagcacagtgagggtttgggatgtcaacacaggcgaggtgctgaataccttgatccaccataacgaggctgtcttgcacctgagattttcgaacggcttaatggtcacatgttccaaagatcgctctatcgctgtgtgggacatggcaagcgctacagacatcacgctgaggcgggtgctggtgggtcatagggcggcagtaaatgtggtggatttcgacgataaatatatcgtttctgccagcggggatcggaccataaaagtttggagcaccagtacttgtgagtttgtgaggactctcaatgggcacaagagaggcatagcctgccttcaatatagggaccgcctggtggtgtccggcagcagcgacaatacaattcgcttgtgggatatcgagtgtggtgcttgtctccgcgtcctggaggggcatgaggagctggtgcggtgcattcgatttgataacaaacggatagtctctggggcatatgacgggaaaattaaggtctgggatcttcaagcggccctagatccgcgagcaccagcctcaaccctgtgtctcagaactctggtcgagcactccggccgggtgtttaggttgcagttcgacgagtttcagatcatttccagctcccatgatgatactatactgatttgggattttctgaacgtaccaccatctgcacagaacgagacccgctctccatcaaggacttacacatacattagccgctag

SEQ ID NO: 116771 - DNA, 1395 bp, Artificial Sequence
  Description of Artificial Sequence: Synthetic coding sequence
atggagatccgcctgcctgacctggcattaaaaaggatatttagcttcctggatctgtttggacttctacaggtgagtcaggtgaacaaacactggaaccggatcgccgacagcgactatttatggcgctctctgagcctgcaacgctgggactgctctaactttactaaccagcacctgggcacacacacctggaagcaattttttctccatcagaggcggaaggagctcaggttagcccttgcacagccccacaactttatctataaggttaccaagaacatcgcattcgagacagagctggcctatctttccgggaataggttgactgtggatgagcaggagaaatccatcatctgtagcgtgtcgcctaaacaggagctgtgtgcctgggacgttcaggagggtacaatgatttggtcttcacctgttcaggaatttcatttttctaaccttgtgaccctgcctcagatgcacttagccatcacgatggacaggaagaagacaataaaagtgtggaattgccaggatcgggatgccttggccgttttgcccatgcctcagccctgctactgtatggaggcctatctgaccaaagacggccctttcctgatggtgggcgatgccgccggagacatctacacattcaccctgcctggcctacgggacgtctcaaaagtgaccgcctttcagtacggtattgtgctcctgcactgttcaccagacaagaagtgggtgtttgcctgcggcacttactccagaacactgccacaggtgttcttgaccgagtctctccttaggccctcagaagggtcggtccccctttccaccttcctccctcacaagctttgtgctagtgcttgctggaccccgaaagtgaagaatcgaatcaccctgatgtcacaaagttcaaccggcaagaaaaccgagttcataaccttcgacctgactaccaaaaaaactggtggtcagacagttattcaggcctacgagatcgcgtcatttcaagtggcagctcatctgaaatgtcctatttggatgggggcctcggatggctacatgatcgtgttcaccagtggcccgtacctgcttctcttcagtattacgggctttctgctccagcggtttgaggatcaccaggctgccatcaacaatttttgggtggacccatgttatgtactgaccaccagtgaaaattcggtgcacgtgtacatgtgggaagagggggggaggcatccttacctgagatcttgctgtcatctcgagaacacttggcatgatcacacaacagactcatgcatctcttcagtcatgtgcgacaacgctagcattgtactcagggtgagaaaggtgtccgacagcagtatactggtcatgtattctctgaacacctag

SEQ ID NO: 116772 - DNA, 1092 bp, Artificial Sequence
  Description of Artificial Sequence: Synthetic coding sequence
atgctcgcgctaagagacgagcctcactcccctgatagcagaagccaggctttcgaaacagagttagcttacctctccggaaaccgactgaccgtagacgagcaggaaaagtctataatctgcagtgtgtctcccaagcaggagctatgcgcatgggacgtacaggaaatgcatctcgcgatcacaatggaccgaaagaagaccattaaagtttggaattgtcaggaccgggatgcgttggctgtgctcccgatgccacaaccttgctattgtatggaggcctacctgactaaagatggtccattccttatggtcggagatgctgctggagatatctacacgttcacattacctggcttacgggatgtctctaaggtaactgcttttcagtatggaatcgtacttcttcactgctcgccagataaaaagtgggtgtttgcatgtgggacatattcacggaccctgccccaggtattcctcacagagagcctgcttcggcccagtgagggtagcgttcctctgtctacattccttcctcacaaactgtgtgcgtctgcctgttggactccgaaggtcaagaaccggataacccttatgtcccaatcttcgacagggaagaaaacggaatttattacattcgatctcactactaaaaaaactggagggcaaactgtgatccaggcctacgaaattgcttccttccaggtggctgcccacttaaaatgcccaatctggatgggcgcctccgacggctatatgattgtgtttacttcaggaccatatctgctcctttttagcatcaccggattcctccttcagagattcgaagaccaccaggccgccataaacaatttttgggtagacccatgctacgtgcttacaaccagtgagaactctgtgcacgtgtacatgtgggaggaaggtggaaggcacccgtatctgagaagctgttgccacctggaaaacacatggcatgatcatactacagatagctgcatctcatccgtaatgtgcgacaacgcctcaattgttctgcgagtgagaaaggtgagcgattccagtatcctcgtcatgtactcattgaatacctag

SEQ ID NO: 116773 - DNA, 1185 bp, Artificial Sequence
  Description of Artificial Sequence: Synthetic coding sequence
atggaaatcaggctgccagatttggctttgaagaggatcttctcttttttggacctgttcggtttgcttcaagtttcacaggtgaacaaacattggaatcgaatcgctgacagcgattacctgtggaggtcgctgtctctacagcgatgggactgttcaaattttactaaccagcatctggggacccacacatggaagcagttttttttgcaccagcggcggaaggagttgcggctcgctcttgctcagccacacaatttcatttacaaagtgacgaagaatattgctttcgagacggagcttgcctacctcagcgggaataggttgacagtcgacgagcaggaaaaatcaattatttgttccgtttctcctaaacaggagctctgtgcgtgggatgtgcaggaggtgggggatgccgccggtgatatctacacattcaccctccccggcctgagagacgtgagcaaggtgaccgcttttcagtacgggatagtcctgctgcattgctccccagataaaaaatgggtgtttgcttgcggtacctacagccgcaccttgcctcaggtattcctgaccgaaagtttgctgcgccctagcgagggttcggtacctctctcaacatttttgccccacaaactctgtgccagtgcttgttggacaccgaaggtaaagaataggattaccctaatgtctcagagctcaaccggaaagaagaccgaatttatcacttttgatcttaccaccaaaaaaacaggaggccagactgtgatccaggcctacgagattgcttcttttcaggtggccgcccatcttaaatgtccaatttggatgggcgctagtgacggctatatgatagttttcacgtccgggccataccttctgttgttctctataaccggattcctcctgcaaagatttgaggaccaccaggccgcgatcaataacttctgggtggacccatgctacgtgctgaccacatctgaaaactctgtccatgtctacatgtgggaggaaggtggcagacacccatatctgcgctcatgctgtcatcttgaaaatacgtggcacgaccataccacagattcatgtattagctctgtaatgtgtgataacgcttccatcgtccttagggtgaggaaagtgtcggattcatccattctggtgatgtattcactgaatacgtag

SEQ ID NO: 116774 - DNA, 1338 bp, Artificial Sequence
  Description of Artificial Sequence: Synthetic coding sequence
atgagcccaacccaccaaatccaagaccccaagcattggaatcgaatagcagatagcgactatttgtggcgatcactgtcactgcagcggtgggactgtagtaactttactaatcaacatctcggcactcatacctggaaacaattctttctccaccagagaagaaaagagctgagacttgcgctggcccagccacacaactttatatataaagtgactaagaatatagcctttgaaacagaactggcctatctttctgggaaccggctgacagtggatgaacaggagaaatctataatctgtagcgtgagtccaaagcaggaactatgtgcctgggatgtgcaggaagggaccatgatttggtcctctccggtgcaagagttccatttctctaatctggtcacgctgccccaaatgcacctggccatcactatggaccgcaagaaaaccataaaggtatggaactgtcaggacagagatgccctagccgtcctccctatgccacagccctgttactgtatggaggcatacctgaccaaagatggacctttcctcatggttggagatgcagcaggagatatctatactttcaccttgccaggcctgcgggacgtgtcaaaagtgaccgccttccagtacggtatagtcctgttacattgcagccccgacaagaaatgggtttttgcttgcggcacttactccagaacattacctcaggtttttctcacagagagtcttctacgcccatcagaaggttccgtaccgttatcaaccttcctccctcacaagctgtgcgctagtgcgtgttggacccctaaagttaaaaacaggataacactaatgagtcagagctcgaccggcaaaaagactgagttcatcacatttgacttgactaccaagaagaccgggggtcagacggtgatccaggcttacgagattgcttcctttcaggtggccgcgcacctgaaatgccccatctggatgggggcatcggacgggtatatgatcgtgttcacgtctggtccatatctgctgctgttcagcattacggggtttcttctccaacgctttgaggatcaccaggcagctatcaataacttctgggtggatccctgctacgttcttaccactagcgagaattccgtccatgtttacatgtgggaggagggcggcagacatccatacctacgtagttgctgccatctcgagaacacttggcatgaccatactactgattcttgcattagttctgttatgtgcgacaacgcttccatcgtcctgcgcgtcaggaaggtgtcagatagtagtattttagtgatgtactccctgaacacctag

SEQ ID NO: 116775 - DNA, 1239 bp, Artificial Sequence
  Description of Artificial Sequence: Synthetic coding sequence
atggccgcagctgctggtgaagaagaggaggaggaagaggctgctcgcgagagcgcagccagacccgccgcaggccctgctctatggagactcccagaggagttactcctactgatttgctcatatttagatatgagagccctgggtaggcttgcacaggtgtgtaggtggttgaggagatttacaagctgtgatctgctgtggaggcgcattgctagggccagcctgaatagcgggtttacgcggttgggcactgatctgatgacaagcgtgccggtgaaagaacgcgtgaaggtcagccaaaactggcgactgggacgatgccgagagggcatcctgctgaagtggaggtgcagacagatgccctggatgcagctcgaggatgattcattgtatattagccaggccaacttcattttggcttaccaattcagacccgacggcgcaagcctgaataggcgccccctgggggtctttgccggccatgatgaggacgtttgccattttgtgctcgccaatagtcatatcgtctctgcaggaggagatggtaaaattggcatccataagattcacagtaccttcaccgtcaagtatagtgctcatgagcaggaggtgaattgtgtggattgcaaggggggcatcattgtcagtggcagccgcgatagaaccgccaaggtatggcctctagcgtctggtaggctcggtcagtgcctgcatactatccagactgaggacagagtttggtcaattgccatttcccctcttctgtcatcttttgtcaccggcactgcctgctgcgggcacttttccccactgagaatctgggatcttaattccggccagctcatgacccaccttggctcagacttcccacccggtgctggggtgctcgatgttatgtatgagtctccatttactttgctgtcttgtggttacgacacctacgtccgatattgggaccttcgcactagcgtgaggaagtgcgtcatggagtgggaggagccgcatgattccaccctttactgcctccagaccgacgggaaccaccttctagccaccgggagctcttactatggggtcgtccgactatgggatcgccggcaaagggcctgcttgcacgcgtttccactgacctcgacccctctgagcagtcccgtgtattgcctgcgtctgacaactaagcatctgtatgccgcgttatcatataacttgcatgtgctggacttccagaacccatag

SEQ ID NO: 116776 - DNA, 1239 bp, Artificial Sequence
  Description of Artificial Sequence: Synthetic coding sequence
atggcagccgccgccggcgaagaggaagaggaggaagaagcggcgcgggaatccgccgcaagaccggctgccggccccgcgttgtggcgcctgcccgaagagctgctactgctaatctgctcatatcttgacatgagggctctggggagactagcacaagtgtgcagatggctgcggcggttcacaagctgcgacctgctctggagacgaatcgcccgagcttccttgaatagcggattcacccgactcggcaccgacctcatgacctcagtaccggttaaagagcgcgtcaaagtttcacagaactggcggctcgggagatgccgtgaagggatattactgaaatggcggtgcagccagatgccatggatgcagctggaggatgattctctgtatatcagccaggcgaactttattctggcatatcagttccggcctgatggagcctcgctaaacagacggcccctgggagtgttcgctggacacgatgaggatgtgtgtcattttgtgttagcgaattcacacatcgtatccgccggcggtgacggcaagatcggtatccataagattcactcaacctttacggtgaaatatagcgcgcacgagcaggaggtcaactgtgttgactgtaaaggagggatcatagtgtctggaagccgagataggaccgccaaagtctggcctctggcctccggtaggcttggccagtgcctgcacacaattcagacagaggaccgcgtgtggtccatcgcaatttcccccttgttgtcatcctttgtaacaggaaccgcctgctgtggccactttagcccactgaggatttgggatttaaattcaggccaactgatgacccacctgggaagtgatttcccgccgggagctggggtgctggatgtcatgtacgagtctccttttactctcttgagttgtggatacgatacgtatgtgaggtactgggatctgaggaccagtgtgcgcaaatgcgtgatggagtgggaagagccccatgactccaccctgtattgtctgcagacggatggcaaccatcttcttgccacggggagctcttattatggggtcgttcggctctgggatagacggcaaagagcatgccttcatgcgtttccgctgacttccacccccctttcgtcccccgtatattgtctgaggctcacaactaaacacctgtatgccgcactgtcttataatctccacgtgcttgatttccagaatccttag

SEQ ID NO: 116777 - DNA, 639 bp, Artificial Sequence
  Description of Artificial Sequence: Synthetic coding sequence
atgagggccctaggtcgtctagcccaagtttgccgctggctgcgacgctttacatcatgtgacctgttgtggaggaggatcgcacgcgcttcccttaattctggcttcaccaggctcggcactgacctgatgaccagtgtccctgtgaaggagagagtgaaagtctcgcagaattggagactgggaaggtgcagagagggaattctcctgaagtggcgctgtcgccagatgccatggatgcagttagaagacgacagcctatatattagccaggctaatttcatcctcgcataccagtttagaccagatggcgcctccctcaatcgcagacctctgggagtgttcgcaggccatgacgaagacgtttgtcacttcgtgcttgcaaactcccacatagtatctgccggcggagacgggaagatcgggattcacaagatccactctactttcacagtaaaatattctgcccatgagcaagaagtcaattgcgtggattgtaaaggcggcataatcgtgtcaggatcgcgcgaccgaactgccaaagtttggccactcgcatctggtcgtttgggtcagtgccttcacaccattcagactgaagatcgggtgtggtcgatagccatttcacccctgctttag

SEQ ID NO: 116778 - DNA, 576 bp, Artificial Sequence
  Description of Artificial Sequence: Synthetic coding sequence
atgacttccgtgcccgttaaggaacgcgtgaaagtgtcccaaaactggcggttggggaggtgccgcgaagggatcttgctcaagtggcgctgccgccagatgccatggatgcaactcgaggatgactcgctgtatatctcccaggccaatttcatcctggcatatcagtttagaccagatggcgcatcactgaatcgaagacccctcggtgtgttcgcaggtcatgatgaggatgtctgccacttcgtgctagcgaattcccatatcgtgtccgccggaggcgatggaaagatcggcatccacaagatccatagtaccttcactgtcaagtactctgctcacgagcaggaagtgaattgtgttgattgtaagggggggattatcgtgagcggctcccgcgacaggaccgcaaaagtatggccgcttgcaagcggccgcttaggccagtgtctccatactatccagacggaggatagagtttggagtatcgccatatcccccctgctgtcatccttcgtcacagggaccgcctgttgcggccatttcagtcccctgaggatctgggaccttaattag

SEQ ID NO: 116779 - DNA, 1884 bp, Artificial Sequence
  Description of Artificial Sequence: Synthetic coding sequence
atgtgcgtgccccggagcggcttgattctgtcttgcatttgcctgtattgcggggtgcttcttcctgtactactgcctaatctgcccttcctgacgtgcctttctatgtctacactcgagtccgtaacctatctgccagaaaaaggactgtattgccaacggctaccctcttcccggacccacggcggaactgagagtctcaaagggaaaaacactgagaatatgggcttctatgggacactgaagatgatattctataagatgaaaaggaaactggaccacggatccgaagtgaggtcttttagtctgggaaagaaaccatgcaaagtgtctgagtacacaagtactaccgggctcgtaccttgttctgccactcccaccacatttggcgacctgcgagctgcgaatggccaaggccagcagcggcgccggataacaagtgttcagccgcccactgggctacaggagtggctcaaaatgttccaatcttggagcggacctgagaagctgctggccctcgacgagctcatcgatagttgtgaacccacacaggtcaagcacatgatgcaagtgatcgagccacagtttcagcgggacttcataagcctgttacccaaggaactagccctatatgtgttgtcgtttctagaacctaaagatttgctacaggccgcacagacttgcaggtattggaggattctggctgaagacaatctgctgtggcgcgagaaatgcaaggaggaaggaattgacgaacctctccacatcaagcggagaaaggtaataaagccagggtttattcatagtccctggaagagcgcctacatccgtcagcaccgcatagataccaactggcggaggggtgaactgaagagccctaaagtgttgaaaggacatgatgatcacgtgattacttgtctgcagttctgcggaaaccggatcgtttcggggagcgacgataacacccttaaggtctggtctgccgtcacagggaagtgtctgagaactctggtcggccacacaggtggggtctggtccagccagatgagggataatattattatcagtgggtcaaccgatcggacactgaaagtctggaatgcggaaaccggcgagtgcatccatacactgtacggccatacgtctaccgtacgatgtatgcacctgcacgagaagcgggttgtctccggatctcgcgacgctacactgcgggtttgggatattgagactgggcaatgcctacacgtgctgatgggccatgtcgctgccgtcaggtgcgttcaatatgatggacgaagggttgtcagcggcgcttacgactttatggtgaaggtgtgggaccctgagacagaaacctgtttacacactctccagggacacaccaacagagtttacagcttgcagttcgacggtatacacgtcgtgtcaggcagtctggatacatccattcgagtgtgggatgtagagactgggaattgcatacacacactgactgggcaccagagcctgacctccggcatggaacttaaagacaatattctggtgagtgggaatgccgacagtacggtgaagatttgggatattaagacaggccaatgcctgcagaccctgcagggacctaataagcaccagagcgctgtaacatgtctccagttcaataaaaatttcgtgatcaccagttcagacgacggaacagtgaaattgtgggatttgaaaaccggtgagttcatcagaaatctggtgacgttagagtcgggcgggagtggtggggtcgtatggaggataagggcttctaacactaaactggtgtgtgctgtaggctctcgcaatggcaccgaagagactaaactgctggtgcttgatttcgacgtggacatgaaatag

SEQ ID NO: 116780 - DNA, 2124 bp, Artificial Sequence
  Description of Artificial Sequence: Synthetic coding sequence
atgaatcaagagttattgagcgtgggaagcaaaaggcggcgaacgggaggatctctgagggggaatcctagctcgagtcaggtagatgaagagcaaatgaacagggtcgtggaagaggagcagcagcaacagcttaggcaacaagaagaagagcacacagccaggaatggtgaagtggtaggtgtggagcctaggcccggagggcaaaatgactctcagcaggggcagctcgaagaaaacaacaaccgcttcatctccgtagatgaggatagcagtggaaaccaggaagagcaagaagaggacgaggaacatgccggggagcaggacgaggaagacgaggaggaagaggaaatggaccaggaaagcgatgacttcgaccagagtgatgactccagccgagaggatgagcacactcacacaaattcagtgacaaatagtagtagcatcgttgatctgccagtccaccagttgtctagtccattttacactaaaactactaagatgaagaggaaattggaccacggatcagaggtccgaagtttttctcttggcaagaagccatgtaaagtcagcgaatacacaagcaccaccggactggtgccatgctccgccacccccactacttttggggatttaagggccgctaacgggcagggacagcagaggaggcggatcacctctgtgcagccgccaacaggactacaggaatggcttaaaatgtttcagtcctggagcgggcccgaaaagttgctcgccttagacgaactgattgattcttgcgaacccacccaggtgaagcatatgatgcaggtgatagagccccaattccaaagagacttcatctctcttctcccaaaagagttggcactctatgtcctcagttttctagaacccaaggatctgctccaggcagcacaaacatgcaggtactggcgcattctagccgaggacaacctattgtggagggagaaatgcaaagaagagggcatcgatgagccgctccacatcaaaaggcgaaaagtgattaagcccggattcattcattctccctggaagagtgcttacatccgccagcacagaatcgacaccaactggcggagaggagagttgaagtctccgaaagtcctcaagggtcacgatgaccacgttattacttgcctccagttttgtggcaaccggatcgtttctggaagtgacgacaacaccctcaaagtatggagcgctgtgacggggaaatgcttgcgcactcttgtggggcacactggtggggtgtggtccagtcagatgagagacaatatcattatttccggcagcaccgaccggaccctgaaagtttggaatgctgagaccggagaatgtatccacaccctttatggtcacacatcaactgttagatgtatgcacctgcacgagaaaagggtggtcagcggaagtcgagacgctacactgagagtctgggatatcgagactggccagtgcctgcatgtgctaatggggcacgtggccgccgttcggtgcgtccaatatgacggacgcagggtagttagcggagcctacgactttatggtgaaggtctgggacccagagactgagacatgtctgcacaccttgcagggccacacaaatagagtgtattcactgcaattcgatggaatccatgtggtgtctgggtctcttgatactagcatccgcgtctgggacgtggagaccggaaattgcattcatacccttacgggtcatcagagtctcacgagtggaatggagctgaaagacaatatcctcgtgtctggaaatgccgatagcacagtcaaaatctgggatattaagaccggccagtgtctgcaaactctgcaagggcccaacaaacaccagtctgccgtgacatgtctgcagttcaacaaaaattttgtgatcacctcaagtgacgacggcacagtaaaactgtgggacctgaagaccggagaattcattcgcaaccttgtcaccctggagagtggaggaagcggcggtgtcgtctggcggatccgggcctctaacacaaagctagtgtgcgccgtcggcagcagaaacggcacggaggaaactaagctgctggttcttgatttcgacgtggatatgaagtag

SEQ ID NO: 116781 - DNA, 1770 bp, Artificial Sequence
  Description of Artificial Sequence: Synthetic coding sequence
atgtcaaagccaggtaaaccaaccttgaatcacggcctcgttccggtcgacttaaagtccgcaaaggaacccctcccccaccagaccgtgatgaagattttttctatatctatcatcgctcagggattacccttctgccgcaggcgcatgaagcgcaaactggaccacggatcggaagtcagatctttctcgttaggtaaaaaaccttgcaaagtctcagaatacacctctacaactgggttggtgccctgtagtgccacaccgaccactttcggggacctacgggccgctaacggccaaggccagcagcggagacggatcacctcggttcaacctcctacgggtctgcaggagtggttgaagatgttccaatcttggagcggtcctgaaaagctgctcgctctggacgaattgatcgactcttgcgagcccacccaagtcaaacatatgatgcaagtcattgaaccacaattccagcgagatttcatttcactgctgcccaaggaattagcactgtatgtgttatcctttctggaacctaaagatttgctgcaggcagctcagacctgccgatattggaggatcctggcagaggataacttactttggagagagaaatgcaaagaagagggcatcgatgaacccctgcacatcaaacgtcgcaaggtaattaaacccggttttattcactccccatggaaatctgcatacattcggcagcaccggatagacaccaattggcgtcggggcgaacttaaaagccctaaggtactcaaaggccacgatgatcacgtgattacatgtctacagttctgcggaaatcgaatcgtctctgggtccgacgacaacaccctgaaggtgtggagcgctgttacgggcaagtgccttcgtacacttgtgggacataccggcggggtgtggtctagccaaatgcgcgacaacatcatcattagtggctccactgaccggaccctgaaagtatggaacgctgaaaccggggagtgtattcacacattgtatggacacacatctaccgtcaggtgcatgcatttacatgagaaaagggtggtcagtgggtcacgtgacgccacactgagggtgtgggacatagagacagggcagtgtctccacgtactcatgggccacgtggcagcggtgcggtgcgtgcaatatgacggccggagggtggtcagtggcgcctatgatttcatggtcaaggtctgggacccagagacagaaacctgtctgcacacccttcagggccacacaaaccgggtgtactcactgcaatttgacggtatccatgtcgtttccggtagccttgatacctccattcgggtctgggacgtagagaccggcaactgtattcatacccttacgggacaccaatcattgacaagcgggatggaactgaaagataacatcctcgtttccggcaacgcggactccacagtgaagatatgggacattaagactgggcagtgcttgcagacgctgcagggtccaaataaacaccagagtgcagtcacgtgtcttcagtttaacaagaacttcgtcatcacctcctccgacgacggaaccgttaagttatgggacctgaagacaggcgaatttataaggaatctggtgactttggaatcaggcggcagcggcggtgtcgtgtggcgtattcgtgcctcgaatacaaagttagtgtgtgccgtggggagtcggaacggcactgaggagactaaacttctggtgctcgactttgacgtggatatgaagtag

SEQ ID NO: 116782 - DNA, 1596 bp, Artificial Sequence
  Description of Artificial Sequence: Synthetic coding sequence
atgcttttctttaagtgtatttctctgctgcttatttggctgattcccggacagtctactacagggctggtgccttgtagcgccactccaactacattcggagatctaagggctgccaacgggcagggtcagcaaagaaggcggatcacatctgtccaaccaccaactggtctgcaggagtggctgaaaatgttccagtcatggagcgggcccgagaaactgctggccctggacgaattgattgactcctgcgagccaacgcaggtgaaacacatgatgcaagtcatcgagccccagtttcagagagacttcatctcccttttaccaaaggagctggccctctatgtgctgtcttttctcgagcctaaagatcttctccaggccgctcagacctgccgatactggcgcatcttggccgaagacaatttgctgtggagagagaagtgcaaggaggagggaatcgatgagcccttgcacatcaaacggcggaaagtcatcaagcctggctttatccacagcccatggaaatccgcttacatacgccagcaccgcatcgacacgaactggcgacgtggagagttaaaatcaccgaaagtgctcaaaggccatgacgaccatgtaatcacgtgccttcagttctgtgggaaccgtatcgtctccggctcagacgacaatactctgaaggtgtggagcgccgtcaccggaaagtgcttgagaaccctggtgggccacactggcggcgtttggtcctcccagatgagagacaacatcatcatcagtggcagcactgacaggacattgaaggtgtggaacgccgagactggcgagtgcattcacacgctatacgggcacaccagcacagtgaggtgcatgcacctccacgaaaaaagagtggtgtccgggtcccgggacgccacgttgcgagtatgggatattgagacgggccagtgcctgcacgtcttgatgggccatgtagcagctgtgaggtgtgtgcagtatgacgggaggcgggtcgtgagcggagcctatgatttcatggtcaaggtttgggatcctgagactgaaacttgcctccatacactgcagggccacactaatagggtctattcactgcagttcgacgggatacatgtggtttcagggagtctggatacgtccattagagtttgggatgtcgaaaccggtaactgtatacatactctgaccggccaccagtcgctcacctccggcatggagctgaaggataatatcttagtgtccggcaacgcagacagcaccgtgaagatatgggatattaagacaggccagtgtctccaaactctccaagggccaaacaaacaccagtctgctgttacctgtttacagttcaataagaattttgtcattacgagcagcgacgatggaaccgtcaagctgtgggacctgaagaccggggagtttattcgtaacctggtcactttggaatcaggaggctctggaggagttgtctggaggatcagggcttctaacacaaagcttgtctgcgctgtggggagtcgtaacggaaccgaagaaaccaagctcctggtgcttgacttcgacgtcgatatgaagtag

SEQ ID NO: 116783 - DNA, 1797 bp, Artificial Sequence
  Description of Artificial Sequence: Synthetic coding sequence
atggatgattatagcctggatgagttcaggcgccggtggcaggaggagttggcacaggcccaggccccaaaaaagcggagacgacccgaagccgcagagagacgggcacggcgccctgaagtgggtagtggccgcggtgaacaggccagtggggatcctgctctcgctcagaggctcctcgaaggcgccggccggcctccagcggctcgggcaactcgggctgaggggcaagacgtcgctagcaggtcgcgctcgcctctggctagggagggagccggcgggggggaacagctggtcgatcaacttatcagagatctcaatgagatgaatgacgtgccattctttgacatccagctgccctacgagcttgcgatcaatattttccagtatctggaccgcaaggaactgggccggtgtgcacaggtaagcaaaacttggaaggtgatagcggaggatgaagtgctgtggtaccgactctgccagcaggaggggcacctacctgacagtagcatttcggattactcatgttggaagctgatcttccaagagtgtcgggctaaagagcacatgctgcgtacgaattggaagaatagaaaaggcgctgtgtcagagctcgaacacgtgcctgacaccgtgctctgtgacgtgcactcacacgacggggttgtcattgcaggttatacctcaggcgatgtgagagtttgggatacccggacctgggactatgtggctccgtttcttgagtcagaggatgaggaggacgaaccgggtatgcagcctaatgtttcttttgtgagaattaattcgagtctggccgtcgcggcctacgaagatgggttccttaacatatgggatctccgtacaggcaaatatcccgtgcaccggttcgaacacgacgccagaatccaggccctcgccctgtctcaggatgacgcaaccgttgctactgcaagtgccttcgacgtggtgatgctatcacccaacgaagaaggctactggcaaatcgccgccgaatttgaggtgcccaagctagttcagtacctggagattgttcctgagaccagacgctatcccgtcgctgtggcagccgccggagacctgatgtatctgctgaaggccgaagactcagcccgaactctcttgtatgcccatgggccacccgtcacctgtttggatgtctccgccaatcaggtggcctttggagttcagggcttaggctgggtttatgagggaagcaagattttggtttattctcttgaagccgggcggcggttgcttaagcttggaaacgtgctgagggatttcacttgcgtaaacttaagtgatagtccacccaacttgatggtaagcggcaacatggatggaagggttcgcatccatgatctgcgcagcggtaatattgccttgagcctgagtgctcatcaactgcgggtctctgccgtgcagatggacgattggaagatcgtatcgggaggcgaggaaggactcgtatcagtgtgggactaccgcatgaatcagaagctgtgggaggtgtactctggacaccccgtccaacacatctcgtttagtagccattctctgatcactgctaacgtcccctaccagactgtcatgagaaacgccgatctagattcgtttacaacgcatcgtaggcaccgagggctaattcgagcctatgaatttgccgtcgatcagctggccttccaaagtccgctacctgtgtgtcgaagcagttgtgacgccatggccactcattattacgatctcgccctcgcgtttccatacaaccatgtatag

SEQ ID NO: 116784 - DNA, 1599 bp, Artificial Sequence
  Description of Artificial Sequence: Synthetic coding sequence
atggatgactacagtttggacgaattcagacggagatggcaggaggagctggcccaggcacaggcccctaaaaagaggcggagacctgaagctgccgagcgccgggcacggcgtcccgaaaacgaaatgaacgatgtgcctttctttgatatccagctgccgtacgagctcgcaatcaatatcttccagtacctcgataggaaggaactaggcagatgcgcccaggtgagtaagacatggaaagtcattgccgaagacgaggtcctctggtacagactgtgtcagcaggagggccacttaccagactccagcatcagcgactattcctgctggaaattaatcttccaggaatgccgagctaaggaacacatgctgagaaccaattggaaaaaccggaagggcgccgtgagcgaacttgaacacgtccccgataccgtgttatgtgacgttcatagtcacgacggcgtagtgattgctggatacaccagcggtgacgttcgggtgtgggacacccggacctgggattatgttgctcctttcctggagtctgaggatgaagaggacgaaccaggcatgcaacctaatgtgtcgtttgttaggattaatagtagcctggcagttgccgcttatgaggacggttttctcaatatctgggatctgaggactgggaagtacccggtccatcggttcgaacacgatgctcggatacaggccctggcacttagccaggatgacgctactgtggccactgctagcgcattcgacgtggtgatgctctcccctaatgaagaaggttattggcagattgccgcagaatttgaagtacccaaactcgtccagtacctggagatcgtgccagagacacgccgctatcccgtggccgtagcagcggccggcgacttaatgtacctcctcaaagccgaggactccgcccgcactctcctgtacgctcacggcccccccgtgacatgcctcgacgtatccgctaaccaggtggccttcggcgtgcagggcctcggttgggtgtatgagggttctaagattcttgtatacagcctggaagcagggcgaaggctgctgaagctaggaaatgtgttgagagatttcacctgtgttaacttgtctgacagcccgcccaacttgatggtctcggggaacatggacggtcgggtgcggatccacgatctgaggtcagggaatattgccttaagtctgtcagcgcatcagcttcgtgtgtcagccgttcagatggatgactggaaaatcgtgtcaggcggggaggaggggctggtgtctgtctgggactacagaatgaaccagaagctgtgggaggtgtattctggacatccagtgcagcacatctcatttagcagccattccctcataaccgcgaatgtaccctaccaaaccgtgatgcgaaacgccgacttggactcttttacaactcatcgccgacaccgaggcctgattcgggcctatgagtttgctgtggaccagttagcatttcagtcccctttgcccgtttgtcggtcctcttgcgacgctatggctactcactactatgatcttgcgctggcatttccatataaccacgtgtag

SEQ ID NO: 116785 - DNA, 1599 bp, Artificial Sequence
  Description of Artificial Sequence: Synthetic coding sequence
atggacgactatagtttagacgagttcagaaggcgctggcaggaagagttggctcaggctcaagcccctaagaagcgacgccgaccagaagcggcggaacggcgcgcacggcgacctgagaatgagatgaacgacgtgcctttctttgacatccaattaccttacgagctcgccattaacatttttcagtacttggaccggaaggagctgggacgttgcgcccaagttagcaaaacttggaaggttatcgccgaggacgaggttctttggtatcggttatgtcagcaagaggggcacttaccagactcctccatatctgattattcttgctggaagctgatcttccaggagtgccgggctaaagagcacatgcttcgcaccaactggaagaatcggaagggggcggtttctgagcttgagcacgtgcctgacacagtgttgtgcgacgtccatagtcatgatggagttgtgatcgctgggtacacaagtggcgacgtgagagtgtgggacacacggacgtgggattacgttgccccattcctggagtctgaggatgaagaggacgagcctggcatgcagccaaacgttagctttgtgcgtattaattcttccctcgctgtcgctgcgtatgaggacggttttctaaacatttgggatctccgcactggtaagtatcctgttcacaggtttgagcatgacgcgagaatccaagctctagcacttagccaagatgacgccaccgtcgccactgcctccgcatttgacgtcgtgatgctttcaccaaatgaagagggctattggcagatcgcagcagagtttgaggtgcccaaactggtgcagtacctggagatcgtccctgagacacgaaggtatcccgtcgccgtggccgctgcaggggatctgatgtatttacttaaggccgaagatagtgctagaacactcctctatgcacatgggccccccgtgacctgcctggacgtatcagccaatcaggtggcgttcggagttcagggtctgggatgggtgtacgagggctctaagattctggtgtacagcttagaagccggtcggcggttacttaagctgggtaacgtgctgcgggatttcacctgcgtcaatctgtccgatagccccccgaatttgatggtgtcaggcaatatggacggcagggtgaggatacacgacctgcgctctggaaacattgccctgtctctgtccgctcatcagctgcgcgtatccgctgtacaaatggacgactggaagattgtgtcagggggcgaagagggcctggtctccgtttgggactaccggatgaatcagaagctatgggaggtgtatagcggccaccctgtccaacacatttccttttcgtcccactctcttatcacagccaatgtcccttatcagaccgtaatgagaaacgccgatcttgacagctttacaacccaccgcagacaccgaggattaataagagcatacgagtttgcagtggaccagctcgccttccagtcacctctgccggtatgtcggtcgtcttgcgatgctatggccacccattactatgacctcgcactagcattcccttataaccatgtctag

SEQ ID NO: 116786 - DNA, 2871 bp, Artificial Sequence
  Description of Artificial Sequence: Synthetic coding sequence
atggaggctggcgggctgcctctggagctctggaggatgattctggcatatctgcatctgccagacctggggcgatgttcactcgtgtgccgggcctggtacgaactgattctgagtttagactctaccagatggaggcagttgtgtctgggatgcactgaatgccgacacccaaattggccaaaccagcctgatgtagagcctgagtcttggcgggaagcctttaagcagcactacctggcatcaaagacttggaccaaaaacgcactggaccttgagagctcaatatgtttcagcctctttagaagacggagagagagacggacgctctccgttggtcccggtcgtgagtttgactcactgggtagtgcactggcaatggccagtctctatgaccgtattgtactattccctggcgtttatgaagagcagggggagataatccttaaggtaccagttgagattgtgggtcaaggcaaactcggcgaggtggcattgctggcaagtattgatcagcattgctccaccacacgcctgtgtaacttggtattcactccagcatggttctctccaatcatgtacaaaaccacaagcggccatgtgcagtttgacaactgcaactttgagaatggccacattcaagtgcacggccccggcacttgtcaggtgaagttttgcaccttcaagaatacccacatcttcctgcacaacgtcccactgtgtgtactcgaaaattgcgaattcgttggcagcgagaacaactccgtgactgttgagggccatccatctgcagacaaaaattgggcctacaaatatttgctcgggctcatcaaaagttcgccaactttcctgcccactgaggactctgacttcctgatgagcctggacctcgagagtcgcgatcaagcatggtctcctaagacttgtgatatcgtcattgaaggctcccagtccccaacaagccccgccagcagctcacccaagccaggcagcaaagctggatcccaggaggccgaagtgggctccgatggggagcgcgtggcacaaacacccgacagtagcgatggaggtctgtcaccaagtggggaggacgaggacgaggaccaactaatgtaccgtttgtcctatcaggttcaggggccccgacctgttctcggcggttcgttcctgggccccccactcccaggcgccagcatccagttaccatcttgcctagtcctgaattccctgcagcaagagctccagaaggataaggaggcaatggcgcttgccaacagtgtgcagggctgcttgatccgcaagtgcctgtttagagatgggaagggaggggtgtttgtctgttctcacggcagagcaaagatggagggaaacatatttcgcaatctgacctacgccgtgcggtgcatccacaacagcaaaattatcatgcttcgcaacgatatctacagatgccgagccagcgggatatttttgcgcctggagggcggcggtttgattgcagggaacaacatctatcataacgcggaagccggagtagacatccggaaaaaatcaaaccccttaattctttgtaatcagatccaccacgggttgcgaagtggcattgtggttctgggtaacggaaaaggcatcattcggaataaccagatttttagcaacaaagaggcagggatctacatcttataccacggcaaccctgttgtgtctgggaaccacatattcaagggccgcgctgccggcatagccgttaatgagaacgggaagggccttatcaccgaaaatgtgatcagggagaatcagtgggggggggtggatattcgccgaggaggtatacctgtgctgaggtctaatctgatctgcttcggatattctgacggcgtggtcgtcggggatgaggggaaagggctcatagagggaaataccatctacgcaaataaaggatgcggcgtgtggatgatgtcatccagtcttccacacgttactagcaaccacgtttcatataacggcctttatggggtcgcggtcttttcccagaaggacggcagcagcgaactgcccaggggacacagggctcaggagaatttctccgaagacggggacgccatattgtgggagacggaactcgagaaggaagacgacccactaagaaggccaataactattgccctcgtcgagagcaattccataaatcataatggggcctccgggctgtatgtgcagtcctctgaggccttgcatgtgatcactaacgtcatccatgctaacggcgacagaggcattaccgtggcccagtctagtcagcccaccagggtggctaacaacagcatcagttgtaacaggcagtccggggtaaaggtggaggcccaatgtaaggtggaactccggggcaatggaatctatgacaatagggggcacggaattataacaaaaggggattcaactattgtgatcgagaacgatatcattggtaacagagggtccggactccaattgctgccgagatctgacaccaaggtgataaagaaccgaattcattcattcagggcttatggcatcgccgttcggggcagggcaaaagccctcgttcaagagaacattatttttcaagggaaaacgagcaaaactatatttcagcagatctctaacaatcgggaatgcattatgcagaataacaagtttctagttttcaagaagaaatcagatacatggcgactcgtaaatccccccgctcgaccgcacctggagaatagtttacggcggcccagcgctgcacacaacggtcaaaaggtgacagcgatggctaccagaatcacggcgcgggtagaaggggggtaccacagcaatcggtcagtcttttgcactatactttag

SEQ ID NO: 116787 - DNA, 216 bp, Artificial Sequence
  Description of Artificial Sequence: Synthetic coding sequence
atggaggctggtggtctgcctctcgagctctggcggatgatcttggcctaccttcacttgccggatcttgggcgttgtagcctcgtgtgtcgggcttggtacgaactcattctgagcctagacagcactagatggagacagctatgtttaggttgcaccgagtgtcggcacccaaactggcctaaccaacctgatgtggaacccgagtcctggtag

SEQ ID NO: 116788 - DNA, 1446 bp, Artificial Sequence
  Description of Artificial Sequence: Synthetic coding sequence
atgctgagaaacgacatatatcgctgtagggcctccggaatatttctgcgattggaaggaggagggcttatcgcgggaaacaatatctaccacaatgcagaagccggtgtggacattcgcaaaaaaagtaatcccctgattctctgcaaccaaattcatcatgggctgaggtcggggattgtcgtgctgggcaatggtaaaggcatcatcaggaataaccaaatcttcagcaacaaagaggccggaatttatattttgtaccacggcaacccagtggttagtggaaatcacatctttaagggccgtgcagccggaatcgctgtgaacgagaatgggaaggggctgatcacagaaaatgtgattcgagagaatcaatggggcggggttgacatcagaagaggcggaatacctgtgttaagatcgaatttgatctgttttggctactctgatggggtggtggtgggcgatgagggcaagggcttgatcgaaggcaacacgatctatgccaataaggggtgtggcgtctggatgatgtccagctccctgccccacgtgacgtccaatcacgtgtcctacaacggtctgtatggcgtggctgttttctcacagaaggatgggagcagcgaactgcccagaggacacagggctcaggagaattttagcgaggatggagacgccatactctgggagaccgaactggaaaaagaggatgatccactgaggagacccattaccatagcacttgtggagtccaatagtattaatcacaacggggctagtggcctttatgttcaatccagtgaagcgttgcacgtaataaccaatgtgatccacgccaatggtgaccgcggaatcactgttgcccagagctcacaaccaactcgcgtcgccaataactctatcagctgtaatcggcagtcaggggtgaaagtggaagctcagtgcaaagtggagctccgcggcaatggcatttatgacaatcggggtcatggaattatcacgaagggagactccacaattgtaattgagaacgacattattggcaatcgcggctccggcctgcagctgttgccccgtagtgatacaaaagtgattaagaataggattcactcttttagagcttacggaattgccgtgcgcggacgagctaaggccctcgttcaagaaaacatcattttccaggggaaaactagcaagacgatattccagcagatctctaataatcgagagtgtatcatgcagaataataagtttttggtgtttaagaagaagagcgatacctggcgactcgtaaatccgcctgcccggccccacttagagaatagtctccggcgacctagcgccgcccataatggccaaaaggttactgctatggccacccgtatcacagcgcgcgtggaaggggggtatcacagtaaccggagcgttttctgtacgattctctag

SEQ ID NO: 116789 - DNA, 2532 bp, Artificial Sequence
  Description of Artificial Sequence: Synthetic coding sequence
atggtagctgaggagtccggacccggggcacagaacagcccttaccagctcagacggaagaccctcttacctaagcggactgcctgtccaaccaaaaatagcatggaaggagcgtcaacaagcacgacagagaattttggtcacagagcaaaacgcgcacgcgtgtctggaaagtcccaggacctgtccgcagcccccgccgaacagtatctccaggagaagctgcctgatgaggttgtgttaaaaatcttctcctacctcctggagcaggatctctgcagagccgcctgtgtgtgcaaacgtttttctgagcttgccaatgaccccattctctggaagcgcctgtatatggaagttttcgagtatacccgcccaatgatgcaccctgagccaggcaaattctatcagatcaatccagaggaatacgagcaccctaacccctggaaggaatccttccagcagctgtacaaaggagctcatgttaaacctggcttcgcagagcacttttatagtaaccctgcccgctataagggccgagaaaatatgctgtactatgatactattgaggatgcactcgggggagtccaggaggcccacttcgatggtctcatttttgtacattccggaatctacacggacgaatggatttatatagagtcccctatcacgatgatcggggccgcacccgggaaagtagctgacaaggtgatcatcgagaatacccgagattcaacctttgtattcatggaaggttccgaagatgcctacgttgggtatatgaccattcggttcaaccccgacgataagtcagcccagcatcacaatgcccatcattgcctggagatcaccgtgaattgctcccctatcatcgaccactgtattatccgctccacatgtacggtgggctctgcagtgtgcgtgtctggtcagggcgcttgccccaccattaagcactgcaacatttctgattgcgagaatgtcggattatatatcactgatcatgcccaggggatctatgaagacaacgaaatctccaacaatgctctcgcggggatttgggtaaaaaaccatggtaatccaattatccgtcggaaccatatccaccacggcagggatgtaggcgtgtttacctttgaccatggcatgggttatttcgagagttgcaacattcacagaaacagaatcgcaggttttgaggtgaaggcttatgccaatccaactgttgtccgctgtgagatacatcatggccaaaccgggggcatatatgtacacgaaaaaggacgtggacagttcattgagaataagatctacgccaacaactttgccggcgtgtggatcacatcaaattccgacccaactattcgtggtaactccatcttcaatggtaaccaggggggcgtgtacattttcggcgatggacggggactcatcgaagggaacgatatatacgggaacgcactggcaggcatacagattagaaccaacagttgtcctattgtgaggcataataagatccatgatggacaacacggcggtatctatgtccacgagaagggtcagggtgtgattgaggagaacgaagtgtattccaatactttggcgggggtctgggtaaccaccgggagcaccccggtactgcgcagaaacagaatccactccggcaaacaggtgggagtttatttctacgacaatgggcacggtgtgctcgaggataatgacatttacaatcatatgtatagcggcgtccagattagaaccggctcaaatcccaaaatcagacggaataaaatctggggagggcagaacggcgggattttagtgtacaactccgggctgggatgcattgaggataatgagatattcgataacgccatggctggagtgtggattaagactgattccaatcctacactgagaaggaataagatccatgatgggagagacggggggatttgcatttttaatggcggtcgcggtttgctcgaggaaaacgatatctttaggaacgcacaggccggtgttttgatctctaccaatagccatccaatcttgcgaaaaaacagaatcttcgacggtttcgccgctggaatcgagataacaaaccacgccactgctacgctggaaggcaaccagatatttaacaacaggtttggtggcttattcctggcgagtggagtgaatgtgacaatgaaagacaataaaattatgaacaaccaggatgccattgaaaaggccgtatcaagaggccagtgtctttataaaatcagtagttacacttcatatcctatgcacgatttttataggtgtcatacctgtaacaccactgacaggaatgctatatgtgtaaactgcattaagaagtgccaccagggccacgacgtggaattcatccgccatgaccgctttttttgcgattgcggggctggtacactgtcgaatccttgtaccctggcaggtgaacccacccacgataccgacaccctctacgacagtgcacctcccattgagtctaacacactacaacataactag

SEQ ID NO: 116790 - DNA, 282 bp, Artificial Sequence
  Description of Artificial Sequence: Synthetic coding sequence
atggagggcgcctccacttctaccacagaaaactttggacaccgggctaaacgggcacgcgtcagtggaaaatcacaagatctgtcggctgcccctgcggaacagtacctgcaggagaagttaccggacgaggtggtgctcaagatatttagctatctcctggaacaagatctgtgtcgagctgcctgcgtatgtaagaggttttctgagctcgccaacgaccctatcctatggcttggcgaagttgcccacgcctacaacccttcaacactgggaggctag

SEQ ID NO: 116791 - DNA, 2532 bp, Artificial Sequence
  Description of Artificial Sequence: Synthetic coding sequence
atggttgcggaggaatcaggccccggggcgcagaactcaccatatcaactgaggcgaaagacattgcttcctaaacggactgcgtgtcctaccaaaaactctatggaaggcgcctccacttcaactacagaaaacttcgggcacagggccaaacgagcacgggtgtctgggaagtctcaggatctgtcagctgcgcccgcagaacagtatttgcaggagaaactgcctgatgaagtggtgctgaagattttctcctatctcctggagcaggatctgtgccgggccgcttgcgtctgcaaaaggttctccgagctggccaacgatcctattctctggaagaggctgtacatggaagtttttgagtacacaaggcccatgatgcaccctgaacctggaaaattttaccaaatcaatcctgaagaatacgagcatcccaatccgtggaaagaatccttccagcaactctacaagggagcccacgtgaaaccgggcttcgctgagcacttttattccaaccctgctcgttataagggccgtgaaaacatgctttactacgatactattgaggacgctctggggggggtgcaggaggctcacttcgatgggctgatcttcgtgcactctggaatctataccgatgaatggatatatattgagtcccctatcacgatgataggtgcagcccccggaaaggtggcggacaaggttatcattgagaacaccagagactctacatttgtgttcatggagggatctgaagatgcgtatgtgggctacatgactatcaggttcaatccagacgataagagcgcccaacatcacaacgcgcatcactgcctcgagatcacagtgaattgttctccaatcatcgatcattgtattattagatccacctgtaccgttggctctgccgtgtgtgtgtccgggcagggggcatgcccaacaattaagcattgcaacatttcagattgtgaaaatgtggggctgtatataaccgatcacgcccaaggcatttacgaggataatgagatttcgaacaacgcattagcaggcatttgggtcaaaaaccacggtaacccaatcatacgcagaaaccatatccaccacggaagagacgtaggggtgttcaccttcgaccacggcatggggtatttcgagtcttgtaatattcataggaacaggattgcgggttttgaagtaaaggcttacgctaacccaactgtggtgaggtgcgagatccatcatggccagaccggcgggatatacgtacacgaaaaaggcaggggacagttcatagagaacaagatttacgctaacaactttgctggcgtgtggattacaagtaacagcgacccgactatccgggggaacagcattttcaacggcaaccagggcggcgtctatattttcggcgatggtaggggactgatcgaaggtaatgacatttacggcaacgctcttgcaggaatccagattagaaccaactcttgccctatcgtgaggcacaacaaaatccacgacggtcagcacggcggcatttatgtccacgagaagggccaaggggtcatcgaggagaacgaagtgtacagcaataccctcgccggagtgtgggtgaccacaggctctactcccgttctccgtcggaatcgcatccattccggaaagcaggtaggagtgtacttttatgataatggacatggagtgctcgaagataatgacatttacaaccatatgtactccggagtacagatacggactggaagtaatcccaagatcagaaggaacaagatttggggcgggcagaatggtgggatcctggtttataactccggactcggatgcattgaggacaatgaaatctttgacaacgccatggctggcgtctggattaaaacggactccaatccgacccttcgcagaaataagattcatgacggcagggacgggggtatatgcattttcaacggcggccggggattactggaggaaaacgatattttcaggaatgcacaggctggagttctcatctccacgaattctcaccctatccttcgcaaaaaccggatcttcgatggctttgccgcgggcattgagattactaatcatgctacagccactcttgaaggcaatcaaatcttcaacaatcgattcgggggactttttctggcgtcaggcgtgaatgtaacaatgaaggataataaaattatgaataaccaggatgccattgaaaaggctgtcagcaggggacaatgcctttataagatcagctcttacacgtcttaccctatgcacgacttctatagatgtcatacttgcaatactactgatcgtaatgctatttgcgtcaattgtatcaagaagtgccaccagggacatgacgttgaattcattcgccatgaccgctttttttgcgactgtggtgcggggaccctgagcaatccatgtacccttgccggtgagcccacccatgataccgacacactgtatgacagtgccccaccgatcgaatcaaacactcttcagcacaattag

SEQ ID NO: 116792 - DNA, 2784 bp, Artificial Sequence
  Description of Artificial Sequence: Synthetic coding sequence
atgaattccgttagggctgcaaatcgccgccctcgaagggtgtctaggcctcgaccagtgcagcagcagcagcaacagccgccacagcagccgccacctcagccacctcagcaacagcctcctcaacagcaacctccacctcctcctcagcaacaacaacaacagcagccgccaccaccccctccaccaccgccacccttaccacaggaacggaataacgtaggcgagcgagacgacgacgttccagcagacatggttgccgaagaaagcggccctggagcacagaactccccttaccagctgcggaggaagactctgttgcccaagcggaccgcatgccccaccaagaatagtatggagggagccagcacaagcacaaccgaaaactttggccaccgcgctaagagagccagagtgtctggaaaaagtcaggacctctctgcggcaccagcggaacagtacctgcaggagaagcttccagacgaagtggtcttaaaaattttttcctacttgctggagcaggatctatgccgggctgcctgcgtttgcaaacgcttcagtgagttggccaacgatcctatactgtggaagcggttgtatatggaggtcttcgaatatacccggcctatgatgcacccggagcctggaaaattttaccagataaacccggaagagtacgagcatccgaatccttggaaagagtccttccagcagctctacaaaggagcccacgtgaagcccggcttcgcagaacacttctactccaaccctgcccgttataaggggcgcgagaatatgctgtactatgacaccattgaggacgctttgggcggcgttcaagaagcacattttgacggtttgatatttgtgcacagtgggatctataccgacgaatggatctacatcgaatctcctattactatgataggagccgctcctggtaaggtggcagataaggtcataatcgagaacacccgcgacagcactttcgtctttatggaggggtcggaggatgcgtacgtaggttacatgaccatccgttttaatccggatgataaaagcgcgcagcatcacaacgcccaccattgcttggaaattacagtcaactgtagtcccatcatcgaccactgcattatccggagcacttgcaccgtgggtagcgccgtctgcgttagtgggcagggcgcctgccccacaataaaacactgcaatatctccgattgtgagaacgtggggctgtacattacagaccatgcacaggggatttacgaagacaatgagatctccaacaacgccctcgcaggcatctgggtcaaaaaccacgggaaccccatcattcgccgaaatcacatccaccatggacgggacgttggcgtgttcaccttcgaccacggtatgggatactttgaatcttgtaatattcatcgaaacaggatcgcgggcttcgaagtaaaagcctatgctaaccccactgtcgtcagatgcgaaattcaccacggacagactggcgggatctacgttcatgaaaagggacgcgggcaattcatcgagaacaagatttacgcgaataatttcgcgggtgtgtggatcacctctaacagcgaccccacaatccgtggcaattcgatctttaatggcaatcagggaggcgtctacatcttcggggatggtcgggggttgatcgaaggtaacgatatttacgggaatgcactcgccggtattcaaatccgcaccaatagctgtcctatcgtgcgacataacaagatccacgatgggcagcatggtggcatttatgtgcatgaaaaaggccagggggtgatcgaggagaacgaggtctactccaacacactcgctggggtgtgggttaccaccggatctactccggttctccggcggaacaggatccattccgggaaacaagtgggcgtctatttttacgataatggccatggcgtcctggaggataatgacatttataaccacatgtactcaggggtgcagatcagaactggctccaaccccaagattcggcgcaacaaaatttgggggggccagaatggtggcattttggtatacaattctgggctgggttgcattgaagataacgaaatctttgataatgcaatggcgggtgtgtggatcaaaaccgactcaaatcctacactccgcagaaataaaatccacgacggtcgggatggcggaatttgtatctttaatggcggcaggggcctgctcgaagaaaacgacatctttcgcaacgcacaggctggcgtcctaatttctacgaactcacaccctatcctgcggaagaatcggattttcgatgggttcgctgcaggtattgaaattaccaatcatgcgactgcgaccttggagggcaaccagatttttaacaatcgatttggcggcctgttccttgcatctggagttaacgttacaatgaaagataacaagatcatgaataaccaggacgctatcgagaaggccgttagccgtggccagtgcctgtacaagataagtagctatacgagctaccccatgcacgacttctaccggtgccacacatgcaataccaccgaccggaatgctatatgtgtcaattgtataaagaaatgccatcagggacatgacgtcgaattcatcaggcatgatcgctttttctgcgattgcggcgctggtactctgtccaacccatgcacgctggcaggcgagcccacacatgacaccgataccttatatgacagtgcgcctccaatcgaaagcaataccctgcagcacaattag

SEQ ID NO: 116793 - DNA, 1056 bp, Artificial Sequence
  Description of Artificial Sequence: Synthetic coding sequence
atggagatcaaggaggagtttacctctctggtcatggatgaagctctactgaaagagatgacctttatgcacgaaaagggccagggggtgatcgaggaaaatgaggtatacagcaacacccttgccggcgtgtgggtgactaccggaagcactcccgtacttcgacggaacaggattcactctggcaagcaagtaggggtctacttttacgataacggacacggtgtgctggaggacaatgatatctataatcatatgtactccggagttcaaatccgtaccggctccaaccccaagattcggcggaacaagatttggggcggacagaacggtggcattctggtttacaactccgggttggggtgcatagaggataacgagatctttgataatgccatggcgggtgtctggatcaaaacagactccaacccgacactccggcggaacaagattcacgacggcagggacgggggcatctgtattttcaacggtggccgagggttactggaagagaatgatattttcagaaacgcccaggctggagtgctgatatcaaccaactctcatcccattctcagaaagaaccgcatcttcgatggtttcgcggccggaatcgagattacaaatcacgccactgcaacactggagggcaatcagatctttaataaccggtttgggggcctatttcttgcgtccggcgtgaacgttaccatgaaagacaacaaaatcatgaacaaccaggacgccatagagaaggccgtgtcacggggccagtgcttgtacaagatctccagctacacatcgtaccctatgcacgacttctaccggtgccacacctgcaacactaccgacagaaacgctatttgtgtgaattgcatcaaaaagtgtcaccagggccatgacgttgaattcataaggcacgatcgttttttctgcgactgcggggccggaacgttgagcaatccatgcacccttgcaggcgaacctacccacgatacagacaccctgtacgatagtgccccacccattgagtctaatactctgcagcacaattag

SEQ ID NO: 116794 - DNA, 1305 bp, Artificial Sequence
  Description of Artificial Sequence: Synthetic coding sequence
atgccatctgagattctactgaaaatattcagctacctcgatgctgtgagtctactctgtactggatgcgtctctaggcgattttaccatctcgctaacgacaacttcatttggatcggtatctacagcactgctttctcacccgccagaagtaattggaagttcaattcagttgagaagatcgcaatgagtatgagtttcctttctgtgcaagataaagaagccgggtattggaaaaaggagtatatcacaaaacaaatcgcctctgtgaaggcggcccttgctgatatcctaaaacccgtgaatccatacactggactccccgtaaaaactaaagaggctcttcgaatcttcgggttgggatgggccatcatcctgaaagagaagggtggaaaagagtatatcatggaacacgttgaccttagtatcaacgatacatctgtcacggtcatatggtatggtaaaaaatggccctgcctggccagtctgagcactctcgatttgtgtgggatgactccagttttcaccgactggtataagaccccaaccaaacacagactgcgatggcacagcctcatcgccaaatataatctgagccacctgacaattagtaccatgatcggctgtgataggctgattagaatcttctgtttacaccccggactactagtcggtgtgtggaaaaaagaagaggagcttgccttcgtaatggctaatctccatttccatcaccttgtggagcgaagcaccctcggctccgcgactatcccctacgagttacccccccacagcccatttctcgacgatagccccgagtatgggttgcacggttaccagctacacgtcgacctgcattcaggtggagtcttctatctgtgtggtacgttcaggaacctttttactaagcggggcaatatagagaacggacacgtgaaattgatagtcatacacctgaagaataacagagagcatctgcctttaataggcaaggtcgggttatcttggaaaactgatatcttcgatggctgcatcaagagctgcagcatgatggatgttacgttgctggacgagcatggtaaaccattctggtgcttcagcagcccagtgtgcctgcgaagtcccgccacacccagcgattcttctagttttttgggacagacttacaacgtggactacgtggacgccgaagggagagtccacgtggaactggtgtggatccgagaaaccgaggagtatctgatagtcaaccttgtgttgtatttgtctattgccaaaatcaaccattggttcggaacggagtattag

SEQ ID NO: 116795 - DNA, 1533 bp, Artificial Sequence
  Description of Artificial Sequence: Synthetic coding sequence
atggctaccggtagagggcggatcttacagcagcactggctaggactgcagacactgagggggccctctcggggcggcggagctgcccgaggaagagctcgggcgttcggctgccgcaagggtccgggggtgaaactatccgctggatccgcggccttgcggtgccacgcaggcggaggacagcattgggagtcttccttcagctgttgctctggatttttagacgggatgcccagtgagatcctgctgaaaattttctcatatctggatgctgttagcttgttatgtacgggttgcgtgagccgccgcttctaccacctggctaacgacaactttatctggattggaatatatagtacagcttttagccccgcacggtccaattggaagtttaatagcgtggagaaaatagctatgagcatgtcatttctgtcagtgcaagacaaagaggccggatactggaaaaaagaatatattaccaaacagatagcctcagtgaaagctgctctggctgacattctcaagcctgtcaacccatacaccgggctgccagttaaaacaaaggaagccttgagaatatttgggctggggtgggcaataatcttaaaggagaaggggggcaaagagtatatcatggagcacgtcgatctgagcatcaatgacacttcggtcaccgtgatctggtacggtaaaaagtggccgtgtttggcatcactttccaccttagacctatgcgggatgacacctgtgtttacggattggtacaagaccccaactaagcacagactgcggtggcattctctgatcgctaaatacaacctgtctcacctgacgatctctactatgatcggttgcgaccggctgatcaggatcttttgcttacatcccggactgctggtgggggtctggaaaaaggaagaggagctcgcattcgtgatggccaacctccactttcatcacctggtcgaacggtctacattgggctccgcgactatcccttatgaactgccaccacactcaccgttcctggatgactcaccagagtacgggctgcacggttatcagcttcacgttgatctgcacagcgggggcgtcttttacctttgcggtacattcaggaatctgtttaccaagagagggaatattgagaacggacacgtgaagctgatagttatccacctcaagaacaaccgagagcacctgccattgatcgggaaagtggggctgtcgtggaaaaccgacatattcgacggctgtatcaagtcatgttctatgatggatgtgacattactggacgaacacggtaagcccttttggtgtttctcctcccccgtctgtctgcgctcccccgctactccctccgatagcagtagttttctgggtcagacctataacgtagattatgtcgacgctgagggccgcgtgcatgttgaactggtctggataagggagactgaggagtacttgatcgtgaacttggtgctgtacctgtccatcgcaaagataaaccactggttcggcactgagtactag

SEQ ID NO: 116796 - DNA, 879 bp, Artificial Sequence
  Description of Artificial Sequence: Synthetic coding sequence
atgatggcatttgcccctcccaagaatacagacggtcccaaaatgcaaactaagatgtcaacatggacacctctgaatcatcagctgcttaacgacagggtgtttgaggagagacgcgccctacttggaaagtggttcgacaaatggacagacagccaacgacggcgcattctaacagggctgctcgagagatgctcgcttagccagcagaagttttgttgcagaaaactccaggagaagattccagctgaggccttggattttactacgaagcttccaagagtcctgagcctgtacatcttttccttcttagacccccgtagcctgtgcagatgtgcgcaagtctgttggcactggaagaacctggctgagctggatcagctgtggatgcttaaatgtctcagatttaattggtacatcaacttctccccaactccctttgaacagggcatctggaaaaagcactacatccagatggtgaaggaattacacattacaaaaccaaaaacgcctcccaaagacgggttcgtcatcgccgacgtccagttagtcacgtccaacagtcccgaggagaagcaatctcccctctcagcgtttagatccagctcttcactgaggaaaaaaaacaattccggcgagaaggcattacccccctggagatcatctgacaaacaccccaccgacattatcagatttaattacttggacaatagggacccaatggagaccgttcagcaagggagacgaaagaggaaccagatgaccccggacttttcacggcagagccacgacaaaaaaaacaaattacaggacagaacccggcttaggaaggcacaatcaatgatgagtcggcggaacccctttcctctgtgtccctag

SEQ ID NO: 116797 - DNA, 891 bp, Artificial Sequence
  Description of Artificial Sequence: Synthetic coding sequence
atggacggagatggcgacccagagtccgtgggtcagccagaggaagcctccccagaggaacaacctgaggaagcaagcgccgaggaggagaggcccgaggaccaacaagaagaggaggccgctgccgccgccgcatacctggatgaactgcctgaaccgttactcctgagagtgttggctgccctgcctgccgcagagttggttcaggcctgccgcctggtgtgtctaagatggaaggaactggtcgacggcgcgcccctgtggctgcttaagtgtcaacaggaagggctcgtacccgagggcggtgtggaggaggagcgggaccattggcagcagttttactttcttagcaaaaggcggagaaatctgcttcggaatccatgtggggaggaagatctcgaggggtggtgtgacgtcgaacacggtggcgacgggtggagagtggaggaactcccaggcgactcaggagtcgagttcacccatgatgaaagcgtgaaaaagtacttcgccagctcctttgagtggtgcaggaaggcccaggtgattgacctccaggccgagggctattgggaggagctgctggacaccacccagcccgctatcgtggttaaagactggtacagcggacgctccgacgccgggtgtctgtacgaattaacggtgaagcttcttagtgaacacgagaatgtccttgcagaattttcctcagggcaggtggcagtgccccaggattctgacggaggcgggtggatggaaatttctcatacttttaccgattacggtcctggcgtgcggttcgtgagattcgagcacggcgggcaggactccgtctattggaagggctggtttggggctcgcgttactaatagctcagtgtgggttgagccctag

SEQ ID NO: 116798 - DNA, 594 bp, Artificial Sequence
  Description of Artificial Sequence: Synthetic coding sequence
atggacggcgatggggaccctgaatccgtgggtcaacccgaagaggctagccctgaggaacagccggaagaagcttccgctgaagaagaaagacccgaggatcaacaagaagaagaagcggcagctgctgccgcgtacctcgatgagctgcccgagccgctccttctgagggtacttgcagcactacccgcagccgaactggtgcaggcctgccggttggtgtgcctcaggtggaaagagctcgtagacggagcacctctgtggctccttaagtgccagcaggagggcttggtgcccgagggcggtgtagaggaagagcgcgatcattggcagcagttctattttttatcgaagagacggcgcaatcttctaaggaatccatgcggcgaggaagatctcgaggggtggtgcgatgtcgagcatgggggagatgggtggcgggtggaggaattaccaggggacagcggggtggagtttacacatgatgagtctgcccccgtgctgccaggcggagtggctaaacacagaggcctccttggcggggccgcaggccacgattcggccggccaccgcggcgagggcctcgtgaggtag

SEQ ID NO: 116799 - DNA, 1614 bp, Artificial Sequence
  Description of Artificial Sequence: Synthetic coding sequence
atgaaacactactcaccgacggattatgtgaactggctggaggagtataaggtcaggcagaaagccggcctggaggcaagaaagatcgtcgcgtcttttagcaaacgattcttctcggaacacgtgccatgcaatggctttagtgacatagaaaacttagaggggcctgagatcttttttgaggatgagcttgtgtgcatcctgaacatggagggaagaaaggcgctcacctggaaatattacgctaaaaagatcttatattatctccgacagcaaaaaatcctgaacaatctgaaagcctttttgcaacagccagacgattacgagagttatctcgagggggccgtgtatatagaccagtactgtaatccactgagcgacatttctttaaaggacatccaagcacagattgactcgatagtggagctagtctgtaagaccttacgagggatcaactccaggcacccttccttggcatttaaagctggagaatcgagcatgattatggagatcgagcttcagagtcaggtgctcgacgcgatgaattacgtcctgtacgaccaactgaagttcaaggggaataggatggactattataacgcactgaatctgtatatgcaccaggtccttatccgcagaacaggcataccaatctccatgtcattgctctatcttacgatagcaagacaactgggggttcccctggagccggtgaatttcccaagtcatttcctcctccggtggtgccaaggcgctgaaggagccactctggatatcttcgattatatctacatcgacgcatttgggaagggtaaacagctcacagtgaaagagtgcgagtatctaatcggacaacacgtgaccgccgctctgtatggggttgtgaacgtcaaaaaagtgttgcaacgcatggttgggaaccttctttcccttggtaaacgtgagggaatcgaccagagctaccagctgctcagggactctctcgatctctacctcgccatgtaccctgaccaagtgcagcttctgctgctgcaggctcgattgtatttccacctgggcatctggccagagaaagtactcgacattttgcagcacatccagaccttggatcctggccaacatggcgccgtaggctacctggttcagcacacactcgagcacattgagaggaaaaaagaagaagtgggcgtggaggtgaaactgcgatccgacgaaaagcacagagacgtgtgttatagcattggactgatcatgaaacacaagcggtatggttacaattgtgtgatttacggctgggatcctacttgtatgatggggcacgaatggatccgcaatatgaatgtgcacagtcttcctcacggccatcaccagcccttttataatgtcctggtggaggacggctcatgccggtacgcagcccaggagaatcttgaatataatgtggaaccacaggagattagccatcccgacgtgggcagatacttctctgagttcaccggcacacactacatccctaatgcagagctggaaatccgataccccgaggacctggaatttgtgtacgagactgtccagaatatctattccgccaagaaagaaaatatcgacgagtag

SEQ ID NO: 116800 - DNA, 1887 bp, Artificial Sequence
  Description of Artificial Sequence: Synthetic coding sequence
atggccgccgctgccgtcgacagcgcaatggaagtcgtgcccgccttagcagaggaggccgcgccagaggtagcgggcctatcttgtctcgttaaccttcccggcgaggttttggaatacatcctgtgttgtggcagtctgacggcggcagatatcggtcgcgtgagctcgacctgccggaggctccgggagctctgtcagtctagcggtaaggtgtggaaagagcagtttcgtgtcaggtggccctccctgatgaaacattacagccccaccgattatgtgaactggctggaagagtacaaagtgaggcaaaaggctgggctggaggctaggaaaattgtggcctctttctccaaacgtttcttcagcgagcacgtgccctgcaacggattttccgacatcgaaaaccttgaggggcccgagatttttttcgaggacgagctggtctgtatattaaacatggaggggagaaaggccctgacctggaagtactacgccaagaagatactgtattatctgcggcagcagaagatcttgaataacctgaaggcttttttgcaacaacctgatgattatgaatcatatctcgaaggcgctgtttatatcgaccagtactgtaatccactaagtgatatcagcctcaaggatatccaggcccaaatcgactcgatcgtggaactcgtatgtaagacccttagaggtataaactccagacacccatcccttgcctttaaagctggtgagagttcaatgatcatggaaattgagctgcagtcccaagtgttggacgcaatgaactacgttctctatgaccagctgaagttcaagggcaacaggatggactactataacgcactcaatctatacatgcaccaggtcctcattaggaggaccgggatcccgatatccatgtccctactgtatctcacaatcgcccgacagctgggagtcccacttgagcctgtcaatttcccctcccatttcttgctccggtggtgtcagggcgcggagggagcaaccctggacatctttgattatatttacatagatgcatttgggaagggaaaacagctcacagtcaaagaatgtgagtatctgattggtcagcacgtgacagccgccttatacggggtggtgaacgtgaagaaagtcctgcagcggatggtaggaaacctgctctctcttggcaaacgagaagggatcgatcagagttaccagctgctgcgcgattctttagatctgtatcttgcaatgtatccagatcaggtccagctgctgctccttcaggcaagactgtatttccatctcggcatatggccagaaaagagcttctgcctggtgttaaaggtactggacatactacagcatatccagaccctggaccccggccagcatggagcagtaggctacttagtgcaacacaccttggaacatatcgaacgcaaaaaggaggaagtgggagtggaggtgaagttgaggtcagacgaaaagcacagggacgtgtgctatagcatcggattgattatgaaacataagagatacggttataactgcgttatctacggctgggatcccacctgtatgatgggacacgagtggatccggaatatgaatgtacatagcttaccacacggacaccatcagcctttctacaatgtacttgtggaggacggttcctgtcggtacgcagctcaggaaaacctggagtataacgtcgaaccccaggaaatctcccatcctgatgtggggcggtactttagtgaatttacaggcacccactacatacctaacgctgaattagagatcagatatccagaagacctcgagtttgtctacgaaaccgtccagaacatatatagcgccaaaaaagaaaatatagatgaatag

SEQ ID NO: 116801 - DNA, 1866 bp, Artificial Sequence
  Description of Artificial Sequence: Synthetic coding sequence
atggcagcagctgcggttgacagcgccatggaagtggttcctgccctggccgaggaggcagcacccgaagtggcagggctatcctgcctggtaaacctacctggagaggtcctggaatatatactttgttgcggtagcttgactgctgctgacataggacgcgtgtcgtctacatgtcgccgcctccgggaactttgccagtcttcggggaaagtgtggaaagagcaattccgtgtacggtggccaagcctcatgaagcattatagcccaaccgactacgtgaactggctggaggaatataaggttaggcaaaaggcaggactcgaggcacgaaaaatcgtggccagcttttctaaaagattcttcagtgagcatgtgccctgtaacggattctcggacatagaaaacttggagggtcctgaaatatttttcgaagacgaacttgtgtgcatccttaatatggagggaaggaaagctctcacctggaaatactatgctaaaaaaattctgtactatctgcggcagcagaaaattctgaataacttgaaagcattccttcagcagccggacgactatgagagttaccttgagggggctgtctacattgatcagtattgtaatcccctcagtgatatctctctaaaagatatccaggcacagatagactctattgtggagttagtatgtaaaactttaagaggtattaatagcagacacccatccctggccttcaaggcaggcgaatccagcatgataatggaaattgagctccaatcccaggtcctcgatgcaatgaactacgtcctgtatgaccagctcaagtttaaaggaaataggatggactactacaacgccctcaacctttatatgcaccaggtccttatcaggcgcacaggtattccgataagcatgtcccttctatacctaaccatcgcccgccagctcggcgtgcccctggagccggttaatttcccgagccattttcttttaaggtggtgtcagggcgctgagggagcgactctcgacatatttgactatatttacattgacgccttcggcaagggcaagcagctgaccgtcaaagaatgtgagtacctgataggccagcacgtgaccgccgcactgtacggcgttgtcaacgtcaaaaaagtgctgcagcggatggtcgggaatttgctcagcttagggaaacgtgagggtatcgaccagtcctatcagctgctacgcgactctctggatctctacctcgcaatgtatcccgaccaagtgcagctgttgctgctgcaggccagactgtatttccacctgggtatttggcctgaaaaggttctggacatcttgcaacacattcagaccctggatcctgggcagcacggagcggtgggctatctggtgcagcacacgttggagcatattgagaggaaaaaagaggaggtgggagtagaggtcaaactgcggtctgatgaaaaacatagagacgtttgctattcaattggacttatcatgaaacataagcggtacggctacaattgtgttatctacggctgggatcccacgtgtatgatgggccacgagtggatacggaatatgaacgtccacagcctccctcatggccatcatcagcccttttacaatgttttagtggaagatggatcttgccgttacgccgcccaggaaaatctcgaatataatgtggagccccaggagatctcccaccccgatgtcgggcggtattttagcgaatttactggcacccactatatcccaaacgccgaactggaaattagataccccgaagacttagagttcgtatatgagaccgtgcaaaacatctattccgccaagaaagaaaacatcgacgaatag

SEQ ID NO: 116802 - DNA, 1434 bp, Artificial Sequence
  Description of Artificial Sequence: Synthetic coding sequence
atgaaacactattctccaacagattacgtcaattggctcgaggagtacaaggtgcgccaaaaggccggccttgaagcaagaaagatagtcgcatcattctcgaaacgtttctttagcgaacatgtgccctgtaacggattctcagatattgagaacctcgaagggccagaaatattcttcgaggatgagctagtgtgcatattgaacatggaggggcggaaggccttaacctggaaatattatgccaagaagatcttgtactacctcaggcagcagaaaattctaaataacctaaaagcctttctccaacagccggacgactatgagtcttatctggagggtgccgtgtatattgaccagtattgtaatccgctctcggatattagcctgaaagacatccaggcccagatcgactctatagtggagctggtttgtaaaaccctgcggggaattaacagcagacacccatctcttgcgttcaaggccggcgagagttctatgatcatggagatagaactgcagtcccaggtcctcgatgccatgaattatgtgctgtacgatcagctcaagtttaaaggtaatcggatggactattataatgctctgaacctttacatgcaccaggtcctgatccgccggaccggtattcctatatctatgagtctcctgtaccttacaatcgcgaggcagctgggcgtccctttggagccagtcaactttcccagccattttctacttaggtggtgccagggggccgagggcgagggcattgaccagtcttatcaactgttgcgggattcattagacctgtacctggctatgtatccagaccaggtgcagctgctgctgctgcaggcccgcttatacttccatctgggaatatggcccgagaaggtgctagatatcctgcagcacattcagacactggatcccggccaacacggtgctgtcggctacctggttcaacacacgttggagcacatcgagcgcaagaaagaagaggtcggcgttgaggtcaagctgaggtcggatgagaagcatagggacgtgtgttattcaatcggattgatcatgaaacacaagcggtatggctataactgcgtaatctacgggtgggaccccacctgcatgatgggtcatgaatggatcaggaacatgaacgtgcattccttgccccacgggcatcaccaacctttctacaacgttctggttgaagacggcagttgccgttatgccgcccaagaaaacttggaatacaatgtagagcctcaggagattagtcaccccgatgtgggaaggtacttttccgagttcactgggacccactatataccaaatgctgaactggaaatccgctatcccgaggacttggaattcgtttacgaaactgtccagaacatttacagcgctaaaaaggagaacatcgacgagtag

SEQ ID NO: 116803 - DNA, 1212 bp, Artificial Sequence
  Description of Artificial Sequence: Synthetic coding sequence
atggagccagttggctgttgcggggagtgccgcggaagcagtgtggatcccaggagcacgttcgttctcagcaacttggctgaggtggtggagcgggtcctaacattcttaccagctaaagcactccttagagttgcttgcgtgtgcaggctgtggagggagtgtgtacggagggtcttgcgaactcaccgctcggtgacctggattagcgctggtttagcagaggcaggtcacctggaagggcattgcttggtgcgggtggttgcagaggaactcgagaacgttcgcatactgcctcacacagttttatacatggctgatagtgagacatttattagcttggaagaatgccggggacataagagagccaggaaaagaacatctatggaaaccgccttggcgttagagaagctgttccctaagcaatgtcaggtgctaggcattgtgacacctgggattgtagtcacacccatgggaagcggctctaacagaccccaagaaatcgagattggtgagtcaggctttgccctcctcttccctcagatagagggtattaaaatccagcccttccatttcatcaaagatcctaagaatctcaccctagagcgtcaccagttgaccgaagttgggctgctcgacaaccctgagttgagagttgtcttggtgttcggctacaattgttgtaaggtgggagcatctaactacctgcagcaggtggtgtctacgttctctgacatgaacatcatccttgctggggggcaggtggacaatctgtcctccctcactagcgagaagaaccccttggatatcgatgcgtcaggcgtagtgggcctatccttctcaggccacagaatccaaagcgccacggtgcttctgaatgaagacgtaagtgatgagaaaaccgccgaagcggctatgcagcgcctgaaggccgctaatatccccgaacacaacacaatcggtttcatgtttgcctgtgtgggcaggggcttccaatactaccgggctaaaggcaacgtagaagccgacgccttccggaagttcttccctagcgtgcctctgtttggtttctttgggaacggggagatcggttgtgatcgaatcgtgaccggaaattttatccttcggaagtgcaatgaagttaaggatgacgacttattccactcctacacaacgataatggccctgattcatctggggtcgagtaaatag

SEQ ID NO: 116804 - DNA, 831 bp, Artificial Sequence
  Description of Artificial Sequence: Synthetic coding sequence
atggagcccgtaggatgttgcggcgagtgccgcggttccagcgtagacccaaggtcaacctttgtcttgagcaatcttgccgaggtggtggagcgtgtattaacgttcctacccgcaaaggcactgctccgggtggcatgcgtgtgcaggttgtggcgcgagtgcgtgcggagagttctcaggacacacaggagcgtcacctggatcagtgctggactggctgaggcaggtcaccttgaagggcattgtttagtccgcgttgtggctgaggagctggagaatgtgcggattctgcctcacacggtgttgtatatggcagattccgagaccttcatttctctggaggaatgtcgtggacataagcgagctcgcaaaagaacttcaatggaaaccgccctggctttggagaagctgttccccaaacagtgtcaggtcctcgggattgttacccccggcattgtggtgacacccatgggtagcggatctaatcggccgcaggagattgaaatcggagaatccggcttcgctttgctgtttcctcagattgagggcattaagatccaaccattccacttcattaaagatcctaaaaatttaacattagaaagacaccagctaacagaggtgggcttactggataatcccgaactccgggtggtccttgtcttcggctataattgctgtaaggtcggggcctcgaactatctgcaacaagtcgtgagcacattctctgacatgaacatcatcctggctggcggacaggtggataacttgagcagtctcacctctgagaagtacgtgctctgcgccagcgatttcgtttgcgaatag

SEQ ID NO: 116805 - DNA, 900 bp, Artificial Sequence
  Description of Artificial Sequence: Synthetic coding sequence
atggcagacagcgagacattcataagcctcgaagagtgccggggacataaacgcgcaaggaagcgaacatccatggagacagctttagcgctcgaaaaactattccccaagcagtgccaggtcctcggcatcgtcactcctggtatcgtggtgacacctatgggatcagggtccaatcgaccgcaagagatagagatcggagagtctggctttgccctgctcttcccacagatagaaggaatcaagatacagcccttccactttattaaggatccaaaaaacctcacactggagagacatcaacttaccgaggtggggcttctggacaatccggaactccgcgtcgtgttggtgttcggatataattgctgtaaagtaggagcatctaattatctgcaacaggtggtgagcacattcagtgacatgaatattatcctggccggaggacaagtggataacctgtccagcctcacctcagagaagaaccctctggacattgacgcgagtggcgtggtaggcttgtccttcagtgggcatagaatccagtcagccacagtacttttaaatgaggacgtctctgatgagaagacggcagaggctgctatgcaacgcctgaaggctgctaacataccagaacacaatacaatcggattcatgttcgcctgcgtggggcggggcttccagtattatcgcgcaaagggcaatgtagaagccgacgcctttcgcaagtttttcccaagcgtccctttgttcgggtttttcggcaacggagagatcgggtgcgaccgcatcgtgactgggaactttatccttaggaaatgtaatgaggtgaaagacgatgacctttttcattcttataccaccatcatggccctaattcacttaggctccagcaaatag

SEQ ID NO: 116806 - DNA, 1743 bp, Artificial Sequence
  Description of Artificial Sequence: Synthetic coding sequence
atgggagagaaggccgtgcccctcttaaggagacgtcgtgttaagcgcagctgcccaagttgcggatcagaactgggggtggaggaaaagcgcggcaagggaaaccccattagcattcagctgtttccaccagagctggtggagcatattattagcttcctccctgtccgagaccttgttgcactcggacagacttgtcggtactttcacgaggtgtgcgatggcgaaggagtgtggaggcgtatatgcagacgcctgtcgcctcgcctacaagaccagggttccggcgtgcgaccctggaagagggctgctatcctgaactacaccaaaggcctttacttccaggccttcggggggcgccgaaggtgccttagcaagtccgtggccccacttttggcccatggataccgcagattcctcccgacgaaggaccacgtattcatcttggattacgtaggaactttatttttcctaaagaacgcgctagttagcacactgggtcagatgcagtggaagagagcctgcaggtatgtcgttctttgcagaggcgctaaggatttcgcctcagatccacggtgtgatactgtgtaccggaagtatctgtacgtgctggccacccgggagccgcaggaagtggttggcaccaccagttcacgggcctgcgactgcgtggaagtttacctacaaagctccggacagcgcgtgttcaaaatgacattccaccatagcatgacctttaagcaaatcgtactcgttggccaggaaactcaacgggccctactcttgctaacggaagaggggaaaatttatagtctggttgtaaacgaaacacaactagaccagccacgatcatacaccgtgcagctggccctgcgaaaagtcagtcactatctaccacatctgcgggtcgcctgcatgacctcaaaccagtctagcacattatacgttaccgaccaggggggcgtatacttcgaggtgcacacaccgggcgtttaccgagatctgttcggtacgctgcaggcatttgatccactggaccagcagatgccccttgccctgagcctgcccgctaagattctcttttgtgcactgggctacaatcatttgggcctggtggacgaattcggccgcatctttatgcaaggcaacaatcgttacgggcaactcggaactggcgataagatggaccgaggcgagcccacgcaggtgtgttacctgcagcgacccattaccttatggtgcggtctgaaccatagcctcgtactctcacagtcctccgaatttagtaaagaactcctgggttgtgggtgtggcgccggcgggcgcctccccggctggccgaagggcagtgcctcttttgtgaaactgcaggtgaaggtaccactgtgcgcgtgtgctctctgtgctacccgtgaatgtctgtatatccttagttctcacgatattgagcagcacgctccctatcggcaccttcctgcctcgcgagtcgtgggaacgccggagcccagtcttggcgcacgagccccacaggaccccggagggatggcccaagcctgtgaagagtacctaagccaaatccactcctgtcagaccctgcaggataggacagagaagatgaaggagatcgtgggatggatgcctctgatggcagcacagaaggacttcttttgggaggcccttgatatgttacaacgcgcagagggtggcggcggtggagtgggaccacccgctcccgagacctag

SEQ ID NO: 116807 - DNA, 957 bp, Artificial Sequence
  Description of Artificial Sequence: Synthetic coding sequence
atgggcgagaaagcagtgcctcttctcaggagaagacgagtgaagcggtcttgccccagttgcggtagcgagctgggcgttgaagagaaacgaggtaaaggcaatcccatttcgatccagctcttcccgcccgagctggtggaacacatcatttcattcttacctgttcgtgaccttgtcgccctcggacagacctgccggtactttcatgaagtatgtgacggggaaggcgtttggcggcgcatctgtcgcagactatcaccgcggcttcaggaccaggatacaaagggcctctacttccaggccttcgggggccggaggaggtgtctttcaaagtcggtggccccactcctggcccacgggtaccggcggttcctgccgactaaagatcacgtgtttattcttgattacgtggggactttattcttccttaagaatgccttagtgagtacgctcggacagatgcaatggaaacgcgcgtgtaggtacgtggttctgtgccgcggtgctaaggattttgcctctgatcctcgctgtgacacagtctatcggaagtacctttatgtgttggcgacgcgagaaccccaagaggttgtaggtaccacaagcagccgcgcttgcgattgtgtagaagtctatctgcaaagcagcggacagcgcgttttcaaaatgacttttcaccatagcatgacgtttaaacagatagtgctggtaggccaagaaacacagagggcactcttactcctgactgaggagggtaagatatacagtcttgtggtgaacgaaacccagctcgaccagccccgctcttacacagtccaactagccctgcggaaggtgtcccactacttaccgcacctaagagtagcttgtatgacctctaaccaaagttcaacgctttacgtgaccgatccaatattgtgttcgtggctccaacccccctggccgggtggatag

SEQ ID NO: 116808 - DNA, 1857 bp, Artificial Sequence
  Description of Artificial Sequence: Synthetic coding sequence
atggtgtgggaatcacagcaggagaggggaggccagggccctcgccggcaagagggtcgaagcagggagggagccatccgcatggtgaggggatctcagcgccggaagcttcaaaaatttacacgtctgtgtggtagggaggagggcttgcgtgtgaagcgcagctgcccgtcatgcggaagtgaacttggtgtggaggaaaaaagaggaaagggcaaccccatcagcatccagctcttccccccggagctggtggagcacattatttcttttttgcccgttcgggacttggttgcgctagggcagacctgccgctacttccatgaagtgtgtgatggcgaaggcgtttggagaaggatctgtcgtcgactgagccctagacttcaggaccagggcagtggcgtccgaccctggaagagggctgctattctgaactatacaaagggcttatatttccaggcattcggcgggcgaaggcgctgtctgagcaagtccgtcgcaccgctactagcacacgggtatcgcaggtttctgccaaccaaagatcatgtgttcattctggactacgtaggcactctgttctttctgaagaatgccctcgtatccaccttgggccagatgcagtggaaaagggcttgtcggtatgtggtgctgtgccggggtgccaaggattttgccagcgatccgcggtgtgatacagtgtacaggaaatacttgtatgttctggcaacacgggagcctcaagaggtggtgggtaccacatcctctagagcttgcgattgtgtggaggtgtatctgcagtcatccggacagagggtgttcaaaatgacctttcaccatagtatgacgttcaagcagatcgttctggtcggccaagaaactcagcgtgccctgcttcttttgacagaagaaggaaagatctatagcttagtggttaatgagacccaacttgatcaaccccgaagctataccgtccagctcgcactccgcaaggtgagtcattacctcccccaccttcgagtcgcctgtatgacaagcaatcaatctagtaccctctatgtgacggaccaggggggcgtgtactttgaggtccatactccaggggtctatcgcgacctttttgggacccttcaagcctttgatccgcttgatcagcaaatgcctctggcactgtccctgcctgcgaagatcctgttctgtgccctgggttataatcatctggggcttgttgacgagtttgggcgtattttcatgcagggcaataatagatacgggcagctgggtactggtgacaagatggacagaggtgagccaacacaggtttgctatctgcaacgtccaattactctatggtgtggattgaatcatagtctcgttctgtcacaaagctctgaattcagtaaggaactcttggggtgtgggtgcggcgccggaggacgcctcccagggtggcccaaaggatccgcctcatttgtcaaacttcaggttaaggtacccctctgcgcctgtgccctgtgtgccactagggaatgcctctatatattgtcctcacacgatatcgaacaacatgcgccctatcgccacctcccagcctctagggtggtgggaactccggaaccaagccttggcgcccgggccccccaagatcctggtggcatggcccaagcatgcgaagaatacctgtcacagatacacagttgccaaactctccaggatcgtaccgaaaagatgaaggagatcgtgggctggatgcccctcatggcagcacagaaagactttttctgggaagctctggatatgctccagcgtgcagaaggcgggggagggggggtaggcccaccagctccggagacttag

SEQ ID NO: 116809 - DNA, 957 bp, Artificial Sequence
  Description of Artificial Sequence: Synthetic coding sequence
atgggggagaaggcggtacccctcttaagacgccgccgggttaagcgatcatgtccctcttgtggctctgaactgggcgtcgaggagaagaggggtaagggcaaccctatttcaatccagcttttccctcccgagcttgtagaacacatcatttcttttctgccagtgcgtgatttggtggcgctcggacagacttgcagatatttccatgaggtgtgtgacggtgagggtgtgtggcgcaggatctgtcggaggttgagtccaagattgcaagaccaggatacgaaagggctgtacttccaagcctttggcggaaggcgccgttgcctgtcgaagagtgtggctccactgttggcccacggttataggagattcctgccaacaaaggatcatgtctttattctggattacgtgggaactttgttttttctcaagaatgcccttgtgtcaacactgggacagatgcaatggaaacgcgcatgtcgttacgtcgttctctgccgaggggcaaaagacttcgcatctgatcctagatgtgatactgtatacagaaagtatttgtacgttctggccactagagagcctcaggaggtcgttggaaccacatcttcccgcgcatgcgactgcgtggaggtatatctgcagtcctcgggtcaaagagtttttaaaatgacattccaccacagtatgacatttaagcagatcgtcttagtggggcaggaaacccagagagccctgctgctgttgaccgaggagggcaaaatttactcactcgtggtgaatgaaacccagttggatcaaccacgcagttatactgtgcaactggccctgagaaaggtctcgcactatctgccacatttgcgcgtggcttgcatgactagcaaccaaagttccaccctgtacgttaccgatccaatcttgtgctcctggcttcagccaccttggcctggaggatag

SEQ ID NO: 116810 - DNA, 1707 bp, Artificial Sequence
  Description of Artificial Sequence: Synthetic coding sequence
atggttaagaggtcttgcccgagttgcggttctgaactcggtgtggaagaaaaacgaggtaagggaaaccccatcagtattcagttgttcccccctgagctggtggagcatatcatctcgtttctgcctgtgcgggacctagtggcactagggcagacttgtagatacttccacgaagtgtgcgacggggagggcgtgtggcggcggatttgtaggcgcctctcacctcgactgcaggatcagggctctggcgttcggccttggaaacgagccgctatcctcaactacacgaaaggcttatacttccaagcctttggcgggcgacgacgctgcctgagtaaatccgtggctcctctgcttgcacatggctacaggagatttttgcctaccaaggatcacgtcttcatccttgactacgtgggtacactgtttttcttaaagaatgctctcgtctcaaccctgggtcagatgcagtggaagagggcttgtcgctatgtggttttgtgccgcggagctaaagacttcgcctccgatccgcggtgcgacacggtctacagaaagtatctgtacgtcttggccacccgggaaccacaagaggtggtgggcacaacctcttcacgcgcatgtgactgcgtcgaggtttacctgcagtccagcgggcagagggtgttcaaaatgacatttcaccactcaatgactttcaagcaaattgtgttagtgggccaagagacccagcgagctctgcttttactcactgaagaaggaaagatctatagcctggtcgtgaatgaaacgcagctcgatcagccccgctcctatactgtgcaattggcactgcgcaaggttagccattacctgccccatttacgcgtagcctgtatgacgtctaatcaatcctccacattatacgttacggaccaaggcggcgtgtattttgaggtgcacacccccggtgtttatcgtgatttattcggcaccctgcaggccttcgacccactagaccagcagatgcctctggcgctgtccctacccgccaagatactgttctgcgcactagggtacaaccatctgggcctggttgatgagttcggcaggatttttatgcaaggcaataaccggtatggccagctcggaacaggagacaagatggaccgaggggagcctacacaggtgtgttacctccagcggcccattactttgtggtgtggactcaatcacagcttagtgttgtctcaatcaagtgagttctcgaaggagttgcttggctgcggttgcggagctggggggagacttcctgggtggcccaaggggagtgccagcttcgtgaagctgcaggtcaaggttcctctttgtgcctgcgcgctctgtgctacacgagagtgcctctacatcctttcgagtcacgatattgaacagcatgctccctaccgccacctgcccgcctctcgggtggtgggtacgcccgagcctagcttgggagccagagcgccgcaagatcccggaggcatggcccaggcttgcgaggagtatctctcacagattcactcttgccagactcttcaggaccggaccgaaaagatgaaggagattgtgggttggatgccactaatggccgcacaaaaggatttcttttgggaagcgttggacatgctccaacgagccgaggggggagggggcggagtgggcccgcctgctcctgagacctag

SEQ ID NO: 116811 - DNA, 1104 bp, Artificial Sequence
  Description of Artificial Sequence: Synthetic coding sequence
atgccgttcttaggccaggattggagatcacccggctggagctggatcaagaccgaagacggttggaaaagatgtgaatcctgcagccagaagctcgagcgtgaaaacaaccgctgcaacatttcccattcaatcatcctgaacagcgaagatggggaaatatttaacaatgaggaacatgaatacgcttctaagaagcgcaagaaagaccatttcaggaacgataccaacactcagtctttttatagagaaaaatggatctatgtgcataaagaaagtacgaaagagagacacggctactgcactctgggtgaagcctttaaccggcttgattttagcagtgccattcaggacattcggcggtttaactacgtggtcaagctgcttcagctcattgccaagtctcagctgaccagtttgtccggagtcgcccagaagaactacttcaatatcctggacaagatcgttcagaaggtacttgatgaccaccataaccccaggcttattaaggacctcttgcaagacctgtcatccacattgtgtatacttatcagaggggtggggaagtccgtcctggtagggaacattaatatctggatttgccgactggagacaatcctggcttggcaacagcagctgcaagacctccagatgacaaaacaagtcaacaatggcctgacactctccgacctgccactccacatgctgaacaacattctctaccgtttttccgacgggtgggacatcattacactggggcaggtgacccccactctgtacatgctgtcggaggatcggcagttgtggaagaaactgtgccagtatcactttgctgaaaagcaattctgtagacacctgatccttagtgagaaaggccacattgaatggaagcttatgtacttcgccttgcagaagcactaccctgccaaggagcagtatggcgatacgctgcacttttgcagacactgctcaatactgttttggaaagattaccatctggcacttctgttcaaagattcagggcatccatgcaccgcggccgatcccgactcttgcttcacccctgtatccccccagcacttcattgacttgtttaagttctag

SEQ ID NO: 116812 - DNA, 1077 bp, Artificial Sequence
  Description of Artificial Sequence: Synthetic coding sequence
atgcccttcctcgggcaggactggcgaagtccaggatggtcctggatcaagacggaggacggatggaagaggtgcgagagttgcagccagaaactcgagagagaaaataacagatgcaacatcagccacagcataatactgaacagtgaggatggtgagatattcaacaacgaggagcacgaatacgctagtaaaaaacggaaaaaagaccatttccggaacgatacaaacacccagagcttctatcgggaaaaatggatctacgtgcataaagaatccaccaaggaacgccacggttattgcactctcggtgaagcctttaatcgtttagacttttcctcagcaatccaagacatcagacgattcaattatgttgttaagttgctgcagctgattgcaaaatcacagctaacaagcctttccggcgtggcccagaagaactactttaacatcctggacaaaattgtgcaaaaggtactcgatgatcatcataaccctagactgatcaaagacctgttacaggacctctcctccaccctctgcattctaattcgaggggttggaaagtctgtgctggtcggcaatattaatatttggatctgtcgcctggagacaatcctggcctggcagcagcagctgcaggacttacagatgaccaagcaggttaacaatggcctcaccttatcagacttgccactgcatatgttaaacaatattctgtataggtttagcgacggctgggacataattacgctggggcaagtcactcccacgctttatatgttgagcgaggatagacagctctggaaaaaattgtgccagtaccactttgccgaaaagcaattttgcaggcacctgattctgagtgagaaaggccatattgagtggaagctcatgtattttgccttacaaaaacattaccctgctaaagaacagtacggagatacactacacttttgtcgccactgttctatactcttctggaaggattccggacatccctgcaccgctgcagatcccgattcttgctttacacccgtctccccacaacactttatagacctattcaagttttag

SEQ ID NO: 116813 - DNA, 876 bp, Artificial Sequence
  Description of Artificial Sequence: Synthetic coding sequence
atggagaagtactcaattatgaaaagtatgaatatgcaccgtaagaaaggcaagaggactatcctggaaatgactcagatcctgaagaggcacggctattgcaccttgggggaggcgttcaaccggctagacttctcttcggctatccaggatattcggcggtttaattatgtggtgaagttactacagctgatagcgaaaagccagctgacctcactgtctggtgtcgcccagaaaaattactttaatatcctggataagatcgtacagaaagtgttggatgaccatcataatcctcgtcttataaaggatctacttcaggatctctccagcaccctttgcatattaattagaggggtggggaaaagtgtcctggttgggaatattaatatctggatctgtaggctcgaaacaattctcgcgtggcagcaacagctgcaggaccttcagatgaccaaacaggttaacaatggactgacactctcagatctaccgctccacatgcttaacaacatactataccgtttttccgacggctgggacatcattaccctgggacaggtgacgcctactctctatatgctgtcagaggataggcagttatggaagaagctgtgccagtaccacttcgccgaaaagcaattctgccgccacctgatactttctgagaaaggtcacatcgagtggaagctgatgtatttcgcactccagaagcattaccccgctaaggaacagtacggcgacacattacatttttgtcgccattgcagtatccttttctggaaggactcaggacatccttgcactgcagcggaccccgactcttgctttacccccgtgtctccacaacattttattgacctgtttaagttctag

SEQ ID NO: 116814 - DNA, 876 bp, Artificial Sequence
  Description of Artificial Sequence: Synthetic coding sequence
atggagaagtacagcattatgaagagcatgaacatgcatcgaaaaaaagggaagcgcacgatcctggagatgacccagatcttaaagaggcatggatattgcactctcggcgaggccttcaacagattggacttctcttctgcgatacaagacatcagacgttttaactacgtcgtgaagttactgcaactgatagccaagagccagctcacctcactatcaggcgtggctcaaaagaattactttaatatcttggataaaattgttcagaaagtccttgacgaccaccacaaccctcggttaatcaaagaccttttacaggatctatcatccacactctgtatcctaatccggggcgtagggaagagtgtcttggtgggaaatataaacatttggatctgcagacttgagacaatactcgcctggcagcagcagctgcaggacctgcagatgacgaagcaggtgaacaatggtctgaccttgtccgatctgccactgcacatgttgaacaatattttgtaccggttttccgatgggtgggacatcattacactcggtcaggtgactcctacactctacatgctgagtgaggaccgccaactttggaagaagctgtgccagtaccacttcgccgagaaacagttttgcagacacttgatcctgtccgagaaaggacacattgagtggaagctcatgtacttcgctttgcagaaacattacccagccaaagagcagtatggagataccttacacttttgtcggcactgctctattctattttggaaggattcaggccacccatgtactgccgcagaccccgattcctgctttactccggtaagcccacagcatttcattgatctattcaaattttag

SEQ ID NO: 116815 - DNA, 993 bp, Artificial Sequence
  Description of Artificial Sequence: Synthetic coding sequence
atgcccttcctgggccaggattggcgatcccctggttggagttggatcaagacagaggacggatggaagaggtgtgagtcatgctcacagaaactcgagagagaaaacaacaggtgtaacatatctcactccatcattctaaacagcgaagacggcgagatttttaataacgaagagcacgaatacgccagcaagaaacgtaagaaggaccatttccgcaacgacacaaatacacaatccttctatcgggagaagtggatctatgtgcacaaggagtcgacaaaggagcggcacgggtactgcacattaggggaggctttcaaccgcctggactttagtagtgccatccaggatatccgccggttcaactacgttgtaaagttgcttcaactaattgcaaagagccagctgacatctctctcaggagtggctcagaaaaactattttaatatccttgacaaaatcgtccaaaaagtgctggacgatcatcacaatccacgtctcattaaggacctcttgcaggacctttcttccacattgtgtatattaatacgaggagtgggcaaatccgtgctcgtggggaatataaacatctggatttgtaggctcgagaccatcttggcttggcagcagcagctccaggatttgcaaatgacaaaacaggtcaataacggcttgactctgtctgaccttcctctccttagcgaggataggcaactgtggaaaaagctctgtcaataccacttcgccgagaagcaattctgccgccacctcattttgtctgagaaaggacacatcgagtggaagttgatgtactttgccttgcagaaacactacccagccaaagaacagtatggcgatactctgcatttttgtagacactgcagcatactgttctggaaagacagtggacacccctgtaccgcggcagatcccgactcttgttttaccccggtttcccctcagcatttcatcgatctgttcaagttttag

SEQ ID NO: 116816 - DNA, 378 bp, Artificial Sequence
  Description of Artificial Sequence: Synthetic coding sequence
atgccattcctcggccaagactggaggagccctgggtggtcctggatcaagaccgaagatgggtggaagcgatgtgaatcctgcagccagaaattagagagggagaacaatcgctgtaacatttcccacagcataatcctgaacagcgaagacggcgaaattttcaacaacgaggagcacgagtatgcctccaaaaaaagaaaaaaggatcatttcagaaacgacaccaatacccagtccttttaccgggagaagtggatctacgtccacaaggaaagtacaaaggaaagacatggctactgtactcttggagaggcctttaatcgcctcgatttctcctcagccattcaggacattcggcggtttaactacgtttag

SEQ ID NO: 116817 - DNA, 852 bp, Artificial Sequence
  Description of Artificial Sequence: Synthetic coding sequence
atgggagcctctgtcagtcgggggagggccgcacgggtcccagctccagagccggaaccagaagaggctcttgacttgtcgcagctgccaccagagctattgctcgttgtgctgtcccacgttccaccaagaacactgctgggaaggtgcagacaagtgtgcagagggtggagagccttagttgatgggcaggccctgtggctcctcatcttggctagggatcatggcgcaactgggagagcattactgcatctcgcccggagctgtcagtctccggctcgaaatgccaggccttgcccattagggagattttgcgcaagacggcctataggtcgcaacctgattaggaatccgtgtggacaggagggtttaagaaagtggatggttcagcacggaggggatggttgggtcgtggaggaaaatagaactaccgtacctggggcgccatcccagacatgtttcgtgacctccttttcctggtgctgtaagaagcaggtacttgatctggaagaggaaggactgtggcctgagttgttggattctggacggattgagatttgcgtctctgactggtggggcgcgcgccatgacagtggctgcatgtaccgactgcttgtgcagcttcttgatgccaatcaaactgtgctcgataagtttagtgcagtacccgaccccatcccccagtggaataataacgcttgcttacatgtgacccatgtgttttccaatatcaagatgggcgttcggtttgtgtcatttgaacacaggggccaggacacccagttctgggcaggacactatggggctagagtgactaactcctcagtaatcgtgagggtgcgactttcctag

SEQ ID NO: 116818 - DNA, 852 bp, Artificial Sequence
  Description of Artificial Sequence: Synthetic coding sequence
atgggagcgtccgtctctaggggccgggcagctcgggtaccagcacctgagcccgagcccgaagaagccctggacttatctcagctccctccagaattgcttctggtcgttttatctcacgtgccccccagaacactgctgggtcggtgtcgccaggtttgcagaggttggagggcacttgtggacggacaggccttatggctcctgattcttgccagggaccatggcgctacaggccgcgcactgctgcatttagcaaggtcatgtcagtcgcccgccagaaatgccagaccttgtccccttgggcgcttctgcgctcggcgacccataggtaggaatcttatccgcaatccctgtggtcaggagggcttgcggaaatggatggtccagcacggcggcgatgggtgggtcgtagaggagaatcgtacgactgtcccaggtgccccaagccagacttgttttgtgacttctttttcttggtgctgcaagaagcaggtactggatttagaagaggagggcttgtggcctgagttgctggattctggccgcatcgaaatttgcgtgtccgattggtggggcgcccgacacgacagcggatgtatgtaccggctcctcgttcagcttctggacgccaaccagactgttctggataagttttctgccgtgcccgacccaattccgcaatggaataacaacgcctgcttacacgtaacccacgtattctccaacattaaaatgggggtcagatttgttagtttcgaacaccgaggccaagatactcagttctgggccggccactatggagcccgggtcaccaatagctccgtaattgtgcgcgtccgactgtcttag

SEQ ID NO: 116819 - DNA, 1107 bp, Artificial Sequence
  Description of Artificial Sequence: Synthetic coding sequence
atggctgccgccgcggaagaaagaatggccgaagagggcggcggcggtcagggagatggcgggtcatctctggccagcggcagcacacaacgccaaccaccacccccagcccctcagcacccacagccagggtcacaggccctacctgctccagctcttgcgcctgaccaactgccacagaataatactcttgtcgccctacctatagtagcaatcgagaacattctctcttttatgtcttacgacgagataagtcagttacgactggtgtgtaagcggatggatttggtgtgtcagcgtatgctaaatcagggctttttgaaggttgagcggtaccataatctctgtcagaaacaggtgaaagcccagctcccacggagggagtccgagaggcgcaaccactccctggcccgccacgctgatattcttgcagcagtcgagaccagactctctctcctgaatatgacttttatgaaatacgtggatagcaacctgtgttgcttcataccagggaaagtgattgacgaaatttatcgcgtgctgaggtacgttaacagtacccgggcaccacagcgtgcccatgaggtgttgcaggagcttcgcgacattagttctatggcaatggaatacttcgatgagaagattgtgcctatattgaagaggaaactgcccggctcagatgtctcaggaagactgatgggttcaccgccagtgcctggacctagtgcagctctcacaacaatgcaactgttcagcaagcagaaccctagcagacaggaagttaccaagttacaacagcaggtcaaaacaaacggagctggggtgacagttctaagacgtgagataagcgaactgcgcactaaagtacaggagcagcagaaacagctgcaggaccaagatcagaagctgctggaacaaactcaaataatcggagaacagaatgctagattggcagagctagagaggaagctgcgtgaagtcatggagtcagctgtcggcaattcctccggctcagggcagaacgaggaaagtcctaggaaaagaaagaaggccaccgaagcaatcgactctctgcgaaagtcaaagcgattgaggaacagaaagtag

SEQ ID NO: 116820 - DNA, 540 bp, Artificial Sequence
  Description of Artificial Sequence: Synthetic coding sequence
atggccgctgccgcagaagagcggatggctgaggagggcggtggtggacagggcgatggaggatcatccctggcaagtgggtctactcagaggcaaccgcctcctcccgctccgcaacatccccagccaggctcacaggctctgccagcacctgccctggcacctgaccaacttccgcagaacaataccctggtagcactccctattgttgccattgagaacattttatcttttatgtcctatgatgaaattagtcagttacgcctcgtctgcaaaaggatggatttggtatgccagcgcatgctcaaccagggattcctgaaggtagagcgctatcacaatctgtgccaaaaacaggtgaaggcccagctgccaaggcgggaatcggagagaagaaaccacagccttgcacgacacgctgacattctggcagcggtggagacaaggctgtctctgctgaatatgaccttcatgaaatatgtcgactcgaatctttgctgtttcatcccaggtaaattccaggatagacttcagccatag

SEQ ID NO: 116821 - DNA, 1416 bp, Artificial Sequence
  Description of Artificial Sequence: Synthetic coding sequence
atggcggccatggaaacagagactgcgcccctcaccttggagtcactgcccaccgatccgttgctgctgatcttatccttcctggactaccgcgaccttatcaattgctgctacgtgtcaaggcggcttagccagctgagttcacatgaccccttgtggcggagacactgtaagaaatactggctcattagcgaggaggaaaagacgcagaaaaaccaatgttggaaaagtctctttatcgatacctatagtgacgtgggtcgttacatcgatcattacgcagccatcaagaaggcctgggacgatctgaaaaaatacctcgagcccagatgtccacgcatggtgctgagtctgaaggagggagctagagaggaagacctcgacgccgtcgaggcacagatcgggtgcaaactgcccgacgattacagatgcagctacagaattcacaatggtcaaaaactggtggtcccaggtctgctgggatcaatggccctgagcaatcattaccggagcgaagacttactcgacgtggacaccgccgcaggaggattccagcaaaggcagggactcaaatactgtttaccattgactttttgtatccacactgggctttcccagtatatagctgtcgaagccgcagaaggcaggaacaagaatgaggtcttctatcagtgtcccgatcaaatggcccggaacccagcggcaattgatatgtttatcatcggcgccacatttaccgactggttcacatcttatgtgaagaacgtggtgtccggcggctttcccatcattagagaccagatctttcgatacgtgcacgacccagagtgcgtggccactaccggagacatcaccgtcagcgtatctacaagctttctgcccgagctcagcagcgttcaccctccccattacttttttacatatcggattaggattgaaatgtcgaaggatgcgctccccgagaaagcttgccaactggacagcaggtactggcgcattactaacgctaagggagacgtagaggaggtgcagggaccaggcgtggtgggcgaattccccattatttcgccgggaagggtttacgaatacacctcctgtactaccttcagtactacttctgggtatatggaaggctactacacctttcatttcctgtactttaaggataaaatcttcaacgtagcaattcccagatttcacatggcctgccctacatttagggtgtccatagccaggttggaaatgggcccggatgaatatgaagaaatggaggaggaggaggaggaggaagaggaagaggacgaagacgacgatagtgcagacatggatgaatcagatgaggatgatgaagaagaaagacgaagacgcgtttttgatgtacctattcgaaggcggcgttgcagtaggctcttttag

SEQ ID NO: 116822 - DNA, 519 bp, Artificial Sequence
  Description of Artificial Sequence: Synthetic coding sequence
atggagaccgagaccgcccccctcaccctggagagccttccgaccgatcctttgttgttaatcttaagttttctggattacagagacctgattaattgctgttacgtcagtagacgcttgtcccagctttcatcccatgacccactgtggcgacgtcattgcaaaaagtattggctaatctcggaggaggaaaaaacgcagaagaatcagtgttggaagagcctcttcatcgatacgtactcggatgtggggcggtacattgatcactatgccgcaatcaaaaaagcagggatgattagcagaaacatatggtcaccaggagtcctcggctggttcgtgtccattaatagaggctgtagcagaggtagacctaggtgttgtggctctgcggactggtgtaagttgcccgacgattatagatgtagctatcgaattcacaacgggcaaaaactggtggtgcccggctcctactgggaagcatggcactgtttaattacaatcgtcctgaagatctgttag

SEQ ID NO: 116823 - DNA, 1248 bp, Artificial Sequence
  Description of Artificial Sequence: Synthetic coding sequence
atggccgcaatggagacagagaccgctcctctgacgctggaaagtctacccacggacccgctgcttctgattctgtcgttcctggactatagagacctgattaattgttgttacgtgtccagaaggctttcacagcttagctcccatgacccactttggagacgccactgcaaaaagtactggttgatctctgaggaggagaagacccagaaaaaccaatgttggaagtccttatttattgatacttacagcgacgttggccgatacattgatcactacgccgccattaaaaaagcatgggatgacctgaagaaatacctggaacctagatgcccccgtatggtgttgagtctcaaagagggggcccgggaagaagatctagacgcggtcgaggcccagataggctgcaagctccccgacgattataggtgtagctatcgcattcataatggacaaaagctggttgtgcccggcttgctgggctccatggctctcagcaaccactacaggagtgaggacctgctggacgttgatactgccgcaggtggcttccagcaaaggcagggactgaagtattgcctgccacttaccttctgtatccatacagggctgagtcagtatattgctgtggaagccgctgagggacgcaataagaacgaagtgttttaccagtgtcctgatcaaatggctcgaaaccctgccgctatcgatatgtttatcataggggcaacgttcacagattggtttacgtcatatgtcaagaatgtggtttccgggggattccctatcatccgcgaccagatattcaggtatgtgcacgacccggagtgcgttgctaccaccggagacatcaccgtgagcgtctcgacctcgtttctccccgagctgtcatcagtccaccctccacactatttttttacatatcggatccggatcgagatgtccaaggacgcgttgccagaaaaagcctgccagctggactcacggtactggagaatcacaaacgccaaaggcgatgtggaggaggtgcagggccctggcgtcgtaggcgaattccccatcatcagccccggaagggtgtatgaatatacgtcctgcacaacctttagcaccaccagcggctatatggaaggttactacacgttccacttcctgtactttaaagacaaaatatttaacgtggctataccacgattccatatggcctgtcccacattccgcgtttcgattgcacgcctggtgtcctag

SEQ ID NO: 116824 - DNA, 2238 bp, Artificial Sequence
  Description of Artificial Sequence: Synthetic coding sequence
atggaggaggagctgcagcattctcactgtgtgaattgcgtcagccgacggtgcatgacccgccctgaacccgggattagctgcgatctaatcggatgtcctctggtctgcggtgctgtgtttcacagttgcaaggccgatgaacaccgtttgttatgcccattcgagagagtaccgtgcctgaatagcgactttgggtgccctttcactatggccagaaacaaagtggcggagcatttggagatgtgtccagcaagcgtggtgtgctgtacaatggagtggaaccgatggcctgtgtcatatgccgataggaaatcctacgaaaatctaagtcgcgacgtcgacgaggttgcccagctagacatggccctggccttacaagaccagagaatgctgttagagtccttaaaggtggcaacgatgatgtctaaagcaactgataaagtgagtaagccaagagaacagatttcagtcaaatcatcggtacccgagattccgcacgcgaatggcctcgtctctgtggatgaagagtcctacggagccctttaccaagccacagtggagactactcgttccctggccgccgccctggacattcttaacactgccactagagacatcggaatgctgaacacatcagtccccaatgatatggatgagcaacagaatgcgcgtgaatcgctcgaagatcagaatctcaaggatcaagaccacttgtatgaggaggagatcggcgccgtgggaggtattgactataacgacacaaatcaaaatgctcagagcgaacagaatggtagcagcgatcttctatgtgacttaaatacttctagctacgataccagcgctctctgcaacgggtttcctctagagaatatttgcacccaggtgatcgaccagaatcaaaacttgcatggagactctaaacagagtaacctgacaaatggcgactgtgtcgcgagctctgacggcacatctaaaccttcatctagcctcgctgtggccgctcagctcagagaaatcataccctcaagcgcgcttccaaacggaacggttcagcatatcctgatgcccgacgacgaaggcgagggagagctgtgctggaaaaaagtcgacctcggcgatgttaaaaatgttgatgtgttgagctttagccacgcaccaagctttaacttcctgtctaattcctgttggtcgaaaccaaaggaagacaaggcggtggatacatctgacctcgaagtagccgaagatcctatgggattgcaggggatagatctcataaccgctgctttgctgttttgcctgggtgatagcccaggggggagggggatttccgatagcagaatggcagacatataccatattgacgtgggaacgcagacttttagcctgccttctgccattctcgccacctcgacaatggtcggagagattgcctccgcgtctgcgtgtgaccatgcgaatcctcagctaagcaaccctagccccttccagacactgggcctggatctcgttctcgagtgtgtggctaggtaccagccaaagcagagaagtatgttcacgtttgtgtgcgggcaactttttcgcagaaaagaattctcaagccattttaagaacgtgcacggtgacattcacgcaggcctgaacgggtggatggagcagaggtgcccactcgcatactatggatgtacttactctcagcggcggttttgcccttccatccagggagccaagatcatacacgacaggcatttacggtccttcggggtgcaaccttgcgtttcaaccgtgttagtggagccggctcgcaattgcgttctggggctgcataatgatcatctctccagcctgccctttgaagtgttgcaacacattgccgggttcctcgatggattcagtctgtgtcagttgtcttgcgtatccaaactgatgagagatgtgtgtggatcccttctccagagcagagggatggtcattctccagtggggtaagaggaagtaccctgaaggcaactcctcttggcaaattaaggagaaagtctggcggttttctaccgcattttgttcagtaaacgagtggaagtttgcagatatcctctccatggcggaccatctgaagaagtgctcctataacgtggtggagaaacgagaggaagcgatccctttgccctgtatgtgcgtgactcgggaactgaccaaggaaggtcggtccctgcgcagtgtcctgaaacccgttctctag

SEQ ID NO: 116825 - DNA, 1620 bp, Artificial Sequence
  Description of Artificial Sequence: Synthetic coding sequence
atggccgtatgcgcacgcctgtgtggcgtggggccttctcggggatgccgccgtcgccagcagcgtcgtggtcccgcagagacggcagcagccgactcagagccagacaccgaccccgaagaggaaaggatcgaagctagcgcaggggtgggtggcgggctgtgtgccggtccctcccctccaccaccgcggtgttctctgttagaactcccccctgagttactggtagaaatttttgcatccttacctggcacggacttgcccagcctcgcacaggtctgcacgaaattccgcaggatattgcataccgacactatttggcggcggaggtgtagggaggagtacggagtctgcgaaaacctgcggaaactagagattactggagtttcatgtcgggatgtatacgccaagttgctgcataggtaccggcatattctgggcctctggcagccggatatcggcccctacgggggcctgcttaacgtggtcgtagatggcttgtttatcatcggctggatgtacctcccccctcatgatcctcacgttgatgaccctatgcggtttaagccactgttccggattcatctcatggagcgcaaggccgcaacagtggagtgtatgtatggacacaaaggtccccatcacggtcatatccagattgtgaagaaggatgagttcagcacgaagtgcaaccaaacggatcatcacagaatgagcggcgggcggcaagaggagtttcggacctggctccgtgaggagtgggggagaaccctggaggatattttccatgagcatatgcaggaactgatactaatgaagttcatctacacatctcagtacgataattgtctcacatatagacgcatctacctgcccccatcccgccccgatgacttgataaagcctggactgtttaagggcacgtatggttctcatgggctagaaatcgtaatgctgtcttttcacggcagaagagctcgcggtactaagattaccggagatccaaatatccctgccggccagcagacagtagagattgacctcaggcacaggatccagctacctgaccttgagaaccaaaggaattttaacgagctaagcagaatcgtgctggaggttcgagaacgtgttagacaggagcaacaggagggggggcatgaagctggcgaggggagaggaaggcaaggccctagagaaagccagccgtctccggcccagccacgagctgaggcaccctcaaagggccctgacgggacgcctggagaggatggcggggagcctggtgacgcggtcgctgccgcggaacagccagcacagtgtggccaagggcagccatttgtgcttcctgtgggggtgtccagcagaaacgaggactatccaaggacatgtaggatgtgtttctatgggactgggctcattgcaggacatggctttacatctccagaacggaccccaggagtgtttatcctttttgatgaggaccggttcgggttcgtctggctggaactgaagtccttctctctgtactcaagggtgcaagccacattcagaaatgctgatgcccctagcccacaggccttcgatgaaatgttgaagaacatccaatcattgaccagttag

SEQ ID NO: 116826 - DNA, 1068 bp, Artificial Sequence
  Description of Artificial Sequence: Synthetic coding sequence
atgccattcctgggccaggactggaggtcaccgggccaaaactgggtgaaaactgcagacggttggaaacgttttctcgacgaaaagagcggctccttcgtctcagatctgagcagctactgtaataaggaagtctataacaaagaaaatttgttcaactctctgaattacgatgtagctgcaaaaaagcggaaaaaggacatgctgaattcaaagactaagactcagtatttccatcaggagaaatggatttacgtgcacaagggttccacaaaagagagacacggatactgtactttgggcgaggctttcaatagactggacttttccacagcaattttggacagtaggagattcaactatgtggtaaggctgctcgaactcatcgccaagagtcagcttacatcgcttagcgggatcgcgcaaaaaaatttcatgaacatcctggaaaaggtcgtgcttaaggttcttgaggaccagcagaacatccgcctaatcagggaactgctccagacactgtacacttctctgtgtaccctagtgcagagagtaggaaagagtgtgttggtcggcaacataaacatgtgggtgtaccgcatggagactattctccactggcaacaacagttgaacaacatacagatcacccggcccgcgttcaaaggacttacttttaccgatctccccctgtgcttgcagttaaatattatgcagcgcctaagtgacggaagggatctcgtctctctgggtcaagctgcccccgacttgcatgtcctatccgaggatcgactcttatggaagaagttgtgtcaataccacttctccgaaagacagatccgcaaacgtctaattttgtccgataaggggcagttagattggaaaaagatgtactttaaactggtgagatgttatccccggaaggagcagtacggagacacactgcaactctgtaagcattgtcacatcctgagctggaaaggtaccgaccatccctgcaccgctaataacccagagtcatgttccgtctcgttaagtccacaggattttatcaatctgtttaagttttag

SEQ ID NO: 116827 - DNA, 789 bp, Artificial Sequence
  Description of Artificial Sequence: Synthetic coding sequence
atgccattcttgggccaggattggcgcagccctggccagaactgggttaagactgccgacggatggaagcgttttctggacgaaaaatctggaagtttcgtgtctgatctgtcaagctactgcaacaaagaggtgtacaataaagaaaacctctttaacagtttaaactacgacgtggcagctaagaagagaaagaaggacatgctcaactctaaaactaaaacgcagtatttccaccaggagaaatggatatacgtgcacaaggggtctaccaaggagcggcatggatattgtacactcggggaagcatttaaccggttagatttttctactgctattctggacagtcgccgctttaattacgtggtgcggcccgcctttaaaggcctcacattcactgatctccctctttgccttcaactgaacatcatgcagcgactgagcgacggacgagacctggtgtcactgggacaggccgcgccagatcttcacgtgctgtccgaggatagactactctggaaaaagctgtgtcagtatcattttagcgagagacagattaggaagcgtctgatactctcagataaggggcagctggactggaaaaagatgtacttcaagcttgtcagatgctaccctaggaaggagcagtacggggacacactgcagctctgtaagcactgccacatcttgtcctggaaaggcactgatcatccctgcactgctaacaatcccgaaagctgttccgtgtccctgagcccacaggattttattaatctgtttaagttttag

SEQ ID NO: 116828 - DNA, 1668 bp, Artificial Sequence
  Description of Artificial Sequence: Synthetic coding sequence
atgctgctctttctctcagtgccacagcctcggcctccaggcgctcgcaccagagcaggagcagctagagtggctaggtggagaaggttgaggcttcagcagctgagaagactaagaggactgcttcgtgtgttacgagggcggccaggcgctggtagccgccgcagaggccgcatggccctgtgcgggcaggctgctggggctgctagccttccatcggagcttatcgtgcatatcttctcctttcttccagcccccgacagactacgtgcctccgccagctgctcacattggcgcgagtgtcttttttacccagccctttggccacagctccggatctgcctgcgtgtaagtcccgccgagcagccaagactcgaatttttgatgcgaaaatgcggctggttcgtcagagagttgcgagtggagtttgccgcagagaattatctgtccggcggcgggccaggggacggcggaggcgctgacactggtacggggggagaagaggtggaggcccttcagttatctgcccggtggctcgaagtcctacggacatatctggagctggtgctgtgtgtactggtttcgatacgtaataatcgcaatttgcagaaattcagtttgtttggcgatatcagtgtgttgcagcagcagggttccctcagtaacacctacctgagcaaagttgatcctgacggcaagaagataaagcagatccaacagttattcgaagagatactcagcaacagcagacagctcaagtggctgagttgcggctttatgctggaaatcgttaccccaaccagtcttagcagcttatcaaatgctgtcgcaaacactatggaacacctgagtctgcttgacaacaacatccccggcaacagcactctgattactgcagtagagctggagcgtttcgtaaacctccatagcctggcactggacttctgtgacttcaccgctgagatggccagagtcctcactgactccaaccacgtgccccttcaacgccttagtcttttagtgcataacgtgtcagtgatgcacaaatccttggataacatgccaaatgatgaacattggaaggctttgagtagaaagagtacaagctttcgggtttatataatggcctttgacattaaaagcgaggacatgctgaagatcctgaaacctagtatccccctggaaaggatacactttgattcttacatcacctgcgtgagtggggcgatcgtagatctgatctctcgtcaatacgacaaattcctgacacattttattctcatgaatgatgtcattgataccagcggctttccagacctgtcagacaaccgaaatgaagaccccctggtactcctcgcctggaggtgtacgaaactttccctgttagctatccacggctacacggtgtgggctcataacctgatcgccatcgcgcgactccgcggtagcgatctgaaggttctagaagtgacagaggagagcatagatttcgatcagggggagctggctgaccaagacgtggaccctgtgcataatctcattgagcaagtgagtttgggcttgggtcagccatggcatgccgtgatggacattgaatcactgagcgtgtttactgagccaaatcgccatttctaccgagagatgcagtcattctcagaagacatctag

SEQ ID NO: 116829 - DNA, 9 bp, Artificial Sequence
  Description of Artificial Sequence: Synthetic coding sequence
atgcgttag

SEQ ID NO: 116830 - DNA, 2136 bp, Artificial Sequence
  Description of Artificial Sequence: Synthetic coding sequence
atgcacctgaaaccctactggaagctgcagaaaaaagaacatccaccagaagtttctcgcgaaacccagagaaccccgatgaatcatcagaaggccgtgaatgatgagacctgcaaggcttcccatatcacttccagtgttttccctagcgcgtcccttggaaaagcgagtagccggaaacctttcggaatcctctctccgaatgttttatgctcgatgagtgggaagagccccgttgagtcctccctgaacgtcaagactaagaagaatgccccgtctgccaccattcatcagggggaggaggagggccccctggatatctgggccgttgtaaagccaggtaatacaaaggagaagattgccttctttgcctcccaccagtgtagcaatcgcattggctctatgaaaattaagtcctcttgggacatcgatggacgagcaacaaaaagaaggaaaaagtccggcgacctcaaaaaagcaaaagtgcaggtcgaacgtatgagggaggtcaactcccgatgctaccagccggaacccttcgcctgtggcatagagcattgttccgttcattacgtgtctgacagtggagatggggtgtatgctggaaggcccttatctgtcatccagatggtggcattccttgaacagagagccagcgcccttctcgctagctgctccaagaactgtacaaactctcctgcaatagtccgctttagcggccagagccggggcgttcccgccgtgtccgaaagctattctgccccgggggcgtgcgaagagccgactgaaagagggaacttggaggtgggagagccccagtccgaaccagtgcgcgtgctggatatggtggccaagctggagtcggagtgtttgaaacgccaaggccagagggaaccagggtcactcagcaggaacaatagtttccgacggaatgtgggcagggtactcctggccaactctactcaggctgatgaggggaaaactaaaaaaggggttctggaggcacctgacactcaagtgaaccccgtgggatcagtgtcagtggactgcggcccatctagagccgatcgctgtagcccgaaagaggatcaagcctgggacggagcctcccaggattgcccgccgctccccgctggtgtctcctttcacatcgacagtgcagaactcgagccggggagccagacagcggtaaagaatagcaatcgatatgacgtggaaatgaccgatgagcttgtcgggttgccattcagctcacacacatattctcaggcaagcgagctaccaacggatgccgtcgactgcatgagccgggaactcgtcagtctcacttctcgcaaccccgaccagcggaaggagagtttgtgtattagcattacagtaagtaaggtcgacaaagaccaaccatcaatactcaacagttgcgaagaccccgtgcccggcatgttatttttcctccctcccggacagcacttgtcagattacagtcagcttaatgagagcactacaaaggagtcatctgaggccagccagctggaggatgctgccggtggcgacagtgcttctgaggagaagagtggctccgccgagcccttcgttttaccagctagctctgttgaaagtacactccctgttttagaggccagttcttggaagaaacaggttagccatgacttccttgagacccgatttaagattcaacagctgctggaaccacagcagtacatggcgtttctcccacaccacattatggtgaaaatttttcgactactgccaacaaagagcttggtggctctgaaatgtacgtgttgctactttaagttcataatagagtactataatattcgacccgctgattcccgatgggtacgagatccgcgctatcgagaggacccctgcaaacagtgcaaaaaaaaatatgtgaagggcgatgtcagtttgtgtaggtggcatcccaaaccatattgccaggcactgccctacggcccggggtattggatgtgttgtcacagaagtcagaagggttttcccggatgcaagctcgggctgcacgataaccactgggtgccagcttgtcattcattcaacagagcaattcataagaaagcaaaaggcaccgaagctgaggaggagtattag

SEQ ID NO: 116831 - DNA, 2136 bp, Artificial Sequence
  Description of Artificial Sequence: Synthetic coding sequence
atgcatttgaagccgtactggaaactccagaagaaggagcatccccccgaagtgagccgcgaaacgcaacgtacccccatgaaccatcagaaggccgtgaacgacgagacctgcaaggctagtcatattacctctagtgtttttccgtctgcttccctggggaaggcgtcgtcaagaaaacccttcggtatcttgagtcccaatgttttgtgcagtatgtctggcaaaagccccgtagagagctcattaaacgttaaaacaaaaaagaacgccccgagcgccacaattcaccaaggcgaggaggagggcccccttgacatatgggccgtcgtcaaacctggcaacacaaaggaaaaaatagcatttttcgcaagccatcaatgttctaatcgaataggttctatgaagattaagtcctcttgggatatcgatggcagggccacaaagagaagaaaaaaaagcggagacttgaaaaaagcgaaggttcaggtggaaaggatgagagaagttaattcacggtgctatcagcccgagccgttcgcttgtggcatagaacattgctcagtgcactacgtgtccgatagcggagacggcgtttatgcggggaggccactctcggtgatacagatggtggccttcttggaacagagagcctctgcactgctggcctcttgcagtaaaaactgcacgaactcacccgctatcgtaaggttttccggacagtctcgaggcgtcccggccgtgtcagagtcatacagtgcccccggcgcctgtgaggagccgaccgaacgtggtaatttggaggtgggggagcctcagtcagaacctgttcgcgtgctggatatggtggctaaactcgagtcagaatgcctgaagcgacagggacaaagggaacccggctctctttcaaggaataattcattccgccggaacgttgggcgagtcctgctagctaacagtacgcaggcggatgaaggcaagacgaaaaagggcgttttggaggctcccgacacgcaggtgaatcccgtgggatccgtgagtgtggattgcggaccatcccgggctgataggtgttcacccaaagaagatcaggcttgggatggagcgtcccaggactgtcctcctctcccagcaggagtttcctttcacattgactcagccgagttggagcccggatcacagacagcggtgaagaattccaaccgctacgatgtagaaatgacggatgaactggtaggtctgccattttccagccatacatactcccaggcttcggagctgcccactgatgcggtggactgcatgtctagagagttggtctctctgaccagtaggaatccagatcagaggaaggaatccctgtgcatatctatcaccgtgagcaaggttgacaaggaccagccctccattctcaactcttgcgaagacccggtgcccggcatgctcttttttctgccccccggccaacacctgagcgactactctcagttaaacgagtcaacgaccaaggagtcgtcagaagcatctcagctggaagacgctgccggtggtgattcggcaagcgaggagaagtccgggtcagccgagcccttcgttctgcctgccagctccgtagagagcacactcccagtcctggaagctagttcctggaaaaaacaggtgtcgcatgattttctagagactcgctttaaaatccaacaattgctggagcctcaacagtatatggccttcctgccacaccacatcatggtaaagatttttagactgcttccaactaagagcctcgttgcccttaaatgtacgtgttgttatttcaaatttatcatcgaatactacaacatccgccctgcggactcccgctgggtgcgggatcccaggtatcgggaggacccttgcaagcagtgcaagaaaaaatacgtaaagggagatgtttcactatgtcgctggcatccaaaaccatactgccaggccttgccgtatggtccaggctattggatgtgctgccaccgtagccaaaaaggcttccccggttgcaagctaggactgcacgataatcactgggtcccggcctgtcactcttttaatcgcgccattcacaagaaggccaaggggacagaagccgaggaagaatactag

SEQ ID NO: 116832 - DNA, 567 bp, Artificial Sequence
  Description of Artificial Sequence: Synthetic coding sequence
atggctagttggttacccgagaccctcttcgagaccgttgggcaaggtcctcccccgtctaaggactactatcagctattggtgacccgctctcaggtcattttccgctggtggaagattagtttgaggagtgaataccgttccactaagcctggggaggctaaggaaacccatgaggacttcctggagaactcccacctacagggacaaacggccctgatatttggcgctaggattctcgactacgtgatcaacctgtgcaaagggaaattcgatttcctggaaaggctatcagacgatctgctgctcaccatcatttcctatctcgatctcgaagatattgcccgcctctgccagacaagccatcgcttcgctaagttatgcatgtctgacaaactttgggaacaaatcgttcagtccacatgcgacactatcacccctgatgttcgggctttagccgaggatactggctggagacagttattcttcacaaataagctacaacttcaaaggcaacttagaaaaaggaaacaaaagtacggcaatctgagagagaaacagccatag

SEQ ID NO: 116833 - DNA, 2832 bp, Artificial Sequence
  Description of Artificial Sequence: Synthetic coding sequence
atgggaccccgaaagaaatcagtgaagacctgcatcatgaataacgagatcccagaggaaatgactgcggatgaaactaaggactacatgaatcagctaagtcatgaggtgctgtgccacatttttcggtatcttcctttgcaagacatcatgtgcatggagtgtctctcacggaagctgaaggaggccgtgactctgtatctgcgggtcgtcagggtcgtggatctgtgcgctggccggtggtgggaatacatgccgagcggatttactgatgcgtctttcctcactcttttgaaaaagatgccagacgtagagcagttgtatgggctccacccccggtacctggagcgcagacgggtccgcggccatgaggccttctcaatcccgggtgtcctggaggcactccaggcttgccctaacctggtgggagtggagacatcacacctggagctggtggagtctatttggacttacatgccccacgtgcacatcctcggcaagttccgaaataggaatggcgcgtttccgattccaccagagaacaagctcaaaattccaattggagcgaagattcagaccctgcacctagtcggggtgaacgtgccagagatcccctgtatacccatgctccgacatctctacatgaaatgggtaaggctcacaaagcctcagccttttaaagacttcctctgtatctccctgcggactttcgtgatgagaaattgcgcgggcccgacaaatagcctgaaatacgtccctttggtaaccggactggccagcgctcgcaatctggagcacttggagatggtgcgggtcccctttctgggaggtctcatacagcacgttgttgaagatagctggcgatcgggcgggttccggaatctgcacacaatagtcctgggggcctgcaaaaacgcgttggaggtggatctgggatatctgattattaccgctgcgcgacgtttgcacgaggtgcgcatccaaccttctctgaccaaagacggggtcttcagtgccctaaagatggcagaattggaatttccgcagttcgaaactctgcatctggggtacgtcgacgaattcctactgcagtctagaatggccaacgccgacttggtgaagtatgggttggctgatgtggtagaaaatcccgggatcatcactgacatcggcatgaaagccgtcaatgaggtctttagctgtattaagtatctggcaatctataattgtcctcacctacacaacccttataattggatctccgaccattccaggtggacacgcctggtcgatatcaatttggtccgctgccatgccctgaagttggacagcttcggccagttcatcgagctgcttccctcacttgagtttataagcttagaccagatgttcagggaaccgccgaagggatgcgcacgcgtgggtctgtccgcaggcactggaatcggtgtgagcagtgccttagtttcgaaccagaactctaataacgacgataataatgcccagaataacaatgccaatattcatgacaataatcaccatcatccggacgacagcgatgaagaaaacgactttaggcaggatttacaacctggtgagcagcagttcgctgccgacgccctaaacgaaatggaagacattgtccaggaagacggagaagtggttgctgaaagtggaaataataccccagctcacagccaggcgatcatccctgttgacgtggatgaggagcaggcaggtccatcaggactgcagcgggtagttaagccaactagtataacagtgcacgactccgaaagtgacgatgaagaggatagccttgagttgcaggaggtgtggattccgaagaatggtacccggcgatactctgaaagggaggagaaaaccggtgagagcgtccagagccgcgaactatcagaagtagcaaagacaaagccaagacacgctatgaagaggaagagaactgccgataagtctacctctaccagtgatccagtaatcgaggatgaccacgtgcaggttctggtgctgaagagcaaaaatctcgtgggagtgacaatgaccaactgcgggattactgacctcgtcctcaaggactgcccaaaaatgatgttcatccacgcaacccggtgtagagtgctcaaacacctgaaagtggaaaatgcccccatcgttaatcggtttgactatgctcagtgtaagaaactaaacatggatcaggtcttagaccagatcctgcggatgccaccggagagaaatcggatcatctatttaaggccaatgcaacaggtggatacactaacccttgagcagaaacttttttctggaccgtacccctatcacatctgcatcatacacgaattcagtaatccgccgaatgtccgaaataaggtgcgaatcaggtcgtggatggatacaatcgcaaacattaaccaggaactcattaagtacgaatttttcccagaagcaacccgaagcgaagaggacttgaagaaatacccaaagtacccctggggcagagagatttataccttggaaggtgtggttgacggtgccccatactctatgatatccgactttccatggctccgttcactcagagctgccgagccaaattcttttgccagatatgacttcgaggacgatgaggaaagtacaatatacgccccacggcgtaaggggcaactttctgccgacatatgcatggagacaataggcgaggagatctccgaaatgaggcaaatgaagaaaggagtgtttcagcgagtggtggccatcttcattcactattgcgacgtgaacggcgagcccgtggaggatgattacatatag

SEQ ID NO: 116834 - DNA, 3567 bp, Artificial Sequence
  Description of Artificial Sequence: Synthetic coding sequence
atgggcccaagaaaaaagtctgtgaagacttgcattatgaacaacgagatacctgaggagatgacagctgacgagacgaaagattatatgaatcaattgtcccacgaggtcctgtgtcatatctttcgatatctgcccctgcaggacatcatgtgcatggagtgcttgtctcgcaagcttaaggaggcggtgacactctacctcagggttgtgcgggttgtagatctctgcgctggccggtggtgggaatacatgccctccggctttacagacgccagcttcttgacactgctcaagaagatgcccgacgtcgaacagctgtatggattgcacccacgctatttagagaggcgaagagtgagaggccatgaagcattcagtataccaggcgtactagaagctctacaggcctgtccaaacctcgtgggtgtcgagacaagccatcttgagcttgttgagtccatatggacttacatgccacacgtgcatatcctgggcaagtttcgcaatcggaacggtgcctttccaatacccccagagaacaagctgaaaatccctattggcgcaaagatccagactctgcatctcgtgggtgttaatgtgccagagataccatgcatcccgatgttgcgacatctgtacatgaaatgggtgagactaactaaacctcaacccttcaaggacttcctctgtatttctctgcgcacgttcgtaatgcgaaactgtgcaggaccaaccaactcacttaagtatgtgccacttgtgactggtttggcttctgcaaggaatctagagcatctcgagatggtacgggtgccattccttggcggactgattcagcacgtggtggaggatagctggcgcagtggcggcttcagaaacctgcataccatcgtgctgggagcttgtaaaaacgccttagaagttgacctcgggtacctcattatcaccgcagctcgaagactccatgaggtgagaattcagccgagcttgaccaaagacggtgtgttctccgcccttaagatggccgagttggaattccctcagttcgaaaccctacacctaggatacgtcgacgagttcctcttacagagcaggatggcaaatgccgatttagtgaagtatgggctcgccgacgttgtggagaatcccggcattatcaccgatattggtatgaaggctgtgaacgaagttttctcatgtattaaatatctggccatttacaattgcccacatctacacaatccctacaattggatcagtgatcacagccgatggactagactggttgacattaatttggtgcgatgtcacgcgctgaagttagactcttttggtcagttcattgagcttctcccgtctctggagtttattagccttgaccaaatgtttcgagagccccctaaggggtgtgccagagtcggccttagtgccggcaccggcatcggcgtgtcatccgccttggtctcaaatcagaactcaaacaacgatgacaataacgcacagaataacaatgctaatatacatgataacaatcaccatcaccctgacgattcagacgaggagaatgactttaggcaggatctgcagccaggagagcagcaatttgctgccgatgccctaaatgagatggaagatattgtccaggaggacggagaggtggtggccgagtctggcaataacacccccgcacattcacaagccataattcctgtggacgtggacgaagagcaggctggcccctctgggctccagcgggtcgtgaagcccacgtccattactgttcacgatagcgagagcgacgatgaggaggattctctagaactccaggaggtgtggattccaaaaaacggaacacggaggtactctgagagggaagaaaagaccggagaaagcgttcagagccgggagttgagcgtgtctggaaaaggtaaaacccccctgaggaaaaggtacaactctcaccagatgggccagagcaaacagtttccactggaggaaagctcgtgcgagaaaggctgtcaggtcacatccgaacagatcaaggcagatatgaaagctgcgcgggatattcctgaaaaaaagaaaaacaaggatgtttacccaagctgcagctcaactactgcatctaccgttggcaattcctctagccacaatactgctagtcagagcccagacttcgtgcgtactgtgaatagcggtggaagctccgagccatccccgacagaggtggacgtgtcccggcagtgcgcttgttccccgggaggaagcgaggactccgaagctatggaggaaggcgacgccgaatcctccgtgtgccctagatgctgttgccatagaccccaggagagccagaggagaacctctagatgtagtgacgaggaacggccgagcacttcccgcgcatgcgttgtgaacgggcctgatggcacaagaagcgccttctcttttcgaaccctgccacagggcggatcgagtggacctgcccatgacgaacgcacaaacggatccggttctggcgcaacaggtgaagaccgacgaggaagtagccagcccgaatcatgcgatgtgcagtccaatgaagattaccctcggagacctctgacccgcgccagatccaggctctcccatgttttacttgtttccgagtctgaagttgccaagactaaacctaggcacgcaatgaaacggaagcgtacagccgataaatccacgagtacgtccgatccagtgattgaggacgatcacgtgcaagtgcttgtcctgaagtccaaaaatctagtcggagtcaccatgactaactgtggcataaccgatctcgtgttaaaagattgtcctaaaatgatgttcatacacgccactaggtgccgtgtcctcaaacacttaaaagtggaaaacgcacctatagtgaatcggtttgactatgctcagtgtaaaaagttgaacatggatcaagtgctggaccagattctgcgtatgcctcctgagagaaatcgaatcatatacctgcggccgatgcagcaggttgacacactgacactggaacaaaagctcttctctgggccttatccctaccatatctgcatcatccatgaattctccaatcctcctaacgtgagaaataaggtcaggatccgctcatggatggatacaattgctaatattaatcaggagctgattaaatatgagttttttcccgaagccacgcggtccgaagaggatttaaaaaaataccctaaatacccctggggacgtgagatctacactctggaaggagtggttgacggcgccccgtactctatgatctcagatttcccgtggctgagaagcttgcgggccgctgagccgaatagctttgcgaggtacgacttcgaggacgatgaggagagcaccatttatgctcctaggcgcaaaggccagttgtctgccgatatctgtatggagactatcggggaagaaattagtgaaatgagacagatgaagaaaggggtgtttcaaagggtggtggctattttcatacactattgcgatgtgaatggggaacctgtggaggatgattacatctag

SEQ ID NO: 116835 - DNA, 3342 bp, Artificial Sequence
  Description of Artificial Sequence: Synthetic coding sequence
atggggccaagaaaaaagtccgttaagacatgcatcatgaataacgaaatccccgaggagatgactgccgacgaaacaaaagactacatgaaccagttgtctcatgaagtattgtgtcacatctttcgttaccttcccctacaggatatcatgtgcatggaatgtctttcacggaaactcaaagaagccgtgacattgtatctccgggtcgtgagggtagtcgatctatgtgctggaaggtggtgggaatatatgccctccggtttcacagacgccagctttctgacactgttgaaaaagatgcccgacgtggaacaactatatggtctgcatcccagatacctggagcgtaggcgagtacggggacacgaggctttttcaattccaggcgtgttggaggccctccaggcgtgtccgaatctcgttggtgtggaaacgagccacctagagctagttgagagcatttggacgtacatgccacacgtgcacatcttaggcaaattccgtaatagaaacggtgccttccccattcctccagaaaacaagctcaagatccctataggcgcaaagattcagactctccacctggtgggagtgaatgtcccagaaatcccctgcatccccatgctgcgtcacctgtacatgaagtgggttagacttacaaagccccaaccgttcaaggacttcttgtgtatcagcttacgcacattcgtgatgcggaattgcgctgggccaacaaacagtttgaaatatgtacccttagtgacaggcctcgccagtgccagaaacttggaacatctggaaatggttagagtgccttttcttggaggccttatccaacacgttgtggaggactcttggagatctggcggcttccgaaacctgcacacaatcgtgcttggggcctgcaaaaacgctctggaggttgacttggggtacctgatcatcacggccgcgcgccgtctccacgaagtgagaattcagccgagtctgacaaaagacggtgtgttcagcgcactcaaaatggctgaactggagttcccccagttcgaaacccttcacttaggttatgtagacgaattcctcttacagtctcggatggccaacgcagacctcgtcaaatacggactagccgacgtggtggagaatccagggattatcaccgatattgggatgaaggccgtgaacgaggtgttctcttgcataaagtacctggcaatttacaattgcccacacctccataacccatataattggatctctgaccactcgagatggacgaggctggtggatatcaacctagtgcgttgccacgccctcaagctcgatagcttcggtcagttcatcgagctcctgcctagtcttgagtttataagtctcgatcagatgtttcgggagccccccaaagggtgcgcaagggtgggtttgtcggcaggtactgggattggagtcagctctgctctggtttctaatcaaaattctaataacgacgacaataacgcgcaaaataacaacgccaacattcatgataacaaccaccatcaccccgacgacagcgacgaagagaatgacttccggcaggatttgcagccaggcgagcagcagtttgccgctgacgcactgaatgaaatggaggatattgttcaggaggacggcgaggtggttgctgaaagtgggaacaatactcctgcccattcccaggccatcatccccgttgacgtggatgaagagcaggcagggcctagtggactgcagcgcgtcgtgaaacctacttccattactgtccatgattctgaatctgatgatgaggaggactcactggagctgcaggaagtctggattcctaagaatggaactcgccggtattccgagagggaggaaaagacaggggagtccgttcaaagtcgggagctgtctgtaagcggcaaggggaagacacccctcagaaagcggtataactctcaccagatggggcaaagtaagcagtttcctctggaggaaagcagctgtgagaaagggtgccaggtaacaagcgagcagattaaagccgacatgaaagcagccagagacatcccagaaaaaaaaaaaaacaaagatgtgtacccaagctgttcatcaacaactgctagtactgtagggaactcctcttcccacaacacagctagccaatctcctgactttgtgcggacggtgaatagtggagggtcatctgaacccagccccaccgaagtggacgtttcgcgccaatgcgcgtgcagcccgggcggtagcgaggattcagaagccatggaagagggagacgctgagtcctcagtctgtccacggtgctgctgtcacaggccgcaggagagccagaggagaacatctagatgcagtgacgaggaacgcccatcgacatccagggcctgcgtcgtaaatgggcctgatgaggtggcaaagacaaagcccagacacgctatgaaacgcaagagaaccgcagacaaatctacctcaacctccgaccctgtgatagaggacgaccacgtgcaggttctcgtgctcaagtcaaaaaacctggtgggcgtgactatgacaaattgtgggatcacagatttggtgctcaaagactgtcctaaaatgatgttcattcatgccactcggtgtcgcgttctgaagcacctgaaggtggagaacgcccctatcgtgaaccgatttgactatgcccaatgcaaaaagcttaacatggatcaggtcttagatcaaattttgcgcatgcctcctgaaagaaaccgtataatctacctccggccaatgcaacaggttgatacactgacccttgagcaaaagctgttttccggcccctacccatatcacatttgtatcatacacgagttttctaaccctcctaatgtccgcaataaagtaagaatccggagttggatggacactattgcaaacatcaaccaggagctgatcaagtatgagttcttcccggaggctacacgttccgaggaggacctcaagaagtaccccaaatacccatggggacgggagatctacaccctggagggcgtggtggatggagccccctatagcatgatcagtgatttcccatggctccgcagccttagggccgccgagccaaactcctttgcacgatatgactttgaagatgatgaggagtccaccatctatgccccgagaagaaagggtcagttgtccgctgacatctgtatggaaactataggtgaggagattagcgaaatgcgacagatgaaaaagggcgttttccagcgagtggtggctattttcatccattattgtgatgttaacggagagccagtagaggatgactatatttag

SEQ ID NO: 116836 - DNA, 2832 bp, Artificial Sequence
  Description of Artificial Sequence: Synthetic coding sequence
atggggccacgaaaaaaaagcgtaaaaacgtgcatcatgaacaatgagatcccggaggagatgaccgcagacgagacaaaagactacatgaatcagctctcacacgaagtgctgtgtcatatctttcggtatctccccctccaagacatcatgtgtatggaatgcctctctcgcaaactgaaagaagcggtgactctttacctgagagtggtgcgggtggtcgacctgtgcgcaggtagatggtgggaatacatgccctctggatttactgatgctagttttttgactctcttgaagaagatgccagatgtggagcagctatatgggctgcatccacggtaccttgaaagaagacgcgtaaggggccatgaggctttcagcattccaggcgtactggaggctctgcaagcttgtcctaatctggttggagttgagacatcgcacctcgaactggtagagtcaatttggacttacatgcctcacgttcatatcctcggcaaatttagaaatagaaatggggcttttcctatcccacctgaaaacaaattaaagatacctattggcgcaaagatccagactcttcacctcgtaggcgtgaatgtgcctgaaattccttgtatcccaatgctccggcacctatatatgaaatgggttaggctgacgaaaccccaaccctttaaggattttctgtgcattagcctacggacattcgtgatgaggaactgcgctgggcctaccaattctctcaagtatgtccctctggtgaccggcctggcaagcgctaggaaccttgagcacctggaaatggtaagggtcccattcctaggcggcctcattcagcatgtggtggaggacagctggagatccggcggatttcggaatttacataccattgttcttggggcatgtaaaaatgcccttgaggttgatcttggctatctgataatcacagcggcccggcgactgcacgaggtaagaattcaaccatcactgaccaaagacggagtattttctgcacttaagatggccgagttggagtttccgcagtttgaaaccctgcacctcggctatgtcgatgagtttttattacagtctagaatggccaatgccgacctggtgaaatatggtctcgccgatgttgtggagaatcctgggattattactgacataggtatgaaggccgttaacgaagtttttagctgtatcaagtatctagctatatataattgtccccacctgcacaatccttacaattggatcagtgaccacagcaggtggactcgactcgtcgacatcaacctcgttagatgccacgcccttaaattggatagcttcgggcaatttattgaacttctgcccagtctggagttcatctcgctggatcagatgtttcgcgaacccccaaagggttgtgcgcgtgttggcctcagcgctggaacaggcattggtgtctcatcagcgctggtgtccaaccaaaactccaacaatgacgacaacaacgcccagaataataacgccaacattcacgacaataaccatcatcatccagacgatagcgatgaggaaaatgatttcagacaggatctgcagcctggcgaacagcaatttgccgccgacgcccttaatgaaatggaggatatcgtgcaggaagacggtgaagtcgtcgccgagagcggcaacaacactcctgcccattcccaagccatcattcctgtggacgtggatgaggagcaggctggcccttctgggctccagcgagtggttaagccaacttcaatcaccgtgcatgactccgaatctgatgatgaagaagattcccttgagctccaagaggtgtggattcccaaaaatggcaccaggcgatacagtgaacgcgaggagaagaccggtgagagtgtgcaaagtcgcgaacttagcgaggtagccaagacgaagcctaggcacgctatgaagcgcaaacgaactgcagacaaatccacctcaacctccgatcctgtgatagaagacgatcacgtgcaagtgcttgtgttgaagagtaagaatctcgtgggtgtgactatgacgaattgtggcattaccgacctggtgctgaaagactgtccaaagatgatgtttattcatgcaacaagatgccgagttctaaagcacctgaaagtagagaatgcccccatagtgaacagattcgattacgcgcaatgtaaaaaattgaacatggaccaggtactggatcagatattgcgcatgccccctgaaaggaataggattatatatctgagacccatgcaacaagtcgacactttgacgctcgagcagaagctgttttcgggaccctatccctaccatatctgtatcatccacgagtttagtaatcccccaaacgtgagaaacaaagttcggatacgatcgtggatggataccattgccaacatcaaccaggaactaatcaagtacgaatttttcccagaggcgaccaggagtgaggaggacctgaagaaatacccaaaatatccatgggggcgagaaatctataccctggaaggcgtggtagacggcgccccatactcaatgatctctgattttccatggctcagatcccttcgggccgcggagcccaatagttttgccagatacgatttcgaggacgacgaggaatctaccatttacgccccaaggcgcaaaggacaactctcagcagatatctgcatggagaccattggcgaggagattagcgaaatgcggcaaatgaagaagggggtcttccagcgggtggttgccatcttcatacactactgcgacgttaatggtgaacctgtcgaggacgattatatatag

SEQ ID NO: 116837 - DNA, 1329 bp, Artificial Sequence
  Description of Artificial Sequence: Synthetic coding sequence
atggatgaggagagcgaactcattcagccacaagaccaatcgtgctgggccttcttgccggacttgtgtctgtgtcgtgtgttctggtggttgggcgatcgagatagatctcgcgccgcactggtgtgccgcaaatggaatcagatgatgtacagcgccgagctgtggcggtacaggaccatcactttttccgggaggcccagcagggtgcatgcatccgaggtggaaagtgccgtctggtatgttaagaaattcggcagatatcttgaacatctcgaggtgaagttcatgaatccctataatgccgttctgactaagaagttccaggtgacgatgcgtggcctgctgagttgcttgtctaaatccaataaccgcctgaaaagcttatccatccagtacctcgagctagatcgcctcgtctggagaaacagtataaggtcatccttcatttcttcactgtctttttttctgaaaaaaatgggcaaacggctggactatctgaaccttaaaggtgctagactcaccgtggagcagggctgtcagattttggattctctgagctacatgcgcaacgagaatgtcattagcgagttgaatatcgaagactacttctctcaccaccttgccgtgtataattccccccagtttaaaaaaaccatgtctacgttccacaacctagtctccttgaatctgaactataattgtataagcgacgaactcctggaaaatctttgcgagaacgccagtacccttcggacaatcaacatcaagtgtcacgttcacgatccccacggccaggtgatttggggtatgagttgggcaaagcttgcccgccaagccaccaacttgaaggttaacttttttttcgagaggattatgaaatatgagaggctcgccaggattctcctgcaagagatccctatcaggagtatctcactgagaagctgctatttctccgatccagactgcagcatgcgcccgaccctcatcgacctgcttcccacctttagacatacactgcagaaactgacctgcgagtttaacaacaatcacgaaagcctggatgaggagttgcaccttctcattatctcctgcagaaaactattttatttcaaaatctgggcctttctggatgtgtccttcgtggaaaggatcctgaagtcccagaaagagcgtcagtgtgccttgcgcgttttcaaagcccggatctacaccaaccgatacgagacgaatgaggaggataagactctccaggaaatttatcgaaaatacaggaagttgattgaatccgagttgtcttattttgttatcgtctactctgtgatgtag

SEQ ID NO: 116838 - DNA, 1164 bp, Artificial Sequence
  Description of Artificial Sequence: Synthetic coding sequence
atggcagggagtgaaccacggagcggaacaaatagtccacccccccccttctctgattgggggcgcctggaagctgccattcttagtggatggaaaacattctggcaaagcgtgagcaaggagagagttgcacggacaacctctagggaggaggtcgacgaggccgcatcaaccttgacccggctgccgattgacgttcagctctatatactgtcgtttctctcaccgcacgacctgtgccagctagggagcactaaccattattggaatgaaacggtaagggacccaattctctggcgttacttcctactgcgggacctgccatcttggtcatccgttgattggaagagtctccctgatctcgagatcctgaaaaaacccatcagtgaggtgactgacggtgctttcttcgactacatggccgtgtacagaatgtgctgcccatacacacgtcgggccagcaaaagttcgagacctatgtatggcgccgtcacgtcattcctgcattcactgattatccagaacgagcccaggttcgcaatgttcggccccggcttggaagagctcaacaccagtctcgtgctcagcttgatgtcttcggaggagttgtgccctacagctggacttccccagcgacagattgacggcataggttcaggcgtcaacttccagctgaacaaccagcataaatttaacatcctgattttgtactctacgacaaggaaggaacgggacagggccagagaggagcatacatctgcggtgaataagatgttcagccgccacaatgagggtgacgaccaacaagggagcagatattctgtgatcccccagatccaaaaggtgtgtgaagtggtggacggcttcatttacgtggccaatgcggaagcccataaacgccacgaatggcaagatgaatttagtcatataatggctatgacggatccagccttcggttctagtggacgcccattgttggtgctgtcatgcatctcccagggggatgtgaaaagaatgccatgcttctatcttgcacacgagctgcatttgaacctgttaaaccatccttggctcgtgcaagacaccgaggctgagacactcactggctttcttaacggaattgagtggatcctcgaggaagtggagtcaaaacgtgcccggtag

SEQ ID NO: 116839 - DNA, 924 bp, Artificial Sequence
  Description of Artificial Sequence: Synthetic coding sequence
atggctggaagtgagcccaggtccggaacgaattccccaccgcctcctttttccgactggggccggctcgaggctgccattctgagcgggtggaagacgttctggcagagtgttagcaaggaaagagtcgcacgcacgacctccagagaagaagtcgatgaagctgccagcacattaacccggctccctattgatgttcagctctacatactttccttcttgtcacctcacgacctttgtcagttggggtctaccaaccactactggaacgagacggtgagggatccgatcctatggcggtactttctcctgagagacctgccttcttggagtagtgtggattggaaatccctgcccgatctggagatccttaagaagcctatctccgaagtgacagacggcgccttttttgactacatggccgtgtatcgaatgtgttgcccctacactcgtcgggcgtcgaaatcatctaggcccatgtacggcgctgtaacttcgtttctgcacagcctgatcatccagaatgaacctaggtttgcaatgttcggacccggcctggaagagttaaatacttccctggtgctgtcactcatgtcgtccgaggagctgtgccccacagccggtctgcctcaaagacaaattgacggaatcggctccggggtgaatttccagctcaataatcagcacaaattcaacatcctaattttgtattcaacgacacgtaaagaacgggacagagcccgggaagaacacacttctgccgtgaacaaaatgttttcaagacacaacgaaggagatgaccagcaaggttcacgatactcagttatcccacagatccagaaagtgtgcgaagtggtggacgggttcatttacgttgcaaacgccgaggcccataagtccaagtactcttacgtacacttctag

SEQ ID NO: 116840 - DNA, 2130 bp, Artificial Sequence
  Description of Artificial Sequence: Synthetic coding sequence
atgggcaaagcacgtaggtcacctcccggccatcataggcactgcgaggggtgcttcaaccggcactgccacattcccgtggaacccaacaccagttgtctcgtcatctcttgccatctcctttgcggtgcaacatttcatatgtgcaaagaagccgagcatcaactgttgtgccccctggagcaggttccatgtctgaattcggagtacggctgccccttgagcatgtctcgccacaagctggccaagcatctccaggtgtgccccgcatctgtagtatgctgctctatggagtggaataggtggcctaacgtggactcagagacaacactgcacgagaatattatgaaagagacccccagcgaggaatgcctggataccgctctcgccctgcaggatcaaaaggtgttatttcgctctctcaaaatggtggaactcttccccgagaccagggaggcaacggaggaagaacccactatgaacggcgaaacatctgttgaggaaatggggggtgctgtggggggagtagacatcggactcgtccctcacgggctgagtgcgaccaacggtgagatggctgaattgtctcaggaggagcgggaggtgctcgccaaaacgaaggagggaatggatctggtcaaatttggacagtgggaaaacatattctctaaggagcatgccgcatctgccctaactaatagctcagccagctgcgaatctaagaacaaaaacgatagtgagaaagagcaaatcagctcggggcacaatatggtggagggcgaaggggcgcccaaaaagaaggaaccacaggagaaccagaagcagcaggacgtgaggactgctatggagactacaggtttggccccttggcaggacggcgtccttgagcggctgaagaccgctgtagatgctaaggattataatatgtaccttgtgcacaacggccgtatgctcatccacttcggacagatgcccgcttgtacacctaaggagcgagacttcgtctacggcaagctggaggcacaggaggtgaagactgtctacaccttcaaggtgccagtctcttactgcggaaagcgcgcacgcctgggcgacgccatgctcagttgcaagcccagcgagcataaggccgtagacacaagtgatctgggcatcaccgttgaggatctccctaagtctgacctaatcaagaccacactccaatgtgcccttgagagagagctaaaaggtcacgtgatttccgagtccaggtcaattgatgggctgttcatggatttcgccacacagacctacaattttgaaccagagcagttctccagcggaacagtactggccgatctgaccgctgctactccaggtggcctacatgtggaacttcactctgaatgcgtgactcgcagacacaacaagtcttccagtgccttcactttcacctgcaacaaattctttcggagagacgagtttccgctccattttaagaatgtgcacacagacatacaatcctgcctcaacggatggtttcagcatcggtgtcccttagcttacctgggatgcacctttgtccaaaaccactttaggccacccggccagaaggcgaaggtcatctacagccaagagctaaagacctttgccattaagcctgaagtggcaccagaactgtctgagggccgcaagaacaatcacctccttggacacggcggaaagagtcaaaattctcttacctctcttccactggaaatcttgaaatatatcgccggctttttggattctgtgagcctagcacagttgagccaggtgagcgtgttgatgcggaatatctgcgcgaccctcctgcaagagcggggcatggtgctgctccagtggaagaagaagaggtattcgcatggcgggaccagctggcgggtgcaccgtgaaatttggcaatttagctctctgtttagcaaaatcaagagttgggaatttaatgaggtcacatctatgagtgagcacctaaaatcatgccccttcaacatagttgaacacaaaaccgaccccattctcctgaccagcatgtgtcaacctcgggaacaggcaagagaaagcttagttagtacgttcaggatcagaccacgcggtcggtacgtctcctag

SEQ ID NO: 116841 - DNA, 2811 bp, Artificial Sequence
  Description of Artificial Sequence: Synthetic coding sequence
atgaccacagggctaagcgatcaacaggtggtgtgtgatttggatcaccgcgccgtggaagccctgcttcaggcagtcaggaagcggatggccggcgctagtcccgctgtgccacatgaacgcgcaagattgactggaggtgcggcagccgtagaaccagcctgcagaggcggcggaggtgctatggcatctctggacctcccttatagatgtccccggtgcggtgagcacaagcgtttccgctccttatcctcacttagagcccatctagaatacagtcacacctacgagacactttacatactctctaaaacaaactctatttgtgatggagccgcggctgcagcggccgccgccgccgctgcaagcggcttccccctggctccggagcccgccgctttattggccgtgcctggcgcaagaagagaggtgtttgagtccacctcttttcaggggaaagagcaggccgctggaccctcccccgctgcaccccacctgctccaccaccaccatcatcacgctcccttggcccacttcccaggcgatctcgtacccgcatcactgccttgcgaggagttggcagaacccggtcttgtgccagcagccgcagcgcgctacgctcttcgcgaaattgaaatccccctcggtgagctgtttgccagaaaatctgtggcaagctctgcatgcagcacaccccctccaggaccgggccctggcccctgtccgggacccgccagcgcatcccccgcatcgccaagtcctgcggatgtcgcttacgaggagggactggctcgactcaagatccgggctctcgagaagctggaggtcgatcgccgacttgaacgccttagcgaggaggtggaacagaagatcgcggggcaggtgggccgactgcaagcagaactcgaacgcaaggcggctgaactcgaaacggcgagacaagagagcgcccggttgggaagagagaaggaggaattggaggagcgcgcctccgaactcagtcgacaggtggatgtaagcgtggaactcttggcctctcttaagcaagacctagtgcataaggagcaagaattaagtagaaagcaacaagaggtcgtacagatcgaccagtttctgaaggaaacagcagccagagaagcatctgctaaattgcgcctccagcagtttatcgaggagctgctggaacgagcagatagggcagaacggcaactccaggtgatatccagctcatgcgggtccacaccttccgcctctctggggagggggggcggcgggggaggtgctggccccaacgcgcgaggccccggccgtatgagggagcatcacgtgggtcccgcagtgccgaatacatacgcagtgtcccgacacggcagttctccatcaacaggcgcgtccagccgcgttcccgcggcgtcccagagctccggctgttacgactcagacagtctggaactcccgcgaccagaagaaggcgcccccgaggactccgggccgggcggattaggaacaagagcacaagcggctaacggtggatccgagagatctcagcctcctcgcagttccgggctcaggaggcaggcaatacagaattggcagagacgacctcgccggcattccacggagggagaagagggcgatgtctccgatgtcgggtctcgcaccaccgaaagtgaagccgaggggccactggacgcccccaggcctggccccgccatggccgggcccctcagttcctgtcgccttagcgccaggcctgagggaggaagcggccgcggcaggcgggccgaacgagtttccccttcaaggtccaacgaggtcataagcccagaaatcctcaaaatgcgagccgccctattttgcatttttacttacctcgacacgcggaccttgttgcatgctgcagaggtgtgtcgagattggcgttttgtagcccggcatcccgcagtgtggaccagagtgttgttagaaaatgcgcgcgtgtgttctaaatttctcgccatgctagcacagtggtgcactcaggcacacagcctaacactacaaaaccttaaacctcgccaaagaggtaaaaaagaatccaaggaggagtacgctaggagtacacggggctgtcttgaggccggacttgaatccctgctgaaagccgcggggggaaacctcttgattctcaggattagtcactgcccaaacattttaaccgatcggtccctgtggctggccagctgttactgtcgggcccttcaggccgtaacctatcgaagcgctaccgacccagtggggcacgaggtcatctgggcccttggagctgggtgccgggaaattgtgtcactgcaggtcgccccgctacatccttgccaacagccaactcgattctctaaccggtgcctccaaatgatcggccggtgttggccacatttgcgagcactgggcgtcgggggagctgggtgcggtgtgcaagggctggcctctctcgcgagaaactgtatgcggctgcaggtgctggaactcgaccacgtctcagaaatcactcaggaagtggctgcagaagtctgtcgggagggcttgaaaggcttggagatgttggtcctcaccgccactcctgtcacacccaaagcacttctgcacttcaatagcatctgtaggaacctgaaatccatcgtcgtccagattggcattgccgactacttcaaggagccgagtagtcctgaggcccaaaagcttttcgaggatatggtgaccaagctgcaggcactgagacgcaggccaggtttttctaagattctgcatataaaagtagaaggaggatgctag

SEQ ID NO: 116842 - DNA, 2628 bp, Artificial Sequence
  Description of Artificial Sequence: Synthetic coding sequence
atggcttcccttgatctgccctaccggtgccctaggtgcggagaacataagaggtttcggtctctgtcctccctccgggcacatttagagtactcccatacctacgaaactctttatattctaagtaaaacaaatagcatctgcgacggcgcagcagccgctgcagccgccgcggccgccgcgagcggttttccccttgctcctgagccggctgcgctcctggcggttcccggtgccaggcgggaagtttttgaatctaccagctttcagggtaaggaacaggcagccggcccatcgcccgccgccccccatttattacaccaccaccaccatcatgccccactggcccacttcccaggcgacctggtgccagctagtctgccctgcgaggaactggccgagcctgggttagtaccagccgctgctgccaggtacgcgctgcgagaaatagaaatccctctgggcgagctgttcgcgcggaaaagcgtggcgtccagtgcttgctctaccccacccccaggtcccgggcctggaccctgccctggaccggcatccgcttcacccgccagcccaagtcccgctgatgtggcttacgaggagggcctagcgagactcaaaatccgcgcgctggaaaagttagaggtggatagacgcctagagcgtctcagtgaggaagtcgaacagaagatagcgggccaggtggggagactacaagctgaactcgagagaaaggccgcagagctggaaacagcccggcaggagtctgcccgactaggtagggagaaggaagagctggaggaacgtgcctccgagctgagcaggcaggtggatgtaagcgtggagctgcttgccagcctcaagcaggacctggtccataaggagcaggagctgagccggaagcaacaggaagtggtgcaaatcgatcagttcttgaaggagacggccgcccgcgaggcttccgcaaagctgaggctgcagcagttcatagaagagctgctggagcgagctgacagagccgagcgccagctgcaagtgatcagcagtagctgcggatctacacccagcgcctccctgggccgcggcggagggggcggtggggcaggcccgaacgcgcggggcccagggagaatgcgcgagcaccatgtcggaccagctgtacctaatacctacgcagtgtccaggcatgggtctagcccaagtaccggagcatcaagccgtgttcccgcagccagtcagagtagcggctgctatgattccgattcacttgagctgccgcgccctgaggagggggctcccgaggactccggccccggggggttggggacgcgtgcccaggccgctaatgggggttcagaacgatcgcaaccaccccggtccagcggcttgcgtcgccaggcaatacagaattggcaaagacgcccaagacggcattccacagaaggcgaggagggcgatgtttccgacgttggcagccgaacaacggagtctgaggcagagggccctcttgatgctccacgaccaggaccggccatggctggtcccctatccagctgtcggttgtcggcacggccagagggagggtccggaaggggacggcgagcggagcgcgttagcccttcccgcagcaacgaagtcatcagccctgaaattttgaaaatgcgggctgctctgttctgtatcttcacttatctagatacgcgcacgctcctccacgcggccgaggtctgccgtgactggcgatttgttgctaggcatcctgctgtctggacaagggtactgctggagaatgcaagagtgtgctctaaatttttagctatgctggcgcagtggtgtactcaagcccacagccttacgctacagaacttgaagccgaggcaaaggggcaaaaaagagtcaaaagaggagtatgccaggtctacacgaggatgcttggaagcgggcctcgagtctctactcaaggccgccggaggtaatctcctgatactgagaatcagtcactgtcctaatattctaaccgaccggagtctctggctcgcttcttgctattgtcgggctctgcaggctgtgacttaccggagcgccacagaccctgtgggccacgaggtgatttgggcattaggagccggttgtcgggagattgtgtcgctacaggttgcacctcttcatccctgtcagcaacccactagattttcaaatcgctgtctgcagatgataggtcgctgctggccacatttgcgggctctcggagtgggaggagcgggatgtggagtccaaggtcttgcatcgctggcccggaattgcatgaggctgcaggtgctggagctggaccacgtaagcgagatcacacaggaggtggctgctgaggtgtgtcgggagggattgaagggcctggaaatgcttgtcttgaccgctaccccagtgacaccaaaagcccttttacatttcaacagcatctgtcggaacttaaagtctatagtggtgcaaatcggtatagccgattacttcaaggagcccagctcacccgaggctcagaagctgtttgaggacatggtcactaagctccaggctcttcgaagacgacctggcttttccaagattctgcacattaaggtagaaggtggctgttag

SEQ ID NO: 116843 - DNA, 2154 bp, Artificial Sequence
  Description of Artificial Sequence: Synthetic coding sequence
atggcctcctcatcggattcagaagatgatagtttcatggccgtggatcaggaagagacagtacttgagggaactatggaccaggacgaagagccgcaccccgtcctggaagcagaggagactcgtcataatagatctatgtcagagctgcccgaggaggtcctcgagtatattctgtctttcttgtcgccttaccaggaacataaaactgcagccttagtgtgtaagcaatggtaccgcttaatcaaaggagtcgctcatcaatgctatcacggattcatgaaagctgtccaagagggaaatatacagtgggaatcccgtacgtacccatatcccggtaccccaatcacccaacgattttctcattcagcatgctattatgatgccaatcagtcaatgtacgtgtttggtggatgcacgcagtcctcctgtaacgctgcatttaacgacctgtggagactggacctgaatagtaaggaatggattcggcccctggcttcaggttcgtacccatctccgaaggccggagccactctggttgtctataaagatctcctggtgttattcggtggatggacacgcccctcaccctaccccctccaccagccagaaagatttttcgacgagatccatacatatagtccgtctaagaactggtggaattgtattgtgaccacccacggccccccaccaatggccggacactcttcatgcgtgatcgatgacaaaatgattgtgttcggggggtccctcggttcccgacaaatgtctaatgacgtctgggtgctggacttggagcaatgggcgtggtcaaagcccaacattagcggcccctcaccacaccccaggggaggccagagccagatcgtgatcgacgatgccacaattttgatccttgggggctgtgggggtcccaatgcgttgttcaaagatgcgtggctgctccatatgcacagtggtccatgggcatggcaacccctcaaagtggaaaacgaagaacacggagctcctgaactgtggtgccatcctgcatgtagagtcggacagtgtgtcgtggtgttttcacaggctccttcaggtcgtgcccccctcagtccaagcctcaacagcagaccctctccgatatcagccaccccaccggcactggtccctgagacccgcgaatatcgttcgcagtcacctgtgagatctatggacgaagcaccttgcgtaaacggcagatggggcacacttcggcctagagctcaaagacagacccctagtggcagccgagagggaagcctgtcaccagcacggggcgatggaagcccgattctgaacggtggttccctgtctcctggcactgctgccgtcgggggcagctccctggacagccctgtccaggccatatctccctcaacacctagcgctcccgaagggtatgacctgaagatcgggctatctctggcacctaggaggggctcactcccggaccaaaaggatctcaggctcggctctatcgacctcaattgggacctcaaaccagcatcaagctctaatcccatggacggaatggataatcggacggtgggcggttcaatgagacaccctccagaacagaccaatggtgttcatacccccccccatgtagcctccgctctggccggtgctgtgagtcctggggccttgcgccggtctctggaggccataaaggccatgtcttctaaggggccctctgcatcagctgctctgtcccctccactgggctctagccccggctcccccgggagccagagtttgtcgagcggggagacggtgcccataccccgccctggtccagcccagggggatggacactctttacccccaatagccaggagacttggccatcaccctcctcagagcctcaatgtgggcaagcccctgtaccagtctatgaattgcaagcccatgcagatgtacgtgcttgacattaaagacaccaaggagaagggccgggtgaaatggaaggtgtttaattcttccagtgtagttggccccccggagacctcccttcatactgtggtccagggcaggggggaactcattatcttcggcgggctgatggataagaagcagaacgtgaagtattatccaaaaacgaatgcattgtacttcgttcgtgccaaacggtag

SEQ ID NO: 116844 - DNA, 900 bp, Artificial Sequence
  Description of Artificial Sequence: Synthetic coding sequence
atgagtagccctccacaaattgtgatcgacgatgcaactattcttatcctgggcggatgcggcgggcctaacgcccttttcaaagatgcctggctgctccacatgcatagcggaccatgggcttggcagcctctgaaggtggagaacgaagagcatggtgctcccgagctgtggtgccatccagcctgccgagtcgggcagtgcgtggtagtattctcccaggcaccgtctgggcgtgccccactgagcccttctcttaatagcaggccatcccctatttcagcaactccccccgcccttgtccccgagactcgtgagtatcgcagccagtcaccagtcaggtctatggatgaggccccttgtgtgaatggcaggtggggtactctgaggccaagggcccagcgccagacaccctcggggtccagagagggatctttgtctcctgcgagaggcgacggatcccctatcctgaacggcggatctctttctcctggaaccgctgccgttggcggctctagccttgatagtcctgtgcaggctatttccccatccaccccctcggcccctgagggatatgacctgaagatcgggctctctctggctccgaggcggggatcacttccagaccagaaggacctgcgcctcggctctatcgatctgaattgggatcttaaacccgccagtagcagcaatccgatggatggaatggacaacaggactgtgggaggttccatgcggcaccccccagagcagaccaacggcgtccatacacccccgcacgtcgcctctgcactggcaggagccgtttctcctggagcgctacgcagatcactggaggccatcaaagccatgagcagcaaaggtccatctgcatcagccgccctaagcccaccgctgtag

SEQ ID NO: 116845 - DNA, 900 bp, Artificial Sequence
  Description of Artificial Sequence: Synthetic coding sequence
atgtcctctcccccacaaattgtcatagatgatgcaactatcctgattttggggggatgtggcggaccaaatgccctgttcaaggacgcctggctactccacatgcacagcggtccatgggcctggcagcctctgaaagttgaaaatgaggagcacggcgcccccgagctctggtgccaccccgcctgccgagttggccagtgtgtcgtggttttcagtcaagccccttccgggagggctcctttgagtccctctctaaattcccggccgtcccccatcagcgctacccccccagccttggtcccggagactagggaatacagatctcagtcaccagtaagaagcatggacgaagccccctgcgtgaacggacgctgggggaccctccgaccccgggcacagcgtcaaaccccatccggaagcagggagggatccctctcacctgcccgtggcgatggttctccaatactcaacggaggatccctctcacccgggacagcagctgttgggggctcaagcctggacagccccgtgcaggccatcagtccctctacaccgtctgctcccgagggctacgacctgaaaatcgggctaagcctggctccgcggaggggcagcctgccggatcaaaaggatctcagactgggaagcatcgatctgaactgggacttgaagccagcatcatcgtcgaatccgatggatggaatggacaaccgtaccgtcggtggttcaatgaggcatccgccagagcaaacgaacggcgtccataccccgccccacgtggctagcgccctggccggcgcagttagccctggcgcactgcggcggtcactcgaggctataaaagctatgagctcaaaaggaccttcggcgtctgcggccctgtcaccaccactttag

SEQ ID NO: 116846 - DNA, 2127 bp, Artificial Sequence
  Description of Artificial Sequence: Synthetic coding sequence
atgagcttcaaggataaagacgaacgtatttcctgtctggaagcttatgtcacactcacctccaaatcctctaggttcacagacgagacagagatcttgaaaatgagccagcgccactctggccaggccggtactgaagccgggaatggcgcggacagcccaccaattgtaaacagcaaatacagtacatttagagatttttgctcaacttcttcattccaggactcgggctacaacgaattgaagagctgctcttttgataacattgacaaagagtacctggggaaaaaggagaaagggcccacactgctctacgaacatccagaaacttccggacttgggttgactcatcctctcgagtcccctactcagaagaaaaagtgtattctgcccagaaaagagaaagataagacacctgaactgtgtgagacccccaagatttcagggaaaaaatgtctgccaagaagacgcctgaatgtgtctttcgcattgttgaaaggcgacttcgagtctcagaatagcagcctcgagagcagcatttcccaggtgattaacctggagaagaacataccaagctccgccagcggcttctctagggcgaacaacttctctcccctggtgactagcaccctgaaaacggaggaagtcacctcatgcagtcagaaattgcgcttgaattttagccagcagaagacgtccaccatcgacgactctaaagatgattgttctttattcgaagttgagtgtatctcgcctattcaggggaacaattttaaagactcgataacccacgatttctccgatagctccctatgtattaatgacgagaacgcttgccctgaactcctggggtcaagcgtcagcggtaccacctgtgggacagatgaggatatcttcgtgacccctataagcaacctggtggccaacatccgttttaacgcatcacagatccttagtccttcaccagaggtccggggctcgattagtactcctgaggactctgggttcaattcgctatcccttgaaaaatctgaagactcactgagtgatcaagagggttcattccaagagctgcttcaaaaacacaaggggacacccaaggtgggagacactataagaaagactagacaccttggccggtccagaaggttgtcaaccctccgggagcaaagttctcaatctgagaccgaggaggagaaacagattgtccacccagatagcgaaaagcgggcagcagccgcctccgcgattagcgagggtcagctctcatcggacgaatctggggatctcacttttagcctcaagaacctgtcaaaaaccccagctctacagttggttcacgaactgttcatgaaaagtaaacgcaaaaggttacaagagaattcagggcacgaattcctggagcagggggatggggagaagatagctgtgctgcagtgtattctagctgggctgattggaaagaaaatgggcatcgagaagttagatatcctaacggagctgaaatatcgcaacctgaaacacatactggcgatggtgttagagtcgttgacggccgagagcctttgcagcgtttggaaggtcagccgtaactggcgcgaaatcgtcgtccaagacaagaatgcaaaccgccgccggaaattctacatcacacagctgaagactgattccgaaggggctgtgctgaacgtagaagacgcagccactcggcttcagctgctcaaccgctccgcactgagatccgttcaggctcaggccaggattcccgggtcccagcgcgagcaggggtctacactgagcccatggggcgaggtgcttacccctctcgccagctccagtgtgacccatctctctagcaagcaagaagagtacgtgaaagtggccaaaactctctttactgatgaggccctgaaaccctgtcctcgatgccagtcacccgcaaagtatcagccatataagaagcgtgggctctgttcacggacagcctgcggctttgacttctgcgtcctgtgcctttgcgcatatcatggatcagaggagtgtagcagaggcgccgccaaacccaggaaccgtaaggacgctctgcctggaagtgcccaatctaaacgaaatcttaaaaggttgtag

SEQ ID NO: 116847 - DNA, 675 bp, Artificial Sequence
  Description of Artificial Sequence: Synthetic coding sequence
atggcagtgggaaacatcaacgaactacctgagaacattttgctggaattatttacacacgtccctgcgcgccagctgctcctcaactgtagactcgtgtgcagcctttggcgtgatctgatcgatctggtaaccctctggaaacgaaagtgcctgcgagaagggttcatcacagaagactgggaccagccggtagccgactggaaaatcttttattttctccgcagccttcatagaaacctcctgcataacccatgcgccgaagagggctttgagttttggtctctggacgtgaatggcggagatgagtggaaggtagaggacctctctcgggaccagcggaaagagttccctaacgatcaggtccgttcccaggctcggctcagggtacaggtgccagctgttaggagcgctccggtggtccgggccagggcctccggtgacttaccggcgagacccggcgatcatcccgccgaagaaaggtgccaagttgagggtggtctgccacacatcctccaactgcccgcacggaggcccctgcacctcgtatccgctcgcaggagaggccatagtctgctcggacggctggttcgtccagagggccatcagcagcaacaccaccaccgtgcccctgccgctctgacccctcctgaaccccctagtgccgagccctag

SEQ ID NO: 116848 - DNA, 768 bp, Artificial Sequence
  Description of Artificial Sequence: Synthetic coding sequence
atggctgttggcaatattaatgagcttcctgagaacatactgctcgaactgttcacccacgtgcctgcccgtcagctgctgctcaactgccgcctggtttgtagtctgtggcgtgatctgatcgatcttgtaaccctctggaaacgcaagtgcctgcgggagggattcatcaccgaggactgggaccagcccgtcgccgattggaaaatcttttatttcctgcggtctctgcaccggaatctgcttcataatccttgtgccgaagaaggatttgaattttggagcctcgacgtgaatggaggagacgagtggaaggtggaggacctgtcacgcgaccagcgcaaggaatttcccaatgatcaggtgaaaaagtacttcgtcacttcatactacacttgtcttaaatcacaagttgtggaccttaaagccgaagggtattgggaagagctgatggatactacgcgccctgatattgaggtaaaagattggtttgcagccaggccagactgcggtagcaaataccagctttgtgtccagttactttcatcagctcatgccccgctcgggacttttcagcctgatcccgctacaatccagcagaagtctgacgccaaatggagggaggtcagccataccttttcgaactaccctcctggagtgaggtatatttggtttcagcatggaggggtcgacactcattactgggccgggtggtacggacccagagtgacaaattcctcaataacaatcggaccaccccttccttag

SEQ ID NO: 116849 - DNA, 675 bp, Artificial Sequence
  Description of Artificial Sequence: Synthetic coding sequence
atggctgtgggcaatattaacgagctaccagagaatattctgttggaactgtttacccacgtgccggccagacagttgctgttgaattgtcgcctggtgtgctcgctttggagagacctcattgatctcgtgacactctggaagcggaagtgcctgagagaggggttcattaccgaggactgggaccagcctgtggcagattggaaaattttttatttccttagatcactgcataggaatctgcttcataatccctgtgcagaggaggggttcgaattctggtccttagatgtgaacgggggggatgagtggaaggtggaggatctttcgagagaccaaagaaaggagttccccaatgaccaggtcaggtcccaggcaaggctgcgggtgcaggtccccgcagtcagatccgctcctgtcgtgagggctagggcatctggagaccttccagcccgccccggtgaccaccccgccgaggaacgatgccaggtcgaaggagggttaccgcatatacttcagcttcccgcaagacgacccctccaccttgtgagtgcgcggcgccgcgggcactcattgttgggccgtctggtgcgcccggagggacatcagcagcaacaccatcacagagccccggctgcccttacaccgccagagccccctagcgccgagccttag

SEQ ID NO: 116850 - DNA, 675 bp, Artificial Sequence
  Description of Artificial Sequence: Synthetic coding sequence
atggccgtgggcaacatcaacgagcttccagagaatattctattagaactttttacgcacgtgcctgcacggcagctcctcctcaattgtagactcgtatgttccctgtggagagatcttattgacctcgtgacactttggaaacgcaaatgtctgagagaggggttcatcaccgaggattgggatcagcccgtcgcagactggaagatattttattttctccggtcattgcaccgaaacttgctgcataacccctgcgccgaggaggggttcgagttttggtctctggacgtcaatggaggcgacgaatggaaagtcgaagatctctccagagaccagcgtaaggaattccccaatgatcaagtgcgctcccaggcacggttaagggtgcaggtacccgctgtgcgttcagcccccgtggtgcgcgcaagggcttcaggggacctgcccgctcgcccaggtgatcatcctgccgaggagaggtgccaagtggagggagggttacctcacattctccagctacctgcacgccgcccactgcatctcgtatctgcccggaggcggggccatagcctgctcgggcgcctggtccgtccagaaggacaccagcaacagcaccaccacagagcgcccgcagctcttaccccacctgagccaccttccgccgagccatag

SEQ ID NO: 116851 - DNA, 771 bp, Artificial Sequence
  Description of Artificial Sequence: Synthetic coding sequence
atggctgttggtaatatcaatgagctgcccgaaaacatcctcctcgagttgtttacacatgttcctgcaaggcagctgttactcaactgccgactagtgtgcagtctctggagagacttaatcgatctggttaccctttggaagcgcaagtgcctccgcgaagggtttatcactgaagattgggaccaacctgtggccgattggaaaattttctatttcctgcggtcacttcacagaaacctcctgcataatccgtgtgctgaggaggggtttgaattctggtccctagatgtgaacgggggagacgagtggaaggttgaggacctttctcgcgatcagcgaaaggaattcccaaacgatcaacatctgccccaggtgcctggcggaggcccgcagggccgccgggtgcttggcggcgctgatggctatcacacagccgggcatcgcggtcagggcctcgtgcgatctcaagccagactccgcgtgcaggtgccagccgtgcgcagcgctcccgtggtaagagctagggctagtggagatctgccagcccggcccggcgatcatcccgccgaggagaggtgccaggttgaaggcggattgccacacatcttacagctccctgcgcggagaccactccaccttgtctcagcacggcgccgtggtcatagcctgctgggccggctggtgaggccagagggccaccagcagcaacaccaccacagagccccagctgcactcaccccccccgaacctccaagcgctgagccctag

SEQ ID NO: 116852 - DNA, 768 bp, Artificial Sequence
  Description of Artificial Sequence: Synthetic coding sequence
atggcagtcggtaatattaacgagttacccgagaatattctgctagagttatttactcacgtgcctgccagacagctgctacttaattgcaggttagtgtgcagcttgtggcgtgacctgattgacctggttaccctatggaagaggaagtgcttgcgcgaaggcttcatcactgaggattgggatcaacccgttgcagactggaagatcttttacttcctcaggagcctccacagaaatttgctccacaatccatgcgccgaggagggctttgagttctggtctttagacgttaatggaggcgacgagtggaaagttgaggacctgtccagggaccagagaaaggagttccccaatgaccaggtgaaaaagtacttcgtaacttcgtactacacgtgtcttaaatcccaagtggtcgatttgaaagccgagggctattgggaggagctaatggacaccactagaccggacatagaagtaaaagattggttcgccgcgagaccagattgtggttcgaagtatcaactgtgcgtgcagcttttgagcagcgcccatgcccctttgggcacttttcagcccgatccagctaccatacagcaaaagtccgacgcaaagtggcgggaggtttcacatacattttctaactacccaccaggcgtcagatacatttggttccagcatggaggagttgacacccactattgggcaggatggtacggcccgagggtgacaaactcatctataacaattggccccccactgccttag

SEQ ID NO: 116853 - DNA, 498 bp, Artificial Sequence
  Description of Artificial Sequence: Synthetic coding sequence
atggccgtcgggaacattaacgagctgcccgaaaatatcctcctggagcttttcacacatgtaccagcccgccagcttctcctgaattgtagactcgtctgctccctttggcgggatcttatcgatttggtcacactatggaagcgcaaatgtttacgggaagggttcatcaccgaagactgggaccagcctgtcgccgactggaaaatcttctacttcctgagatccttacaccggaacttactacacaatccctgcgctgaggagggattcgagttctggagcctggacgttaatggtggggacgaatggaaagtggaagatctctcaagggaccaacgaaaagaatttccaaacgaccaggttaggtctcaggcgcggttgagagttcaggtaccggccgtgcgtagcgcgcctgtcgttagggctcgggccagtggtgacttacctgccaggcctggagaccatcctgcagaggagcgctgccaggtggaatag

SEQ ID NO: 116854 - DNA, 861 bp, Artificial Sequence
  Description of Artificial Sequence: Synthetic coding sequence
atggccgcacctgctcccggcgctggagccgcaagtggcggggctggctgctctggcggaggggccggggcaggagccggcagcggcagcggcgccgctggcgccggcggacgcctccctagccgagtcttagaactggtgttcagttatttggagctgagcgagctgcgctcatgtgctctggtttgcaagcactggtacaggtgtctccacggtgatgaaaacagcgaggtgtggaggtccctgtgtgcccgcagtctagctgaggaagcccttaggaccgacatattatgtaatttgcccagctataaggccaaaattagagcctttcagcatgccttcagcacaaatgactgtagccgcaacgtttatattaagaagaatggatttactctgcatcgaaaccccattgctcagagcacagacggagccaggacaaaaatcggattttccgagggtaggcatgcttgggaggtgtggtgggaagggcctctcggcacagtggccgtgattggaatcgccaccaaacgcgcacccatgcagtgccaaggatacgttgccttgcttggctcagacgatcaaagctggggatggaatcttgttgacaacaatctactccataatggagaagtcaatgggagtttcccgcagtgtaataatgcccctaagtatcagatcggagaacggattcgcgtgattctggacatggaagataaaacactcgcttttgaacgaggctatgagtttctcggtgtggcatttaggggcctgccgaaagtttgtctatatcccgctgtcagtgccgtgtacggcaatactgaggtgaccctggtgtacctggggaagcctctggatggttag

SEQ ID NO: 116855 - DNA, 1812 bp, Artificial Sequence
  Description of Artificial Sequence: Synthetic coding sequence
atggatagaggatctctgctcccgtttcagctgtggtgccccaggcctttcggtacatactcccagaatcagcctcggcccccctctgcggctctgaagccctcagcctgtcccgagccaggcggcggcgccgagcccgaccacggccccgcccactcagagaatacgcctcccgccttagccaccgaggttcctgctagccagccagccccactgctgtccgccgccgcagcaggcgacgaaggccgggtgctgttggacacctggtatgtaatcaagcccgggaacacaaaagaaaaggtggcctttttcgttgcccatcagtgtggcgggggaagccgggcaagttccatgaaagtgaaaggccactggggttccgatagtagcaaggccaagcgtaggaggcgatgtctcgacccgaccaaggccccacctgatcccggcggccgcgaaggaccccctgcagctgaagagggtccggcatcagctggagaggatgtcgacctcttgtcggtcgccgaaatggtggctctggtcgagcagagggcagctttagctctccagtcctaccccagaccaaccactccggccccggtggtgtttgtcagtgctgagcaggggggacccgcgaaaggcgtgggctcagaacgccgaagcggagggggcgactgcagcagagttgcagaggcggttgcccacttcgaggcccaacgggactcgccccccaccaaaggattacggaaagaggagcggcccgggccgggccctggtgaagtccgcattgcatttcggatcagcaacgggcgcgagcctagggcccctgactcaggtctgccctctggtgggggaggtagaccaggctgcgcttatccaggcagcccaggcccgggggcccgggccaaagataaaattacctgtgacctatatcaactgatatccccctctagagatgccctgccaagcaacgtggaattcctcctggcaagggctgatgaggcttctgaaggggattctcccgccccagcgcgcccagaagacactccgccagcgccaccaccccctcccgccagggactgcggcgcctccggattccacgtagatgtcgtcgttacgggggtcgtggacgaatgtatcttttttggcaaggacggcaccaagaacgtcaaggaggagactgtatgtctgaccgtgtcccccgaagaacctccaccaccaggccaattgttcttcctccaaaaccgtgggccagacggaccccctgagccgcctcctgctgactcacccgctacagcccctggacccgatgacgccgaaggaactgccgacacctcattgtgtaggctctataggcatgtatcacacgacttcttggagatccgattcaagatacagagactgctggaaccacggcagtacatgctgctactccccgaacatgtgttagtgaagattttctctttcctgccaacccgcgcactggctgccctaaagtgtacctgtcatcacttcaagggcatcatcgaagcctttggcgttagggcaaccgactcccggtggagtcgggatcccttgtaccgagatgacccttgcaagcagtgtcggaaacggtatgagaaaggagacgtgagcctgtgtcgatggcatccaaaaccttaccatcatgatctaccatatgggcgttcctactggatgtgctgcaggcgcgcagaccgtgagacgcccggatgccgcctcggactgcatgataacaactgggttttgccttgcaatgggcctgggggaggaagagcaggaagggaagagggtcgttag

SEQ ID NO: 116856 - DNA, 609 bp, Artificial Sequence
  Description of Artificial Sequence: Synthetic coding sequence
atgacgtgtctgactgatgtgcctacaggatgtgctgccgtggaacctaccgcacgcctgccagcagctgcttgggcctctaccataactaccgggtgttgcccagccatgggacaagccggagccggcccagcggggcgcagagggggggaagcaggagggggagagggaagagcccatcatgcccatccatcgcccttacctcgcgaaccccgtgtgcgcaccgggcccccggcccactccccgacccctggatccatagatccaagtcccgaactgtcatggggcagcgcaggggtgacgcaggagagccccctcttagatcccgtggattttcttttgttcagaacgagagccgtcgacccgctccgacgggtgttttttttcttttatcagcacctgacgttcttctccatacaaccacagcctcccccgtgccacgcctttcaccccaaggaccctcccgctggctcccggagacagctcatcttagttcctttaaaaggccctcctatcctcgcgcccattctctccctcacccctatcttatcgcgctggagctgttatttcccacgaagccgaatagctcagggctggcacctcagctag

SEQ ID NO: 116857 - DNA, 1359 bp, Artificial Sequence
  Description of Artificial Sequence: Synthetic coding sequence
atggctagtcgcatcaatacaaacttcactctgattcctaatcagaagttacgacgcagcaacaggcaaacttcctgttacagtaaaactctgggttctggatttcaacctatttctactttcgggaactttaaggctctcccactggagatatttcagattatcctgaaatatttgagcgtcaaggatatctctatgctgtcaatggtctcaaaaacagtgagccagcatattattaattatatctccacaagcagtggtagcaaaagactcttgctccaggatttccataacttggaattgccggacagacggcaggactccgccatcctcgaacactacaggtcactcgggctgctctttaagaggtgtacgttgctgctgcccacgaaggagcgcctgaaatacattcataagatattgaccgaagtctcttgcttcaaattcaacggctgcgccgctccgatgcagtgccttggattgacatgctatggtatgtttctccagacgcttacggcgggatgggacgagttggaatgccaccgcgtctataatttcctttgcgagctgactaacctgtgtaggaaaattcaaatggccgtgtgttccaaacccgggtctgcgcaaaagctggaactgaggatcagactgttttgcagaaacgtcctcctggaccactggactcatcgctccgactccgccttttggctcactcggatcctgaaaccctggcctatggttaaccaggccagattactgtatataattttcggaccgatttctccacaagatggtcaggtggtctggcaggaaatgatcgaagaacccactgacgaattcagcctgaagggcctcgctgatgcaatcaaactgctgtacgacgcatccacaaaagagtggaccgcggacgatgtgatttcactggttgacgagctctctgttgtgcccagagagtggctgcttgaaaataacgcgagactgttgatgctcagcgggaacaatatctgtttctcttttatggcatccaaggcggtaaatggccggacaatcgagctcgcccgcttagtggtgttcctggcccttgtgtgcgagaaggaactgtactgcatggattggacggtgaagatgatgcaaaaggtgtgcaaggtgttttctaccccggtggaacggaaaaacttcctgcagaatgtggcaaatgcctttgcttgcgtaatcatggagatgctccagagcattatgtcgggcgaccgcgacgaggacgaccgctcctttttaaatctgtttcatctcgtgcacgcgcaagcaaacttccacaaggaggtcctgtacctgacaatgaatactcctcttagcacttag

SEQ ID NO: 116858 - DNA, 2133 bp, Artificial Sequence
  Description of Artificial Sequence: Synthetic coding sequence
atgggagggaagcagcgagatgaggatgatgaggcatatggcaagccagtaaagtacgacccctccttcagagggcctatcaagaaccgaagctgcactgatgttatttgctgcgtgctctttctgctttttattcttgggtacatagtcgttggtattgtagcatggctctacggagacccccgtcaggtgctgtatccgcggaactcaacaggagcctattgcggaatgggggagaataaagataagccttatctcctgtacttcaacatcttctcctgcattctctcgtccaacatcatctctgttgctgaaaatgggttgcagtgtccaacccctcaggtttgcgtgtcatcatgtccagaagacccctggaccgtgggaaagaacgagttctctcagaccgtaggggaagttttttacaccaagaataggaatttctgtcttcccggtgttccatggaatatgaccgtgattacttccttacagcaggagctctgccccagcttcctgctgcctagtgctcccgcccttggaagatgtttcccgtggaccaatgttaccccaccagccctaccaggaatcacaaacgacactacgattcagcaggggatctccggcctgattgatagtttgaatgccagggatatctcagtgaaaatctttgaggatttcgcacagtcttggtactggattctggtggctctaggagtggcattggtgttaagtctgttatttatcctgctcctgcgtctggtcgccggccctctggtccttgtactgattctgggcgtcctgggagtgctcgcatatgggatttactattgctgggaggaatatcgcgtgctacgtgataagggggcaagcatatcccagcttgggttcacaaccaatctgtctgcatatcagtcagtgcaggaaacctggcttgctgcgctgatcgtactggcagttctggaagcgattctccttctcatgctgatatttctgagacaacgcattcggattgcaatcgcactcctgaaagaggcttccaaagctgtggggcagatgatgagtaccatgttctaccctctggtaactttcgtcttgctcctgatttgtatcgcgtactgggccatgacggctctctatctcgccactagtggccaacctcaatacgtactttgggctagcaacatttcatctccaggctgtgagaaggtccccataaatacctcgtgtaatccaacagcacacctcgtcaattcttcatgtccgggattgatgtgtgtgtttcagggatatagtagcaaaggcctgattcaacgatcagtctttaatttgcaaatctacggtgtgctgggcctattctggaccctcaattgggtgcttgcgctgggacagtgcgtcctagccggtgcctttgcctcattttactgggcatttcacaaaccacaagatatacccacctttcctcttatctctgccttcattcgaacgttgcggtaccacactggctctctcgcattcggggcgctcattctgactctggtgcagatcgctcgcgtcatccttgaatacattgaccacaagctccggggggtacagaatcccgtggctcggtgtatcatgtgctgtttcaagtgctgcttgtggtgcttagagaagttcatcaaatttttaaaccggaatgcgtacatcatgatcgcaatatacgggaagaacttttgtgtgtcagcaaagaacgccttcatgctgttgatgagaaacattgtgagggtcgtggtgctcgataaggtgaccgacttgctgctattcttcggtaaactgctagtggtgggaggcgtgggggtcctatcattcttcttcttttctggtcgcatccctggactgggcaaagactttaaatcacctcatctgaactattactggctgcccatcatgaccagtatcctgggtgcctatgtcattgcttctggatttttctctgtcttcggtatgtgtgtagatactttatttctgtgttttctggaggacttggaacggaataacggctccctcgatagaccctactatatgagcaaatctctgcttaaaatcctcggaaagaaaaatgaggctccgccggacaacaaaaaacgtaaaaaatag

SEQ ID NO: 116859 - DNA, 1206 bp, Artificial Sequence
  Description of Artificial Sequence: Synthetic coding sequence
atgaaatgtgactttaattgcaaccacgtgcactccgggttgaagctcgtgaagcctgacgatatcggccgactcgtgagctacacacctgcctatctggagggcagttgtaaagactgcattaaggactatgagagattgagctgtattgggtcaccaatcgtttcccctcgaattgtgcagttggagactgaaagcaaacggctacacaacaaggagaatcagcacgtgcagcaaacactaaatagcaccaatgagattgaggcactagagacatctagactgtatgaggattccggttattcttcctttagtctgcagtctggactgtcagaacatgaagagggcagtctcctagaggaaaacttcggagactcacttcagagttgcctgctacagatccagagtcccgatcagtacccaaacaaaaacctgcttcccgtcctgcatttcgaaaaggtggtttgcagcacactaaagaagaatgccaagagaaacccgaaagttgatcgcgagatgctgaaagagataatcgcccggggcaactttaggttacagaacatcatcggtaggaaaatggggctggagtgtgtcgacattctctccgaacttttcaggcgagggctgcgccatgttcttgccaccatactcgcccagctctcagatatggatctaatcaatgtgtcaaaagttagcacgacctggaagaaaattttggaggacgacaaaggggcctttcagctgtactccaaggccatccagcgggtgactgagaacaacaataagttttccccccacgccagcactcgcgaatacgtgatgttccgtacgccactggccagcgtccagaagtctgctgctcagacgagcttgaaaaaggatgcccaaacaaagctgagtaaccaaggggaccagaagggttctacttactcgagacacaacgagttctcagaggtcgctaagactctgaagaagaatgaatccctcaaggcgtgcattaggtgcaacagtcccgccaaatatgactgttacctgcaaagagcgacctgtaagcgagagggttgcggctttgactactgtactaaatgtttgtgtaattaccacacaaccaaggattgctctgacggaaaactcctaaaggcctcatgcaaaatagggcctcttcccgggaccaagaaaagcaaaaaaaatttgagaagactgtag

SEQ ID NO: 116860 - DNA, 882 bp, Artificial Sequence
  Description of Artificial Sequence: Synthetic coding sequence
atggacgccccacattctaaggctgctctggacagcattaatgagctgccagaaaatatcctgttagagctctttactcacgttcctgctagacagcttctcctgaattgccgcctcgtgtgctctctgtggcgggatctaatcgatctgatgactctttggaaacgcaaatgccttcgggagggatttatcacaaaggattgggaccagcctgtcgcagattggaaaatcttttattttctcaggtcattgcatagaaacttgcttaggaatccatgtgctgaagaggacatgtttgcatggcagatcgatttcaatgggggcgatcgctggaaggtggagagtctgcccggggcacacggcaccgacttccccgaccctaaggtcaaaaaatattttgtgacctcttacgagatgtgcctcaagtctcagctggtggacctggtggcagaggggtactgggaagagctgctggacacttttaggcctgacatagtcgtcaaagattggtttgccgctcgcgcggactgtggctgcacataccaactgaaggtccaacttgcctccgccgattattttgtgctagcttcattcgagccgcccccagtaacaattcaacagtggaataacgccacatggacagaagttagttacaccttctcagattatcctagaggcgttcgatacattttgttccagcacggagggcgcgacactcagtattgggccggttggtacggcccaagagtcactaatagcagcatcgtggtctcaccaaaaatgactaggaaccaagcatcgtccgaggcgcagcctggccagaaacacggacaggaggaagccgctcaatctccctatagggcggtggtgcagatattttag

SEQ ID NO: 116861 - DNA, 750 bp, Artificial Sequence
  Description of Artificial Sequence: Synthetic coding sequence
tagaatgagctccccgagaatatccttttggaactgttcactcatgtcccggcacggcaactgctgctgaactgccgcctggtgtgttccctatggagggatctgattgatctaatgaccctctggaagcgcaaatgccttcgcgagggtttcattaccaaggattgggatcagccagtggcagattggaaaatcttttactttttacggtcactgcaccgcaacttgctgcgcaacccatgtgcggaagaagatatgttcgcctggcagatcgattttaatggcggggacagatggaaggtcgaatctttgcctggcgctcacggcaccgatttccctgatcccaaggtgaaaaaatatttcgttactagctatgaattcgccgccagggccgactgcgggtgcacataccagctcaaggtgcagttggctagtgccgattacttcgtgctagcctccttcgaacctcccccagtgacaatacagcagtggaataacgccacctggacagaagtgagctacacattttcagactacccacggggagtaaggtacatactgtttcaacatggcggaagagatacacagtattgggcgggctggtacggaccgcgggtgaccaactcatccattgtcgtgtctcccaaaatgacacgaaaccaagccagcagcgaggcgcagcctgggcagaagcacggacaggaggaggcggctcagtctccttatagggccgtggtgcagatattttag

SEQ ID NO: 116862 - DNA, 1569 bp, Artificial Sequence
  Description of Artificial Sequence: Synthetic coding sequence
atgcgcttgagggtgagacttctcaagaggacctggcccttggaagttccagagacagagcccacactggggcatctaagatcccaccttcgccagtctctgctgtgtacatggggctactcatctaacaccagatttacaatcacgctaaattacaaagatcccctcaccggagacgaggagactctggccagctatggcatcgtgtccggagatctcatctgtcttattctgcaagatgacatacccgccccaaatatccccagctccacagactctgagcattcgagtcttcagaacaacgaacagccaagccttgctacttcgtctaaccaaacctccatgcaagacgagcagccctcagacagctttcaaggccaggccgcgcaaagcggagtctggaatgatgatagtatgctcggcccttcccagaacttcgaggccgagtcaatccaggacaacgcccacatggccgaggggacgggcttctacccaagcgagccgatgttgtgctccgagagcgttgagggccaggttccccacagtcttgagacactataccaatctgcagactgtagcgatgcgaatgatgctcttatcgtgctgatacacttgctgatgctcgaatcagggtatattccccagggtaccgaggccaaagctctaagtatgcctgaaaaatggaaactgtctggcgtttataaactccagtatatgcatcctttatgtgagggttcttctgcgactcttacctgcgtcccattaggtaatctaattgtggtgaatgccaccttgaagatcaataacgagatccgttcggtcaagcgactacagctgctgcccgagagcttcatctgtaaggaaaaactgggggagaatgttgccaatatctacaaggacttgcagaaactgtccagattattcaaagaccaactggtgtacccccttctcgcttttactcgccaagcccttaacctgccagatgtgtttgggcttgttgtactgcccctggaacttaaactgcggatattccgactcctagatgtgcgatccgtgttgtcactgtcggcggtctgcagagacttattcaccgcctccaacgaccccctattgtggaggtttctttacttacgcgacttccgggacaatacagtgagggttcaggacactgactggaaggagctgtaccgcaaacgacacatccagcgcaaggagtctcctaagggaaggttcgtgatgctgcttccaagtagcacgcacaccatcccgttctacccaaaccccttgcatccccgcccatttcctagttcccgcctgcccccaggaataatagggggagaatacgatcagagaccaacactcccatacgtcggtgacccaatttctagtctcatccccgggcccggggaaaccccttcccagtttcccccactgagaccaagattcgatccggttgggcctctccctggccctaacccgatattgcctggccgaggcggccccaacgataggttcccattccggccctcaagaggcaggcctactgacggaaggctcagctttatgtag

SEQ ID NO: 116863 - DNA, 1332 bp, Artificial Sequence
  Description of Artificial Sequence: Synthetic coding sequence
atggctcggcccccaggcggcagcggccctctactcgacagcgagcactccagcctccagaataatgagcaacctagcctcgccacgtcctctaatcagactagcatgcaggacgaacagcctagtgatagttttcaagggcaggcagctcagtccggcgtttggaatgacgacagtatgctcggaccctcgcagaatttcgaggctgaatctatccaggataacgcacacatggccgagggaaccggattctacccctcagagcctatgttatgcagcgagtccgtcgaagggcaggtgcctcactctctggaaaccttgtatcagtcagcagactgctctgatgcaaacgacgcccttatagttctcattcacctgctgatgcttgagtccggctacatcccccaagggaccgaggctaaggcactcagtatgccggagaaatggaaactgagcggggtttataaacttcagtatatgcaccctctgtgtgaaggttccagcgcaactctgacatgcgtgcctcttggaaatttgattgttgtgaacgctaccctcaagattaacaatgagattagaagtgttaaacgcctgcagctgttgccagagagttttatctgcaaggagaagttgggagaaaatgtcgcgaacatttataaagacttgcagaagctttcacggctttttaaagatcagctcgtgtacccactgttggcttttacaaggcaggctttgaatcttccagacgtgtttgggttggtcgtgctccccctcgagctgaagttacgaatctttcgcctgctcgacgttcgatcagtgttgagcttaagcgctgtgtgcagggatctgttcaccgcctctaatgacccactgctgtggcgattcctttacctgcgcgattttcgcgataacacagtgagagtacaggatacagattggaaagagttatatcgcaagcgccacattcagcggaaagagtctcctaaaggtcgctttgtaatgctcctgccaagctcaacgcacaccatcccattttaccctaatcccttgcacccgaggccattccccagtagtcgcctgccacccgggattataggcggggaatacgaccagagaccgacgctcccatacgttggtgaccccatctcatcccttatacctgggccaggagagacgcctagtcagttcccaccactgcgacctcgattcgatccagtgggcccactccctggtccgaaccctatcctgccgggtcgggggggccccaatgatcgatttccctttcgcccatcacgaggccgacctacggacggaagactctcattcatgtag

SEQ ID NO: 116864 - DNA, 1227 bp, Artificial Sequence
  Description of Artificial Sequence: Synthetic coding sequence
atgcaagacgaacaaccatccgactcatttcagggacaagcagcacaaagcggcgtttggaatgacgacagtatgctgggtcccagtcaaaacttcgaggctgaaagcatacaagataatgcacatatggcagaaggtaccggattctatccgagcgagccaatgctatgcagtgagagcgtagaggggcaggtgccgcattcgctggagactttgtaccaatccgctgattgttctgatgccaacgacgccctgattgttctaatacatttactgatgctcgagtcgggatacattccccaaggcacggaagccaaggccctttctatgccggaaaagtggaagctctctggcgtgtacaagcttcaatacatgcacccattgtgtgaaggaagctcagccacactaacctgcgtccccctgggcaatctaatagtcgtgaacgctacactcaaaatcaacaacgagattaggtcagtgaagcggttgcagttgttaccagagtcatttatctgcaaggaaaagctgggcgagaacgtcgctaatatttacaaggatctgcagaaactaagtcgactattcaaagaccaactggtttatccgctcctggcttttactagacaggctctgaatctccccgacgtgtttggactggttgttctaccactcgaactcaaactgagaatatttcggctcttggatgttcgatcagtgctgagtctgtctgccgtgtgcagggatctgtttaccgcctccaatgaccctctcctgtggcgtttcttgtatctgcgcgatttccgtgacaacacagtgcgtgtccaggacacggattggaaggagctatacagaaaacgtcatatccaaagaaaggaatctccgaagggaagattcgtcatgttactgccgagctccacacacacgattcccttttatccaaatcctctgcaccccagacctttcccatcctctcggttgccacccggcatcattggaggggagtatgaccagcgcccgacgctgccatacgttggcgacccaatttcttctttgattcctggacctggtgaaactccctcgcaatttccaccactcaggccccgattcgatcccgtggggcctcttcctgggcccaacccgatcctgcccggccgaggtgggcctaacgatcgattcccttttagacctagccgcggccgacctactgatgggaggttatcttttatgtag

SEQ ID NO: 116865 - DNA, 699 bp, Artificial Sequence
  Description of Artificial Sequence: Synthetic coding sequence
atgcagctcaccttcgcgtggttacacgtgtttgggagaaccctccggatgatgaacttttcaggaaaagggtgtgcaaacccctgggggcattgctccatttacaataagaaccctccattggggtttagtttccggaagttatacatgcagctggacgagggtagtctgactttcaacgccaaccccgacgaaggtgtgaactatttcatgagcaaggggatcctcgatgactcacctaaagagatagctaaattcattttttgtacgcgcacgctaaactggaagaagttaagaatttacctggacgagaggcgggacgtgctcgacgacctggtaactctgcacaactttcgtaaccaatttcttcccaatgcactgagagagttctttcgacacattcacgccccggaagaacgcggcgaatatctagaaacattgattacaaagtttagccaccgcttctgcgcctgtaaccctgacctaatgagagaacttggcctgagccctgacgccgtttacgttctgtgctactcactgatcttgctctctattgatctcaccagtccgcatgtcaaaaacaagatgtccaagcgggagttcatcagaaataccagacgtgccgcacagaatatttccgaagattttgtagggcacctctatgacaacatctatcttatcgggcatgttgcagcatag

SEQ ID NO: 116866 - DNA, 960 bp, Artificial Sequence
  Description of Artificial Sequence: Synthetic coding sequence
atgggtcaggggctatggcgggtcgtgcgcaaccagcagctgcagcaagaggggtacagtgagcagggctacttgaccagggagcagagtcgtcggatggccgcctctaacattagtaacacgaaccaccgtaaacaggtacaggggggaatcgacatttatcacctgttaaaagcccgtaaatccaaggagcaagaggggtttattaatttggagatgttacccccagaactgagctttactatcctgtcatacctgaacgctactgatctctgtctcgcatcatgcgtctggcaggacttggccaacgacgaactgctgtggcaagggttgtgtaagtctacttgggggcactgtagcatttacaataagaacccacctcttggtttttcgttcagaaaactgtatatgcagctggatgaaggatctctgacattcaatgctaatccagacgaaggagttaattacttcatgagcaagggcatcctggatgactcccccaaggagatcgcaaaatttatcttctgcactcgcactctgaactggaagaaattgcgcatctacctcgatgaacgccgcgacgtgttggatgatctcgtcacactgcacaacttcaggaatcagttcctacctaatgccctccgggagtttttcaggcacattcatgctcccgaagagcgaggagagtatttggagacactcatcaccaagttttctcaccggttttgtgcttgtaaccctgatctcatgcgagagctgggacttagcccggacgccgtctatgtgctgtgttacagcctgattttgctttccatagacctaacgagccctcatgtgaaaaataaaatgtcaaagagagagtttatccggaacacacggagagccgctcagaacatctcagaagactttgtaggacatctgtacgacaacatttacttaattgggcacgtagccgcatag

SEQ ID NO: 116867 - DNA, 555 bp, Artificial Sequence
  Description of Artificial Sequence: Synthetic coding sequence
atgggacaaggactctggagagtcgtgagaaaccagcagcttcaacaggaaggctactcggagcagggttacctcactcgcgagcagtctcggcgaatggccgctagtaacatttccaacaccaaccaccgtaaacaggtgcagggcgggattgacatctaccacttgctaaaagccagaaaatcgaaagaacaggagggctttattaatctagagatgctgccacctgagttgagcttcactatccttagttatttaaacgcaacggacctttgcctggccagttgcgtgtggcaggacctggcaaacgacgaactgctatggcagggactttgcaaatcaacatggggtcactgttctatttataataaaaacccccctctgggatttagcttcagaaagctctatatgcagttggacgagggttctctaacctttaacgcaaaccctgatgagggcgtgaactattttatgtccaaaggcatccttgatgacagtcctaaggagatagctaagttcattttttgcacccgaacccttaactggaaaaagtag

SEQ ID NO: 116868 - DNA, 1344 bp, Artificial Sequence
  Description of Artificial Sequence: Synthetic coding sequence
atgccagacattatatgggttttccctccacaagccgaggccgaggaggactgccactcagacaccgtcagggccgatgacgacgaggagaatgagtccccggccgaaaccgacttacaggcccagttacagatgttccgcgcgcaatggatgttcgagctcgctcctggcgtgtcctcttcgaatctggagaaccggccctgccgagcagcccgcggcagtcttcagaagactagtgctgacacaaagggcaaacaggagcaggctaaggaggaaaaggcacgcgagctgttccttaaagcagtggaagaagaacagaacggcgccctgtatgaagccattaagttttaccgccgagccatgcagctggtccctgatatcgagttcaagataacttatacaaggtcccctgacggagacggggttgggaactcctatatcgaggataacgacgatgattccaagatggctgacctcctgtcctactttcagcagcaacttacgttccaggaatcagtgttgaagctgtgccagcctgaactggagagcagccagatacacattagcgtcctgccaatggaggtcctcatgtacatcttcagatgggtggtctcctccgacttggatctccgctccctcgaacagctgtctcttgtttgcagaggattctacatatgcgcccgggatccagaaatatggcgtcttgcatgcctcaaggtctggggccgctcttgcatcaagctggtgccttacaccagttggcgggagatgtttctcgaaaggcctcgtgtgcgcttcgatggcgtctacatttccaagactacatatattcggcaaggggagcagtcactggatgggttctaccgtgcctggcaccaggttgagtattaccggtatattaggttcttcccagatgggcacgttatgatgttgactacaccagaagagccccagagcatcgtgccccgccttcgaactcgcaacacccgaaccgacgcgatcttgcttggtcactatcgattatctcaggacactgacaaccagacgaaggtgttcgctgtgatcacgaaaaagaaggaggagaagcctcttgattacaagtatagatattttcgacgagtgcctgtgcaggaagcagaccagtcctttcacgtgggtctgcagttatgtagttcaggccaccaacgatttaacaaattaatttggatccaccactcctgtcatattacgtataaatctactggagagacagctgtgtccgccttcgagatagacaagatgtatacccccctcttttttgcacgagtcaggtcctacactgccttctccgagagacccctttag

SEQ ID NO: 116869 - DNA, 1314 bp, Artificial Sequence
  Description of Artificial Sequence: Synthetic coding sequence
atggccgaggctgaggaggactgtcattccgacactgtcagagcggacgatgacgaggagaacgaatcccccgctgagacagatctgcaggcacaactccagatgttcagggcccaatggatgtttgagttggctccaggggtgagctcaagcaatctggaaaatagaccatgccgggctgcacgcggcagtctgcagaaaacgtccgccgatacaaagggtaaacaagagcaggccaaagaggagaaagcgagggaactgtttttaaaggccgtggaagaagagcagaacggcgcactgtacgaggctattaagttttaccgaagagctatgcagctcgtaccagatattgaattcaagataacctacactaggtctcccgatggcgacggagtcggtaattcctacatcgaggacaacgatgacgacagtaaaatggctgacctgttgagttactttcagcagcagctcacgttccaggaatctgtgcttaagctctgccagccggaactggagtcaagtcagattcatattagcgtgttacccatggaagtgttaatgtacatattcaggtgggttgtgtcttcggatctggatctccgcagcctggaacagttatctctcgtatgtagaggattctacatctgtgcccgtgatcctgagatctggaggctcgcttgccttaaagtgtggggccgaagctgcatcaagctcgttccttacacatcctggagggaaatgtttctggagcggcctagagtgcgcttcgacggtgtctacatcagtaaaacgacatatatccgacagggggaacagtccctggatggtttctatagggcgtggcaccaagtcgagtattatagatacataaggttctttcccgacggacatgtcatgatgctgactacccccgaggagcctcaatccatagtgcctcggctgcgaaccaggaacactcgcacggacgcgattctgctcggccattatcgcctgtcccaggataccgataatcagacaaaagtgttcgccgtaatcacgaaaaaaaaggaggaaaaaccgttagattataagtatagatacttccgccgggtccctgtccaggaggccgaccaaagcttccacgtaggactgcagctgtgctcttccggacaccagaggttcaataagctcatttggatccatcactcctgtcacatcacatacaaatctacaggggagactgccgttagcgcatttgagatcgacaagatgtacacgcccctgttcttcgcccgtgtgagaagttacactgcttttagtgaaagacccctgtag

SEQ ID NO: 116870 - DNA, 1212 bp, Artificial Sequence
  Description of Artificial Sequence: Synthetic coding sequence
atgttcagggcccagtggatgttcgaacttgccccaggcgtgagcagttcaaacctggaaaacagaccctgtcgtgcagcgaggggatcgctacagaaaactagtgccgataccaagggcaagcaggaacaggcaaaagaagagaaggctcgagagctgtttctcaaggctgttgaggaggaacagaatggggccctgtacgaggcgatcaaattttatcgacgagctatgcagctcgtgcctgatatagagttcaagatcacatacacccgatcccccgacggggacggcgtgggaaacagctacatcgaagacaacgacgacgatagcaagatggccgaccttctttcctattttcagcagcagctaacctttcaggaaagtgtgctgaagctgtgccagcccgaactggaatcgagccagatccacatctcagtgcttccgatggaggtgctcatgtatattttccggtgggtggtgagctcagacttggatctgaggagtctcgaacagctgtccctggtatgcaggggcttttacatctgcgcccgcgatccagaaatttggcgactggcctgtttaaaagtctggggccgatcctgcatcaagctggtgccctataccagttggcgggaaatgtttctcgagaggccaagagtgaggtttgatggcgtgtatattagcaaaacaacttacatcaggcagggcgagcagtcccttgatgggttttatagagcatggcatcaggttgagtattataggtatatccggtttttccctgatggtcacgttatgatgcttaccaccccagaggagcctcaatccattgtccctcggctgcgtactcgaaatacacggacagacgccattttattgggccactataggttgtctcaggacaccgataatcagactaaggtcttcgccgttatcacaaaaaagaaggaagagaaaccgctcgattataagtacaggtacttccgcagggtgcccgtgcaggaagccgaccagagtttccacgtgggcctgcagttgtgttcttctggccaccagagattcaacaaactaatatggattcatcacagctgtcatattacttacaaatcaactggggaaactgcagtatcagcattcgagattgataagatgtataccccgcttttcttcgctcgggtgcgctcgtatactgctttttctgagaggcctctctag

SEQ ID NO: 116871 - DNA, 147 bp, Artificial Sequence
  Description of Artificial Sequence: Synthetic coding sequence
atgtttcgtgcccagtggatgtttgaacttgctccgggtgtatcctcgtctaatctagaaaaccgcccctgcagagcagcccgaggatccctccaaaaaacgagtgccgatacaaagggtaagcaggagcaagccaaggaggagtag

SEQ ID NO: 116872 - DNA, 357 bp, Artificial Sequence
  Description of Artificial Sequence: Synthetic coding sequence
atgttcagagcacagtggatgttcgagctggcaccaggggtgagctcaagtaatctggagaacagaccctgccgggccgctcgtggctctctgcagaagacatctgccgatacaaaagggaagcaggaacaggctaaagaggagaaagcacgcgagctcttcctcaaagcagtggaagaggaacagaatggggctttgtatgaggcaatcaagttttatcgcagggccatgcagcttgtcccagatatcgagttcaaaatcacttatacacgcagcccagatggcgatggggtggggaatagctatattgaggacaatgacgatgacagtaagatggctgatctactctcctattag

SEQ ID NO: 116873 - DNA, 438 bp, Artificial Sequence
  Description of Artificial Sequence: Synthetic coding sequence
atgtttcgggctcaatggatgttcgaattggctcccggagtatcatcctcaaacttagaaaaccgcccttgtagagctgctagaggatctctgcagaagaccagcgcggacaccaaaggaaagcaggagcaggccaaggaagagaaagctcgagaattgttcctgaaggctgtagaggaagagcagaacggcgccctgtatgaagccattaagttctaccggcgcgcaatgcagttggtccccgatattgagttcaaaattacttacacacgcagtcctgacggggatggagtcggaaacagctatatagaggataacgatgacgattcaaagatggcagatttgctcagctattttcaacagcagctgacatttcaggagtctgtacttaaactgtgccagcctgaattggaatcgagccaaatacacattagctag

SEQ ID NO: 116874 - DNA, 3132 bp, Artificial Sequence
  Description of Artificial Sequence: Synthetic coding sequence
atgcggaggttcaaaagaaaacatttaactgcaattgactgtcagcatctggcccgcagtcaccttgcagttacccagcccttcggtcagcgctggaccaatcgcgacccgaatcacggattgtatcccaaaccccgaaccaagcgcgggagtaggggccagggctcacagagatgcattcccgagttcttccttgcggggaagcagccttgcacgaacgatatggcaaaatccaatagtgtgggacaggacagctgccaagactccgaaggggatatgatctttcccgccgagtctagctgtgctctcccccaggaagggagcgcgggtccaggaagtccaggatccgcgccccctagcagaaaacggtcatggtcttccgaggaagaaagcaatcaggccacagggacgagcaggtgggacggtgtgtctaagaaggctcctagacatcacttgagcgttccatgcactcgtcctagagaagccagacaggaggctgaggactcgacttctcggctatcggctgagtctggagagaccgaccaggacgcaggcgatgtcggccctgatccgattcctgacagctattatggactcctcggaacattgccgtgtcaggaagccctaagtcacatctgttctctgccgtccgaggttctgcgtcacgtgttcgccttcctgcccgtcgaggacctctactggaatcttagtctggtgtgccatttgtggcgggagatcattagtgatcctctgttcatcccatggaagaagctgtatcacagatatctcatgaacgaggagcaggccgtcagcaaggtggacggaatactaagcaactgtggcattgaaaaggaatctgatctctgcgtgttaaatctgataagatacacggctaccacaaagtgctcgcccagcgtggacccagagcgagtactttggagcctgcgtgatcacccattattgccagaggctgaggcttgtgtgagacagcacctcccggatctatacgcggccgcaggaggtgttaatatctgggcccttgtcgccgccgtcgtgcttctttcctcgtcagtgaatgatatacagaggctcctgttctgcttgcggcgcccaagctcaactgtgaccatgcctgatgttacagagactctgtattgtattgctgtgctgctgtacgccatgagagaaaagggtataaatatcagcaaccgcatccattacaacattttttattgcctttatctccaggaaaattcttgcacccaggcaaccaaagttaaagaggagcctagtgtttggcctggtaagaagaccatccagttgacacatgagcaacagctgatcttaaatcataaaatggagcctctgcaggtggtgaagatcatggcgttcgcgggcactggtaaaacttccactttggtgaaatacgctgaaaagtggtcccaatcaaggttcctgtacgtgacattcaataaaagcatagccaaacaggctgagcgcgttttcccatcaaatgtgatttgtaaaacgtttcattccatggcctacggccatatcggtagaaagtaccagtctaagaagaagcttaacctgtttaagctgacccccttcatggtcaacagtgttctcgctgaaggtaagggggggttcatccgcgctaagctggtctgcaaaacgttagaaaactttttcgcgtctgctgatgaggagcttacaatcgatcatgtgcccatctggtgtaagaactctcaggggcagagagtcatggtggagcaatctgaaaaactgaacggcgtattggaggcatcacgtctttgggacaacatgcggaagctcggagaatgtacagaggaggcccaccagatgacgcatgatggctatttaaagctttggcagcttagcaagccttccttagcgtccttcgacgccatcttcgtagacgaggctcaggactgcacccccgcgatcatgaacattgttctatcacagccttgcggaaagatcttcgttggtgatccccaccagcagatctataccttccgtggagcagtcaatgctctttttacagtccctcacacccacgtcttctacctgacccagtccttcagatttggggtcgaaatcgcatacgtgggtgcaacaattttagatgtgtgtaaacgcgtgcgtaaaaagaccctggtgggtggaaaccatcagagcggtattcgcggagatgcgaaaggccaggtggcgctgctgagccggactaacgctaacgtttttgacgaggcagtgcgggtcactgaaggagagttcccatcgaggatccacctgatcgggggcatcaagtcattcggtctggacaggataattgatatctggattttgttgcagccggaggaggaacggaggaaacagaacctcgtgatcaaggataaattcatcagaagatgggttcacaaagagggcttctcgggctttaaacgctacgtgacagcagctgaagacaaagagttggaagcaaagatagcggttgtggaaaagtataacatccgcattccagagctggtccaaagaatagagaagtgccacattgaagatctagatttcgccgagtatattctcggtaccgtgcacaaggcaaagggcctagagtttgatacagtgcatgtcctggatgatttcgtcaaagtgccctgcgctagacataatctcccacagctgccccacttccgggtagaatctttttccgaggacgagtggaatctcctctacgtcgccgtcacaagggcaaaaaagcgactcatcatgacaaagtcgctagaaaatatcttgacgctagcgggagaatactttctgcaggctgagctcacatccaacgtgctgaagaccggggtggtgagatgctgcgttggacagtgcaataacgcgattccagtagacaccgttctgactatgaaaaagctgccaatcacctacagcaatcgcaaggagaataaagggggttacctttgccatagctgtgccgaacagcgcatcggacctctcgcctttctgaccgcttcaccagaacaggtgcgcgccatggaacgcaccgtcgaaaacatcgtgctgccgagacacgaagccctgcttttcctggtcttctag

SEQ ID NO: 116875 - DNA, 1215 bp, Artificial Sequence
  Description of Artificial Sequence: Synthetic coding sequence
atgaacgaagagcaggcagtgtccaaggttgatggaattttgtccaattgtgggatcgaaaaggagtctgatttgtgcgtgctgaatctcatcaggtatacagcaactaccaagtgtagtccctccgtcgacccagagagggtcctttggtccttgagagatcatccacttctgccagaggccgaagcctgtgtacgtcagcacctacctgatctttatgccgccgcaggcggcgtgaacatctgggcactggtggcagcagttgtgctgctgtcctcaagcgtgaacgacattcagcgtctgctgttttgccttcgccgcccttcatccaccgttacaatgcccgacgtgactgaaacactgtattgtatagcagttctcctgtacgcgatgagagaaaaggggattaatatctccaatcgcattcactacaacattttttactgcttatacctccaggagaattcatgcacacaggctaccaaggtgaaggaggagccgtcagtgtggccgggaaagaagacaattcaacttacgcacgaacagcaacttattttgaaccacaagatggaacccctgcaggtcgtcaaaataatggccttcgctggaacaggtaaaactagcacattagtgaagtatgccgagaagtggagccagagtcggtttttatacgtgaccttcaacaaatccattgcgaagcaggccgaaagggtgtttcctagcaacgttatctgtaagacctttcactctatggcctatggacacattggaagaaaatatcagagtaaaaaaaagttgaacctttttaaactgacgccgtttatggtgaatagcgtactcgctgaaggtaagggtggcttcatacgggctaaactggtatgcaaaaccctcgaaaacttctttgcctccgcagacgaggaactgacgatcgatcacgtgcccatttggtgtaagaattctcagggtcagcgggtcatggtggagcaaagcgaaaagctgaatggcgtcttggaggcatcccgactttgggataacatgaggaaactgggtgaatgtaccgaggaagcacatcagatgacgcatgatggctacttgaagctatggcaattgagtaagccttctctggccagtttcgatgccatctttgtggacgaggcccaggccggagccaggcatggggcccattgcggagagcatcggaccgcaccagcctag

SEQ ID NO: 116876 - DNA, 3285 bp, Artificial Sequence
  Description of Artificial Sequence: Synthetic coding sequence
atgtcctacgaagttacgagcgggtgccactggacttgccaggtccccgaaagctgtgataacggtctgcattgcgctgggcccctgggacacctgcatcgccgctgccagcgtacatctgctcacctgctcgtgttcaccgaacacgcggaaatgaggaggttcaagagaaagcacttaaccgccattgactgccagcatcttgctcggagccacttggccgtgacccaaccgtttggccagaggtggacaaatcgggatcctaatcatggcctctacccgaaaccccgcacaaagagggggagtcgggggcaaggctcccagcgctgcatccccgaattctttctggccgggaagcaaccctgtacaaacgatatggcaaagtctaattccgtgggccaggactcgtgccaagactccgaaggagacatgatctttccagccgaatccagctgcgccctccctcaggagggttcagcaggacctgggtcgccagggtccgctccaccctccaggaaaaggagctggagcagtgaggaggagtcaaaccaggccactggtactagccgctgggacggggtgtcgaagaaggctccccggcaccacttatcagtgccctgcacacgtccacgggaggctcgccaggaagcagaggattctacctcccgcctctccgcggaaagcggggagacagaccaggatgcgggtgacgtcgggcccgaccccattccggatagttactacggactgctcggtacactgccgtgtcaagaagccctgtcccatatctgcagtctgcccagcgaagtcctgcgacacgtatttgcctttttgcccgtcgaggacttgtactggaacctctccctggtgtgccacctctggagagagattatctcggacccgctctttataccatggaaaaagctgtatcatagatatcttatgaacgaggaacaggccgtttccaaagtagacggtatcctctcaaactgtggaatcgagaaggagtctgacttgtgcgttctgaatttgatcaggtacaccgccactaccaagtgtagcccctctgtcgatcccgaacgggtcctgtggagcctcagggatcaccccctgctacctgaggctgaggcttgcgtgcggcagcatctgccagacctctatgcagctgctggaggtgtgaatatatgggctcttgtggcagccgttgtgctccttagctcctctgtgaacgacatccaacgcctgttgttctgtttgaggcggccaagctctacagttactatgccagacgtcaccgaaacactgtactgcattgccgtactactgtacgccatgcgggagaaagggatcaacatcagcaacaggattcactataacattttctattgcttgtatctgcaagaaaattcctgtacacaggcaaccaaggtcaaggaagagcctagcgtgtggccaggaaagaagaccattcagcttacacatgagcagcagctgatcctgaatcataaaatggaaccactgcaggtggtcaaaattatggccttcgctgggaccggcaagacctcaacgctggtgaagtacgccgagaaatggtctcaaagtcggttcctctatgtgaccttcaacaaatcaatagccaagcaagccgagagagtcttccctagcaatgtgatttgcaagacatttcactcaatggcctatgggcatattggtcggaaataccagagcaagaaaaagcttaacctgttcaaactgactccttttatggtcaacagtgtgcttgctgaggggaaggggggttttattagggcgaaattggtctgtaagacccttgagaatttcttcgcctccgctgacgaggaactcactattgaccacgtgcccatatggtgcaagaactctcagggccagagggtgatggtagaacagagcgaaaaattgaatggcgtcctggaggcttcacgtctgtgggataatatgcgaaaactcggggaatgtacagaagaggctcaccaaatgacccacgacggctatctcaagctgtggcagctctccaagccaagtctggcctctttcgatgccatattcgtggatgaagcccaggattgcacgccagcgatcatgaacattgttctgagccagccctgcggtaagatctttgtgggggacccacaccagcagatctatacattccggggagctgtcaacgctctgtttaccgttccccatacccacgtgttttaccttactcagtcgtttcgcttcggtgtggagatcgcctacgtgggcgccactatcctggatgtctgtaagagagtgcgcaaaaagaccctagtgggcggtaatcatcagtcaggcattagaggggacgctaagggccaagtagctcttctcagcagaaccaatgcaaacgtatttgacgaagctgtgcgcgtcaccgagggagaattcccgagtaggatacaccttattggggggatcaaaagttttggtctcgacagaattatcgatatctggattctgctgcagcctgaggaagagcggcgcaagcagaatctggtcattaaagacaaatttattcgacggtgggtgcacaaggaagggttctccggctttaagcgttatgtaacagccgccgaagataaggagctcgaggctaagatcgccgttgtggaaaaatacaatatccgcattcctgagctggtgcagaggatcgagaaatgccacatcgaggacctggactttgccgagtacatactcgggacagtgcataaggcaaaaggcttagagttcgacactgtgcacgtcctagatgattttgtaaaagttccttgcgcccggcataatttgccgcaactgccccattttagagttgaatcgttctctgaggatgaatggaaccttttgtatgtggcggtgacacgggcgaagaagaggttaattatgaccaaaagccttgaaaatatactcactcttgccggagaatacttcctccaggctgagcttaccagcaacgtactgaaaactggggtcgtacggtgctgcgttggacaatgtaataatgcaattcccgttgatactgtgttgaccatgaagaagctgccaattacctattccaaccgcaaggaaaacaaaggtgggtatttgtgccattcatgtgctgaacagcggatcggccccttagctttcctgaccgccagtcccgagcaagtccgcgctatggaacgtaccgtggagaatatagtattgccaagacatgaggccttgctcttccttgttttttag

SEQ ID NO: 116877 - DNA, 1644 bp, Artificial Sequence
  Description of Artificial Sequence: Synthetic coding sequence
atggcgtatggccatatcgggagaaaatatcaaagcaaaaaaaagctaaatctgtttaaacttacacctttcatggtgaattcagtgctcgctgaaggtaaaggaggattcatccgggctaagttagtatgcaagactctggagaacttctttgcatccgctgatgaagaactgactatcgatcacgtcccgatctggtgcaaaaacagccagggtcagagagtaatggtcgaacagtccgaaaagctgaatggtgtgctggaggctagtaggctgtgggataatatgcgaaaactgggcgaatgtaccgaagaggcccatcagatgacccacgacgggtacctcaaactctggcagttgagcaagcccagcttggcaagcttcgacgcaatcttcgtggacgaggcgcaagactgtactcctgccatcatgaacattgtcctttcacagccttgcggcaagatattcgtgggcgatcctcaccagcagatttatacattcagaggcgcggtcaacgccctctttacagtaccgcacacgcatgtgttctacctgacacagagttttcgcttcggcgtggagatcgcctatgttggggccactatccttgatgtgtgcaagagggtgagaaaaaaaacacttgttggagggaaccaccagtccggaattaggggagatgcaaagggtcaggtagccctgctctctcgaacaaatgcaaacgtgttcgacgaggccgtgcgtgtgaccgaaggagagtttccctctcggatccacctgattgggggaatcaagtctttcggacttgatcgcatcatcgatatttggatactcctgcagcccgaggaggaacggagaaaacagaatttggtgatcaaagataagtttatcaggcgatgggtgcataaagaaggattttccgggtttaagaggtacgtcaccgccgcagaagacaaggaactggaagcgaagatcgccgttgtggagaaatataatataagaattcccgaacttgtgcagcggatagaaaaatgtcacatagaggacttagactttgcagaaatggaaagccaccacgtcggtcaagctggactggaacttccaaccagcgagtatattcttggcaccgttcacaaagctaagggtctggagtttgataccgttcacgttcttgatgacttcgtgaaggtgccttgtgctagacacaacttgccccagctacctcacttccgcgtcgagtcgttcagtgaggatgagtggaatctgctctacgtggccgttaccagggccaagaaaagattgatcatgaccaagtcattggaaaacatcctgactttagcaggggaatatttccttcaggctgaactgacgagcaacgtcctaaagactggcgtggtgaggtgctgcgtgggtcagtgtaacaacgccataccagttgacacggtgctgactatgaaaaagcttcccatcacttacagcaacagaaaagagaacaaaggggggtacctgtgccactcttgcgctgaacagcgtattggccccctggcttttctgacagcctctcctgaacaggtgagggccatggaaagaactgttgagaacatcgtgcttccacgtcacgaagcgctcctcttcctggtgttctag

SEQ ID NO: 116878 - DNA, 1215 bp, Artificial Sequence
  Description of Artificial Sequence: Synthetic coding sequence
atgaatgaggagcaggccgtgtctaaggtggacgggatcctgtctaattgtggtattgaaaaggagtctgacctgtgtgttctgaaccttatccggtatacagcgacaacgaagtgcagtccatcagtcgacccagaacgagtgctttggtccttgcgagaccatccactgctgcccgaggccgaggcctgtgtacggcagcatctgccagacctgtatgccgccgctggcggggtgaatatttgggccctggtcgccgccgtcgtgctgctcagtagcagtgtgaacgacatccagagactgttgttctgccttcggaggccgtcctcaaccgtcacaatgcccgacgtcactgagacattgtactgtatcgctgtgctgctgtacgccatgagagagaaagggatcaacatcagtaacaggatacattacaatattttttattgtctgtaccttcaggagaatagctgcacccaggccaccaaagtgaaagaagagccctccgtgtggcccggaaagaagacaatccagcttacccacgagcagcagctaatcctgaaccacaagatggagcccctgcaggtggtgaagattatggccttcgccgggaccggcaagacgagcacgctcgtgaagtatgccgaaaagtggagtcagagtcggttcttgtacgtgacctttaacaagtctatcgccaagcaggcagagcgcgtgttcccctccaacgtcatttgcaaaactttccattccatggcatacgggcacattggtagaaagtatcagagcaagaaaaagctgaatctgttcaagctgacccccttcatggtgaactctgttttagccgagggtaaaggcggctttatcagggcaaaactggtgtgcaagactttggaaaatttcttcgcatcagccgatgaggaacttactatcgaccacgtgcctatttggtgcaaaaattcccaaggccagagagtaatggtggagcagtccgagaagctcaacggagtgctggaggcatccaggctgtgggataatatgcggaagctgggcgaatgtacggaagaggcgcatcagatgacacacgacggctacctcaaactatggcagctcagtaagccttccctggcttcgtttgatgccatctttgtcgacgaagctcaggccggcgcacggcacggcgcccattgcggcgagcaccgtactgctcctgcctag

SEQ ID NO: 116879 - DNA, 576 bp, Artificial Sequence
  Description of Artificial Sequence: Synthetic coding sequence
atggatcctaagcagaccacacttctctgcctggttctgtgtttggggcaaagaattcaggcacaggaaggtgacttccccatgccttttatctcagccaagagtagtccggtcattccgctagacgggtctgtcaagatccagtgccaagcgatcagggaggcttatctgacacaactaatgattattaagaattcaacgtatcgggagattggacgacgcctgaaattctggaatgaaacagacccagaattcgtaatcgaccacatggacgcaaataaggcagggagataccaatgtcagtatcgcattggacattacagatttaggtattctgacacactagagctggtggtcaccgatagcattcaccaggactatacaacacagaatctgatccgcatggcagttgcaggtctggtgctcgtcgccctgttggccatcctggttgagaactggcacagtcacacagcgctcaacaaggaggcctccgccgatgtggccgagccatcttggtcacagcagatgtgccagcctggactgacatttgcccgtactcccagtgtctgtaagtag

SEQ ID NO: 116880 - DNA, 537 bp, Artificial Sequence
  Description of Artificial Sequence: Synthetic coding sequence
atggaccccaagcagacgactctattgtgcctaggcttatacggcaaaccctttctgagtgccgatcgtggattagttctgatgcctggggaaaacatttctcttacatgctccagcgcacacataccttttgatcggttctccttggccaaagagggggagctgagtcttccacagcaccagtctggcgaacatccagccaacttttctctgggtccagtggacttaaatgtctccggcatatataggtgctatggctggtataacaggtccccttatctttggagcttcccctcaaacgcactcgaactggtggttacagacagcatacatcaagattacaccacccagaacctgatccgcatggctgtggcaggtctggtgctggttgcactgctcgccatactcgtcgagaactggcattcacacaccgcacttaacaaggaggccagcgcggacgtggccgagccctcctggagccagcagatgtgccagccaggccttacgtttgcaaggacaccgtcggtctgcaagtag

SEQ ID NO: 116881 - DNA, 864 bp, Artificial Sequence
  Description of Artificial Sequence: Synthetic coding sequence
atggaccctaagcagaccactctcctgtgtctcgttctgtgccttggacagaggatacaggctcaggagggggatttcccaatgcctttcatctctgctaagagttcacccgtcattccactggacggcagcgtgaagatacagtgccaggcgattcgagaggcctatcttacacagctaatgatcatcaagaattctacgtatcgggagattggacggcgcctcaagttctggaacgagaccgaccctgaatttgtgattgatcacatggatgccaacaaggctggacggtatcagtgccaatacaggattgggcattatcggtttcgttactcagacaccctcgaactcgtggtcactggactatacggaaagccctttctaagcgctgacaggggtctagtacttatgccaggtgaaaacattagcttgacttgctcctctgcgcatatcccgttcgatcgcttttcgctagcaaaagaaggggaactcagtctgcctcaacatcagagcggcgagcatcccgctaacttctcactggggcccgtggacctgaacgtgtccgggatctacaggtgttatggatggtacaaccggtctccctacctctggagctttccttccaatgccttggaactcgtagtgaccgacagtattcaccaagactacaccactcaaaacttgataaggatggcagtggccgggctggtcttggtcgccttgctggcgattctggtggagaattggcattcacacacggcattgaataaggaagcttccgctgacgtggctgagccgagttggagtcagcagatgtgccagccaggcctgacattcgcacggaccccaagtgtatgtaagtag

SEQ ID NO: 116882 - DNA, 828 bp, Artificial Sequence
  Description of Artificial Sequence: Synthetic coding sequence
atggaccccaagcagactaccttgctgtgcctgggagactttcctatgccattcatttctgctaagtcctctcccgtgattcccttagatggttccgtgaaaattcagtgccaggccatccgcgaggcttatctgacgcaattgatgatcattaaaaattcaacctatcgggagatcggtcgaaggctcaagttttggaatgagacggatcccgaatttgttatcgatcatatggacgcaaataaggcaggacgctaccaatgccagtataggatcggacattataggttcagatatagcgatacgttggaattggtggtcaccggtctgtatggcaaacccttcctgagcgctgatcgcggcctcgtcctgatgcctggcgaaaatatctcccttacttgtagctccgcccatatccccttcgatcgcttttcgctagccaaggagggcgagctgagtttacctcaacatcagtctggggagcaccccgccaacttttctctgggcccagtggacctgaacgtcagcggcatatacaggtgctatgggtggtacaatcggagtccttatctgtggtcgttcccgagcaatgcactggaattagtggtcacagactcaatccaccaggactacaccacccaaaatctgattaggatggcagtggcagggttagtccttgtggctctactggccatactggtggagaattggcattcccacactgcccttaacaaggaggcctctgctgacgtagctgagccctcttggagccagcagatgtgtcagccaggtttaactttcgctcgaaccccatccgtatgcaaatag

SEQ ID NO: 116883 - DNA, 630 bp, Artificial Sequence
  Description of Artificial Sequence: Synthetic coding sequence
atggaccctaaacagaccacgctgctgtgtctgggggacttccctatgccctttatctcagccaaatcttcgcccgtcattcccctggacggctcagttaagatccaatgccaggcaatccgagaggcctacctcacccagctgatgattatcaagaattccacctaccgagagattgggcggcgcttaaaattctggaatgaaactgatccggagtttgttatcgaccacatggatgcaaataaagcggggaggtaccaatgtcagtatcgaatcggccattacaggtttagatactccgacaccctggagttagtggtgaccggtctctatggaaaacccttcttgagtgccgacaggggcctggtgctgatgcccggcgaaaacataagccttacctgcagcagtgcccacattccgttcgacagattctcactcgctaaggagggggagctctcactccctcagcaccagagcggagagcaccctgccaacttttctctggggcccgtggatcttaacgtgagcggtatctaccggctgcaccccccacgactgcacgatgccgaactcgacccgcatggccgaggcagaaccggtcccaggggatctctgggccatacaggttag

SEQ ID NO: 116884 - DNA, 762 bp, Artificial Sequence
  Description of Artificial Sequence: Synthetic coding sequence
atggatcccaagcagacaaccctgttgtgtctcggcgattttcctatgccattcatttctgccaagtctagtccggttattcctctggatgggtcagtcaagatacaatgccaggcgataagggaggcctatcttacccagctcatgatcatcaagaacagcacatatagagagatcggccggagattgaaattttggaatgagactgaccccgaattcgtcattgaccatatggatgcgaataaggcaggaaggtaccaatgccagtatcggatcggccattataggtttagatactccgacacactcgagctggtcgttaccgggttatacggtaaaccctttctttctgcggatcgagggctcgtgttgatgcctggcgagaacatcagtttgacttgttccagcgcccatatccctttcgataggttctcgctggctaaagaaggggagctcagcctcccccaacatcagagcggggagcatcccgccaatttttctctaggacccgttgacctcaatgtgagcggcatttatcgctgctatgactccatccatcaggattataccacacaaaacctgatcaggatggccgtggccggcctcgtgctggtcgctctgttagccatcctggtcgagaactggcacagtcacacggcactgaataaagaggcctcagccgacgttgccgagccgtcgtggtcccagcagatgtgtcagcccgggctgactttcgctcgtaccccttctgtgtgtaagtag

SEQ ID NO: 116885 - DNA, 798 bp, Artificial Sequence
  Description of Artificial Sequence: Synthetic coding sequence
atggatccgaagcaaacgaccctcctgtgcctcgtgctctgtctgggccagcggattcaggcgcaggagggcgatttcccaatgcccttcatcagcgcaaaaagctcccccgtaataccgttagacgggagcgtcaagatccaatgccaggctatacgggaggcgtacttgacccagctaatgatcatcaagaatagtacatacagagagatcggaaggaggctgaaattttggaatgagacagatcccgagtttgttatagatcacatggacgctaataaggcaggccggtatcagtgtcagtataggattggccactacagattccgctatagcgataccctggagctggtcgtgaccggactgtacggaaaaccctttctgtcagctgatcgagggctcgtgctgatgcccggagagaacatctccctgacttgttcaagcgcgcacatccccttcgatcggttctcattggctaaggagggcgaactgtccctgcctcagcatcaatccggtgagcaccctgccaatttttcccttggaccggtggacttgaatgtctctggtatctaccgctgctacgactcaatccatcaggattacactacccagaacctgatccgtatggctgtcgcaggattggtcctcgtggctttacttgcaatattagtggagaattggcactctcatactgcacttaataaggaagcctcagccgacgtggccgaaccctcctggtcacagcagatgtgccagcccggtctgacgtttgctaggaccccttccgtgtgcaaatag

SEQ ID NO: 116886 - DNA, 540 bp, Artificial Sequence
  Description of Artificial Sequence: Synthetic coding sequence
atggacccaaagcagaccacgctgctgtgcttgggtgactttccaatgcctttcatttctgcaaaaagctccccagtgattcctctggacggatctgtcaagattcagtgccaggcgatcagagaagcctatctcacccagcttatgatcataaagaatagtacctatcgggagattggtcggagactcaaattctggaatgagactgaccccgaatttgtaattgatcacatggatgctaataaggccggccgctatcagtgtcagtaccggataggtcattacaggtttcgatattccgacacactggagctggtggtgacggatagcatccaccaagactacaccactcaaaacctgattaggatggctgtggctggcttggtgctggttgctctgctcgccattttagtggaaaactggcacagtcacacagcgctaaataaggaagctagtgctgacgtggcagagcctagttggtcccaacaaatgtgccaacccgggctgacctttgcacgaacaccatctgtgtgcaagtag

SEQ ID NO: 116887 - DNA, 720 bp, Artificial Sequence
  Description of Artificial Sequence: Synthetic coding sequence
atggacccaaaacaaaccacgctgctttgtcttgtcctgtgcttgggccagcggattcaggctcaagaaggcgattttcccatgccttttatcagtgcaaagagctcccccgtcatccccttggacggaagtgtcaagattcagtgtcaggctatccgtgaagcttacttaacacagcttatgattattaaaaatagcacatatcgcgagatcggacggaggttgaagttctggaacgaaaccgaccccgaattcgtgattgaccacatggacgcaaacaaggcagggcgataccagtgtcagtacagaattggacactaccgctttagatactccgacacattggagctcgtcgtaactggcctctacggcaaacccttcctgtcagccgacagagggctagtcctgatgccgggtgagaacatcagcctgacctgtagcagcgcccacatcccattcgataggttctcactggcgaaagaaggcgagctgagtttaccacagcaccaaagtggagagcaccctgccaatttcagcctgggacctgtcgatctcaatgtttccggtatttacaggtgctatgggtggtacaatcggtccccctatctgtggagcttccccagtaatgcgctggagttggtggtcacagggaggtacagacccgtgcagccttgcgtgtgggtgggctgcccaggaccgtgtcaccgcgccgggatttag

SEQ ID NO: 116888 - DNA, 774 bp, Artificial Sequence
  Description of Artificial Sequence: Synthetic coding sequence
atggcacctgccatggagtctccgacactgctttgcgtcgctctcctgttctttgcccctgacggtgtcttggccgtcccccagaagcctaaagtgtccttgaaccccccgtggaatcgtatttttaaaggcgagaatgttactttgacttgtaatggtaacaacttttttgaggtgtcttccactaagtggtttcataatggatctctgtctgaggaaacaaattctagcttgaatatagttaatgcaaagtttgaagatagcggtgagtacaaatgtcagcaccaacaggtgaacgaaagtgagcccgtttatctcgaggttttctctgactggctgctgttacaggccagtgccgaagtggtaatggagggacaacctctctttctaagatgccatggctggcggaattgggacgtgtacaaggtcatctattacaaagatggcgaggctttgaaatactggtatgagaatcacaatatttctattacgaacgccacagttgaggactcggggacctattattgtaccggtaaagtttggcagctggactatgaatccgaacctttgaatattacggtcattaaagcccctagagagaaatactggttgcaattctttatccctctcctggtggtgatcctgtttgcggtcgatacaggattattcatctctactcagcagcaggtcacttttctgctcaaaatcaagcgaacgcgcaaggggtttagactgctgaatcctcacccgaaacccaaccccaaaaataattag

SEQ ID NO: 116889 - DNA, 261 bp, Artificial Sequence
  Description of Artificial Sequence: Synthetic coding sequence
atgatcccagccgttgtgttgttactgctccttttggtggagcaggctgcagccctgggggaaccgcaactctgctatattctggatgcgatcctcttcctctatggcatcgtccttacactgctctattgccgattgaagatacaagttcgcaaggcagccatcacctcatacgagaagtcagacggtgtgtacactggcctctccacgagaaaccaagaaacctacgagacactcaagcatgaaaagcccccccagtag

SEQ ID NO: 116890 - DNA, 339 bp, Artificial Sequence
  Description of Artificial Sequence: Synthetic coding sequence
atgattcccgctgtagtactcctcttgctgcttctggtggagcaggcagccgccttgggcgaacctcaactgtgctatatactagatgccattctgttcctgtatgggattgtcctgacacttctgtattgtcgattgaaaatacaggtgcgaaaggcagcaattaccagttacgaaaagagcgacggtgtctacacaatggaatctcccagcattacaagactggaatgctccggcatgatctgggctcattgtaatctgtgtttgctcggcagcagagactcacgcgcgtctccctcccgcgtcgctaagaccaccggaacaaccatgccttcctag

SEQ ID NO: 116891 - DNA, 792 bp, Artificial Sequence
  Description of Artificial Sequence: Synthetic coding sequence
tagtgctcctttggcgtgcagctgatgggaaagtgggtaccatgggtgtctgtgtttcaggaggagacggtcacactgcattgcgaggtccttcacttgccaggctcgtcatccacccagtggtttttaaatggtaccgcaactcagacctctacccccagttatagaatcacaagcgcctctgtgaatgacagtggcgagtaccgctgtcagagaggtttgtccggtcgctccgacccaattcaattggagattcaccgcgggtggcttttattacaagtttcctctcgcgtctttatggagggagagccattggccttaagatgtcatgcctggaaggataagctggtatataacgtcctctactatcggaacggaaaggccttcaagttttttcattggaattccaatctgacaattctgaaaacaaatatctcccataatggaacttatcactgctctggtatggggaagcacagatacacatccgccgggatttcacagtatacagtaaaaggccttcagctacctactcccgtgtggtttcacgttctattctacctggcagttggcatcatgttcctcgtgaataccgtgctgtgggtcactatccgcaaggaattgaagcgcaaaaagaagtggaatctggagatcagtttagactccggacacgagaaaaaggtgatctccagcctacaagaggaccgccatttggaggaagagctgaagtgccaggaacaaaaggaggagcaactgcaggaaggagtgcaccgaaaggaaccacagggatag

SEQ ID NO: 116892 - DNA, 567 bp, Artificial Sequence
  Description of Artificial Sequence: Synthetic coding sequence
atgtggtttctgaccacgctgcttctctggggctggctcctgctccaagtgagttctcgcgtctttatggaaggcgagcccctggcactccgctgtcacgcatggaaagacaagctagtttacaatgtcctctactatcgtaacgggaaggcgttcaaatttttccactggaattctaacctgacgatcttgaagaccaatatctcccacaacggcacctatcactgctccgggatggggaagcacaggtatacctccgccgggatctctcaatatacggtgaaggggcttcagcttccaactccggtttggtttcacgtgcttttctacctcgccgtcggaattatgttcctggtgaataccgtactgtgggtcactattcggaaggaactcaagaggaaaaaaaagtggaacctggagattagcctcgattctggacatgaaaaaaaagtaatcagctctctgcaggaagacagacatctggaggaggagctgaaatgtcaggaacagaaggaagagcagctccaggagggagtccatcggaaagagcctcaaggggccacttag

SEQ ID NO: 116893 - DNA, 843 bp, Artificial Sequence
  Description of Artificial Sequence: Synthetic coding sequence
atgtggttcttgaccactctgctgctgtgggttccagttgacggccaggttgacacaacgaaggccgtgatcactctgcagccgccttgggtatcagtcttccaagaggaaaccgtgacactacactgcgaggttctacatctgccaggttcaagcagcacgcagtggtttctcaatggcaccgccactcaaacatcgacaccttcctatagaattacctccgcctctgttaacgactctggcgagtatcggtgccaacgagggctgagcggcagaagtgaccccatccaactggagatccacagagggtggttgctgctgcaggtttcctccagagtgtttatggaaggagaacctctggctctcagatgtcacgcatggaaagataaattggtgtacaacgtgctttactacaggaacgggaaggccttcaaatttttccattggaattccaacctgacaatccttaagaccaatatttctcacaacggaacctaccactgttccggtatggggaaacacaggtacacgtccgccggcataagtcagtacacagtcaaggggttacaacttcccacacccgtgtggttccatgttctattctacttggctgtgggaattatgttcctggttaacaccgtcctgtgggtgactatcaggaaggagctcaaacgaaaaaagaagtggaatttggaaatcagcttggactctggacatgaaaaaaaagttatctcttccctccaagaggaccgacacctcgaagaggagttgaaatgccaggaacagaaggaagaacagctccaagagggcgtccataggaaagagcctcagggggctacttag

SEQ ID NO: 116894 - DNA, 954 bp, Artificial Sequence
  Description of Artificial Sequence: Synthetic coding sequence
atgactatggagacacaaatgagtcagaatgtgtgcccacggaacctttggctattgcagcccctgactgtccttctattgctagccagcgcggactctcaggcagcagccccacctaaggccgtgctgaagctggaaccgccttggataaacgtgctgcaggaagactctgttacacttacttgccagggcgctagaagccctgaatccgactccattcagtggttccataacggcaacttaatcccaactcatacacagcctagttatcggtttaaggctaataataatgactcaggcgagtatacctgccagaccgggcaaacaagcttgagcgaccccgtgcaccttaccgttcttagcgagtggctcgttttgcaaacccctcaccttgagtttcaagagggtgagaccattatgctccggtgccatagctggaaggataagcctctggttaaagtcacattttttcagaacggtaaaagccagaagttttctcacttggatcctacattcagcatcccccaagccaaccattcccactccggcgactatcactgtactgggaacatcggttacacactgttttcttccaagcctgttaccattaccgtgcaagtgcctagcatgggatcatcctcccccatgggtataatcgtagctgttgtgatagcaaccgctgttgccgcaattgttgccgcagtggtggccctgatatattgtcgaaagaagaggattagcgccaactcaactgatcccgtgaaggctgcccagtttgagccccctgggcgacagatgattgccatacgcaagcggcagctggaagaaaccaataacgactacgagaccgcagacggaggttacatgacgctcaatcccagagctccaactgacgatgacaagaacatttacctcacgttgccaccgaatgaccatgtcaactccaacaactag

SEQ ID NO: 116895 - DNA, 951 bp, Artificial Sequence
  Description of Artificial Sequence: Synthetic coding sequence
atgacaatggagacccaaatgtcgcagaacgtgtgtccacgtaacctgtggttgctgcaaccactgacagtgctcctgctgctcgcaagcgcggactcacaggccgcaccaccaaaagccgtgctgaagttggaaccgccatggattaacgtgttacaggaagattccgtcacactgacctgccaaggtgcccgttctcccgagtctgattcaatacaatggttccacaacgggaatctaatccccactcacacacagccgtcgtaccgcttcaaggctaataacaatgacagtggagagtatacttgccaaaccgggcagacatcactgagcgatcccgtccacctgaccgttctgtcggagtggctggtcctgcagaccccccacttagagtttcaggaaggcgaaactatcatgctgcggtgccattcttggaaagataagccactggtaaaggtcacgttctttcaaaatggtaaatcacagaagtttagccacctggacccaactttcagtatacctcaggccaaccacagccattctggcgactatcattgcacggggaacatcggctacactttgtttagctccaaacccgttaccatcactgtgcaggtgccaagtatgggttccagcagccctatgggcataatagtggcagtcgtgatcgctacagccgtggctgccatcgttgccgcagtagttgctctaatctattgtcgcaagaaaaggatttcagcaaactctaccgaccccgtgaaggcagcccagttcgagccccctggcaggcagatgattgccataagaaaaaggcaattggaggagaccaacaatgattacgaaacagccgatggcggctatatgactttgaatcctagggctccaacggatgacgataaaaacatatatctgaccttacctcccaacgaccatgtgaactcgaacaattag

SEQ ID NO: 116896 - DNA, 876 bp, Artificial Sequence
  Description of Artificial Sequence: Synthetic coding sequence
atgggcattctgagttttctccctgtgctggcgactgagtccgattgggcggactgtaagagcccccaaccatggggacatatgctgctctggaccgctgtcctgttcctggcccccgttgcgggcactcctgcggcccctccaaaggctgtcctcaagctggagccacagtggattaacgttttgcaggaggatagcgtgaccctcacctgtcgaggaacacacagccctgagtccgattctatccaatggttccataacggcaacctcattccaacccacacccaacctagctaccggttcaaggccaacaataatgacagcggcgaatacacatgtcagactggtcaaacttccctctctgacccagtccacctgaccgtgctgtcagagtggctcgtcctgcaaaccccacacctcgaattccaagagggagagactatagtcttaagatgccacagctggaaggacaagcctctggtcaaagtgactttttttcagaatggaaagtctaaaaaattctcccggagcgaccctaattttagcatccctcaggccaatcatagtcatagcggggactatcactgtactggaaatatcggctacaccctgtattcctcaaaacccgtcacaattacagtccaggctcctagttcctcccctatggggattattgtcgcagttgtgactggaattgccgtcgcagctatcgtcgctgcggtcgtggcccttatttactgcagaaaaaaacggatttccgctaaccctacaaatccagatgaagcagacaaagtgggtgccgagaacacgatcacatacagtctcctgatgcaccctgacgctctggaggaacctgatgaccagaacagaatttag

SEQ ID NO: 116897 - DNA, 933 bp, Artificial Sequence
  Description of Artificial Sequence: Synthetic coding sequence
atgggcattctatcttttcttcctgttctggctaccgaatctgattgggccgactgcaagtcaccgcagccctgggggcacatgctgctgtggaccgctgtcttatttctggctcccgtggccggtaccccggcggcgccaccaaaggcagtgctgaaattggaaccccaatggattaatgtgttgcaggaggattctgttactttaacttgccgcggcacacactctcctgaaagcgacagtatccagtggttccataatggcaacctgatcccgacccatacacagccgtcctaccggttcaaagccaacaataacgactctggcgagtatacctgccagacaggccaaactagtttatctgaccctgtccacctcactgtcctcagcgaatggttggtgcttcagacgccccatctggaattccaggaaggagaaaccatcgtcctgcgatgccactcttggaaggataaacccctggtgaaggtgaccttcttccaaaatggaaagtcaaagaaattctctcgcagtgatcccaattttagcatacctcaggcaaatcatagtcacagcggggattatcattgtacaggaaatattggttataccctgtattctagtaaaccagtcacaatcaccgtgcaagctccatcctcttccccgatggggattatcgtggccgtcgtgaccggcattgccgtcgcagctattgttgctgctgtggtggcgctgatatattgccggaagaaacgcatttcggcgctcccaggttacccggagtgtcgcgaaatgggcgagacccttcccgagaaacccgccaaccccacaaacccggatgaggctgataaggtcggggccgagaatacaatcacatatagcctgctgatgcatcctgatgcactggaagaacctgacgatcagaataggatctag

SEQ ID NO: 116898 - DNA, 912 bp, Artificial Sequence
  Description of Artificial Sequence: Synthetic coding sequence
atggggattctcagcttcctccccgtgctagcgaccgaatctgactgggcagattgtaaatcccctcagccttgggggcacatgcttttgtggacagcagtgttgtttcttgctgccccccctaaggctgtcctgaagctcgaaccacagtggataaatgtgctccaagaggacagcgtgactctcacatgtcgggggacacatagccccgaaagtgactcgattcagtggttccacaatggaaatttaatcccaacgcatacacaaccttcataccgcttcaaagccaataataatgacagcggcgaatacacgtgtcagactggccagacatcgttaagcgatccagttcatttgactgtgttgtcagagtggttggtgttgcagacaccccatcttgagttccaggagggagagacaatagtgcttaggtgccactcatggaaagataaaccattggtgaaagttactttctttcagaatgggaaatctaagaagttctcacgttccgatcccaacttttccataccacaggccaaccactctcacagtggagattaccactgcacgggcaatatcggatacacactctacagctcaaagccggtgactataactgtccaggccccatcctcctctcccatgggcatcatcgtggctgtggtgaccggcatagccgtggccgcgatagtagcagccgtcgtagctcttatctactgtaggaagaagaggatcagcgcattacccggctatcctgagtgccgcgaaatgggagagacactgcctgagaagcccgcaaaccctactaatccagatgaggcagacaaagtgggcgccgaaaataccattacatactctcttctcatgcatcccgatgccctggaggaacctgacgaccagaacaggatttag

SEQ ID NO: 116899 - DNA, 912 bp, Artificial Sequence
  Description of Artificial Sequence: Synthetic coding sequence
atgggcatactgtcctttcttcccgtcctggccacagagtccgattgggcagattgcaaatcacctcagccatggggccacatgttactttggactgcagtgttatttctcgccgctccaccgaaggcggttctcaaattggaacctcagtggataaatgttttgcaggaggacagtgtcactctcacatgtcggggcacccatagcccagaatcagatagcattcagtggtttcacaatggaaacctgatcccgacgcatactcagccttcttacaggttcaaggcgaacaacaatgattctggggagtacacttgccagacaggccagaccagtctgtctgaccccgtgcacttaacagttctgagcgaatggctggtgttgcaaacacctcacctggagttccaggaaggagaaactattgtgctgcggtgtcatagttggaaagacaagccactcgtgaaagtgaccttcttccagaacgggaaatcaaagaaattttcacgaagcgatcctaatttttctatcccccaggctaaccatagtcactccggagactatcactgcactggtaatattgggtacaccctctatagctccaaaccggtcacgatcactgtgcaagcgccatcaagcagccccatggggattatcgttgccgttgttacgggaatcgcagtcgcggccatcgtagcagcagtggttgcattaatatactgccgtaaaaaaagaatctcagccctgcccggatacccggaatgccgggaaatgggcgaaacactccctgagaaaccggccaaccctacgaatcccgatgaagctgacaaagttggggccgagaatacaattacgtatagtctcttaatgcatccggacgcccttgaggagcctgacgaccagaaccgtatttag

SEQ ID NO: 116900 - DNA, 933 bp, Artificial Sequence
  Description of Artificial Sequence: Synthetic coding sequence
atggggatccttagttttctccctgttctggcaaccgagtcagactgggctgactgcaagagcccacagccatggggccacatgctgctgtggaccgccgttctgttcctagcacccgttgcagggacacccgcggccccaccaaaagctgtgctgaaacttgaaccgcaatggatcaatgttctacaggaagactcagtgactctgacttgtagggggacacatagccctgagtcagactctattcaatggttccacaatgggaacttgattccaacccacacgcagcccagctataggtttaaggcaaataacaacgatagcggagagtatacctgccagacaggtcagacttccttgtccgatcccgtccatctgaccgtcctatcagagtggcttgtgctccagacaccgcacttggaatttcaggagggagagaccatcgtcctgcgatgccattcatggaaggacaagcccctggttaaagtgactttcttccagaacggcaagtcaaaaaagttcagccgatctgacccaaattttagtatcccgcaagctaatcactcccactcaggggactaccattgtacggggaatattgggtacactttgtattcgtccaaacccgtcactatcactgtacaagctccatcttctagcccaatgggcatcattgtggctgtcgtgaccgggattgcggtagccgccatagtggctgccgttgtcgcactgatctattgcaggaagaagcgcatcagcgcattacctggatatcccgaatgtcgggaaatgggcgagacgttgccagaaaagccagcaaaccccaccaaccccgatgaggcagataaggtcggggccgagaacactattacttactccctgctcatgcatccagacgcgctggaagagcctgacgaccagaaccggatctag

SEQ ID NO: 116901 - DNA, 876 bp, Artificial Sequence
  Description of Artificial Sequence: Synthetic coding sequence
atggggattctgtcgttcctgcctgtgttggctaccgaatcagactgggcagattgcaaaagcccccaaccttggggtcacatgctcctctggaccgcagtgttattcctggctcctgtggcgggtactcctgccgcccccccaaaggctgtgctgaaactggagccacagtggatcaatgtcttgcaggaggattctgtaaccctgacctgtcgagggactcattctccggagtccgatagtattcaatggttccacaatggcaatttaatcccaacccacactcagccatcttacaggttcaaagcaaataataatgattctggtgagtacacctgtcaaacaggccagactagtttgtccgatccagtgcacctcaccgtcctctcagagtggctcgttcttcagacgcctcatcttgaatttcaggagggagagaccattgtccttcggtgccactcctggaaagacaagccactggtcaaagtgaccttctttcagaatgggaagtcaaaaaagttcagccgcagcgaccctaacttctcaattccacaggcgaaccattctcactccggcgactatcattgcactggcaacatcgggtatacactgtactcaagcaagccagtgactatcacagttcaagcccccagttcctcccccatgggaattatcgtggcggttgttacaggaatcgccgtggctgcaatcgtcgctgctgtggtggccctcatttactgccgcaagaaacgcatttctgccaacccgactaaccccgacgaggctgacaaagtcggtgccgaaaacaccatcacgtactctctcttgatgcatcctgatgcactggaagaacccgacgaccaaaaccgcatctag

SEQ ID NO: 116902 - DNA, 705 bp, Artificial Sequence
  Description of Artificial Sequence: Synthetic coding sequence
atggggattctttcatttctgcctgtcctggctaccgaatcggactgggcagattgcaagagtccccagccatggggacacatgctgctctggactgccgtgctgttcctggctcccgtggctggaacaccagcagctccacctaaagctgtactgaaacttgaacctcagtggataaacgttctgcaagaggattctgttaccctcacttgtaggggaacgcactctcccgaatctgattccattcagtggtttcataatggcaacctgatcccaacccacacacagccctcttatagattcaaagccaacaacaacgatagtggcgagtatacatgtcagacaggacagaccagtctttccgaccctgtgcatttgactgtgctttccgaatggctggttcttcagacccctcacctggaattccaagagggggagactatcgttctgagatgtcatagctggaaggacaaaccactcgtgaaagtcactttctttcagaacggcaagtcaaaaaaattttcgcggtccgaccccaacttttccatacctcaggccaatcattcccactctggtgattatcactgtactgggaacataggatacaccctgtactcaagtaagcccgtgacaattaccgtccaggggcctagattaagaacggcggccaaacagagctcattggtgggggcagaagtgccgtag

SEQ ID NO: 116903 - DNA, 771 bp, Artificial Sequence
  Description of Artificial Sequence: Synthetic coding sequence
atgggtattttgtcattcctgcctgtcctggcaacagagtctgactgggcagactgtaagagccctcagccatggggccacatgttattgtggaccgcagtgctgttcctgggagagagcggtcccccagctgcacccccgaaagctgtccttaaactggagccccagtggattaacgtgttgcaggaggacagcgtcacccttacttgccggggcacgcactctccagaatctgactcaatccagtggttccacaatgggaaccttattcccacccacacacaaccctcatataggttcaaagcaaataataatgactctggtgaatatacctgtcagacaggccaaacctcccttagtgacccagtccacttgaccgtgctgtccgagtggctagttctgcagacgcctcacctggaatttcaggaaggcgagacaatcgtattaagatgccactcttggaaagacaaaccacttgtgaaggttaccttttttcagaatggaaagagtaaaaaattttcgcggtcggacccgaatttctccatccctcaggctaatcattcccattctggtgactatcactgtaccgggaacattggttacactctgtactccagcaagcctgtcaccatcaccgtgcaagctccgagttcatcccccatgggcatcatcgttgctgtggtaacgggaattgcagtagccgctattgtggccgctgtggttgcgctaatctattgcagaaagaagagaatctccgttagcacctggtag

SEQ ID NO: 116904 - DNA, 765 bp, Artificial Sequence
  Description of Artificial Sequence: Synthetic coding sequence
atgtggcagctgctcctccctactgctctattgcttctggtgagcgccggtatgagaaccgaggatcttccaaaggctgttgtgtttctagaaccacagtggtaccgcgtattggagaaggattcagttacgctcaaatgccagggggcctattctcccgaggataacagtacccagtggttccacaatgagagcctgatttccagtcaggccagctcctattttatagacgcggccaccgtcgacgattcgggagaatatcgatgccagaccaatctttccacactttccgatccagtccagctcgaagtgcacataggctggctgctgctacaggccccaaggtgggtgttcaaggaagaggatcccatacaccttcgctgtcacagctggaagaatacagccctccacaaggttacctatcttcagaatggaaaggggagaaagtacttccaccacaacagtgatttctacatcccaaaggcaaccttgaaggacagcggatcgtatttctgcagagggttattcgggtcaaaaaatgtctcatcggaaaccgttaacattaccatcacccagggcctcgcggtctccaccataagttctttttttccaccaggttatcaagtatccttttgcctagtgatggtgcttctttttgctgtcgatactggactgtatttcagtgttaagacaaacatcaggtcatccacccgggattggaaggaccataagttcaaatggcggaaggacccccaggataaatag

SEQ ID NO: 116905 - DNA, 873 bp, Artificial Sequence
  Description of Artificial Sequence: Synthetic coding sequence
atgggcgggggcgccggggaaagactgtttacatcttcatgtctggtcggccttgtccccttggggctccgcatatccctggtgacctgcccccttcagtgcggtattatgtggcagctgctgctgccgaccgcgctgcttctgctggtcagcgccggaatgagaaccgaggatctccccaaggcagtcgtgttcctggaacctcagtggtatcgggtcctggagaaagatagcgtcacactcaagtgtcaaggcgcgtactccccagaagacaattctacccaatggttccacaacgaatctctaattagcagccaggccagcagctatttcattgatgcagcaacagtggacgatagcggggagtatcggtgccagacaaatctgagcactctttccgaccctgtgcagcttgaggtccacatcggatggctgctactgcaggctccccggtgggtattcaaggaagaagaccctatccaccttcgctgccactcttggaagaacaccgctctccataaggtgacttatctgcaaaatggaaaaggccgaaagtattttcatcataactctgatttttatattcccaaggccactctgaaggactctggatcctatttttgtcgaggactcttcgggagcaagaatgttagctccgagactgtgaacatcaccatcacacaggggttagcggtgagcactattagttcattttttcctcccgggtaccaggttagcttctgcctggtcatggtgctactctttgctgtggacactggattgtatttctcagtgaaaacaaacattcgctccagcacaagagattggaaggaccacaaattcaaatggaggaaggatcctcaggataagtag

SEQ ID NO: 116906 - DNA, 816 bp, Artificial Sequence
  Description of Artificial Sequence: Synthetic coding sequence
tgaccgctgggtctcaggatttctctggtgacttgtccgttacagtgcggtatcatgtggcaattgctgctgccaactgctcttttactcctcgtgagcgccggaatgcgcacagacctccccaaagctgtcgtgtttttggaaccccagtggtaccgagtgctcgagaaagattctgtcaccttaaagtgccagggcgcgtactcgccagaggataactctacccagtggtttcacaatgaatctctgatcagctctcaggcgagttcttatttcatcgacgctgcgacagtcgatgactccggagagtacagatgccagaccaacttgagcacgttaagcgatccagtgcaattggaggtccacatcggctggttgctgttgcaggccccacggtgggtgttcaaagaggaggatcccattcaccttagatgtcattcctggaaaaataccgctctgcataaggtgacctatctacagaacgggaagggcagaaaatacttccaccataatagcgatttctacattcccaaggcaaccctgaaggatagcgggtcatacttttgtaggggcctgttcggaagtaagaatgtgagtagtgagacggtgaacatcactatcacacaggggctcgccgtatccacaataagcagcttttttccccctggataccaggtgtcattctgcttggtgatggtactcttgttcgccgtcgatactggactatatttctccgttaaaacaaatataagatcatctacacgggattggaaggaccataaatttaagtggcgtaaggatccgcaggacaagtag

SEQ ID NO: 116907 - DNA, 765 bp, Artificial Sequence
  Description of Artificial Sequence: Synthetic coding sequence
atgtggcagctgttattacccacagcactgctgctattagtgtcagccggtatgcgcaccgaggacttgccaaaggcggtggttttcttggagcctcagtggtaccgagtgctggagaaagattccgtgacactcaagtgccagggggcctacagtccagaggacaatagtacccaatggttccacaatgagagtctcatctccagtcaggcatcctcatatttcatcgacgcggccacggtcgatgacagcggcgaatatagatgtcagactaacctcagcacgctctccgaccctgttcagctggaggtccatatcggatggctgctgctacaggccccccgctgggtctttaaggaggaagatcccatccatttgcggtgtcatagttggaagaacacagccctgcacaaggtcacgtacttacagaacggcaaaggtcggaaatatttccaccataacagcgatttttatataccaaaagcaaccctcaaagattccgggtcatatttttgtagaggtctgtttggtagcaagaatgtgagtagcgagactgttaacatcacaatcacccaagggctagctgtgagtacaataagttcgttttttccaccgggctatcaggtctcattctgcctcgtgatggttctgttattcgccgtcgacaccggcctgtattttagcgtgaaaaccaacattcgcagcagtaccagagactggaaggatcacaaattcaagtggcgcaaggacccgcaggacaaatag

SEQ ID NO: 116908 - DNA, 318 bp, Artificial Sequence
  Description of Artificial Sequence: Synthetic coding sequence
atgtggcagctgctgcttccaacagccttactcctccttgtgtcagccggcatgaggacggacctgcccaaggccgtggtgtttctcgagccgcagtggtacagggttctggagaaggactctgtcacgctgaaatgtcagggcgcctattctcctgaagacaacagcactcagtggttccataacgagtctttgatctcgtcacaggcatcttcctattttattgacgccgccaccgtggatgattccggagagtatcgttgtcagaccaacttgagcaccctgtccgaccctgtgcagctggaggtacacatttag

SEQ ID NO: 116909 - DNA, 870 bp, Artificial Sequence
  Description of Artificial Sequence: Synthetic coding sequence
atgggtggaggtgctggggagagattatttacgtcttcatgtctggtcggcctggtcccactgggcctgcgaatttccctggtgacctgcccactccagtgtgggatcatgtggcaactcctcttacccactgctctgctacttctggtctcggcggggatgcgcacagatctgcccaaggcagtagtatttcttgagccccagtggtatcgcgttcttgaaaaagacagcgtgactttgaagtgccagggtgcgtacagtcctgaggataatagtacccagtggtttcacaatgagtctctgatcagctcccaggcgagctcctatttcatcgacgctgccactgttgatgatagcggagaatatcgctgccagaccaacttgtcaaccctgtctgatccagtgcaactggaagtgcacattggatggcttcttctacaggctcccaggtgggtgttcaaagaggaggacccaatccacctccgttgccactcatggaaaaataccgccctgcacaaagtgacctatctgcagaatggaaagggtcggaagtacttccaccacaactccgatttctacattccgaaagcgactttaaaggactctgggagttacttttgtcggggtttgtttggcagtaaaaatgtgtcaagtgagacggtgaatattaccatcacccagggactggcagtttccacgatttcaagttttttcccccctggatatcaagtgtccttctgcctggtaatggttttgctcttcgccgtcgatactggcctgtactttagtgtaaagactaacatccggagctcaaccagggactggaaagaccacaaatttaagtggaggaaggatccacaggataagtag

SEQ ID NO: 116910 - DNA, 765 bp, Artificial Sequence
  Description of Artificial Sequence: Synthetic coding sequence
atgtggcagctactgctgccaacagccttgctcctactcgttagcgccggtatgcgcacggaagatctgccaaaggccgtggtatttctagaaccgcagtggtacagggtgttagaaaaagattccgtcactctgaagtgtcagggcgcctacagccccgaggacaattctacccagtggttccacaacgaaagcctgataagtagtcaggcttcctcatacttcatagatgccgccactgtcgacgattctggtgaataccgctgtcagaccaacctttctacattgagtgatcccgtccagctggaggtacacattggctggcttttgttgcaggctccccgctgggtgttcaaagaagaagatcctatccatctgcgctgccacagttggaagaacaccgctttgcacaaagtcacttacctgcagaatggaaaagggcgcaagtactttcatcataactccgatttctacatacctaaggccacactgaaagatagcggcagctacttctgcaggggcctgtttggctcaaagaacgtgagttcggagaccgtaaacattaccatcacgcagggactggcagtgtcgacaattagtagcttctttccccctgggtatcaagtttctttttgccttgtgatggtgcttctattcgccgtcgatactggcctttatttttccgtgaaaactaatataaggagtagtacgcgagactggaaggatcataaattcaaatggcgcaaggatcctcaggataagtag

SEQ ID NO: 116911 - DNA, 702 bp, Artificial Sequence
  Description of Artificial Sequence: Synthetic coding sequence
atgtggcagctgctcctacctaccgcgctcctgcttcttgtgtctgcaggcatgcggactgaagacctgccaaaggctgtagtattcttggagccgcagtggtactcagtactggagaaagactcggtgacactcaagtgtcagggggcatactccccggaggataattccactcagtggtttcacaacgaaaacctgatcagctcccaggcctccagctatttcattgatgctgctacagtgaacgactcaggcgagtatagatgccagactaatctgtccaccctttcagaccccgtgcagctcgaagtccatattgggtggttattgctgcaagcccccaggtgggtgttcaaggaggaggaccccattcatctgcggtgtcacagttggaagaacactgctctccacaaggtgacctatcttcaaaacggtaaggatcgcaagtattttcatcacaacagtgatttccacattcccaaagccaccctaaaggactccggttcttacttttgcagaggactcgtggggtccaagaatgtcagcagtgagacagtgaacattactataacgcagggcttggcagtttctaccatttcttcattcagtccgcctggctaccaggtctctttctgtctggttatggtcctgttattcgctgtggacacggggctgtattttagcgtaaaaaccaatatctag

SEQ ID NO: 116912 - DNA, 702 bp, Artificial Sequence
  Description of Artificial Sequence: Synthetic coding sequence
atgtggcagctgttgttgccgacagctttgcttcttctggtgtcagcgggaatgcggactgaagacctacctaaagcggtagtgtttttagagcctcagtggtatagcgtcttggaaaaggatagcgtaaccctgaagtgtcagggtgcctactccccggaggacaattcaacacaatggttccacaacgaaaacctgatctcgagccaggccagctcctacttcatcgatgccgccaccgtgaatgacagcggcgagtatcggtgtcaaacgaatctgagtaccctgagcgaccccgtacagctggaggttcatataggctggctacttctacaggcaccacgctgggtctttaaagaggaagatcctattcatctgagatgtcactcttggaaaaataccgcgttgcacaaagtaacctatctccaaaatggtaaagatcggaaatattttcaccataattctgacttccacataccaaaagccaccctgaaagatagcggcagctacttttgtagagggctcgtaggctctaaaaacgtcagttccgagaccgttaacattacaatcacccaggggctggcggtgagcactatctcgagcttcagcccccccggttatcaggtttccttttgcctcgtcatggtgctgttgttcgccgttgacacaggcctgtatttctctgttaaaaccaacatctag

SEQ ID NO: 116913 - DNA, 2076 bp, Artificial Sequence
  Description of Artificial Sequence: Synthetic coding sequence
atggaaatcgccccccaagaagcgccccctgtacctggggccgacggagacattgaagaggcccccgcggaggctggttcccccagtcctgcttccccaccggccgatggcaggctgaaggccgcggccaagagagttacttttcctagtgacgaagatatcgtgagtggtgcagtagagcccaaggatccctggcgtcacgcccagaacgtgactgttgatgaagtcatcggcgcttataaacaggcctgccagaagctgaattgtagacaaattccaaagctcctgaggcagctgcaggaattcaccgatttgggccacaggctggactgtctggatctgaagggagagaagcttgactacaaaacatgcgaagctctcgaagaagtcttcaaacggctccagttcaaggtggtggaccttgagcaaacgaatttggatgaggatggagcttctgccctgtttgacatgatcgaatactacgaatccgccacacatctgaacatctcctttaataaacatatcggcacaagggggtggcaggccgccgcgcatatgatgaggaagacctcctgccttcagtatttggacgcacgaaacaccccactgttagaccactcagccccatttgtcgcaagagccctgcgcattcgctctagcctggccgttctccacctagagaacgcctccctcagcggtcgccccctgatgttgctggcaacggcactcaaaatgaacatgaacctccgggagctgtacctggctgataacaagttaaacggcctgcaggattcagcacagcttggtaatctgctgaagttcaactgttctctgcagatccttgacctgagaaacaaccatgtcctggatagtgggttggcttatatatgcgaaggactcaaagaacagcgaaaagggctggtgaccctagtgctttggaataaccagttaactcataccgggatggcttttctgggtatgacactgccacacacacaatcactcgaaacactaaacctggggcacaaccccatcgggaacgagggcgtgcgccatctcaagaacggcttgatttccaaccgtagcgtcctgcgactgggtctggcatctacgaagttgacctgtgagggcgccgtagctgtggcagaattcatcgctgagtccccccgtctcttgcggctcgacttgagggagaatgagataaaaacgggtgggctgatggcactgagtctggcattaaaggttaaccattcgttgctccggctcgacctggatagagaaccaaaaaaggaagccgttaagtctttcattgaaacacagaaagcgctgctagctgaaatacaaaatggctgtaaaagaaacctggtgcttgcaagggagcgcgaggagaaagaacaacctcctcaattgagtgcctccatgcctgagacgacagccaccgagccacaacctgacgatgagccagccgcaggcgtccaaaatggtgcacctagccccgccccctccccggacagcgatagcgacagcgattctgacggtgaagaagaggaagaagaggagggcgaaagagacgaaacaccgtgtccagcccttgtacccccaaccgacagcctcggtccaggtgaccgctcgcctcccggctctccatctacacctaccgaacagaggatttcggtcagttctcctgggagggggcataaggtgttcgtagtgacaagagtggaaagcccaccagagagagctgaaccccccgcgtcaccgacaccgccgtcccctcctccgcccccttccccccctgcatctccctcattgcccccagccggcgccatcgacacccgggataccgggagttctgaacctcagcctccaccagagcctccacgttctggaccacccctgccaaatggcctcaagcccgagttcgcgctggccttgccacccgagcctcctcctggcccggaagttaagggcggttcatgcggcctggagcatgagctatcttgctccaagaatgaaaaagaactggaagagctgctccttgaagcctcccaggagtcgggccaagagactctgtag

SEQ ID NO: 116914 - DNA, 459 bp, Artificial Sequence
  Description of Artificial Sequence: Synthetic coding sequence
atgggggtgcctcgccctcaaccatgggcccttggtctgctgctgttccttctgccaggttccctgggtgcggagtctcacctgtcgctgctttatcatctgaccgccgtgtcttctcctgctccaggaacccctgctttctgggtgtcaggctggttggggccccagcagtatctatcatacaattctctccgtggtgaggctgagccctgcggcgcatgggtgtgggagaatcaggtgtcttggtactgggaaaaagagacaacagacttaagaattaaggaaaaactgtttttggaagcctttaaggcgttgggtggtaagggaccgtacactcttcaggggctgttaggctgtgagttgggcccggataacacaagcgtgcctactgcctgcgggagtacctggaggggcgcagccgagacttggtcaggtcgatcaccaccaccatgcgcatag

SEQ ID NO: 116915 - DNA, 1098 bp, Artificial Sequence
  Description of Artificial Sequence: Synthetic coding sequence
atgggcgttcctcgtccacagccctgggctctgggactgctcttatttttgctccccggctcattgggcgccgaatcccacctgtccttgctgtaccacttaacggctgtgtcgtcgcccgctcccggaacaccagccttctgggtctccggctggctgggacctcaacagtatttatcttataatagtctgcggggtgaggccgaaccgtgtggggcctgggtgtgggagaaccaggtaagttggtactgggaaaaggaaaccactgacctgcggatcaaggagaagctgtttcttgaggctttcaaggcactgggaggaaaaggcccctacaccttgcaaggtctcctggggtgcgagctcggaccggacaatacatctgtccccacagctaaatttgctttgaatggcgaggagtttatgaattttgatctcaagcagggcacatggggcggtgactggccggaagccctggcaatatctcagagatggcagcagcaggataaggctgccaataaggaactgacattcctgttatttagttgccctcaccggctgcgagagcacctggaacggggtaggggcaacctcgagtggaaggaacccccctccatgaggcttaaggccagaccctccagccctggctttagcgtgctgacttgctcagccttttcattttacccacccgaactgcagttgcggtttctcaggaatgggttagccgccggcactggccagggagactttggccctaacagcgatggcagtttccatgcttcttcctccttgaccgtaaagagcggcgatgagcatcactactgctgcatagtgcaacacgccggcctggcccagcctctgcgagtagagctggaatcacctgcaaagagcagcgtactggtggtgggtattgtgatcggggttctgctgctgacggccgcagccgtgggaggcgcgctactgtggaggcgcatgcgtagtggcttacctgccccatggatctcacttaggggagatgacacaggggttctgcttccaaccccaggcgaggcacaagacgctgatttgaaggacgtcaacgtgattcccgccacagcttag

SEQ ID NO: 116916 - DNA, 708 bp, Artificial Sequence
  Description of Artificial Sequence: Synthetic coding sequence
atgggcgtcccacggccgcagccttgggccctgggactcctgctcttcttgttgcctggatccctcggggcagagtctcacctcagcctactttaccatctgacggccgtctcatcccctgctcctgggacaccagcattctgggtgagtggttggttagggccgcaacaatacctgagctacaatagtctgagaggcgaggccgagccctgcggggcttgggtttgggaaaaccaggtcagttggtactgggagaaggagacaaccgacctcaggattaaggagaagctctttctggaagcttttaaggcgttgggtggaaaggggccatatacactgcaggggcttctcggttgtgagctgggtccggacaataccagtgtaccaacagccaaatttgccctcaacggtgaagaatttatgaattttgacctaaagcaggggacgtggggtggagactggccagaggccttagctatatctcagaggtggcagcagcaagacaaggccgctaacaaggagttaacattcctgctgttcagttgtcctcaccggctgagggagcacctcgaacgtggacggggaaatctggagtggaagggctgttggactaagatcgatacttcttggggctgtgctcagatatttattccaagtgcaaccaaggagaaactgcgcctgaatcagagcccaccaccttgcgcttag

SEQ ID NO: 116917 - DNA, 1734 bp, Artificial Sequence
  Description of Artificial Sequence: Synthetic coding sequence
atggatggcgaagcgactgtgaagcccggtgaacagaaagaggtagtgaggagaggtagggaggttgattacagccggctgattgcaggcacccttcctcagtcccatgtgacatcgagaagggctgggtggaaaatgccactgtttctgattctgtgtttattgcaggggagtagtttcgcgctgccccaaaagaggccacacccgcgctggctgtgggagggctctctgccgtctcgcactcatctgagggccatggggactctcagaccctcttcacccttgtgctggagagaagagtcttcgtttgccgctcccaacagcctgaagggttcacgcctcgtgagtggggagcctggtggcgcagtcactattcaatgtcactacgcgccaagctcggtgaaccgccaccaacgcaagtattggtgcaggctgggtcctcctcggtggatctgtcaaacaatcgtttcgacaaatcagtatactcaccacaggtaccgcgatagggtggcgctcaccgactttcctcagcggggactcttcgtagtgcggctgagccagctatcccccgatgatattggttgttatttatgtggcatcggtagtgagaataatatgctgtttctgagcatgaacctgacgatcagcgcagggccagcatctacactgccaactgcaacccctgccgccggcgaacttactatgaggagttacgggaccgcgtcacctgtcgccaatcggtggacacctgggacaacccagacgcttggacaagggaccgcctgggacacagtcgcttctacccctgggacatctaagaccacagcatccgccgaaggcagaagaacacctggcgctacccgacctgctgcccccggcacagggtcttgggcggaaggcagcgtcaaagctcctgcccccataccagaaagtccgccatcaaagtcaaggtcaatgtccaatactacagagggcgtctgggagggcaccaggtcgagcgtcacaaatcgggctcgggcgtccaaagaccggcgcgaaatgaccacaaccaaggccgaccgccctcgggaagacatcgagggggtcaggatcgctttggacgccgccaagaaagtccttggcacaattggtccccccgcccttgtgtcagaaaccttggcctgggagatactccctcaggctacccctgtgtccaaacagcagagccaaggcagtattggcgagaccaccccagccgccggcatgtggactctggggactcccgccgccgatgtgtggatactcggcaccccggctgcagacgtgtggacatcgatggaggctgcaagtggcgaaggatcggccgctggggaccttgacgccgcgacaggcgatcgcggacctcaggcgacgttgtcacagacccccgctgtcggaccttgggggccaccaggaaaagagagcagtgtcaagagaacgttcccagaggacgagtcaagtagcaggaccctggctccagtgagcacgatgctcgccctgttcatgttaatggccctggtgctccttcagcgcaaactgtggagaaggcgcacaagccaagaggccgaacgcgttacactgattcagatgacccactttctggaggtcaacccccaggcagatcagctgcctcacgtagagaggaaaatgctccaggacgatagcttgccagccggtgcaagcctcacggctcctgagcgaaatccgggtccttag

SEQ ID NO: 116918 - DNA, 1608 bp, Artificial Sequence
  Description of Artificial Sequence: Synthetic coding sequence
atggacggggaggcgacagtcaagccaggcgaacaaaaggtgccgctgtggacacacggctggccacccgatgaccccagcccctcttttgcagcaggtagttcattcgcattgccccagaagcgccctcatccccggtggctatgggaaggttcactaccctctaggacgcatctgcgagccatgggaacactcagaccctcttcacctttgtgctggcgggaggaaagcagctttgcagctcccaactcactaaaggggagccgtctggtatcaggcgagccaggcggtgccgtaaccattcagtgtcactacgcaccaagttcagttaaccggcaccagcgcaaatactggtgtcggttaggcccccctcgatggatctgtcagaccatcgtgtccacaaatcagtacactcaccatcgctatcgcgacagggtggctctgaccgacttccctcaaagaggcctgttcgtggtcagactgtctcagttgtctccagacgatattgggtgctacttgtgcggtatcggatcggaaaacaatatgctcttcttgagcatgaatctgaccatcagcgccggccctgcaagtacgctgccaaccgccactccggctgccggggagctgaccatgagatcgtatggcactgccagcccagtggccaatcgctggacaccagggaccacccagacgctagggcagggtacggcttgggataccgtggcgtccaccccaggcacctccaagacgaccgcgtcggcagaaggacggcggacccccggcgccactcgaccagccgctcctggcaccggatcttgggccgaagggtcagttaaagcccctgcgcccatacccgaatcccccccttccaagagccgatccatgagcaatactactgaaggagtatgggaaggtacgaggtccagcgttaccaatcgagccagggctagtaaggaccgccgggaaatgaccaccaccaaagctgaccggccacgcgaggacatagaaggggttcgtatcgccctggacgccgctaaaaaagttttgggtactattggacccccggcgctggtgtcggaaactcttgcctgggagatactgccacaggccacaccagtgagcaagcagcagtcccagggttctatcggcgagacaactcccgccgccggaatgtggacacttggaacaccagcagccgatgtgtggattacctcaatggaagccgcttctggggaaggcagcgcagcaggggacctcgacgctgccactggggatcgcggcccccaggcgacccttagccagacccctgcagttggaccctggggccccccaggaaaggaaagcagtgtaaaacgcgctacctgccccggtttaagcacactgaaggagatcaaggtttccgccgtgttgacccagaatccacactctctcctctgcgtaagcgcagctcaggaagcagaaagagtgacactgatccagatgacccacttcctcgaagtcaacccacaggctgaccagcttccgcatgtcgaacgtaaaatgctccaggacgattccttgcctgcaggcgcatcactgactgctccggaacgcaacccaggaccctag

SEQ ID NO: 116919 - DNA, 798 bp, Artificial Sequence
  Description of Artificial Sequence: Synthetic coding sequence
atggacggtgaggctacagtcaaacccggcgagcagaaagaagtggtgagacgcggaagagaggtggattacagtcggctaatagcgggcaccctgccccaatcgcatgtcaccagcagaagggctgggtggaagatgccgttgtttctgattctgtgtctgctgcaggggtcatccttcgccctcccccagaagcgacctcaccccaggtggctctgggaaggctcattgccaagccggacacatctgagagccatgggaactttgagaccttcttcgcctctgtgttggcgggaggagtcttctttcgcggccccaaatagcctgaaaggctctaggttggtgagtggtgaaccagggggggcggtgacgatccaatgtcactatgccccctcttctgttaatcggcatcaaaggaagtattggtgccgccttgggccccctcgttggatctgccagacgatcgtctccacaaatcagtacactcaccatcggtatagggaccgggtggcactgacagactttcctcagcggggtctgtttgtcgtgagactttcacaactgtcccccgatgatattgggtgttacttatgcggaatcggtagtgaaaataatatgctttttctttctatgaatttaactatatcggcagtgctgttccaaaaaatgaaggctgctctcgggccttggctactgagcctgccctgctggccctgtctgtgtctgtggctttggttttattgtaaaggctcttcaggagagggcggcccactaaggcgccagaaaggaagtccgtag

SEQ ID NO: 116920 - DNA, 798 bp, Artificial Sequence
  Description of Artificial Sequence: Synthetic coding sequence
atggacggggaggcaacggtaaagcctggcgaacagaaagaagtagtccgtcggggaagagaggtggactatagtcggttgattgcagggacattgccacagagccacgtcactagtagaagggcagggtggaaaatgcctctgtttcttattttgtgcttactacagggcagttccttcgctcttccccaaaaaagacctcatccccgctggctgtgggaagggtcgcttcccagtcgcactcacctgcgcgcgatgggtactttacgaccctcaagccccctgtgctggagagaagagtccagctttgctgctccaaacagccttaaggggtctcggctggtgagcggcgagcctggcggggctgtaaccattcagtgtcactatgctccgtccagtgtgaacaggcatcaaaggaagtattggtgtcggctcggtccaccacgatggatctgccagacaatagtgtcaacaaaccagtacacgcatcaccgctaccgcgacagagtcgcactcactgactttcctcaacgagggctgtttgtcgtgcggctttcacagctaagcccagacgacatcgggtgctatctatgcgggatcggcagcgaaaataacatgctgttcctgtcgatgaatctaacgatctccgccgttctgttccagaaaatgaaggcggctctgggaccatggttgctgtcactgccatgctggccctgcctgtgcctatggctgtggttctactgtaaggggagcagcggcgagggggggcccctgagaaggcagaagggtagtccgtag

SEQ ID NO: 116921 - DNA, 1101 bp, Artificial Sequence
  Description of Artificial Sequence: Synthetic coding sequence
atgctgccacggctactgctccttatctgtgcaccactgtgcgagcccgccgagctgtttttaatagcatccccttcacatcccacagaagggtctccagtcaccctgacatgcaaaatgcccttcttgcagagctccgacgcccagttccagttctgtttttttcgcgacactcgggccctaggtcctggatggtcttcttctcctaaactacagatcgcagccatgtggaaggaagataccggaagctattggtgcgaggcccagacgatggcgtctaaagtgttacgcagccggcggagtcaaattaacgtccacagggtgcctgtggcagacgtctcactggaaacacagccaccgggcggtcaggtcatggagggcgacagattggtgctaatctgtagcgtagccatgggcacaggcgatatcaccttcttatggtacaaaggtgctgtgggactgaacttacagtcgaagacacagcgcagtcttaccgccgagtacgaaattccctcagtcagggagtcagatgctgagcagtactactgtgtcgccgaaaatgggtatggccccagtccctcaggcctcgtaagcataactgtgcgaatccccgtctcacgccccatcctcatgctgcgggcacctagagcgcaagcagctgtggaggacgtcctagagctgcactgcgaagccctgagagggtccccccctatactatattggttttaccatgaggacattacactgggaagtcggtcagccccatccggaggcggggcgagttttaatctctccctcaccgaggaacatagcggcaactacagctgtgaggctaacaatggccttggagcccagcgatctgaggcggtgacactcaattttaccgggcgtaggtctgctcgcgacccactgcggagcctcccatcaccacttcctcaggaattcacttatctgaactcccccacacctggacagctgcaaccaatctacgagaatgagcccagagagcagtctgttgctgttcatggcaggcagcagcactcttctgagcagaaagctcagaaaccctggggccatatttggagaaccaggttcccttag

SEQ ID NO: 116922 - DNA, 1290 bp, Artificial Sequence
  Description of Artificial Sequence: Synthetic coding sequence
atgctgcctaggttgctgctccttatctgtgccccactgtgtgagcccgccgagctgttcctgatcgcctcacccagccaccccacagagggatctcctgttacactcacctgcaagatgccattccttcagagttctgacgcacagttccagttctgtttcttccgggatacgagagccttgggccctgggtggtcatcctcccctaaactccagatcgctgccatgtggaaggaagacacggggtcctattggtgcgaggcccaaacgatggctagtaaagttttgaggtctaggaggagccagatcaatgtacatcgggtgcctgtggccgatgtgtctctggaaacccagcctccaggtggtcaggttatggagggtgatcgcctcgttctcatttgcagcgtcgcaatgggcacaggagacataaccttcctctggtataaaggtgccgttggattaaatctgcagtcaaagacccagcggagcctgaccgctgaatatgagatcccatcagtgcgtgaatctgacgccgaacaatattattgcgtggccgaaaacggatatggcccctccccaagcgggctggtcagcatcacagttcggatccccgtctctagaccaattctgatgcttcgcgcgcccagagctcaggcggccgttgaggatgtgctcgaattacactgcgaagcactgaggggatcccctccaattttgtactggttttatcatgaggatataacgctaggcagtaggtctgccccctctggaggcggggcctctttcaacctgtccttgacagaagagcacagcggtaattactcttgcgaagccaacaacggacttggcgcacagaggtcagaggcggtgaccctgaatttcaccgttccaacgggggctagatctaaccatttaacttcaggggtcatagaggggttgttgagtacactagggcctgccactgttgctctgctattttgctacggccttaagcggaagattggtcgaagatcagcgcgcgacccgctgagatctctcccctcacctctgccacaggagttcacatatctgaatagtcctacacccggacagctgcagccaatttatgaaaacgtcaatgtcgtgtctggggacgaagtgtattcactggcttattacaaccagccagagcaggagagcgtggctgccgagacactgggcacccatatggaggataaagtctccttggacatttactcccgcctacgaaaggccaatatcactgatgtagattacgaagatgcaatgtag

SEQ ID NO: 116923 - DNA, 1287 bp, Artificial Sequence
  Description of Artificial Sequence: Synthetic coding sequence
atgctgcccagactcctcctgctgatctgcgcacccctgtgtgagcccgcagagttattcttgattgccagcccctcgcatccaaccgaaggctcccctgtgactctgacgtgtaaaatgccctttctgcagtcatccgacgcacagttccagttctgtttcttccgtgatactagggctctgggacctggctggagcagctccccgaaactgcaaatcgccgcgatgtggaaggaggataccggaagctattggtgtgaggcccagacaatggcttccaaagtactcaggtccaggcgctcacagattaacgtacatagagtccctgtggccgatgtgtctctcgagactcagcctcccgggggccaagtgatggagggcgaccggctcgttctcatatgtagtgtcgcgatgggaactggagacattacatttctgtggtacaaaggcgccgtgggtctaaatcttcagtcaaagacccagagatcattgactgccgaatatgaaatacctagcgtaagagaatcagatgcagagcagtattattgcgtggctgagaatggctatgggccttccccatcaggtctggtctccataactgtgcggattcccgttagtcgccctatcctgatgcttcgggcgcccagagctcaggcagcggtggaggacgtgctggagctccactgtgaggcactgaggggctcgcctccaattctatactggttttatcatgaggatattacactgggcagtaggtccgccccttcaggcggcggagccagcttcaacctgtcacttaccgaggagcactctggtaactactcctgtgaagccaataacgggttgggagcccaacgttccgaagccgtgacactgaacttcacagtgcccaccggtgcaagatctaaccatctgactagcggcgttatagagggtctgctgtctacgctcggacccgccaccgtggctcttctattttgttacggcctcaagcgcaaaattgggaggcgaagcgccagggaccctctgcgttcccttccgagccccttgcctcaggagttcacctacctgaactccccaactcccggacagctacagccaatttacgagaatgtgaacgtggtgagcggagacgaggtgtacagcctggcttactataatcagcccgaacaggagagcgtggcagagacactcggaacccatatggaagataaggttagcctggacatttatagcaggctgcgaaaagcaaacataactgatgtggattacgaagacgccatgtag

SEQ ID NO: 116924 - DNA, 2670 bp, Artificial Sequence
  Description of Artificial Sequence: Synthetic coding sequence
atgagctatttcggtgaacacttttggggcgagaaaaatcacggctttgaggttctctaccactccgtgaaacagggaccaatcagtactaaagagttggcggatttcatccgcgagcgggcaactatagaggagacatacagtaaggctatggctaaactctcaaaactggcttccaatgggaccccgatgggtacgttcgctcctctgtgggaggtgtttagggtgtcctccgataaactagctctctgtcacctggagctgacaaggaagttacaggatctgatcaaggacgtactgaggtatggtgaagaacagctgaaaacacataagaaatgtaaagaagaagtggtgagtacactggacgctgtgcaggtgctaagcggcgtttcacagctgctgcccaagtcaagagagaactacttgaaccggtgcatggaccaagagcggctcaggcgcgaaagtacctcccaaaaagaaatggacaaggccgagactaaaacaaagaaggccgcagaaagtctccgccgttctgtggaaaagtacaactctgcacgggccgactttgaacaaaagatgctagattccgctctcaggtttcaagctatggaagaaacacatctcagacacatgaaagccctcctgggatcatacgcacactctgttgaggatacacacgtgcagattggccaggttcacgaagagtttaagcagaatatcgagaacgtctctgttgaaatgctgctcagaaaattcgcagagagcaagggtaccgggagagaaaaacccggtcctcttgactttgaggcctacagcgcggcagccctgcaagaggcaatgaagcgtctgagaggagcgaaagcctttagactgccggggttgtctaggagggaaagggaacccgagccccccgcggctgtggacttccttgaacctgacagcggcacctgtccagaggtggacgaagaagggtttactgtcagacctgacgtgacccagaatagtacagccgaaccatcccgattcagttcgtccgactctgacttcgacgacgaggaaccgcgcaagttctatgtgcacattaaacctgctcccgcgagggcccccgcatgtagtccagaagctgctgctgctcagctcagagcgacagctgggagcctcattctgccccccggccctgggggcaccatgaagagacactcctctagggatgccgcaggaaagccacagagaccacgctccgccccgcggacatcttcttgcgcagaacggctgcagagcgaagaacaggtgtctaagaatctgtttggaccgcccttggagtccgcgtttgaccacgaggacttcacaggatcaagctcccttggattcacttcaagcccatctccgtttagtagtagctctccagaaaatgtggaggactccggtctggacagccccagccacgcggccccaggccccagtccagattcatgggtccctagaccaggcactccgcagagtccgccatcatgccgcgccccccctccggaagcccgcggcattagggcgcctccacttcctgatagcccccagcctctcgcaagttcccctgggccctggggattggaggctctggcagggggtgacctgatgcccgcacccgcagatccaacggcaagggaaggacttgcagcgccgccgcgccgcctcaggtccaggaaggtgtcttgtcctctgacgcgctccaatggcgatttgtcccgtagtctgtcaccttccccccttgggagtagtgcagccagcactgcactagaacggccttcattcctgtcccagactggccacggtgtgagtcggggaccttcgcctgtggtcctgggcagtcaggatgctctgccaatagcaacagcattcactgaatatgttcatgcctactttcgcggccacagcccaagctgccttgctagagttactggtgaattgaccatgaccttccccgccgggattgtgcgcgtgtttagcggaacaccaccacctcctgtcctttcctttaggctggttcatacaacagccattgaacacttccagcccaacgcagatctcctgtttagtgatcctagccagtccgatccagagaccaaagatttttggctcaacatggccgcactcacagaagccctgcagagacaagccgagcaaaatcccaccgcctcatattacaatgtggtccttttgcggtatcagttctctcgccccggcccacagtctgtccccctacagctcagcgcgcactggcaatgtggtgccacccttactcaggttagtgtggagtatgggtatcgaccaggagcaactgccgtgcccacccccctgacaaacgtacaaattcttttacccgtgggggaacctgtaacgaacgttagactccagccagcagctacatggaacctggaggagaagaggctgacatggaggctcccggacgtttcagaagccggaggttcagggaggctgtctgcgagttgggagccactctccgggccctccaccccctctcccgtggcggctcagtttacatctgagggaaccacacttagcggagtggacctggagctggttggatcaggctatagaatgtccttggtaaagaggcgcttcgctacaggcatgtacctggtatcttgctag

SEQ ID NO: 116925 - DNA, 2670 bp, Artificial Sequence
  Description of Artificial Sequence: Synthetic coding sequence
atgtcctactttggcgagcacttttggggggagaaaaatcatggtttcgaggtcttgtaccacagcgttaagcagggacccatttcaaccaaggaacttgcggacttcatccgtgagagggccacaattgaagaaacttatagcaaggctatggctaaactcagcaaactggcttccaacggtactcctatgggaactttcgctccactgtgggaagtctttcgagtgtcttctgataaactggctttatgccaccttgagctaaccagaaaactccaggaccttataaaagacgttttgcgctatggagaggagcagctgaagacccataaaaagtgtaaggaagaagtggtgagcactctcgacgctgtgcaggttttaagtggggtctctcaactgttgcctaaaagtagggaaaactacttgaaccgctgtatggaccaagaacgcttacggagggaatctacctcacagaaagaaatggataaggccgagacaaaaactaaaaaagccgccgagtccctcagacgctccgtcgagaagtacaacagcgcacgagctgactttgaacaaaaaatgctggacagcgccctaagatttcaggccatggaggagacccacctacggcatatgaaggcactcctgggctcttatgcccacagcgtagaggacacccatgtccagatcggacaagtccacgaggaatttaagcagaatattgaaaacgtcagtgttgagatgctgctgcggaagtttgccgagagtaaaggaacagggagagagaaacctggcccactcgattttgaggcatatagtgccgccgcgcttcaagaggcgatgaagcgactgcgcggcgcaaaggcattccgcctaccaggcttgagccgccgagaaagagaaccagaacctcctgccgccgtggacttcctcgagcccgactcaggcacatgccctgaggtagacgaagagggtttcacggtgaggccagatgtgacacaaaattctactgctgagccttccagattttcttcatccgactccgattttgacgacgaggaaccacgcaagttctatgtgcacatcaagccagctcccgcccgggcaccagcgtgctcccctgaagcagccgccgcgcagctgcgggctacagccggcagtctgatcctgcctccgggacccggcggtaccatgaaacggcatagttctcgcgatgccgcagggaagccccagcgacccaggagcgccccgcgcacctcttcttgcgccgaacgcctccagtcagaggagcaggtgtctaagaacctcttcggcccccccctcgagtccgctttcgaccacgaggattttaccggctcctcttccctgggtttcacgagttcaccatcaccattttccagctcaagtccagagaacgtagaggactcggggttggactccccctcccatgccgcccctggcccatcccccgattcttgggtgccacgacccggtacgccacagtcgcctcccagttgccgagcgcctccacccgaggcgagagggatcagggcccctccgctgcccgactccccccagcccctggccagtagccccggaccatggggccttgaggccctcgccggaggtgatctgatgcccgcacccgccgaccccacagcccgagagggccttgccgcgccaccgcgaaggctgcggagtcggaaggttagctgtccattgaccaggagcaacggcgacctgagcaggtcccttagcccttcacccctcgggtcaagcgccgcatccactgccttggaacgtccgagcttcctctcacagactgggcacggagttagtcgaggtccgagcccagtcgtcttgggctctcaggacgcgctgcccattgcaacggcttttactgaatatgttcacgcatatttccggggacactctccatcttgcctggcaagggtgaccggggaactgactatgacgttccctgccggcatcgtgagggttttctctggcactcccccacctcccgtcctatcatttcggctggttcataccactgcaatcgagcacttccaacccaacgctgatctgctattcagcgacccctcacagtcggaccctgaaaccaaagacttctggctgaacatggctgctttgaccgaggcacttcagcgccaggcggagcaaaacccgacagcaagctactacaacgtcgttctccttcgataccaattcagccggcctggaccacagtccgtgccgttgcagctcagtgctcattggcaatgtggagctactctgacccaggtgagtgtggagtatgggtaccgacccggcgccaccgccgtccccactcctttgacaaacgtgcagattttactgccagtgggggagcccgtgactaacgtgcgtcttcagcctgccgccacatggaatctcgaagagaaacgacttacctggcgccttcccgacgttagtgaagctggcggtagtgggcggttaagcgcctcctgggaacctctctcggggccctctacacctagccctgtcgccgcccagtttacatcagaggggaccactctgagcggggtggatctggaacttgtcggatcaggttacaggatgagcctagtcaagcgcagattcgctaccgggatgtaccttgtcagttgctag

SEQ ID NO: 116926 - DNA, 2670 bp, Artificial Sequence
  Description of Artificial Sequence: Synthetic coding sequence
atgtcctattttggcgagcacttctggggcgaaaagaatcatggcttcgaggtgctgtatcactccgtaaaacagggccccattagcaccaaggagctggccgattttattagggaacgcgctacaatagaagagacatattccaaggccatggctaagctcagtaaactggcatccaacggtaccccgatggggacttttgccccactttgggaggtctttagagtcagctccgacaagcttgcactgtgccatctggagctgacccgtaagcttcaggatttaattaaggatgtcctccgctacggggaagagcagctcaagactcacaaaaagtgcaaagaggaggtggtttcaacactggacgccgtacaagtacttagcggggtgagccaacttttgcctaagagcagggaaaactacctgaatcggtgtatggaccaggaacgacttcggcgtgaaagcacatcccaaaaagagatggacaaggccgagaccaaaaccaaaaaagccgcagagagtctgaggaggtcggtcgagaagtataacagtgctagagcagattttgagcagaaaatgctcgactcagcactacgatttcaggcgatggaggagactcatctccgccacatgaaggcactgttgggatcatacgcgcactctgtggaggacacccatgtccagattggacaagtccacgaagaattcaagcaaaatatagagaatgtgtctgtggagatgttactaagaaaattcgctgagagcaaaggcacaggtcgggagaagccaggccccctcgatttcgaggcctacagcgcagccgcattacaagaagccatgaagcggctgcgcggcgccaaggccttccgcctccccgggctctcccgaagagaaagggaaccagagccgcccgctgccgtcgactttcttgagcccgacagcgggacatgtcccgaggtggacgaagagggtttcaccgttaggcccgatgttactcagaactccaccgctgaaccctcccggttcagttcctccgacagcgactttgatgacgaagaaccccgaaagttctatgttcatatcaagccagcccccgctcgcgcgccagcatgcagtccggaggcagcagcggcccagttgcgggccaccgccggaagtttgatattgccgcctggcccaggcgggaccatgaaaaggcattcttcgcgggatgcagcagggaaacctcagcgtccaaggagcgctcctcggactagcagttgtgcagagagactgcagagtgaggagcaagtgtctaagaatctgtttggtcccccactggagtctgccttcgaccacgaagactttaccggctctagcagtttagggtttacgagttccccttcccctttttcttccagcagccctgaaaatgtggaggactcaggcttagattcccccagtcatgcagctcctggaccgtcgcccgactcatgggtgcccaggccagggacaccgcagagcccgccttcttgtcgcgcccctcccccagaggctcgagggatccgagcaccgcccctgcccgacagccctcagccactcgcaagctcccccggcccatggggactggaggcactggctggcggggacttgatgcctgctcccgccgaccccacggccagggagggccttgcagctccaccacgtaggttgcgctcgcgtaaggtgtcctgtccacttaccagatctaacggggacctctctagatcactctctccctctcccttgggtagctcagccgcgagtaccgccctcgaaagaccttcgtttctttcccagacgggacatggcgtgagtcggggtccttcccccgtggtgctaggcagccaggatgcccttccaatagctacagccttcacagagtatgtgcatgcatacttcaggggccatagcccttcctgcctcgccagggttacaggcgaactgacgatgaccttcccagcaggcatcgtccgggtcttttcaggtacaccacccccccccgtgctgtctttccggctggttcacactactgcgattgagcattttcagcctaatgccgacctcctgtttagcgaccctagtcagtcagatcccgagaccaaagacttctggctaaatatggctgcgctcactgaagcgctgcaaaggcaggccgaacagaaccctaccgcgtcttattataacgttgttctgttgcgttatcaattcagccggcctggtcctcagtccgtgcccttacagctgtctgcacattggcagtgcggagcaacattaacacaagtaagtgtggagtacggataccggccaggtgctacagccgtgcccacgcctcttacaaacgtgcagatactcctgcccgttggagagccagtgaccaacgtaaggctgcagcctgcagcaacctggaatctcgaagagaaaagactgacttggaggctgccagacgtcagtgaggcaggagggagtggccgcctaagcgctagctgggaaccgctctcgggcccaagtacacccagcccagtggccgctcagttcacaagcgagggcaccacactcagcggagtggacttggagttagtcggatcaggttatcggatgtctctggtgaagaggcgcttcgcgacagggatgtacctggtgagctgttag

SEQ ID NO: 116927 - DNA, 2676 bp, Artificial Sequence
  Description of Artificial Sequence: Synthetic coding sequence
atgtcttattttggagaacacttctggggtgaaaaaaatcacgggttcgaagtattgtatcactcggtgaaacagggtcccatctctacgaaggagttggctgattttattagggagagagctactatcgaggaaacgtactcaaaagctatggctaagcttagtaagttggcgtcaaatggcactcccatggggacctttgcgcctttatgggaggtcttcagggtgagctcggacaagttagccctgtgtcacctagaactgacacgcaagctacaggatctgatcaaggatgttttacggtatggcgaggagcaactgaagacacataaaaagtgtaaggaagaagtggtgtctactctagacgcggttcaggtgttatcgggagtgtctcaactgctcccgaagtccagggaaaactatctaaaccgttgtatggaccaggagcggttgagacgcgaatctacgtcccagaaggaaatggataaggccgaaacaaaaacgaagaaagccgcggagtcactgcggcgctcagtcgagaaatacaactctgcccgtgcggactttgagcagaagatgctggattcagccctgagatttcaggcaatggaagaaactcatttaaggcatatgaaggccctcttggggagctatgctcatagtgtagaggatacgcatgttcagatcgggcaggtccacgaagagttcaaacaaaatatcgaaaatgtgagtgtagagatgctgttaagaaaatttgccgaatccaaaggaacaggtagggaaaagccaggaccattggatttcgaagcgtatagtgcagcggctctgcaggaggccatgaaaaggctcaggggcgccaaggcgttcagattacctggcctcagtcgtagggaacgggaacctgaaccccctgcggcggtggacttcctcgagcccgattccggtacttgtccagaggtggacgaagaaggattcactgttcgtccagacgtgacccagaacagtaccgcagagccgagtagattcagtagtagcgattccgactttgacgatgaggagccccggaagttctacgttcatattaagcccgcccccgcacgagctcctgcttgtagcccggaggcagccgcagcgcagctgagagctacagctggttcgctgattctgccgccaggtcccggaggcacaatgaagcggcactcaagccgggatgctgctggcaaaccgcagaggccgaggtctgcgccgcgcacaagcagttgtgctgagcgtctgcaaagcgaagaacaggtgtccaaaaacctcttcgggcctcctctggaatctgcttttgaccatgaggattttaccggaagcagtagtcttgggtttactagttccccctcccctttctcctcaagctctcctgagaacgtcgaagactctgggctggactccccctcccacgctgctccagggcctagccccgattcgtgggtccccaggcctggaacacctcagtctcccccaagctgtcgggctccccctcccgaagcccggggtattcgagcgccgcctcttccagactcacctcagccattagcctccagtcccggaccctggggcctcgaagctctcgccggaggtgacttgatgcctgcgcctgcggatcccacggcacgggagggcctggccgctccacccaggagactccggtctcgcaaagtgagctgccctctcacacgaagcaatggagacctcagccggagtttgagcccctccccgctcggctctagcgctgcctctaccgccttggaacggccttccttcctaagccagacagggcatggagtgtcgagaggccccagcccagtggtcctgggctcccaggacgctctccccatagccaccgctttcaccgaatatgtacacgcctatttccggggacattctcccagctgtttggccagggtcactggcgagttgaccatgacatttccagcgggaatcgtccgggtcttctcaggtactccccccccccccgtcctgtccttccgtttggttcataccacggccatcgaacactttcagcctaacgccgacctcttgttttccgatccgtctcagagcgacccagaaactaaagacttttggctgaacatggcagcactcaccgaggcgcttcagagacaagcggagcagaatccgactgcctcttactacaatgtcgtccttcttcgctaccagttttcccgaccaggtccacagtcagtgccactgcaactgtcagcgcattggcagtgcggagcaactctgacacaagtgtcagtggagtatggataccgtcctggagccacggctgtgcccacccccttgactaatgtccaaatactcttacctgtaggagagcccgtcaccaacgtccgcctgcagcccgcggccacctggaacctggaggaaaaaagattaacctggcggttgcccgacgtgtctgaagcaggtggatcgggcagactgtcagcgtcttgggaaccacttagtggcccttctactcccagtcccgtggcggcacagttcacgagcgaaggaaccacactctccggagtggatcttgaacttgtcggctctggttaccgcatgagcctggtgaagcgtaggtttgcgacagcagcccctccccagggatgtacgtggtag

SEQ ID NO: 116928 - DNA, 2520 bp, Artificial Sequence
  Description of Artificial Sequence: Synthetic coding sequence
atggcaaaactctctaagctcgcatccaacgggacacctatggggacttttgcccccctgtgggaagtcttcagggtgtcaagcgacaaacttgctctgtgccacctcgaactgacacgcaaattgcaggacctgataaaggacgtgcttagatacggcgaggagcagctgaagacccataaaaaatgcaaggaagaggtggtctccacgctagatgccgtccaggtgctcagcggagtctctcaattactacccaaatcgcgggaaaactacctgaacaggtgtatggaccaggagcgtttgcggcgtgaaagcacaagccagaaggagatggataaggccgaaacaaagacgaaaaaagccgcggaaagtctgcgaaggagcgtggagaaatacaattccgctagagccgacttcgaacagaaaatgctggattctgctcttaggttccaggctatggaagagacacatctcagacacatgaaagctctgctgggctcttacgctcactccgttgaagacacacatgttcaaatcgggcaggtgcacgaggagtttaaacaaaacatcgagaatgtaagtgttgagatgctccttagaaagtttgcagaatctaagggtactgggcgagaaaagcccgggccccttgactttgaagcttattctgccgctgcactccaggaagccatgaagaggctgcgcggagcgaaagctttcagacttcctggcctgtctcgcagggaaagagagccagagcctccggctgcagtcgactttctggagccggatagtggaacttgcccagaggtagatgaagagggattcaccgttcgccccgacgtgacccagaatagtacggccgagccatctcggtttagtagttcagattctgacttcgacgatgaggagcccagaaagttttacgtgcatataaagccagcccccgcccgggcccccgcgtgttctcccgaagctgctgccgcgcagctgagagctaccgccgggtccctgatcctgcctcctggtcccggcggcacaatgaagaggcatagctcaagagacgcagcggggaaaccccagaggccccggtccgcacctaggacgtcctcttgtgctgagcggctgcagtcagaagaacaggtttcaaagaatctttttgggccacccctggagagcgccttcgaccatgaggacttcacagggagtagttctcttggtttcactagctccccctcccccttctcttcctcctctcccgaaaatgttgaggacagtggcctggatagcccttcccacgccgcccccggtccctcaccggattcctgggtaccaagacccgggacaccacagtctccgccgtcttgccgggctcctccgcccgaggcacgcggaattagggctcccccactaccggatagtcctcagcccttagcctccagcccaggcccttgggggttggaggctctggccggcggggaccttatgccagcccccgctgatccgacagccagggaaggtctggctgctcctcctcgacgtctgagaagcaggaaggtctcttgtcctttgacccgttctaatggggatctgtctcgaagcttgagtccctcgcccctcgggtctagcgcggcttctactgctttggagagaccctcctttcttagtcagacggggcatggggtgtcccgcggaccatctccagtggtgttggggtcccaggacgccctgccaatcgctactgcattcaccgagtacgtccacgcctacttccgcggccacagcccaagctgtttagcccgagtaacaggggagttgacgatgaccttccccgccggaatcgttagggtcttctccggaacccctccacccccagttctctcctttagactggtgcatactaccgctattgaacatttccagccaaacgccgacctgctcttttcggatccttcccagagcgaccctgagaccaaggacttttggctgaacatggccgctctgaccgaagcgcttcagcggcaggcagaacagaaccccacagcaagctactacaacgtggttctgctgagatatcagttctcccggcccggccctcagagtgttcccttgcaactgagcgcccattggcagtgcggagccaccctgacccaagtttcagtcgagtatggatacagaccaggggcgacagccgtcccaacaccactgactaacgtccagattctactacctgtcggggagccagtcacgaatgtgaggttacagccagccgctacctggaacctggaggagaagagactcacctggaggctgccggacgtctcggaggccggaggttctgggcggctgtccgcttcttgggaaccattgagtggaccaagcactccgagtcccgtcgctgcacaattcacgagtgaggggacaacgctatctggcgtggacttggagctcgtgggatccgggtatcgtatgtcactggtaaagcgccgcttcgcaaccggtatgtacctggtaagctgttag

SEQ ID NO: 116929 - DNA, 2670 bp, Artificial Sequence
  Description of Artificial Sequence: Synthetic coding sequence
atgtcctattttggcgaacatttttggggggaaaagaatcatggcttcgaagtgctgtaccattccgtgaagcaaggacctattagtacaaaagaattagccgactttattcgagagcgcgccacgatagaagaaacgtatagtaaagccatggcaaagctcagcaaactggcctccaacggaacaccaatgggtactttcgccccattatgggaggtctttagggttagctctgacaaattagccctttgccacctggaactcacacgcaagctgcaggatctgataaaagatgtgctcagatacggagaggaacagctgaagactcataagaaatgcaaagaggaagtcgtaagcaccctagatgctgtccaggttctatccggcgttagccagttgcttcctaagagtcgcgagaactacctcaatagatgcatggatcaagaacggctgagaagggagagcaccagccagaaagaaatggacaaagcggagactaaaaccaaaaaggccgcagaaagcttgcggagatcagtggaaaaatacaattccgctagagcagatttcgagcaaaaaatgttagattccgcactgcgcttccaggccatggaagagactcacctgaggcacatgaaggctctgctcggaagctatgcccacagcgtcgaagacacccacgtgcagatagggcaggtgcacgaggaatttaaacagaatattgaaaatgtctccgtggagatgctgctgaggaaatttgctgagtcaaagggcactggcagagagaagcctggcccgctggatttcgaggcttacagcgccgccgccctgcaggaggccatgaagcgcctcaggggcgccaaagcctttaggttgccaggcttgtcacgaagagaaagggaacccgagccgccggcggcagtcgacttcttggagcccgattccggcacatgtcccgaagtggacgaggaagggttcacggtccggccggacgttacccagaacagcaccgcagagccatcaagattttcaagttctgacagtgactttgacgacgaagagccccgcaaattttatgtccacataaaaccagcacccgctcgagccccggcctgtagccctgaagccgccgcagctcagctgagagccacagcaggctccctgattctgcctcccgggcctggcggtactatgaaacgacactcatctagggacgcagccggtaagccccagagaccccgtagcgcccctcgtacctcaagctgcgcagagcggctgcagtctgaggagcaggtttcgaagaacctcttcggtccgccattggaaagtgcattcgaccatgaggactttactggatcctcttctctcgggttcacaagttccccttcgccatttagcagttcttcacccgaaaatgtggaggacagcggattggacagccctagccacgcggcgccagggccatcccctgactcatgggtcccacggcccgggacaccccagtcaccgccttcttgccgggcacctccgccagaggctcgcggcatcagagccccccccctgccagactctccacagccattggcaagcagccccggcccctggggcctcgaggctcttgcaggaggcgatttgatgcctgctcctgccgaccctacagcccgtgaggggctggccgcccctccaagacggctgaggtctagaaaggtgagttgcccactgacaaggagtaacggtgacctgagccgaagtttgagcccttcacctctgggctccagtgccgcatcaacagcgctcgagcggccatcgttcctctcgcaaacaggacatggcgtctcacgtggaccttccccagtagtcctgggctcacaggatgccctgcccatcgcgactgcctttacagagtatgtccacgcgtacttccgagggcactcacccagctgtctggctcgagtaaccggggaacttactatgacctttccggccggcattgtgcgcgtgttcagcggcacacctccgcccccagtgctctctttccgattggtgcacacaaccgccatcgagcattttcagcctaatgccgatttgctgttttcagatccctcacaaagcgatcccgagaccaaggatttctggttgaacatggctgcactgaccgaagccctgcagaggcaggccgagcagaacccaactgctagttactataacgtggttctgctcagataccagttctcccgcccaggccctcagtctgtgcccttgcaactgtctgcccactggcagtgcggggcaacccttactcaggttagcgtggaatatgggtaccggccaggcgcgactgccgtgcccacgcccttgacaaatgttcagatattactccctgttggggagcccgtgacaaatgtcaggcttcaacccgctgccacgtggaacctggaggaaaaacgccttacttggcgtctgccagatgtctcagaagccggcggttctggccgactgtccgcgtcttgggaacccctgtctgggccgtctacaccttcccctgtggccgcccagttcaccagcgaaggcaccactctctccggagttgacctggaactagtcggatcagggtatcgtatgagtctcgtgaagcgacgctttgctactggcatgtaccttgtctcctgctag

SEQ ID NO: 116930 - DNA, 2670 bp, Artificial Sequence
  Description of Artificial Sequence: Synthetic coding sequence
atgagctactttggggagcacttctggggggagaagaatcacggatttgaggtgctatatcatagtgttaaacaaggtcctatcagcaccaaagagcttgctgattttattagagagagagcaactatcgaggaaacatacagcaaggccatggccaaactgtccaagcttgctagtaacggcacacctatgggtacatttgctcctctttgggaggtatttcgggtgtcttcagataagctggcactctgccacttggagctcacccggaaactgcaggacctgattaaggatgtactacgctatggggaagagcaattgaaaacccacaaaaagtgtaaggaggaggtagtgagtactctggatgccgtccaagttctgtctggagtttcccagctgttgccaaagagccgtgagaactacctgaaccggtgcatggaccaagagagactgagacgcgagagcaccagccaaaaggaaatggataaggcagagaccaaaactaagaaagctgctgaaagtcttcggcgctccgtagaaaaatacaactccgcccgagctgactttgagcagaagatgctcgactctgcactacgtttccaggctatggaagagacgcacttacgacatatgaaagctctactggggagctacgcacacagtgtggaggacacccacgtgcagataggccaggtccatgaggagtttaagcagaacatagaaaacgtgagcgtcgagatgcttcttcgtaaattcgcagagtctaaggggacgggaagggaaaagcctggtcctctggacttcgaggcttactccgcagccgctctccaggaagctatgaaaagattaaggggagcaaaggcctttcggttaccaggtctgagtcggagggaaagagagcccgagcctcctgctgcagtggactttctcgagccagattccggaacatgcccggaggtcgatgaggaagggttcaccgtccggcctgacgtgacccagaactcaacggctgagccgagccgattctcctcttcagattctgatttcgatgacgaagaaccccggaagttttacgttcacattaaaccagccccagcacgcgcccctgcatgcagccccgaagccgccgctgcacagctgcgggcaaccgccgggtccttgattcttccgcccggcccgggaggcaccatgaaaagacattcttctcgggacgccgcagggaaaccccagagacctcggtcagccccacggacctcaagttgcgctgaacgcttacagtcagaggaacaagtaagtaaaaacctgttcggcccaccccttgaaagcgctttcgaccacgaagattttactggctcgagcagtctgggcttcacatcttccccctccccatttagctcttctagcccagagaatgtggaggatagtgggctggatagtccaagtcacgccgcacccgggccttccccagacagctgggtccctcgtccggggactccgcagtcacctccaagctgtcgggcccctccccccgaggctagaggtatacgagccccccctctgccagactcccctcaacccctagcctcctcaccggggccctggggactggaggccttagccgggggggacctcatgccagcaccagccgatccaacggccagagagggcctagctgccccgcctagacgcctacgctcccgcaaggtctcttgcccactgacccgaagcaatggcgacttgtcaaggagtctcagcccaagccctctcggctcaagcgctgcttccaccgcccttgaaagacccagctttctatcccagaccggccatggggtgtctcgagggccttcccctgtcgtcttggggtcgcaggacgccttgccaatcgccaccgcctttacagagtacgtgcatgcatactttcgcggtcattctccctcctgccttgcccgggtgaccggagaactcaccatgacctttccagcggggatcgtgagagtgtttagcggcactccccctcctccagtcctcagtttccggctcgtgcacactaccgcaatcgagcacttccagccgaacgcagacctgcttttttcagacccttcccagtccgatcccgagactaaagatttttggcttaacatggcagctctcactgaagccctgcagcgacaagctgaacagaaccctacagccagctactacaacgttgtcctgttacgctaccagttttcacgacccggtccccagtctgtaccgctccagctctctgcccattggcagtgtggtgcgactttgactcaggtgagtgtcgagtacggctatcgaccaggcgctactgcagttcctacaccacttacaaatgtgcagattctgctccctgtgggagaacctgtgacgaacgttcggttgcagccggcagctacttggaacctggaggaaaagaggttaacctggaggctgccggatgtcagcgaggcgggaggttctggaagattaagcgctagctgggaacctctgtctggcccttctaccccgtcccctgtggcggcccagtttacaagtgagggaacaacgctcagcggagttgatctagagctcgtcggctctggctaccgaatgtctctggtgaagcgccgctttgcaacagggatgtacctcgtttcctgctag

SEQ ID NO: 116931 - DNA, 1137 bp, Artificial Sequence
  Description of Artificial Sequence: Synthetic coding sequence
atggtcatggcatatttcgtagaaaatttttggggggaaaaaaactctggcttcgacgtgctgtatcacaatatgaagcatggccagattagtaccaaggagctagctgattttgtgcgcgaaagggcgactattgaggaagcgtatagccgcagcatgacaaaattggctaagtccgcctccaactactcccagttagggacttttgcacccgtatgggacgttttcaagacctcaacagaaaaactagctaattgccatctagatctggttcggaaactacaggagttgattaaagaggtacagaagtatggggaggagcaggtgaaatcgcacaagaaaacgaaagaagaggtggcagggacactcgaggcggtgcaaacaattcagagtataactcaagcgctgcagaaaagcaaagaaaattataacgcgaagtgcgtggagcaggagagattaaaaaaagaaggggcgactcagcgagagatcgaaaaagccgcagtgaagtctaagaaggccacggacacatataagctttatgtcgaaaagtatgctctggcaaaagccgacttcgagcagaagatgacagagaccgctcagaaattccaggacattgaggagacgcaccttatacacattaaggagataatcggatccctaagtaacgcaattaaggagatacatttgcagatcggccaagttcatgaggaattcataaataatatggcaaacacgaccgtggaatcactgattcaaaagttcgccgagagtaaaggaactggcaaggagcgccccggcctcatcgagtttgaggaatgtgataccgcttccgctgtggaaggtatcaagccccggaaacgaaagactttcgccttgccggggatcattaaaaaggaaaaagatgccgagtcggtgtggagctttaccgtggtggcccaggtgggcatgcaatggcgcgatctcggacttctacactcacccccacccagatttaagaggttttccagttatctttccttaccgagcagctggaactacggcgcacaccatcacatctggcttattttttgcattttcagcagagacagggttagcccatactggcccggttggtcgagaacccccgatttacgctag

SEQ ID NO: 116932 - DNA, 2433 bp, Artificial Sequence
  Description of Artificial Sequence: Synthetic coding sequence
atggttatggcgtacttcgtagagaatttctggggagaaaagaatagcggtttcgatgtcctttatcacaatatgaagcacggacaaatctctacaaaggaactggctgacttcgttcgcgaacgggctacaattgaggaggcttacagcagaagtatgaccaagctggcaaaatctgccagcaattattcccagttagggacctttgcaccggtctgggacgtgtttaaaaccagtacggaaaagctcgccaattgccatctcgacctggtgcggaaactgcaggagctcatcaaggaggtccaaaagtacggcgaagagcaggtgaagagccataaaaaaaccaaggaggaggtcgctggtactttagaagctgtgcaaactattcagtccatcacccaggcactgcagaagtctaaagaaaattataatgctaaatgcgttgaacaggagcgactgaagaaggagggggccacacagcgcgagatagaaaaggccgcagtgaagagcaagaaagcaaccgatacgtataaattgtacgtcgaaaaatacgcattggccaaggccgattttgagcagaagatgacagagaccgcccagaagttccaggacatcgaagaaacacaccttatccacattaaggaaataatcggaagcttatccaatgccataaaggagatccatctgcagattggtcaggtgcatgaggaattcatcaataacatggcgaataccacggtggaatcacttatccagaaatttgccgaatcaaaggggacaggcaaagaacgtccaggactgatcgaatttgaagagtgcgacacagcatcagcggtagaaggtattaagccccgtaaaaggaagactttcgcccttccggggatcatcaaaaaggagaaagatgccgaaagcgtggagtgccctgacgctgattcgctaaacatacctgacgttgacgaagaggggtacagcatcaaacccgaaactaatcaaaatgacactaaggaaaaccatttttactcctccagtgacagtgactctgaagacgaagaaccaaagaaataccggatcgagattaaacctatgcatccaaataactcccaccacaccatggccagtctggacgagctgaaggtctctattggtaacatcaccctctcgcccgccatcagtgtgtccaccaacacgagactgaacagaaatttcaacgatgaagagttgactaaaagcaagccctccgctcctcccaatgaaaaggggacctctgatttacttgcatgggatcctctctttggcccgtcactggattcttccagctcatcatccctgacatcctcatccagcgcacggcctactacacctctgagtgtcggaacaatcgtaccccccccccgtcccgcatctcgcccgaaactaacatctggaaaactgagcggcattaatgagatcccccggcccttctccccgccagtgacttccaacacaagccccccgccagccgccccactggccagagcagagtcttcgtccagcatatcaagttctgcctcccttagtgctgccaataccccaactgtaggcgtgtccagaggcccttctcccgtgagcctaggcaaccaggacaccctacctgtcgctgtggctctgacagaaagcgtcaacgcctattttaagggagccgaccccaccaagtgtatagtcaagatcacaggagacatgactatgtcctttccatcaggcatcattaaagtgttcacaagtaatcccacacccgcagtgctgtgttttcgagtgaagaatattagccggttggagcagatcctccccaacgcacagcttgtcttctcggatccatctcagtgtgattctaatacaaaggatttctggatgaacatgcaagccgtcaccgtttacttgaagaaattgtcagagcagaaccctgctgcgtcttactataatgtagatgtcctaaagtaccaggtctcctccaatgggatccagtctacacccctgaacctcgctacatattggaagtgctctgccagcacaacagatttgagagtggattacaagtataacccagaggcaatggtggctccatctgtgctttcaaatattcaggtggtggtgcccgtggacggaggcgtgacgaacatgcagagtttgccacctgccatctggaatgcagaacagatgaaagcattctggaagctcagtagcatctcagagaaaagcgagaatggcggaagcggttccctgcgtgcaaagttcgacctgagtgagggccccagtaaacccactacactcgcagttcagtttttatccgagggatccacattgtctggcgttgattttgagctggttggcactggttatcgcctgtcacttatcaaaaaacgttttgcaacgggaagatatctggcggattgttag

SEQ ID NO: 116933 - DNA, 2433 bp, Artificial Sequence
  Description of Artificial Sequence: Synthetic coding sequence
atggtaatggcatactttgtcgaaaatttctggggtgagaagaactctggatttgatgtcctctatcacaatatgaagcacggtcaaatatccacgaaggaactagctgatttcgtgagagaacgagccacaattgaagaagcctactcccgatccatgactaaactggctaagtcagcatccaattacagccagttggggacttttgctcctgtctgggatgtgttcaagaccagcacggagaaactcgcgaattgtcacctagacctggtgcgaaagttgcaggagctgatcaaagaagtccagaaatacggtgaggaacaagtcaagagccataagaagacaaaggaagaggtggctggaactcttgaggcggtacagaccattcagtccataacccaagcactgcagaagtctaaggagaattacaacgccaaatgcgtggagcaagagaggctcaagaaagagggggcgacacagcgtgaaatagaaaaagcagctgtgaagagcaagaaagccaccgatacttacaaactttacgtggagaaatacgccctggccaaggcggatttcgagcaaaaaatgaccgaaaccgcccagaaattccaggacattgaagaaacccacttgatccatatcaaggaaattatcggatctctcagcaacgctataaaggaaatccatctgcaaatcggtcaggtgcatgaggaatttataaacaacatggctaatactaccgtagaaagtttgatccagaagttcgcagaaagtaaaggcaccgggaaagagcgacccggcctaattgagttcgaagagtgcgataccgccagtgccgtcgaaggcatcaaaccgaggaagagaaaaacctttgcactgcccggaatcatcaaaaaagagaaagatgcggagagcgtggagtgcccagatgcagactccttaaacattcccgacgtcgacgaggagggatactctatcaagcctgaaaccaatcaaaatgatacgaaagagaatcacttctatagtagttctgattccgatagcgaggatgaggagccaaagaagtacaggatcgaaattaaacctatgcatcctaacaattcccatcatacaatggcaagtctggatgagctcaaggtgtcaatcggcaatattacgctgagtcccgctatctcccgccactcccccgtgcaaatgaaccgcaacttatctaatgaagagctgacaaagagtaagcccagtgccccgccaaacgaaaaaggcacatctgacctcttagcttgggatcctctgttcgggccctctctcgattcatcctcatcttccagtcttacatccagcagttccgcaaggccaaccactcccctgtccgtcggcacaattgtgcccccaccaagacctgcgtcccgtcccaagctgaccagcggaaagctttctggcataaatgaaatccccaggccattctcaccacccgttactagcaatacttcccccccgccagcagcaccattagcgcgcgctgaaagctcctctagcatcagcagctctgcatccctgagtgcagccaacactcctacagtgggggtgagccgggggccttccccggtttccttaggcaaccaggacacgttgcctgtggctgtggccctgacggagtctgtgaatgcgtacttcaaaggcgcagatcccacaaagtgcatcgtgaaaattacaggggatatgaccatgtcatttccatccggaattattaaagtgtttactagcaaccctacccccgccgttttgtgtttccgagtgaaaaacatctctcggttagaacagatcctgcctaatgcacagctagtgttctcagatccttctcagtgcgacagcaatacaaaagatttttggatgaacatgcaggcagttaccgtgtacttgaagaagctgtcggagcagaaccctgccgcgtcctactacaatgttgacgtgctgaaatatcaggtgagttctaacggtattcaaagtactcccctgaatctagccacttactggaagtgttcagcctccaccacagaccttcgcgttgattacaaatataatcctgaagctatggtggctcccagcgtgctgagcaacatacaggtcgtggtgccagtggacggcggggtgaccaacatgcagagcctccctccagccatttggaacgcggagcagatgaaagccttctggaaactctcttctatttcagagaaatcggagaatggaggcagcggcagtcttcgggcaaaatttgacctgagcgaagggccgagtaagcctacaacacttgccgtccagtttctaagcgagggatccaccctgagtggggtggacttcgagctggttgggactggttacagattatccctgatcaaaaagcgattcgctactggccggtacttagccgactgttag

SEQ ID NO: 116934 - DNA, 2334 bp, Artificial Sequence
  Description of Artificial Sequence: Synthetic coding sequence
atggtgatggcttacttcgtcgagaatttttggggtgaaaaaaattccggctttgacgtcctctatcataatatgaaacacggtcagatcagtacaaaagaactcgcagacttcgtccgcgagcgggcaactatcgaagaagcctactcgcgcagtatgacgaagctggccaaatcagcctccaactacagtcagttgggcacatttgctcctgtttgggacgtgtttaaaacaagcaccgagaaactggccaactgccaccttgacctggtgagaaaattacaggaacttatcaaggaagtgcagaaatatggggaggagcaggtgaaatcccacaaaaaaacaaaggaggaggttgcaggcacattggaggcagtacagaccattcagagcatcacccaggctttgcagaagtccaaggagaactataatgcaaaatgtgtggagcaggagcgtctaaaaaaggagggggccactcagcgggaaattgaaaaggccgctgtgaagagcaaaaaagccactgacacctacaagttatacgtagaaaagtatgcacttgctaaagccgactttgagcagaagatgacagaaactgcccaggttcatgaggaatttataaacaatatggccaataccacagttgagtctctgatacaaaagtttgcggaatccaaaggaacaggaaaggaacgtccaggcctaattgagtttgaagagtgtgatacagccagcgctgtggagggaattaagcctagaaaaaggaaaacattcgctctgcctggtattattaaaaaagagaaagacgcagagtctgtcgagtgtcctgacgcggattctctcaacatcccggatgtggacgaggaggggtatagcataaagcccgagacgaatcagaacgacaccaaggagaatcatttttactcctctagcgatagtgatagcgaggacgaggaaccgaaaaagtatagaatcgagatcaaaccgatgcatcctaacaacagccaccatacaatggcatctttggacgaattgaaagtgagcattgggaatattaccctcagccctgccatctcaagacattccccggtccaaatgaatagaaatctgagtaacgaagaactgacaaagtcaaagccctcagctcctcccaacgagaaaggcacttcagatctgttggcatgggatccactgttcggccccagccttgattccagcagttcatcctcccttacatcctctagtagcgctcgccctaccacccccttgagcgtgggcacgattgtgccaccccctcgtccagcgtctaggcccaagttgactagcggcaagttgagcggtataaatgagatccctagacccttcagccctcctgtcacgtctaacacctccccccccccagctgccccacttgctcgggcagaaagcagttcttccatcagctcaagcgccagcttgtccgccgcaaacacgccaacagtcggcgtttccagaggcccttcacccgtttcactggggaaccaggacacccttccagtggcagtggctctcactgagagtgtgaatgcctacttcaagggggccgatcctaccaagtgcattgtgaagatcacaggcgacatgacgatgagcttccctagtggcattatcaaagtgttcacaagcaaccccacaccagccgtactatgcttcagggtgaaaaatatctctaggttggagcagatcctgcctaacgcccagctggtattcagcgacccttctcaatgcgacagtaacactaaggatttctggatgaatatgcaggccgtgactgtgtacctgaagaagctgtccgagcaaaacccagctgcctcttattacaacgtggacgtgctcaagtaccaggtgagtagcaacggcatacagagcactcccctgaacctggccacatactggaagtgttcagcaagcacgacagacttacgagtagactacaaatataatcccgaggccatggtggctcccagcgttctgtccaatatccaggttgtcgtgcccgttgacggtggcgtgaccaacatgcaatcgctgcccccagccatctggaatgcagagcaaatgaaggccttctggaaattgtcttctatttcagaaaagtctgaaaatggcggcagcggcagcctccgcgccaagttcgatctcagcgagggaccttcaaaacctacgacgctcgcagtgcagttcctgagtgaggggtccacactttctggtgtagatttcgagctcgtcggtactggttaccggttaagcctgatcaagaaacgcttcgccacgggaaggtacctcgcagactgttag

SEQ ID NO: 116935 - DNA, 1668 bp, Artificial Sequence
  Description of Artificial Sequence: Synthetic coding sequence
atggcccggcctgacgacgaagagggtgccgctgtcgcccctgggcatcctctggctaaaggatacttaccgctccctcgcggagctcctgtgggcaaagagagcgtcgagctacagaacggaccaaaggctgggacattccccgtgaatggcgcacctcgcgactccctggcggccgcttctggggtcctaggcgggccacagactcccctggcgcccgaggaagaaacccaggccagactgctgccagctggtgccggcgctgaaacccctggggccgaatctagcccccttcccctgaccgcgttgtcaccccgtcggttcgtcgtcctcctgatcttttctctctacagcttggtgaatgcttttcagtggattcaatactcaatcatctctaatgtgttcgaaggattttatggggtcacactgctgcacatcgattggttgagtatggtttacatgctggcttatgtccccctcattttcccggcgacttggctcctggacaccagaggtttgagacttaccgctctgcttggcagtggcctgaattgcttaggcgcttggataaagtgcggttctgttcagcagcacctgttctgggtgaccatgcttggacagtgtctatgttctgtcgcccaggtctttattctcgggctaccctcacgcatagcatcagtttggttcggaccgaaagaggtatcaactgcctgtgccaccgcggtgctagggaaccaactggggacagcagtgggctttctgctgccacccgtactcgtgccaaacacccagaacgataccaatttactggcctgcaatatctccactatgttctacggcacttcagctgtagccacacttttgttcattctgacagccattgcattcaaagaaaagccccggtacccaccgtcccaagcacaggctgccctacaagacagtcccccagaggaatattcctataaaaaaagcattagaaacttgtttaagaatatcccctttgttctgctgctcattacgtatggcatcatgaccggagccttctactcggtgtctacgctgttgaaccagatgatcctcacctactacgagggagaagaggtgaatgcaggccgcataggactgacgttggtcgtcgcaggaatggtggggtctattctgtgcggtttgtggctggactacactaagacatataagcaaactacacttatcgtgtatattctatcatttattggtatggtgatcttcacatttacactggacctgaggtacatcattattgtctttgttacgggtggagtgcttggtttctttatgacaggctatcttccattaggctttgagttcgcagtcgaaataacctaccccgaatccgaagggacctcatctggacttcttaatgcctcagcccagatttttgggattctctttacgctagctcaggggaaactgaccagcgattacgggccaaaagcaggtaacatattcctgtgtgtgtggatgtttattggtattattctgactgctttgatcaaatctgacctacggcgtcacaatattaatatcggaatcacaaatgttgacgttaaagcaatccctgcggatagtccgacagatcaagaacccaaaacggttatgttgtccaagcagtctgagtccgctatatag

SEQ ID NO: 116936 - DNA, 2469 bp, Artificial Sequence
  Description of Artificial Sequence: Synthetic coding sequence
atgggctttggatcagacctcaaaaattcccacgaggcagttctgaaacttcaggactgggaactgcgcctgctggagactgtgaagaaattcatggcactccggataaagagcgacaaagaatacgcatcgactctgcaaaacttatgcaatcaggtcgataaggagagtacagttcagatgaactacgtgagtaatgtctcaaagtcatggctgttgatgatacagcagaccgagcagcttagtcgcatcatgaaaacccacgcagaagatctcaactctggaccgttgcacagacttactatgatgatcaaagataagcagcaggtgaagaagtcgtacataggtgtgcaccaacagatagaggctgagatgattaaggttacaaaaactgagctagaaaagctgaagtgcagttacaggcagctgattaaggaaatgaactcagctaaggaaaagtacaaggaggccctggcaaaggggaaagagacggaaaaggccaaggaaaggtacgataaagccactatgaagttgcacatgctgcacaatcagtacgtcctggctctgaagggtgctcaactccaccaaaaccagtactatgacatcactttgcccctcttgctggactctcttcaaaagatgcaggaggagatgataaaagctctcaaagggatcttcgacgagtattcacagatcacatccctcgttacggaggaaatcgtgaacgtgcataaggaaatccagatgtcagtggagcagattgatccatcaactgagtataacaacttcatagatgtccaccggactacggcggctaaagaacaggaaatcgagttcgatacctctcttttagaagagaatgagaacctgcaggccaatgagataatgtggaacaacctgaccgccgagtcactccaagttatgctgaagactctggcggaagagctgatgcagacacagcaaatgctgctgaacaaagaggaggctgttcttgagctcgagaagcgcattgaggagagtagcgagacttgtgaaaaaaagtccgatatagtgcttctgctgtcacagaagcaggccctagaggaactgaaacagtccgtgcagcagcttaggtgtacagaagcaaagttttcagcacagaaggaactgttggagcagaaggtgcaggaaaacgatggaaaagaacccccccccgttgttaattatgaagaggacgcccgatcggtcaccagcatggagcggaaagaacgacttagcaaattcgaaagtatcaggcactcaattgcgggcatcattaggagccccaaaagtgccctcggctcttccgcattgtcagacatgatttccatttctgaaaaaccactggcggagcaggactggtatcacggagccattcccaggatcgaggcgcaagagttacttaagaagcagggggactttctcgtgcgggagtctcacggcaaacccggggaatatgtcttgagcgtgtacagtgatggacagcgacgacactttatcattcaatacgtggacaatatgtacagatttgaaggtacggggttctcaaatattccccaactcatcgatcaccattacacaacaaaacaggtcatcaccaagaaaagtggcgttgtgctgctcaaccctatccccaaagataaaaaatggatcctgtcacatgaggatgttatcctgggtgagctgttgggaaaagggaatttcggtgaggtgtataaggggacgctcaaggacaagacaagcgtagccgtcaagacatgtaaggaagatcttcctcaagagctgaagattaagtttctacaggaggctaagatccttaagcagtatgatcatcctaacatcgtcaaactaattggcgtatgtactcagcgtcaacctgtatacattattatggagcttgtctctggcggggactttttgacattcttgagacggaagaaagatgaactgaaacttaagcagctggtgaagttcagcctggacgccgcagccggcatgctgtatctggaaagcaagaactgcatacatcgggacttagccgctcgcaactgtctggttggcgagaacaacgtgttaaagatcagtgatttcggcatgtctcgccaggaggacgggggagtttactcttctagcggccttaagcagatccccataaagtggacagcccccgaagcactcaactatggtcgatactcatctgagagtgacgtgtggtcttttggaatccttctctgggaaacgttttcactaggggtatgtccctaccccggcatgaccaaccagcaggctagggagcaagtggaacggggatacaggatgagcgcacctcagcactgtccggaagatatatctaaaatcatgatgaaatgttgggattacaagccagaaaatagacctaagttcagtgaactccagaaggagcttacaatcatcaagcgcaagcttacttag

SEQ ID NO: 116937 - DNA, 1944 bp, Artificial Sequence
  Description of Artificial Sequence: Synthetic coding sequence
atgaagctgcacatgctgcataatcaatatgtgctagccctgaagggagcccagttacatcagaaccaatattacgacatcactttgccactgctcctggacagcctgcagaaaatgcaggaggaaatgattaaagcccttaaagggatatttgatgagtactcccagataactagcttggttacggaagaaatagtgaacgtgcacaaagaaatccagatgtccgtggagcagattgatccatccacggagtataacaacttcattgatgtgcatcgcacaaccgctgctaaggaacaagagatcgagttcgacacctcactattagaagaaaatgagaatcttcaggctaatgagatcatgtggaacaatctgaccgctgaaagcttacaggttatgctgaagaccctggctgaggagctgatgcagactcagcaaatgttgctgaataaggaggaggccgtgctggagttagagaagaggattgaggaaagctcagagacatgtgagaaaaaatcagacattgtattactgctgtcacagaagcaggcactggaggaattaaagcagagtgtgcaacagctgcgctgtacagaagccaagttctccgcccagaaagaactcttagaacaaaaggtccaggaaaatgatggcaaagagcccccaccagtggtcaattatgaagaggacgccagaagtgtgacatctatggagaggaaagaacggctctcgaaattcgagagcatccgacattccatcgccggaataatccgctcaccaaaaagtgccctagggtcatcagccctctccgatatgatcagtatttccgagaagcctctcgcagaacaagactggtatcatggagcaatcccaagaatcgaggcgcaggaacttcttaaaaagcagggcgacttcctagtcagagaaagtcacggcaagcccggagagtatgtgctgtccgtgtacagcgatggccagaggaggcatttcatcattcagtatgtggataacatgtatagatttgagggaacgggcttttcaaatatccctcagctgattgatcaccactatacaactaagcaggtaattacaaaaaaatcaggcgttgttctcttgaatccaatccctaaggacaaaaagtggatcctgtcccatgaggatgtgattctgggcgagctactcggcaaaggaaattttggtgaggtgtataagggaacgcttaaggataagacaagtgtggccgtgaagacttgcaaggaagacctgccgcaggagctgaagattaaattccttcaggaggctaagattttaaaacagtacgatcaccctaacatcgtgaaactaatcggggtctgcactcagcggcagcctgtgtacatcatcatggaactggtctctggcggtgattttctgacgttcttgcgtcgaaagaaggacgaattaaagctgaagcagctggtaaagttctctctggacgctgccgcaggcatgctctatctggagtctaaaaattgcatccatagggacttggcggccagaaattgcctggtgggagagaataacgtcctcaaaatctccgatttcggaatgagccggcaagaagatggcggggtatactcatctagtggtctaaaacagatacctatcaagtggacagcccctgaggcactgaattacggtaggtatagtagcgagtccgacgtgtggtccttcggtatcctgctgtgggagacctttagcttgggggtttgcccatacccgggtatgaccaaccagcaggcaagagaacaagtggagagggggtaccgcatgagcgcgccccagcattgccccgaggacataagcaagattatgatgaagtgctgggactacaagcctgagaatcgacccaagttctcggagttgcagaaggagctgactattattaaacgcaagctcacgtag

SEQ ID NO: 116938 - DNA, 981 bp, Artificial Sequence
  Description of Artificial Sequence: Synthetic coding sequence
atgggcttcggctccgacctaaagaacagccatgaagccgtcttgaagttgcaggactgggaactgcggctcctagaaacggtgaaaaagtttatggcactgaggataaagtccgacaaggaatacgccagcacgctgcagaacctgtgtaaccaggtggataaagagagcacggtgcagatgaactacgtctctaatgttagtaagtcatggctgctgatgatacagcaaacagagcagctgagccggatcatgaaaacccacgccgaggatctgaactcgggtccactgcataggctgaccatgatgatcaaggataagcaacaggtgaagaagtcatacatcggagtgcatcagcagatcgaagctgagatgattaaagtgactaaaaccgaactggaaaaactgaagtgtagctaccgccaactgatcaaggagatgaatagtgccaaagagaagtataaggaggccctggccaaaggcaaggagacggaaaaagcaaaggaaaggtatgacaaggctactatgaagctgcatatgctgcacaatcagtacgtcctcgccctgaagggcgcccaactgcaccagaaccagtattacgatataactctgcctttattattggatagcctgcagaagatgcaggaggagatgatcaaggccctgaagggcatcttcgacgagtatagccagatcacctccctggtcaccgaggagattgtgaacgtgcacaaagagattcagatgagcgtggaacagatagatccaagcactgaatataacaatttcatagacgtgcatcggaccacagcagctaaggaacaggaaatcgaattcgacaccagcctgctggaggagaacgagaatctccaggcaaacgagattatgtggaacaacctcacagcggaaagcttacaggtaatgaaagagcgccgggggtatcctaatttaaacttattcgttatacagttactggagtag

SEQ ID NO: 116939 - DNA, 3855 bp, Artificial Sequence
  Description of Artificial Sequence: Synthetic coding sequence
atgcacgtgtttatcgtgggaatgtcgttgagttctgtgacgttggccagcgcattgcaggtgagaggagaggcactgtccgaggaggagatatggagtctcctgttcctcgcggcagaacagctccttgaggacctgcggaatgactcgtctgattatgtggtctgcccttggtctgctctgctctcggcagcggggtcactgtctttccagggccgcgtgtctcatattgaggctgccccgtttaaggccccggaactcttgcaggggcagtccgaagatgaacagcccgacgcgtcccagccactgcagctgtgcgagccactccattcaatcctgttgaccatgtgcgaggatcagccacacagacgttgtacgctacagtctgtgctggaagcgtgtagagttcatgagaaagaagtgtctgtgtaccctgcaccagcaggtctgcacattcgccgcctagtgggcttagtgcttggaaccatctcagaggtcgaaaaaagggtggttgaagagtctagctcggttcagcagaaccgcagttacctgctcagaaaacgcttgcggggaactagctcagagtcacctgctgcccaagccccggagtgcctccatccctgccgcgtgtctgagcgaagtacagagacccaatcatctcccgaaccacattggtccacacttacccacagccattgctcgttgctggttaacagggcactgccaggcgcagatccccaggaccagcaagctgggcgtcgcctcagctctggctcggtgcactcagcggccgactctagttggccaacaacaccaagccaaagaggattcctccagcggagatcaaagttttcaagacccgaattcattctcttggccggggaggccccaatgaccctgcatcttcctggaagcgtggtaacgaaaaaaggcaaatcatatcttgctctgagagatctgtgcgttgttctgctgaacggccagcacctggaggtcaaatgcgacgtggagtccaccgttggagctgtttttaacgccgtgacttcatttgccaatctggaggaattgacctactttggactggcctatatgaagtcgaaagagttcttcttcctggactccgagacgagactctgtaaaattgcacccgaagggtggcgcgagcagccacagaagacatctatgaacacattcacactctttctgagaatcaaattttttgtgtcccattatggactgctccaacattctctcactcgtcatcagttttatttacagcttcgcaaagatatcctggaagagagactgtactgcaatgaagagattttgcttcagctgggagtgctagctctgcaggcagagttcgggaattatcctaaggaagtggaaagcaaaccatatttccacgttgaggattatatcccagcctcgctcattgagcggatgactgctctgagggttcaagttgaggtcagcgagatgcaccgcctgtcaagcgcactctggggcgaggatgccgagctgaaattcctgagggtcacacagcagcttcccgaatacggcgtcctcgtacaccaggttttctctgaaaaaagaaggcctgaggaggaaatggctctcggcatatgtgctaagggagtcatcgtgtacgaggtgaagaacaactctcggattgccatgctgcgattccagtggagggaaactggtaagatatcaacgtaccagaaaaaatttacaattactagctcggttaccggcaaaaaacacacattcgtgacagactccgccaagacaagcaaatatcttttggacttgtgctcagctcagcacggatttaacgcccagatggggtccgggcagcccagccacgtgctgtttgaccatgacaagttcgtacaaatggccaacctatccccagcccaccaggcaagatcgaaacctctcatttggatacagcgcctatcttgctcagagaacgagttgtttgtcagtcgtctgcagggggccgctggtgggttgctgtcaacaagtatggataacttcaacgtcgacggttccaaggaggcaggcgccgaagggattggacgtagtccatgtactggaagagagcagctgaaaagcgcttgtgtgattcagaagccaatgacatgggacagcctgtctggaccaccggtgcaatccatgcatgccgggtcaaaaaacaatcgacgtaagtccttcatcgcagagcccgggagggaaatcgtgcgtgttactctgaagcgcgacccgcatcggggcttcggattcgtcataaacgagggtgaatatagtggacaagcagacccaggaatttttatttccagtatcatcccaggtgggcccgcagaaaaggcaaaaacgattaaacccgggggacagattttagctcttaatcacatctctctggagggctttacattcaacatggctgtccgcatgatccagaattctccggataatatcgagcttataattagtcagtcaaaaggagttggaggcaacaatccagacgaagagaagaactcgaccgctaattcaggcgtgagctccactgatatactgtcttttggctaccaaggcagtcttctgagccatacacaggaccaggacaggaataccgaggaactggatatggctggggtccagtctttggtgccgcggcttagacatcagttgtcctttctgcctttaaagggggctggatccagctgcccaccctcaccacctgaaatctcagctggggagatatatttcgtggaacttgtcaaagaggacggtacccttggcttttctgtgacgggggggataaatacttctgtcccctacggtggaatttacgtcaaaagcatagtgcctggaggtcccgccgccaaggagggccagattctacagggagaccggctgctccaggtggatggcgtgatattatgcggcctgactcataagcaggcagttcaatgcctgacaggtcccggacaggtcgcaagattagtcctcgaaagacgcgtgcctcgtagtacacagcagtgtccctcagcaaacgattcgatgggggatgaaagaaccgctgtcagtctcgtcaccgccctgcccggccggccctcctcctgcgtgtccgtaaccgacgggcctaagtttgaggtgaaactcaaaaaaaacgccaacggtctgggtttctctttcgtgcaaatggagaaagaaagttgttcgcacctgaagagcgacctggtgcggattaaacgtctgtttcctggtcagccagccgaagaaaacggagcaatagccgcaggcgatataattcttgctgttaatggaaggtcaaccgaagggctgattttccaagaagtgctccacctactgagaggggcaccacaggaggtaacattgctgctgtgtcgccccccgcctggagctctgccagaattagaacaggaatggcagaccccagagttaagtgccgacaaggagtttacacgggccacgtgcaccgactcctgtacttcacccatactcgaccaggaagacagctggcgggatagcgcgtccccagatgcgggagaggggctgggattacgccctgaatccagccagaaggccatacgggaagcacagtggggacagaaccgcgagcgtccatgggcatccagtttaacgcattcgccagagagccatcctcatctgtgcaaactccatcaggaacgggatgagagcactctggcaacatctttagagaaggacgtgcggcaaaattgttacagcgtgtgcgatataatgcgtctgggcagatactccttcagcagtcccctaacaagactgagcactgatatcttttag

SEQ ID NO: 116940 - DNA, 3930 bp, Artificial Sequence
  Description of Artificial Sequence: Synthetic coding sequence
atgcaacccttgactaaagacgccggcatgtcactttcttctgtgacgttggcctccgccttgcaggtgaggggagaggccctgagtgaggaggagatttggagtcttctgtttctggctgccgaacagcttttggaggatctgagaaatgatagtagcgactacgtagtctgcccttggtcagctttactaagcgccgccgggtcattgtcattccaggggcgcgtcagtcacatcgaggctgcccctttcaaagcccccgagttgctgcaagggcaatccgaggacgaacagcccgatgccagtcagatgcacgtgtactccctcggcatgacactgtactggagcgcaggattccacgtacccccacatcaaccccttcagctgtgcgaaccattgcattctatacttttgacgatgtgtgaagaccagccacacagaaggtgcactctgcaaagcgtgctggaagcttgccgcgtacacgagaaggaagtgagcgtctatccagcacccgccgggctgcatattcgcagattggttgggctggttctcggaacaatctccgaagtggagaaacgagtggtcgaggagagtagctctgtccagcagaataggagttaccttttgagaaagaggttaagaggaacttccagcgagtcccctgccgcccaagcaccagaatgtctgcatccgtgcagggtcagcgaaaggagcactgaaacacagagcagccctgaacctcactggtcgaccttaacacattcccattgttccttacttgtaaacagggcgctccccggcgccgacccacaggatcagcaggccggccgcaggctctcctctggttcagttcattctgccgcagactcctcatggcctacaacccccagccagcggggctttctgcagagaaggagcaaattttcccggcccgagttcattttacttgcgggtgaagctcccatgaccttgcatttacccggtagcgtggtcacaaagaagggaaagagctacctggccctcagagatctgtgcgtcgtgcttttgaacggtcaacatcttgaggtaaagtgcgacgtggaatccaccgttggtgccgtatttaatgctgtgactagctttgccaatctggaggagcttacctactttggtttagcttatatgaagtcaaaggaattctttttcctggacagcgaaaccagactgtgcaaaatcgctccagagggatggagagaacagccccagaaaacttcaatgaatacctttactctgttcctgcggatcaagttcttcgttagccactacggccttctgcagcattcgcttacccgccatcagttttacctgcagctgcgtaaggacattctcgaagagagattgtattgtaacgaagaaattctgctacagctcggagttctggccctccaggccgagtttggaaactacccaaaagaacaggtcgaaagtaaaccctatttccatgttgaggactacatcccagcctctctgattgagcgcatgaccgccttgagagtgcaagtggaagtttccgaaatgcaccgcctgtcttcagccctttggggggaagatgcagaactgaagtttctgagagtgacacagcagctgcccgaatacggggtgctggtgcaccaggtgtttagcgaaaagcgtagacccgaggaggaaatggctttaggaatttgcgccaaaggggtgatcgtctacgaggtgaaaaacaatagcagaatcgcgatgttaagattccaatggcgggagactgggaagatttcaacctaccagaaaaaattcacaataacgtctagcgtcacgggcaagaagcacaccttcgtgactgacagcgctaaaacgtctaagtacctgctagacctctgctccgcccagcacgggttcaacgcccaaatgggatctggccagccttctcacgttctcttcgaccatgacaagttcgtgcaaatggctaatttaagccccgcacatcaggctaggagcaaaccgttaatctggattcagcggctgtcctgctccgagaatgaactgttcgtatccagactccagggagcagcaggcggcctgcttagcactagcatggacaactttaacgtcgacgggtccaaggaggcgggtgcagagggaatagggcggagcccctgcacaggaagggagcagctgaagagcgcttgtgtcatccagaagcccatgacctgggactctctgagcggtccaccagtacaaagcatgcacgccggttccaagaataacagaagaaaatctttcatcgccgaaccaggcagggaaatcgtcagagtgaccctcaaaagagacccccaccggggatttggctttgtgatcaacgaaggggagtacagtggccaggccgatccaggtatattcatttctagcattatcccgggtgggccagctgagaaggccaaaaccataaagcccggcgggcaaatactggccttgaatcacatctctctggagggttttacattcaatatggccgtgcgcatgattcagaactcgcctgataacatagagctgattatcagccaatctaagggtgtaggaggcaacaacccagacgaagaaaagaatagcacagctaattccggagtgtctagtacagacattctgagcttcggttatcaaggcagtctcctgtctcacactcaggaccaggataggaatactgaagagctcgatatggcaggtgtgcagagcctggtacctcgattgcggcaccaactcagttttctgccccttaaaggcgctggctcatcatgcccccctagtccacccgagatctccgctggagaaatctatttcgtcgaactggtaaaagaagacggcacactcggtttctccgtcactggcggcatcaatacctccgtgccatacggtggaatctacgtgaaatctatcgtgccgggggggcccgccgctaaggaaggtcagatcctacagggagacagattactgcaagtcgacggtgtaatactctgcggtctgactcataaacaggccgtgcagtgccttacaggtcctggtcaggtcgctagactggttctcgaacgcagagtcccaagatccacacaacagtgtccctctgccaacgattccatgggagacgaacgaacagccgtgagcctggtcaccgctctgcccggcagaccaagttcatgcgtgtccgtcacggacggacctaagtttgaggtaaagctcaagaagaatgcaaatggactgggatttagcttcgtccaaatggaaaaagagtcatgcagtcacttgaagagcgaccttgtgcggataaaaagacttttccccggacagcccgcagaggaaaacggtgcaattgcagcgggggatatcattttggcagtgaacggaaggtcaactgaaggactgattttccaagaggtcctgcacctgttacgcggggctcctcaggaagtgactctgttactgtgcagaccaccccccggagccctccctgaacttgaacaggagtggcagactccagagctttccgctgacaaggaatttacacgggccacatgcaccgactcctgtacttcacccattttggaccaagaggacagctggcgggacagcgccagtcctgacgccggcgagggcctaggcctgcggcccgaatcaagtcaaaaagccattcgggaagcccagtggggccagaaccgtgagcgaccttgggcatccagtctgacccattcccccgaatctcatccacatctgtgcaaattgcaccaggagagggacgaatcaaccctggccacctctctcgaaaaggatgtgaggcagaactgctattccgtgtgtgacatcatgcgattaggcagatactcattcagtagccctctcacaagactgagtacagatatcttttag

SEQ ID NO: 116941 - DNA, 3834 bp, Artificial Sequence
  Description of Artificial Sequence: Synthetic coding sequence
atgagcttaagctccgtgacactggcctccgctttgcaggttcgcggggaggctctgagtgaggaagagatttggtctctgctgtttttggctgcagagcagctgttggaggatctccgaaatgatagctccgactatgttgtgtgcccctggtccgctctcctctcagctgccggctccctctcctttcagggacgggtgtctcacatcgaggctgcccctttcaaagcccccgaactcctccagggacagtcggaagacgaacagcccgatgctagtcagccactgcagctttgtgagccgctgcatagcattctcctgacaatgtgtgaggatcaacctcatagacgttgcactttacagagtgttctggaggcttgccgcgttcacgagaaagaagtctctgtttacccagctccagccggcctgcacattcgtcgtctcgtcggactcgtgctcggcaccatttctgaggtagagaaaagggtggtcgaagaaagcagctctgtgcagcagaacaggtcttacctccttcgaaaacggctgcgggggacgagttctgaaagtcccgctgctcaggccccagagtgcctgcatccatgcagggtatctgagcggtcaaccgaaacacagtcctcgccagagccgcattggagcactttgacacacagccactgcagcctgctcgtgaaccgggccctccccggggcggatcctcaagaccagcaggcaggcaggcgtctcagcagcggttcggtgcactctgcagctgacagcagctggcccaccacacctagccagcggggctttctgcagcggcgatctaagttcagtcgccctgaatttatcctgctcgctggtgaagctccaatgaccctgcacttgcccgggtcagttgttacaaaaaagggtaaaagctatttagcgcttcgcgatctgtgcgttgtattgctcaatggacagcatctcgaggtaaagtgtgacgtagagtccactgtgggagcagtcttcaacgctgtaacatccttcgccaatctcgaggagttaacttatttcggtctggcatacatgaaatctaaggaatttttttttttggattctgaaacgagactctgtaaaattgcacccgaggggtggcgcgagcagccacagaaaacctccatgaacaccttcacgctattcctgcgcattaagttcttcgtgtctcattacggtcttctccagcatagccttacacggcaccagttctacctgcagctgcggaaggacatcctcgaagagagactgtactgcaacgaggagattctcttacagctcggcgtgctggcactgcaggctgagttcggaaactatcctaaggaggttgagtccaaaccatatttccacgttgaggactacatcccggcaagtctgatcgagcggatgacggccctgcgggttcaggtcgaggtgtctgaaatgcaccgtctgagcagtgccctgtggggggaggatgccgaattaaaattcttgcgggtgacccagcagctgccagaatacggagtgctggtgcaccaggtcttttctgaaaaaaggcgtcctgaagaagagatggccctgggcatttgcgctaagggagtgatcgtgtacgaggtgaagaacaactctagaattgccatgttgaggtttcaatggcgcgagaccgggaagattagcacttaccagaagaaatttacaattacaagctcagttactggaaaaaagcataccttcgtaacagactcggccaagacatcgaagtacctgctggacttgtgttccgctcagcatggctttaacgcacagatgggttccggccagccatcgcacgtcttgtttgatcacgataagttcgtgcagatggccaatctatcaccagcccatcaggctaggtccaagcccctgatttggattcagcggttgagttgttctgagaatgaactgtttgtgtctcggcttcagggtgctgcgggcggcctcctgagcacatccatggacaacttcaacgtcgatggaagtaaagaggcaggcgccgaggggattggaagatccccttgcacgggcagggaacagctgaaatccgcttgtgttatccaaaaaccgatgacctgggattccctttcagggccacccgtacaatccatgcacgccggaagcaagaacaaccgacggaagagctttatcgcagagccaggacgggaaattgtaagagtaaccctgaagagagatccacacagagggtttgggttcgtcatcaacgaaggcgagtactcaggacaagccgaccccggaatctttatcagtagtatcattccggggggaccggctgaaaaagccaaaactatcaagcccggcggacagatactcgctctgaatcatatctcactggaagggttcacattcaacatggccgttaggatgatccagaattcccctgacaacattgaactcatcatatcccagtccaagggagtgggaggtaacaaccctgatgaggaaaaaaattcaacggcgaacagcggcgtaagctctactgatatcttgtcattcggctaccagggttctttactctcacatacccaagatcaggacaggaatacagaagagctggatatggctggcgttcagtctttggtgccacgcctcagacaccagctttcatttctgcccttgaaaggtgctggcagtagctgtccaccaagtcccccagagatctctgccggcgaaatctatttcgttgagctggtgaaagaggatggaactttaggattcagcgtaaccggggggatcaacacctccgtgccttacgggggaatttacgttaaatccatcgtgccgggaggccccgctgccaaagagggccaaatccttcagggagatcgccttctgcaggtggacggcgtcatcctgtgcggacttactcacaaacaggctgtgcaatgtctgaccggccctggacaggtggctaggctggtgttggagagaagagtccccagatcgacgcagcaatgcccctccgctaatgacagtatgggcgatgagaggaccgctgtttctcttgtgaccgctctgcccggaaggccctcctcttgtgtgtcggtaaccgacggtcccaagtttgaagtgaaactcaaaaagaatgcaaatggtctgggattcagctttgtccagatggagaaagaatcctgctctcaccttaaaagtgatctggtgcgcatcaaaaggctgtttcctggccaaccagccgaggaaaacggtgcgattgccgcaggagatattattctggcagttaacggcagatccaccgaaggcttaattttccaggaagtgttgcatttgcttaggggtgcaccccaggaggtgacccttctcctgtgtcggcctcccccaggggcattgcctgaattagagcaggagtggcagactcctgaactgagtgctgataaggagtttactagagctacatgtacagattcttgcacttctcctatcctggatcaggaggatagttggagggacagcgctagcccagatgcgggcgaggggttgggcttgcggcctgagtcttcgcagaaggcaatcagagaggcccagtggggacaaaatagagaacggccctgggcaagctccctgacacactccccagagtcccacccacacctgtgtaaactgcatcaagagagagacgagtcaactttggccacgagcctggaaaaggacgtccgacaaaactgttattcagtttgtgatatcatgcggcttggccgttacagtttcagtagccccttgacgaggctcagcaccgatattttttag

SEQ ID NO: 116942 - DNA, 786 bp, Artificial Sequence
  Description of Artificial Sequence: Synthetic coding sequence
atgggtgatgaacggacagctgtgtcccttgtcacagcgcttcccggtcgtccatctagctgtgtttcagttacagacggcccgaaattcgaggtgaagctgaagaaaaacgccaacggattgggcttttctttcgttcagatggagaaggagagctgtagtcacctaaaatcagatcttgttcggataaaacggttattccccggacagccagcggaggagaatggcgccattgccgccggtgatattatcctagctgtgaatgggagaagcactgagggcctgatttttcaggaggtcctccacctgctgagaggggcccctcaggaagtgaccctgttgctgtgcagacccccgcccggggcactgccagaactggagcaggagtggcagactcctgaactcagcgcagataaagagtttacacgggctacttgcacggattcgtgtacatctcccatccttgaccaggaggatagctggagagatagtgccagcccggatgcgggagaggggctagggttgcgccctgagtcgtctcaaaaggccattagagaggcccagtgggggcagaaccgggaacgaccatgggccagcagcctgacccactctccagagtcccaccctcacctatgcaaactgcatcaagaaagagacgagtcaactctcgccactagcctggagaaggatgtacgtcagaattgctatagcgtgtgtgacataatgcggcttgggcggtattcatttagctctcccttgactcggctctctactgacatcttctag

SEQ ID NO: 116943 - DNA, 3936 bp, Artificial Sequence
  Description of Artificial Sequence: Synthetic coding sequence
ttctcatcgcaccggaccaagagctctggatggcccccaccctccggcacatggggtctttcccaggtgcccccctatgggtgggagatgaccgcgaatagggatgggagagactactttattaatcatatgacccaggcaattccttttgacgatcctcgactggaatcgtgtcaaatcatcccgccagcgccgagaaaggtcgagatgcggagggatcccgttttgggatttggattcgtggctgggtctgagaagccggtcgtagtgcgctcggtgactcctggcggtccctccgaaggaaagctaatccctggtgaccagattgtgatgataaatgatgagcctgtgtctgcagccccacgagagcgtgtaatagacctagtgcgaagctgtaaggaaagcattttgctcaccgtaatccagccctacccgtcacccaaaagcgccttcataagcgcagcaaaaaaggccagacttaaatctaaccctgtaaaggttcggtttagtgaggaggtgatcatcaatgggcaagtttccgagacggtgaaagataactcgctcttattcatgcccaacgttctgaaggtgtacctagaaaacggccagacaaagagtttcaggtttgactgctccacctcaatcaaagacgtgattctgacattacaagagaagctcagtatcaagggaattgagcatttctctctcatgctcgagcagcgcacagagggggctgggactaagctgctcttactgcacgagcaagagacactgacacaggtcacccagagaccctctagccacaagatgagatgtctctttcgcatttcatttgtgccaaaggatccgattgacctgctgcgccgggatcccgtggcctttgagtatctctacgttcagtcctgcaatgacgtggtgcaagagagatttggccccgagctaaagtatgatatcgcactgcgcctggccgctctgcaaatgtacattgccacggtgacaacaaagcagacacagaagatttccttaaagtatatcgagaaggagtggggcctcgaaacatttctgccctcagccgtactccagtcaatgaaggagaagaacattaagaaagccctgagccacctagtgaaggccaatcagaacctcgtgcctcctgggaaaaagttatccgccctccaggcaaaggtccattatctcaagtttctgtcagatctgaggctgtacggcggtcgcgtgttcaaagcaacactggtgcaggcggagaaacggtcagaggttacgctgctcgtcggccctagatacggcatttcccacgtcatcaatacaaaaacaaacctggtggccctgctggctgatttctctcatgtgaataggatcgagatgtttagcgaagaagaaagtctggtgcgagttgagctccatgtactggacgtaaagcctatcacattgctgatggaatcgagcgatgcgatgaatctggcttgcctgacagctgggtattaccggctgctagttgattccaggagatccatctttaacatggcaaacaagaagaacacggctactcaggagacaggccccgagaacaagggaaagcacaatctcttaggcccggactggaactgtatcccccagatgaccacgtttatcggcgaaggggaacaggaggcacagattacctacatcgatagcaagcagaagactgtggaaatcactgactccacaatgtgtcccaaggagcaccgccatctatatattgataatgcctatagctctgatggactgaaccaacagctctcccagcccggtgaggcgccttgcgaggcggactaccggtccttagcccaacggtcgctgctgacactgagcggacctgagaccttaaaaaaggctcaggagtctccccgaggtgcaaaggtcagttttatctttggggattttgcattagacgatggcatttctcctcctaccctgggatacgagacattgcttgacgaaggccccgaaatgctcgaaaaacagcgcaatctctatattggcagcgccaacgatatgaaaggcttggacttgacgcctgaggcagaggggattcagtttgtggagaatagcgtatatgccaacatcggagacgtgaagtccttccaggctgccgagggcatcgaggagcccttgcttcatgacatctgttatgctgagaacactgacgacgctgaggatgaagatgaagtaagctgcgaggaggacctggtcgtcggagagatgaatcagccagcaatcctgaatctctcaggttcatcagatgacataattgacctgacctccctgcctccacccgaaggggacgataacgaggacgatttcttgttaaggtctctgaatatggccatcgccgctcccccacccggatttcgggattcctccgatgaagaggacagccaatcccaggcggcatcctttccagaggacaaggagaagggatcctcactacagaatgatgagatcccggtgagccttattgacgccgtgccgacctctgccgagggcaaatgcgagaagggtttagataacgctgtcgtctcaaccctaggcgcgttggaggcattatcggtgtccgaggaacagcaaacctccgataattccggagtcgctatccttcgagcctactcacccgaatcgtcctctgatagcggcaacgaaactaactccagcgaaatgactgaaagttctgaactggcgaccgcccagaagcagagtgaaaacctgagcagaatgtttttggccacacacgaaggctatcacccattggccgaggaacagaccgagtttcccgcatccaagactccggctggcggcctgccaccaaagagtagccatgccctcgcggcgagacctgcaacagacctgccccccaaggtcgtgccaagtaagcagttattacactcggaccacatggagatggaaccagaaactatggagaccaagagcgtcaccgactatttttccaagctccatatgggcagtgtggcctattcttgtacgtcgaaaaggaagtccaagttggccgacggagaagggaaagccccccctaacggaaacacgactggcaagaagcagcaagggaccaaaaccgctgaaatggaggaagaagcatctggaaagttcggtaccgtgagttcacgtgactcacagcacctcagtacattcaacctggaaaggacggctttccgcaaggattctcagaggtggtacgtggctacggagggtgggatggctgagaagtccggtctagaggccgctaccggaaagacctttccacgggcatcgggcctgggcgcgagggaggctgaaggcaaggaagagggagccccagatggcgaaacctcagatggctcaggtttgggccaaggtgatagattcctcacagacgttacttgcgcctcttctgctaaagatcttgataatcctgaagatgccgactcctcaacctgtgaccatccctccaaacttcctgaggccgatgaatctgtagcacggctgtgcgattaccatctcgccaagaggatgagttctttgcaaagcgagggccacttctcattgcagtcctctcaagggtcctccgtggatgcaggttgtgggaccggtagcagcgggtcagcatgcgcgacacccgtagagtcaccactgtgcccttcgcttggtaaacatctgattcctgacgcaagtggaaagggcgtcaactacatcccttctgaggagcgagctcctggactgcctaatcatggtgcaacctttaaagagttacatccacagacagaagggatgtgccctcgaatgacagttcctgctttgcataccgccatcaacactgagccactgtttggaactctccgggacggatgccatcgcctcccaaaaattaaagagaccaccgtgtag

SEQ ID NO: 116944 - DNA, 3969 bp, Artificial Sequence
  Description of Artificial Sequence: Synthetic coding sequence
atggacgtgttcagcttcgtcaaaatcgctaagctgtcctctcacagaactaaatcttctggatggcctcccccatctggtacgtggggtctgtctcaagtgccaccctacgggtgggagatgacagccaacagggatggaagagactattttatcaaccacatgacacaggccatccccttcgacgatcctcgcctggagtcatgccagatcattcctccggctccaagaaaagtggagatgcgccgagaccctgtgcttgggtttgggttcgtggcaggatccgagaagcccgtggtagtacggtctgtgacgccgggggggccgtccgagggaaagctcattcccggcgaccagatcgtaatgattaatgacgagccagtcagcgcggcccccagggagagggtgattgacttggtccggtcatgtaaggaaagtatcctgcttacggtaatccagccctatccgtcccctaaatcagcatttatcagcgctgccaagaaggcccggctgaaatccaacccagtaaaggtgaggttctcagaggaagtcattattaacggtcaggtgagtgagaccgtgaaggataacagccttctctttatgccgaacgttttgaaggtctaccttgagaatgggcagaccaaatcatttcgttttgattgcagtacatcaatcaaagatgtgattctgacattgcaggagaagttatccataaaagggatcgagcacttcagcctcatgctggagcagcgaacagaaggggctggtaccaaattactgctcttacacgagcaggagacacttacacaggtgacccagcgcccttcttctcataagatgcgatgtctgtttaggattagttttgtccctaaggatcctattgacctcctgcgccgggatcctgtcgctttcgagtacctgtacgtccagagctgcaacgacgtcgtgcaagagaggtttggtcccgaacttaagtatgacattgccctgaggttggccgcattacagatgtacatcgctactgtcaccaccaagcagacccaaaagatctccctgaaatacatagagaaggagtggggtctggaaaccttcctaccctctgccgtgttgcaatcaatgaaagagaaaaatatcaagaaggcgttgtctcacctcgtgaaagcgaaccagaacctggtcccacctggtaaaaagctcagtgctctgcaggctaaagtgcactatttgaagtttctttcagatttgcggctgtatggggggcgggtgtttaaagcaacactggttcaggccgagaagcgttccgaggtcacgttgctcgtgggccctagatatggaattagccatgttataaataccaaaacaaacctcgtcgcgctgctggccgactttagccacgtgaataggattgagatgttttcagaggaagaaagtttagtgagagtcgaattgcatgtgctcgacgtgaagcccattacactgctgatggaaagctctgatgctatgaacctggcatgcctaaccgcgggatattatagactcctagtagacagtagacgctctatctttaatatggccaacaaaaaaaatacggcaacccaggaaacggggcctgagaataaaggaaaacacaacctgcttggaccagactggaactgcatcccacagatgaccacctttatcggagagggcgaacaggaagcccagattacatacattgatagtaagcagaagaccgtcgagattacggactctaccatgtgtccaaaggaacaccgccacctctacatcgataacgcctactcttccgacggacttaaccagcagctgagtcagcccggcgaagcaccatgtgaggccgactatcggtccctcgcccaacggagcctgttgaccttatctggtccagaaacactgaagaaagctcaggagtctccgagaggcgcaaaagtctctttcatcttcggagattttgcactcgatgatggaatcagtccgcccaccctgggctatgagactttgcttgacgaaggaccagagatgcttgagaagcagcggaatctgtatatcgggtctgccaatgacatgaaagggttggatctcactcccgaggccgaaggtatccagtttgtggagaacagtgtgtatgcgaatattggagacgtgaaaagctttcaagccgccgagggtattgaagagcctttgcttcatgacatatgctacgctgagaacaccgacgacgccgaggacgaggacgaagtatcttgtgaggaagacctggttgttggagaaatgaaccagcctgccattctgaatctgagcggctctagtgacgacatcatcgaccttacctccctgcctccacctgaaggggacgataatgaggatgatttcctcctgaggagtcttaatatggcaattgccgcgccccctcccggatttagagacagcagtgatgaggaggactcacagtcccaggctgcctcgttccccgaggataaggagaaggggagctccttgcagaacgacgaaatacctgttagtctgatcgatgctgtgccaacctccgccgagggaaaatgcgaaaaaggtctggataatgccgtggtatccaccttgggggctttggaggcactgagtgtgagcgaggaacagcagacttcagacaactcaggcgtggctatactgagggcctacagccccgagagtagttccgactcaggcaacgaaaccaactcctcggagatgactgagagcagcgagctggcgactgcccaaaagcagtccgaaaatctctcccggatgtttctggctacacacgaggggtaccaccctctggccgaggagcagaccgagttcccggcaagcaagacccctgccggggggttgccgccaaagtcaagtcatgcattggcagcacggccagccactgacctgcctccaaaggtggtccccagcaaacagctccttcactcggatcatatggagatggaaccagaaaccatggagacaaaatcagtgactgactacttttctaaactccacatgggatccgtcgcttatagctgcacctcaaaacggaaatcaaagctggccgacggagaagggaaggcccctcctaatggaaacacgacagggaagaaacagcagggaactaagaccgctgagatggaagaggaggcttctgggaaatttgggacggtgtcctccagagattcacagcatctgagcacctttaaccttgaaagaactgcgttccgcaaagactctcaacggtggtatgtggctacggaggggggcatggcagagaagtcaggtctggaggctgcgaccggtaaaacttttccccgagcaagcggactaggtgcaagagaagctgaaggtaaagaagagggtgctcctgacggagaaaccagcgacgggagcgggcttggccagggcgaccgatttttaaccgatgtcacctgcgcttcttctgctaaagatttagataaccctgaagatgcggactcctccacttgcgatcacccgtcgaaactcccagaggccgacgaatcggtggctcgtctttgtgactaccatttggcgaagagaatgagttctctgcagtcagaaggtcacttcagcctgcaaagctcgcaaggctcaagtgtggatgccggttgcggcaccggatcaagtggatccgcctgtgccaccccagtggagtcaccactttgtccatccctcggcaagcacctcatcccagatgctagtggaaagggcgttaactatatcccttctgaggaaagagctccgggcttgcctaaccatggggctacctttaaagagctgcatccccagacagaggggatgtgtccccggatgaccgtaccggcactccacacggccataaatacggagccattgttcggcactcttagggatgggtgtcatcgactgcccaagattaaggaaacaacagtatag

SEQ ID NO: 116945 - DNA, 3942 bp, Artificial Sequence
  Description of Artificial Sequence: Synthetic coding sequence
aaatcccactctccgcacagaaccaagtcttcggggtggcctcctcccagcggaacctggggattatcccaagtgcctccttacggctgggagatgacagccaatagggatgggagggactactttatcaaccatatgacacaggcaatccccttcgacgaccctcggctggagagctgccaaatcatacctccagccccacgaaaagttgagatgagacgggacccggttcttggcttcggcttcgtcgccggctctgaaaagccagttgtggttcgctctgtcaccccgggtggacccagcgaaggcaagctgatccctggagatcagatcgttatgattaacgacgaaccagtcagcgccgcaccaagagagagggtgatcgacctagttcgctcctgtaaggagtccatattgttgactgtaattcagccatacccctcgcccaagagcgcatttatctccgcggccaaaaaggcccgtctgaaatccaatccggtgaaggtaaggtttagtgaggaggtgattattaatggccaggtgtctgaaactgtgaaggacaattcactgctgttcatgccaaatgtgcttaaggtatatctggaaaacggccagactaaaagctttagattcgactgttctacttctatcaaggacgtgattctaaccttgcaggaaaagcttagcattaaaggtatcgagcacttttcacttatgcttgagcagcggacagaaggcgccggcaccaaactgctactgcttcacgagcaagagaccctgacacaggtgacccagcgtccgagcagccacaaaatgcggtgtctcttccggatctcattcgttccgaaggacccgatcgatttgctgcgccgggacccagtagcgtttgaatacctgtacgtgcagtcctgtaacgatgtcgtacaggagagatttggtcccgagctcaagtacgacatcgccctgcggctggcagccctgcagatgtatatcgccaccgtcactactaagcagacacaaaagatcagccttaaatacattgagaaagagtggggtctggagacgtttctgccgtctgctgttttgcagtccatgaaagagaagaacataaagaaggccctgagccatctagtaaaggctaaccagaacctcgtaccaccggggaagaagctgtctgcactgcaggcaaaggtacactacttgaagttcctctcggatttgagactgtatgggggacgcgttttcaaggctactttggtgcaggctgaaaaaagaagcgaggttacgctactcgtgggcccccgatatgggatcagtcacgtgattaataccaagaccaatttggttgctctgcttgctgatttttcgcatgtgaataggattgagatgttctctgaagaagaaagcctagtgagagtcgagctgcatgtgctggacgtgaagccaatcactctcctcatggagtcgagtgatgctatgaatctggcctgcctgacagccggttactatcgcctgctcgtggactcacgacgttccatttttaacatggcaaataaaaaaaacacggcaacccaggaaacaggccctgagaacaaaggaaagcacaacctgctggggcctgattggaattgtattccccaaatgaccacattcattggcgagggggagcaggaggctcaaataacgtatattgacagcaagcagaaaacagtagagataaccgactctacaatgtgtcccaaagagcacaggcatctctacattgataacgcgtattcgagtgatgggttgaaccaacagctctcacaacctggggaggccccttgtgaggcagactacaggagcctagcacagcggtctttgctcactttgtcaggtccagaaacactcaagaaagcgcaagaatcaccacggggggccaaggtgtcattcatctttggcgacttcgccctggacgacggtatcagccctccaacactcggttacgaaaccctactagacgaagggccagagatgctggaaaagcagaggaatctttacatcgggtccgccaatgatatgaaaggtctggaccttactccagaggctgagggcatccaatttgtagaaaattccgtctatgctaatataggcgacgttaagtccttccaagccgcggaaggcattgaggaacccctccttcatgacatctgttatgcagagaatactgatgacgcagaagatgaagatgaagtatcttgcgaggaggatttagtggtaggggagatgaaccagcctgctattttaaacctgagtggaagttcagacgacattatcgaccttacatctctgccacccccagagggagacgataatgaggatgattttctgcttaggtctctgaacatggccatagccgccccaccacccggattccgtgacagctccgatgaagaagattcccagtcacaagctgctagctttcccgaagacaaggaaaaaggatcctctctgcagaacgatgagatacccgtgtccctgatcgacgcagtgccgacttctgccgaggggaagtgcgaaaagggtcttgacaacgccgtggtcagtacattgggagctttggaggcgctcagcgtcagcgaggaacaacagacatccgacaacagcggagtagctatcctccgcgcttactctcctgagagtagttcagacagcggtaatgaaacaaatagctccgaaatgacagaatcttctgagctggcaaccgcgcaaaagcaaagcgaaaacctgtcccgcatgttcctggcaacgcatgagggatatcatcccttagccgaagagcagaccgagtttcctgcctccaagacaccagctggtggtctgccacccaaatctagtcacgcacttgccgcacggccagctaccgacctgccgcctaaggtagtgccgtctaagcagttgctgcacagcgatcatatggagatggagccggaaacgatggagactaagtcagtcacagattatttcagcaaacttcacatgggcagtgttgcttactcgtgcacttcaaagcgcaaatctaaattagcagatggcgagggcaaagcacctcctaacggtaatacaactggaaagaagcagcagggaacaaaaactgccgagatggaggaggaagcctcgggaaagtttggcacagttagttccagagattcacagcacctaagtacctttaaccttgaacgcactgcctttagaaaggacagccagcggtggtacgtagccacagaagggggaatggcagagaaatcgggactcgaggcggcgacaggcaaaaccttcccaagagccagcggcctgggtgcccgagaagcagagggtaaggaggagggtgcacctgatggcgagacttcagatggttcaggactgggccagggagaccggttcctgaccgacgttacctgcgcctcttccgctaaagatttggacaacccagaggatgccgacagcagcacctgcgaccaccccagcaaactaccagaggccgacgagtccgtcgcacggctgtgcgactatcacctcgccaaaagaatgtctagcctacagagcgaaggtcacttttcactccagtcttcccagggttcctccgtggatgcgggttgcggcactggaagcagtggatctgcatgtgcaacccccgtggagtcacctctgtgtccaagtctggggaaacacctgatcccggatgcctcaggcaagggagtcaattacattcccagtgaagaacgtgcgccgggtctgcccaaccatggggctaccttcaaggagctgcaccctcaaacagagggcatgtgcccacggatgaccgtgccggcccttcacaccgccatcaacacggaaccgctgtttggaaccctgcgtgatggatgtcatcggctgcccaagatcaaggagactactggatag

SEQ ID NO: 116946 - DNA, 1794 bp, Artificial Sequence
  Description of Artificial Sequence: Synthetic coding sequence
atgtttgcctcttgccattgtgtccccagaggccgcaggaccatgaaaatgattcacttccgttctagcagtgtgaagtctttatcgcaggaaatgcgctgtaccatccgccttctcgacgactctgaaatctcctgtcacatacagcgagagactaaaggacagttccttatcgatcatatttgtaactactactctctactggaaaaggattattttggcatccgatatgtagatcccgaaaagcagagacactggttagaacccaacaagagtatttttaagcagatgaaaacccaccccccctacacaatgtgctttcgggtaaaattttatcctcacgagccccttaagattaaagaggagctcacgagatatctcctgtatctgcagataaaacgcgatattttccatggaagactgctgtgctccttctccgatgctgcttaccttggggcttgcatcgtgcaggccgaactgggagattatgacccggatgaacaccctgagaactatatatccgagtttgagatctttcccaagcagagccaaaagctggaacggaagatcgtagaaatccataaaaatgagttacgcggacagtctcctcctgtggctgagttcaacctgcttctgaaggctcacaccctggaaacatatggcgtggatccccatccttgcaaagatagtacgggcacgacaacctttcttgggtttacagccgccggttttgtcgttttccagggtaacaaaagaatccacttaattaagtggcccgacgtgtgcaaactcaagtttgaaggtaaaactttttacgtgatcgggacccagaaggagaagaaggccatgttagcctttcacacgtccactcccgctgcatgtaaacatttatggaagtgtggcgttgaaaaccaggctttctataagtacgccaaatcatcccagatcaagaccgtaagctcctcaaaaatcttctttaaaggatcccgctttcggtacagtggtaaggtggctaaggaagtggtggaagctagctccaaaatccagcgtgagcctcctgaggttcatcgggcaaacatcacacagagccgctcttcccactctctgaataagcagcttattattaatatggaaccccttcagcccctgctaccatccccgtccgagcaggaggaagaactcccgttaggagagggcgtacccctccccaaggaggaaaacatcagcgcaccactaatttctagcagccccgtgaaagctgcacgcgagtatgaagaccccccaagcgaagaggaagacaagattaaagaagagccactcacaatttccgaattggtctacaatccctctgcatcactattacccactcctgtcgacgatgatgagatcgacatgctcttcgattgcccatcgcgcctggagctggaacgagaggacaccgatagcttcgaagacttggaggctgatgaaaatgcttttctgatcgctgaggaagaggaactgaaggaagcccgaagagcgttaagctggagttatgacatcttgactgggcacatccgggtcaaccccttagtaaaatcattcagtagactcttggttgtgggcctcggactactactgttcgtattcccattgctcctcttactgcttgagtccggcattgacctctcgttcctttgcgaaatacggcaaacccccgaatttgaacaattccactatgagtattactgcccccttaaggagtgggttgccggcaaagtacacctcatcctctacatgctcgggtgttcttag

SEQ ID NO: 116947 - DNA, 642 bp, Artificial Sequence
  Description of Artificial Sequence: Synthetic coding sequence
atgcaggccgaggagaccaaaggcattggaatcacatctatggctaaatgcctggttaaaatacaaacaagacgctcattgcaactgcatatggtgaaccattgtaattcaaacgtattcgtcagactgctgcggctgggctccaaggttacagcacgaaataccggggtcccactgcccaaggaagaaaacatctctgcccccctgatctccagtagccctgtcaaagccgcgagagaatacgaagaccccccctctgaggaggaagacaagatcaaagaggagccactgacaatctcagaattggtatacaatccctcggcttcactcttgcctacgcccgtcgacgacgacgagatcgatatgctgtttgactgtccaagtagattagaacttgagagagaagataccgactctttcgaggatctcgaggctgatgaaaacgcctttctaattgcagaggaagaagaactcaaagaggcacgcagagccttaagttggagttatgatatactgactgggcatatacgagttaatcccctggttaaatctttctctcggctcctggtcgttgggctgggactgctgctgtttgttttcccactgctccttctactcctcgaaagcgtgtctatgcagtag

SEQ ID NO: 116948 - DNA, 804 bp, Artificial Sequence
  Description of Artificial Sequence: Synthetic coding sequence
atgtgctttcgggtgaagttctatccccacgagccgctgaaaataaaagaggagctaacaaggtatctcctttacttacagatcaagcgcgatattttccacggcaggctactgtgtagcttttccgacgctgcatatctgggtgcctgtatcgtgcaggctgagctgggagattatgatccggatgaacacccagaaaattacatcagtgaatttgaaatatttccaaagcagtcgcagaagctcgagcggaagatcgtggagatccacaagaatgagctccgaggacagtcaccccccgtcgccgagttcaacttgctgttgaaggctcacactctggaaacctacggcgtggatccacatccttgcaaagacagcacgggcactacaactttccttggatttactgctgctgggtttgtcgtctttcaggggaacaagcggatccacctcattaagtggccagacgtctgcaagctgaagtttgaaggcaaaaccttctacgtgataggaacccaaaaagagaagaaagccatgctggcctttcacacatcaacgcctgccgcatgtaaacacctgtggaagtgcggcgtggagaaccaagcattttacaagtatgcgaaatcaagtcagatcaagaccgtgtcctcctctaaaatcttcttcaagggcagtcgctttcggtatagcgggaaggtcgccaaggaggtagtagaagccagcagcaaaatccaacgggagcctcctgaggtccacagatgcgttcagaagaagatttgttcgtgctttggggttacctggtag

SEQ ID NO: 116949 - DNA, 1089 bp, Artificial Sequence
  Description of Artificial Sequence: Synthetic coding sequence
atggtgttccgcagaggacaatctccaccagtggccgaattcaatcttctgctaaaggcccatacactggaaacctatggggtggatcctcacccttgcaaagattccacagggaccacgacgtttcttggcttcacagctgccggattcgtggtgtttcaggggaacaagagaatccatctgattaagtggccagacgtgtgcaaattaaaattcgaaggtaagactttttacgtgatcggaacacagaaagagaaaaaggccatgctggcatttcacacgagcacccccgctgcctgcaaacatctctggaagtgtggggtggagaatcaggccttctacaaatacgcaaaaagctcacaaatcaagacagtttccagttcaaaaattttcttcaagggatccagattcagatactccggaaaagtcgcgaaggaagtagtcgaagctagctccaaaatacagagggaacctccggaggtccaccgcgccaacatcacacagagccggagctcacacagcctgaacaagcagcttatcatcaacatggagccccttcaacctttacttccttccccctccgagcaggaggaggaactgccactcggtgagggggtaccattgccaaaagaggaaaatatctcggcacccttgatcagctcgtccccagtgaaggcggcaagggagtatgaagaccctcccagcgaggaggaagacaagatcaaggaagagcccctgactatctcagagctcgtgtataacccaagcgccagcctgctgcccaccccagtcgatgatgatgagatcgatatgctctttgactgtccttcccgcctcgaattagagcgtgaggacacagattcatttgaggatttggaggctgacgagaacgcctttctcattgctgaggaggaggagctaaaagaagcacggagagccctctcttggtcgtacgatatcctcacagggcacattcgagttaatccactagtgaagagcttctcgaggctgctcgtagtgggcctagggctgctgcttttcgtgttcccattgctcctcctgctgttagagtcagtcagcatgcagtag

SEQ ID NO: 116950 - DNA, 1671 bp, Artificial Sequence
  Description of Artificial Sequence: Synthetic coding sequence
atgttcgcaagctgtcactgtgtacctcgaggccggaggacgatgaagatgatccatttccggagctctagtgtaaagtcccttagccaagaaatgcggtgtacaatcagattgctggacgatagtgaaatttcatgtcacattcagagagagactaaaggccagttcctcatcgatcacatttgtaactactatagtcttcttgagaaggattactttggtatcaggtacgtggatcccgagaagcaacgacactggttagagcccaataagtcaatcttcaagcaaatgaaaactcaccctccatatacaatgtgcttcagagtgaaattctaccctcacgagccactgaaaatcaaagaggagttgaccagatacctcctgtacctacagatcaaaagggacatcttccacgggagactgctttgcagctttagcgacgcagcttatctgggagcctgcattgttcaggccgagctcggcgattatgaccccgacgagcacccggaaaattacattagcgaatttgaaatctttccaaaacagtcacagaaactcgagagaaaaatagtggagattcacaagaacgaactgagaggccagagcccccctgttgcagaattcaatctattacttaaggcccacacacttgagacatacggcgtggacccccacccctgtaaagattcaactggcaccacaaccttccttggctttaccgcagccggatttgtcgtttttcaggggaacaaaagaattcatctcattaaatggccggatgtgtgcaagctaaagttcgagggcaaaaccttttacgttattgggactcagaaagagaagaaggccatgctcgctttccacacctccacaccagccgcttgcaaacacctgtggaaatgtggcgtggagaaccaggccttctacaagtacgctaagagcagccagataaagaccgttagctctagtaaaattttttttaagggatcccgcttccggtactcaggcaaagtcgcaaaggaggtcgtcgaggcctccagcaagatccagagggagccacctgaggtccatcgtgctaacataacacagtcgcggagctcgcactctctcaacaagcagctcataatcaatatggagcccctccagccattgctgccaagcccgtcagagcaggaagaggagttaccccttggcgaaggcgtgccattacccaaggaagaaaatatcagtgcaccccttatctcgtcgtcacccgtgaaagccgcccgcgaatacgaagaccccccatccgaggaggaggacaagatcaaggaagagcctctgaccatctccgaactcgtgtataatcctagcgcctccttgctgccaacccccgttgacgatgacgaaattgacatgctttttgactgtccaagtagacttgaactggaaagagaagataccgatagcttcgaagatctggaagcggacgagaatgcctttctaatcgctgaagaggaggagttaaaagaagctcgccgggctctcagttggtcctacgatattctgaccggtcacatacgggtgaatcccttggtgaagtcattttcccgattactagtggtgggcctcgggctgctgttattcgtctttcccctcctgctacttctgctggagtctgtgtccatgcaatag

SEQ ID NO: 116951 - DNA, 423 bp, Artificial Sequence
  Description of Artificial Sequence: Synthetic coding sequence
ggaaccacaactttcctgggtttcaccgccgccgggtttgtggtcttccagggaaataagcggatccatctcatcaaatggccagatgtctgcaagctcaaatttgaggggaagaccttttacgtgatcggtacccagaaggagaagaaggcaatgctggcctttcacacctctaccccagccgcctgcaaacatctatggaaatgtggcgtggagaatcaggccttctataaatatgccaagtcttcccaaatcaagactgtttcctcaagtaaaatcttttttaaaggcagccgcttcaggtattccggcaaggtggcaaaagaagtcgtggaagccagctccaaaatccagcgcgaaccccccgaagtccataggtgcgtccagaaaaagatatgcagttgtttcggtgtgacctggtag

SEQ ID NO: 116952 - DNA, 2145 bp, Artificial Sequence
  Description of Artificial Sequence: Synthetic coding sequence
atgctgcacctcaaagtacagtttctggatgatagccaaaagatattcgtagtcgaccaaaaatcaagcgggaaggccctctttaacctgtcttgcagtcacctgaacctggccgaaaaagaatatttcggcctggagttttgttcccattctgggaataatgtatggctggagttgctgaagccaatcaccaaacaggtcaagaaccctaaagagatcgtgttcaaattcatggtcaaattctttccagtggacccaggacatctgagggaggagttaactcggtacctcttcaccctgcagatcaagaaggacctcgctttaggcaggcttccctgttcagacaactgcacagctctaatggtgtctcacatcctccaatccgagctcggagatttccatgaggaaactgacaggaagcatctggcccagacccggtatctgccgaaccaagattgcctcgaagggaagattatgcactttcaccaaaaacatatcgggcggtctcctgccgaatcagatattttgcttctcgatatagctaggaagttggacatgtatgggattagaccccaccccgccagtgacggagagggtatgcaaatccatttggctgtggctcatatgggagttcttgtgcttaggggcaatacaaaaatcaatacgttcaattgggcaaagatacgcaagctgtcatttaagcgcaaacatttcctcattaagctgcacgccaacatcctggtcctgtgtaaggacacattggaattcacaatggcgtctagggatgcctgcaaggcattttggaaaacttgcgtcgaataccatgcattttttcgtctcagcgaagaacctaaaagcaagccaaaaacgttactgtgcagcaaggggtctagttttcgctatagcggtcgcacccaaaggcagctgctcgagtacggccgcaagggccggttaaaatccctgcccttcgaaagaaagcattatccaagccaatatcatgaacgtcaatgcaggtcctctcccgatctgctgagtgatgtctctaagcaggtcgaggatctgaggctcgcatacggtggcgggtattaccagaacgtgaatggcgtgcatgcctccgagccagtgctagagtctagacggcgtaactccgccctagaggtgacttttgcaacagaacttgaacacagcaagcctgaagctgacccaaccctcctacaccagtcccagtcaagctcttcctttccattcatatacatggatccagtgtttaatacagagcccaatcctaacccagaccccagggacattttcagcgagcgctccagtttgagtagctttcagacgtcctgtaaattcagcggaaaccacatgtcaatatacagtggcctcactagcaaagtgaggcctgcgaaacagttgacttatacagacgttccctacatcccatgcactggacagcaggtgggcataatgcctccacaagtcttcttttacgtcgacaagccaccacaagtgccccgatggtcccctattcgcgccgaggaacggactagtccccacagttacgtcgaacctaccgccatgaagccagcagaaagatctcctagaaatattcgcatgaagtcatttcagcaggatctccaagtgctacaagaggcaatcgccagaacctccggaagatcgaacatcaacgttggattggaagaggaggatccgaacctcgaagatgcatttgtatgcaacatccaggagcaaacccccaagcgtagccagagccaatcagacatgaagacaattcgattccccttcgggagcgaattccgacctttgggcccgtgccccgctctctcccataaagcagacctttttaccgatatgtttgcagaacaggagttgcctgccgtattaatggaccagtcaacggctgagaggtatgtcgcctcagaatcctcagatagtgaaagcgagattctgaaaccagactattatgcattgtatggaaaagaaatccgttcccccatggcacggatccgcctgtccagcggttccctgcagttggacgaggaggatgaggacgcctactttaacactcccactgccgaggatagaaccagcctgaagccatgcaattactttctcgcatag

SEQ ID NO: 116953 - DNA, 1785 bp, Artificial Sequence
  Description of Artificial Sequence: Synthetic coding sequence
atggtgagccacatcctccaatccgaacttggcgacttccacgaggagaccgacaggaagcacctggcccaaaccaggtacctgccaaaccaggattgcctcgagggcaagatcatgcactttcaccagaagcacataggaaggagccctgccgagtcggacattcttctcctagatattgcccggaaactggacatgtatggaattcgcccgcatcctgctagcgacggtgaaggaatgcagatccatctggccgtggcccatatgggcgtcctggtgcttagaggcaacacaaaaatcaatacatttaattgggcaaaaattcgcaagctgagttttaagagaaagcacttcctgattaagctgcatgcaaatatcttggtgctctgtaaggacaccctcgagttcacgatggcttctagagatgcttgcaaggccttctggaagacttgcgtcgaataccacgccttcttccgcttaagtgaagagccgaagtctaaaccgaaaacacttttatgctcaaagggctcctcctttaggtactctggaaggacacaacgccagctgttggagtatggtagaaaggggcgactgaagtccctgccttttgagcgcaagcattatccaagtcagtatcatgagagacagtgtcgctcctcccctgatttacttagcgacgtctccaaacaagtggaggatctgagacttgcatacggcggggggtattaccagaacgtgaacggtgttcacgcttcggaaccagttttagaaagcagaagaagaaactcagcgttggaagtcactttcgccacagaacttgagcattccaagcctgaggccgatccgacgctcctacatcaatcacagagcagttccagcttccccttcatttacatggaccctgtgtttaacacggagccgaacccaaacccagacccacgtgacatcttttcagagcgctcaagcctgtctagcttccagacttcctgcaaattctccggcaaccacatgagtatctactctggactcaccagtaaggtacgcccagccaaacagctgacttatacggacgtgccgtacatcccttgtaccggacagcaagtggggataatgcctcctcaggtttttttctacgtcgacaagcctcctcaggtgccacggtggagtccaatccgggccgaggaaaggaccagcccccacagctatgtggaaccgaccgccatgaaacctgcagagcgctctcccaggaatatcaggatgaaatcctttcagcaggatctccaggttctgcaggaagctatcgcaagaaccagcggtcgatcaaatatcaatgtcggactggaggaggaagatcctaacctcgaagacgcatttgtgtgtaatatccaggaacagacccctaagcggtcacaatcacaatccgatatgaagacaatacgttttccttttggatctgagttccgtcctttaggaccctgcccagcgctgtcccataaggcagacctcttcaccgatatgtttgctgaacaagaattacctgctgttctgatggatcagtctaccgccgaacgatacgttgcatctgagtcatcggactctgaaagtgagattttgaagccagactactacgcactctatggtaaggaaattagaagtcctatggcccggataaggctgtcctcaggcagtctgcagctagatgaggaagatgaggatgcctactttaatactcctacagccgaggaccgaacctctttgaaaccctgcaactattttttggcctag

SEQ ID NO: 116954 - DNA, 2043 bp, Artificial Sequence
  Description of Artificial Sequence: Synthetic coding sequence
atggccctggatgggattcggatgcccgatgggtgctacgcagacggtacttgggaactatcggtacacgtgacggatctgaatagagacgtcactctgagagtcaccggcgaagtccatatcggtggcgtgatgctgaagttggttgaaaaattggacgtgaagaaagactggtctgaccacgcactttggtgggagaaaaagagaacttggctgctgaagacgcactggaccctggacaaatacggcattcaggcggacgcaaagctgcagttcacaccacagcacaaactccttagactgcagttgccaaacatgaaatacgtgaaggtgaaggtcaacttcagcgaccgggtgttcaaggcggtcagcgacatctgcaaaacctttaacattcggcacccagaggaactgagcttgctgaaaaaaccacgggatcctacaaagaaaaagaagaagaagctggacgatcagagtgaggatgaagcgcttgagctcgaggggccacttattactccaggctccggttctatctatagttccccgggcctttattctaagactatgacgcccacttatgacgctcatgatggaagccccttgtcacctacctcagcctggttcggcgactcagccctcagcgagggaaatccaggtattctggctgtgtcccagcctattacatcccccgagatcctcgccaaaatgtttaaaccccaagcactgctggataaagccaagattaatcaggggtggttggactcaagccgatctctgatggagcaggacgtgaaagagaatgaggcgcttctgctgcgctttaagtactattcttttttcgatctcaaccccaaatacgacgctatccgaattaatcagctgtacgagcaggccaaatgggctattctccttgaagaaatcgagtgtaccgaagaggaaatgatgatgttcgccgcattgcagtatcatataaacaaacttagcattatgactagtgaaaaccatctgaacaattcagacaaggaagtggacgaggtagatgccgcactttctgaccttgagataaccctggagggtgggaaaacatcgactattttgggggacatcacctccatacctgaactggcggactatatcaaggtcttcaagcccaagaagctgactctcaagggatacaaacagtattggtgcacttttaaggatacctccatcagctgttacaagagtaaagaagaatcctccggcacacctgctcaccagatgaatctcagaggctgcgaagtgactcccgatgtcaatatttcaggtcagaagttcaacatcaagctgctgattcctgtggcagagggaatgaacgaaatctggctaagatgtgataacgaaaaacagtatgcacactggatggccgcttgtaggcttgcctccaaaggcaaaaccatggctgacagctcgtacaacctggaggtccaaaatatcctcagtttccttaagatgcaacatctgaatcctgacccccagttaatcccagaacaaatcactacggacattacgcccgagtgcctggtgagcccccggtatctcaagaaatacaaaaacaaacagatcacagcaagaatcctggaagcccaccagaacgttgcacaaatgagcctgatcgaggccaagatgcgtttcattcaagcatggcagtcccttccggaatttgggatcacccatttcatcgcacgcttccagggcggcaagaaggaggagctgattggcatcgcctacaaccggctgattcggatggacgcttctaccggggacgcaattaagacctggcggttcagcaacatgaagcagtggaacgtgaactgggaaatcaagatggtaacggtggaattcgccgacgaggttcggctgagtttcatctgcaccgaagtggactgcaaggtcgtacacgaatttattggcggatatatattcctgagcacccgggcaaaagaccagaatgagtcactggacgaggaaatgttttacaagttgacttccggctgggtgtag

SEQ ID NO: 116955 - DNA, 2064 bp, Artificial Sequence
  Description of Artificial Sequence: Synthetic coding sequence
atggcattagacggaattaggatgcctgacggatgctacgctgacggcacatgggaactatctgtccatgtgacagatctcaatcgagatgtgaccttacgagtaacgggtgaagtacacataggaggcgtgatgctgaaactcgtcgaaaagctggacgtgaagaaggactggtccgaccacgcgctgtggtgggaaaagaagcgaacgtggctgctgaagacgcactggacgttggacaagtacggtatccaagccgacgccaaattacagtttacaccgcagcataagctgctgcgcctccagctgcccaacatgaaatacgtgaaagtcaaagtgaatttctcagatcgggtgttcaaagcagtatctgacatatgcaaaacatttaatattaggcatcctgaggaactctccctgctgaagaaaccgcgggatccaacgaagaagaaaaaaaagaaattggatgaccagagtgaagatgaggccctggaactggagggcccactgataacccctggctcaggctccatctacagtagccccggcctctactcgaagaccatgactccaacttatgacgcccacgacggtagcccactgtcgccaacttccgcctggtttggtgacagtgcgctctccgaagggaacccgggcatcctagctgtgagccagcccatcacttcccccgagattctggctaaaatgtttaagccgcaggcgctgctcgacaaggccaagatcaaccagggatggttggattccagtcggtccctgatggagcaggatgtcaaggagaacgaagccttgctccttcgtttcaaatactacagcttttttgacctgaacccaaaatatgacgcgatcaggatcaatcaattgtatgaacaggctaaatgggccatcctgctggaagaaatcgagtgcaccgaagaggagatgatgatgtttgcagccctgcaatatcacattaataaactctccatcatgacgtccgaaaaccatttaaataactctgacaaagaagtggacgaggtagacgccgccctgagcgacctggagattaccctggagggcgggaaaaccagcaccatcctgggtgatataacatcaatacccgagttggccgactatatcaaggttttcaagcccaaaaagcttaccttgaaggggtacaagcagtactggtgcactttcaaggacacgtctatttcttgctacaaatctaaagaagaaagttccgggacccccgcacaccaaatgaacttacgtgggtgtgaagtgacaccagacgtgaacatttccggccaaaaatttaatataaaactcctgattcctgttgccgaggggatgaatgagatttggctcagatgtgataacgaaaagcagtacgctcactggatggctgcctgccggctggcctccaaaggtaaaacaatggccgattcttcttataacctggaagtccaaaatatactgtcatttctcaaaatgcagcatttgaaccctgatccgcagctaattcccgagcaaattactacagacattacccctgagtgcttggtttctccccgatatctgaagaagtataaaaacaagcaacctggatacatacgcgacctgatcaccgcccgcattctagaagcccatcaaaacgtcgcccagatgagccttatcgaggccaagatgaggttcatccaggcatggcaaagcctgcccgaatttggaataacgcattttattgcacggttccagggcggaaagaaggaggagttgatcggaatagcatacaatcggttaattcggatggatgcgagtactggggatgcaataaagacctggcggttctcaaacatgaagcagtggaacgtgaattgggagatcaagatggtaacggtggaattcgcagacgaagtgcgcctgtcattcatctgcaccgaagtggattgtaaagtggtgcacgagttcattggtgggtacatcttcctaagtaccagagccaaggatcaaaacgagagtttggatgaggaaatgttctacaaactcacatccgggtgggtttag

SEQ ID NO: 116956 - DNA, 2043 bp, Artificial Sequence
  Description of Artificial Sequence: Synthetic coding sequence
atggccctggatggcattcgtatgccggatggctgctatgccgatggaacctgggagctgtctgtgcacgtgacagatcttaacagggacgtgacactaagagttactggggaggtacatatcggcggcgtgatgcttaaattggttgagaaactggatgtgaagaaggactggtccgaccacgcactctggtgggagaagaagaggacttggctgttgaagacacactggacccttgacaaatacggcattcaggccgacgcaaagttgcaattcaccccacagcacaagctgcttaggctacaactgcccaatatgaagtacgtcaaagtcaaagtgaatttctctgatagagtgttcaaggccgtatcggacatctgtaagacctttaatatacgacatccagaggagttgagccttctgaagaagcccagggaccccacaaaaaaaaagaaaaaaaagctcgatgaccagtccgaagacgaggctctggagcttgagggccccctcataacgcctggaagcggtagcatttattcctcccctggactgtactccaagacaatgacaccgacctatgacgcccacgacggaagtcccctcagtccaacttccgcttggttcggtgatagcgcactctcagagggcaatccaggaattttagctgtcagccaacccattacctcaccagaaattctagccaagatgtttaagccacaagctcttctcgataaagctaagatcaaccagggctggctcgattcaagccgaagcctgatggaacaggatgtgaaggagaacgaggcgctcctcttgcgctttaagtattattcgttctttgacctgaacccgaagtatgacgctattcgtatcaaccaactgtatgaacaggctaagtgggctattctcctggaagagatcgaatgtaccgaagaggaaatgatgatgtttgccgcactgcagtatcacattaacaaactctcgattatgacctctgaaaaccacctgaacaactctgataaggaggtggatgaggtcgacgccgccttgtctgacctggaaattacactggagggtggcaagacctccaccattctgggggacatcacaagtattccggaattagccgactatatcaaagtctttaagccaaaaaagctgacgctgaagggatacaagcagtactggtgtactttcaaggacacatctatcagctgttacaaaagcaaggaggaatctagcgggacacccgctcatcagatgaatcttcggggctgtgaagttacccctgatgtcaacatatctggtcaaaagtttaatattaagctgttgatcccagtcgcagagggcatgaacgaaatatggttaaggtgcgataacgaaaagcagtatgcccactggatggcagcgtgtagactggccagcaagggaaagacaatggccgattctagctataacctggaggtgcagaatattctatcattcctgaaaatgcagcatcttaatcctgatccccaattgattcccgaacagattaccacagacatcacccctgaatgcctagtgtcacctagatacctaaagaagtacaagaataagcagatcactgctcgcatcttagaagcccaccaaaacgtcgcacagatgtctctaattgaggcaaaaatgaggttcattcaggcctggcagagcctgcccgagtttggcatcacacacttcattgctcgctttcagggggggaaaaaagaggagttgataggcatagcgtataatcggttaattcgtatggatgcaagtacaggggacgctatcaagacttggcgcttttccaacatgaagcagtggaacgtcaattgggagatcaaaatggtcactgttgagtttgcggacgaagtccgattgagcttcatatgtacggaagtagattgtaaggtggtgcacgagttcatcggagggtacattttcctcagcacccgcgcaaaggaccagaacgagtctcttgatgaagaaatgttttataagttgacctccggttgggtgtag

SEQ ID NO: 116957 - DNA, 1902 bp, Artificial Sequence
  Description of Artificial Sequence: Synthetic coding sequence
atggctttagacggaattagaatgccagacgggtgttacgccgatggtacttgggagctttcggtccacgtcacagatctcaacagagacgtgacactgcgagtaaccggggaggtgcatatcggaggagtcatgttgaagcttgttgaaaaactcgatgtcaaaaaggattggagcgatcatgccctttggtgggaaaaaaagcgcacctggctcctgaagacccactggacattggacaagtatggtatccaagctgatgccaagctgcagtttacacctcaacacaagctattgcgcctccagttgcctaacatgaagtatgtgaaggtgaaggtgaactttagcgacagggtcttcaaggcagttagcgacatatgtaagacctttaatatacggcatccggaagagctaagtctcctcaaaaaacctcgggaccctaccaagaagaaaaaaaagaagttggacgaccaaagcgaggacgaagctcttgaactggaaggcccccttattacaccagggagtggttcgatctactctagccctggcctctactctaagacaatgacaccaacatacgacgcccatgacggctccccgctcagccctaccagcgcctggtttggcgacagtgccctatcagaaggtaatccgggaatcctggcagtaagccaaccgattactagccccgaaatcctcgctaagatgttcaaaccacaggcactgttagacaaggccaaaattaatcagggctggttggacagctcgcgctcactgatggaacaggacgtgaaggaaaacgaagcactgctgctgcgatttaaatattacagtttttttgacctgaatcctaaatatgacgctattagaattaaccagctgtatgagcaggccaagtgggccattttgctcgaggaaattgagtgcacagaggaggagatgatgatgtttgccgcattgcaatatcacattaacaagctcagtattatgacaagcgagaatcacctcaacaatagtgacaaggaggtggacgaggtcgatgcagcactttccgatctggagatcacccttgagggcggtaagacctcgaccatcctgggtgacatcacatccataccggagcttgctgactacattaaagttttcaagccaaagaagttaaccctcaaaggctataagcagtactggtgcacattcaaggatacgagcataagctgttacaaatctaaagaggagagttcaggcacacccgcacatcagatgaatctgcgcggatgcgaagtgactccagacgtgaatattagcggccagaagtttaacatcaagttgttaattcctgttgcggaaggtatgaatgagatctggcttcggtgtgacaatgagaagcagtatgcccattggatggcagcatgcaggctcgctagtaaaggaaaaactatggcagatagcagctataatctggaggtacagaatatactgagtttcttgaaaatgcagcacctgaaccctgatccccagctgatacctgagcagatcacaaccgacattactccagaatgtctggtcagtcctcgctatctgaagaaatataaaaataagcagcccgggtatataagagatctcattactgcacgcatcctggaggctcatcaaaatgtcgctcagatgagcctcattgaggcaaaaatgcgattcatccaggcttggcagtctctgcccgaattcggtatcacccatttcatcgcacgcttccagggcggaaaaaaggaggaattaattggaattgcttataataggctgatcaggatggatgcaagcacaggagatgctattaaaacttggcggttttctaacatgaagcagtggaacgttaattgggaaattaaaatggtaaatagctag

SEQ ID NO: 116958 - DNA, 2064 bp, Artificial Sequence
  Description of Artificial Sequence: Synthetic coding sequence
atggctctggacggaattcggatgcccgatgggtgctatgcagacggtacctgggagctgtccgtgcacgtgacagatctaaatagagacgtaaccctccgggtaacaggggaagttcacatcggcggggttatgttgaaattagtggaaaaactcgacgtcaagaaggactggtcagatcacgccctttggtgggaaaagaagaggacctggttactgaagacacactggaccctcgataagtatggaatccaggccgacgcgaagctacaattcacaccccagcataagctgcttaggctgcaactccccaatatgaagtatgtaaaagtgaaagttaacttctctgatagggtgttcaaggccgtttcggatatctgtaaaacttttaacattcgccacccggaagagctgagtttgctaaaaaaaccccgcgaccccaccaaaaagaaaaaaaaaaaactggatgaccagtccgaggacgaggcgctggaattggagggcccactgatcacccccggcagcggcagcatatatagtagtccaggcctttattctaagaccatgactcccacgtacgacgcccatgatggtagtcccttaagcccgacatcagcatggtttggagattcagctctgagcgagggaaatccaggaattctggctgtgtcccaacctattacatctcccgagatactggcaaagatgtttaagccccaggcactgctcgacaaagccaagatcaaccagggctggctggattctagcaggtctttgatggaacaagacgtcaaagagaacgaggcattattactacggttcaaatactactcttttttcgacctgaacccaaaatatgatgccataagaattaaccagctatacgagcaagcaaagtgggctattctccttgaagaaatagagtgtactgaagaagagatgatgatgttcgctgccctacagtaccacatcaacaagctgagcatcatgacttctgagaaccacctgaacaatagcgacaaagaggtcgatgaggttgacgctgcactgagtgacctggagatcacattggagggtggtaaaacttcaacgattcttggggatataaccagtattcctgagctcgcagactatattaaggttttcaagcctaagaagctgaccctgaagggttataagcagtattggtgcacatttaaggatacaagcatctcctgctataagtcaaaggaggagtccagcggaacccctgcccatcaaatgaacctgcggggctgtgaggtgacgcccgacgtgaatatatcgggacagaaattcaatattaaacttctgatcccagtggctgaagggatgaatgagatttggctccgctgtgacaacgaaaagcaatatgcccattggatggctgcgtgtagactggcctctaagggaaagactatggcagacagctcatataatctagaagtccagaacatcctatcatttctgaagatgcagcacctcaacccggacccccaactgattccggaacaaatcaccaccgacataacacccgaatgcctggtcagccccagataccttaaaaagtacaagaataaacagcccggctatattagagaccttatcaccgccaggattctcgaggcccaccaaaacgtggctcaaatgtcactgattgaggccaaaatgagattcatccaggcctggcagtctctaccagaattcgggattacacattttattgcacgcttccaaggtggcaaaaaagaggagttgatcggaattgcatacaatagattaattcgtatggatgcaagcaccggagatgccatcaagacatggcggtttagcaacatgaaacagtggaatgtaaattgggaaattaagatggtcaccgtggaattcgccgacgaggtgcgcctcagctttatttgtactgaggtagattgtaaggttgtccatgagtttatcggcggatacatctttttgtccaccagggcaaaagaccagaatgagtctctggatgaggaaatgttctataaactgacgtccggttgggtgtag

SEQ ID NO: 116959 - DNA, 462 bp, Artificial Sequence
  Description of Artificial Sequence: Synthetic coding sequence
atggccttggatgggatccgcatgcctgacggttgctatgccgatgggacttgggaactgtctgtccatgtgaccgatctcaatagagatgttaccctgcgagttactggagaagtccatatcggaggggtcatgctgaagctcgttgaaaaactagatgtcaagaaggattggagcgaccacgcactctggtgggagaagaaacggacatggctgctgaaaacacactggaccctggataagtacggtatccaggccgatgctaagctgcagtttactccacagcataaactactcaggttgcagttacctaacatgaagtatgtgaaggtgaaagttaacttcagcgatagagtcttcaaagcggtttccgacatctgcaaaacctttaacataagacaccccgaggagttgtctctgttgaagaagccacgcgacccaacaaaaaaaaaaaagaaatag

SEQ ID NO: 116960 - DNA, 2004 bp, Artificial Sequence
  Description of Artificial Sequence: Synthetic coding sequence
atggcgggaatgaaaaccgctagcggcgactatattgactcaagctgggagctgagagtattcgttggcgaggaagaccccgaggccgagagtgtgacactgagagtcaccggagagtcacacatcggaggggtgctgctgaagatcgtcgaacaaatcaataggaagcaggattggagtgaccacgccatttggtgggagcaaaagagacaatggctgttacagactcactggacactggacaagtatggaatccttgctgacgctcggctcttctttggcccccagcaccggcctgtgatcctgagactgcctaatcggcgcgccctcaggctaagagcatcattttcccagccattgttccaggcagttgcagctatctgccggctcctgtcaattcgacatcccgaagagctgagcctattaagagcccccgaaaagaaagaaaagaaaaagaaggaaaaagagccagaagaagagttgtacgacttgtcaaaagtcgtgctggctggcggagtggctcccgccttatttcggggcatgccagcgcacttttccgactctgcgcagactgaggcctgttaccacatgctatcccgcccccaacctccgccagacccactcttgctccagaggctgcctcgccccagctcattgtccgataaaacacagcttcatagcagatggcttgatagctctagatgtttgatgcaacagggaattaaggccggagatgcactttggctcagatttaaatactacagtttctttgatctggatcccaagacagaccctgtgcggctgacacagttatacgaacaagcccgatgggatctactcctggaggagatcgattgcactgaggaagaaatgatggtgtttgccgcactgcaatatcatataaataagctgagccagtcaggggaagttggggagcccgcaggcaccgatccaggtttggacgaccttgacgtagctctctcaaacttagaagtaaaactggaaggatccgctccaacagatgtcctagacagtctgaccaccatccctgagctaaaggaccacctgcgtatatttagaattcccagaagaccacgtaaactgaccctaaaggggtaccggcagcattgggtggtttttaaggagactacactgagttactataaatcacaggatgaggctcctggagaccccatccagcagcttaacctcaaggggtgtgaggtggtacccgacgtaaacgtgtcaggtcagaagttctgcattaaacttcttgtgccttccccagaaggtatgtcagaaatctacttgaggtgtcaggacgagcagcagtatgccagatggatggccgggtgcagactggcttcaaagggtaggactatggcggattcatcttacacttcggaggtccaggccattctggcttttttgtcgttacaaaggactggaagcgggggacctgggaatcaccctcacggcccagacgcgtctgcggagggtcttaatccttatggacttgtcgcccctaggttccagcgaaagtttaaagctaaacagctgacacctcgtattctcgaagcccatcaaaacgtcgcacagttgtccctggccgaagcgcagttgaggttcattcaggcttggcagtcccttccagattttggcatatcttatgtgatggtccgcttcaaaggttctcgtaaagacgagattctggggattgccaacaaccgtctcattcggatcgacctggccgtgggtgatgttgtgaagacttggcgcttcagcaacatgcgacagtggaatgtgaattgggacattaggcaggtcgccatcgagttcgatgagcatattaatgtcgctttcagttgtgtctctgctagctgtagaatagttcacgagtacattggaggctatatctttctgtccactagagagagggcccgcggggaagaactggatgaggacctgttcctccaacttacaggcgggcatgaagctttctag

SEQ ID NO: 116961 - DNA, 1992 bp, Artificial Sequence
  Description of Artificial Sequence: Synthetic coding sequence
atggcaggtatgaagacagcgtctggcgattacattgatagcagttgggagctgcgggtgtttgttggcgaggaggatcccgaggccgagtctgtcactcttagggtgacgggagagtctcacattggtggcgtccttttgaaaatcgtggagcagattaataggaagcaggactggagtgaccatgcaatctggtgggagcagaagaggcagtggctgctgcagacacactggaccttggacaagtacggcattctcgcagacgccagactgtttttcggtccacagcaccggccggtgatcctcaggctgccaaatcgacgagccctacggctgagagcttccttctcccagccactcttccaggctgtagcagctatttgtaggctcctctcaatccgacatcccgaggagttgtccttactacgggcgcccgaaaaaaaggaaaagaagaaaaaggagaaggagccggaggaggaattgtatgatctcagcaaagtcgttttagctggaggtgtcgcaccggccctgttccgaggaatgccagcacacttctcggattccgcccagacagaggcatgttaccacatgctttccaggcctcagccaccccccgaccccttgctgcttcaaagactgccccggccatcatctttaagcgataaaactcagctgcatagtagatggctggacagcagcagatgtcttatgcagcagggtattaaagccggggacgcattatggctccgcttcaaatattatagtttttttgatttagaccctaaaaccgatccagttagattgactcagttgtacgagcaagctcgttgggatctgcttttagaggaaatcgattgtacagaggaggagatgatggtctttgctgcattgcagtatcatatcaacaaactaagtcagtctggagaggttggcgagcctgcagggacagaccctggccttgacgatctggacgtggcattgtccaacctcgaggttaaactagaagggagcgccccgacggacgtactggattcactgactacgattccggagctcaaggatcatcttagaatcttccggcccagaaaattgactctaaagggctaccgccaacactgggtggtcttcaaggaaacaactctgagctactacaagtcccaagatgaggctccaggagatcctattcaacagctgaatttgaagggttgcgaggttgttccagatgtgaatgtgtcaggccaaaagttctgtatcaagctgctagtgccgtccccagagggcatgagcgagatttaccttcgctgccaggatgaacagcagtacgcccgatggatggctggctgccgtttggcttctaagggtcgtaccatggctgactcttcatacacgtccgaggttcaggccatcctcgccttcttaagtctccagaggacgggctctggcggcccaggaaatcatcctcacgggcccgacgctagcgccgaaggccttaatccctacgggctagtagcaccgcggtttcagcgaaaattcaaggcaaaacaactcacccccaggatacttgaagctcaccagaacgtggcccagttgtccctcgctgaggcgcagctgaggttcattcaagcctggcagtctcttcccgacttcggcatttcctacgtaatggtcagatttaaaggatctcgcaaggacgaaatccttgggattgctaataatcggctgatacggatcgaccttgccgtcggcgatgttgtaaagacttggaggtttagcaatatgagacagtggaacgtgaactgggatataaggcaggtagccattgaatttgatgaacatataaatgtggctttctcctgtgtgagcgcctcatgcaggatcgttcatgaatacatcggcgggtatatcttcctctctacccgggaacgagcccggggggaggagctggacgaggacttgttccttcagcttactggaggccacgaggctttttag

SEQ ID NO: 116962 - DNA, 861 bp, Artificial Sequence
  Description of Artificial Sequence: Synthetic coding sequence
atggctggtatgaaaactgcgtctggcgactacattgattcctcatgggagctgagggtgtttgtgggagaagaggatcctgaggcagagtccgtcacgctccgcgttaccggagagtcacacattgggggcgttctgctcaaaatcgttgagcagattaacagaaagcaagactggtccgaccacgccatatggtgggagcagaaacgacagtggctgctacagacccactggacactggacaagtacggcatcctcgctgatgcacggctgttctttggccctcaacataggccagttatattacgtttacccaaccgccgtgccctcaggctaagggcatccttttctcagccactgttccaagcagtcgcagccatatgccggttactgagtattcgacatcccgaggagttatctcttcttcgcgcaccagagaaaaaggaaaaaaagaagaaggagaaggagcccgaagaggaattgtacgatttgtccaaagtggttctggctggcggggtagcacctgcactcttccgcggcatgccagcccatttctctgactccgctcagactgaagcatgctatcacatgctcagccgtccgcaaccgccaccggacccgctcctgctgcagcgtctgccccgcccttctagtttatcagataagacacagctgcattctcggtggctcgattctagtcgttgcctgatgcagcagggaataaaagccggagatgccttgtggctcagatttaagtactactcttttttcgatcttgaccccaagacggacccagtcaggctaacacagctatatgagcaggccaggtgggacctgctccttgaggaaatcgactgttag

SEQ ID NO: 116963 - DNA, 555 bp, Artificial Sequence
  Description of Artificial Sequence: Synthetic coding sequence
atggcggcagctggtggcgcgagactccttagggccgcatcagccgtgctgggcggacccgccggccggtggttgcaccatgctggcagcagggccggctcatctggcctccttagaaaccgaggccccggaggatcggcagaggcgagcaggtcactatcagttagtgcacgagcccggagctcctctgaggacaaaattaccgtccacttcatcaacagggacggcgagacccttaccacgaaaggcaaggtgggcgactctttactcgatgtcgtggttgaaaataacttggatattgacgggttcggggcatgtgagggaaccctggcctgttctacatgccacctgattttcgaggatcatatttatgagaagctggacgctattaccgacgaggagaatgatatgctcgatcttgcctacggtctgaccgatcgcagtcgcctgggatgccaaatttgcctcactaagtctatggacaatatgactgttagagtgcccgaaaccgtggccgatgcaagacaatcaatagacgtgggtaaaactagctag

SEQ ID NO: 116964 - DNA, 1494 bp, Artificial Sequence
  Description of Artificial Sequence: Synthetic coding sequence
atggcctcccgctgttggcgttggtgggggtggtcagcctggccgcggacaaggctgccaccagccggcagcaccccctccttctgtcatcacttttctacccaagagaagacaccgcagatctgtgtggtggggagcgggccagctgggttttatactgcccagcacctgctgaagcatccacaggcacatgttgatatctacgagaagcaacccgtgcccttcggacttgtccgtttcggcgtcgctcccgatcaccccgaagtgaagaacgtgattaatactttcacgcagacagcacactcgggaaggtgtgccttctggggtaacgttgaggtgggtcgagacgtgacggtgcccgagttgagggaggcctatcacgccgtcgtcttatcctatggggctgaagaccatagagcactcgagattcctggagaggaactccccggagtctgctcagccagagcatttgttggatggtataatgggctaccagagaatcaggaactcgagcctgacctttcttgcgacactgcagtgatcctcggccaggggaatgttgctctggacgtagcacgcattcttctcacccctccggagcatttggaggcactgctgctctgccagcgtacagacataactaaggcagctctaggggttttgcgtcagtcgcgagtgaagacagtgtggctggttggaaggcgtggcccgctgcaagtcgctttcacaatcaaagaactgagggagatgatacagctgccaggcgcccggcccatattggacccagtggattttcttggcctccaagacaagatcaaggaggtaccgcgccctcgtaagaggctaaccgaattgcttctcagaactgcgaccgagaagcctggtccagctgaggctgcacggcaggcctcagcatcacgcgcctggggcctgcgattttttcggagtccacagcaggtgcttccttcgcccgacggccgaagagcagcaggcgttcgactggccgtgacaagactggagggtgtggacgaagctactagggccgttcccaccggggacatggaagacctgccatgcggcctggtcctgagttcgattggatataaatcacggcctgtagatccgagcgtgccattcgatagcaaattgggtgtgattcccaacgtcgaaggcagagttatggatgtgcctgggttatattgctctggctgggtcaagcggggacccacaggtgtgatcgccacaacaatgaccgattcctttctcaccggacagatgctgctgcaggacctgaaagcagggttgcttccgtctggcccacgacccggttacgctgcaattcaagctctgctcagcagccggggtgtgagacccgtaagtttcagtgattgggagaagctcgacgcagaagaagtggcccgtgggcagggaactggtaagccacgtgagaaactggtggatcctcaggaaatgctaaggctgctcggtcactag

SEQ ID NO: 116965 - DNA, 1569 bp, Artificial Sequence
  Description of Artificial Sequence: Synthetic coding sequence
atggcctcacgatgctggagatggtggggctggtccgcgtggcccagaactagactcccaccagctggaagtactccaacatttggggggagcgatgaagtcagagatccggctaacgccaaggcccttagaaataaacggcgcaggatgcaggtaagagtgaaactgggaaaatttcagttactgcttgacattcaggagaagacgcctcagatttgcgtggtgggtagtgggcccgctggtttttacaccgcccagcatctgctgaagcacccacaggctcacgttgatatctacgagaagcaacctgtaccttttggtctggtgcgtttcggcgtggcccctgaccaccctgaagtcaaaaacgttataaacactttcacccagacagcccactctggacgctgtgctttttggggcaatgttgaggtcggacgcgacgttaccgtccctgagctccgcgaagcctaccatgcagtggtattaagctatggcgcagaagaccatagagcccttgaaatcccgggagaagagctcccaggtgtatgtagcgcacgggcctttgtaggttggtacaatggtctgccagagaatcaggagcttgagcctgatctgtcttgcgatacagcggtcatactgggccagggcaacgtcgccctggatgtagcccgcatcctgctaacccctcctgagcatctcgaacgcacagacataacgaaggccgcccttggtgtcctgaggcaatcaagagtcaagacagtttggctcgtagggcgtcggggtcccctacaggtagcttttaccatcaaagagctgcgggagatgatccagttgcctggtgcacggccaatccttgaccccgttgattttctcggtttgcaggacaaaatcaaggaagtcccacggcctcgcaagagactgacagagctactgctgcgtaccgccactgaaaagcccggacctgccgaggccgcacgccaggcatccgcgtctcgcgcctgggggctgcgcttctttagatccccgcagcaggtcctgcccagcccagatggcagaagagcagcgggagtgcgtcttgcggtgaccagactggagggggttgatgaagccacgagagccgtcccaactggtgacatggaggacctgccgtgtggcctggtactttcaagtataggctataagagccgccccgtggacccgtctgtgcctttcgatagcaagcttggagtgatcccaaacgtggaggggcgagttatggatgtgccaggtctgtactgctcaggatgggtgaagcggggccctacaggcgtgatcgccacaaccatgacggactcgttccttaccggtcagatgctgctccaggatctcaaggcaggcctgcttccaagcggtcctcgacccggttatgccgctatccaggcactgctgagcagtcggggcgttagaccagtttccttctccgattgggaaaagcttgacgcagaagaggtagcccgtggccaaggaacaggtaagcccagggaaaagttagtcgacccccaggagatgctgaggttactgggacactag

SEQ ID NO: 116966 - DNA, 1356 bp, Artificial Sequence
  Description of Artificial Sequence: Synthetic coding sequence
atggcttcccgttgctggcgctggtgggggtggagtgcatggccccggacaaggctgccccctgccggtagcaccccctccttctgtcaccacttctctactcaggagaaaacgccacagatctgcgttgtgggcagtgggcccgcaggcttttataccgcccagcacttgctcaagcagcacccccaggcacatgtcgatatatacgagaaacaaccggttccattcggattagtgaggttcggagtcgccccggaccacccagaggtaaaaagctatggcgcagaggaccatcgggccctggagatcccgggggaggagttgccaggagtgtgcagcgctcgggctttcgtgggatggtacaatggcttacctgaaaatcaagaattggaaccagatctgtcatgcgacacagccgtgatcttgggccagggtaatgttgctctcgatgtagcgcgtatcctgctcacccccccagagcatttggaacggaccgacatcacgaaagcggctttaggggtcctacgacagagccgggtgaagactgtgtggctggttggtcgccggggccctctgcaggtcgccttcacaatcaaagagctgcgggagatgatccaattgcccggcgccaggccaatcctggaccccgtcgatttccttggcctccaggataaaatcaaagaggtgccccgcccacgaaaaaggttgactgagttgctcctcagaacagcgactgaaaagcccggccctgcagaggctgcaaggcaggcttctgcttcacgcgcctggggtcttcggttctttcggtcaccacaacaggtgcttccttcacccgacggcaggcgggcagcgggcgttagattagctgtgacgagactggagggggtggacgaggctacacgggccgtccctacaggggacatggaggacttaccgtgtggcctcgtgctgagcagcatcggatataagtctcgacctgtggatccctcagtcccttttgatagtaagttaggcgtcatccccaacgtagaaggccgtgttatggacgtgccgggactttactgcagcgggtgggttaaaagggggccaaccggggtgattgcaacaaccatgacagactcctttctgactggccagatgctactacaggatctgaaagcaggcttactgccttcggggccacgccccggctatgccgctatccaggccctgctcagcagtaggggtgtccggccagtgtctttcagcgactgggagaagctggatgccgaggaggttgcccgcggacagggcacaggtaagcctcgggagaaactggtggatccccaggagatgctaaggctgcttggacactag

SEQ ID NO: 116967 - DNA, 1605 bp, Artificial Sequence
  Description of Artificial Sequence: Synthetic coding sequence
atggcgagccggtgctggcggtggtggggctggtctgcgtggcctcggactcgcctgcctccagccggctccacacccagcttctgtcaccatttctctactcaagaaaagacacctcagatctgtgttgtgggctccggtccagccggtttctatactgctcagcatttgctcaaacgggtagaagccttatgtagccagcccagggtgttgaactcccccgcgctgagcggtgagggggaggatctaggcgcatcccagccgctgtcactcgaccccacaagttgccatcctgtgccccagcagcacccacaggctcacgtcgatatctacgagaagcagccggtgcctttcgggctggtgaggtttggggtcgctccagaccatccggaagtgaaaaacgtgattaacacctttacccagaccgctcatagcggccggtgcgccttttggggcaatgtcgaggtggggagagatgtgacggtacctgagctgcgcgaagcttatcatgccgtggtcctcagctacggagcggaggatcaccgtgcactggagattccaggagaggaattgccaggtgtttgttccgcacgggctttcgtggggtggtataacggcttgcccgagaaccaggaactagagccagatctatcttgtgataccgccgtgatcttgggtcaaggcaatgtggccctggatgtcgcccggatactgctcacgcctcccgaacacctggaaagaaccgacataactaaagccgcattgggtgtgcttcgccagtcccgcgtcaaaaccgtatggctggtgggtcgtcgcgggccactccaagtcgcctttacaattaaggaactccgcgagatgatccaactgccgggcgcgcggcccattctggaccccgtggactttctgggcctccaggacaagattaaagaggtgccaagaccacggaaacggctgacagaactactgctgcgtacagctacggaaaagccaggcccggccgaagccgcccgtcaggcaagcgctagcagggcatggggtctgaggttcttcaggagccctcagcaagttttgcccagtccagacggacggcgagcagccggcgtaagactggcggtgacccggctggaaggggtcgacgaggcaacaagagcagtacccaccggggacatggaggacttgccatgtggcctggtcctctccagcatcgggtacaagagcagacccgtggacccttcagttccatttgattctaagcttggagtgatcccgaatgttgaagggagagtcatggacgtgcctggcctgtactgcagtggatgggtaaaaaggggacccactggggtgattgccaccaccatgactgattcttttctgactggccaaatgcttctgcaggatctgaaagccggtttgctgccttcagggcctcgtcctggctacgccgcgatccaggccctgctgtcttcacgcggggtgcgccccgttagcttctcagactgggaaaagctcgacgccgaagaagtcgccagagggcaaggaaccggcaaaccacgcgaaaaactggtagatccgcaagaaatgctgcgtctgttgggccattag

SEQ ID NO: 116968 - DNA, 1146 bp, Artificial Sequence
  Description of Artificial Sequence: Synthetic coding sequence
atgaccacctgcaaggctggagttgttccacttgctagccaacaacacccacaggcgcatgtggatatctacgagaagcagcccgtacccttcggcttagttcgcttcggtgtcgccccggatcatccagaagtaaaaaatgtgataaacacttttacccagacggcccactccgggcggtgcgcattctggggtaatgtcgaggtgggtagagatgtgacggtgcccgaactgagagaggcctaccacgcagtggtgttgagttatggcgcggaagatcatcgggcactggagattccgggggaagagctccccggcgtgtgttcagcccgcgcttttgtggggtggtataatggtctccctgagaaccaggaactggagccagacctctcctgcgacacagccgtgattctgggccagggcaacgtggcattagacgtggctagaattctgttaacccccccagaacatctcgagcgtaccgatatcacaaaagccgctcttggagttctgcgccagtcacgggttaagactgtgtggctggtggggagacgcgggccactccaggtggccttcactataaaggaactccgggagatgatacagctccccggggcacggcctattctggatcctgtcgatttcctggggctgcaggataagataaaagaagtgcctcggccaagaaaaaggttgacagagcttctcctcaggactgctactgagaaacccgggcccgccgaggccgcgcgacaggcatcagcctcccgggcttggggcctgcggttttttcgttccccccagcaagtcctcccatcccccgacggtaggagggccgcgggcgtgcgattggctgttacccggcttgaggttagcttgatgttccttaaagacacccccttccccggtttatgtcatccaccgggagtcgcacatacattgccaaacagggtgagcatgagacccccagtgcagtgtccaagagagacatggaaaacatcactcgtgggttggtgctccgcagccctcgggatccgcgctgcactgagcactcaggcatgtcctctgaccccatcactgggctcttcaccgatgtggcgcgcaggcttatggatgtgtcaagcctccacagccgcagccggctag

SEQ ID NO: 116969 - DNA, 1320 bp, Artificial Sequence
  Description of Artificial Sequence: Synthetic coding sequence
atggaagataaagatagagaacacccacaggcgcatgtggacatttacgagaagcagccagtgcccttcggattggtgcgattcggggtggccccggatcatccagaagttaaaaacgtgataaacacttttacccagacagcacattccggtagatgcgccttctggggaaatgtggaagttggacgggacgtaactgttccagaactgagggaggcctatcacgccgtcgtactttcctatggggcagaagaccatcgcgccctagaaatacccggagaagagttgcccggagtctgcagcgcccgcgcctttgtcggctggtacaatggcctgcctgaaaaccaggaactggaacctgatctgagttgcgacacagctgtaattctaggccagggtaatgttgccctcgatgtagcacgcatcctcctaacaccccccgaacatcttgaaagaaccgacatcaccaaagccgcccttggagtgctgaggcagtccagagtgaaaaccgtttggttggtcggtcggcgcggacctttgcaggtcgctttcaccatcaaggaattgagggaaatgatccagctccctggagctcgcccaatattggatcctgtggacttcctgggattacaagataaaatcaaggaggttcccaggcccaggaagcggttgaccgagctgctgctgagaaccgccaccgagaaacccggcccagccgaggccgcgagacaggctagtgctagcagagcctggggcttgcgatttttccgctcgccacagcaggtgctaccgtcccctgacggaaggcgggcggccggggtgcgcttagctgtgacacgcctcgagggcgtggacgaggctacgagagcggttcctactggagatatggaagacctcccttgcgggctggtcctgtctagcattggatacaagtcgcggcccgtggatccatctgttccttttgactcaaaacttggagtcatccctaacgtcgagggaagggtgatggacgtgcccggcctgtattgcagcggctgggtaaaaaggggccctaccggcgtgatcgccacaaccatgactgactcattcctcactggccagatgctcctccaggatctgaaagctggacttctgccgagcggcccccgccctggatatgccgctatccaagccctgttgagtagtaggggcgtccgtcccgtctcttttagcgactgggagaagctcgacgcagaagaggtggcacggggccaggggactggaaaaccacgagagaaactcgtcgacccccaagaaatgctgcgcctgctcgggcactag

SEQ ID NO: 116970 - DNA, 1494 bp, Artificial Sequence
  Description of Artificial Sequence: Synthetic coding sequence
atggcctcacgttgttggaggtggtggggatggagcgcgtggcccagaacgaggctgcctcccgccggcagtaccccctcattctgtcaccatttttcaacccaagagaagacgccgcagatctgtgttgtcgggtccggcccggccggattctataccgcgcagcacctgctgaaacaccctcaggcacacgtggacatttacgagaaacaacctgttccgtttggattggtacggtttggcgttgcccctgatcacccagaagttaagaatgtgataaatactttcacccagacagcccattctggaaggtgcgcattttgggggaatgtagaggttggccgggatgtgacagtaccagagctgcgcgaggcctatcacgccgtagtcctatcttacggagctgaggaccaccgagcacttgagatacctggtgaagaattgccgggtgtgtgttccgcaagggcctttgtaggatggtacaacgggctgccagagaatcaagagctcgaaccggatctgtcgtgtgataccgcagtgattctggggcaaggcaatgttgccctcgatgtcgccaggatattgcttaccccaccagagcatctcgaagcattgctgctctgtcagaggaccgatatcactaaggctgctctcggagttttacgacagtccagggtcaagactgtatggctagtggggcgacgcgggccactacaggtggcgttcacaatcaaagagctgcgcgagatgatacagctgccaggcgctcgacccatcctcgatcctgtcgattttctcgggctccaggacaagattaaggaggtaccacgtccccgcaagcgtctaactgaactgctccttcggacagccaccgagaagccagggccagccgaggccgcacggcaggccagcgccagtagggcgtgggggctgcgcttcttccgatcccctcagcaggttttgcccagtccagatggtaggcgcgcggctggagttcgcctagcggtaacccgattggagggcgtggatgaagccactcgggcagttccaaccggtgacatggaagatctcccttgcggcctcgtgctgtcttctattggatacaaatcaaggccagttgatccttctgtccccttcgattcaaagttaggagtgattcccaatgtagaaggccgggttatggatgtacccggcctatactgtagtggttgggtgaagcgaggccccaccggtgtgattgctacgactatgactgactcttttctgacagggcagatgctgttgcaggatcttaaggccgggctgctgccctctggccctagacccggatatgcggccatccaggccctgctgagcagtcgcggggtccgaccggtcagcttcagcgactgggagaagttggatgctgaggaggtcgcaagggggcagggcactggtaaacctcgggagaaactggtcgacccccaggaaatgctacgcctgctgggacactag

SEQ ID NO: 116971 - DNA, 1452 bp, Artificial Sequence
  Description of Artificial Sequence: Synthetic coding sequence
atggcttccaggtgctggcggtggtggggttggtccgcctggcccagaacacggttgcccccagcaggctccaccccatctttctgccaccattttagcacacaggagaagaccccacagatatgtgtggtgggaagtggacctgcaggcttctacactgctcagcatctcctcaaacatccgcaggcccacgtagatatatatgagaagcagccggtgcctttcggcttagtgcgttttggggtggcccctgaccaccctgaagttaagaccgcccattccgggaggtgcgccttctggggaaacgttgaagtggggagagatgtcacagttcctgagctccgtgaggcttaccacgccgtggtgttgtcctacggggcagaggatcaccgcgctctcgaaattcctggtgaggaactccccggtgtctgctcagctagggccttcgtaggatggtataacggtctgcccgaaaaccaggaactcgaaccggatctatcatgtgacactgcagtgatcctggggcaggggaatgttgctctagacgtggccaggatcttacttacacctcctgagcatctagagagaacggacataacaaaagctgctctgggcgtattaaggcaaagccgggttaagacagtctggctggtggggcgaagaggtccactgcaggtggcgtttacaatcaaggaacttagggagatgattcagttaccgggcgcgcggccaattcttgatcctgtcgattttctgggcctccaggataagattaaggaagtgcctcgccctcgcaaacgcctgaccgaactcttgttgaggaccgctacggaaaagcctggtcccgccgaagcagccagacaggcctcggccagcagggcatggggtctgaggttttttcgctctcctcaacaagttctccccagccctgatggacgtagggctgccggagttcgcctggctgtcacaagactggagggcgtcgatgaagctactcgggcagtgccaaccggagacatggaagacctgccttgtgggctggtgctgagcagcatcggatacaagagtagacctgtcgacccctcagtgccattcgactccaagctgggagtcatacccaacgtggaggggagggtcatggacgtgccaggattgtattgtagcggatgggttaaacgaggtcccacaggtgtgatagcaactacaatgaccgatagcttcttaacaggtcagatgctcctccaagacttgaaggcaggtcttctgccttctgggcccagacctggatacgcagctatccaggccctcctgtccagtagaggtgtgagacccgtctccttttccgactgggagaaactagacgctgaagaggttgctagaggacaaggaacagggaaacctcgtgagaagctagtcgatcctcaggagatgctgcgactgttaggccattag

SEQ ID NO: 116972 - DNA, 1881 bp, Artificial Sequence
  Description of Artificial Sequence: Synthetic coding sequence
atggctgtgagcggatttacattgggcacttgtatccttttgctccatatttcttacgtagccaattatcccaatgggaaagttacccaaagttgtcatggaatgattccagagcacgggcatagccctcagtcggttcctgtacacgacatctacgttagccaaatgactttccgaccaggcgaccaaatcgaagtgactttgtcgggacacccattcaagggattcttactcgaagcccgaaacgcagaagatctaaatggcccgccaattggttccttcacattgattgattcagaggtatctcagctactgacctgcgaggatatccaaggaagcgccgtctctcaccgttctgctagcaagaagacggagattaaagtgtattggaacgcaccctcaagcgctcctaatcacacacagtttctggtcacagtcgtcgagaagtacaaaatctattgggtgaagattcctggacccataatctcccaaccgaatgcattcccttttacaacacccaaagccactgttgtaccactccctactcttcctccagtgagccacttgaccaagccattcagcgcttcagattgtggaaataaaaagttttgtatccgtagcccactgaactgcgacccagagaaggaagcttcttgcgtgttcctttcctttacacgggacgatcagagcgtcatggtagagatgagcggcccctccaaagggtatctgagcttcgcactctcgcacgaccagtggatgggcgatgacgacgcatacctgtgtattcacgaagaccaaactgtgtacatacagccttcacacttgactggaaggtcccacccggtgatggactcgcgggatactctggaggatatggcttggagactggccgacggtgtgatgcaatgctcatttcgacggaacattaccctcccaggtgtgaaaaacagattcgacctgaacacctcttactacatttttttggcggacggtgccgctaatgacgggcgcatctataaacattcacagcagcccctaatcacgtatgaaaagtatgatgtgaccgattcccctaagaacatcggcgggtcccactcagtcctcctgcttaaagtacatggcgccctgatgtttgtggcctggatgaccaccgtgtctatcggcgtgttggtggcccggtttttcaaacccgtgtggagcaaagcctttctcctgggagaggcagcttggtttcaggttcacaggatgctgatgtttactacgacagtgctcacgtgcatcgcatttgttatgcctttcatctatcgcggaggttggtcccgacatgccggttatcacccatacctcggctgtatagttatgacgctggcagttctgcagcccctgctcgccgtgtttcgacccccgctgcacgaccccaggcgccagatgttcaactggacacattggagcatgggcaccgcagcccgaattattgccgttgccgcgatgttcttgggaatggacctgcccggattgaacctgcctgattcctggaagacctacgcaatgaccggcttcgtggcatggcacgtcggcacagaggtggtgctggaactgaaatattggatgatgaccgaatttagaagcttctcgcatttactccaatggaagcagcgtgtgatgctactcaagcgacagtgctggcagttcatgtccgtggggatgctgctgttcagctcttacttctatctgcagagcaccatatacgaacaggctaaaacccttgcatttgctggtcaggtaattataatcattaagcctaagaagctggaggcctgcccggactgtctagagcacatatgtgaattctccctggggaggctggggtcttgcctgtag

SEQ ID NO: 116973 - DNA, 1779 bp, Artificial Sequence
  Description of Artificial Sequence: Synthetic coding sequence
atggcggtctcaggcttcacgttaggcacctgtatccttctgctgcacatttcctatgtggctaattaccctaacggcaaagtgacccaatcatgccatgggatgattcctgaacacggtcattcacctcagtctgtccctgtgcacgatatatatgtttcccagatgactttcagacccggtgaccagatagaggttactctcagcgggcatccctttaagggttttctcctcgaggctcgtaatgccgaggacctgaacgggccgcctattgggtcgtttaccttgatcgatagcgaggtgtcccaactgttaacatgtgaggacatccagggttccgcagtttcacaccgcagtgcctcaaaaaaaacggaaatcaaagtgtattggaacgctccctcttccgccccgaaccacacccagttcttggtgacggtggttgagaaatacaagatctactgggttaagattccgggtccaattattagccaacctaacgccttcccctttaccacgccgaaagctactgtggtgcccctgcctacactgccgccggtgtctcacctaaccaagcccttcagcgcctctgattgcggcaataaaaagttttgcataagatcaccactgaactgcgacccggaaaaggaggcctcctgtgtgtttctgtctttcacacgggacgatcagagcgtgatggttgaaatgtctggcccgtcaaaagggtatctgtccttcgctctgtctcatgatcagtggatgggcgatgatgatgcttatctctgcatccacgaggatcagaccgtgtatattcagccttctcacttgaccggccgaagccaccctgtcatggacagtagggataccttggaagacatggcttggaggttagcagacggtgtgatgcagtgctctttcaggcgcaatataaccctgcctggtgtaaaaaatagattcgatctgaatacatcgtattatatcttcctggccgacggcgcagctaatgatgggagaatctataaacacagtcagcagccactcatcacatacgagaagtatgatgtaacggacagcccaaagaacatcggggggagccatagtgtgctactgcttaaagtgcacggtgctctcatgtttgttgcgtggatgacaaccgtctccatcggcgttttagttgctcggttcttcaagccggtgtggagtaaggcctttttgctcggcgaggccgcttggtttcaggtccacagaatgctgatgttcactactaccgtgcttacatgcattgccttcgtcatgccttttatctaccggggaggatggtctagacacgctggataccacccatacctaggctgcatagtcatgactctagctgtgttgcagcccctactcgccgtattccggcccccactccacgatcctcggaggcaaatgtttaattggacacactggagtatgggtacagctgcaagaatcatcgctgtcgcggcaatgttccttggcatggatctgcccggcctgaatcttcccgactcctggaagacctatgccatgaccggatttgttgcctggcacgtgggcacagaagtggtgttggaggtccatgcataccgtctctctcgcaaggtagaaattctggatgacgataggattcaaattttacagtccttcaccgccgtagagaccgaggggcatgccttcaagaaagccgtacttgccatctatgtctgtggcaatgttacgttcctgatcatcttcctgagtgccattaaccacctgtag

SEQ ID NO: 116974 - DNA, 729 bp, Artificial Sequence
  Description of Artificial Sequence: Synthetic coding sequence
atgctcagttgcttccgactgctgtcccgccacataagcccttctctggcctctctccgacccgttcgttgttgttttgcgctgcctctccgctgggcaccgggacgtccactggacccaagacaaattgccccccggagacctctggcagctgcagcctcctcgcgagatcccaccggacctgctgcagggcctagtagagtgagacagaatttccacccggactccgaagctgcaatcaatcggcaaattaacctcgagctgtacgcttcttacgtctacctgtcaatggcttattacttttcccgtgacgacgtggccttgaacaacttctctagatattttctgcatcagtcacgggaggagaccgaacacgcagaaaagctcatgaggttgcagaaccagcgtggaggccggatcaggctgcaagacatcaagaagccagagcaggacgactgggaatccgggctgcatgctatggagtgtgcgcttctcctggagaaaaatgttaaccaatcccttctagaattacacgctctcgcctcagacaaaggcgaccctcacctgtgcgattttctggaaacatattacttgaacgaacaggtgaaaagcatcaaggagttgggcgatcacgttcacaacctcgttaagatgggcgcacccgatgcaggattagccgagtatctgttcgatactcacacactgggtaatgagaataagcaaaactag

SEQ ID NO: 116975 - DNA, 552 bp, Artificial Sequence
  Description of Artificial Sequence: Synthetic coding sequence
atgacgacagcttccacgagccaagtccgtcagaattatcatcaagattctgaggcggctatcaaccgacagatcaacttagagctgtatgcttcatatgtttacctgagcatgtcttattatttcgatcgcgacgacgtggcgcttaagaattttgctaagtatttcctgcaccagagccatgaggaacgcgaacacgctgaaaaactgatgaaactacaaaatcagcgaggaggcaggatttttttgcaggacattaaaaagccagactgtgacgattgggagtcaggactaaacgccatggagtgtgccttgcatctcgagaaaaatgtgaaccagtccctcctggagctgcacaagttagctacagataagaacgatccgcacctgtgcgattttattgaaacgcattatcttaacgagcaggtcaaagccattaaagaattaggggaccacgtgactaatctgagaaaaatgggagccccggagtccggtctggcagaatatctgttcgacaaacatacgctgggcgattcggataatgagtcgtag

SEQ ID NO: 116976 - DNA, 699 bp, Artificial Sequence
  Description of Artificial Sequence: Synthetic coding sequence
agcggctttcccgctagcactgtactgggtcgcaatccggccctggtgccccacccaggacggcctcccatcgcttctccccccagccctctgcaccgcactctcgggctgcctcagggtccccggaggcttagcttggtcgccgccatgactactgccagcacctcacaggttaggcagaactatcatcaggattcagaggcggccatcaaccgacagatcaatctagaactgtacgcttcttacgtctacctgagcatgtcttattattttgatcgggatgacgtggcattgaaaaacttcgccaagtattttctgcatcaatctcacgaagagagagaacacgcagagaagctgatgaagctccagaaccagagaggcggccgcatctttctgcaggacatcaaaaagccagactgcgatgactgggagtccggcctcaatgccatggaatgtgccttgcatctcgagaagaacgtcaaccaatcccttctggaacttcataaactggctacagataagaatgacccacacctctgcgactttattgagacacactatctgaatgaacaggtgaaggccatcaaggaactcggcgaccatgtgactaatctgaggaaaatgggcgctcccgagtccggcctagcagagtatttattcgataaacacacacttggagatagcgataatgagagctag

SEQ ID NO: 116977 - DNA, 462 bp, Artificial Sequence
  Description of Artificial Sequence: Synthetic coding sequence
atgacgacggcttccactagccagtcttattattttgacagagacgatgtggccttgaagaacttcgcaaagtacttcctccaccagtctcacgaagaaagagagcacgccgagaagctgatgaagctgcagaatcagcgcggggggagaattttcctgcaggacatcaaaaagcctgactgtgacgactgggagtccgggctgaacgccatggaatgcgcacttcatctcgaaaagaacgtgaatcagagcttgctggagctgcacaaactcgctaccgataaaaacgatcctcacttatgtgatttcatcgagacccactatctgaacgagcaagtcaaagccattaaggagctgggagaccacgtgacaaaccttagaaagatgggtgcacctgaaagtgggctggctgagtacttgtttgacaaacataccctgggtgattctgacaatgaaagctag

SEQ ID NO: 116978 - DNA, 552 bp, Artificial Sequence
  Description of Artificial Sequence: Synthetic coding sequence
atggctactgctcagccctcacaggtgcggcagaagtacgacacaaactgcgacgccgcaatcaattcccacatcacactcgagctctatacgagctatctctatctgagcatggcattttacttcaaccgcgacgatgtcgctctcgaaaacttcttcagatactttctgcgcctatccgatgataaaatggagcatgcccagaagctgatgcgccttcagaatctgcgtggcggtcatatatgcctccatgacatccggaagcccgagtgccagggatgggaatccggtttagtagccatggagtccgcttttcatctcgagaaaaatgtcaaccagagcttactcgacctgtatcagctcgctgtagaaaaaggagaccctcagctgtgtcactttctcgagtcccactacctgcatgagcaggtgaagacaattaaggagctgggggggtatgtctcaaatttgcggaagatttgttcgcctgaagcgggtcttgctgaatatctatttgataaactgacactgggtgggcgcgtgaaggagacatag

SEQ ID NO: 116979 - DNA, 528 bp, Artificial Sequence
  Description of Artificial Sequence: Synthetic coding sequence
atgtcttcacaaattcggcagaattactctactgacgttgaggctgcagtcaacagcttggtcaacctgtacctgcaggctagctacacatatctgtctctaggtttttacttcgacagggatgatgtcgccttggaaggcgttagccatttttttagggagttagccgaggaaaagagagagggatatgagaggctgctgaagatgcagaatcagaggggagggcgggctctcttccaggacattaagaaaccagctgaagacgagtgggggaaaactcccgacgccatgaaggctgcaatggccctggagaagaagttgaaccaagccctcctggacctccacgctcttgggtccgccaggactgacccacatctgtgcgacttcctggagacccacttcctcgatgaagaggtcaagcttatcaagaaaatgggggatcacctcaccaatcttcatcgactgggaggccctgaagcgggtctcggcgaatatctgtttgagcggttaacattgaagcacgattag

SEQ ID NO: 116980 - DNA, 573 bp, Artificial Sequence
  Description of Artificial Sequence: Synthetic coding sequence
atgagctcgcagatccggcagaactattcaacagatgtggaagcggccgtcaactccctggtcaacctgtacctgcaagcttcttacacctatctgtccctgggtttctatttcgacagggacgacgtcgctttggagggcgttagccacttcttcagagagctcgcagaggaaaagagggaggggtacgagagacttttaaaaatgcagaaccaaaggggggggagagctctctttcaggatatcaagaaacccgcggaggatgagtggggcaagactcccgatgctatgaaggcagctatggccctggagaagaagctcaatcaggctctgctggatttacatgccctgggctcagctcgaacggacccccacttgtgtgatttcttagaaactcacttcctggacgaggaggtcaagctcatcaaaaaaatgggagatcatttgaccaacttgcaccgactcggaggaccagaagctggattgggagagtatctctccaagggttccctgagttcgaccacaaagtctttattatcacccgccacttccgaaggcccacttgcgaagtag

SEQ ID NO: 116981 - DNA, 1272 bp, Artificial Sequence
  Description of Artificial Sequence: Synthetic coding sequence
atgcggtcactgggtgccaatatggccgccgcactcagagccgccggcgtgctgctccgggaccctctagcttcttctagctggcgagtctgtcaaccctggaggtggaagtccggtgccgctgcagcagccgtgacaactgaaaccgctcagcacgcccagggagcaaagccgcaggtccagcctcaaaagagaaagccgaagaccgggattctcatgctaaatatgggcggacctgagaccttgggagacgtgcacgactttctacttcggctgtttctggatcgggacctgatgacccttcccattcagaacaagctcgccccgttcatcgcaaagaggcggactccgaagatccaagaacagtaccggagaattggcggggggtccccaattaagatttggacctccaaacagggagaaggaatggtgaaactgctggatgagctctctcctaacacagcaccccataagtattatattggtttcaggtacgttcatcccctgaccgaagaggccattgaggaaatggaaagggatggcctggagagagcaatcgcgttcacccagtaccctcagtatagttgcagtactaccgggagtagcctgaatgcgatctaccgttattacaatcaggtcgggaggaaaccgacaatgaagtggtccacaatcgaccgctggccaacgcaccatttgctcatccagtgtttcgctgaccatattctgaaagagctggaccactttcctctggagaaacgctccgaggttgtcatcctgttttctgcgcacagcctaccaatgtccgtggttaacaggggggatccgtacccccaggaggtcagtgccacagttcagaaggtgatggaacgcctggaatactgcaatccgtacaggctggtctggcagtccaaggtgggacccatgccctggctgggcccacagacagacgaaagtataaaggggctatgcgaacgcggccggaaaaacatcctgctcgtgcctatagccttcacgtctgaccatattgagacactatatgagctcgatatcgagtactcacaggtcttagcgaaggagtgcggggtcgagaatatccgtcgtgcagaatctttgaacggcaaccccctgttttcaaaagctcttgctgacctggttcattcacacattcagtcaaacgaactgtgtagcaagcagctgaccctgtcatgtcccttgtgtgtcaatcccgtttgtcgggagacaaagtccttcttcaccagtcagcagttgtag

SEQ ID NO: 116982 - DNA, 1290 bp, Artificial Sequence
  Description of Artificial Sequence: Synthetic coding sequence
atgcgcagcctcggtgccaatatggcggccgcgcttcgggctgctggcgtcctgcttcgagaccccctcgccagttcctcttggagagtgtgccaaccttggagatggaagagcggtgctgctgctgccgcagtgactacagaaactgcgcagcatgcacagggagctaagcctcaagtacagcctcagaaacggtatgaaagcaacattcgaaagcccaagacagggattttgatgcttaatatgggcggtcctgagaccctgggcgacgttcatgattttcttctgcggttatttcttgacagagacctgatgacactgcccatccagaataagctggcaccatttattgcaaagcggaggactcctaagatccaagagcagtacagaaggattggaggtggtagcccgatcaagatctggaccagcaagcaaggagagggaatggtcaaactcctggacgagctgagcccgaacacggcaccccataagtactacattgggtttcgctatgtccatcccctcaccgaagaggccatcgaagagatggagcgagacgggctggagagggcaatcgcatttacacagtacccacagtactcctgcagtaccaccggctcttctttgaacgccatataccgttactacaatcaggtcggaagaaagcccacaatgaagtggagcactatcgatcgatggcccacccaccaccttctgattcaatgctttgcggatcacattctaaaggagcttgaccacttcccgctcgagaagcgcagcgaggtggtgatcctctttagtgctcactccctgcctatgagcgtggtgaacaggggcgatccataccctcaagaagtgtccgcaacggtgcagaaggtgatggagaggctcgagtactgcaatccctaccgccttgtatggcagagcaaggtgggccctatgccttggctgggcccccagacggatgagtctattaagggcctatgcgagagggggcgaaaaaatatactgttggtgccgattgctttcaccagcgatcacatcgaaaccctgtatgaactggacatagagtactcacaagtgctcgcgaaagaatgtggggtggagaatatccgacgcgcggagtcactcaacgggaaccccctattttctaaggctctggcggatctcgttcacagccacattcagtcaaatgaattatgtagtaagcagctgaccctgtcctgcccattatgcgtgaaccccgtgtgtagggaaaccaaaagcttttttacttcccagcagctgtag

SEQ ID NO: 116983 - DNA, 1149 bp, Artificial Sequence
  Description of Artificial Sequence: Synthetic coding sequence
atgggtttgttactgcctctcgcattatgcatcttggtgctctgttgcggagccatgagtccaccacagctggcactgaatccctccgctctgttgtccagggggtgtaatgattctgacgtcttggctgtggccggtttcgctcttcgcgacatcaataaggatcggaaggatgggtatgtcctgaggctcaaccgtgtgaacgatgctcaggagtatcgtcggggaggccttggaagcctgttctacctcacactggacgtactcgaaaccgattgtcacgtgttgaggaagaaagcctggcaagactgcggcatgcgcatcttctttgaaagcgtgtatggacagtgcaaggccatcttttacatgaataacccatcacgcgtgttgtatctggcggcgtataactgtacactgcgtccagtgtctaaaaagaagatatacatgacctgtccagattgtcccagttctatacctacggactcttcgaaccatcaggtcctggaggctgccactgaatctttagctaagtacaataatgagaataccagcaaacagtactccttgttcaaagtcacacgtgccagcagccagtgggtcgtcggcccgtcttattttgttgagtatctgattaaggagtcaccatgcactaagagccaggctagtagctgctctttacagagcagtgattcagtgcctgtcgggttatgcaagggcagtctgaccaggacccattgggagaaattcgtctcagtcacgtgcgacttctttgaatcacaagctcccgccacgggatctgaaaatagcgctgttaatcaaaagccgactaatctgccaaaagtggaagagtcccagcagaaaaacacccccccaaccgactcacccagtaaggccgggccgcgcgggtctgttcagtatctcccggatctggacgataaaaactcccaggagaaaggccctcaggaagcctttccagtgcatctcgacctgaccaccaatcctcaaggagagactctggacatttcatttctctttctcgaacctatggaagagaaactcgtcgttttgcctttccccaaagagaaggcacgcacggctgagtgtcctggccctgctcagaatgccagcccgttggtgctgccaccgtag

SEQ ID NO: 116984 - DNA, 1149 bp, Artificial Sequence
  Description of Artificial Sequence: Synthetic coding sequence
atggggctgttattaccacttgctctgtgcattttagttctctgttgcggagccatgagcccccctcagcttgcactaaatccatcggccctgttgtcccgcggatgtaatgacagtgacgttcttgcagttgctggattcgcactacgcgacataaataaggaccgaaaggacggatacgtcctgcgactgaaccgcgttaacgacgctcaggagtatcgaagaggcggtttagggtcgctattttatcttacactggacgtcttggagaccgattgtcacgtcctgaggaagaaggcttggcaagactgcggaatgcgtattttcttcgaaagtgtttacggacaatgtaaggctatattctatatgaataacccctcgcgcgtactgtacttagcagcgtacaactgcaccctccgacctgtgtctaagaaaaaaatctatatgacttgccccgactgcccttccagcattccgacagattcatccaaccaccaggtactggaagcagcgacagaatctttggccaagtacaacaacgaaaatacctctaagcagtatagcttgttcaaggtgacacgcgcgagcagccaatgggtggtcggaccctcctattttgtggagtacctgattaaagagtccccttgtaccaagtcccaagcatcttcctgcagcctgcaatccagtgattcggtgcctgtgggcctctgtaagggctccctgacccggacacactgggagaagttcgtgtctgtgacatgcgacttcttcgagagccaggctcctgccacgggaagcgagaactctgctgtgaaccagaaacccacaaaccttccaaaggtggaggaaagccagcagaagaacacgccgcccacggactctcccagcaaggcaggaccccgcggtagtgttcagtacctccccgatctggacgacaaaaactcacaggagaagggaccccaggaggcctttcctgtacatctggatcttacaacaaatccacagggagagacgctggacataagtttcctttttttagaaccgatggaagaaaagctcgtagtcctccctttcccgaaggaaaaagcccgcacggccgaatgccccggccccgcccagaacgctagcccactggtgctacccccttag

SEQ ID NO: 116985 - DNA, 705 bp, Artificial Sequence
  Description of Artificial Sequence: Synthetic coding sequence
atgacatgcccggactgcccttcaagtatccccactgacagcagcaaccatcaggttctggaggcggccactgaaagcctggccaagtacaacaatgagaacacatctaaacagtactcactgttcaaagtcacgagggcatccagccagtgggtggtggggccctcctactttgtcgaatatcttatcaaggagtccccttgcaccaagtctcaagcctcttcgtgttcccttcagtctagcgacagcgtcccagtgggcctgtgcaagggtagtctgacgcgaacccactgggaaaagtttgtgagcgtcacatgcgatttcttcgagtctcaggctccagccaccggttcagagaattctgccgttaatcagaaacctacaaatctacctaaagtagaggagtcccagcaaaaaaatacccccccgacggacagccctagcaaagcgggaccccgaggaagcgtgcaatatttgcccgacttagacgacaaaaacagtcaggagaaggggccccaagaggcattcccagtgcacctcgacttgacaacaaaccctcaaggtgagaccttggacatttcttttctgtttctggaaccgatggaggagaaactggtggttttgccatttcctaaagaaaaagcgagaacagcagaatgcccaggacccgcccagaatgccagccctctcgtgttgccaccatag

SEQ ID NO: 116986 - DNA, 717 bp, Artificial Sequence
  Description of Artificial Sequence: Synthetic coding sequence
atgaggcaatcgggagctagtcagccactgctgatcaacatgtaccttcccgaccccgtgggagatggactctttaaggacggtaagaacccctcttggggcccactgtcccccgccgttcaaaagggatccggacagattcagctctggcagtttctgctggaactgttggcagatcgcgccaacgctgggtgtatagcttgggaaggaggacacggtgagttcaagttaaccgacccagacgaggtggccaggcgctggggggagcggaagtccaagcccaacatgaattatgataagttgagtcgcgccttacgatactattatgacaagaatattatgtccaaggtccacggcaagaggtatgcctaccggtttgatttccagggactggcccaagcatgtcagccccctccagcccacgcacatgccgcagcagccgcagcagcggcggccgctgccgctcaggatggcgccctttacaagctgcccgcaggactggcccccttgccttttcccggcctctcaaagcttaacctaatggctgcaagcgctggagtggcccccgcaggtttctcttattggcctggcccaggtcccgccgccaccgccgctgcagccacagccgctctctacccctctccaagtttacaaccccctcctgggccgttcggcgcagtggctgccgcaagtcatcttggcggtcactaccactag

SEQ ID NO: 116987 - DNA, 1416 bp, Artificial Sequence
  Description of Artificial Sequence: Synthetic coding sequence
atggatagctcttgccataatgcaacgaccaagatgctggccaccgcgcctgcaagaggtaatatgatgagtacctccaagcctctggcattttcaattgagaggattatggcacgaacaccagagcctaaagccctgcccgtgccacactttctccagggagcactgcccaagggagagcccaagcattctctccatctcaattctagtatcccatgcatgatcccattcgtgcctgtggcctacgatacttctccaaaggcgggggtgaccggaagcgagccgaggaaggcttccctagaagcccccgcagccccagcggctgtgcctagtgcccctgcgttctcatgttccgacctgttgaactgtgctctgtccctgaagggcgacctggcccgggatgctctgcccctccagcagtataagctcgtgaggccccgcgtggtgaaccacagctcgttccatgcgatgggggctctatgctatttgaaccgaggcgatgggccctgccaccccgcagcaggggtcaacatacatccagtggcaagttactttctgtccagccctcttcacccccagccaaagacctatttggccgagcgcaacaagctggttgtccccgctgtcgagaagtacccatcaggagtagcattcaaagatctctcccaggcgcaacttcagcattatatgaaagagtccgcccaactgctatccgaaaagattgcatttaaaactagcgacttctcccgtgggtcccctaacgccaaacccaaagttttcacatgtgaagttttcaatgcgcactacaacctgaccaggcatatgcccgtgcacactggggcgcgtccattcgtctgcaaagtgtgtggtaaaggttttcgacaggccagtaccttgtgtcgacacaagatcatacatactcaggaaaaaccgcataagtgtaaccagtgtggcaaggcctttaaccgcagctctaccttaaacacccataccaggattcacgccgggtacaagccttttgtttgcgagttctgtggcaaagggttccatcagaaaggcaactataaaaatcacaaactgacacactccggcgagaagcagtttaaatgtaatatttgtaacaaggcgttccaccaagtgtacaacctaaccttccatatgcatactcataatgacaagaagccatttacatgccccacctgcggcaagggcttctgccggaactttgaccttaaaaagcacgtaagaaagttgcacgacagctcattgggtctcgccagaactccagccggggagccaggtaccgagcccccacccccccttccacagcagcctccaatgactctgccacctctccaaccgccgctccctacccccgggccccttcagccagggctccatcagggtcaccaatag

SEQ ID NO: 116988 - DNA, 108 bp, Artificial Sequence
  Description of Artificial Sequence: Synthetic coding sequence
atggattcaagctgccataacgcgaccaccaaaatgctggcgacggcgcccgcccggggcaacatgatgagtacttccaagcccttggccttcagcatcgaaaggtag

SEQ ID NO: 116989 - DNA, 1278 bp, Artificial Sequence
  Description of Artificial Sequence: Synthetic coding sequence
atggactccagctgtcacaatgccaccacaaagatgcttgccacggcgccagctagagggaatatgatgagcacctctaagcctctggcgttttcaattgaacgcataatggcaaggacaccagagcctaaggcgctgcccgttccgcatttcctgcagggagcactccccaaaggcgaacccaagcactctctccaccttaactcaagcatcccatgcatgattccatttgttcccgtagcttacgacacatctccaaaagcgggagtgacgggatccgagcctcgcaaggcctcattggaggccccggccgccccagccgcagtacccagcgcccctgcattctcttgcagcgatctgctgaattgcgcgctttcccttaagggcgatcttgctagagatgctttacctctgcagcagtataagctgccaaaaacatatctggcggaacgcaacaagctggttgttcccgctgtggaaaaatatccttcaggcgtagcatttaaggacctttctcaggcacagttacagcattacatgaaagagtcagcgcaactgctatctgagaaaatcgcctttaagacaagcgacttctcaagaggaagccccaacgcaaagcctaaagtgtttacttgcgaggtctgtggcaaagtgttcaatgctcactataatcttaccaggcacatgcctgtgcatacaggagcgagaccgttcgtgtgcaaagtctgcgggaaggggttccgccaggcatccacgctttgcagacacaaaattattcatactcaggagaagcctcataagtgtaatcaatgtggaaaggctttcaacaggagctcgaccctcaacacccatactcggatccacgcgggatacaaaccctttgtgtgcgagttttgtggtaaggggttccaccagaagggtaactataaaaaccataagcttacacattctggcgagaagcagttcaagtgcaacatctgtaataaggccttccatcaggtatacaacctcacgtttcatatgcacacccataatgacaaaaagccgtttacgtgcccaacttgtggaaaaggattttgcaggaactttgacttgaagaagcacgttagaaagcttcatgacagctcgttgggcctggcccggactccagcaggtgagcctggtacagagcctccccctcccctgccacagcagccccctatgactcttcctcccttgcagcctccactgcctacccccgggccgctgcagcctggtctgcaccagggacatcaatag

SEQ ID NO: 116990 - DNA, 1428 bp, Artificial Sequence
  Description of Artificial Sequence: Synthetic coding sequence
atggacagtagttgtcataacgccacaaccaagatgctggcgactgctcctgcccggggcaacatgatgagcacttcaaaacctcttgccttttctatcgagaggattatggcccgtacacccgaaccaaaggccctgccggttccacatttcctgcagggagcactgcctaaaggggagccaaagcatagcttacacctgaattcttctatcccttgcatgataccctttgtccccgtcgcgtacgacacctccccgaaagctggggtcactgggtctgagcctcgcaaagcttccctggaagctcccgccgcacccgctgccgtcccgtcagctccagctttttcctgttctgatttgctcaattgcgccctaagcttaaaaggtgatctcgccagggacgcgcttccacttcaacagtacaaattggttagaccacgggtggtgaaccacagctccttccatgctatgggggctttatgttacctgaaccggggcgacggtccatgccaccccgcggccggagtcaacatccacccagtggcttcatacttcctgtctagccccctgcatccacagccaaagacctacctggccgagagaaataaactcgtcgtgccggccgtggagaagtacccgagcggagtcgctttcaaggacctctctcaggctcagctccagcactatatgaaggagtcagcacagctgctctcagagaaaatagcgttcaagacgtccgatttctcacgcgggtctcctaatgcaaagccaaaggtcttcacatgtgaggtctgcggaaaggtgtttaatgcccactataacctaactcgccacatgccagtccataccggagcacgtccatttgtatgtaaagtatgtggaaagggattccggcaggctagcacactttgtaggcacaagataatacacacccaggagaagccgcacaagtgcaaccaatgcgggaaggccttcaaccgtagctctacactcaacacgcacaccagaatccacgccggctataagccctttgtatgtgagttctgcggcaagggcttccatcagaagggcaactacaagaaccacaagctgacccattcaggtgagaaacaattcaaatgcaatatttgtaataaagcgttccatcaggtgtataatttaacttttcatatgcacactcataatgataagaagcccttcacctgtccgacctgcggaaaaggcttctgtagaaatttcgacctcaaaaagcacgtgcggaaacttcacgacagcagcttaggactcgccagaacaccggcaggcgagccaggcactgagccacccccgcccctgccccagcagcctcccatgacgctgccccctctgcagcccccacttccaacgcctggcccgctgcagccaggcctgcatcagggtcaccagtag

SEQ ID NO: 116991 - DNA, 1380 bp, Artificial Sequence
  Description of Artificial Sequence: Synthetic coding sequence
atggcatcatcagctagcctggagacgatggtcccgcccgcctgccctagagcaggagccagccccgcaacgagcaagaccctggctttcagcattgagcgcatcatggccaagacttctgaaccacgtgctccgtttgagccgaggccgggcgccttggaagccgatggatctcagggaaaaaagctactgaatttatgcagccccctgccctgcatgattcccctgcaaccacttggttatgaggttccttccaagacgcttctgagctattccgaactttggaagtcttcactccgcgctggaggcggcggcggcgggggcggcgggggaggtggcggcggcggcggggcacccgtatgtggtgcgagtggattatgcaagacgaactgcggtgtctgctgtaaggccgaattgggcctcgctccttccgcactcccagcgggaagggtgattaaaccgcaggtaatcaatcaggctgtggggctgccagcaagcgggtccctgtactatttcaactacctcgattcaaccgcttaccccccttcggaacttctctcaggccacttgtttccctctggactcctgaatgcccaggcaccggccgctctggccgcccatccgaagctgttcctgctcgaaaacgctaaattagcaggcctggcggcagataagttcccccaccccgccccctacccccacaaagaacgcctccctgcccccttagagcaagtcctgaaagagaattctgccctgaccgccgaacgtggaggggtgaagggacattccaagctgcctgggggatccgctgatgggaagccgaagaacttcacttgtgaagtttgtgggaaggtttttaatgcccactataacttaacaaggcacatgcccgttcataccggggcccgccctttcgtgtgtaaagtgtgcggcaagggatttcggcaggctagcactctctgtagacataaaataattcacacccaagagaaaccccataaatgcaatcagtgtgggaaggccttcaatagaagtagcaccctcaacacgcacatccgaatacatgctggatataaaccttttgtgtgtgagttctgcggaaaaggctttcaccagaaaggcaactacaaaaatcataaacttacccattccggagagaagcaatataaatgtaccatctgcaacaaggcatttcatcaagtgtacaatctgacctttcacatgcatactcacaatgataaaaaaccatttacatgtgctacgtgcggcaagggcttctgtagaaactttgacctcaagaagcacgtgaggaagctgcacgattctgtcggcccagcggccccaagcgctaaggacctgacccgtaccgttcagtcttag

SEQ ID NO: 116992 - DNA, 1380 bp, Artificial Sequence
  Description of Artificial Sequence: Synthetic coding sequence
atggccagctcagcctccctcgaaaccatggtccctccagcatgcccccgcgccggggctagcccagctacaagtaagacactcgccttcagtatcgagaggataatggccaagaccagcgaacccagagctccctttgagcctcggccgggagccctggaggccgatggcagtcaggggaaaaaactcctgaacctgtgttctccgttgccatgcatgattccacttcagcctctcggctacgaagtgccctcaaaaactttgctaagttactccgagctgtggaagagctcactgcgagctggcgggggagggggaggtgggggcggagggggtgggggtgggggcggtgcacctgtgtgtggtgcatcaggtctttgcaaaaccaactgtggcgtgtgttgcaaagctgaactggggctggctcctagcgctttgccggctggcagagtcataaagcctcaagtgattaaccaggccgtcgggttgcctgccagcgggtcactctactattttaactatctggactctaccgcttatcccccctctgaattgttgtctggccatctattcccaagtgggcttctgaacgcccaggcacccgctgcactagctgcacatcccaagctgtttctgttggaaaatgccaaactagcaggcctcgccgcggacaagtttccccatcctgctccttatccccataaggagcgcttgcccgcgcctctcgagcaagtgcttaaggagaactctgctttaaccgctgagcgtgggggcgtgaaaggccattccaaacttccgggaggatctgctgatggcaaaccaaaaaattttacttgcgaggtgtgcggaaaagtgtttaatgcccactataatctgacccgtcacatgcctgtgcataccggggcacgtccgtttgtgtgtaaagtgtgcggcaagggttttcgccaggctagcacattgtgtcggcacaagatcatccatacccaggagaagccgcacaagtgcaaccagtgtgggaaggcttttaacagatcatcaaccctaaacacacacatcagaatccatgcagggtacaaaccctttgtgtgcgagttttgtggcaaagggtttcaccaaaagggcaactataagaaccataaattgacacattccggagagaagcagtataagtgcaccatttgtaacaaagcctttcatcaagtgtataatctgacatttcatatgcacactcataatgacaagaagccttttacctgcgcaacatgcggtaaagggttctgtagaaatttcgatcttaagaaacacgtgcgaaaactccatgatagcgtcgggccggctgcaccttctgccaaggatctgactagaaccgttcagagttag

SEQ ID NO: 116993 - DNA, 1380 bp, Artificial Sequence
  Description of Artificial Sequence: Synthetic coding sequence
atggcgtcttccgccagtttagagaccatggtccctccagcctgtccccgagctggcgcctcgcccgccacctctaaaaccttggcattctccatcgaaagaatcatggcgaagactagtgagcctcgggctcctttcgaacctcgtccaggcgcccttgaggccgatgggtcgcaggggaaaaaactcctcaacctatgcagtcccctgccttgcatgatccctctccagccacttgggtatgaggttccttcaaagactctgctctcttacagtgaattgtggaaatcctcactacgggctggaggcggcggaggcgggggcggtgggggcggcggcggaggcgggggtgcaccagtctgtggcgcttctggcctgtgtaagactaactgcggggtgtgttgcaaagcggagctgggtcttgccccgtctgcacttccggcggggcgggtcatcaagccccaggtcattaaccaggctgttgggcttccggccagcggctcactatattattttaattaccttgacagtacggcctatccaccatccgaactactttccggacacctgtttccatccggactgctgaacgcccaggccccagcagccttggcagcacatcctaaactctttctgctggagaacgccaagttagcaggcttggccgccgacaaattcccgcatcccgcaccctaccctcacaaggagcggctgcccgctccactggagcaagtcctgaaagaaaattccgccctcacagccgaaaggggaggcgtaaaaggtcacagcaagctaccagggggatccgccgacgggaagcccaagaacttcacttgcgaggtgtgtggcaaggtgttcaacgcccattataatctaacccggcacatgcctgttcacactggggccagacctttcgtgtgtaaggtgtgcggcaaagggttccgtcaggcatcaaccttgtgccggcacaagatcatccatacccaggagaaaccacataagtgcaaccagtgcgggaaggcatttaataggagttccacattgaatactcacattcggattcatgctggctacaagcctttcgtatgcgagttctgtggaaagggatttcaccagaaaggtaattataagaatcacaagcttactcacagcggagagaaacagtacaagtgcaccatctgcaataaagcgttccatcaggtatacaacttgacgttccacatgcacacacacaacgacaagaagccatttacatgcgccacttgtgggaagggcttctgcaggaactttgatctcaagaaacacgtaagaaagctgcacgactccgtcggacccgccgcacccagtgccaaggatttgactcggactgtccaaagctag

SEQ ID NO: 116994 - DNA, 1140 bp, Artificial Sequence
  Description of Artificial Sequence: Synthetic coding sequence
atggctgccaccgccgccgcggtggtggccgaagaggacaccgaactgcgcgatttgcttgtacagacactcgagaatagcggtgttctgaacagaattaaggccgagctaagagccgccgtctttctggcccttgaagaacaggaaaaagtagagaacaaaactcctttggtgaacgaaagcctgaaaaagtttctgaacaccaaagatggacgtctcgtggcttctctggttgccgagtttctccagtttttcaacctagactttaccctggctgtttttcaacctgagacctcaactcttcagggcctcgagggacgagagaatctggctcgcgatctcggaattatagaggcggagggaacagttgggggacccctgcttttggaagtgatcaggcgttgccagcaaaaggagaaaggccccactacaggagagggagccttggatttgtctgacgtccatagccctcccaagtctcccgaaggcaagacaagcgcccagaccacccccagcaaaaaagccaacgacgaagcgaatcagtctgatacctccgtctcccttagcgagcctaaatccaagagctcgcttcatctgctgtcacatgagacgaaaattgggtcttttttaagcaatcggacccttgacgggaaagacaaagccggcctgtgtccggacgaggacgatatggaaggagacagtttctttgatgacccaatacctaagcccgaaaagacatatggacttaggaaggaaccccggaagcaggcaggtagtttagcaagcctgtccgacgccccccccctgaaatctggcctgagcagtttggctggagcaccgagcctgaaagacagtgagagtaagagaggaaacaccgttctgaaagacctgaaactcatctctgataagattggctcccttggcctgggaacaggggaagacgacgattatgttgacgattttaattccactagccaccgctctgaaaagtctgaaatttcgataggcgaggagatcgaggaggatctgtccgttgagatagatgatattaacaccagtgacaaactcgacgacctgacacaggatctgaccgtctctcagcttagtgatgtggccgactacctggaggacgtagcctag

SEQ ID NO: 116995 - DNA, 1200 bp, Artificial Sequence
  Description of Artificial Sequence: Synthetic coding sequence
atggcagccacagctgccgccgtcgtagctgaggaggataccgaactgcgggacctcctcgttcagactctggaaaactctggcgttctgaacaggattaaagccgagttacgggccgcagtcttcttagcactggaggaacaggagaaggttgaaaacaagactccactagttaacgagtcgttgaaaaagtttctgaataccaaagacggaaggctcgtggcttctttggtggcagagttcttgcagttctttaacctggacttcactctcgctgtgtttcagccggaaacctctactctgcaaggtcttgagggacgagaaaacctggcccgagacctcggaattattgaagccgaaggcaccgtgggggggccattgctgcttgaagtgatcagacgttgtcagcagaaagaaaagggccctactaccggcgaaggagcactggacctgagtgatgtccattccccccccaagtctcctgaagggaagactagcgcgcagaccactcctagtaagattcctagatacaagggacaagggaagaagaagacttccggacagaaggctggtgacaaaaaggcaaacgatgaagcgaatcagtccgatacgagcgtaagtctgtctgaaccgaagtctaagtcatccttgcatctactgtcccacgagacaaaaattggcagcttcctgagtaataggacactggacggaaaggataaagctggtctgtgccccgatgaggatgatatggaaggagacagctttttcgacgaccctattcctaagcccgaaaaaacatatggcttgcgaaaagaacctaggaagcaggccgggtcgttagcctctctcagtgacgcacctcccttgaaaagcggactcagcagcctcgccggggcaccaagcctcaaggacagtgagagtaagagaggcaacacagtcttaaaagatctcaaactaatttcggataagattgggtccctcgggctcggcacgggtgaagacgacgattatgttgacgattttaattctacgagtcatcgcagcgagaagagcgagatttccatcggtgaggagatcgaggaggacctctccgtggaaatcgatgacatcaacacttccgacaaactggacgatctgactcaggacctcaccgtttcacaactcagcgacgtagcagactatttagaggatgtagcttag

SEQ ID NO: 116996 - DNA, 1095 bp, Artificial Sequence
  Description of Artificial Sequence: Synthetic coding sequence
atggctgccactgccgctgcagttgtcgctgaagaagacaccgaacttcgagatttgctcgttcagaccctggaaaattccggagtgctcaatcgcattaaggcagaactccgggccgccgtattcttagcgctggaagagcaggaaaaggtcgagaataagactcctcttgttaatgaaagtctgaaaaagtttttaaatacaaaggacggccgcctggtggcttccctggtcgcggaattcctgcagttcttcaatctggactttacacttgcagtgtttcagcccgagacaagcactctccaaggcctggaggggcgggagaacctagctcgcgacctcggtattatcgaggctgagggaaccgtcggcggacccctgctcttggaggttataagacgttgccaacagaaggaaaagggtcctacaacaggggaaaaggctaacgacgaagctaaccaatcagacacttcagtttcactcagtgagccgaaatccaagtcctctctacatctgctcagccatgaaacaaagatcggatccttcttatctaaccgcacactcgacggcaaggacaaagcaggattgtgtcctgacgaagacgacatggagggtgatagcttctttgacgatcctataccaaaaccagagaagacttacgggctacggaaggagccgaggaagcaagcaggatccctggcttctctcagcgacgcacctcctcttaagagcggactctcaagcctggccggagcaccaagcctcaaagattctgagtcaaagaggggaaataccgtgctgaaagatctgaagctcataagtgacaaaatagggtcattgggcctaggaacaggcgaggacgacgactacgttgacgatttcaactccacatcccatagaagtgaaaagtccgaaatcagcattggtgaggagatcgaagaagatctttccgtggagatcgacgacataaatacctctgataagacaatcacccagctcgagtgtcttctgtcgatcggtgccctgcacttcaagaataccgccgacatctttaaagttatttttattctgctaaacaaaatcctgcctatttag

SEQ ID NO: 116997 - DNA, 420 bp, Artificial Sequence
  Description of Artificial Sequence: Synthetic coding sequence
atgtcatctctccccgtgccatacaagctgccagttagcctttcagttggctcctgcgttataataaagggtacaccaattcactccttcatcaacgatccgcagcttcaagtggatttctatactgacatggacgaagattccgatatcgccttccgcttcagagtccattttggaaatcacgtggtgatgaataggagggagttcggcatctggatgttggaggagactacagattacgtgcctttcgaggacggaaagcaatttgagctttgcatctacgtacattacaatgaatacgaaatcaaagtaaatgggattagaatctacgggttcgtccacagaattcctccatcttttgtcaagatggtacaagtttctcgtgatatatccctcacttccgtgtgtgtgtgtaactag

SEQ ID NO: 116998 - DNA, 8616 bp, Artificial Sequence
  Description of Artificial Sequence: Synthetic coding sequence
atgagacgaggacgactattagaaattgcactcggctttactgtgctgctggcctcctatactagccacggagctgatgcaaacctggaggcaggtaacgtaaaggaaaccagagcctctagagctaaacgcaggggaggagggggccacgatgcattgaagggtccaaatgtgtgtggtagtcgatacaatgcctactgttgccctgggtggaagacgttgcccggagggaaccagtgcatcgtgcccatctgcagacactcatgcggtgacggattttgctccaggcctaacatgtgtacctgcccctctggacagatcgcaccatcctgcgggtctaggagtatacagcactgtaatatcagatgcatgaatggaggaagttgcagtgacgatcattgcctctgtcaaaaggggtacatcggcactcactgtggacagccagtgtgtgagtctggctgtttgaacggcggccggtgcgtcgcacccaaccgatgtgcatgtacgtatgggtttacaggccctcagtgcgagcgcgattaccgaaccggaccctgctttactgtaataagcaatcagatgtgtcagggacagctgagcggcatagtctgtacaaagactctgtgctgtgctactgtcgggcgcgcttgggggcatccctgcgagatgtgccccgcacagccccatccttgtcgcagaggttttatcccgaacattcggaccggcgcttgtcaagacgtggacgagtgccaggccattcccgggctctgtcaaggcgggaactgcatcaacaccgtggggtctttcgagtgcaagtgtcctgcgggccataaactcaacgaggtgtcccaaaagtgcgaggacattgacgagtgctccactattcccgggatctgcgagggcggggagtgcaccaatacagtcagctcttacttctgcaaatgtccccctggcttttatacttcccccgacgggactcgttgcatcgatgtgcgccccggttattgctacacagcgctcacgaatggacggtgcagcaatcagctgccccagtcgattacaaagatgcagtgttgttgcgatgccgggaggtgctggagtccaggcgttactgtcgcccctgagatgtgccctatccgagccaccgaagactttaataaactctgtagtgtgcctatggtcatcccaggcaggccagagtaccccccaccacctctcggccccattcccccagtactgcctgtgcccccggggttccctccgggccctcagattcctgttccacgtccccccgttgaatatctttacccgtcccgcgagccaccacgggtgctcccagtgaacgtcactgattactgccagcttgtgcgctatctgtgccaaaatggacggtgtatacccactccggggtcttgccgatgtgaatgcaataagggatttcagttagatctccgtggagaatgcattgatgttgacgagtgcgaaaagaatccctgtgcgggtggagagtgcattaataatcaggggtcctatacctgtcaatgcagagctggttatcagtcaaccctcactagaaccgaatgcagggacattgacgagtgcctgcaaaatggacgcatctgtaataatggaaggtgcatcaatacagatgggtcttttcactgtgtttgcaacgccggcttccatgtcacccgagatggcaaaaactgcgaagatatggacgaatgttctattcgcaacatgtgtctgaatggcatgtgcataaacgaagacgggtcctttaaatgcatttgtaagccgggttttcagctggcatcagacggccgttattgtaaagacattaacgagtgtgagactcccggcatctgcatgaatgggcggtgcgtgaacaccgacggctcctatcgctgtgagtgctttccagggctcgccgtggggctagacgggcgagtctgcgtggatacacatatgcgatcgacttgttatggcgggtacaaacgaggtcaatgtatcaaaccgttatttggcgcagttaccaagagtgagtgttgttgcgccagtacagaatacgccttcggcgagccctgtcagccctgtcctgctcagaatagtgccgaataccaggctctgtgtagtagcgggcccggcatgacatctgcaggctcggatattaacgagtgtgccctcgaccccgacatctgcccaaatggaatatgcgaaaatctgcgagggacatataagtgcatatgcaacagtggatatgaggtcgactccacagggaagaattgtgtcgatattaatgaatgcgtgttgaactctttattatgcgacaatggacagtgcaggaatactccaggtagcttcgtgtgtacctgcccgaaaggcttcatctacaaacctgacctaaagacctgtgaggacattgacgagtgtgaatcgtccccgtgcataaatggagtgtgtaaaaattctcctgggtcctttatttgcgagtgttccagcgaatccacgctggacccaactaaaactatctgtattgagacaataaagggcacctgttggcagactgtgatcgacgggaggtgcgagattaacattaatggtgcaacccttaagtcccaatgttgcagctcactcggggccgcctggggcagcccttgtaccctgtgtcaggtggatcccatatgcggcaaaggctattcccgaattaagggaacccagtgtgaggacatcgatgagtgcgaggtttttcccggtgtctgtaagaatgggctgtgtgtgaatacaaggggcagtttcaagtgtcaatgtcctagtgggatgactttggatgcgacgggcaggatatgcctggatatccgactggagacttgtttccttcgctatgaggatgaagagtgcacgcttcccattgcggggcgtcatcgcatggacgcatgctgctgctcagtgggagccgcttggggtacggaggaatgtgaagagtgtcctatgaggaacacgccagaatacgaagagctttgcccacggggccccggattcgcgaccaaggaaattactaatggcaagccattcttcaaagacatcaacgagtgtaagatgatcccctctctgtgcacgcacggaaagtgccgaaatactatcggatcctttaagtgcagatgtgacagcggttttgctctcgactctgaggagcggaactgtacagatattgatgaatgtcgcataagcccagacctatgtggtaggggacagtgtgtcaatactcccggcgatttcgagtgcaagtgcgatgagggctatgaaagcgggtttatgatgatgaaaaattgcatggatattgatgaatgccagagggatccattactgtgtcgcggcggggtatgccataataccgaggggtcataccggtgtgagtgcccccccggacatcagctgtcaccgaatatatcagcatgcatcgacatcaatgagtgtgaactgagcgcccacttatgccctaacggaaggtgcgtaaatctcattggcaaataccagtgtgcttgcaatcctgggtaccacagcacaccagatagactgttttgtgtggatatcgatgaatgctcaatcatgaacggaggatgcgagacattttgtaccaattcagagggctcctatgaatgcagctgccagcccggcttcgcactgatgcccgaccagaggtcgtgtaccgacatcgatgaatgtgaggacaatccaaatatctgcgacgggggtcagtgcacgaacatccccggtgaatatagatgtctgtgttacgatggcttcatggcctcagaggacatgaagacttgcgtggatgttaacgagtgcgatctcaacccaaatatttgtttatcaggaacctgtgaaaacacaaaaggatctttcatctgccactgcgatatgggttatagcggaaaaaaaggaaagaccgggtgtaccgatattaacgagtgcgaaattggcgcccacaattgcggaaaacatgccgtgtgtacgaatacggctggttcttttaagtgctcttgttccccgggctggatcggcgatggaattaaatgtacggacctcgacgagtgctcaaatggcacacatatgtgctcacagcacgcagactgtaagaatacgatgggttcttatagatgcctctgcaaagagggctataccggtgacggatttacctgtactgacctcgacgaatgcagcgaaaacctgaacctgtgcgggaacggtcagtgcttaaatgctccaggcggatacaggtgcgagtgcgatatggggttcgttcctagcgccgatgggaaagcatgcgaagatatcgatgagtgtagtctacctaacatttgtgtgttcggtacttgtcacaatttgccggggttattcagatgtgaatgcgagataggttatgagttagatagatcagggggaaactgcaccgacgtcaatgaatgtttggatcccactacgtgtatctccggcaactgtgttaacactccaggctcatacatctgtgactgcccccctgacttcgaactgaatccaacgagagtcggctgcgtggacacgaggtctggaaattgttaccttgatatccgcccgaggggggataatggggacacagcctgtagcaacgagatcggcgtgggagtgtctaaggctagctgttgttgcagcctgggtaaagcctggggaacaccctgtgagatgtgccccgctgtgaatacctcggagtataagatcctgtgtcccggaggggagggtttcaggcccaatcctattacagtcattcttgaggatatcgatgagtgtcaggagttaccaggcctctgtcagggcggtaagtgtattaatacgtttggctcttttcaatgtcgctgcccaacgggatattatcttaatgaagacaccagagtatgcgatgatgttaatgaatgtgagaccccggggatttgcgggcctgggacttgttacaataccgtggggaactacacctgtatctgcccgcccgactacatgcaagttaacgggggcaataactgcatggacatgcgacggtccctttgctacaggaactattacgcggacaaccagacatgcgacggcgagctgctgttcaacatgacaaaaaaaatgtgctgttgctcgtacaatataggtcgcgcatggaataagccctgcgaacagtgccctatcccttcaacagatgagttcgcaaccttgtgtggctcccagcggccaggctttgtgatagatatctatacaggccttccggtagatattgatgaatgtcgcgagattcccggggtttgcgagaatggagtctgcatcaacatggttggctcatttaggtgtgagtgtcccgtgggcttcttctacaacgataagctgcttgtgtgtgaggacatagacgagtgccaaaacggacctgtgtgccaaagaaacgccgaatgcatcaataccgccggatcttaccggtgtgattgtaagccaggctacaggttcactagcacggggcagtgcaacgatcgcaatgagtgccaggagatccccaacatttgcagccatgggcagtgtatcgatactgtgggtagcttctactgtctttgccacactggattcaagaccaatgacgatcaaactatgtgtctcgacattaacgagtgcgagcgtgatgcatgtgggaacggtacgtgtaggaacactatcggatcctttaattgtaggtgtaaccatgggttcatcctttcccataataacgattgtattgacgtggacgagtgtgcctcaggtaatggtaacttgtgtaggaacggccagtgcattaacaccgtaggcagcttccagtgccagtgtaacgaaggctacgaggtcgctcccgatggcagaacgtgtgtggacattaatgagtgcttgctcgaaccccggaagtgcgccccaggaacttgccaaaacctggatgggtcttacagatgtatctgcccaccagggtactctctccagaacgaaaagtgcgaagatatcgacgaatgcgtggaggagccagaaatttgcgcactgggcacctgttccaacactgaaggcagctttaagtgcttgtgcccggaaggctttagtctcagctcctctgggcgacggtgtcaagatttgagaatgagttattgctacgctaagtttgaaggagggaagtgtagcagtcccaagtctcgcaaccattcaaaacaggagtgctgttgtgctctcaagggcgaaggatggggagacccatgtgagctttgccctacagaaccggacgaagcctttcgacagatctgtccttacggctccggtatcatagtcggccccgacgactcagctgtggatatggacgagtgtaaggaacctgatgtgtgcaaacatggccaatgtatcaatactgacgggtcttacaggtgcgagtgtccgttcggctacatcctagcagggaatgagtgtgtggacactgatgagtgtagcgtgggcaacccttgcgggaacggaacgtgtaagaatgtgattggtggatttgaatgcacttgcgaggagggcttcgagcctgggcctatgatgacttgcgaggacatcaacgaatgcgcacagaaccctctactgtgcgctttccgctgtgtgaatacatatggaagctacgagtgtaagtgtcccgtggggtatgtgctccgggaggacagaaggatgtgtaaggacgaggatgagtgtgaggaggggaaacatgactgcactgaaaagcaaatggaatgtaagaatcttatcggaacctacatgtgcatttgcggccctgggtaccagcgaagaccagacggcgagggctgcgtggatgaaaatgaatgccagaccaaacctggaatatgcgagaatgggaggtgcctgaacacccgaggttcctacacttgcgagtgtaacgatgggttcacagcgtcgccgaaccaggatgagtgcttggacaacagagaaggctattgtttcacagaggtcctgcagaacatgtgccagatcggctcgagtaatagaaacccagtgactaaatctgaatgttgctgtgacggaggtcgggggtggggacctcactgcgagatatgccctttccaaggtactgtcgcctttaagaaactttgtcctcacggccggggcttcatgactaatggggctgatatcgacgagtgcaaggtcattcacgacgtatgtaggaacggagaatgtgtgaatgatcggggttcatatcactgtatatgcaagaccggatacactcctgacatcacggggacatcatgtgtggacctgaatgaatgcaatcaggccccaaagccttgtaattttatatgcaagaacaccgaggggagttatcaatgttcctgtcctaagggctatatcctacaggaggatggccgaagttgtaaagacctagatgagtgcgccacaaagcagcataattgtcagttcctttgtgtgaacacgatcggggggtttacgtgcaagtgcccgccaggcttcacccagcatcatacaagctgtatcgacaacaatgagtgcacgagcgatatcaacctctgtggatctaagggtatctgtcagaacaccccgggcagcttcacatgcgagtgtcaacgggggttcagtcttgatcagacggggtccagctgtgaggacgttgatgagtgcgagggcaaccacaggtgccagcacggttgtcagaatatcattggcgggtacagatgctcctgcccccagggctacctgcagcattatcagtggaatcaatgcgtcgatgagaatgagtgcctttcagctcatatctgcggcggggccagctgccataataccctgggctcctacaagtgcatgtgtcctgccggcttccaatatgagcagttcagcggaggttgtcaggacattaacgaatgtgggagcgcccaggcaccctgttcctacggttgctccaacacagagggcggctacctctgtggatgtcctcccggctactttcgcattggtcaggggcactgtgtttcggggatggggatggggagaggtaacccggagcccccagtctcaggggagatggacgacaattccttgtcccctgaagcatgctatgaatgtaaaataaacgggtaccccaagcggggccggaaacgcaggtcaaccaatgaaaccgacgccagtaacatcgaagaccagagcgaaaccgaggccaacgtaagtctggccagctgggacgtggagaagaccgctatttttgcttttaatatttcccacgtttctaacaaagtgagaatcctggagctgctgccggcgttgactacattgactaatcataatcggtatctgatcgagtcaggcaacgaggacggtttttttaaaatcaaccagaaggaggggatcagttacctacactttaccaaaaagaagccagtggccgggacttattcactgcaaatctcaagcacccctctctataagaagaaggaactgaaccaactggaggacaagtatgacaaagactatttaagtggcgaactaggtgacaatctgaagatgaagatccaggtgttgctgcactag

SEQ ID NO: 116999 - DNA, 2958 bp, Artificial Sequence
  Description of Artificial Sequence: Synthetic coding sequence
atgggtttcgtcccttctgctgatggaaaggcctgcgaggacatagacgagtgctccctacctaacatttgcgttttcggcacctgccacaacctccccggactgtttcgatgcgaatgcgaaatagggtacgaactcgaccgatctggcggaaattgcactgatgttaatgagtgcctcgacccaacaacctgcatttccggtaactgtgtgaacactccaggtagctacatttgtgattgccctcccgattttgagctgaatcctactcgcgtgggatgcgttgacacgcgcagcggcaattgctacctggatatcagacctagaggagataatggtgatacagcctgcagtaatgagatcggagtgggtgttagtaaggcttcgtgttgttgctctctcggcaaggcctggggcaccccgtgcgagatgtgccctgccgtgaatacatcagaatataagatactctgcccagggggggagggattccgccccaatccaatcacagtcattttagaggacatcgacgagtgccaggaacttcctggcctgtgccagggagggaagtgtataaacacattcgggagctttcaatgccggtgcccgacgggttactatttgaacgaggacactcgggtgtgtgacgatgtaaatgagtgcgagacgcccggaatctgtgggcccggaacatgctacaacaccgtcggcaactacacctgcatttgtcccccagactacatgcaggtgaatggcggcaacaattgcatggacatgaggcgctccctgtgctatagaaattactacgccgataaccaaacctgtgatggcgaactgctgtttaacatgactaagaagatgtgctgctgtagttataacatcggaagagcgtggaacaagccctgtgagcagtgtccgataccttctactgatgagtttgcaacactgtgcggtagccagcgcccgggcttcgtcattgatatttacacagggctgccggtagacatcgatgagtgtagagaaatccccggggtgtgcgaaaatggtgtgtgcataaatatggtgggaagctttcgttgcgagtgtcccgtcggatttttttataacgacaagctgctcgtgtgcgaggacatcgatgagtgtcagaatggacctgtgtgtcagaggaacgctgaatgtatcaacactgcaggaagctaccggtgtgattgcaagcctggctaccgattcacatccaccggccagtgtaatgatcgaaacgaatgccaggaaattcccaacatctgcagtcacggccagtgcatcgataccgtggggtctttttactgtctgtgccacaccgggttcaagacgaacgacgatcagactatgtgtttggacataaatgagtgtgaacgagacgcatgcggtaacgggacttgtcgcaacactatcggttcctttaactgtaggtgcaaccacggcttcattcttagccacaacaatgattgtatcgatgtagacgagtgtgcatcaggaaacggcaatctttgtagaaacggccaatgcattaacacagtaggatccttccagtgccagtgtaatgaaggttatgaggtggctccggacggcagaacttgtgtcgacattaacgagtgcctattggaacctcgcaagtgcgcacccggcacttgccagaaccttgatggctcatatcggtgcatttgcccacctggatactccctgcagaacgaaaaatgtgaagatattgatgagtgcgttgaggagcccgaaatttgcgcattggggacatgctcaaataccgagggctcttttaaatgtctttgtccagaaggtttcagccttagcagctcaggcagaaggtgccaggaccttcgaatgagttattgctatgcgaagttcgagggagggaagtgcagctctcctaaatccagaaatcactcgaagcaggaatgctgctgtgcactgaagggcgaggggtggggtgatccttgcgagctgtgcccaaccgagcccgacgaagcctttaggcagatctgtccctatggctctggcatcatcgttggcccagacgattccgcagtggacatggacgaatgcaaagagcctgacgtctgtaagcacggccagtgtatcaatacagacggaagttaccgatgtgagtgtcccttcggctatattttggccgggaatgaatgtgtcgacacagacgaatgcagtgtagggaacccttgtggaaacggtacatgcaagaatgtgatcggaggcttcgaatgcacctgtgaagagggcttcgaacctggcccaatgatgacctgtgaggacataaacgaatgtgcacagaaccctctcctttgcgcatttaggtgcgtgaatacatatgggtcatatgaatgtaaatgtcccgtgggctacgtgctgcgggaggaccggcgtatgtgtaaggacgaggatgaatgcgaggaagggaagcacgactgtactgagaaacaaatggagtgtaagaacttaatcggcacttatatgtgcatctgcggcccaggttaccagcgccgcccagacggcgagggctgcgtcgatgagaacgaatgccagaccaaaccaggaatatgcgaaaacggtcgatgcctgaacaccaggggcagttacacatgtgaatgcaacgatggttttacagcaagtccgaaccaggatgaatgcttggatgtgatactctcgcttttgctcctgtcccccgcttttccctcctgcttcttcagtccaaggacgatagggaagggaaccgctagccagcgctgttataaaacctgcgtgaggagcgccccagcaaccgggaccccctcccccaacaggaacgctgcagtaaccgagggagaagccggagtgccgaccgtgcgttctgccttatctcgaggtctctggctctctcggaatagtgtgccaatggcagaagactcttag

SEQ ID NO: 117000 - DNA, 3450 bp, Artificial Sequence
  Description of Artificial Sequence: Synthetic coding sequence
atgaggagaggccggttgctggaaatagccctgggcttcactgttctgctcgcatcttatacatcccacggtgccgatgcaaatcttgaagcagggaacgtcaaggaaacccgtgcgagccgggccaagcgacggggtggtgggggccacgatgccttgaagggacccaacgtgtgcggctcccggtataatgcatactgttgccctggttggaaaacactgcctgggggcaaccagtgtattgttccgatctgtcggcattcttgtggcgacgggttctgttcaaggccgaacatgtgcacttgccccagtggtcagatcgctccatcctgtggatccagatccatccagcattgtaatatcaggtgcatgaatggaggttcctgcagcgatgatcactgcctttgccagaagggatacatcgggactcattgcggccagcctgtctgtgagagtggctgtctgaacggaggaagatgcgtggctccgaatcgatgcgcctgcacatatggattcactgggccccagtgcgaaagagattacaggactggaccctgctttacggtgatttccaaccagatgtgccagggacagctgtcgggcatagtatgtaccaaaacattatgctgcacatacattaatgaatgcgaaataggagctcacaattgtggcaaacatgctgtatgcaccaacaccgctggctcttttaaatgttcgtgttctcctggatggatcggcgatggaatcaaatgcactgacctagacgaatgttcaaacggcacccacatgtgttctcagcatgcagactgcaagaatacaatgggctcttacagatgcctgtgcaaagaaggatacactggggacggtttcacatgtaccgacttggatgaatgctctgaaaatctgaacctgtgcggcaatggacaatgcctgaatgctcctggcggttacagatgcgaatgtgatatgggctttgtcccttcagccgatggtaaggcctgtgaggacatcgacgagtgctccctgccgaatatctgcgtgttcgggacctgccacaatttacctggcctattccgttgcgagtgtgaaattggatatgagctagatcgttctggaggaaattgtactgacgtgaacgagtgtctggaccccactacctgcataagtgggaattgcgtgaacacaccaggatcatacatttgtgactgcccccctgattttgaacttaaccctactcgcgtcggatgtgtggatacccggtccggcaattgttatctcgacatacgccctagaggcgacaacggtgataccgcctgctctaacgagattggcgtgggagtgtcaaaggcctcctgctgctgttctcttggtaaagcttggggcaccccctgtgagatgtgcccggcagttaacacgtctgaatacaaaattctctgtccggggggggagggttttcgccctaaccctattacggttatcctggaggacatcgatgaatgtcaagaattgcctggactatgtcaaggcggcaaatgtatcaacacctttggctccttccagtgccggtgtcccacaggctattacctgaacgaggacacccgcgtgtgcgacgatgtgaacgagtgcgagacccctgggatttgtggtccaggaacgtgctataatacggtggggaactacacctgtatatgtccacctgattacatgcaggtgaatggaggcaataactgtatggacatgcggcggagcttatgttatcgcaattactatgcggacaaccaaacatgtgacggtgagctgctgtttaacatgaccaagaagatgtgttgctgctcctataacatcggccgcgcatggaacaaaccatgcgagcaatgtccaattccgtccaccgacgaattcgccactttgtgtgggtcccaacggccaggctttgtaatcgacatctacactggcctccccgtggatatcgatgaatgtcgggagatcccaggtgtatgtgagaacggcgtgtgcattaatatggtggggagcttccgctgtgaatgcccagtgggcttcttctacaatgataagcttctcgtgtgtgaagatattgacgagtgtcagaatggtcccgtttgccagagaaacgccgagtgtattaatactgcgggcagctaccggtgcgattgcaagccagggtacagatttaccagcactgggcagtgtaacgacaggaacgagtgccaggaaatccctaacatttgcagtcatggccagtgcatcgataccgtcggatcattttactgtctctgccacactggattcaagaccaatgacgaccaaaccatgtgccttgacattaatgagtgtgaacgtgatgcttgcggtaatggaacttgcagaaacacgatagggagctttaactgcagatgcaaccacgggttcatcttgagccacaacaacgactgcatcgacgttgatgaatgcgcttcaggtaatggcaacctgtgccggaatgggcagtgcattaataccgtgggctccttccaatgtcagtgcaacgaaggctatgaggtcgcacccgacggaagaacatgtgtggacattaacgaatgcctgctggagcctcgtaagtgcgcccccgggacttgtcaaaatctggacggctcatatcgctgtatttgcccaccagggtattcactgcagaatgaaaagtgtgaggacattgacgagtgtgttgaagagcctgaaatatgtgcattgggcacctgctccaatactgaaggatccttcaaatgtctatgcccagaaggtttctccctttctagctcagggaggcggtgccaggatctcaggatgtcttattgttacgcaaagttcgaagggggcaagtgctctagccctaagtctagaaatcattcaaagcaggagtgttgctgcgcgctcaaaggagagggctggggggacccctgcgagctctgccccacagaacccgatgaagccttccgacaaatttgcccttacgggagcggtatcattgtgggtcctgacgactccgcggtcgacatggacgaatgcaaggaacctgatgtgtgtaagcacggccagtgtattaacacagacggatcatacagatgcgaatgtccgtttgggtacatactcgcggggaatgagtgtgtggataccgacgagtgttctgtcggaaacccgtgtgggaatggcacgtgtaagaatgtgattggaggcttcgagtgtacctgcgaggaggggtttgaacctggaccaatgatgacctgcgaagacatcaatgagtgcgctcagaaccccttgctatgtgcgttcaggtgtgtcaacacttatgggtcttatgagtgtaaatgcccagtgggctatgtgctgcgtgaagatcggcgcatgtgtaaggatgaagacgaatgcgaagagggcaagcatgactgtacctag

SEQ ID NO: 117001 - DNA, 8739 bp, Artificial Sequence
  Description of Artificial Sequence: Synthetic coding sequence
atgggacgacgtaggcgtctctgcctgcagctttattttctctggttgggctgcgtcgtcctctgggcacagggtacagccgggcagccccaacctccccccccaaagcccccacgccctcagccccctcctcaacaggttagaagcgcaacagccggatccgaagggggctttctggcacctgagtaccgagaggaaggagctgccgtggcatcaagggtgcggcggcgcggacagcaggacgtgttacgaggaccgaacgtgtgtggctctcggttccacagttactgttgtcctggttggaagaccctcccaggcggcaaccagtgcatcgtccctatctgtagaaactcctgcggggatgggttttgcagccgtcctaacatgtgtacctgtagctccggacagattagctctacgtgcggctcaaagtctatccagcagtgtagcgtccggtgcatgaacggtggcacctgtgccgatgatcattgtcagtgccagaaaggctacatcggcacatattgcgggcagcccgtttgtgagaatggctgccaaaatggaggaaggtgtatcggaccgaaccgctgtgcctgcgtgtacggctttactgggcctcaatgtgaacgtgattaccgcacaggaccctgctttacccaggtgaataatcagatgtgccagggacaactcaccggcatcgtgtgcactaagaccctgtgttgcgcgacaatcggccgcgcttggggccatccatgtgaaatgtgccccgcacagcctcaaccctgccgtcgaggcttcattccaaatatacggacaggtgcctgccaggacgtggacgaatgtcaggctatacctgggatatgccagggtggcaactgtataaacaccgtgggctctttcgagtgccggtgcccggctgggcacaagcagtcggagacaactcaaaagtgtgaggacatcgacgagtgctccatcatcccgggcatttgtgagactggagaatgcagcaacactgtgggttcatatttctgcgtttgccctagagggtacgtcacctctaccgacggcagccgttgtatcgaccagcggactggaatgtgtttctccggtttagtaaatggcaggtgcgcgcaggaactaccaggaagaatgactaaaatgcagtgttgctgcgagccaggacggtgctggggcattggaactatacccgaggcctgtcctgtccgaggttctgaagaatatcgtcgcctctgtatggatggacttccaatgggtggaatccccgggagcgccggaagccgccctgggggaacagggggtaatgggtttgcaccttctgggaatgggaacggatacggccccggcggaacagggttcatacctattcccggcggaaacggtttttccccgggcgtgggaggagcaggagtgggtgcaggcggacagggtcccattatcacgggcttgacaatactgaatcagacgatagacatttgtaaacatcacgcgaacctctgtttaaacggcagatgtattcctacagtgagctcgtaccgttgtgagtgtaacatgggatataagcaggatgcgaacggtgactgtattgacgtggacgaatgcacgagcaacccttgcaccaatggcgattgtgtgaatacacctgggagctactactgcaagtgtcatgccggcttccagagaacccccacaaagcaggcttgtatcgacatagatgagtgcatacagaacggcgttctgtgtaaaaatgggcgatgtgtgaatactgacggaagcttccagtgcatctgtaatgccgggtttgagcttactactgacggcaagaattgcgtcgaccatgacgagtgcacaacgacaaacatgtgtctgaacggtatgtgcattaatgaagatggcagctttaagtgcatctgcaagccaggcttcgtgctggccccgaacgggcggtactgtactgacgtggacgaatgccagacaccagggatctgcatgaacgggcactgtattaactccgaggggagtttccggtgcgactgtccccccgggctggctgtgggtatggacggaagagtgtgcgtcgatacccacatgcggtctacgtgctatggcggcattaagaagggcgtttgtgtccgcccgtttcctggagctgtgaccaaatccgagtgctgctgtgcaaatccagactacgggtttggggaaccatgccagccctgtcccgcaaaaaatagcgccgaattccacgggctgtgctcctccggtgtgggcataaccgtggacgggagagatattaatgagtgtgcgctagatcccgacatctgcgcaaacggaatttgtgagaacctccggggaagctaccgttgcaattgcaacagcggctatgagccagacgcgtccggtcggaactgtatcgacattgacgaatgtcttgttaaccgcctcctgtgtgataatggcctgtgccgaaatactcccggatcctacagttgcacatgcccgcccgggtatgtgttcagaacggagaccgaaacctgtgaagacattaacgaatgtgagtcgaatccctgcgtgaatggcgcatgccgcaataacctgggtagcttcaactgcgaatgcagtcccggctctaaactatccagtactgggctaatctgtattgactcattgaagggaacctgctggttgaacatccaagatagccggtgcgaagtaaatataaacggggctactttgaaaagcgagtgttgtgcaactttgggtgcagcctggggttccccttgtgaacgttgtgagctcgacacggcttgtccgcgggggctggcccgaataaagggcgtgacctgtgaagatgtgaatgaatgcgaagtctttcccggcgtgtgcccaaacggccgctgcgtcaacagtaagggaagctttcactgcgagtgccccgagggtctaacacttgacggcacgggccgggtatgtctagacatcaggatggaacagtgctatctgaagtgggacgaggacgaatgcatccatcctgtgcccggaaagtttaggatggatgcttgttgctgtgctgtgggcgccgcttggggcacagagtgcgaggagtgcccaaaaccaggcaccaaggagtacgagacgttatgtcctaggggtgcaggatttgctaaccggggtgatgtacttactgggcgtcctttctataaggacattaatgagtgcaaggcgtttccagggatgtgtacttatggcaagtgtcgcaacactatcggtagcttcaaatgcagatgcaatagtggtttcgctctggatatggaggagcggaattgtacagatattgatgagtgtaggatctcccctgatttgtgcggtagcggaatctgcgtgaatacccctggctctttcgagtgcgaatgcttcgaggggtatgagagcgggttcatgatgatgaagaactgtatggatattgacgaatgtgagagaaacccacttctgtgccgaggtgggacctgtgtaaataccgaagggtcctttcagtgcgactgccctctggggcatgaactcagtcctagtcgcgaagactgcgtagacattaatgagtgtagcctcagcgacaacttgtgtaggaacggcaagtgcgtgaacatgattgggacgtatcagtgtagctgtaatcccggttaccaagccactcctgaccgccagggttgcactgacatagacgaatgcatgatcatgaacggaggatgcgacactcaatgcacaaatagcgagggatcctatgagtgttcatgcagtgaggggtatgccctgatgcctgacggtaggtcctgtgccgacattgatgagtgcgagaataatcctgacatctgcgatggcggccagtgcaccaatattcctggcgagtacaggtgtctgtgttacgatggctttatggctagtatggatatgaaaacttgcatcgacgtgaacgaatgcgatctgaattccaatatttgtatgttcggagagtgtgagaacacaaagggaagcttcatctgtcattgtcagctgggttactcagtgaagaaaggcaccaccggctgcactgatgttgatgagtgtgagatcggagcccacaactgtgatatgcacgccagttgcctcaacataccgggctcgtttaagtgctcttgcagagagggatggattggcaacggtatcaaatgtatcgatttggacgagtgtagcaatggaacacatcaatgctctataaacgcccagtgtgtgaacactcctggctcttaccggtgtgcctgttccgagggcttcactggagatggcttcacttgtagcgacgttgatgagtgcgctgagaacataaatttatgtgagaacgggcagtgccttaatgtccccggggcttataggtgcgagtgcgagatggggttcacgcccgcgagcgactccagatcttgccaagacattgatgagtgctcgtttcaaaacatctgtgtgttcggcacttgcaacaatcttcccggtatgtttcactgtatctgtgatgacggatatgagttagataggactggagggaattgcaccgacatcgacgaatgcgctgacccaatcaactgcgtgaacggcctgtgcgtgaacactcccgggaggtacgagtgtaactgtccacctgacttccagctgaatcccactggcgtgggttgtgtcgacaaccgcgttgggaactgctacctgaagttcggcccgaggggagatggatcactctcttgtaacacggaaattggggttggggtatctcggagctcgtgctgttgcagcctgggaaaggcatgggggaatccctgcgagacatgcccaccagttaatagcaccgagtattatacattgtgcccaggtggagagggcttccggccaaatccgatcaccatcatcttagaagacatagatgagtgccaagaactgccagggttgtgtcagggaggtaattgtatcaacaccttcggtagtttccagtgtgagtgcccgcagggatattaccttagtgaagacacgcggatttgtgaggatatcgatgagtgcttcgctcatcccggagtttgcgggccaggcacctgttacaatacactcggcaattacacctgcatctgcccccctgaatacatgcaggttaacggggggcacaactgcatggacatgagaaagagtttctgttaccggtcctacaacgggacgacttgcgaaaacgagcttccattcaatgtgaccaagcgtatgtgctgctgtacctacaatgttggaaaggcttggaacaagccttgcgaaccttgtcccactcctgggactgctgactttaagacgatttgcgggaatatcccgggattcacctttgatatccatactgggaaggccgtggatatcgatgaatgtaaagaaattcctggaatctgcgcaaatggtgtttgtatcaaccagattggtagctttcgatgcgagtgccccactggattttcttataatgatttactcctggtttgtgaggacatcgatgagtgctctaatggagataatctctgccagcggaatgcagactgcatcaattccccaggttcgtacagatgtgagtgtgctgccggctttaaactgtctcccaacggagcctgtgtggacaggaacgagtgcctggagattcccaatgtctgttcccatggcttatgcgtcgatctgcaaggttcataccagtgtatctgccataacgggtttaaagcaagccaagatcagacaatgtgcatggatgttgacgagtgcgagcggcacccctgcgggaatggcacatgtaagaacactgttgggagctataactgcttatgctaccccggctttgagcttactcacaataatgattgtctggatatcgacgaatgctcctcattcttcggccaagtgtgtcggaatggccgctgctttaatgaaattggaagctttaagtgcctgtgtaatgagggatatgagctcacccccgatggaaagaattgtattgataccaacgagtgcgtggcactaccaggctcctgctcaccaggaacttgtcagaatcttgaggggtcattccggtgtatctgcccccccggatatgaggtgaagtctgaaaactgtatagacatcaacgaatgtgacgaagatcccaatatctgtttattcggctcctgcacaaacacacctggtggatttcaatgcctctgcccacccggctttgtgctctccgacaacgggcgcagatgttttgatacccgccagagcttctgtttcaccaacttcgaaaatggcaaatgttcagttcctaaggccttcaacactactaaggcaaagtgctgttgctcgaaaatgcccggcgaaggatggggtgatccctgtgaactgtgtccaaaggatgacgaggtagctttccaggatctctgcccatacggccacggcacagtcccatccttgcatgacacgcgggaggatgtcaatgaatgccttgagtcccccggaatctgctccaacgggcaatgtatcaataccgatggctccttcagatgcgaatgccctatgggatataaccttgattacaccggcgtgaggtgcgtagatactgacgagtgtagtattggcaacccatgtggtaatggtacctgcaccaacgttatcgggtctttcgagtgtaattgtaacgagggatttgagcctggaccgatgatgaactgcgaagacatcaacgagtgcgctcagaacccattgttgtgcgcattccgctgcatgaatacattcggaagctatgagtgcacttgcccgattggttatgccctccgagaggaccagaagatgtgtaaggacctggacgagtgtgcggagggcttgcatgattgcgaatcccggggaatgatgtgtaagaatctgattggtacattcatgtgtatctgccccccaggcatggcgcgacgacccgacggagagggctgcgtagatgagaatgaatgtcgaaccaagccaggtatttgtgaaaatggcagatgcgttaatatcatcggctcgtatagatgcgaatgtaacgaaggcttccaatcctcatcaagcgggactgagtgcctggacaatcgtcagggtttgtgtttcgctgaagtgctccagactatttgtcagatggcgagcagcagccggaacctggtcacaaagagtgaatgctgttgtgatgggggtcgtggatggggacaccaatgcgaactttgccccctcccgggtaccgcacagtacaagaaaatatgccctcatgggcctgggtacaccacagacgggagagatatcgacgagtgcaaggtcatgcccaatctgtgcacaaatggtcagtgtatcaacaccatgggaagcttccgctgcttctgtaaagtcgggtatactaccgatatttcaggaacatcatgtattgatttggatgagtgctcccaatctcctaaaccgtgcaactatatctgtaaaaacacagagggatcttatcagtgttcttgtcctcgcggctacgtgttgcaggaggatggaaagacttgtaaggacctggatgaatgccaaactaagcagcacaattgccagttcctgtgtgtgaataccttaggggggttcacgtgcaaatgccctccaggattcacacagcaccacaccgcatgcattgataacaacgagtgcggatcccaaccatcgctttgcggggccaagggaatctgccagaatacgcccggcagcttctcatgtgagtgtcagagaggcttttcgctggatgccactggcctcaactgcgaggacgtggatgaatgtgatgggaatcataggtgccaacacggctgtcagaatatccttggaggctaccgatgcggttgccctcagggatatatccagcactaccagtggaatcagtgtgtggacgaaaatgagtgtagtaacccaaatgcctgcggctctgcatcctgctataatacactgggttcttacaagtgcgcttgtccctcgggctttagcttcgatcagttttcttccgcctgccacgatgttaacgagtgcagctcctccaaaaacccctgcaattacggatgtagtaacacagagggagggtacttgtgcggctgtcctcccggttattatagggtagggcaaggccactgtgtctccggtatgggtttcaataaagggcaatatcttagcctcgatacagaagtagatgaggagaatgctctgtctccagaggcttgctatgaatgtaaaatcaacggttactccaagaaggattctcgacaaaaaagaagcattcacgaacctgatcccactgctgtcgaacagattagtctggaatccgtggacatggacagccctgtgaacatgaagttcaacctttctcaccttggttcaaaggagcatatactcgagctccgtcctgccattcagcctctaaataatcacattaggtatgttatttcccaagggaatgatgacagtgtgttccgcatccatcagcggaacggtctttcttacctgcacacagctaaaaaaaagctgatgcctgggacctacaccctcgagatcacctctatcccactgtacaaaaaaaaggagctaaaaaaattagaagagagcaatgaagatgattatcttcttggcgagctgggagaagcacttcggatgcggctacagatccagctgtattag

SEQ ID NO: 117002 - DNA, 8739 bp, Artificial Sequence
  Description of Artificial Sequence: Synthetic coding sequence
atgggacggagaaggcgcctgtgtttgcaactgtactttctatggctgggctgtgtggtgctatgggctcagggaactgctggacagccacagcccccgcccccgaaaccgccacgaccccagcccccaccccagcaggtacggagtgctaccgcgggcagcgaaggtggctttttagcccctgaataccgggaggagggggccgccgtggcctcaagggtgcgcaggcggggtcagcaggacgtcctgcgaggccccaatgtgtgtggaagcagattccacagctattgctgtcctggatggaaaaccctgcctgggggaaaccagtgtatagtccctatttgcagaaactcttgtggggacggcttctgttctagaccaaatatgtgtacgtgctcaagtggccaaatatctagcacatgcgggtctaaaagtatccagcaatgttctgttcgatgtatgaacggagggacttgtgcagacgatcattgccaatgccagaagggctacattggaacttactgtggccagccggtctgtgagaacggctgtcagaacgggggccgctgcatcggcccaaataggtgcgcatgcgtgtacggattcaccggcccccagtgcgagcgggactatcggaccggcccctgttttacccaggtaaacaaccaaatgtgtcagggccagctgaccgggatagtttgcaccaagacactgtgttgcgcaactatcggccgcgcttgggggcatccctgcgaaatgtgtccggctcaaccccagccctgtcgcagagggttcattccaaatatccgaaccggggcctgccaagacgttgatgagtgtcaggccatccccggaatttgccagggcggaaactgtattaatacggttggaagcttcgagtgcagatgtccagccgggcataagcaaagcgaaacaacacagaaatgtgaggatatcgatgagtgtagtatcattcctggcatctgtgaaactggagaatgttctaataccgtcggcagctatttctgtgtatgccctcggggctacgtaaccagcactgacgggtcacgctgcattgatcagcggactggaatgtgtttcagtggcctcgtgaatggccggtgcgcgcaggaattgccaggccggatgaccaagatgcagtgttgctgcgagccaggccggtgctggggcatcgggaccatccccgaagcatgtccggtgaggggcagtgaggaatacagacgtctgtgcatggatggcctcccaatggggggaatccccggtagtgcaggcagtcggcccggaggcaccggcgggaacgggtttgccccttcagggaatggaaacggatatggacccggagggaccggttttattccaattccaggaggaaacggatttagcccgggcgttggtggggctggtgtgggcgctggcggccagggcccaataattacagggctgactattcttaaccagacaattgacatttgtaaacaccacgcaaacttatgtttgaatggccgttgcatacctactgtgtcgagttacaggtgtgagtgcaacatgggatataaacaggatgccaatggagactgtattgacgtggatgagtgtacatcaaacccttgcacgaatggggactgcgtgaatacacctgggagctattattgcaaatgtcatgcggggttccaaagaacaccgaccaagcaagcatgcattgacatcgatgaatgtatccagaatggcgttctctgcaagaacggacgctgcgtgaacaccgacggctcttttcagtgcatttgcaatgccggctttgagcttactactgatggcaagaactgtgttgaccatgatgagtgtactactacgaatatgtgcctgaatgggatgtgcattaatgaggatggcagcttcaagtgtatctgtaagcccggatttgtcctcgccccaaatggtaggtactgtactgatgtcgacgaatgtcagaccccaggaatctgtatgaatggacattgtatcaattcggaaggctcatttcgctgtgattgtcctcccgggctagccgtggggatggatggacgcgtttgtgtggacacgcacatgaggtctacctgttacggcggcatcaagaagggggtctgcgtgcgccccttcccaggagccgtgacgaagagtgagtgctgttgcgctaatccagactatggctttggggaaccatgccagccatgcccagctaaaaactccgccgaattccacggcttatgttccagtggagtcggcattaccgtagacgggcgggatatcaacgaatgcgccctcgaccccgacatctgcgccaacggtatctgtgaaaacctaagagggagctaccgttgtaactgcaactccggttatgagccagatgcatctgggcgaaactgtatagatatcgatgagtgccttgtgaatcggctgctctgcgataatggactgtgccgtaatactcccgggagctattcttgtacatgtcctcccggatacgtcttccgaacagagacagaaacctgtgaagatatcaacgagtgcgaaagcaatccctgcgttaatggcgcctgccgcaataatctcggcagtttcaattgtgagtgctccccaggtagcaagctgtcctccacgggattgatatgcattgactcccttaaggggacctgctggctgaatatccaagacagtaggtgtgaagttaatatcaatggtgccaccctgaagtccgagtgctgtgccaccttaggcgcggcatgggggtctccttgcgagaggtgtgagcttgacaccgcctgcccccgtggcctggctcggatcaagggcgtgacctgcgaagatgtgaacgaatgtgaagtgtttccgggcgtttgtcctaacggacgctgtgtaaattctaagggctcctttcactgtgagtgcccagagggtctgactctggacggcactggcagagtgtgtctcgacatacgaatggagcagtgttatttgaagtgggacgaagacgaatgtatacaccccgtgccgggcaaatttaggatggacgcttgttgttgcgccgtaggagccgcctgggggaccgagtgtgaggagtgtcccaagcccggcacaaaagaatatgaaaccttgtgccccagaggagccggttttgcaaaccgaggggatgtcctcaccgggcgccctttctacaaggacattaacgaatgcaaagcatttcctgggatgtgtacctatgggaagtgccgcaacactattgggtcctttaagtgccggtgtaacagcggattcgcactggacatggaagagagaaattgcactgacatcgacgaatgtagaattagtccggatttgtgtggaagcgggatttgcgtcaatacgcccggcagcttcgagtgtgaatgttttgagggctacgaatcgggttttatgatgatgaagaattgcatggatatcgacgaatgtgagcggaatcccctgctgtgtcggggaggaacatgcgtaaacactgagggttccttccagtgcgactgtccactcggtcacgagctgagtccatctcgtgaagattgcgtcgatatcaacgagtgctccctttctgataacctttgtcgcaacggaaagtgcgttaacatgattgggacctaccagtgctcttgtaaccccggatatcaggccacccccgataggcaagggtgcaccgacatcgatgagtgcatgatcatgaacggtggatgcgacacccagtgcaccaactctgaggggtcctatgagtgcagctgcagcgagggctatgccttgatgcctgatggccgcagctgcgccgacatcgacgaatgtgagaacaaccccgatatttgcgacgggggtcagtgcacgaacattccaggcgaatacagatgcctttgttatgatggctttatggctagtatggacatgaaaacctgcatagacgtcaacgaatgtgatctgaacagtaacatctgcatgtttggtgagtgtgaaaatactaaggggagttttatctgccactgccagctcggatattccgtcaaaaaggggacaacagggtgcaccgatgttgatgagtgcgagatcggtgcccacaattgcgacatgcacgcctcgtgcttgaacatccccggttcgttcaagtgcagttgtagagaaggctggattggaaacggcattaagtgtattgatctggatgaatgcagtaacggcacacaccagtgtagtatcaatgcacaatgtgtgaacacacctgggtcatatcgttgcgcctgcagtgagggatttaccggcgacggattcacctgttctgacgtcgacgaatgcgccgaaaacattaacctatgcgagaatgggcagtgcctgaacgtcccaggcgcctaccggtgtgaatgcgagatgggatttaccccagcttcagactctcggagttgccaggacatcgatgagtgctctttccagaacatttgtgtctttggaacttgtaataatctacctggcatgtttcactgcatttgcgatgatggatacgagctggatagaactgggggaaattgcaccgatatcgatgaatgtgccgatccaattaactgcgtcaatggtctgtgtgtcaatacccctggccgctatgagtgtaactgtccccccgacttccagctcaaccctaccggggtcggctgcgtggataaccgtgttggcaattgttacctgaagttcggaccaaggggcgatggcagtttgtcctgtaacactgagatcggtgtgggagtcagtcggagctcctgctgctgctctcttgggaaagcatggggcaatccatgcgagacgtgcccaccagtcaattcaacagagtactacacactgtgccccgggggggagggattcagacccaatcctattacaattatcctggaggatatcgatgagtgtcaggagcttcccggtctgtgccagggaggcaactgtatcaacactttcggcagctttcagtgcgaatgtccacagggctactacctgtcagaagataccagaatttgtgaagatatagacgagtgttttgcccatccgggggtctgtgggccagggacctgttataatacactcggaaattatacatgtatttgtccaccagagtacatgcaggtgaacggcggccacaactgtatggatatgcgcaaaagtttttgttacagaagctataacggtaccacatgtgagaacgaactcccattcaacgtgaccaagcgcatgtgttgttgtacatataacgtgggcaaggcttggaataaaccttgcgaaccctgccccacacctggcaccgctgattttaagaccatttgtggaaacattcccggctttacattcgatatacatacagggaaagccgtcgatattgacgagtgcaaagagatcccagggatttgtgccaacggtgtgtgcatcaaccagatagggagttttagatgcgaatgcccaaccggcttctcctataatgatctgctcctggtgtgtgaagatatcgatgaatgctcaaacggtgataatttgtgccaacgaaacgcggactgcattaatagccctgggagctacagatgcgagtgcgcagcgggtttcaagctgagccccaatggcgcgtgcgtcgaccgtaacgagtgtcttgaaatcccaaacgtgtgttcgcacggtctttgtgtggatttgcagggatcataccagtgcatatgccacaacggctttaaggccagccaggatcagaccatgtgtatggacgtggatgagtgtgagcggcatccatgtggaaacggcacatgtaaaaataccgtcggctcttataactgcctttgttatcctggcttcgaactaacccataataacgactgcctggacatcgacgagtgttcctctttcttcgggcaagtctgcaggaacggtcggtgctttaacgagattggctccttcaagtgcttatgtaatgaaggctatgagctgaccccagatgggaagaactgcatagacaccaacgaatgcgtggcacttcccggaagctgttcacctgggacttgccagaacctggaaggctcattccgatgtatatgtcctcctggttacgaagtgaagagtgagaattgcattgatataaatgagtgcgacgaagatcctaacatctgtctgttcggctcttgtacgaacacgcctggaggttttcagtgtctgtgccctcctggatttgtactctccgataacggccgtcgctgtttcgacacacggcagtcattttgctttaccaatttcgaaaatggaaaatgctcggtgcctaaggcattcaacacaaccaaagccaagtgttgctgtagcaaaatgcccggcgaggggtggggcgacccctgtgagctgtgtccaaaggatgatgaggtggcctttcaggatctgtgtccttacgggcacggaactgtgccttctctccacgacactagagaagatgtcaatgagtgcttagagagtcctggtatttgttctaacggacaatgcattaacactgacggcagctttcgctgcgagtgccccatggggtataatcttgattacacaggcgtgaggtgcgtcgacaccgacgaatgttctatcggaaatccatgtggcaacggcacatgcacaaatgttatcggatcgttcgagtgcaattgtaatgagggctttgagccgggccccatgatgaactgtgaagatataaacgagtgtgctcagaaccccctgctgtgcgcatttagatgcatgaacacgttcggtagttacgaatgtacatgcccgatcggctatgcattgcgcgaggaccagaagatgtgcaaggacctggacgaatgcgctgaaggacttcacgattgcgagtcccgggggatgatgtgcaaaaatctgattggcacgtttatgtgcatttgtcctccgggaatggctcgcagaccggacggcgaaggttgcgtcgacgagaacgagtgtagaaccaaaccaggcatctgcgagaacgggagatgcgtaaatatcattggatcctacagatgtgagtgtaacgagggctttcaaagctccagcagcggcacggagtgtttagacaaccggcaaggcttatgttttgctgaggtccttcagacaatctgccaaatggccagctcgagccgcaatcttgtcaccaaatccgagtgctgttgtgacggggggcgtggctggggccaccagtgcgagctgtgcccacttccaggcactgcccaatataagaagatctgccctcacgggccggggtacactaccgacgggagggatatcgacgagtgtaaagtgatgcccaacttgtgtaccaatggtcagtgcatcaacacaatgggctccttcaggtgcttctgcaaggttggttatacaaccgacatctctggcacgtcttgtatagatcttgacgagtgttcccagagccccaagccctgcaattacatctgtaaaaacaccgaagggtcctatcagtgttcttgtccgcgaggatatgtgctgcaagaagacggcaagacatgtaaggacctggacgagtgccagaccaagcagcataactgccagttcctgtgtgtaaacacactaggagggttcacctgcaagtgtccccccggcttcacccagcatcatacagcgtgcatcgacaacaatgaatgtgggtcgcagccatcattgtgtggagccaaagggatatgccagaacacgccagggagcttctcctgtgaatgtcagagggggtttagtctggatgcaactggtttgaattgcgaagacgtcgatgagtgcgatgggaatcacaggtgtcagcatggctgccagaacatcctgggaggctatagatgtggctgtccccagggctacatccagcattatcagtggaatcaatgcgttgacgagaacgagtgcagtaaccccaatgcgtgcggttctgcttcctgttacaataccctcggatcctacaagtgcgcttgcccgtcaggattttcattcgaccaattcagttcagcttgtcatgatgtgaatgagtgtagttcctctaagaacccctgcaactacggatgctctaacacggagggaggttatttgtgcggctgtccacctgggtattatagggtggggcaagggcattgtgtgtccggaatggggtttaataaggggcagtatttgagtctggataccgaggttgatgaagagaacgccctgtctcctgaggcctgttatgagtgcaaaatcaacggatactccaagaaggactcgcgccagaagaggtcaattcacgagccagatcccacagccgtcgagcaaattagtctggaaagtgtggacatggactccccggtgaatatgaagtttaatctctctcatttaggatctaaagagcacattttggagttgagaccagcgatccagcctctgaataatcacatccgatacgtgatatcccaaggcaatgacgatagcgtgtttcgcatacaccagagaaatggcctctcgtatctgcatacggcgaagaagaaactgatgccagggacatacacgctcgagataaccagcatccccctttataagaaaaaggagcttaaaaaactcgaggaaagcaatgaagacgactatcttttgggagaattaggggaagccctgagaatgcgtctccagatccagctgtattag

SEQ ID NO: 117003 - DNA, 597 bp, Artificial Sequence
  Description of Artificial Sequence: Synthetic coding sequence
atgggactccggaaggggcatggcaccctaggacagggactgtctgccttacagagcgagcagggccgactcattcagttgctgtctgaatctcagggccacatggcacacttggtgaactccgtgtctgatatacttgatgcattgcagagagatcgcggtctggggaggccacggaataaagcagacctccaacgggctccagctaggggcactcggccacgcgggtgcgcaaccggtagccggccacgagactgcttggacgtgctactaagtggacaacaggacgacggcgtctattctgtcttccccacccattatccagctggcttccaggtgtattgcgatatgcggacagacgggggcggctggaccgtatttcagcggagagaagacggaagcgttaatttctttagagggtgggacgcttaccgggatggtttcgggcggctcacaggagaacattggcttggaccactggactggtgcactttgtctttggccctgctggttccagttgccccttcccccactcccccccacagttttgttaatgtgctgcaccctccagttccaggggggcccactctgcagtag

SEQ ID NO: 117004 - DNA, 912 bp, Artificial Sequence
  Description of Artificial Sequence: Synthetic coding sequence
atgggactccggaaagggcacggcacattgggccagggtctaagcgctctccagagcgagcaggggagactaatacaattactatctgagagtcaggggcacatggcccaccttgtgaatagtgtgagcgatatcttggacgcactacaacgcgatagaggcctgggccggccacggaataaagctgatctccagcgggcacccgctcgcggcacacgcccacggggatgcgcaaccgggagccgcccacgtgattgtctagacgttctgctgtccgggcagcaggacgatggtgtgtatagcgtgttccctacccattatccagccggctttcaggtgtactgtgacatgcgcacggacggcggaggatggacggtattccagaggcgcgaggacggcagcgtcaatttttttcgggggtgggacgcttaccgggatgggttcggccggctgacaggtgaacactggcttggacttaagcgaatacatgcactgaccacccaagcagcttacgaactgcacgtggaccttgaggactttgaaaatggaaccgcttacgcccgatacgggtcattcggcgtgggactcttcagtgtggaccctgaggaggacggttatcccctgaccgtagccgattactcaggcacagcaggggactctcttctcaagcattccggcatgaggttcactacgaaggatcgggacagtgaccactcagagaacaactgtgccgccttctacagaggggcttggtggtaccgaaattgtcacacctccaacctgaatggtcagtatttacggggcgcccacgccagttacgctgatggagtggagtggagcagctggactgggtggcaatatagcctcaaatttagtgaaatgaaaattcgcccagtgcgcgaggaccgctag

SEQ ID NO: 117005 - DNA, 1386 bp, Artificial Sequence
  Description of Artificial Sequence: Synthetic coding sequence
atggttaatgacagatggaagaccatggggggtgctgcccagctggaggatcggccccgggacaaaccccagaggccgtcttgcggttacgttctttgtactgtgctgctggccctggcagtcttgttagcggttgctgttaccggtgcagtgctgtttctcaaccacgcccacgcccccggcactgcccccccccctgtagtttctaccggggcagcttcggctaacagtgcactcgtcaccgtcgaaagggccgacagttctcacttgtccatcctgatcgacccacgatgtccggatctgaccgactcctttgcaaggttagagtccgctcaggctagtgtgttgcaggccctcactgaacaccaagctcagccccgcctggtcggcgatcaggagcaagagctactggacacactggcggatcagctccctagattgcttgcacgcgcatctgagttgcaaaccgagtgtatgggcctgaggaagggacacggaacgttaggccaaggcctgtccgcgctccagtctgaacaggggcgcctgatccagctgctctccgaaagccagggtcacatggctcatctggtgaactctgtttcagatattcttgacgcattgcagcgggaccggggtcttggacggccacgaaacaaggcagatctgcagcgcgcccccgcccggggaacccggcctcgaggctgcgccaccggcagcaggccccgggattgcctcgacgtattgctatcagggcagcaggacgacggcgtttattccgtgttcccaacccactatcccgcaggatttcaagtgtactgcgacatgaggaccgatgggggaggctggacagttttccagcgccgggaggatggatccgttaacttctttcgggggtgggatgcctatcgcgacggcttcggccggttgaccggcgaacactggctggggctcaaacggattcacgccctgaccacccaggctgcatacgaattgcatgtggacctcgaggattttgaaaacggaacagcttatgcacgctatggcagcttcggcgtgggcctgttttcggtcgatccagaagaggatggttaccctttgacagtggccgattactccggcactgccggggattccctgcttaagcattccggtatgcgtttcactactaaagatcgagattccgaccactctgaaaacaactgtgccgccttctataggggagcctggtggtaccgtaactgccatactagcaacctgaatggccaatacctgcgcggagcccacgcgagttatgctgacggtgtggagtggagttcgtggacaggttggcagtacagccttaagttttctgagatgaagatccgacctgtcagggaggaccgctag

SEQ ID NO: 117006 - DNA, 933 bp, Artificial Sequence
  Description of Artificial Sequence: Synthetic coding sequence
tgaacaggggccgttctctttctgaatcatgctcacgctccaggcacggccccaccccctgtggtctcaacaggggccgcctccgcgaacagtgccctagtgacagtggagagagcggatagttcccatctgtcaattctgattgacccacgctgtccagatctgacggatagtttcgcccggctggagtccgcgcaggcctcggtactgcaggcactaaccgaacatcaggcacagccccggctcgttggtgatcaggaacaggaactcctcgacactctggccgaccagctgcccaggctgttagcacgcgcctccgaactgcagacagaatgcatgggtcttagaaagggtcatggtaccttagggcaggggctttctgcacttcaatcagagcagggacggctcatccaactactatctgagtctcaggggcacatggcgcaccttgtcaactctgtgtccgacattctggacgcgttacaacgggatagggggctgggacgcccgaggaataaagctgacttacagagggcgccggcccggggaacacgaccaagggggtgcgcgactggcagtagaccgcgcgattgcctggacgtcttgctctcaggccagcaagacgacggggtgtacagtgtgttccccacccactaccctgcaggttttcaggtgtactgcgacatgagaacggacggtggaggctggaccgtgttccagagaagagaggacgggagcgttaacttcttccgaggttgggatgcatacagggatggctttgggcgactgaccggggaacactggctcggccccctcgactggtgcactctctccctggcactcctcgtgccagtggctccttcaccgacccctccccactccttcgtgaacgtgcttcatccccctgtgccaggaggccctacgctgcagtag

SEQ ID NO: 117007 - DNA, 1386 bp, Artificial Sequence
  Description of Artificial Sequence: Synthetic coding sequence
atggtcaatgacagatggaagacaatgggtggcgcagcacagcttgaagatagacctagagacaaacctcagcgccctagctgtggctacgtgctttgtaccgtgttgttggccctcgctgtgttactggccgtggccgtcaccggtgcagtcctctttttgaatcacgcacacgccccgggaacagcccctccaccggtcgtaagcaccggcgcagcctcagcaaacagtgccctagtgacagtggagcgcgccgattcttctcacctgtccatattgatcgatcccagatgcccagaccttactgattcctttgcgcggttagagtccgcgcaagcgtctgtgttacaggcactgacagaacaccaggcccagccacggctggtgggagaccaagaacaggaattgctcgacacccttgcagaccaattgccgaggctgcttgccagggctagcgagttgcaaaccgaatgcatggggcttcgaaaagggcacggcacattgggtcaaggcctgtcggcactccagagcgaacagggacggctcatccagctgttaagtgagtctcaggggcacatggctcatctcgttaattcagtctcagacatcctggatgccctgcagcgcgacagaggacttggtagaccgcgcaacaaagctgatttacagagagcccctgcgagggggacccggcctcggggatgtgctaccggctcccggcccagggattgtctggacgtcctcctcagtggacaacaagacgacggggtgtattctgtttttccaacccactaccctgcagggttccaggtctattgtgacatgcgaactgacggggggggttggaccgtgtttcagcggagggaggatggatcggtcaacttctttcgcggttgggacgcatatcgagacgggtttggaagattgaccggagaacactggttgggtctgaagcgcatccatgccctgactacgcaggctgcctacgagttgcatgttgacctcgaggactttgagaatgggacagcctacgccagatacggttccttcggggtggggctgttctctgtggatcccgaagaagatggttatccacttaccgtagcagattactccggaacagcaggcgactccctgctaaaacactctgggatgaggttcactaccaaggatcgggattctgaccattccgagaataattgcgcagctttctataggggcgcttggtggtacaggaattgccacacgtcgaacctcaacggccagtacctaagaggagcccacgcctcatacgcagatggagtggagtggtcgtcatggaccggatggcagtacagcctgaaattcagcgaaatgaaaatacgccccgttcgggaggaccgctag

SEQ ID NO: 117008 - DNA, 870 bp, Artificial Sequence
  Description of Artificial Sequence: Synthetic coding sequence
atggttaatgataggtggaagacaatgggtggcgctgctcagctggaggataggcccagagacaagcctcagcggccttcctgtggctatgtgttgtgtaccgttctgctggccctggccgtactactggccgtggcagtgaccggagcagttctgtttctgaatcacgcgcacgcccccggcaccgccccacctccagtggtctcgacgggcgctgcctcagccaatagcgctcttgtcactgtagaacgtgccgacagtagtcacttaagcattctgattgaccctagatgcccagatcttaccgatagttttgctcggctagagtccgcacaggcctccgtgctgcaggccctgaccgaacaccaggcacagcccagattggttggcgatcaggaacaggaattgctggatacacttgcagatcagctccctagattgttggccagggcctctgaactccagacagaatgtatgggcctgcggaagggtcacgggactctgggtcaggggttgtctgccctacagagcgaacagggaaggctcattcagctgttaagcgagtcccagggccacatggcccatctcgtgaacagcgtgtcagacatccttgacgcactacagcgcgatcgggggttaggcaggccacgaaacaaagcggatctgcagagagccccggccaggggcaccaggccacggggttgcgccacaggcagcagacctcgggactgcctggatgttttactcagcggtcaacaggatgatggggtgtacagcgtcttccctactcactaccccgctggatttcaagtttactgcgacatgaggacggacggcgggggttggacggtattccagcgaagggaatag

SEQ ID NO: 117009 - DNA, 540 bp, Artificial Sequence
  Description of Artificial Sequence: Synthetic coding sequence
atggtgaacgaccgctggaagacaatgggaggggcggcccaacttgaagaccggccgcgggataaaccacaagcccgaaagcttcggcttcgagaaaggccaagttgtggttacgtactgtgcaccgttctgctggctctagccgtgcttcttgcggtggccgtcacgggtgcggttttattcctcaatcacgcgcacgcacccggtactgcccctccacctgtcgtcagcactggcgcggcttctgctaattcagcgctggtgaccgtggaacgcgcggactctagtcatctgtctattctcattgatcccaggtgccccgacctcaccgacagttttgccaggctcgaaagtgcccaggcaagtgtgctgcaagccttgacagagcaccaggcccagcctagactcgtaggcgaccaagaacaagaactgctggatactctcgccgaccagctgcctcggttgttggcacgggctagcgaattgcaaaccgagtgtatgggtcttaggaaggggcatggtacattaggccagggatag

SEQ ID NO: 117010 - DNA, 1170 bp, Artificial Sequence
  Description of Artificial Sequence: Synthetic coding sequence
atgcggagggttacactcttcctcaatgggtcacccaaaaacggcaaagtggtagccgtatacggcaccctctctgacctcttgtcagtagccagctcgaagctgggtatcaaggccaccagcgtgtataacgggaagggtggcctaattgatgacatcgccctgatacgggacgacgacgttttgtttgtctgcgagggtgaacccttcattgatcctcagaccgattcaaagccaccggaaggactccttggattccataccgattggttgacacttaatgtaggtgggcggtactttactacgactaggtccactctagtgaacaaggaacccgattcaatgctagcccatatgtttaaagacaaaggggtttggggcaataagcaggaccacagaggtgctttcttaatcgatcgttcaccagaatatttcgagcctatcctcaactatctacgtcacggccagctaattgtcaatgacgggattaacttactaggggtgttggaagaagctcgattcttcggaatcgattccttgattgaacacctggaggtcgcaataaagaatagccagccacccgaggatcactctccgataagtcgaaaggagttcgtgcggtttctcctcgccacgcctacaaaaagcgagctgagatgccagggtctgaacttctcgggagcagacttatccaggctggatctgcgatacattaacttcaaaatggcaaacctgagtagatgtaatctggcccatgctaacctttgttgcgcaaacctggagcgcgccgacctctctggatccgtgctcgattgcgccaatctgcagggcgtgaagatgctgtgctcaaacgcggagggggcttctctgaagttgtgcaatttcgaggacccttccggattgaaagccaatctcgagggcgcaaacctgaagggcgttgatatggaaggttcccaaatgactgggatcaaccttagggttgccactctgaagaacgcaaagctgaaaaactgcaacctccgtggagctacgctcgctggaaccgacctcgagaattgcgacctcagtggctgcgatctgcaggaagctaacttacgcgggtcaaatgtcaagggagccattttcgaggagatgctgactccactgcacatgagtcagagtgttcgctag

SEQ ID NO: 117011 - DNA, 939 bp, Artificial Sequence
  Description of Artificial Sequence: Synthetic coding sequence
atggccaaggttttttcttttatcttggttacaacagcgcttacaatgggtagagagattagcgctctcgaggactgcgctcaggaacagatgaggctgcgcgcccaggtcagactgctcgaaacacgcgtcaaacagcagcaagtgaagattaaacagctgttacaagaaaacgaggttcagtttctggataaaggagatgaaaataccgtaatcgacctcgggtccaagcggcagtacgcagactgttccgaaatatttaacgatgggtacaaactgagtggattttataagatcaagcccttacaatcacctgcagagtttagcgtgtactgcgacatgtctgacggtgggggctggaccgttatccagcggaggtcggacgggtctgaaaattttaacaggggctggaaggattacgagaacggcttcggcaactttgtgcagaaacatggggagtactggttaggaaataaaaacctgcattttctgaccacacaggaggattacactctcaaaattgacttggcggactttgaaaaaaattcacgatacgcccaatacaagaatttcaaggtgggggacgaaaagaatttctatgagctgaacattggcgagtactcagggacagccggggactcacttgctggcaactttcaccccgaggtccagtggtgggcatcgcaccagcgtatgaagttcagtacatgggaccgggaccatgacaattatgaagggaactgcgcagaggaagatcagagtggatggtggtttaaccgctgccactcagcaaatttgaatggggtctactacagtggaccctacacagccaaaaccgataacggtatcgtttggtacacttggcacggatggtggtatagcctgaagtctgtggtgatgaaaatccgcccaaatgactttatccctaacgtgatctag

SEQ ID NO: 117012 - DNA, 939 bp, Artificial Sequence
  Description of Artificial Sequence: Synthetic coding sequence
atggccaaggtgtttagtttcatattagtaacgaccgcccttacgatgggacgcgagatcagcgccctggaagactgcgcccaagagcagatgcggctgagggctcaggttcggctgttagagacgcgggtgaaacagcaacaggtcaagattaagcagctgctgcaggagaatgaagttcaatttctagacaaaggagacgagaatactgttattgacctggggtccaagcgacagtacgcagactgttcagaaattttcaacgatggatacaagctgtctggcttttataaaattaaacccctgcagagcccagcagaattttctgtctattgcgatatgtcagacggcggaggatggaccgtgatccagaggcgaagcgatggcagcgaaaactttaatcgaggatggaaggattacgaaaacgggttcggcaactttgtccagaaacatggggagtattggctggggaataaaaacctgcatttcctaactacacaggaggattacacgcttaaaattgacttggcagacttcgagaagaactcccgttacgctcagtataaaaatttcaaggtgggagatgaaaagaacttttacgagctgaatataggggaatacagcggaaccgccggcgattcactagcaggtaactttcatccagaagtgcaatggtgggcctcccaccaaagaatgaagttctccacctgggaccgcgatcacgataattatgagggcaattgcgcagaagaagaccagtctggctggtggtttaataggtgtcactctgccaacctaaatggcgtgtactattccggaccatatacagccaagacggataacggtatcgtctggtacacctggcacggatggtggtactcattgaagtcagttgtaatgaaaataaggcccaacgatttcatccccaatgtaatttag

SEQ ID NO: 117013 - DNA, 939 bp, Artificial Sequence
  Description of Artificial Sequence: Synthetic coding sequence
atggccaaggtgttcagttttatcctagtgacaacggccctgacaatgggacgagaaatttcagccttggaagactgtgcccaagagcaaatgaggctgcgagcccaggttaggctgctagagactagggtgaagcagcagcaggtgaagattaaacagctgctgcaggaaaacgaagttcaatttctggacaaaggcgacgaaaataccgttattgacttagggtccaagcgccagtatgccgactgcagcgagatctttaatgacggatacaagctttctggcttctataaaatcaagccccttcagagcccagctgagttttccgtgtactgcgacatgagcgacgggggtggctggacagttattcagcgccggtctgacggcagtgagaactttaatcggggatggaaggactacgagaacggcttcggaaactttgtgcagaaacacggggaatactggctcgggaacaaaaacttacacttcctcactacacaggaagactatacccttaaaattgatcttgcagattttgaaaaaaacagtcggtacgcccagtacaagaactttaaagttggcgatgagaaaaatttttacgagctgaatattggggagtattcaggaaccgcgggagactctcttgctggaaacttccatcccgaggtgcagtggtgggccagccaccaaaggatgaaatttagcacttgggatcgcgaccatgacaattatgaaggcaattgtgccgaagaagaccaatccggttggtggttcaacaggtgccacagtgcaaatctaaacggggtgtactacagcggaccatacactgctaaaactgataatgggatcgtgtggtatacttggcatggatggtggtattctctgaaatcagtggtgatgaagataagacccaatgatttcatccctaacgtgatctag

SEQ ID NO: 117014 - DNA, 939 bp, Artificial Sequence
  Description of Artificial Sequence: Synthetic coding sequence
atggccaaggtgttttcatttattcttgtgacaacggccctgaccatgggccgcgaaatcagcgccctggaggactgtgcccaggagcagatgaggttgcgcgcccaggtgcgcctcctcgaaactcgggttaagcagcaacaggttaagattaagcaattgctgcaagaaaatgaggtgcagttcctggataagggcgacgaaaatacagtcattgaccttggcagcaagaggcaatacgctgattgctcagagatattcaatgacgggtacaagctttccggtttttacaagatcaagccactgcaatccccggctgagttcagcgtttattgcgatatgtccgatgggggggggtggacagttatccagcggagatcggatggatccgaaaattttaatcgcggctggaaggactatgagaatggctttgggaattttgttcaaaaacatggggaatactggctgggcaataagaatctgcatttcctcacaactcaggaggattacacactgaagattgatttggccgactttgaaaaaaactctagatacgctcagtataaaaacttcaaagtcggagatgaaaaaaatttctatgagctgaatatcggtgaatacagtggcactgccggggacagccttgcagggaactttcatccagaagttcagtggtgggcgtcccatcagcgaatgaagttttctacttgggaccgcgatcacgataactacgaaggaaactgtgccgaggaagaccagtccgggtggtggttcaaccgctgccattcagccaatctgaatggtgtgtactatagcgggccctacactgcaaaaaccgataacggcattgtgtggtacacctggcacgggtggtggtactctttgaagtctgtggtgatgaaaatccggcctaacgacttcattccaaatgtgatttag

SEQ ID NO: 117015 - DNA, 939 bp, Artificial Sequence
  Description of Artificial Sequence: Synthetic coding sequence
atggcaaaagtcttctcttttattttagtgaccacagccctgaccatgggtcgcgagatctcagccctggaggattgcgcccaagaacagatgcgacttcgggctcaggtaaggttgctcgagacccgggttaagcagcaacaagtcaagatcaaacagctcctgcaagagaatgaggtgcagttcctggacaagggcgacgagaatacagtcattgacctcggaagtaagcgacagtacgcagattgctcagaaattttcaacgatggttataagctgtccggcttctataaaattaagcccctacagagtccagccgaattctcagtgtattgcgatatgagcgacggaggagggtggactgtgattcaacggcgctcagacggtagcgaaaattttaaccgagggtggaaggactacgaaaacggatttggaaatttcgtgcagaagcacggagaatattggttggggaacaaaaatctgcatttccttacaactcaagaggactacactctgaaaatagacttagctgactttgagaagaattcacgctacgcacagtacaagaactttaaggtcggcgacgagaagaatttctatgagctcaatattggcgaatatagcggcaccgctggggatagcttggccggaaacttccaccccgaggtgcagtggtgggcctctcatcagcggatgaagttttccacatgggacagagaccacgacaattatgaaggaaactgtgctgaggaggatcagagcggttggtggttcaataggtgccacagtgctaacctaaatggcgtatattactcaggaccgtatacggccaagactgacaatggaattgtctggtacacttggcacgggtggtggtacagccttaagagcgtagtaatgaaaatccgacccaatgactttatcccaaatgtgatttag

SEQ ID NO: 117016 - DNA, 939 bp, Artificial Sequence
  Description of Artificial Sequence: Synthetic coding sequence
atggctaaggttttttccttcatcctagtcactacagcactcaccatggggagagaaattagcgcactcgaggactgcgctcaagagcagatgcggctgcgggcccaagttagactactagagactcgggtgaaacagcagcaagtcaagatcaaacaattgctgcaggaaaacgaagtccagtttctggacaagggcgacgagaataccgtgattgacctgggcagtaagcgacagtacgctgattgcagcgaaatctttaatgatgggtataagttgagcggcttctacaaaatcaaacctctgcagtcccctgccgagttctccgtttattgcgacatgagcgatggcgggggttggactgtgatccagcgtagatcagacgggagcgagaattttaacagaggatggaaggactatgagaacggtttcgggaattttgtccaaaagcatggggaatattggctgggcaacaagaatttacacttccttactacccaggaggactacactcttaaaattgatctggccgactttgagaagaactctaggtacgctcaatataaaaacttcaaagtaggcgacgagaagaacttttacgaactgaacatcggtgagtactcaggtactgctggggactccctagccgggaatttccaccccgaggttcaatggtgggcatcgcatcagcggatgaagttttccacatgggatcgtgatcacgataattacgagggtaattgtgctgaggaggatcagtcaggctggtggtttaaccgttgtcacagtgcaaatctgaatggcgtgtattactcagggccatacactgccaaaactgataacggcattgtatggtacacatggcatggatggtggtactcgctcaagtcggtggttatgaaaatccgccccaacgacttcatccccaatgtgatatag

SEQ ID NO: 117017 - DNA, 849 bp, Artificial Sequence
  Description of Artificial Sequence: Synthetic coding sequence
atgcgtctcagagctcaggtgcgtctgctcgaaacgcgcgtgaagcagcagcaagtgaaaataaagcaactgctgcaagagaacgaggtacagtttctggataaaggagatgaaaacaccgttatcgatctcgggagcaaacgccagtacgctgactgtagcgagatctttaatgatggctacaaacttagtgggttctataaaattaagcctcttcagtcacccgcagaattcagcgtttactgcgatatgagcgatggaggggggtggactgtgatccagaggcgatcagacggaagtgagaatttcaacaggggctggaaagattacgaaaatggttttgggaactttgtgcaaaagcatggcgagtactggttaggcaataagaacctgcattttttgaccacacaggaagactacacactgaagatcgacctggctgattttgaaaagaatagtaggtacgcacagtataaaaactttaaggttggcgacgagaaaaatttctatgaactgaacatcggcgaatactcagggaccgcaggagattccctagcaggcaactttcacccagaagtccagtggtgggccagtcaccaacgcatgaagttctctacctgggaccgcgaccacgataattacgagggaaactgtgccgaggaagaccagtctggttggtggttcaatcgatgccactcagcaaatctcaacggcgtgtactactctggaccctacacagccaaaaccgataacgggatcgtgtggtacacctggcacggatggtggtattctctgaagtcagtggtgatgaagataaggccaaatgactttatccctaacgtcatttag

SEQ ID NO: 117018 - DNA, 939 bp, Artificial Sequence
  Description of Artificial Sequence: Synthetic coding sequence
atggcgaaagtgttttccttcattttggtgacaactgcccttacaatggggagggaaataagtgcactggaagattgtgcccaggaacagatgcgcctccgggcccaggtaagactgttggaaacaagggtcaagcaacaacaggtgaagattaagcagctcttgcaggagaatgaagtgcagttccttgataaaggagatgagaatacagttatcgaccttggatctaagcggcagtacgccgattgttccgaaatctttaatgatggctacaaactgtccggattctacaagataaagccactgcagagtcctgctgagttctccgtgtattgcgacatgtctgatggcggaggttggactgtaattcagcgaagaagcgatggttccgagaacttcaacagaggatggaaagattacgagaatggctttggtaatttcgtgcagaagcacggcgagtactggttaggcaacaagaatctgcattttctcaccacccaggaagactatactctgaagattgatctggcagattttgaaaagaactcaaggtatgcgcagtataagaactttaaggtgggagatgaaaagaatttttacgagcttaatatcggagagtactccggtacagccggggacagcctggcggggaacttccatcctgaagtgcagtggtgggccagccatcagaggatgaaatttagcacttgggaccgtgatcatgacaattatgagggtaactgtgccgaggaggaccagtctggctggtggtttaatcggtgtcattcagctaaccttaatggagtgtactacagcggaccatacacagccaagacagacaacggcatagtctggtacacttggcacggttggtggtatagcttgaagtccgtcgtgatgaagatacgccctaacgatttcatcccgaacgtcatatag

SEQ ID NO: 117019 - DNA, 1320 bp, Artificial Sequence
  Description of Artificial Sequence: Synthetic coding sequence
atgaagctcgcgaactggtattggttaagtagcgcagtgctcgctacatatggattcttggtcgtagcgaataacgagactgaagaaatcaaagacgagagggctaaggatgtgtgtccagtaaggctggagtcccgcggcaaatgcgaggaggcaggtgaatgcccataccaggtaagccttccgcctctgacgatccagctgccaaaacagttctcccgcatcgaagaagtgttcaaagaagtgcagaacttgaaagagatcgttaattctctcaagaagagctgtcaggactgcaaactgcaagctgatgacaacggcgatcctggtagaaatggcctgttgctcccttccactggtgcgcccggggaagtaggcgacaacagagtacgcgagctggaatctgaagtgaacaagctgtcaagtgaactcaagaacgcaaaagaggagattaacgtgttgcatggaaggcttgagaagctgaacctcgtcaatatgaacaacatcgaaaactatgttgattccaaagtggctaatctgacatttgtcgtgaattcattagatggtaaatgttctaagtgtccctctcaagaacagatccagtctagaccagtgcaacacctaatttataaggactgtagcgactactacgccataggaaaacgctctagtgagacctaccgcgtaacacctgaccctaaaaattcttcatttgaggtctactgtgacatggagaccatggggggggggtggaccgttctgcaggcccgactggatgggtccaccaacttcacgcggacgtggcaggattataaagctggctttgggaacttgcggcgggagttctggctgggtaacgataaaatccaccttcttacaaaatctaaggagatgatcctgcgaatagatctcgaagattttaatggtgtggaactctacgcgctgtacgaccagttttatgtagctaacgaatttctgaagtatcgcttacacgtagggaactataatgggacagcgggagacgccctgcggtttaacaagcactacaaccacgaccttaaattttttacgacccctgacaaggataatgacaggtaccctagtgggaattgtggattgtattattcctcaggctggtggttcgatgcttgcctgtccgctaatcttaacggcaagtactatcaccagaagtataggggcgtgcggaatggaatcttctggggaacctggcctggggtaagcgaggcgcatccgggcggctacaagagctcatttaaggaggcaaagatgatgatccggcccaagcactttaagccttag

SEQ ID NO: 117020 - DNA, 1095 bp, Artificial Sequence
  Description of Artificial Sequence: Synthetic coding sequence
atgacttccgaactggatatctttgtggggaatacgaccttaatcgacgaggacgtctacagattatggttggatggctactctgtgacagacgctgtggcactgagggtccggtccggtatacttgagcagaccggagcaacagctgctgtgctgcagtcggacacaatggatcattacaggacctttcacatgctagagaggttgttgcacgcacctccaaaactcctccatcagttaatcttccagatcccaccctcacggcaggcgttattgattgagaggtactatgcctttgacgaagcttttgtgagggaggttttgggaaagaaactttctaagggaacgaagaaagacctggatgatatttctacaaaaaccggcattacactgaagagctgcaggaggcagttcgacaattttaaacgcgtattcaaggtcgtggaggaaatgagagggtcattggtggataacattcagcagcactttctactgtccgacaggctagcccgcgactacgctgcaattgtgttttttgccaacaatcgctttgaaaccggcaaaaagaaacttcagtacctgagttttggggacttcgcattctgtgccgaactgatgatccagaactggacactcggagcggttggcgaagcccctaccgaccccgactctcagatggacgacatggacatggacctcgacaaggaattcctgcaggatctcaaggagctgaaagttcttgttgccgacaaagacctgctagatttacacaaatctttggtatgtacagcgctccggggcaagctcggagtgtttagtgagatggaggcgaacttcaagaatctgtctagaggcctggtcaacgttgccgctaagcttacccataataaagacgtcagagacctattcgtcgacctcgtggagaagttcgtggagccctgccggagcgatcactggcccttgagcgacgttagatttttcttgaaccagtattccgcaagtgtgcattcactcgacggattccgccaccaggctctgtgggatcgttacatgggcactttacgaggctgtcttctgaggctctaccacgactag

SEQ ID NO: 117021 - DNA, 1074 bp, Artificial Sequence
  Description of Artificial Sequence: Synthetic coding sequence
atgacaagtgagctcgacatctttgtcggtaacactactctgattgacgaggatgtttacaggctctggctggacgggtatagcgtgactgacgccgtcgcactccgcgtgcggtcagggatcctcgagcagactggcgcaaccgctgccgtgctccagagcgacaccatggaccactaccgcactttccatatgctggaacgtctgttgcatgcccctcccaaattattgcatcagctgatcttccagatcccgccttctagacaggctctgctgatcgagcgctattacgcttttgatgaggcgttcgttcgtgaagtgctcggaaagaaattgtctaagggcaccaagaaggacctcgacgacatttctacgaaaacaggaattacccttaagtcatgtaggaggcagtttgacaactttaaacgagttttcaaagtcgtcgaagagatgcgtggctcacttgtggataacattcagcagcacttcttgctctccgacagactggcccgagattacgccgccatcgtcttcttcgccaacaaccgctttgagacaggcaaaaaaaaactgcaatacctatcattcggtgattttgcattttgtgccgaactgatgatacaaaattggacactgggcgccgtggattcccaaatggacgacatggatatggatctcgacaaggagtttttgcaggaccttaaagagctcaaggtcctggtagcagataaggatttgttggacttgcacaaatccttggtatgtaccgctctgagaggtaaattgggggttttcagtgagatggaagctaatttcaagaacctgtctagaggcctggttaatgtggccgccaagcttactcacaataaagatgtcagggatctatttgtggaccttgtcgagaaattcgtggaaccttgtagatccgatcactggcctctgagtgacgtccgcttcttcctgaaccagtacagcgcttctgtacactcactggatggcttccggcatcaggccctctgggaccgctatatgggcacactgcggggttgcctgctgcgcctgtaccacgactag

SEQ ID NO: 117022 - DNA, 1989 bp, Artificial Sequence
  Description of Artificial Sequence: Synthetic coding sequence
atgtggagctggaaatgtctgctgttctgggcggtcttggtgaccgctacactctgtaccgctcgacccagccctacgttgcccgaacaggctcagccgtggggtgcccccgttgaggtcgagagttttctggttcatcctggggatctcctgcaactgcgatgtcgcctgcgtgacgatgtccagtctatcaattggctcagagacggggtgcagttggccgaaagtaatcggacgagaatcacaggggaagaggtcgaggtgcaggattcagtgccagcagactcaggcctgtacgcatgcgtgacaagttctcccagtgggtctgatactacatacttctccgtgaacgttagcgacgcacttccatcttctgaggacgatgatgatgatgacgatagcagctcggaagagaaggaaaccgacaacaccaaacccaataggatgcctgttgccccctactggacaagtcccgagaagatggagaagaaactgcacgcggtccccgcagccaaaaccgtgaagtttaagtgtccctcgagtggcacacctaatcctaccctccgatggctgaagaatgggaaagaattcaagcccgatcaccgcatcgggggctacaaagtgagatacgccacttggtctatcataatggattcagttgtgccctcagataaagggaactacacatgtatcgtggagaatgagtatgggtctattaatcatacataccagcttgacgtggtcgaacggtccccccatcgcccgatcctgcaggcgggattgccggccaataagaccgtggccctgggaagcaacgtagaatttatgtgcaaggtttatagcgatccccagcctcacatccagtggctgaagcatattgaagtaaacggctccaaaatcggcccggataatctgccttatgtacagatcctgaaaaccgcgggggtgaacacgactgacaaagaaatggaagttctacatttgcggaatgtctcgttcgaggacgctggcgagtatacttgtctagcagggaacagtatcggcctctcccaccactcggcgtggctcactgtgctagaagcccttgaggagaggcctgccgtcatgacatcaccactttatctggaaatcatcatctactgcaccggggccttccttatcagttgcatggttggatctgttattgtgtacaaaatgaaaagcggcaccaagaagagcgacttccacagccagatggccgttcacaaacttgctaagtcgatcccccttagacgccaggtaaccgtctcagccgactcatctgcatcaatgaactccggagtcttgcttgtccggccatcgagactgtcgtctagtggaactccaatgctggccggtgtgtccgagtatgaactgcctgaggatccccggtgggaactgcctagagatcgcctggtcctcggcaaacctctgggcgaaggctgtttcggccaggtcgttctcgctgaggcaataggcctggacaaggacaagcctaaccgcgtaacgaaagtcgcggtcaaaatgttgaagtccgatgccactgaaaaagacctgagcgacttgatcagcgaaatggagatgatgaagatgatcggcaaacacaaaaatatcattaacctcctcggggcttgtacccaggacggccctctttatgtgattgttgaatatgctagcaagggtaaccttagagaataccttcaggccagacgaccacctgggctggagtactgctataatccttcgcacaacccagaggagcaactctcctcaaaagatttggtatcttgcgcataccaggttgcaagagggatggagtatctggcgagcaaaaaagtttggaaccttaaggcgcctttggtccacaccccaaggccaggttcccaggagtgtccaggcgatcgcggtcagtgtgacgaagactcacgactgtggccaagaactggccacagcccccaccggctgttgtag

SEQ ID NO: 117023 - DNA, 1104 bp, Artificial Sequence
  Description of Artificial Sequence: Synthetic coding sequence
atgtggagctggaagtgtttactcttctgggctgtgctggtgacggctactctgtgcacggccagaccgtcaccaactctgccagaacaggctcagccatggggcgcacccgtcgaggtggagtcatttctcgtacacccgggggacctcctccagctgcgctgtagattgcgggacgatgtgcagagtatcaactggctgcgggacggtgtgcagctggccgagtccaacagaacgcgcattaccggagaggaggtggaggtgcaggatagtgttcccgctgactccgggctttacgcctgtgtgacgagttccccctcgggaagcgatacgacttacttttctgtaaacgtcagcgtgcctatagatgcattgccttcttcagaagatgacgacgacgatgacgactcatcctccgaggagaaggagacagacaacactaagccaaaccccgtggctccatactggacctcacccgagaaaatggagaagaagttgcatgctgtgccagccgctaaaaccgtgaaattcaagtgcccatcgtcaggtacgcccaacccaactcttcgctggctgaaaaatgggaaagaatttaagccagaccatcggattggcgggtacaaagtaagatacgctacctggagtatcatcatggattctgtcgtcccttctgacaaaggtaactatacttgcatcgtcgaaaatgagtacgggtcaatcaaccacacttaccagctggacgtggtagaacgctcccctcaccggcctattctccaggcgggcctgcccgcaaacaaaacagtggctctcggtagcaacgtggagtttatgtgcaaggtctacagtgacccacagcctcacatccagtggctgaagcacatcgaggttaacggtagtaagatcggacccgacaatttaccttatgttcagatactgaaacacagcggaatcaattcaagcgacgctgaagtgctcactctgttcaatgttactgaagcacagagcggcgagtacgtgtgcaaagttagcaattatattggcgaagccaaccagtctgcctggcttacggtgacaagaccggtggccaaagattgttggtcctag

SEQ ID NO: 117024 - DNA, 2196 bp, Artificial Sequence
  Description of Artificial Sequence: Synthetic coding sequence
atgtggtcatggaagtgtctgcttttttgggcggtgcttgtgacagccactttgtgtactgcgcgacccagtcctaccctgccagagcaagacgcactacctagttctgaggatgatgacgatgacgacgacagctcatctgaagaaaaagagactgataacacaaaacccaacccagtggcgccctattggacttcacctgagaagatggagaagaagttgcatgctgtgcctgctgccaaaaccgtcaaatttaaatgccctagttccgggacacccaatccgactctccggtggctgaagaatggaaaggagttcaagcctgatcatcggatcggcggctacaaagttaggtatgccacctggtccattattatggactctgtggttccttctgacaagggaaattatacatgcatcgttgagaacgagtacgggagcatcaaccacacctaccagttggacgtggtcgagcgcagtccacatagaccaatcctgcaagctgggctgccagctaacaaaacagtcgctcttggcagcaacgtagagttcatgtgtaaggtgtattccgaccctcagcctcacatccagtggctgaaacacattgaggtgaatggcagcaagatagggcccgataatttgccatatgtgcagattttaaagactgccggtgtgaataccaccgacaaggagatggaggttctgcacctgaggaatgtatccttcgaggatgccggggaatacacctgcctggcggggaattccattggactcagtcaccactcagcttggctgacagttcttgaggcactagaagagcgccccgcggtaatgacctccccgctctacttagagattattatctattgtaccggtgcgttcctcatttcttgtatggtggggtctgtcatagtctacaaaatgaaaagcggcacgaaaaagtcagattttcatagtcaaatggctgtccacaagttggctaagtcaattcctctaagaaggcaggtcacagtatcagcagatagctccgcctccatgaactctggcgtcctgctggtcagacctagccgcctgtcttctagcggcacccctatgctcgcaggcgtctctgagtacgagctcccagaggatcccaggtgggagctacctagggaccggcttgtgctgggtaaaccattaggcgaaggatgtttcggtcaagttgtgctcgcagaagcgatcggtctggacaaggataagcctaatcgcgtgactaaggtcgcggtaaagatgttaaagagcgatgcaacagagaaggacctctctgacttaataagcgaaatggaaatgatgaagatgattggaaaacacaagaatataatcaacctgctgggtgcctgtacgcaagatgggcctctttacgttattgtggagtacgcatcgaaagggaatctccgggagtacctacaggccagacgcccccccgggctggagtattgctacaatccttcacataatccagaggaacagctttccagcaaggatctagtgtcatgcgcttaccaggtggcaagaggaatggaatatttagcgtccaaaaagtgtatccatcgggatcttgccgctagaaacgtcctggtaacagaggacaacgtgatgaagatcgctgactttggattggcccgcgatattcaccacattgattattacaagaagaccacaaatggacgactgccggtgaagtggatggcaccggaagcgctattcgaccgtatatatacacaccagtcggacgtctggagttttggtgtcctattgtgggaaatttttacattgggagggtcaccctatcccggtgtcccagttgaagaacttttcaagctgttaaaggaagggcatagaatggataagccaagtaactgcactaatgagttgtatatgatgatgagagattgttggcatgctgtgcccagccagaggccgacttttaaacagctagtggaagatctggaccgcattgttgccctcactagtaatcaggaataccttgatctgtccatgcccctggaccagtattctccgagttttccagacacaaggtctagtacatgctcttcaggggaagactccgtctttagccacgaaccgctgcctgaagaaccatgccttccaaggcacccagcacagctcgccaacggggggctgaaaagaagatag

SEQ ID NO: 117025 - DNA, 2439 bp, Artificial Sequence
  Description of Artificial Sequence: Synthetic coding sequence
atggctgccgtcacacgcgattttggagagatgctcctccattccggaagagttctgcccgccgaagcgcaaccatggggcgctcctgttgaggtcgaatcgtttctggtgcatcctggagatctacttcagctcagatgtaggctccgggatgacgtacagagtattaactggctgcgagacggcgttcaactcgcggagagcaatcggacacgaataaccggggaagaggtcgaggtgcaggatagcgtccccgcggacagcggactctacgcttgcgtgaccagctccccttctggcagcgatacaacgtattttagcgtgaacgtttccgacgcactgccctctagtgaggacgacgacgatgacgacgacagtagctcagaggaaaaggagactgataacacgaagccaaatcgaatgccggtagccccgtattggacctcccccgagaaaatggagaaaaaactacatgcagtcccagccgccaaaactgtgaagtttaaatgccctagcagcggtactccgaaccctaccctgcggtggctaaaaaatggtaaggaatttaaacctgatcaccgtattggtggctacaaagtgcggtatgccacatggagtatcattatggattccgtcgtaccttccgacaaggggaattacacttgcattgtcgagaacgaatatggatccattaaccacacctatcagctcgacgtagtcgagagatcccctcataggcctatccttcaggctggcctgccggccaataaaacagtcgcacttgggagcaacgtcgaattcatgtgcaaagtttactccgatcctcagccacatatccagtggctcaagcacattgaggtgaacggaagcaaaatcggaccggataacctcccctacgtgcagatattgaagacagccggggtgaacacaacggacaaggagatggaagttttgcatctgcggaacgtctctttcgaagatgccggcgaatatacgtgtcttgccggaaacagtatcgggttgtcacatcattccgcttggctgacagtgctcgaagctctggaggagcgcccagccgtcatgacctccccactgtatctggaaatcatcatatactgcactggagcgtttctcatctcctgtatggtggggtctgtgatcgtatacaagatgaaaagcggtactaagaaatctgattttcacagtcagatggcggtgcacaagctagcaaagtcaattcccctccgacggcaggttagtgcagacagtagcgcgagcatgaactccggtgttctgctggtaaggccgtcgcggctgtcatcttccggaaccccaatgctcgcaggagtgagcgaatacgaattacctgaagaccctcgttgggagctgccacgcgaccgcctcgtccttggaaagccccttggagaaggttgcttcggccaggtagtactcgccgaagctatcggcctggataaggacaaacctaatcgcgtgaccaaagttgctgtgaagatgttaaagtccgatgccactgaaaaggacctgagcgatctgatcagcgagatggaaatgatgaagatgattggcaaacataaaaatatcattaatctgctgggtgcttgtacacaagatgggcctctttacgtcatcgtcgagtatgcgtcaaaaggcaacctccgcgagtatctgcaggcccggcgaccaccaggtctcgagtattgctataaccccagccacaatccggaagagcagctctcttctaaggacctggtgagctgtgcttatcaagtcgccagaggtatggagtacctggcgagcaagaagtgcattcatagagatttggcagcgagaaacgttcttgtcacagaagacaatgtcatgaagattgccgattttgggctcgctcgcgatattcatcatatagactactacaaaaagacaacaaatgggcgcctgcctgtcaagtggatggctccggaagctttgtttgaccgtatttatacacaccagagtgacgtgtggtcattcggggttctcctctgggaaatcttcacacttggcggcagtccttatccgggagtcccagtggaggagttattcaaactcctcaaggaggggcaccgcatggataaaccctcaaactgcaccaatgaactgtacatgatgatgagggattgctggcacgcggttccatcgcagcgacccacatttaagcagctagtggaagatttggacaggatagtggccttaaccagtaaccaggagtaccttgatttgtcaatgcctttggaccagtactccccatccttcccagacacccgctccagcacatgctcttctggggaggactccgtgtttagccacgagccacttccggaggaaccctgcttgcctcgacatcctgcacaactagccaatgggggcctaaagaggcgatag

SEQ ID NO: 117026 - DNA, 2469 bp, Artificial Sequence
  Description of Artificial Sequence: Synthetic coding sequence
atgtggagctggaaatgcttgttgttctgggccgtgctggtgaccgctaccctctgcacagctcggcccagtcccaccctccctgagcaggcccagccctggggggcccctgtagaagtagaatctttcctggttcacccaggagatctgctgcagctgcgctgcagactcagagacgatgtccagtccatcaactggctcagagatggcgtacaactggcagagtccaacagaacacgcattactggagaggaggttgaggtgcaggattccgtgcctgccgactcaggtttgtatgcatgtgttacttcatccccttcggggtcagacacaacatacttttccgtgaacgtatcagtcccaatcgatgcacttccctcttccgaggatgacgatgatgatgatgattcttcgagtgaagaaaaggagactgataatacgaagcccaaccccgtcgcgccttattggacctcaccagaaaaaatggaaaaaaagttgcatgctgtcccggctgcaaaaacagtgaagttcaagtgtccaagctctggaactccaaatcccacattgcggtggctcaaaaatggtaaagaattcaagcccgatcaccggataggtggttataaagtcaggtatgcaacatggagtattataatggattcagtcgtgccctccgacaaagggaattacacatgtatcgtggagaatgagtacggctccatcaatcacacatatcagcttgatgtcgttgaacgctcacctcatcggccaatcctccaagctggcctgccagccaataagacggtagctctaggctcaaatgtggaattcatgtgtaaagtttattccgacccgcagcctcacattcagtggctgaagcacattgaggtgaacggctcaaaaatcggacccgacaatctgccttacgtccagatcctgaagcactccggcatcaattcctctgacgcagaggttctcactctgtttaacgtgacagaagcccagtccggagaatacgtatgcaaagtgtctaactacattggcgaagcaaaccagtcagcatggctgacagtcacacggccagttctggaggaacgcccagctgtcatgacatcccccctttacctggaaatcataatctactgcaccggcgcattcctgatttcatgtatggtgggatcagtaatcgtatataagatgaaatctggtaccaaaaaatccgacttccactctcagatggcagtgcacaagctcgccaaatcaatccctcttagaagacaagtgacagtaagcgccgattcctctgcctctatgaactctggggtgctcctggtgaggccctcacggctgagttcctcaggaactcccatgctggccggcgtgtccgaatatgagctgcccgaggacccccgatgggaactcccccgtgacaggctggtgctcggcaagcctctgggagaggggtgctttgggcaggtggtgttggcagaagccatcggcctggataaagataaacctaaccgcgttaccaaggtcgccgtgaagatgcttaagagtgacgccactgaaaaagacctgagtgacctaatatctgagatggaaatgatgaagatgatcggtaaacacaagaacataataaatctcttaggcgcatgcactcaggacgggccgctctacgtaatcgtggaatacgcctctaagggaaatttacgggaatacctccaggcccggcggccccccggcctggagtactgttataatcccagccataatcctgaggaacagctaagcagcaaagacttggtgtcttgcgcatatcaggtggccagaggtatggagtaccttgcttccaaaaagtgtattcaccgcgacctggctgcccgcaatgtgctggtgacagaagataacgtcatgaagatcgccgatttcggcctcgcacgcgacatccaccacatcgattattataaaaagaccaccaatgggagactgccagtcaagtggatggctcccgaggcactgttcgataggatttacacccaccagtcagatgtttggtctttcggcgtgttgttgtgggaaattttcactctgggcggaagcccgtatcccggagtgcccgtggaagagctcttcaaactgctgaaagaagggcaccgaatggacaagccatcaaattgtaccaatgaattgtacatgatgatgcgcgattgttggcacgcagtacccagccagagacctacttttaaacagctcgttgaggacctggatagaatcgtggcactgacatccaatcaagagtatttggatttatcgatgccactagaccaatactcaccctcgtttcccgacacacgcagcagcacatgcagcagtggagaggactctgtgttttcgcatgagccattgccggaagaaccctgcttaccccggcatcccgcccagctggctaacggagggctcaaacggagatag

SEQ ID NO: 117027 - DNA, 2202 bp, Artificial Sequence
  Description of Artificial Sequence: Synthetic coding sequence
atgtggagctggaaatgcttattgttctgggcagtgctggtgacagcaaccctgtgcacagcccggccgtccccaacgctgccagagcaggatgctctgccaagctccgaggatgacgacgatgacgacgattcttcttccgaagagaaagagactgacaatacaaagcctaaccgcatgccggtcgccccctattggacttcccctgagaaaatggaaaagaagctacacgctgtgcccgccgcaaaaaccgtgaaatttaagtgtcccagttccggtacgcccaatcccaccctgagatggttaaaaaacgggaaggagtttaaacccgatcaccgaatcggagggtacaaggtaaggtatgctacctggtctattattatggacagtgtagtaccctccgataaaggcaattacacatgcattgtggaaaatgaatatgggagcatcaaccatacataccagttggatgtggtggagagaagccctcaccgcccaatactgcaagctggcttgccagctaataaaacggtggcgctggggtccaacgtagaattcatgtgtaaggtctacagtgacccccaacctcatattcagtggctcaagcacattgaagttaatggcagtaagattggacccgataacctgccttatgtgcaaattctaaaaacagctggcgtcaatacgactgacaaagagatggaagtgctccatctcagaaatgtgtcctttgaagacgctggggaatacacttgcttagctggcaactcgatcggattgtcccaccacagtgcctggctcactgttcttgaggcactcgaagaacgacccgcagtgatgacatcaccactgtatctcgagataatcatttattgcacaggcgcgttcctgatctcttgcatggttggcagtgttatagtgtacaaaatgaagagcggaactaagaaatcagattttcatagtcaaatggctgtgcacaagctcgccaaaagcattccccttcggagacaagtcaccgtttcagccgacagttctgcgtcaatgaatagtggagttctcctggtgcgtccatctcggctttcgtcaagcggcacacctatgctggctggggtatctgaatatgaacttccagaagatccacgctgggagctgccccgggaccggctggttctaggtaaacctttgggtgagggctgcttcgggcaggtggttttggccgaagccatcggactcgataaagataaaccaaacagagtgactaaggttgcagtgaaaatgctaaagtcagacgccacggagaaagatctaagtgacttgatctccgaaatggaaatgatgaaaatgatcgggaagcacaagaacattatcaatcttcttggcgcctgtacccaagatggtccactgtatgtcatcgtcgagtatgcgagcaagggaaacctgcgtgagtatctgcaagccagaaggccccctgggttggaatactgctataatccaagccacaaccctgaagagcagctgagctcgaaggacctcgtgtcttgtgcctatcaagttgcgagagggatggaatacctggcatctaagaagtgcatccatagggatcttgcagcccgaaacgtgttggtaactgaagacaacgtgatgaagattgcagactttggactcgccagagacatccaccatattgactattataagaaaacaacaaatggcagactccccgtgaagtggatggccccagaggcgctgttcgaccggatctatacccatcagtcagacgtctggagttttggagtgctgttatgggagatattcacactggggggaagtccatatcctggtgttcctgtcgaagagttgtttaaactgctgaaggaaggccatagaatggacaaaccttccaattgtacaaacgagctctatatgatgatgagagattgctggcacgccgtaccatcgcagcggccaactttcaaacagctcgtggaggacctcgatcgaattgtggccctgacatctaatcaagaatacctcgatttgtcaatgccactagaccaatatagcccgtcttttcctgatacaagatcttcaacctgttcaagtggcgaggattccgtcttcagtcatgaacctttacctgaggaaccttgcctccctcgtcatccagcacagctggcgaatggcggtcttaaacggcgttag

SEQ ID NO: 117028 - DNA, 2463 bp, Artificial Sequence
  Description of Artificial Sequence: Synthetic coding sequence
atgtggagttggaaatgcctgctgttctgggccgtcctggttacggccactctgtgcactgctcggccctcccctacactgcctgagcaggctcagccctggggcgctccagtggaagtcgaaagcttccttgtacacccaggggatctgctgcagctgcggtgccgcctccgcgacgacgtgcaaagcattaactggctgcgtgatggcgtgcaactggcagagagtaacagaactaggatcactggcgaagaggtggaggttcaggatagtgtacccgctgatagcggtctgtacgcatgcgtaacaagttcaccatctggatcagacaccacatatttcagcgtgaacgtttctgatgcactgccaagcagcgaggacgacgacgatgacgacgatagctccagcgaagagaaagagaccgacaataccaaacccaaccccgtcgccccttattggacatctccagagaagatggagaaaaaactccatgcagtcccagctgccaaaacagtgaaatttaaatgtcccagcagcggaactcctaaccctacactaagatggctcaaaaacggcaaagaattcaaacccgatcaccggattggtgggtacaaggtacggtacgctacctggtctatcatcatggattcagttgtcccatccgacaaaggcaactacacctgcatagtagagaacgaatatggttcaatcaaccacacataccagctcgacgtcgtggagcgctcaccgcatcggcccatactgcaagctggcctgccagccaacaaaacagtcgccctcggatcaaacgtagaatttatgtgcaaagtttactccgatcctcagccgcacattcagtggctcaaacatattgaagtgaatggctcaaagattggacccgataacttgccttacgtgcagattctgaagacggctggagttaacaccaccgacaaagagatggaagttttgcacttgcggaatgtcagctttgaagatgccggtgaatacacctgtctcgctggcaacagtattggcttgtcacatcattcagcttggctaacagttctggaagcccttgaggaacgccccgccgtcatgacctcacccctgtacctcgaaattatcatttactgtaccggcgctttccttatcagttgcatggtcgggtcagtgattgtttacaaaatgaaatcaggaacaaaaaaatctgactttcacagccagatggccgtgcataagctggctaagtcaattcccctccggaggcaagtgacagtcagtgccgattctagtgctagtatgaactccggcgttctcctggtgaggcccagtcgccttagcagttctggcactcccatgctggccggggtgtctgagtacgaactcccagaggaccccaggtgggaattacccagagaccgtctggtactcggtaagcccctcggggagggatgctttggacaggtagtcctggctgaagcaattggactggacaaagataagcctaacagagtcacaaaggtcgccgtaaagatgcttaaatccgatgcgaccgagaaagacctgtccgacctcattagcgagatggaaatgatgaagatgattgggaagcacaagaacatcattaatctgctgggtgcatgcacacaggacggccctctttatgttattgtcgagtacgcctctaaaggaaacctccgtgaatatctgcaagcccgaaggcctcctggtctcgaatactgctacaacccaagtcacaaccccgaagagcagttgagttccaaggatctggtctcttgcgcctaccaggtcgcacgaggcatggagtacctcgcatcgaagaagtgtatacaccgcgacttggccgcacggaatgtgctggtgactgaagacaatgttatgaagattgccgacttcggcctcgcgcgggatatccaccacattgactactataaaaaaacgacaaatgggaggctgcctgttaaatggatggctcctgaggcgctgtttgaccgcatttacacacaccaatcagatgtttggtcgttcggtgtccttctctgggaaatattcacattgggcggctcaccctaccccggagtgccagtggaggagctgtttaaactcctcaaagagggacatcgaatggacaagcccagcaattgcactaacgaactgtacatgatgatgcgggattgctggcatgctgtaccaagtcagcgccctacgtttaagcagttagtggaagacctggatcggattgtagcgttaactagcaatcaggaatacctcgacctgagcatgcccctcgatcagtattcccctagttttccagacactagaagtagcacctgctcctccggagaggactctgtcttttctcatgagcctctgcctgaggagccttgcttgcctcgtcacccggcccagcttgcaaacgggggtttgaaacgacgctag

SEQ ID NO: 117029 - DNA, 2202 bp, Artificial Sequence
  Description of Artificial Sequence: Synthetic coding sequence
atgtggtcctggaagtgcttgctgttttgggctgtgttggtgacagcaactctctgcacagcaagaccctcgccgactcttcccgaacaggacgccctcccctcttcagaagacgacgatgacgacgacgactcaagttctgaggaaaaagaaactgacaacacgaaacccaatccagtagctccctattggactagtcctgagaagatggagaaaaagctccacgccgtacccgctgctaagaccgttaagttcaaatgccccagtagcggtacccccaaccctacgctgagatggctgaaaaacggcaaggagttcaaacccgatcatcgcatcgggggatataaagtacgttacgccacctggagcattatcatggattctgtggtgccttctgacaaggggaattatacctgcattgtggaaaacgagtacggtagtatcaatcatacctaccagctagacgtcgtggagagatcccctcataggcccattctgcaggctggcctcccagcaaataagactgtggccctcggctccaatgtggagtttatgtgtaaggtatattcagaccctcagcctcacattcagtggttaaagcacattgaggttaacggttccaagatcggtccagacaacttaccttatgtgcaaatccttaagcattcagggatcaatagttcagatgccgaagtgcttacactgttcaacgttaccgaggctcaatcaggcgaatacgtgtgcaaggtcagcaactatattggagaggcgaatcaatcagcatggctgactgttacaagaccagtcgcgaaagcgttggaggaaaggcctgctgtcatgacctctcccctctatctggaaattatcatttattgcacaggcgccttccttatatcatgcatggtgggcagtgtgattgtatataagatgaagagtgggactaaaaagagtgattttcattctcaaatggccgtacacaagttggccaagtctatccctttgcgtcgacaggttaccgtcagcgccgattctagcgcatctatgaacagcggcgtgctactggtccggccttcacgcctatcatctagcggaacgcctatgctggcgggcgtcagcgaatacgaactgccggaagatccacgatgggaactccccagagataggctcgttcttggtaaacctcttggcgaggggtgctttggccaggttgttctagccgaagccatcggcttggacaaggataaacctaaccgagtcacaaaggttgctgttaagatgctgaagtccgacgctactgagaaggatctgtctgacctcatctcagagatggagatgatgaaaatgattggaaagcacaagaatattattaatctcctcggtgcatgcacgcaggacggaccactctacgtgattgtggagtatgctagcaagggcaatctgcgagaatacctgcaagcgagacgcccgcctggtttggaatactgttacaacccatcccataaccctgaggagcagctctctagcaaggacctggtctcgtgtgcctaccaggtcgcacgcggcatggagtatctggcttccaagaagtgcatacatcgggatctagctgctaggaatgtgctggtcaccgaagacaacgtgatgaagatcgccgacttcgggctggccagggatatacaccatattgattactacaaaaagaccacaaacggcaggctccctgtgaaatggatggccccggaggctctctttgaccggatctacacgcaccagtctgacgtgtggtcatttggagtcttgctgtgggagatctttaccctgggtgggtccccatatcctggcgttcccgttgaagaactctttaaactcctgaaggaaggacatcggatggacaaaccctccaactgcaccaacgagctatacatgatgatgcgcgattgctggcatgccgtgcccagccagcgtccaacctttaagcaattagtcgaggacctggatcgaattgtggcattgacgtccaaccaggagtatctggatctgtcgatgcccctggatcagtacagtccatcttttccagatacccgaagctctacctgctccagcggtgaggactcggtatttagccatgaacccctgccggaggagccttgcctcccaagacatcccgctcaacttgccaacggcggcctgaagcgtcggtag

SEQ ID NO: 117030 - DNA, 2463 bp, Artificial Sequence
  Description of Artificial Sequence: Synthetic coding sequence
atgtggagttggaaatgtctgttattctgggccgtcttggtgacagcaactctttgcacggctcgtccctcgccgacccttccagaacaagcgcaaccttggggggcgccggtagaagtcgagtcattcctcgtgcatcctggagacttactccagcttcgctgcaggctgcgtgatgatgtccaatcaataaattggcttagggatggggtgcagttggctgagagcaaccggacacgcataacaggagaagaagtcgaagtccaagactctgtgccggctgatagcggtttatatgcgtgcgtgacgagctcacccagtggctcagacaccacatacttcagtgttaacgtgagcgacgccctaccttcaagcgaagatgatgacgatgacgacgattccagctcagaagagaaggaaacagataacacaaaaccaaatcctgttgccccctactggacatcacctgagaagatggagaagaaactccatgctgttcctgccgccaaaactgtgaaatttaaatgcccatcttcagggacacctaatcccaccctgaggtggctaaaaaacggaaaggagtttaagcctgatcaccggattggcggttataaggtccggtacgccacttggtctatcataatggattcagtcgttccctccgacaaaggaaactatacatgtatcgtggagaacgagtacggctcaattaatcacacctatcagctcgatgtcgtcgaaaggtcgcctcataggcctattttacaggctggcctcccagccaataagacggtggcactcggcagcaatgtcgaattcatgtgcaaggtgtattcggacccccaaccacatatacagtggttgaaacacatcgaggttaacggctctaagatcggaccagacaatctcccgtatgtgcagatactgaagactgctggagtgaacactacagacaaagagatggaagtcttacacttgcgcaacgtgagtttcgaggatgcgggagagtacacttgtctagctggaaactcaattggcctgagccaccactcggcatggctgacggtccttgaggctctcgaagaacgcccagcagtgatgacgtcccctctgtacttggagattatcatctattgcacaggggccttcctcatcagctgcatggtcggatctgtgatagtctataaaatgaagagcgggactaagaaatccgactttcattcacagatggccgtgcataaactcgctaagtctattcccctacgtagacaggttacagtgagcgcagattccagcgcaagtatgaatagcggggtgctgctggtcagaccctctaggctttcatcaagtggcacacccatgttggcaggagtgtcggaatacgagctgccagaggaccccaggtgggaactgcccagagaccggttagtgcttggaaaacccctaggtgaggggtgttttggacaggtggtgctggcagaggcaatcggactggacaaggataagccgaatagggttactaaggttgcagtgaagatgctcaagtctgacgcaaccgagaaagacctaagtgacttaatatctgaaatggagatgatgaagatgatcggaaaacacaagaacataattaacttacttggtgcctgcacccaggatggccctttgtacgtcattgtggaatacgccagtaaggggaacctgcgggagtaccttcaagcccgtcgccctcccggactggagtactgctacaatcctagtcacaatcccgaggaacagctgtctagcaaggatttagtatcctgcgcctatcaagtggccagaggaatggagtacttggcgagcaaaaagtgtatccatcgagatcttgccgctcgtaatgtcctagtcactgaggacaatgtgatgaaaattgcagattttggcctcgcgcgggatattcatcatatagattattataaaaaaaccaccaatggaaggctgccagtgaaatggatggcacccgaggcactctttgacaggatatacacccatcagagcgatgtctggtccttcggcgttctgctttgggagatctttaccctgggcggcagcccttatccaggggtgcccgtggaagagctctttaaactgctaaaagagggacaccgtatggataagccttctaactgcaccaacgagctttacatgatgatgagagactgctggcacgccgtgccctcccagcgtcctacgttcaaacagctcgttgaggaccttgacagaatcgtagcccttacttccaatcaagagtacttagacttaagtatgccactagatcagtacagcccctctttccctgatacacgatcttccacgtgttcttctggcgaggacagtgtgttttcacacgagcccctgcctgaagagccgtgtctgcctagacaccctgcgcaactggcgaatggcggtctgaaaagaagatag

SEQ ID NO: 117031 - DNA, 2463 bp, Artificial Sequence
  Description of Artificial Sequence: Synthetic coding sequence
atgtggagctggaagtgcttgctattttgggccgtgctcgtgaccgctaccctctgcactgcccgtccatcacctactctgcccgagcaggctcagccctggggagctcctgtggaggttgagtccttcctggtccatcccggcgacctgctgcagctgcggtgcaggttgagagatgacgttcagtccatcaattggttgagggatggagtgcaactggcagagtctaatcgcacgcggataacgggcgaagaagttgaggttcaggattcagttcccgctgactccgggctgtacgcttgtgtgacctcaagcccaagtggctccgatacaacatatttcagtgtcaatgttagtgacgctctcccctcaagtgaagacgatgatgatgacgatgatagttcatccgaggaaaaagaaaccgacaacacaaagcccaatcctgtggctccctactggacttcgcctgagaagatggagaagaagctgcatgctgttccggcagccaagacagtaaagttcaagtgtcccagttccgggaccccaaatccgactcttcgctggctgaagaatggcaaggagtttaaacccgaccacaggatcggagggtacaaagtcaggtatgcgacatggtcaattattatggactcagttgttccatccgacaaaggtaactacacctgcatagtggagaatgaatatggatctatcaaccacacgtaccagctggacgtggtggagaggtcccctcatagaccaatcctacaggccgggcttcccgccaataagaccgttgcccttggatctaatgtggagtttatgtgcaaagtctattctgatcctcagccacatatccagtggttgaaacatattgaggtgaatggctccaagatcggtcccgacaatttgccctacgtgcagatcctgaaaactgctggggtaaacacaacagacaaagagatggaggtcctgcacttgcggaacgtctcctttgaagacgctggtgagtatacgtgtttggctgggaatagcattggcctgtctcatcacagtgcttggttaacggttttggaggcattggaagaacggccagcagtcatgacctcacccttatatctggaaatcattatctattgtactggcgcatttctgatatcttgtatggtcgggagcgtcattgtttacaagatgaaatcaggtacgaagaaaagcgattttcatagccagatggccgttcataagctagcaaagtcaattccactgcggcgacaagtgactgtctcagccgattcttctgcaagcatgaactcaggagtgctcttagtgcggccgagtcgcttatcgagtagcggaacccctatgcttgccggtgtgagtgaatatgagttacctgaagatccacgatgggaactcccccgggacagattggtgctcgggaagcccctcggggagggctgctttggacaagtggtgctggccgaggccatcggcctcgacaaagataaaccgaacagagtgactaaagtggccgtgaaaatgctcaaatctgacgcaaccgagaaagatctgtctgaccttatctctgaaatggaaatgatgaaaatgattggcaaacacaagaacataatcaatctgctgggggcttgcacacaggatggtccactgtacgtcattgtggagtacgctagcaagggcaaccttagggagtatctgcaggctagaagaccacctgggttagagtactgctataaccccagccataatccagaggaacagcttagctccaaggacctggtatcatgtgcctaccaggtggcaagaggcatggaatatctggcatctaagaaatgcatccatcgggacttagccgcgcgtaacgtcctcgtgaccgaggacaatgtgatgaaaatagccgattttggccttgcccgtgatatccaccacattgattactataaaaaaacaaccaacggccggctccccgttaagtggatggctcctgaggcgcttttcgataggatctacacccaccagtcagacgtgtggtcattcggcgtgcttctctgggagatcttcaccttgggagggtccccttacccgggcgtcccagtggaggagctttttaaactattgaaggaggggcatagaatggacaaaccatccaattgcaccaatgagctgtatatgatgatgagagattgctggcacgcagtaccctctcagaggccaacctttaaacaactggtcgaagaccttgaccgtatcgtggccctgacttctaaccaggaatatctagacctgtccatgcccctggaccagtactctcctagttttcccgacacacgaagctcaacgtgctcatcaggcgaggacagcgttttcagccatgagccgttgcccgaagagccctgcttaccacggcaccctgcgcagcttgccaatggtggactgaaacggcggtag

SEQ ID NO: 117032 - DNA, 324 bp, Artificial Sequence
  Description of Artificial Sequence: Synthetic coding sequence
atgtggtcttggaaatgtttactattctgggccgtgctggtgactgccaccctatgcaccgcccggccttcccctacccttcctgagcaagcccagccttggggcgcacccgtggaggtcgagagtttcctggtccatccaggggatctgcttcagctgaggtgccggttacgggacgacgtacagtcaatcaactggttgagagacggcgtgcagctcgcagagagtaaccggacccgaatcaccggcgaggaagtcgaagtgcaagatagcgtgcccgccgattccggtctgtatgcctgcgtcacttcttccccttcctag

SEQ ID NO: 117033 - DNA, 2562 bp, Artificial Sequence
  Description of Artificial Sequence: Synthetic coding sequence
atggaggctagagtcagtctcaagaggcggatagaactaactgtggaatatccctggagatgtggcgccttgagtcctactagcaactgccgcaccgggatgtggagctggaagtgcctcctcttttgggccgtgcttgtgacagcaactttgtgcaccgccagaccaagccctaccctgcccgaacaagcgcaaccctggggggctcccgtagaggtggaatcattcctagtccaccccggggatctcctgcagttaaggtgtcgactccgagacgatgtgcagagtatcaactggctgcgggacggcgttcaactagccgagtccaacagaacccgcatcactggcgaagaagtcgaggtgcaggatagcgtgcccgcagactctggactttatgcatgtgtcacatcatcgccaagcggctcagacaccacatatttctctgttaacgtatccgatgccctgccttctagtgaagacgatgacgatgacgacgatagctcttccgaggagaaagaaaccgacaatacaaaacccaatcccgtcgctccttactggacatcacctgaaaaaatggagaaaaaactgcatgctgtgcccgcagcaaagaccgtcaagtttaaatgcccttccagtggtacccccaatccaaccctgcggtggctcaaaaacgggaaggagttcaaacccgatcaccgtatcgggggatataaggtgcgctacgcgacatggtcaattattatggacagtgtggttccgtcagacaagggaaattatacgtgcattgtggagaacgagtacgggagtatcaaccatacataccagctggacgtcgtggaaagatcccctcacaggcccatcctccaggccggcctgcccgctaacaagacagtcgcattaggctcgaacgtggaatttatgtgcaaggtctactctgaccctcagcctcacatccagtggttgaagcacatcgaggtcaatggcagtaagattggaccggacaacctcccttatgtacaaattcttaaaactgctggggtcaacacaaccgacaaggaaatggaagttctgcacctgcggaacgtttccttcgaggatgcaggcgagtacacttgcttagcaggcaattctatcggattatcccaccatagtgcctggctaacagtgttggaagctttggaagaacggccagctgtgatgacatcccctctgtacctcgagatcattatatactgcacaggagctttccttatttcttgtatggtgggctccgtcatagtatacaagatgaaaagtggaaccaagaagagcgatttccattcacagatggccgtgcataaattggccaagtccatccccttgcgccgtcaggtgacggtttctgcagattcttccgcctcaatgaatagcggtgtgctgttagtacgcccatcacggctgtcttcttccgggacgccaatgctagccggggtgtctgaatacgagttgcccgaggatcctagatgggagctgcctcgggaccgactggtcctcgggaaacccttaggcgaaggttgtttcgggcaggtagtactcgcggaggccatcggactcgacaaggataaacctaatagggtcacaaaggtggcggttaaaatgctgaagagcgacgccacagagaaggacctctcagatctgatatcagaaatggagatgatgaaaatgattggcaaacacaagaatattataaacctgctaggggcatgtacacaggatggccccctttacgttattgtggagtacgcttcaaaagggaacctgcgtgagtacttgcaagccagacgacctcctggacttgagtactgttacaacccttcccacaacccggaagagcaactgtcttcgaaggacttggtttcttgcgcatatcaggtggctcgcggtatggagtatttggcatccaagaaatgcatccatcgagaccttgctgccaggaacgtactggtgactgaggataacgtgatgaagatcgccgactttggactggctagggacattcatcacatcgattactacaagaaaactaccaatggacgcctgcctgtgaagtggatggcccctgaggcactgtttgaccgcatatatacccaccagtccgatgtctggagtttcggggtgctcctgtgggagatctttactctcggaggctccccctatcctggggtgccggttgaggaactgttcaagcttctgaaggagggtcaccggatggacaagcccagcaactgcacgaatgagctttacatgatgatgcgtgactgctggcatgcggtgcctagccagagacctacatttaaacagctggtggaagacctggacagaatcgtggctctgactagcaatcaagaatacttggacttgagcatgcccctggaccaatactctcctagctttccggacacacggagctccacatgctccagtggcgaggatagcgtcttctctcacgaaccactgccagaagagccctgtctgcctcgacatcccgcccagttggctaatggagggctgaaacggcgctag

SEQ ID NO: 117034 - DNA, 168 bp, Artificial Sequence
  Description of Artificial Sequence: Synthetic coding sequence
atgtggagctggaagtgcctgctgttttgggctgtgttggtcacggccactctctgtaccgcacgaccctcgcctacacttcccgagcaagacgcccttccttcatccgaggacgacgacgacgatgatgatagcagctccgaggagaaagaaactgataatacctag

SEQ ID NO: 117035 - DNA, 6 bp, Artificial Sequence
  Description of Artificial Sequence: Synthetic coding sequence
atgtag

SEQ ID NO: 117036 - DNA, 2469 bp, Artificial Sequence
  Description of Artificial Sequence: Synthetic coding sequence
atgtggagctggaagtgtctgctattctgggccgtgctcgtgactgctacattgtgcacagctcgcccatcgcccaccctgcctgagcaggcccagccgtggggtgccccagtcgaggtagagtcattcctggtccaccccggcgatcttctccagctccgctgccggctgcgtgacgatgtccaaagcattaactggctgagagatggtgtccagctggccgagtcaaaccggaccagaatcaccggggaagaagtggaggttcaggatagcgtccccgcggattccggtctgtatgcgtgtgtgaccagttccccaagcggctctgacactacctacttcagtgtgaatgtatctgacgcgcttccttcttccgaagatgatgacgacgacgatgatagttctagtgaagagaaggagacagacaacactaagcccaatcgcatgcctgtcgccccttattggacttctcccgaaaagatggagaaaaaattgcatgcggtgcccgccgcgaagacagtgaaatttaaatgcccctcaagcgggacaccgaatccaaccctgcggtggcttaaaaatggaaaggaattcaagccagatcacaggatcgggggctataaggtcagatatgccacatggtctatcattatggactcagttgtaccctctgataagggcaattatacatgtatcgtggaaaatgagtacgggtctataaatcatacctaccagctagacgtagtggaacggtctcctcaccgaccaattctgcaagcaggtctgcccgcaaataaaactgttgcactgggtagtaacgtggagtttatgtgcaaggtgtacagcgaccctcagccgcatattcagtggctgaagcacattgaggttaacggcagcaagataggtccagacaatttaccttacgtgcaaatcctgaaaaccgctggtgttaatacaactgacaaggagatggaagtacttcatctgagaaacgtttcttttgaggatgccggtgagtacacttgccttgccggaaactccattggactttcacaccactcagcttggctgaccgtgcttgaggcactggaggagcgtcctgctgtgatgaccagcccgctgtatctggagattatcatctattgtactggtgcttttttaatctcatgtatggtgggttccgtgatcgtctacaagatgaagagcggaacaaagaagagcgacttccatagtcagatggctgtgcacaaactcgccaaatccatacccttaaggagacaggtgacagtcagtgctgactcctctgcttcaatgaattctggcgtgctcctggtcagaccgtccaggctatccagctctgggactcccatgctggcgggcgtaagcgaatatgaactgccagaggacccacgctgggaactccccagggacagactcgtgcttggtaaaccccttggcgagggatgtttcggacaggtcgttctcgcggaagccatcggcctcgacaaggataaacctaatcgggtgaccaaagtggctgttaagatgttgaaatccgacgccacagagaaggacctttccgacttaattagtgagatggaaatgatgaagatgattggcaagcacaaaaacatcatcaatctgctaggggcttgcacccaggacggcccactctatgtcatcgtggagtatgcgtccaaaggcaacttaagggagtaccttcaggcccgcagaccacccggcttagagtattgttacaacccctcgcacaaccctgaagagcaattgtcttcgaaggatctggtgagctgtgcttaccaggtggctcggggcatggaatatctggcttccaaaaagtgcatacatcgggatctggccgcgagaaatgttctggtgactgaggataatgtgatgaagattgctgatttcgggctcgcgcgggacatacatcatatagattattacaagaagaccactaacggccgcctcccagtgaagtggatggcccctgaagcactctttgatagaatatacacccatcaatccgacgtttggagtttcggcgtactactatgggagatctttactctaggcggctcaccctacccaggagtgcccgttgaggagctcttcaaactgctgaaagaaggacaccggatggataagccaagcaattgcaccaacgagctatatatgatgatgcgggactgctggcacgccgtgcccagccagcgcccaaccttcaagcaactggtggaggatttggatagaattgttgcactcacatccaatcaggagtatcttgacctcagtatgcctctggaccagtactccccatcattccccgatactcggagctccacatgttcatcaggtgaggatagcgtgttctctcatgagccattgcccgaagagccttgtttaccacggcatcctgcccagctggcaaatggaggactcaaacgccgttag

SEQ ID NO: 117037 - DNA, 897 bp, Artificial Sequence
  Description of Artificial Sequence: Synthetic coding sequence
atgtggagttggaagtgcctccttttttgggctgttttggtgaccgctacactctgcaccgctcgcccatccccaactctgccagagcaggcccagccatggggcgcaccagttgaagtggagtctttcctcgtgcacccaggtgatctgctccagctgcggtgtcgtttgcgagacgatgtgcagtcaataaattggctgcgtgacggggtgcagcttgctgagtccaatcgtaccagaataactggcgaagaagtggaggtgcaagattcagtccctgccgatagcggtctatatgcctgcgttactagcagcccatcgggctctgacacgacatacttttctgtgaatgtctcagacgccctgccttcatctgaggacgatgacgacgacgacgacagcagtagtgaagagaaagagacagacaacacaaaaccaaacaggatgcccgtggccccctattggaccagcccagaaaagatggaaaaaaaattgcatgcggtgcccgctgctaagaccgtgaaattcaagtgtccgagttcaggcacccctaacccaacactgcggtggcttaaaaatggtaaggaattcaagcccgaccacagaatcggcggatacaaggtacggtatgccacatggtcaataattatggactctgtggtgcccagcgacaaaggtaattatacgtgcatcgtggagaacgagtatgggagtatcaatcatacataccaactggatgtggtcgaaaggtctccgcaccgtcctatcctccaggcgggcctacctgccaacaaaactgtggctctggggtctaatgttgaatttatgtgtaaagtgtacagtgatccacagccacacatccaatggctgaagcacatcgaggtgaatgggtcttag

SEQ ID NO: 117038 - DNA, 438 bp, Artificial Sequence
  Description of Artificial Sequence: Synthetic coding sequence
atgtggtcctggaagtgtttactcttttgggcagtactggtgacagccaccctatgtactgcccggccatcccccaccctcccagagcaggacgccctcccttcctctgaggacgacgacgatgacgatgatagcagcagtgaggaaaaagaaacggacaatacaaaaccgaatccagtggcgccgtattggacaagccctgagaagatggagaaaaaactgcacgcagtgccagcggccaagaccgtgaagttcaagtgtccaagcagtggcacccctaaccccaccctccgatggctgaagaacgggaaagagttcaagcctgaccacagaataggtggttataaagtgagatacgctacctggagcatcattatggattctgtggtgccttctgataaaggaaattatacatgtatcgttgaaaatgagtactag

SEQ ID NO: 117039 - DNA, 429 bp, Artificial Sequence
  Description of Artificial Sequence: Synthetic coding sequence
atgtggagctggaagtgtttgcttttttgggccgtactggtcactgccaccctgtgtactgctcggccttcacctacacttccagaacaggatgccctgccaagcagcgaggacgacgatgacgatgacgatagctcctcagaagagaaagaaaccgataataccaagccaaacaggatgcctgtggccccctattggacaagcccagaaaagatggaaaaaaagctgcatgctgtgcctgccgctaaaaccgtcaaatttaagtgccccagttctggaacccccaatccgaccctgagatggctcaaaaacggcaaagaatttaagccagatcataggattggaggatacaaggtgcggtatgctacttggtccatcattatggacagtgtcgtaccctctgacaagggcaattatacctgcatctag

SEQ ID NO: 117040 - DNA, 258 bp, Artificial Sequence
  Description of Artificial Sequence: Synthetic coding sequence
atgtggtcctggaagtgtctgttgttctgggcggtgttagtgaccgctacattgtgtacagcacgcccatctcctactctgccagagcaagatgcactgccgtcatctgaggatgatgacgacgacgacgactcgagtagcgaagaaaaggaaactgataatacgaagccaaatcctgtcgccccatattggacctccccagagaagatggagaagaaactgcatgccgtccccgccgcaaagaccgtaaagttctag

SEQ ID NO: 117041 - DNA, 2463 bp, Artificial Sequence
  Description of Artificial Sequence: Synthetic coding sequence
atgtggtcttggaaatgtcttctgttctgggcggtgctggttacggccacactgtgcacagcaaggccaagtcctacccttcctgagcaggctcagccctggggtgcaccggtggaagttgagtcatttttagtgcacccgggagatctgctccaattgagatgccgcctccgggacgacgtccaatcaattaactggcttagagatggcgttcagctggcagaaagcaaccgtacacgaatcactggcgaagaagtggaggtgcaggattctgtgcctgctgacagcggcctgtacgcttgcgttacatctagcccatccgggagcgacactacgtacttttccgttaacgtctctgatgcactgccatcctccgaagacgatgatgatgatgatgatagcagttcagaagagaaggagactgacaacaccaagcctaacaggatgccggtggcgccgtattggaccagcccagagaagatggagaagaagctccacgctgtgcccgctgcaaaaacggtgaagtttaaatgccccagctccggcacccccaacccaaccctgcggtggctgaaaaacggcaaggaattcaaaccagaccatagaatcggaggatataaggtccgttatgcaacctggtctatcatcatggactcagtagtcccttccgacaaagggaactatacttgcattgtggagaatgaatacggcagcattaatcatacctatcagctggacgtggtggaacgctctccccatcgaccgatcctgcaagctggcctgcctgccaataaaactgttgcactcgggtccaacgttgagttcatgtgtaaggtgtacagcgatcctcagccccacatacagtggctcaaacacattgaagttaatgggagcaagattgggcccgacaatttaccctacgtgcagatcttgaagactgctggtgtgaacactacagataaggagatggaggttctgcacctgcgaaatgtgtcctttgaggatgcaggtgaatacacatgcctcgccggtaattctatcggattatcccatcactcagcatggcttaccgtcttagaggccctggaagagaggccggctgttatgactagtcctctctacctggagattattatttactgcacaggcgcttttctcatcagctgcatggtcggctccgtcattgtctacaagatgaagtctggcaccaagaagtcagatttccattcacaaatggctgtgcacaaactcgccaagtccattccactccgaagacaggtctctgctgatagtagcgcaagcatgaattcaggagtcctcctggtacgcccatcccggctgtcctcaagtggaacccccatgctggctggcgtgtcagagtacgagctgccggaagatcccaggtgggaactcccaagggatcgtctcgtactcgggaaaccccttggcgagggatgctttgggcaggtcgttcttgccgaagccatcggacttgacaaagataagcccaacagggtcacgaaggtggctgtgaagatgttaaagtctgacgcaacagaaaaggatcttagtgacctgatctctgaaatggagatgatgaaaatgatcgggaaacataagaatataataaaccttctcggagcttgcacccaggacggccccctctatgtgattgtggagtatgcctccaaggggaatctccgtgaatacctgcaggcaaggaggcctcctggcctcgaatattgttacaacccctcgcataatcctgaggaacagctcagctctaaggacttagtgtcttgtgcttatcaagtggctagggggatggagtatctggcgagtaagaagtgtatccatcgcgatttagccgccagaaacgtcttggtaaccgaggataatgtaatgaagatagctgactttgggctcgccagagacatccatcacatagattactataagaaaactaccaatggccgcctgcccgttaagtggatggctcccgaagccctctttgaccgcatctatactcaccagtccgacgtgtggagttttggggtgctgctgtgggaaatttttactctgggaggtagtccgtacccaggggttccagttgaggaactgttcaagcttctgaaggagggacatcgtatggacaaaccatccaactgcacaaacgagctgtatatgatgatgagagactgttggcatgctgtgcccagtcagcgcccaaccttcaaacagttggtggaggacttagaccgcatcgttgccctaacaagtaaccaggagtatctggatctgagtatgccccttgatcagtatagtcctagtttccccgatactaggagttctacatgctcctccggggaggacagtgtcttcagccatgagccactgcccgaagaaccctgcctcccacgccatcccgctcagctagcgaacgggggtctcaagcgtcgctag

SEQ ID NO: 117042 - DNA, 2010 bp, Artificial Sequence
  Description of Artificial Sequence: Synthetic coding sequence
atggtttcttggggtcggtttatttgcctggtagttgttactatggccaccctgagcctcgctcgtccatcattcagtcttgtggaagacacaaccctcgaacctgaagacgctatctctagcggagacgacgaggacgacaccgatggagcagaggacttcgtcagcgaaaactcaaacaataagcgcgccccttactggactaacaccgaaaagatggagaagagactacacgcagtgccggcggccaacaccgttaagtttcggtgcccagccggaggtaaccccatgcccacgatgcggtggttaaagaacggaaaggaatttaagcaagaacatcgcataggaggctataaggtgagaaatcagcactggagcctgattatggagagcgttgtacctagtgacaaaggcaactatacctgtgtggttgagaatgagtacgggagcatcaaccacacataccacctggacgtggtggaaaggtcgccacataggccaatcctgcaggctggcttgcccgctaacgctagcacggtggtagggggagacgttgaatttgtctgtaaggtgtattccgatgcccaaccacacatccagtggatcaaacatgtcgagaaaaacgggtctaaatacggtcctgatggactgccatacctgaaagtcctgaaggctgcaggtgttaatacaaccgacaaggagatcgaagtgttgtacatccggaacgtaaccttcgaggacgcgggagaatatacatgtttagccggaaactcaataggcattagtttccatagtgcttggctcaccgtactgcccgcccccggtcgggaaaaggaaatcacagccagtccagattaccttgagatagctatctattgcatcggagtattcctcatcgcctgcatggtagtcacagtgatcttgtgtaggatgaaaaatactactaagaagccggacttctcctcacagcctgccgtacataaactgaccaagcggatccctctgagaagacaggtaagcgccgagagctcttcaagcatgaattccaacaccccgttggtgagaatcaccacaagactgtcttccacagcagatactccaatgttagcgggcgtctccgaatacgagcttcccgaggaccccaagtgggagttcccccgggataagctgaccctaggaaagccgctgggtgagggctgctttggtcaggtcgttatggcagaagctgtgggaattgataaggataaaccaaaagaggctgtcactgtggctgtgaagatgctgaaggacgatgccactgagaaagacctcagtgacttggtgagtgagatggagatgatgaaaatgatcgggaagcacaaaaacatcatcaatcttctgggggcctgtacgcaggacggtcccctctacgtgatagtcgaatacgctagtaaaggaaacttgcgggagtacctcagagcacggcggcccccagggatggaatattcatacgacattaacagggtgcctgaagagcaaatgacattcaaagacctggttagctgcacctaccagctcgcccgcgggatggagtatctggcatcccagaagtgtattcatagagatctggcggcacgaaacgtcctcgtgacagaaaacaacgtaatgaaaatcgctgacttcggcctggcgagagatattaacaacatagactattacaagaagacaacaaatggccgtctcccagtaaaatggatggcacccgaggcactgtttgaccgggtgtacacacatcagtcagatgtgtggtcattcggagtgctgatgtgggagattttcaccctcggaggcagtccctaccctggcattcccgtggaagagctgttcaagcttctcaaagagggtcatcgtatggataaacccgcgaattgtacaaacgagctgtacatgatgatgcgagattgttggcacgccgtcccctcccagaggcctactttcaaacagcttgttgaagacttagatagaatatag

SEQ ID NO: 117043 - DNA, 2460 bp, Artificial Sequence
  Description of Artificial Sequence: Synthetic coding sequence
atggtgtcttggggtagatttatctgcctcgtggttgttacaatggccacactgagcctggcgaggccatcattcagcctcgtggaagacactacgcttgagcccgaagagcctcctacgaaatatcagatctctcaacctgaggtctacgtggccgctcccggagagtctttggaagttaggtgtctcctgaaagatgccgctgttatttcctggaccaaggatggggttcatcttggtccaaacaaccggacggttctcattggggagtatctccaaattaaaggcgcgacgcccagggacagtgggttatatgcctgtacagcttcaaggaccgtggatagcgagacatggtacttcatggtgaatgtgaccgacgccatcagttcgggcgacgatgaggacgacaccgatggcgccgaagattttgtgtctgagaattcaaacaacaagagggccccatattggaccaatacagagaagatggagaagcgactccacgccgtcccagccgccaacacagtgaaatttaggtgtcccgccggggggaatcccatgccgaccatgagatggctaaaaaatggcaaggagtttaaacaagaacaccggattggagggtataaggtccgtaaccagcattggtccctgatcatggaaagcgttgtccctagcgacaaggggaattacacgtgcgtggtagagaacgaatacggtagcataaaccacacataccatcttgatgtcgtggagagaagtccgcatagacctatcttgcaggctgggctgcctgccaacgcatcgaccgtcgtcgggggcgatgtggagtttgtgtgtaaggtttactctgacgcgcaaccccacattcagtggataaaacatgtcgaaaagaatggttccaagtatggtcctgacggcctcccatacctgaaggtccttaaggccgccggcgtcaacaccacagacaaggaaattgaagtcctctatattaggaacgtgacttttgaggacgcaggcgagtacacttgtctggccggaaactcgattggcattagcttccactctgcctggcttacagtgctgcctgcgcctggccgcgagaaagaaatcaccgcttctcccgattacctggagatcgcgatctactgcatcggagtctttcttatcgcatgcatggttgtcacagttattctctgtaggatgaagaatactacaaaaaaacccgacttttcctctcagcccgcggtacacaaactcaccaagaggatcccactccggaggcaggtatccgccgagagctcttcttccatgaacagtaacacaccgctggtcaggattaccaccaggctgtcatctacggccgatacacccatgttggctggggttagcgagtatgagctgccggaagatccgaaatgggagtttccccgagataaacttaccttaggaaaaccccttggagagggatgttttggacaggttgtgatggctgaggctgtcggaatagacaaggacaaaccgaaagaggctgtgactgtcgcagtcaaaatgctgaaagacgacgcaacagaaaaggacctgagcgatctcgtctccgaaatggaaatgatgaaaatgataggaaagcacaaaaatatcatcaacctgcttggagcttgcacccaagatgggcctctctatgtgatcgttgaatatgcgtccaaaggcaatttgcgggaatatttgcgcgcgcgaaggccaccagggatggagtattcatatgatatcaatcgcgtcccagaagagcagatgacttttaaggacctagtatcttgtacctatcagcttgcccggggaatggaatacctggccagtcagaagtgcatacaccgggacctggccgcccgaaacgtgctggtcacagagaacaacgttatgaagatcgcggatttcggcctggccagggatataaataacatcgactattataagaagacgaccaacgggcggcttcccgtaaagtggatggcccccgaggctcttttcgaccgggtctatactcaccaatcagacgtgtggtcttttggagttctgatgtgggaaattttcacccttggtggctcaccttaccctggaatacctgttgaagaattgtttaaactgctgaaagaaggacaccgcatggacaagccggcaaactgcactaatgaactctatatgatgatgcgggattgctggcacgccgtgcccagccagagacccacatttaaacagctggtggaagatctggataggattttgaccctcactaccaacgaggagtacctggatttaagccagcctctggaacaatattccccctcataccccgatacaagatctagctgctcttccggagacgacagtgtgttctctccagaccctatgccttacgaaccctgtctgccacagtatcctcacattaatggcagcgttaaaacatag

SEQ ID NO: 117044 - DNA, 2358 bp, Artificial Sequence
  Description of Artificial Sequence: Synthetic coding sequence
atggttagttggggtcggtttatatgtctggtcgtagttacaatggctaccctctccctggcaagacccagtttctccctcgtagaagataccacgctggagcccgaagagccacccactaagtatcagataagtcaaccagaggtctacgtcgctgcccctggagaaagcctcgaagttaggtgtctgctgaaagatgcggccgtgatcagctggactaaagacggcgtccatctgggtccaaataacagaaccgtgcttatcggagagtaccttcagatcaagggggccacgccgcgcgactctggtctgtatgcttgcacggcttcaaggacagtcgacagcgagacctggtatttcatggtaaacgtcaccgatgccatcagctcgggagatgatgaagatgacacagatggcgccgaagactttgtctccgagaattctaacaacaaacgtgcaccttactggaccaataccgagaagatggaaaaaaggctccacgctgtccccgcggctaacacagtcaagtttagatgccccgccgggggtaatccaatgcctacaatgaggtggttgaagaatgggaaggagttcaagcaggagcaccgcatcggcggctacaaggtccgcaaccagcattggtccttgatcatggagtccgtggtgccatctgacaaaggcaattacacctgtgtggtagagaacgagtatgggagtatcaatcacacatatcatctggatgtggtggagcggtctccccaccgcccaattctccaggccggactgccagccaacgcttccaccgttgtcggcggggacgttgaatttgtatgtaaagtctactcggacgcccagccccacattcaatggatcaagcacgtcgagaaaaacgggagtaagtacggcccagatggcctgccataccttaaagtattgaaagcggcaggagttaatactactgataaggagatcgaagtcctgtacattcggaacgtgacctttgaggacgccggcgagtatacttgtctggctggcaattccattggtatcagcttccattctgcttggctgacagtgctaccagcaccgggtcgagagaaggagatcacagcgtctcccgactacctggaaatcgccatttattgtataggagtctttttgattgcctgcatggttgtgactgtaatcctctgtaggatgaagaacaccacgaaaaaaccggactttagctcccagcctgccgtgcataaactgaccaaaagaataccactgcggaggcaggtctcagccgagtccagctcttctatgaattccaatactcccctggtgcgaatcactacgcgcctttcctcaaccgcggacaccccaatgcttgccggcgtgtccgaatacgagctccctgaggatccgaagtgggaattccctcgggacaaattgaccctggggaaacctttgggagaagggtgtttcggccaggtggtgatggctgaggctgtgggcatcgacaaagacaaacccaaggaggctgtaaccgtagcggtgaagatgctgaaagacgacgccaccgagaaagacctgtcagacctggtgagcgagatggagatgatgaaaatgattggaaagcacaagaatatcattaacctgctgggtgcttgtacacaggacgggccactttatgttatcgtggagtacgcaagtaagggtaatcttagagagtatctgagggctcgccgccccccagggatggaatactcctacgacattaatcgggtgcccgaagaacagatgactttcaaagacctcgtttcatgcacataccagctcgcaaggggaatggaatacctggcgtcgcagaagtgtattcatagggacctggccgcccggaacgtcttggtcacagaaaacaatgtcatgaagattgccgacttcggcctggctagagatatcaacaacatcgactactacaagaagacaacgaacggacggcttccagtcaaatggatggcccccgaggctctgttcgacagagtgtacacccaccagagcgatgtgtggagttttggtgtcctcatgtgggaaatattcacgttgggaggtagtccgtaccctggcattcccgtagaagagttgtttaagctgctgaaagaaggccaccgcatggacaaacctgctaattgcaccaacgagctgtacatgatgatgcgtgactgttggcatgccgttccctctcagcgccccaccttcaagcaacttgtagaagacctcgatcgaattcttacgctgaccaccaacgaggagtatttagacctctctcagccgctggagccctatagcccctgctacccggatcctcggtag

SEQ ID NO: 117045 - DNA, 2115 bp, Artificial Sequence
  Description of Artificial Sequence: Synthetic coding sequence
atggttagctggggacgcttcatttgcctagtggtagtgactatggccactttgagtctggctcgaccatctttcagtctggtagaggacacaacactggagcccgaaggcgctccgtactggacaaacacagaaaaaatggagaaaagactgcacgccgtgccagccgcaaacactgtgaagtttaggtgtcccgcaggaggtaacccgatgccaaccatgcggtggctgaaaaacggaaaagagttcaagcaagagcacagaatcggcggctataaggttcgtaaccagcattggagccttatcatggaatccgtcgtgccgtcggacaagggtaactacacctgcgtggtagagaatgagtatgggtccatcaaccatacctaccatctcgacgtggtggaaagatctccccatcgcccgatcctgcaggccggtctcccagctaatgcttctaccgtggttggaggtgatgtggagttcgtctgcaaggtgtacagcgatgcgcagccacatattcagtggattaaacatgtcgagaagaacggtagtaagtacggtcctgatgggctgccctacctaaaggtgctcaaagctgccggggtcaacacaaccgacaaagagattgaggtgctgtacatccgcaacgtaacctttgaggacgcaggcgagtacacctgcctagccggtaattcaatcggaatttctttccatagtgcttggctgactgtcctcccggcccccggccgcgagaaggagataacggcctcacctgattatctggagatcgctatctactgtatcggagtcttcctgatcgcttgcatggtggttaccgtgattttgtgtagaatgaaaaacacaacgaagaaaccagatttttcaagtcagccagccgtgcataagctgaccaaaagaattccactccgcaggcaggtgagcgccgaaagctcaagctctatgaactctaacactccacttgtgagaattacaacccggctttccagtacagctgacactccgatgctcgctggggttagtgagtacgagctccctgaggaccccaaatgggagttcccccgggacaaactgactcttgggaagcctttgggggagggttgtttcggtcaagtggtcatggcagaggccgtcggaattgacaaggacaagcccaaagaggcagtcacagttgccgtaaaaatgctgaaggatgacgcgactgaaaaggatctgtcggacctagtgagtgagatggaaatgatgaaaatgatcggcaagcacaaaaacattattaatctgttaggggcctgcacacaggatggaccactgtatgtcattgtcgagtacgcctccaagggcaatttgcgagaatatttacgagccagacgcccacccggcatggaatattcatacgacattaaccgggtccccgaggaacagatgacttttaaagacctggtaagctgcacataccagcttgcccggggcatggagtatcttgcgagccagaagtgtatccatcgcgatttggccgctcgtaatgtgttggttaccgaaaataatgtgatgaagatcgctgattttggattggctcgggatatcaataacatcgactattacaaaaagacaacgaatggacgtctgcccgtaaagtggatggcaccagaagccctttttgatagagtctacactcaccagtcggatgtgtggagttttggcgtccttatgtgggagatatttaccttgggaggcagtccttaccctggcatcccagtggaggagctgtttaaattgttgaaagaggggcaccgcatggataaacctgctaactgcactaatgaactgtacatgatgatgagagactgttggcacgcagtgccctctcagaggccaacatttaagcagctcgtggaagacttggacaggatactgaccctcaccactaatgaggagtacctcgatctttctcagcctctggagcagtacagtcctagttatcccgacactcgtagcagctgttcaagcggcgacgacagtgtattcagccctgaccccatgccatacgagccctgtttgccccagtaccctcatattaacggcagtgtgaagacgtag

SEQ ID NO: 117046 - DNA, 2124 bp, Artificial Sequence
  Description of Artificial Sequence: Synthetic coding sequence
atggtatcttggggacggttcatctgcctcgtcgtggttacaatggcgaccctatccctcgctcgaccttccttctcccttgtggaagatacgaccttagagccggaggacgccatctcgtctggagacgacgaagatgacaccgacggagcagaggacttcgtgtctgagaatagcaacaacaagagggctccgtattggaccaatacggaaaagatggaaaaaaggctccacgcggtccccgccgcaaataccgtgaaatttaggtgccccgctggcggtaatccaatgcccactatgaggtggctgaaaaatggaaaggaatttaaacaggagcaccggatcggtggatataaggtgagaaaccagcactggagcctgatcatggagtcggtcgttccctctgataaaggtaattatacatgtgtggttgaaaacgaatacggcagtattaaccatacttatcaccttgatgtagttgaaaggtctccacaccggccaatattgcaagccggtttaccggccaacgcgtcaaccgtcgtcggtggtgacgtggagttcgtttgtaaggtctattccgacgcgcagcctcacatccagtggattaaacacgtcgagaaaaatggttcaaaatatggaccagatggactcccgtatcttaaagtcctgaaagccgccggagtaaacaccaccgacaaggagatagaggttctctacatccgcaatgtgacttttgaggacgcaggggagtatacatgtttagcgggtaacagcataggaatctcctttcactccgcatggctcactgtgttacctgcccctggaagagagaaggagatcactgccagtcctgactacttagagattgctatctactgtataggggtctttttgatcgcatgcatggtagtaactgtgatcttgtgtaggatgaaaaacactacgaaaaaaccagacttttccagtcagcctgccgtgcacaagctcaccaaaaggattccactgcgtcgccaggtgacagtgtcagctgaaagttcctcaagtatgaactcaaacacgccgcttgttaggatcacaacacggctgtctagtacagcggacacccctatgttagcaggcgtcagcgagtacgaattacccgaggaccccaagtgggaattccctagagataaactgaccctgggaaaacctctcggggaagggtgttttggacaggtggttatggcggaagctgtgggtattgacaaagataaaccaaaggaagctgttacggtcgcagtgaaaatgctaaaagacgacgcgactgagaaggatttgtctgatttagtgtccgaaatggaaatgatgaaaatgatcggaaaacacaaaaatattataaatctcctgggggcttgcacccaggacggaccactctatgtgatcgtagagtacgcttctaaaggtaatttacgtgagtatcttagagcgcgcaggccccctggtatggagtacagctacgacattaacagggtgccggaggaacagatgaccttcaaagatctggtgtcatgcacatatcaacttgcaagggggatggaatatctggcgtctcagaaatgtatacacagggaccttgccgctagaaacgtgctggtgacagaaaacaacgtcatgaaaatcgctgatttcggccttgctagagatataaataacatcgattactataagaaaactaccaacggacggcttcctgtgaaatggatggcacccgaggccctttttgaccgtgtctatacccaccaatctgatgtgtggagcttcggcgtgcttatgtgggagatcttcaccctgggcggttctccataccccggtatacccgtggaagagctctttaagctgctaaaggagggccaccggatggacaagcctgctaactgtacaaacgaactctacatgatgatgagggattgctggcacgccgtcccaagccagagacctacttttaaacagctggttgaagacctggatcgcattcttactctgaccaccaacgaagaagagaagaaggtgagtggggctgtcgattgccacaaaccaccctgcaacccatcccacctgccatgtgtgttggctgtggaccaatag

SEQ ID NO: 117047 - DNA, 2466 bp, Artificial Sequence
  Description of Artificial Sequence: Synthetic coding sequence
atggtgtcctgggggaggttcatctgcctggtagtagtgaccatggcaactctgagccttgccagaccatcattctccctagtagaggacactaccttggagcctgaggaaccacctaccaaatatcagatttcgcaacccgaagtctatgttgcagctccaggagaaagcttggaggtccgatgtttgcttaaggacgcagccgtgattagctggaccaaggacggtgtgcatctcggtccaaacaaccgcacagtattaattggcgagtacctgcaaataaagggagccacaccccgagacagcggcctgtacgcatgcactgcgtccagaactgttgacagcgagacctggtacttcatggtgaacgtgacggacgcaatcagttcaggtgatgatgaagacgacactgatggcgccgaagactttgttagcgaaaatagcaacaacaaaagggccccatattggactaatacagagaagatggaaaagagacttcacgctgtgcccgcagccaataccgtcaagtttcgttgcccagcagggggtaaccccatgcctactatgcgctggctcaaaaatggaaaagagttcaagcaggagcataggataggtggctacaaggtgcgcaaccagcactggtctctgataatggagagcgtggtaccctctgataagggcaactacacttgtgtcgtcgaaaatgagtatgggagtatcaatcacacatatcatctagatgtggttgagcgtagtccgcatcgccccatccttcaagccgggctcccagcaaatgcatctacagtggtggggggtgacgtcgagttcgtgtgtaaggtgtattcagacgcccagccacacatccagtggatcaaacatgtggagaagaacggcagtaagtacggaccagatgggctcccgtacctcaaggtgctgaaggccgctggggtcaacacaacagacaaagagatagaagtactgtatattagaaatgtcacatttgaagacgcaggcgagtacacctgcctggccggcaacagcattggaatctcgttccactctgcgtggctcaccgtccttcccgctccaggccgggagaaggaaattaccgcttctcccgactatctcgaaatcgccatatattgtattggtgtgttcctgatcgcctgcatggtggtgacagtcatcctgtgcagaatgaagaataccaccaaaaaaccagatttcagcagccagcccgcagttcacaagcttaccaagcggatacctttgcgccgccaagtgaccgtttcagctgaatccagcagctccatgaactctaatacaccattagtgcgaataactacaagactctcttccactgcagatacacccatgttagcgggcgtctcggaatacgagctgccggaggatcctaagtgggagttcccacgcgataaactgacgttaggtaagccactcggggagggatgcttcggtcaggtggtgatggctgaggctgtcggcatcgacaaagacaagcccaaagaggccgtgacagtggccgtaaagatgctcaaagatgatgccactgagaaggacctgagtgaccttgtctcggagatggagatgatgaagatgattgggaaacacaaaaatatcatcaatcttctgggagcgtgtacacaggacggacccctgtacgtaatagtggagtacgccagcaaaggcaacctgcgggagtaccttcgtgcccggaggcctcccggcatggagtattcgtacgatatcaacagggtgcctgaggagcaaatgacttttaaagacctcgtctcctgtacttaccagctggccaggggtatggagtacctcgcctcccaaaaatgtatacacagggacctggcggcgagaaatgtgctggtcacagagaataacgttatgaaaattgcggactttggactggctcgggatattaataacattgattattacaaaaagacaacaaacggaaggcttcccgtaaagtggatggctcctgaggcactgttcgaccgggtgtacacccaccagtccgatgtgtggtcgtttggggttctgatgtgggagatcttcaccctgggcggttccccctatcccggaattcctgtggaggagctgttcaaactactaaaagaaggacacagaatggacaagccagccaattgcaccaatgagctgtatatgatgatgcgcgactgttggcacgctgttccatcccagagaccgacgtttaaacaattggtggaagacctggaccggatcctgactctcacaaccaatgaagagtacctggatctgtctcagccgcttgagcagtattctccaagctaccctgatacccggagtagctgttcttcaggtgatgactccgtcttttctccagaccccatgccctacgagccatgtctgcctcaatacccccatatcaatggctcagtcaagacttag

SEQ ID NO: 117048 - DNA, 765 bp, Artificial Sequence
  Description of Artificial Sequence: Synthetic coding sequence
atggtatcgtggggccgttttatctgcctcgtggtcgttacaatggcaacattatctttggctagaccttcctttagtctggttgaggacactacactggaacccgaggagccacccacaaaatatcagattagccagcccgaggtgtatgtagccgcgcccggagaatctctggaggtgcgttgtctgctcaaggatgccgctgtgatatcttggaccaaagacggcgtgcacttgggccctaacaaccggacagtgcttataggagagtatctgcagatcaaaggtgccacccctagagactccggcctgtatgcatgcacagcctctcggaccgtcgactcagaaacatggtattttatggttaacgtaacagacgcgataagctctggagacgacgaagacgacacagacggcgccgaagatttcgtttccgaaaactccaacaataagagagctccctactggacaaataccgaaaaaatggagaaacgtctacacgccgtcccggctgccaatacagtcaagttcaggtgccctgctggggggaatccaatgcccacaatgcgttggctgaagaatggaaaggagttcaagcaggaacaccgtataggcgggtacaaagttagaaaccaacattggtccttgataatggagtccgtggtgccctccgataagggtaattacacctgcgtggtcgagaatgagtacggttctatcaaccacacctatcacctggatgtggtggggtcacaaggcctttag

SEQ ID NO: 117049 - DNA, 2043 bp, Artificial Sequence
  Description of Artificial Sequence: Synthetic coding sequence
atggtgagttggggccgatttatatgcctcgtggtagtcacaatggctaccctgagtttggcaagaccatctttcagcctggtggaggataccacactggaacccgaggatgctatatcatctggtgacgacgaggatgataccgacggtgctgaagatttcgtctcggaaaatagtaataacaaacgcgccccttattggacaaatactgagaagatggaaaagcgcctccacgcagtccctgctgctaacacagtgaaattccgatgtcctgcaggggggaatcccatgccgaccatgaggtggctgaaaaatggtaaggaattcaaacaagagcaccgcatcggcgggtacaaggtgcgcaaccaacactggagccttataatggagagtgtagtccccagtgacaagggcaattatacctgcgtagtggaaaatgagtacggcagcattaaccacacttatcacctggatgtcgtggagcggtccccgcaccgccctattctgcaagctggacttcctgccaatgcttctaccgtggtggggggtgacgttgagtttgtatgtaaggtgtactccgatgcacagccccacatacaatggatcaaacacgtggaaaaaaacggtagcaagtatggaccagacggactaccttacctcaaggtcctgaagcacagtggcattaattcttccaacgctgaagttcttgccctgttcaacgtgaccgaggcagacgcaggcgaatatatatgcaaagtatcgaactatattggccaagccaatcagagcgcttggttgaccgtgctccccaagcagcaggcacctggacgagaaaaggaaatcacggcctctcccgattatctcgaaatagctatttactgtatcggtgtctttcttattgcttgcatggtggtgactgtgatcctgtgcaggatgaaaaacaccactaaaaaaccagacttttctagtcaacctgcagttcataagttgacaaagcggatccctctaagaaggcaagtcaccgtctccgccgagagtagctcttccatgaatagtaatactcccctggtccgcatcactaccaggctgagttccacggctgacactccaatgttagcgggagtaagtgaatacgagctgccggaggaccccaaatgggagttcccaagagacaaactgactttaggcaagccactaggtgagggctgtttcggccaggtcgttatggctgaggccgtggggatcgataaagacaagcccaaagaagcggttactgtcgctgtcaagatgctgaaggatgatgctactgaaaaagacttgtcagatctggtttcagagatggagatgatgaagatgatcggaaaacacaaaaatatcataaatttgttgggcgcctgtactcaggatggtccattgtatgtgattgttgagtacgccagtaagggtaacctgagggaatacctgagggccagacgtcctcccggcatggagtacagctatgatatcaaccgcgtgccagaggagcagatgacctttaaagacctagtttcttgcacgtaccagctcgccagagggatggagtatcttgcgtcccaaaaatgtatccatcgggatcttgccgcacgaaacgtgttggtcactgaaaataacgtgatgaagattgccgattttgggctggcgcgtgacatcaacaacatcgattattacaagaagacaaccaatgggagactccccgttaagtggatggccccagaggccctgttcgaccgggtgtatactcaccagagtgatgtctggagttttggcgttctgatgtgggagatcttcacactcggtggcagcccttatccgggaatcccagtggaggaactgtttaagctgttgaaagagggccatagaatggacaagccggcgaactgtaccaacgagctgtatatgatgatgcgggactgctggcacgctgtgccctctcaacgccctacttttaaacagctggttgaagacctcgaccggattctgacattgaccacgaacgagatctag

SEQ ID NO: 117050 - DNA, 2310 bp, Artificial Sequence
  Description of Artificial Sequence: Synthetic coding sequence
atggtttcgtggggacggttcatttgcctcgtagtcgttaccatggccaccctctctctagccaggccgtcattcagtctcgtggaggataccacactcgaaccagaggagccacccaccaaataccaaataagtcagccagaggtgtatgtcgccgcccccggtgaatcactggaggtgaggtgtctgctgaaggacgctgcagtaatcagttggactaaggatggcgttcatttagggcccaataaccgcacagtactgatcggagaataccttcagattaagggtgccacgccaagggatagcggtctctacgcctgcactgccagcaggactgtagatagcgagacatggtattttatggtgaatgtgaccgacgccatctcctctggcgacgacgaagacgatacagatggcgcagaggactttgtgtccgagaacagcaacaacaagagagcaccttactggactaacaccgagaagatggagaagcggctgcacgctgtcccagccgctaataccgtgaagtttaggtgtccagctggaggcaatcccatgccaacaatgcgatggctgaagaacgggaaggaatttaagcaggaacacaggataggtggctacaaagttcggaaccaacactggtcactgatcatggagagcgtagttccaagcgataaagggaattacacatgtgtagtggaaaacgaatacggctccatcaatcacacttaccacctggacgtggtcgaaagatcaccacacaggccaatcctccaggccgggctgccagctaatgcttcaactgtggttggcggggacgtggagtttgtgtgtaaggtgtatagtgacgctcaaccacacattcagtggattaagcacgtagagaaaaacggctctaagtacggacccgatggcctcccctatttaaaagtgcttaaacactccggaattaactcaagtaatgccgaagttcttgcccttttcaacgttaccgaagctgatgccggggaatacatttgtaaggtcagcaattacataggacaagcgaaccaatctgcctggttgactgtgttacccaagcagcaggcgcctggacgagaaaaagagattaccgcatctccggattacctggaaatcgcaatttactgcatcggcgtctttctcatagcctgcatggtagtgaccgtcattctgtgtagaatgaagaacacaaccaagaagcctgacttctcttcccaacctgctgtgcataagctgaccaagcgcattcctttgcgaaggcaggtgacggtgtctgcagaaagcagcagctcaatgaattcaaacacacccctggtccgaattacaacaagattgagcagcaccgctgatacccctatgttagcaggagtgtctgagtatgagctgccagaggacccaaaatgggagtttccaagagacaagttgaccttaggaaagcctctgggtgaagggtgcttcggtcaggtcgtcatggcggaagccgtagggatcgacaaagataagcctaaagaggctgtgactgtggccgtcaagatgctcaaagatgatgcgacggaaaaggatctcagcgatttggtttctgaaatggagatgatgaagatgataggtaaacacaagaatatcattaatcttctgggggcttgcacccaggacggtcctctctatgtgatagtggagtacgccagtaagggcaacctgagagaatacctgcgggcccgtcgccccccaggtatggaatatagttatgacattaaccgcgttcccgaagaacaaatgacattcaaagacctggtgagttgtacataccagcttgcccgcgggatggagtacctggcatcccagaaatgcatccacagagacctcgcagcacgtaacgttctggtaaccgagaataacgttatgaagatcgccgacttcggcctggccagggatataaacaatatcgactactataagaaaaccactaacggcagactgccagtgaagtggatggcccctgaggcccttttcgatcgtgtctatactcatcaaagcgacgtgtggtccttcggggttttaatgtgggagatctttactctcggaggcagcccttacccaggaattcccgtggaagagctctttaagctgttaaaagagggacaccgaatggataagcccgcaaattgcaccaacgagctctacatgatgatgcgagattgctggcacgcggtgccttcacagagacctaccttcaagcagcttgttgaagacctggatcggatccttaccctgacaacaaatgagatctag

SEQ ID NO: 117051 - DNA, 2307 bp, Artificial Sequence
  Description of Artificial Sequence: Synthetic coding sequence
atggtgagctggggccgttttatatgcctcgtagtggtcactatggccaccctgagcttggctcgcccttccttttcgctggtggaagataccacattagaacccgaggaaccgccgacaaagtatcagatatcacagcccgaggtgtatgtcgccgccccaggcgaatccctcgaagtacgctgtctcctgaaggacgcagctgtcataagctggaccaaagatggggtgcacttaggtcctaacaacaggaccgtgttaatcggagagtatctgcagattaaaggtgcaacacccagagatagtggactgtatgcctgtacagccagccgaacggttgattccgagacttggtatttcatggtaaacgtgaccgacgctatctcttcgggggacgacgaggatgacaccgacggcgctgaagacttcgtttctgagaacagcaataacaaaagagcgccctattggactaatactgagaagatggagaaacgattgcacgccgtcccggctgcaaacacagtgaagttccgttgccctgcaggcgggaatcctatgcctaccatgagatggcttaaaaacgggaaggaattcaaacaggagcatcggattgggggatataaagtacgaaaccagcactggagtctcattatggagtccgtggtcccctctgataagggaaattacacctgcgttgtagagaatgagtacggaagcattaatcacacataccacctcgacgtcgtggagaggtctccccaccgcccaatcctgcaagctggattgccagctaatgcttcaaccgtggtcggtggagacgttgaatttgtctgcaaggtttatagcgatgcacagcctcacattcagtggattaagcacgtggaaaaaaacgggagtaaatacggccccgacggcctgccatatttaaaagtgctgaaacatagcggcattaattctagtaatgccgaagtcctggcactgtttaacgtaaccgaggccgacgccggagagtatatttgcaaggtcagcaactatatagggcaagctaaccaaagcgcatggttgacagtcctccctaaacaacaggctcccggtagggagaaagaaattaccgccagtcctgattacctagaaattgctatttattgtattggtgtgttcctgatcgcttgtatggttgttactgtgatcctctgccgcatgaaaaatacgacgaagaagcctgattttagcagccaaccagctgtgcacaagttgaccaagcgaatacctcttcgacgccaggtgaccgtatctgcggagtcctcatcctccatgaatagcaacacaccgctggtgcgaattacgacacgcttatcatcgactgccgatacccctatgctcgcaggggtgagcgaatatgaattgcccgaagacccgaaatgggagtttccccgggataagctgacactgggcaaaccacttggggagggctgctttgggcaggtggtcatggctgaggcggttggcattgataaagataaacctaaagaggcggttactgtcgcagtgaaaatgctgaaagacgatgcaactgagaaggacttgagcgatctggtgtccgagatggagatgatgaaaatgatcggaaagcacaaaaacattatcaatctgttgggggcatgtacccaggacgggcctctgtatgtcatcgtcgaatacgcttcaaagggtaacctgcgagagtatttgcgcgctcgacgccctcctgggatggagtactcttatgatatcaatcgcgtgcctgaggagcagatgaccttcaaggacctggttagctgtacttatcaacttgcgcgagggatggaatatctggcaagtcagaagtgtatacatcgggacttggcagcaagaaatgtactggtaaccgagaataacgttatgaagattgcagatttcggcctggccagggacatcaacaacatcgactactacaagaagacaacaaatggccgcctgcctgttaaatggatggcacccgaggccctcttcgacagggtttacacacatcaaagtgatgtgtggagtttcggcgtactgatgtgggagatttttactctggggggctcaccttacccggggataccagtggaggagctctttaaattgctaaaagaaggccaccgaatggataagcccgctaactgtactaacgagctatatatgatgatgagagactgttggcatgcggtgccctcacaacgccctacatttaaacagttggttgaagatctagatcggatcctcacgctaacgaccaatgagtag

SEQ ID NO: 117052 - DNA, 2124 bp, Artificial Sequence
  Description of Artificial Sequence: Synthetic coding sequence
atggtatcttggggacgcttcatctgtctggttgttgttactatggcgacgctatccctggccaggccaagcttcagcttggtggaggacactaccctggaacccgagggcgccccttactggacaaacactgaaaagatggagaaacggttgcacgccgtccctgcagccaatactgttaagttcaggtgtcccgcaggagggaatccgatgcccacaatgcggtggctcaaaaacggtaaggagttcaagcaagagcaccgaatcggcggatacaaggtgcgcaatcagcattggtccctaatcatggagtcagtggtcccaagcgataagggcaactatacctgtgtggtcgagaatgagtacggatccattaaccatacttaccaccttgacgtagttgaaaggtccccccaccgccccattctgcaggccgggttgcccgccaacgcttccaccgtcgtcgggggcgacgtagagttcgtatgcaaagtgtacagcgatgcacagccccatatccagtggatcaaacacgtggagaagaatggaagcaaatacggccctgatggcctgccatacctgaaggtactaaagcacagcggcattaactccagcaacgcggaagtactcgcactctttaatgtcactgaggccgacgcaggagaatatatctgcaaggtaagcaactacatcggacaggcaaaccagtccgcctggctcacagtgctgcccaagcagcaagcgcccgggcgggagaaggagatcacagctagtccagattatctggaaattgctatttactgcattggcgtctttctgattgcttgcatggtcgtgacagtcatactgtgccgcatgaaaaataccacaaagaagccagacttctcaagtcagccagcagttcacaagctcaccaaaaggattcccttgaggagacaggtcactgtctctgccgaatccagttcttctatgaattctaatacaccccttgtcaggatcactacaagactaagttccactgcagacacccccatgctggctggtgtctctgaatatgagctgcctgaagatcccaagtgggaatttcctcgagataaacttaccttgggtaagcccctaggagaaggatgcttcggccaggttgtaatggccgaggccgttggaattgataaagacaaaccgaaggaggccgtgaccgttgccgtgaaaatgttgaaggacgacgctacggagaaggatctctcagatctggtgtcggagatggaaatgatgaagatgatcggcaagcacaagaacatcataaatctgttgggagcctgtacacaggatggccccctatacgtgatcgtggaatatgcttcaaaagggaacttacgagagtaccttagggcaaggcggccgcccggcatggagtattcatacgacataaatagagtgcccgaggaacagatgacctttaaggatctcgtctcatgtacataccaactcgcaagagggatggagtaccttgcttctcaaaagtgtatccatcgcgatctggccgccaggaatgtactcgttacggagaataacgtcatgaaaatcgccgatttcgggctcgcaagagacatcaacaacattgattactataaaaagactaccaatggacgcctcccagtcaaatggatggctcccgaagcgctgtttgaccgtgtgtatacacaccagtcagacgtctggtcatttggggtgctgatgtgggaaattttcactctcggcggatctccatatcccggcatcccagtggaagagctgtttaagctgcttaaagagggacaccgaatggataagcctgctaactgcacgaacgaactgtacatgatgatgcgagactgttggcacgccgtgccaagccagagacccactttcaagcagttggttgaagacctagaccgcattttgaccctgacaactaacgaggagtatttagatctaagtcaacctttggaacagtattctccttcctaccccgacactaggtcgtcctgctcaagcggagacgactcggtgttctcccccgacccaatgccctatgagccctgcctgccccagtatccgcacatcaacgggagtgtgaagacctag

SEQ ID NO: 117053 - DNA, 2118 bp, Artificial Sequence
  Description of Artificial Sequence: Synthetic coding sequence
atggtttcttggggaaggttcatttgtctggtcgtggttacaatggctacactgtctttggcacgaccttccttctctctcgtggaggataccactctggagcctgaagagcctcctacaaagtatcagatttctcagcctgaggtctacgtggccgcccctggcgagtctctcgaggtcaggtgcctcctgaaggacgccgccgtgatctcatggactaaggatggtgttcacttaggccctaataacagaaccgtcttgatcggggagtacctgcaaatcaagggggccacaccccgcgactccggcctctacgcttgtacagcgtcgaggacagtcgacagcgaaacctggtacttcatggttaacgtcacggatgcaatatcgagcggcgatgatgaggatgataccgacggggcagaagactttgtgtctgaaaattccaacaacaaacgggccccttactggaccaacactgaaaaaatggaaaaacgtctacacgcagtgccggcggccaacactgtgaagttcaggtgccccgccggtgggaatcctatgcctacaatgagatggctaaaaaacggcaaggaattcaagcaggaacatcgtattggggggtataaggtaaggaaccagcattggagcctgatcatggaaagtgttgtgccatctgataaggggaactacacatgcgttgtggagaatgaatacggctccatcaaccatacataccacttggatgtagtggaacggagcccacatcggccaatcctgcaggcaggtttgcctgctaacgcgtctacagttgtgggtggcgatgtggaatttgtgtgcaaggtttatagcgacgcgcagcctcatatccagtggatcaagcatgtagagaagaatggtagtaagtatggaccagatggcctgccatacctcaaggtattgaaggttagtgccgagagctcgtcctccatgaacagtaatacacctcttgtgaggataacaaccaggctgagttctacagcagatactccaatgctcgcaggcgtgagcgagtacgagctgccggaggacccaaaatgggaattcccgcgcgacaagctgactctcgggaagccactgggggagggatgtttcggccaggtggtaatggccgaagccgtgggcatagataaggacaaaccaaaagaagctgtcactgttgccgtcaagatgcttaaggatgatgcaaccgagaaagacctgagcgacctcgtttctgaaatggaaatgatgaagatgatcgggaagcataagaatattatcaacctgctaggggcgtgcacccaggacggacccctttatgttatcgtcgaatacgcctcgaaggggaatctccgcgagtatctccgggcccgcagaccacccggcatggagtactcctatgatattaatcgggtacctgaagagcagatgactttcaaagacctcgtctcatgcacatatcagctggcacgaggtatggaatacttagcgagccagaaatgtatccatagagatctggcggcccggaacgtgcttgtcactgaaaacaatgtgatgaagatcgcagacttcggccttgccagggatatcaacaacatcgattactacaaaaagaccacaaatggaaggctaccagtaaagtggatggcacccgaagccttgtttgatagggtctatacccatcagtccgatgtctggagtttcggtgtcctgatgtgggaaatcttcacattaggcggcagcccctatccggggattcccgtggaagagctgtttaaattgttaaaggagggccatcgaatggataaacctgccaactgcacaaatgagctttatatgatgatgcgcgattgctggcatgcagtacctagccagaggccaactttcaaacagctggtggaagatttggatcgcatacttactcttaccactaatgaggagtacctggacctgtcacagccactggagcagtactcaccaagctatcccgatacccggagctcatgctcaagcggcgacgacagcgtcttctccccggatcctatgccttacgagccttgtctgccccagtatccgcatatcaacggctctgtgaagacctag

SEQ ID NO: 117054 - DNA, 2130 bp, Artificial Sequence
  Description of Artificial Sequence: Synthetic coding sequence
atggtctcatggggacgtttcatctgcctcgtcgtagtcacaatggcaacgttatctttggccaggcctagcttttccctagttgaagacaccaccctggagccggaggagcctcccactaaatatcagattagtcagccagaagtgtacgtggcagcccctggagaaagcttggaagtccgatgtttgttaaaagatgccgctgtaatctcatggacaaaggatggggtgcatcttggccctaacaaccggacagtcctcattggggaatacctgcaaattaagggcgccactccccgggattctggcttatacgcttgtactgctagccggacagtggactctgaaacctggtactttatggtgaacgtcactgatgccataagctctggcgacgatgaggacgacactgatggtgccgaagactttgttagcgagaattccaataataaacgcgctccttactggaccaacaccgaaaagatggagaagagactccatgctgtccccgcggccaatacagtaaagttccgttgcccagctgggggaaacccaatgccgaccatgcggtggctgaaaaacggaaaagagtttaagcaggagcacagaataggaggatacaaggtgcgaaaccagcattggtccctgattatggaaagcgtggtgcctagtgataaggggaattacacttgtgtcgtcgagaatgaatatggatccatcaaccacacgtatcatctggatgtggtggcccccgggcgggaaaaggagataacggcctcaccagactatctggaaatagccatttactgtataggagtattccttattgcctgtatggtagtgaccgtcatcctgtgccggatgaagaacaccacaaagaagccagatttttcctcgcagcccgcggttcataaacttaccaaacggatcccccttcggcgtcaagtgacggtatccgctgaatcctcaagcagcatgaatagcaacacaccactggtgcgcatcactacccgcctgtccagcaccgccgataccccaatgctagccggggtgagcgagtacgagttgccagaagaccctaagtgggaatttcccagagacaaattaaccctgggtaaacccctcggggagggctgttttggacaagtggttatggccgaagccgtggggatcgacaaagataagcctaaagaagctgtgactgtagccgtgaaaatgctgaaagacgacgcaacagagaaggatttatctgatctcgtgagtgagatggagatgatgaagatgataggaaagcataaaaatatcataaacctgctgggtgcctgcacgcaagacggccccctgtatgtcattgtggaatatgcgtccaagggtaacctgagggaatacctccgggcccggagaccccctggcatggaatattcctacgatatcaacagggtgcctgaagaacagatgacgttcaaagatctggtgagttgcacgtatcaactcgcgagggggatggaatacttagcgtcccaaaagtgcatccatagggatctcgccgccagaaacgtgctggtgacagaaaataacgtgatgaaaatcgccgactttgggttggcccgggacattaacaatatagactactataaaaagaccaccaacggacggctaccagtgaagtggatggctcccgaagcactctttgatagggtttacactcatcagagcgacgtctggtcctttggcgttctcatgtgggaaattttcaccctgggcggatcaccatatcctggcataccagtggaagagctgtttaagctattgaaagaaggtcatcggatggataagccagcgaactgtactaatgagctatacatgatgatgcgcgactgctggcacgcggtgccatcccaaagaccaacctttaagcaactggtggaggacctagacaggattctcacactcacaaccaacgaggagtacctcgacctaagtcagccgctggagcaatatagcccatcctatcccgacacgcggagcagctgctcttccggagacgattctgtgttctctccggacccaatgccttacgaaccctgcctccctcaatacccacacatcaatggttctgtcaagacctag

SEQ ID NO: 117055 - DNA, 2469 bp, Artificial Sequence
  Description of Artificial Sequence: Synthetic coding sequence
atggtatcatggggcaggtttatatgcctcgtggtcgtgaccatggctacccttagtctggctagaccaagcttctccctggtcgaggacaccactctggagccagaagagccccctacaaagtaccagatctcccagccagaagtctacgtcgcggcgcccggggagagtctggaggttcggtgtcttctgaaagatgctgccgtgatatcttggacaaaggacggggtccacttgggacctaacaaccgcaccgtgctaatcggcgagtatctgcaaatcaaaggggcaacaccgagggattcgggactttatgcctgcacggcttctaggaccgtcgattctgagacctggtattttatggttaacgtgactgatgctattagtagcggagatgatgaggacgatactgatggcgccgaggacttcgtatccgagaatagcaacaacaagcgggcgccttattggactaacactgagaagatggaaaagaggctccacgctgtgccagcggcaaacacggttaagttccgctgtcccgctggagggaaccctatgcccaccatgaggtggctgaaaaacggaaaggagttcaagcaggaacacaggattggcggctacaaggttcgcaaccagcattggagcctgatcatggaatccgtggtgccctcagacaaggggaactacacatgcgtggtggagaatgagtatggcagcatcaaccatacatatcacctggacgtcgttgaaaggtccccccatagaccaatactgcaggctgggctcccagcaaacgccagcaccgtggtaggtggagatgttgagttcgtttgtaaggtctatagtgatgcacagccacacatacagtggataaagcacgttgaaaagaatggtagtaaatacggaccagatgggttgccctatctgaaagtgttgaaagtgaccaaagcggcgggcgtgaacacaaccgacaaagagatcgaagtgctttacatccgtaacgtaacctttgaagacgccggtgagtacacgtgtttggccggtaactctattgggattagcttccactcggcctggctgacagtgctgccagcgcctggcagggagaaggaaataactgctagcccagactatttagagattgccatctactgcattggggtgtttctaatcgcctgcatggtagtcactgttattctatgcagaatgaagaataccacaaagaagcctgacttctcctcacagcctgccgtgcacaagttaaccaaacgtatcccattgcgccggcaggtgagcgctgagtccagcagttcaatgaactcgaacacgcccctcgtaagaattaccactcggctcagctccactgccgacacccctatgcttgctggggttagcgagtatgagctgccagaggaccccaagtgggaatttccaagagacaaacttaccctgggcaaacctctcggggagggttgcttcggccaagtagtgatggctgaagcagtcggaattgacaaggataagcccaaggaagccgtcactgtcgcagtgaagatgctgaaagatgatgccaccgagaaggatctctctgatttggtgagtgagatggaaatgatgaagatgatcggtaaacacaaaaacattattaatttgttgggcgcatgcacacaggatggaccactttacgttatcgttgagtatgcgagtaagggtaatctccgggagtatttaagggccaggcgaccacccggcatggagtatagctacgatattaatcgggtgccagaggaacagatgacatttaaagatctggtctcctgtacttaccaactcgccaggggtatggagtaccttgcctcccaaaaatgcatacatcgggatctcgctgctaggaacgtccttgttactgaaaacaacgtgatgaagattgccgattttgggttagccagggatattaataacatcgattactataaaaagactactaacgggcggcttcccgtcaagtggatggccccggaggctctgttcgaccgtgtgtacacccaccagtctgatgtgtggtcctttggtgtgctgatgtgggaaatctttactctgggtggatctccctatcctgggataccggtcgaagagctgttcaagctgctcaaagagggccacagaatggacaaacccgcgaactgcactaacgaactgtacatgatgatgcgagactgttggcatgcggtgccaagccagcgtccaaccttcaaacagctggtcgaggatctggatcgtatcctgacgctcactacaaacgaagaatatttagacctgagccagccattggagcagtattctccttcataccctgacacgagaagcagctgctcctccggggatgactctgtatttagccccgaccctatgccttacgaaccatgtttaccacagtacccccatatcaacggatcggttaagacatag

SEQ ID NO: 117056 - DNA, 2469 bp, Artificial Sequence
  Description of Artificial Sequence: Synthetic coding sequence
atggtctcctggggtcgattcatctgcttggtggtcgttactatggcaactctaagtttggctcgaccaagtttctctttggtcgaagataccacactggagcccgaggaaccgcccactaagtaccagatttctcagcctgaagtatacgtcgccgctcctggggagtctttggaagtacgctgtctcttaaaggacgcggccgtaatcagctggacaaaggacggagttcaccttgggcctaacaataggaccgtcctaattggtgagtaccttcaaataaagggtgctacaccaagggacagcggtttgtatgcctgcacagctagccgaaccgtggacagtgaaacttggtactttatggtgaatgttactgacgctatatcctctggcgacgacgaggatgacactgacggcgctgaggatttcgtcagcgaaaactcaaacaataagagggccccttattggactaatacagaaaagatggagaaacgcctacatgctgtgccagctgccaataccgtcaaattccggtgccccgccggcgggaatcctatgcctactatgaggtggttgaagaatggcaaggagtttaagcaggagcatcggattggcggatacaaggtgcggaaccagcactggtcactcatcatggagtccgttgttccgagcgacaagggcaattatacatgtgtcgttgagaatgaatatgggtccatcaaccatacatatcacctggacgtggtggagcgatcacctcatcggcccattctgcaggcaggcctgcctgcgaatgccagcaccgttgtcggcggggacgtcgagttcgtttgcaaagtgtattccgacgcccagccacatatccaatggattaagcacgtggagaaaaacgggtctaagtacggtccagacggtctaccatacctgaaagttttaaagcattctggcatcaattccagcaacgctgaggtgttagctttgttcaatgtgaccgaggctgacgcaggtgaatatatatgtaaggtgtcaaattatatcggtcaggccaatcagtcagcatggctcaccgtgttgccaaaacagcaagccccagggagggagaaggagatcacggcatctcctgactacctcgagatagctatctattgcattggggtctttctgatcgcctgcatggtcgtaacagtaattctttgtcgtatgaagaataccactaaaaaaccagacttctcctcacaaccagccgtgcataagctgactaaacgcatccctctgcggcgccaggttacagtttcagccgaaagtagttcctccatgaatagcaacacacctttggtgagaatcactacacgcctaagctcgaccgccgacacaccaatgttagccggcgtaagcgagtacgaactgcctgaagaccctaagtgggagttcccacgggacaaactgacactgggaaagcctcttggcgaaggctgctttggacaggtggtgatggctgaggctgttggcattgataaagacaagccaaaagaagcagtgactgtggcagtgaaaatgctgaaggatgacgcgaccgaaaaggatctttccgatttggtcagtgagatggagatgatgaaaatgatagggaaacacaaaaatataatcaatcttttaggcgcttgcacccaggacggccctttatatgtgatcgtcgaatatgcatctaagggtaatctcagggaatacttaagagcccggcgccctccaggtatggagtattcatatgacattaatagagtgcctgaggagcagatgacgttcaaggacctcgtgagctgcacctatcagctcgcacgcggcatggagtatctggcgtcccagaagtgtatccaccgtgacctggcagctcgcaatgtgttagtcaccgagaataatgtaatgaagatcgccgatttcggcctggctcgtgacatcaataatatcgactactataagaagactaccaatggccgcttacccgtgaaatggatggccccagaggccctattcgatcgcgtatatacacatcagtctgatgtgtggagcttcggagtgctgatgtgggaaatctttacgctagggggcagtccgtatcctgggatccccgttgaggagctctttaagttgcttaaggagggccatagaatggataaaccggctaactgtactaacgagttgtacatgatgatgagggattgttggcatgctgtaccttcacagcgccccacattcaagcagctagttgaagatctggacaggatcctaactttgacaactaacgaggaatatctagatctgtctcagcctctcgaacagtattccccaagctatcctgatacaagatcttcctgctccagcggggacgattcggtattctcgcccgatcccatgccctacgagccttgtctgccccagtacccacatataaatgggagcgtgaagacatag

SEQ ID NO: 117057 - DNA, 1515 bp, Artificial Sequence
  Description of Artificial Sequence: Synthetic coding sequence
atgacaccctcaccactcctgctgctgctgctaccaccacttctgctcggtgcctttccacccgctgcggctgccaggggaccccccaagatggccgacaaggtggtccctaggcaggtggcccgtctcgggaggactgtgcggctccagtgtcccgtggaaggggaccctcctccgctcacgatgtggaccaaagatgggaggactatccacagtgggtggtcaaggttccgtgtgctcccccagggtctgaaagtgaaacaggtggagagagaagacgccggtgtgtacgtgtgtaaagccactaatggcttcgggtccctttccgtcaattatactctcgttgttctggacgatatatcacctgggaaggaaagcctggggcccgattctagtagcggggggcaggaggatcctgctagtcaacaatgggctcggccacggttcactcagccatccaaaatgcggcgccgtgtcattgcgcgccctgtcggatcctccgtcaggctgaaatgcgtggcttcaggtcacccacgcccagatatcacttggatgaaagacgaccaagccttgacccgccccgaagcagcagaacctaggaagaagaaatggactctgtctctcaaaaacctacggccggaagattccggtaaatatacttgtagggtatctaatagagccggagccataaatgctacttataaggtcgacgtcatccagcgaacaaggtctaaacctgtgttgaccgggacgcatcccgtcaacaccaccgtcgacttcggtggaacgacctcatttcagtgcaaagtgcggtccgatgtgaaacccgtgatacagtggctcaaacgagtggagtatggtgcagaggggaggcacaatagcaccattgatgtggggggtcagaagttcgtcgttttgccgactggagacgtatggtctaggcctgacggcagttacttgaataaacttttgataaccagggctaggcaagatgatgccgggatgtatatatgtctgggcgcaaataccatggggtacagcttccgcagtgcttttcttactgttttgcctgatccaaagccccctggcccgccagtggctagcagcagttcggctaccagcctgccctggcctgttgtaattggcatcccagcaggagccgtattcattttggggaccttactgctgtggctgtgccaagcccagaagaagccgtgcaccccagcccccgcccctccactccccgggcatcgacctcccggcacggcgcgcgaccggagcggagacaaggatctcccatccttggccgccctgtccgcaggtccgggggtggggttgtgtgaggagcacgggtctcctgcggccccccagcatctgctgggccccggcccagtggcagggccaaagctgtaccccaaattgtatactgatatccacacccatacacatactcactctcatactcattcgcacgttgagggaaaggttcatcagcacatccactatcaatgctag

SEQ ID NO: 117058 - DNA, 1515 bp, Artificial Sequence
  Description of Artificial Sequence: Synthetic coding sequence
atgactccatcacctctgctccttctactgttaccccctctgctgctcggagcgtttccacccgcagccgccgcaaggggcccccccaagatggcagacaaggttgtgcctcgccaggtagcgcgcctgggccggacagtgaggctccagtgccccgtggagggtgaccccccgccactcacgatgtggacaaaggatggacggaccattcacagcggatggtctaggttccgggtgctgcctcagggccttaaagttaagcaggtggagagggaagacgccggcgtgtacgtctgtaaggctacgaatggctttggcagtctgagcgtcaattacactcttgtggttcttgacgatatttctccgggaaaggagagtctgggccctgactcctcgagcggcggccaggaggatccggcgagtcagcagtgggccaggcctaggtttactcagccctccaagatgaggagaagggtcattgcacgccccgtaggatcctctgtgcgcttaaaatgtgtagctagtggacacccgcgacccgacatcacgtggatgaaggatgaccaggctttgacccgcccagaggctgcagaacctagaaagaagaaatggacactctccctgaagaatttacgaccggaggactcaggaaaatacacttgccgagtgtccaatcgtgctggggctataaacgcaacttacaaggtagacgtgatacagagaacacgaagtaaacccgttctgaccggaactcacccggtgaatacaaccgttgattttgggggtacaacctcgttccagtgcaaagtgaggtcagacgtgaagcctgtgatccagtggctcaagagggttgagtacggcgcggagggccggcacaactccactattgatgttggtggtcagaaattcgttgtgttgcctactggggacgtttggtcaaggccagacggttcctatttgaataaactccttattacacgcgcgcggcaagatgacgccgggatgtacatctgcttaggcgctaacacaatgggttactccttccgaagcgcctttcttactgtcctcccggaccctaaacccccaggccccccggtggctagctcctcatcagcgacctccctgccatggcccgtggtgattgggatccccgcaggggcagtgtttatactcggtactctcctgctttggctctgccaggcacaaaagaagccttgcacaccagctcctgcaccacccctgcctggccatcggcctccaggcaccgctagagacagaagtggcgacaaagacctcccgtccttggctgctctttccgcgggccctggcgtgggcctctgcgaggagcatggatcgccggcggccccccagcacctgctgggaccaggaccagttgccggaccaaaactttatccaaagctttatacggacatccacacccatacccacactcattctcacacccacagccatgtggaagggaaagtccaccagcacatccactatcaatgttag

SEQ ID NO: 117059 - DNA, 1515 bp, Artificial Sequence
  Description of Artificial Sequence: Synthetic coding sequence
atgacaccgtcacccctgctgctgctcttgttgcccccattattgctgggtgcttttccccctgccgccgccgccagagggccgccaaagatggctgataaagtcgtgccccgccaggtggctagactgggacgcacggtacggctgcagtgtcccgtggagggcgacccgcctcccctaaccatgtggacgaaggacggacgaacaatccatagcgggtggtcccggtttagagtgctgcctcagggactcaaagtcaagcaagtagagcgagaggatgccggtgtctatgtctgcaaggcaactaacgggtttggaagtctctccgtgaattacacactggtcgtcctggacgacatttctcctggtaaagaatctctcgggcctgactcgtctagcggagggcaggaggacccggcatcgcaacaatgggcccgaccccggttcacacagccttctaagatgcgacgtcgagtgattgctcgccccgtcggctccagtgtgcgcttgaagtgtgtcgccagcggtcacccacgtcccgacatcacctggatgaaggatgaccaggctcttacgaggcccgaggccgcggaacccagaaaaaagaagtggacactctcactgaagaacctgagaccggaagactccggaaagtacacctgtagggtatccaacagggccggagccatcaacgcaacttacaaagttgacgtcattcagagaacacggtccaagcccgtgctcaccgggacccacccagtgaacacaactgtggacttcggcggcacaacttccttccagtgcaaggtgcggagcgatgttaaacctgtcatccagtggctgaaaagagttgaatacggtgccgagggccggcataactcaaccatcgatgtgggcggccagaaattcgtcgttttacccactggagacgtctggtccaggccagacggcagctatttaaataaattgctgatcaccagagctagacaggacgacgcaggcatgtatatatgcctcggtgccaacacaatgggctattcctttcgttcagcctttttgactgtgcttcctgaccctaaaccccccggacctccagtcgcaagttcttcatctgccacatcactaccatggccagtcgtcatcggcatcccggccggtgccgtgttcatcctgggcacattgctactgtggctgtgccaagcacagaaaaagccatgcacccccgcccccgcaccgccattgcctggacatagaccgccagggactgcccgggatcgctctggcgacaaggatctgccctctctggccgcactctctgctgggcccggagtcggcctttgtgaggagcatggcagcccggcagcacctcagcacctcctgggaccgggaccagtcgcgggtccgaaactgtaccctaaactgtacacagacatccacactcatacccacacacattctcacacccactcccatgtcgaaggcaaggtgcaccagcatatccactaccagtgttag

SEQ ID NO: 117060 - DNA, 459 bp, Artificial Sequence
  Description of Artificial Sequence: Synthetic coding sequence
atgactccctcgcctttgctcctgttattactccccccgctcctgctaggagccttccccccagcggcagccgccaggggaccccctaaaatggcagacaaggtcgtgccccgacaggtggcccgccttggacggacagttagacttcagtgtcctgtggaaggagacccacctcctctcacgatgtggacaaaggacgggagaacaatacacagcggttggagcagatttcgggtcctgcctcaaggactgaaagtgaagcaagttgagagagaggacgccggtgtctacgtgtgtaaggccactaacggtttcggtagcctgtcagtcaactacacattggtagtgctggacgacattagtcctgggaaggagtcattggggccagactcctcgtccggaggccaggaagacccggcaagccaacagtgggctaggcctagattcactcagccttag

SEQ ID NO: 117061 - DNA, 1515 bp, Artificial Sequence
  Description of Artificial Sequence: Synthetic coding sequence
atgaccccttccccactgttacttctgctcctaccaccactcctcttgggagccttcccccctgctgctgctgcgaggggccccccgaagatggcagataaagtggtgcctcgccaggtggctaggctggggcgcactgtgagactgcaatgtccagtcgagggcgatccaccacctctgacgatgtggactaaagacgggagaaccattcatagcgggtggtccaggttcagagtgttgccccagggcctgaaagtgaagcaggtggagcgcgaggacgctggtgtctacgtatgcaaagcaacaaacggcttcggaagcctttctgtgaactacacattagtcgtgttggacgatatttccccaggcaaggagtcactgggcccagacagttcaagcggtggccaagaggatcctgctagccagcaatgggctcggccccggtttacccaaccaagcaagatgagacggcgtgttatcgcgcggccagtggggtcgtcggtgcgcttgaagtgcgtcgccagtgggcaccctaggcctgatattacttggatgaaggacgatcaagcgctgaccagaccagaggctgctgagccaaggaaaaagaaatggaccctctcgctgaaaaatcttcgccctgaggattctggcaagtacacctgtcgggtatctaaccgggccggcgcaatcaacgccacttataaagtggatgtcattcagcgcaccagatcaaagcccgtactaactgggacccacccggtgaacacaactgtcgattttggcgggactacctccttccagtgcaaggtacgatcagacgtgaagcccgtgattcagtggctgaagcgagtcgaatacggagccgagggaaggcataattctaccattgatgttggcggacagaaatttgtggtgctgccaactggggacgtgtggtcacgccccgatggttcatatttaaacaaactgctgatcacccgtgcccgccaggatgatgcaggaatgtatatctgtcttggtgccaatacaatgggctactcgttccgctccgccttcctcaccgtcctgcccgatcctaagcctccagggcccccggtcgccagcagcagttcagccacaagtttaccatggcccgtggtgatcggcattccagcaggcgcggtctttatcttggggactctcttgctctggctgtgtcaggcacagaagaagccatgtacccccgcgccagccccaccacttccaggccaccgtcctccagggacggctagagaccggtcgggcgataaagatctgcccagcctggcggcactgtccgctgggccaggcgtcgggctctgcgaggagcacgggtccccagctgcaccacagcacttgctgggccctgggcctgtagccgggcctaaactctatccaaagctgtacaccgatatccacacacacacccatacccactctcatactcactcccacgtggagggaaaagtccatcaacacattcactatcagtgttag

SEQ ID NO: 117062 - DNA, 243 bp, Artificial Sequence
  Description of Artificial Sequence: Synthetic coding sequence
atgacgccatcccctctcctgcttcttctactgccacccctgctcctaggggcattccctccggctgccgctgccaggggcccaccaaagatggccgataaagtggttccacggcaggtcgcccgtttgggaagaacagtgaggcttcaatgccctgtagaaggcgatcctcctcctctgacgatgtggactaaagacgggagaacaatccattcaggctggtccagattccgagtgttatag

SEQ ID NO: 117063 - DNA, 1326 bp, Artificial Sequence
  Description of Artificial Sequence: Synthetic coding sequence
atggccgacaaagtggtcccacgccaggtcgctcggcttggaagaacagttcgcctgcagtgcccagtggagggagaccctcccccacttactatgtggacaaaggatggccgcactatccatagcggctggagtcggttcagggttctgccgcaaggcctgaaagtgaagcaggtggagcgggaggacgcgggggtgtatgtatgcaaagctaccaatggttttggctctttgtccgtcaattatactctggtggtcctggatgacatcagccccggaaaggaatccctggggcctgacagtagcagcggtggacaggaggatcctgcctcccagcaatgggcacggcctagatttacccagcccagcaagatgagaagacgcgtaattgcccgtcctgtgggtagctctgtccggcttaaatgcgtggcctctggacacccaagacccgatattacatggatgaaggatgatcaggccctgacccggcccgaggctgctgagccccgcaaaaaaaagtggacactgtcactgaaaaacctccgccctgaagactcagggaaatatacctgccgagtgtccaacagagcaggcgctattaatgcaacatataaggtggatgttatccagcgaacccggagcaaaccagtcttgaccggcacacaccctgtcaatacaacagtggactttggcggaacgacttccttccagtgtaaagttaggagcgatgtcaaaccagtaatccagtggctaaaacgggtggaatacggggccgagggtaggcataattccacaatcgatgtcggcgggcagaagttcgtcgttttgccgaccggggacgtgtggtcacgaccggacgggtcttacttgaataagctcctgatcactagagcccgacaggatgatgctggcatgtatatatgtctaggcgcaaacaccatgggctattcattccgatcagcgtttctaacagtcctgcctgaccccaagccccctggcccccctgtggcctccagctcatccgcgaccagcctaccttggcctgtggtcatcggcatacccgctggtgcagtatttatattaggcacgctcttgttgtggctgtgtcaggcccaaaaaaagccatgtacccccgccccagccccccccctgccagggcaccggccaccagggacggctcgcgaccggagcggcgacaaggatcttcccagcctggcggcactgtcagctggtcctggcgtgggactatgcgaggagcacggttcgccagctgccccccagcatcctacagtcgttgtggctccagacctgtgcaacttcatgtag

SEQ ID NO: 117064 - DNA, 1131 bp, Artificial Sequence
  Description of Artificial Sequence: Synthetic coding sequence
atgcagtggacatcattactcttgctggcgggcttgttctcacttagtcaggctcagtatgaagacgacccacactggtggttccactatctccggtcccaacagagcacgtattatgacccatatgacccgtacccatatgagacatacgagccttatccctacggcgtagatgaaggtcccgcctatacctatggaagtccatcccccccggatccccgagactgtccacaggagtgtgattgtccaccgaatttcccaaccgcgatgtactgtgataaccgaaatctcaagtatctccctttcgttccttctaggatgaaatatgtttactttcaaaataatcaaataacgtcgatacaggaaggggtgttcgacaatgctacaggactgttgtggattgcacttcatggaaaccaaatcaccagcgataaggtgggacgcaaagtgttctcaaagctgcgccacctagaaagactgtatttagaccataataatcttacccggatgccaggccctctgccacggagcctccgggagctgcatttagatcataatcagatctcacgggtccccaataacgctttggaaggcttggaaaatctgactgccctgtacctccaacataacgagattcaggaggtcgggagctccatgagaggactgagatctctgattctgctggacctttcctataaccacttgcgaaaggtcccggatggtctgcctagcgctctcgagcagctgtacatggaacataacaatgtgtataccgtgcccgatagctactttcgcggcgcgcccaaactgctatacgtgagattaagtcacaacagcctgaccaacaacggtttggcttccaacactttcaacagtagttccttgctggagctggacttatcctacaaccagctccagaaaatacctcctgtgaatacgaatctcgagaatctttatctccaggggaacagaataaacgaattcagtatctcttcattttgtaccgtcgtggacgtagtgaatttcagcaagctccaggtgctccgcctggacggaaacgagatcaagcggtccgcaatgcccgcggatgcccccctgtgtttgcggctcgctagtctgattgaaatctag

SEQ ID NO: 117065 - DNA, 1092 bp, Artificial Sequence
  Description of Artificial Sequence: Synthetic coding sequence
atgcagtggacctctctgctgctgctggccgggctgttctccctgagtcaggctcagtatgaggatgatccacactggtggtttcattacctcagaagccagcagtctacttattacgacccatatgacccctacccatacgagacgtatgagccgtatccttacggagtggatgagggacctgcatatacttacggctcgccatctccccccgatcctcgcgactgtccccaggagtgtgattgcccccccaatttcccccctttcgtcccgagcaggatgaaatacgtgtacttccaaaacaaccagattacatctatccaggagggggtatttgacaatgcaaccgggctgctttggattgccctccacggtaaccagattacgagcgataaggtgggaaggaaggtgttctctaagttgcgacacttagagcgtctatacctggaccacaataacctaactagaatgcccggtcccctcccgagaagccttagagagctgcacctggaccataaccagattagtagagtcccgaacaacgcgctagaaggcctggagaatctgactgccctgtatctgcagcacaacgaaatccaggaggtgggaagttccatgcgaggcctgagatccttaattttactcgatttgagctacaaccacctgcgaaaggtgcctgacgggttaccatcagccctcgagcagctctacatggagcacaataacgtgtacacagttcctgattcttactttcggggcgcgcccaaactcctctatgttagactttcacataattcacttaccaataatggtctggccagtaataccttcaactcttcctctcttttggagctggatctgtcttataatcaactgcagaagattcctccagttaacactaacctggagaacctctacttgcaggggaaccgaataaacgagtttagtatatcctccttctgcacagtcgtcgacgtagtgaattttagtaagcttcaggtactcaggctggacggtaatgaaattaaaaggtcggccatgccggccgatgcaccactgtgtttacgcctcgcttccctcatcgagatctag

SEQ ID NO: 117066 - DNA, 594 bp, Artificial Sequence
  Description of Artificial Sequence: Synthetic coding sequence
atgaagatgaccctgatcgggggcagtaccacttccgccgctagttcgccgccgacgacaatccccatgactctcacccgtatgcgaccgactagcctgactcccatgggctggatgaaaggccagccgactcccacagcactacacccgctgcagattcctgcaacagcaccccgttctgccaccgcccatcctacttcaacagctatgtattgcgataaccgcaacctgaaatacctgccattcgtcccctctagaatgaagtatgtgtacttccaaaacaatcagattactagcatccaagagggagtttttgacaacgcaactggcttgctgtggatcgccctacatggaaaccagatcacatctgacaaagttgggagaaaggtgttctcgaaactcaggcacctggaacgtctttacttggatcataacaaccttacccgtatgcccggaccccttccacgatccctgagggagctgcatctggatcacaaccagatctcccgtgtgcccaacaatgcactggagggaagaacctccagaccatgtacgagcaatacgatgcggagcagaaagtgggctgtgccctag

SEQ ID NO: 117067 - DNA, 2025 bp, Artificial Sequence
  Description of Artificial Sequence: Synthetic coding sequence
atggtggtcgcccacccaacagcaaccgccacaactacaccgacagccacagtaacagccaccgttgttatgacgaccgcaaccatggatctgagagactggttattcctgtgctatggcttgattgctttcctgacggaagtgatcgatagtacgacttgcccgagtgtctgccgttgtgataacggcttcatctactgtaatgaccgagggctgacatctattcccgccgacatacctgatgacgccacaactctatatctacagaacaaccaaatcaataacgctggcattccacaggatctgaagaccaaagtaaatgtgcaggttatctacctgtatgagaacgacctcgatgagttcccaattaacctgcctcgaagtttgagagagctccacctgcaagataacaatgttagaaccattgccagagactccctggcacgaataccgctattggaaaagctgcatctggacgataactctgtgtctacagtcagtatcgaggaggacgccttcgccgactcaaagcagctgaaactacttttcctgagccgcaaccacctgagttctattccttcaggcctgccgcataccctggaggaactgcgcctggacgataacagaatcagcacgatccctctgcacgcattcaagggcttgaactctctgaggagacttgtgctggacgggaacctattagccaatcagcgcatcgcagacgacacgttttcaaggttacaaaacctcacagaactgagcctggtgaggaactctctggctgccccgcccctgaaccttccaagcgctcacctccagaaactttacttgcaggataacgccataagccacattccttacaatacactggccaaaatgcgggaactcgagaggttagatctgtctaataacaatttaactaccttaccgcggggactcttcgacgacctggggaacctggcacagttgctgttgcgcaacaacccgtggttctgtggatgcaatcttatgtggttgcgcgattgggtaaaagctcgtgccgcggtggttaacgtgagggggctgatgtgccagggccccgaaaaggtccgcgggatggcgatcaaagacatcacatccgaaatggacgagtgcttcgagactggccctcagggaggggtcgccaacgccgcagcgaagaccactgcctctaatcacgcaagtgccacgactccccaaggctctttgttcaccttgaaagctaaacggccagggctccgactcccagatagtaacattgactatcccatggcgaccggtgacggtgccaaaaccctggcaattcatgtgaaagctctgacggccgattcaatacgtatcacttggaaggcgacgcttcccgcatccagctttagactgagctggcttagactgggccactctccagcggtcggatcaataactgaaacactggtgcagggggacaaaacagagtacctcttgacagctctagagcccaagtctacctacatcatctgtatggtaaccatggaaacaagcaatgcatacgtggccgacgagacacctgtctgcgccaaggcagagacggcggactcctacggccccactacaaccctcaatcaggaacaaaatgctggccctatggcaagcttgccgttggcggggataattggcggggcagtggcgctagtgtttctgttcctggtgttgggtgcgatctgctggtacgtccaccaggccggcgagttgctaactcgcgagcgtgcatacaacagaggttcgcgaaagaaggatgactacatggaatccggaacaaagaaggacaactctatattggagattcgcggtccaggactgcagatgctgcctattaacccgtatcgagccaaagaggagtatgtcgtccacacgatctttccatctaacggtagtagcttatgcaaggctacacacacaataggatacggtaccactagaggctatcgggacgggggaattccggatatagactacagctatacctag

SEQ ID NO: 117068 - DNA, 1983 bp, Artificial Sequence
  Description of Artificial Sequence: Synthetic coding sequence
atgggcctgcagactacgaagtggccctctcatggggcctttttcctcaagagctggctcatcatctctctcgggctgtactctcaggtttctaagctgctggcctgtccttcagtatgcagatgcgatcgaaattttgtctactgcaacgaacggtctctaacttccgtgcccctcggcatcccagaaggcgtgacagtgctgtatctacataataaccagattaataacgccggatttcctgcggagctgcacaatgtgcagagtgttcacaccgtatacctctacggtaaccagctcgacgagtttcctatgaacctgccaaaaaacgtaagggtgctccacctacaggagaataacatccagaccattagtcgcgccgctctggctcagttgttgaaattagaggagttacatctggacgacaacagcatcagcactgtaggggtagaggatggggcctttcgagaggcgatctcgctcaaactgctgtttctcagtaagaatcatctgtcttctgttcccgtgggactgcccgttgatctgcaggaactaagggtggacgagaacagaattgctgtcatctccgacatggcttttcagaacctcacatctcttgagcgcctgatcgtggacggcaaccttctgacgaataagggcattgcagagggcaccttctctcatctgactaagctgaaagaattctcgattgttcggaactcactgagccatcctccaccggacctgccgggcacacatctcatacgactatatctccaggataaccaaatcaatcatattcctctgacagctttcagtaatctgagaaaacttgagaggttggatatctctaacaatcagttgcgtatgttgacgcagggggtatttgacaacctatccaatctgaagcagttgaccgccagaaataacccttggttctgcgactgtagcatcaagtgggtgacagagtggctgaaatacatacccagcagcttaaatgtgaggggattcatgtgccaggggcccgagcaggttcgaggaatggctgtgagggagttgaatatgaacctcttgagctgtcccaccacgacccctggcctcccactcttcacaccagcaccatcaaccgctagtccaaccactcagccaccaacattatcgatcccaaacccttcaagaagttacactcctccgacccccacaacatcgaaattgcccacaatccctgactgggacggtagggagcgcgtgacccccccgatctcagagagaattcagctttcaatacattttgtaaatgatacatccatccaagtgtcctggctcagcctgtttacagtgatggcctacaagctgacctgggtgaaaatgggacactctctggtgggggggatcgtgcaggagaggatcgttagtggagaaaaacagcatctcagcctggtaaacttggagcctaggtcaacttaccggatttgtctagtgccattagatgccttcaattatcgggcagtcgaggataccatctgctctgaagctactacccacgcctcgtaccttaataatggaagtaataccgcatcaagtcacgagcagactacaagtcacagcatgggctcacctttcctcctggctgggctgattgggggggcagtgatatttgtgctcgtggtcctactttctgtgttttgctggcacatgcacaagaaaggacggtacacgtctcagaaatggaaatacaatcgtgggcggcgtaaagatgattactgcgaagccggtaccaagaaagataactccattctggagatgacagagacgtcgtttcagatcgtctctcttaataacgatcagcttctaaagggagattttagactccaaccaatatatactcctaacggtggaataaactacacagactgccacatccctaacaacatgagatactgtaattcgtccgtacctgaccttgaacactgccatacatag

SEQ ID NO: 117069 - DNA, 942 bp, Artificial Sequence
  Description of Artificial Sequence: Synthetic coding sequence
atggccgtccgcgagttgaacatgaaccttctctcttgcccaactacaaccccggggcttcccctgtttactccggctccatcaactgcgtcccccacgacccagccacctacattgtctatacctaaccccagcaggtcctacacccctccaactcctacaacttcaaaattgcctacaatccccgattgggacggtagagagagggtgacccctcccattagcgagcggatccagttaagtattcactttgtgaacgacacaagcatacaggtatcatggttatccctgttcacagtcatggcctacaagctgacttgggttaagatggggcatagtcttgtgggaggaatcgtgcaggaaagaattgtgtctggcgaaaaacaacacctgtcactcgtgaatctggagccaagaagcacctatcgcatttgtctcgttccacttgacgcctttaattacagagcggtggaggacaccatctgcagcgaggccacaacacatgcttcttatttgaataacgggtccaacacggcttctagccatgagcagaccacctcccattcgatggggtcgccatttctcctagccggattaatcggaggcgccgttatcttcgtgcttgtggtcctattgagtgtgttttgttggcacatgcataaaaaaggcagatacacatcgcagaaatggaagtataacagaggtcgccgaaaggatgactattgcgaggccggcaccaagaaagataactccatcctggaaatgactgaaaccagcttccaaattgtcagcctcaataacgaccagcttctaaaaggcgatttccgactccagccaatttacacccccaatggcggcataaactataccgattgtcacatccccaataacatgcgctactgtaactctagcgtgccagacctggaacactgccatacatag

SEQ ID NO: 117070 - DNA, 1983 bp, Artificial Sequence
  Description of Artificial Sequence: Synthetic coding sequence
atgggtctccagacaacaaagtggccctctcacggggctttttttctgaagtcatggttaattatctcactagggctgtattcccaagtaagcaagttactggcttgcccatcagtgtgtcggtgtgaccgcaactttgtgtattgcaatgagcgatcacttacatccgtcccacttggcatcccggagggcgtcacagtgttatacctccataataatcagattaacaatgccggtttccctgcggagctacacaatgtgcagagtgttcatactgtttacttatacgggaatcagctggacgaattccccatgaatctgccgaaaaacgtccgggtactgcacctgcaggaaaacaacatccagaccatctcacgtgctgccttagctcagctgctaaaactagaggaacttcatttagacgacaacagcatatctacggtcggtgtggaggacggtgcctttagggaagctatatcactcaagttgttgttcctgagcaagaaccacctgagcagtgttccagtgggactgcccgttgatttgcaggagttgcgggtggacgaaaatagaatcgctgtgatcagcgacatggctttccagaatctgaccagtctcgagcggctcatcgtggatggcaacctactgaccaataaagggatcgcagagggtacgttttctcatttaaccaagctaaaagagttctctatcgtgcggaacagtctttcccacccgccaccagatctacctggaacacaccttataagactgtatcttcaagataaccaaattaaccatatacccctaaccgctttctccaacttgagaaagctcgaacgccttgacattagtaacaatcagctccgaatgcttacgcaaggagtgtttgacaacctcagcaatctgaagcagcttactgcccgaaacaatccgtggttttgtgattgtagcatcaaatgggtcaccgagtggctgaaatacataccaagctcactgaacgtcaggggattcatgtgccaaggccctgagcaagtccggggcatggccgttcgagaactgaatatgaacctcctgagttgccccaccaccacgccaggcctcccgcttttcacccccgccccctcgactgcatcccctactacccaaccacccacgttgtcaatccccaatccttcacggagctatactccaccaactcctaccacttccaagctaccaactatacctgactgggacggtagggagagagtcactccaccgatatcagagcgcatccagctttccattcacttcgttaacgatacatccattcaggtgtcctggttgtctctcttcaccgtgatggcatataagctaacttgggtaaagatgggccatagtctcgtgggaggcatcgttcaggagaggatagtctccggtgaaaaacagcacttgagtctggtcaatctcgaaccccgctcaacttatcgaatttgtttagtgcctttagacgcctttaattatagagctgtcgaggatacgatctgctcggaggcaactactcatgctagctatttgaataacggatccaatacagcatcttcacatgagcagacgaccagccactcaatgggttcccccttcctactggctggactcatcggaggggcagtgatcttcgtcctcgtggtgttgttgtctgtgttttgctggcacatgcacaagaaggggaggtacaccagccagaaatggaaatataacaggggccggaggaaagatgactattgcgaagccgggacaaaaaaagacaatagtattttagaaatgacggagacttcatttcagatcgtctccttgaacaatgaccagctgctcaagggggactttaggctccaaccaatttacacccccaatggtggaattaactatactgactgccacatccccaataatatgaggtactgtaattcttccgtgcctgatctggaacactgccacacgtag

SEQ ID NO: 117071 - DNA, 1950 bp, Artificial Sequence
  Description of Artificial Sequence: Synthetic coding sequence
atgatctcagctgcctggtctattttcctaattggaaccaaaatcggattgttcttacaagtcgcccccctaagtgtcatggccaagtcttgccccagtgtgtgtcgctgcgacgctggatttatctattgcaatgaccggtttttaacctccatcccaacagggatcccagaggatgcaaccaccctttacttgcaaaataatcagattaacaacgcaggcatcccatctgacctcaaaaatctgcttaaggtggagagaatttatctttaccataatagtcttgatgagttccctaccaacctacccaagtacgtgaaagagctgcatctccaggagaataacattcgtactattacctacgactctctgagcaaaattccctacctagaagagctgcaccttgacgacaacagcgtgagcgccgtgtccattgaagaaggagctttcagggacagcaactatctccggcttctgttcttatctaggaaccatctgagcaccattccatggggcctcccaaggaccatcgaggagctcagactcgatgataacaggatcagcaccatcagctccccaagccttcaggggttgaccagcctgaagcgactggttcttgacggcaacctgctaaataaccatggcctgggcgacaaagtcttttttaatctcgttaatctcaccgagctgtcgctggtgcgcaattcattaacggcagcccccgttaatcttcctggcacgaacttgagaaaactttacctgcaggacaaccacatcaatcgcgtgccccccaacgcttttagctaccttcgccagttatataggctggatatgtcaaataacaacctatcaaacctgccccaagggatttttgacgatctcgataacattacgcaactgattctccggaacaacccttggtactgtgggtgtaagatgaaatgggtcagggattggttgcagtcacttcccgtgaaagtcaacgttcggggcctcatgtgtcaagcgcctgagaaagtgcgcgggatggccatcaaggacctgaacgctgaactgtttgactgcaaggattcaggtatcgtgagtactatccagatcaccacagcgattcctaacacagtttacccagcccaagggcagtggccggcacccgtaacaaagcagccagatatcaaaaacccgaagctgactaaagaccaccagaccaccggaagcccctctagaaagaccatcacgattactgtgaagagcgtgacgagtgatacgatccatatttcatggaaattagcgttgcccatgaccgctctccgcttgagttggctgaagttggggcatagtcctgcgtttggatccatcacggagactatagttaccggcgagcgcagtgagtacctggttactgccctagagcccgacagcccgtataaggtctgcatggttccgatggagacgagcaatctgtatctcttcgatgagactccagtatgcatcgaaacggagactgcaccactgagaatgtacaatcctacgactaccctgaatagagaacaggagaaggagccttacaagaatcccaacctccccctggcggctatcatcggcggagcagtggccctggtgactatcgccctgctcgccctggtctgctggtatgtgcaccgcaacgggtcgttgttctcgagaaattgtgcttacagtaagggacgcagaagaaaagacgattacgccgaagccgggaccaaaaaggacaattcaatattggaaatccgcgagacatccttccagatgttaccaatatccaatgagccaatctcaaaggaagaatttgttatacacactattttccccccaaatggtatgaacctctacaaaaacaaccacagcgagtccagcagcaatcgtagttatagggactccggtattcccgacagtgaccattcgcatagttag

SEQ ID NO: 117072 - DNA, 1950 bp, Artificial Sequence
  Description of Artificial Sequence: Synthetic coding sequence
atgatttcagctgcctggagtatttttcttatcggtacaaaaattggtttgtttttgcaggtggctcccctgtctgtgatggcaaagtcatgtccctctgtctgtagatgtgatgccggcttcatctactgcaacgatcggttcttgactagtatccctacaggcatccctgaggacgctacaaccctgtatctgcagaataaccagatcaacaatgccggaattccatccgacctgaagaacctgctgaaggtagagcgcatttacctttaccacaactcactcgacgagttccctactaacctccctaagtacgtgaaagagctccatcttcaagaaaacaatatcaggaccattacctatgattctttatccaagatcccgtacttggaagaactgcaccttgacgataacagcgtgagcgctgtgagcatagaagagggtgcgttcagggatagcaactacttgagactcctgttcctttcccggaatcatctttctactattccatggggactgcctcgcactatcgaggaattaaggctcgacgacaatcgcatctccactatttcttccccttctcttcagggcctcacatctcttaaacgcctggtactggacggcaatttgctcaacaatcacggattgggggataaagtgttctttaaccttgtcaacttgacagaactgtccctggtgcggaattcgcttacagccgctcctgtaaacctgcccggaactaacctcaggaagctctatctgcaggacaatcatattaaccgcgtgcctcctaatgctttcagttatctgcggcaactttaccgattggatatgagcaacaataatctatccaatctgccgcaagggatcttcgatgacctcgataatattacacagttaattctccgcaacaacccttggtactgtggctgtaagatgaagtgggtacgggattggcttcagtccctgcccgtgaaagtaaacgttcgcgggctgatgtgccaagccccagagaaagtgaggggcatggccatcaaggacttaaacgccgagctcttcgactgcaaggactcaggtattgtgagtacaatccaaatcactacagctattcctaacactgtctaccccgcacagggacagtggccagctccggtgaccaagcagcctgacattaagaaccctaagctcacaaaggatcaccagaccacaggtagtccctcccgcaaaacaatcactattaccgttaagagtgtcacaagcgataccattcacatctcatggaagctcgccctccccatgactgctctccggttaagctggttgaagctaggtcacagcccagctttcgggagtataaccgaaacgattgtgacaggcgaaaggtccgagtatcttgtgaccgcgctggaaccagactccccctataaggtttgtatggtgcctatggaaacctccaatctgtacctgtttgatgagacacctgtttgcatcgagacagaaactgcacctcttcgaatgtataaccctacgacaacgttaaatcgggagcaggaaaaggagccctacaaaaaccccaacctacctctggccgctataattgggggggcggtggctctggtgaccatagccctcttggctctagtctgttggtacgttcaccggaacggctccctgttttctcggaattgcgcgtattccaaggggcggagaagaaaagacgattacgccgaagcaggaactaagaaggacaactctattctggagatccgcgaaacaagctttcagatgctaccaatttccaatgagcccatttcaaaagaggaatttgtcatacatacaatctttccacctaacgggatgaatctctacaaaaacaatcactctgaatcgtccagtaatcgctcttatagagactcgggtattccagactccgaccattctcacagttag

SEQ ID NO: 117073 - DNA, 1884 bp, Artificial Sequence
  Description of Artificial Sequence: Synthetic coding sequence
atgattagtgctgcctggtccatatttctcatcgggaccaaaatcggtcttttccttcaagttgcccccctgtccgtgatggccaaatcatgtccctccgtgtgccggtgtgatgctggattcatctattgtaacgataggtttttgacaagtattccaactggcatacctgaggacgccaccacactgtatctacaaaacaaccagattaataacgccggtatcccctccgacttgaaaaatctattgaaagtggagcggatttatctgtaccataattccctggacgagtttcctacaaatctccctaaatacgtgaaggagctccatctgcaagagaacaatattcgtaccattacatacgattcactgtctaagatcccctatttagaagagctgcatttagatgacaactccgtatccgctgtcagtattgaggaaggggcctttagggactcaaactatctgcggctgttgttcctctctcgaaaccacctgtcgaccatcccatggggactgccccgcacaatcgaggagctgcgacttgatgacaatagaatctccacaatttcgagcccaagtctccagggtctcacctccctgaagcgtcttgtgctggacgggaacctgttgaataaccatggcttgggcgataaagtcttcttcaacttggtaaatctaactgagctctcgttggttcgcaattccctgacagctgctccagtcaatctgccgggtacaaaccttagaaaactgtacctccaggacaaccacatcaacagggtccctccgaatgctttcagctatcttcggcaattatacagacttgatatgtcaaacaataacctgtcaaatcttccccaggggatttttgacgacttggataatatcacccaattaatactgcggaacaacccatggtattgcggttgcaaaatgaagtgggttcgagattggttgcagagcctgcctgtgaaggttaatgtgagggggctgatgtgtcaggctccggagaaggtgcgcggcatggccattaaggacctgaacgccgaacttttcgactgcaaggatagtggaatcgtaagcaccattcaaattaccactgccattccgaataccgtgtacccagcacagggccagtggcctgcacctgtcactaagcagcccgatattaagaatccgaagctgactaaagatcaccaaaccaccggtagcccctctagaaaaaccattaccatcactgtgaagagtgtcacgagcgataccatccacatatcttggaaattggccttgcccatgaccgccctgaggctctcgtggctgaagctgggccacagcccagccttcggcagcatcactgaaaccatcgtgacaggggaacgtagcgaatacctggtcaccgccctggagccagatagcccctacaaagtgtgcatggtgcctatggaaacttcaaatctttacttgttcgatgagacaccggtgtgcatcgagacggagacagccccactgaggatgtataatcctaccacaacactgaacagagagcaggaaaaggagccctataagaaccccaacctgccgctggccgctattattgggggagccgtcgctcttgtcacaattgccttgctcgccttggtctgctggtacgtgcatcgcaacggctcgttgttctcccggaactgtgcatacagtaagggacgaaggcgtaaggatgattacgcagaggcaggtactaaaaaagataattcgatcctggaaataagagagacttcctttcaaatgcttcccatctccaatgaacccatctctaaagaggagtttgtcatacacaccatttttccccccaacggaatgaacctgtataaacaatcccagtag

SEQ ID NO: 117074 - DNA, 402 bp, Artificial Sequence
  Description of Artificial Sequence: Synthetic coding sequence
atgccaccctcgaagcctcatccaccggtggttgggaaggtcacccatcactcaattgagctttactgggatcttgaaaagaaagcaaaaagacagggccctcaggaacaatggtttcgcttctccatcgaggaagaggatcccaaaatgcacacatacggcataatatatacaggctatgcaacaaaacacgtcgtggaaggactggagcctagaacattgtatcgctttcgccttaaggtgacttcaccttctggagaatgcgagtattctcctttagtctctgtctccaccaccagttccatatggctgggcggggagccaatttctagcgagcaccttcaccgcgctgtgtcagttaacgacgaggatctgctcgtacgcatcctgcagggagggtag

SEQ ID NO: 117075 - DNA, 849 bp, Artificial Sequence
  Description of Artificial Sequence: Synthetic coding sequence
atgccaccttccaaacctcatcctcccgtagtcggtaaggtcacacaccattccattgagctttattgggatctcgagaagaaggcgaagagacaaggtccccaggagcagtggtttcggtttagtatcgaggaagaggaccctaaaatgcacacatacggcatcatctatacaggttatgcaaccaagcacgtagtcgaaggtttagagccccgtactctctaccgatttcgcctgaaagtgacatccccttcgggcgaatgcgaatactcccccctcgtgagcgttagtacaactagctccatttggttgggcggcgagccaatcagctcagaacatcttcacagggctgttagcgtaaacgacgaagatcttctagtgcgcatccttcagggcggacgcgtgaaggtggacgttcccaacaaattcggatttactgcattaatggtggcagcccagaaagggtacacctcactgatgttagcttgctatgctggacacttagacgtggttaaatacttgcgccgccacggagccagttggcaggctcgtgatctagggggctgcaccgccctgcactgggctgcagacggcggtcactgctctgtcatcgaatggatgattaaggacgggtgtgaggtcgatgtggtggacaccgggtcaggctggacaccgctcatgcgggttagcgctgtgagcggcaaccaacgggtcgcctctctgctcatcgacgcgggagctaacgtcaatgtgaaggacaggaacgggaagactcccctgatgagcgtcgtgtcgctccttgaggagcgcaaaaaaaaacagagacccaaaaaaagctgtgtgtgctag

SEQ ID NO: 117076 - DNA, 1116 bp, Artificial Sequence
  Description of Artificial Sequence: Synthetic coding sequence
ctccagaaacagaaaatcatgccaccgtcaaagccacacccccctgtggtgggcaaggtcacacaccattctatcgagctgtattgggacctggagaaaaaagcgaaaaggcaggggccccaggagcaatggtttagattctccattgaggaagaggaccccaagatgcacacttatggaatcatctacactggctacgctactaagcatgtggtggagggcctggagcctagaactctatacaggtttcggctgaaggttacgtccccatccggagaatgtgagtacagtcctctcgtgtctgtatcaacaacccgaccgagcctctcgaagtcgttggtcaaaatccgcatggttacttccgtgctgcacggacctcccactgaaaatacaggcgagccaatcagctcagagcacctgcatcgagccgtttccgtgaacgatgaggatctgctcgtgaggatcctacaaggcggaagagtgaaggtggacgtcccaaacaagttcggtttcaccgcacttatggtagctgcccaaaagggctacaccagattggtcaagatactggtgtcaaacgggacggatgtaaatctcaaaaacggctcaggtaaagactccttgatgctcgcttgttacgcagggcacctggacgtcgtcaagtatttgaggcggcacggagcgagttggcaagcgagagacctgggagggtgcactgccctacactgggctgccgatggaggtcactgttcggttatcgaatggatgataaaggacggttgtgaagtcgacgtggtggacaccggaagcggatggacacctctgatgagggtcagtgccgtatccggcaaccagcgggtagcctctctccttattgacgccggggccaatgtaaatgtaaaagaccgtaatggcaaaactcctttgatggtggccgtgctgaacaatcacgaagagctcgtgcagctattactggataaaggcgcagacgctagtgtaaagaatgagtttggaaagggcgtgttggagatggcccgtgtctttgacagacagagcgtcgtgagtttactagaggagagaaagaaaaagcagcgtccaaagaagtcatgcgtatgctag

SEQ ID NO: 117077 - DNA, 1038 bp, Artificial Sequence
  Description of Artificial Sequence: Synthetic coding sequence
atggaaccgcaaaaaattatgccaccatctaaaccccacccgcccgtggtagggaaggtaacccaccactctatcgagctgtactgggacctggaaaaaaaagctaaaagacaaggcccccaagagcaatggttccgcttcagtattgaggaggaggatcctaaaatgcacacctatggtataatctatacgggatatgccactaaacatgtggtcgaagggctcgaacccaggaccctctacagattccgactgaaagtgacgtcaccttcaggggaatgcgaatattccccactcgtgtccgtaagcacgactagagagcccatctcttcagagcatctgcaccgcgccgtgagcgtgaatgatgaagatttgctcgtgagaatcctgcagggaggacgggtgaaagtggatgtgcctaacaaattcgggttcaccgctctcatggtggctgcccagaagggatataccaggctcgtgaaaattctggttagtaatggaaccgacgtgaacctgaaaaacggctccggaaaagattctctaatgctggcgtgttacgccggacacctggatgttgttaagtatctacgtcgacatggcgcttcctggcaagctcgcgacctgggaggttgcaccgctctgcattgggctgctgacgggggccactgttccgtgattgagtggatgattaaggacgggtgcgaggtcgacgttgttgacacaggaagcgggtggacaccactgatgcgggtctcagcggtgtccgggaatcaaagggtagcgagcctgttaattgatgcaggggccaacgttaatgtgaaagaccggaacggcaaaactcctttgatggtggcggtcctgaacaaccatgaggagctggtgcagctcctgctagacaaaggggcggacgcttctgtaaagaacgaattcggcaaaggcgtgctggagatggctagggtgttcgaccgtcagtcggtggtgtcattgctcgaggagaggaaaaagaaacaaagacccaagaaatcctgcgtgtgttag

SEQ ID NO: 117078 - DNA, 1020 bp, Artificial Sequence
  Description of Artificial Sequence: Synthetic coding sequence
atgcccccaagcaagcctcatccccccgtagtgggaaaagtgacccatcacagtattgaactatattgggatctggagaagaaggctaaacggcagggcccccaggaacaatggttccgtttctctatcgaagaagaagatcctaaaatgcacacttacggtatcatttacactggttatgctacaaagcacgtggtggagggcctggagcccaggaccctgtatcggtttcgattgaaagtgacctctccgtcaggcgagtgtgagtatagccccctggtgtctgtttcaaccacacgggagccgattagcagcgaacacctgcatagggccgtgagtgttaatgatgaggacctcttagtccgtattcttcagggggggagggtcaaagtcgatgtcccaaataagtttgggtttacagccttaatggtggccgcccagaaaggatatacgcgactggtgaagattttggtgagcaacggtacagacgtcaatcttaagaacggctccggtaaagacagtctgatgctcgcatgctacgcagggcacctggacgttgttaagtacctgcggagacatggggcctcttggcaggctcgagacctcggaggctgtacagccctacactgggctgctgacggggggcactgctccgtcattgagtggatgatcaaagacggctgcgaggtcgatgtggtcgacacaggatctggctggactcccctgatgcgtgtgtccgcagtgagcgggaatcagagggttgcctccttactgattgatgcaggagcgaacgtgaacgtcaaggatagaaacgggaagacacccctgatggttgcagtgctgaataaccacgaggaactcgtgcaactcctcctcgataaaggcgctgacgcctcagttaagaacgagtttggaaaaggagtgctggagatggctcgggtctttgatagacaatctgtcgtgagcctgcttgaagagcgtaagaagaagcagcgaccaaaaaaatcttgtgtttgctag

SEQ ID NO: 117079 - DNA, 375 bp, Artificial Sequence
  Description of Artificial Sequence: Synthetic coding sequence
atgcccccttcgaaacctcatccgcccgtggtcggaaaagtgacccaccattccatagaactgtactgggacctggagaagaaagccaagcgtcagggccctcaagagcagtggtttagattcagcattgaggaggaggatcctaagatgcacacatacggaatcatatacaccgggtacgctactaagcatgtggttgaaggattggagcctagaacgctctatcgatttcgtctaaaagtgaccagcccatccggggagtgtgagtactccccccttgtttctgtgtcgaccactagagaaccaatcagcagcgaacacctgcatagagccgtgtccgtgaacgatgaggaccttctggttaggatactttag

SEQ ID NO: 117080 - DNA, 402 bp, Artificial Sequence
  Description of Artificial Sequence: Synthetic coding sequence
atgccgcctagcaagccacatccccccgtggttggcaaagtaacccaccactcaatcgaactttattgggatctcgaaaagaaagccaaaagacagggcccccaggagcaatggttcaggttttcaattgaggaggaggatccaaagatgcacacttatggaatcatatacacaggatacgctacaaagcacgtagtggaaggactcgaacctcggaccctgtaccggtttagacttaaggtgacaagcccatcaggagaatgcgaatatagtcctctggtatcagtatcaacaaccagttccatatggttggggggggaacccattagcagcgagcatttgcatcgggcagtctcagttaatgatgaggacctcctggtacggattctgcagggcggctag

SEQ ID NO: 117081 - DNA, 441 bp, Artificial Sequence
  Description of Artificial Sequence: Synthetic coding sequence
atgcctccttctaagccccaccctccagtcgtggggaaggtgacccaccattccatcgaactgtattgggacctggagaaaaaggccaagcggcaaggcccccaagagcagtggtttcggttttcgatcgaggaggaggatcccaagatgcatacctacggaatcatatataccggatacgctacaaaacatgtcgtggaaggcttggaacctagaaccttgtatagattccgtcttaaggtgacatctcctagtggggagtgtgagtacagccccttggtgtcagtgagcaccacgtcagagtattctgatcgcccccacagccctttgtccagatcaatggagatgaccagcaacctggaaaagatcttctgcctgtcattcgggttaaccaggagcagaaacgatacaattttcaaacattgcaacaacatatgttag

SEQ ID NO: 117082 - DNA, 600 bp, Artificial Sequence
  Description of Artificial Sequence: Synthetic coding sequence
taagaacctattagcagtgaacacctgcacagggcagtgagtgtcaacgacgaggacctcttggtacgcatccttcagggggggcgcgtaaaggttgatgtgccaaacaagtttggcttcacagcactcatggtggctgctcagaagggctatacccggctggtcaaaatactggtgagcaatggaacagacgtgaaccttaagaacggtagcggcaaggatagtctgatgttggcctgctatgctggccatctggacgtagtcaaatacctgaggcggcacggcgcttcatggcaggcacgggatcttggagggtgcactgctcttcactgggccgccgatggtgggcattgctctgtcattgagtggatgatcaaagatggttgcgaagttgacgtggtagacactggctccggctggacccccctcatgcgcgtttccgccgtttcagggaaccagcgggttgcctctctcttgattgatgctggcgctaacgttaatgtgaaagataggaacgggaaaactcccctgatgagcgtcgtgagtcttctcgaggagagaaagaaaaagcaacggccaaagaagagctgcgtctgctag

SEQ ID NO: 117083 - DNA, 735 bp, Artificial Sequence
  Description of Artificial Sequence: Synthetic coding sequence
atggaagtaaccggagtgagcgccccgaccgtgacagtgttcataagtagttctttgaacaccttccgaagcgagaaaaggtacagccgttccttgacaatcgccgagtttaagtgcaagttagaactgctcgtcggctcccccgcctcttgtatggagctggaactgtacggtgttgatgataagttctattcaaagcttgaccaggaggatgcgctactaggtagttacccagtggatgacgggtgtcgcatccatgtgatcgatcactccggcgctcggctcggtgaatacgaagacgtgtccagagtcgagaagtacacaatttcgcaggaggcctatgaccagcgtcaggacaccgtaagaagtttcctgaaacgttctaagctgggacggtacaacgaagaggagcgggctcagcaggaagccgaagcagcacagaggttggctgaggagaaggctcaggcctccagcattcctgtgggctcaaggtgtgaggtccgagcagccggtcagtcaccacgccgcggcacagtgatgtacgtagggctgacagacttcaaaccaggatactggatcggggtccgttatgatgagcccttgggtaaaaatgatggatccgtgaacggaaagaggtacttcgaatgccaggcgaagtatggcgcattcgtcaagcctgccgtggttactgtgggggactttcccgaggaagactacgggctggacgagatctag

SEQ ID NO: 117084 - DNA, 1497 bp, Artificial Sequence
  Description of Artificial Sequence: Synthetic coding sequence
atggactcccaaaaggaggcacttcagagaatcattagcactttggcaaataaaaatgacgaaatccagaactttatcgatacactgcaccacactcttaagggcgtgcaggaaaattcttccaatatcctatctgaattggacgaggagtttgacagcctgtactccattctcgacgaagtcaaggaatccatgattaactgtatcaagcaggaacaggccaggaaatcccaggagctgcaaagccaaatcagtcagtgcaataacgcactggaaaactctgaggagctactggaattcgccacccgcagtttggatatcaaggagcctgaggagttctccaaggccgcccgacagattaaggaccgggtgacgatggcctctgccttcagactgtctcttaagccgaaagtgtctgataatatgactcacctgatggtggacttctcccaggagagacagatgctacagaccctgaagttccttccagtaccgaaggctcctgagattgatcctgtggagtgtctggtggccgataatagtgtgaccgtggcgtggcgaatgcctgaagaagacaacaaaattgaccattttatccttgagcatagaaagacaaatttcgatggcttaccgcgcgttaaagacgagcgctgttgggaaatcatcgataatatcaaaggcaccgagtatacgctgagcggcttaaagttcgacagcaaatatatgaattttagagtgcgggcctgtaacaaagctgtggccggggaatacagcgaccccgttaccttagagacaaaggcactgaacttcaatctcgataatagtagctctcatctgaatctaaaagtcgaagacacctgcgtagaatgggatcctactggtggcaaaggacaggaaagtaagatcaaagggaaggagaataagggcagatcaggaacaccttcaccaaagcggacttcagtgggttctcgcccccccgccgtgcgcggatcaagagatcggttcaccggagagagctatacagtgctcggtgatactgctattgaaagcgggcagcactactgggaagtaaaggcacagaaggactgtaagagttactccgtgggagtcgcctacaagacgctgggaaaatttgatcaactgggtaagactaacacttcatggtgcatacacgtgaataattggctccagaatacattcgcagcaaagcacaataacaaagtgaaagcactagacgtgactgtccccgagaaaatcggggtattctgtgatttcgatggaggacaactctctttctatgatgccaattctaagcagctcctctatagtttcaagactaagttcacacagcctgtccttccggggtttatggtgtggtgcggcggcctcagtctgtccaccggaatgcaggtgccatctgcggtgcggaccctccagaagtctgagaacggcatgacagggagcgcctcctctctaaacaatgtcgtcacccagtag

SEQ ID NO: 117085 - DNA, 438 bp, Artificial Sequence
  Description of Artificial Sequence: Synthetic coding sequence
atggactcccaaaaggaagctttacagagaattatctctaccctcgctaataaaaacgacgagatccagaacttcattgacacactgcaccacacactgaagggggtacaggaaaacagtagcaatatcctgtcggaactcgacgaggagtttgacagcctctattccatcctggatgaggtgaaggagagcatgataaattgcattaagcaggaacaggctagaaaatcacaggagctccagagtcagatatcccagtgcaataacgctctcgagaattcagaggagctgctggaattcgctacaagatctcttgacataaaggaacccgaggaattcagcaaggtgcacaagaattgcatcaacacgcttaataaggggagttgcatcttcaagaaggcgtttctcttttttttctcattcggctttctctattag

SEQ ID NO: 117086 - DNA, 1593 bp, Artificial Sequence
  Description of Artificial Sequence: Synthetic coding sequence
atggactcccagaaatactgcttcaaagaaaacgaaaacgtgactgtggataaagcttgcttcctgatctccaacataacgatcggacccgaatctatcaacctccaacaagaagcgctgcaaagaataatcagcacattagccaataagaatgatgaaatccagaactttatcgatacactgcaccacaccttgaagggagtccaagaaaattccagcaacattctgagcgaactcgacgaggagttcgattccctctactccatccttgacgaggtcaaggaaagcatgatcaattgcatcaagcaggagcaggcccgaaaatctcaggagcttcagtcccagattagccaatgtaataatgctctggagaatagcgaggaactactcgagttcgccaccagaagtctcgacataaaggaaccggaagagttctccaaggccgccaggcagattaaagacagagtcacgatggcctctgcctttcggctatcactgaaacctaaggtgagcgacaatatgacacatctgatggtggacttttcacaggagcggcagatgctgcagacgttaaagttcctccccgtaccaaaggcgcctgaaattgaccccgttgagtgcctggtggcagacaactctgtgaccgtcgcttggaggatgccggaagaagataacaaaattgaccattttatcctggaacatcggaaaaccaattttgacgggctgccccgagtcaaagacgaaaggtgctgggagatcattgataatatcaagggcacagagtacacacttagcggcttgaagttcgactctaagtatatgaacttcagagtacgtgcctgtaacaaggctgtggccggagagtacagtgacccagtcacgctggagacaaaagccctgaatttcaacttggataatagtagctcccacctgaacctgaaggtggaggacacttgcgttgagtgggacccgaccggaggcaagggccaagagtctaaaattaaaggcaaggagaacaaagggcgctccggaaccccatctcctaaacgcacatccgtgggttcccgacctcccgctgtacgcgggtcccgtgatcggttcacaggcgaatcgtatactgtactcggagacaccgcaatcgaaagcggccaacattactgggaggtgaaggcgcagaaagattgcaagagttattccgtaggggtggcttacaaaacactgggaaaattcgatcagcttggaaaaactaacaccagttggtgtattcacgtgaataactggctgcagaacacattcgctgccaagcataacaataaggtgaaggcattagatgtgaccgtgcccgagaaaattggggtgttctgtgacttcgatgggggtcagctgtctttttatgacgccaatagtaagcagctgctgtattcattcaagacaaaatttactcagcccgtgctgcccggctttatggtttggtgcggggggctaagtctgtccactggaatgcaggtgcctagtgcagttcggaccctacaaaagtcggagaatggaatgacaggctcagccagctctctgaacaatgtggttacacaatag

SEQ ID NO: 117087 - DNA, 1152 bp, Artificial Sequence
  Description of Artificial Sequence: Synthetic coding sequence
atggcaagcgcatttagactcagcctcaagcccaaggtgtcagataacatgacgcacctgatggtggacttttcccaagaaagacagatgctgcaaaccttgaagttcctccctgttcctaaggccccagaaatcgatcctgtcgagtgccttgtagctgataactcagtcactgtggcttggcggatgccagaggaggacaacaaaattgatcacttcatcctggagcaccgcaagacgaactttgatggccttccacgagtgaaggatgagcgctgctgggagatcatcgataacattaaaggcaccgaatatacactgagtgggctgaaattcgattctaagtatatgaactttcgtgtgagggcctgtaataaggcagtggccggtgaatactccgaccctgtcacgctggaaacaaaagccctgaatttcaacttagataattcctcatctcatttgaacctcaaggtggaggatacttgtgtcgaatgggatccaaccgggggaaagggacaggaatcaaagatcaaagggaaggagaacaaggggagtgtacatgtgacaagcctgaagaaacatactagcggtacgccatctccgaaacgaacaagcgtcggcagccgcccccctgcggttcgagggtcccgggataggttcaccggggagtcgtacaccgtcttaggggataccgccattgagagcgggcaacattattgggaggtcaaagctcaaaaggattgcaaatcatacagcgtgggagtcgcttacaaaacattagggaagtttgaccagctgggcaagacaaatacctcatggtgtattcatgtaaacaattggctgcagaacacctttgccgctaagcacaataataaggtcaaagccttagacgtaaccgttccagagaaaatcggtgtgttctgtgatttcgacgggggtcaactgtcattctacgatgccaactccaaacagctgctctacagctttaagacaaaatttacacagcccgtgctccccggttttatggtatggtgcggtggcctgtcactgagtacagggatgcaggtcccgagtgccgtgaggacacttcaaaagagtgagaacggcatgacaggcagtgccagttctcttaataacgtagtcacacagtag

SEQ ID NO: 117088 - DNA, 5685 bp, Artificial Sequence
  Description of Artificial Sequence: Synthetic coding sequence
atggcacctgaggctggcgccaccctgcgtgcccccagacgcctgtcttgggccgccttgctacttttggctgcattattacccgtcgcgagctccgccgccgcttccgtggatcaccctctcaaacctagacacgtcaaattactgtctaccaaaatgggccttaaggtcacctgggacccaccaaaagatgctacgagtaggcctgtggaacactacaatatagcctatggcaaatcactgaaatcactgaaatatattaaggttaacgccgaaacttacagcttcctgattgaagatgttgaaccaggagtggtatatttcgttctgctcacagcagagaatcactccggtgtgtctagacccgtgtacagggctgagagccctccaggcggcgaatggatagagattgatggctttcccatcaaagggccagggccatttaatgagaccgtcaccgaaaaggaagtccctaataagcctctgcgcgtcagggtgcgcagttcagacgaccgtctgtcagtggcctggaaggccccaagactgagtggcgcaaagtcaccaaggcgaagcagaggctttcttttaggatacggcgaaagcggccgcaaaatgaattacgtgcctctgactagggatgagcggacacatgagattaaaaagttagctagtgagtctgtgtatgtggtgagcttgcaatccatgaattcacagggaaggagccagccagtgtaccgagccgcccttactaaacgtaagatctccgaggaggatgagttggatgtgccagacgatattagcgttcgagtcatgtcctcacaatctgtcttagtgtcctgggtggacccagtactggagaaacaaaaaaaagttgtggcatctcgtcagtatactgtgaggtatagggagaagggcgagctggcccgatgggactataagcagatcgcaaataggcgggtgcttattgagaacctgatccccgataccgtatacgagttcgctgtgcggatttcacagggtgaaagggatggtaaatggtcaacctcagtctttcagaggactccagaatcagcaccaactaccgcacctgagaacctcaatgtttggcccgtgaacggcaaacccacagtcgttgcggctagctgggacgcccttccagaaacggaaggcaaagtcaaagagtacattttaagttatgcacccgcactgaagcctttcggtgctaaatcactgacatatcctggggacacaacttctgccctggtcgatggtctgcaacccggcgaaaggtacctgttcaaaatcagggcgaccaatcgtcggggccttgggccacactctaaagcatttattgtggctatgcctactacaagcaaggctgatgtagagcagaacacggaagataatggcaagccggagaagcccgaaccttcaagccctagcccccgcgccccagcctcctcccagcacccgagtgtaccagcatctccccaggggcggaacgctaaggacctcctgcttgacctaaaaaataaaattcttgctaatggtggggcccccagaaagccacagcttagagcgaaaaaagcagaagagctcgatctccaatctaccgagattacaggagaagaagagctgggttcccgcgaggatagccccatgtcaccgtctgacacccaggatcaaaagagaacactacgcccgccttcgcgccatggtcattcggtggttgccccaggccgcaccgccgttagagcccggatgccggccctccccagaagagagggagtggacaagccgggcttctcactagctacccagccacgtccgggagctccaccatcagcctcagcttctcccgcccaccacgctagcacacagggcaccagtcatagaccatccctgcccgcttcattgaacgacaacgacctggttgatagtgacgaggatgagagagctgtgggctctctacaccctaagggggcattcgcacagcctcggcctgctctgtccccaagcaggcagtcaccttcatctgtgctgcgggataggagttccgtccatcccggtgccaagccagcgtcccctgcccgccgcacccctcattctggcgccgcagaagaggattcctccgcctcagcgcctccaagcaggctcagtcctccacacggggggtcatctagattactaccgacacagcctcacctcagcagcccattgagtaagggcggtaaggacggagaagacgcccccgccacgaattctaatgccccttcacggagcactatgtccagcagtgtgtcttcccacctgagttcacgaacccaggtgagcgagggggcagaggcatctgacggagagagccatggcgacggtgaccgcgaggacggcggacgccaggctgaagccaccgctcagaccttgagagcaaggcctgccagcgggcacttccatctgctgagacacaaaccttttgccgctaatgggcggagccctagcaggttcagcatcggtcgggggccacgattacaaccttcttcctcaccccaaagcacggtaccctcaagggcccatcctagggtgccctcacactcagactctcatccgaagctgtcatcaggaatccacggagatgaggaagacgagaagcccttgcccgctactgtcgtcaatgaccacgtgccatcctcctcaagacagcccattagcaggggttgggaagacctgcgcaggagcccacagaggggtgccagcctccatagaaaggaacctattccagaaaatccaaagagcaccggggccgacacccaccctcaaggtaagtattcttccttagctagcaaggctcaggacgtgcaacaatccacagacgccgacacagaaggtcattcgccaaaagcgcagcctgggtcaacagataggcatgcgtctccggcaaggccccccgctgctagaagccaacagcacccttcagttcctagacgaatgaccccaggtcgagcgccccaacagcagcccccaccccctgttgcaacctcccagcatcatcctgggccccaaagccgtgacgccgggaggtcaccttctcagccgagactgtccctgacgcaggctggtagaccgaggcccacctcacaaggtcgcagccattctagttccgatccatatactgcatcctcaagaggcatgctgcctaccgcgctgcagaaccaagatgaggatgcccagggcagctatgacgatgacagtaccgaggtagaggcccaggacgtgagggcccccgcacacgccgcaagggcgaaagaggccgccgccagcttgcctaagcatcaacaggtggagtctcctacaggggctggagctggtggtgaccacagaagccagagaggacatgctgcatctcctgcgcggcccagccggcctggaggcccgcagtcccgggctcgggtgcccagtcgcgcagcgccaggaaaatccgagccgccgtccaagagacctcttagttctaagtcacagcagagtgtgagtgccgaggacgacgaagaggaggacgccggttttttcaagggagggaaagaggacttactcagcagctcagttcctaaatggccatcaagtagtacaccacgaggcggaaaagacgccgacgggtccctcgctaaggaagagcgggaacctgccatcgccctcgctccccgcggggggagcctggcgccggtaaagcggcccctgcccccacctcccggcagttccccacgcgcctctcacgtgccttctagactgccgccaagatcagctgctactgtgtctccagtggcgggaacacacccttggccacagtacaccactagagctcccccagggcacttctctacgacccctatgcttagtttaagacaacgtatgatgcatgcacggtttcgaaatcccctgtcacgacaaccagccagaccctcttacaggcaagggtacaatggccggccaaacgtcgaaggaaaggtgttacctggaagtaatgggaagccaaatgggcagagaattattaacggaccacaaggtaccaagtgggtcgtagatctggacagaggactggttctgaatgctgaggggcgttatcttcaagactcccacgggaatcctctacgtattaaattgggtggagatggccggacgattgtggacctcgaggggactccagtcgtgtcccccgacgggcttcccctgtttggacagggtcggcacggcacccccctcgcaaatgcacaggacaaacctatcctgtccctgggaggaaaaccactggttggtctcgaagtcataaagaagaccacccacccccccactactacaatgcagcccaccactacaaccactccacttcctaccacaacaacaccaagacccaccaccgctacgactcgtcgaacaaccaccacccggcgcacgactacacggaggccaaccactaccgtacgaactacaacccgtaccacaacaactaccactcctaccccgaccactcctatcccaacctgccctcccggaacattggaaaggcatgacgacgacgggaatcttatcatgtcctcaaacgggatcccggagtgctatgcggaagaagatgaatttagtggactggagacagataccgccgtgcctaccgaagaagcttatgtaatttacgacgaagattatgagtttgaaacctcaagaccaccaacaaccactgagcccagcactacagcaacaactccccgggtcatccccgaggagggcgcaatttccagtttcccagaagaggagttcgatttagccggtagaaagagatttgtcgcaccctacgtgacttatctcaacaaggatccctctgccccatgttccttgacggacgcactcgatcatttccaagttgacagtcttgacgaaattatccccaatgatctgaagaaatccgaccttccaccccagcacgccccaaggaacattaccgtggtcgcggtcgaggggtgtcactcctttgtgattgtggattgggacaaggccacccctggtgacgttgtaactggttacctggtgtattccgctagctacgaagacttcataagaaacaagtggtccactcaggcttcatcagtgacacacctccctatagaaaacctgaagccaaatacccggtactactttaaggtccaggctcaaaacccccacggatacggccctataagcccatcagtatcctttgtcacagaatcagacaacccactcctggtggtgaggcctccagggggggagccaatctggatcccttttgcttttaaacacgatccaagttatacggactgccacggtcgtcagtacgttaagcgaacctggtatcggaaatttgtcggtgtcgtgctgtgtaattccctgcggtataaaatctacctgagtgataacctgaaggatacattctacagtattggagactcctgggggcgtggagaagatcactgccaatttgtcgactcacacttagatggtcggacagggccccaaagctacgtggaagcattaccaacaattcagggctattacagacagtaccggcaggaacccgtccggttcggcaacataggcttcggaacaccttactactacgtgggctggtatgagtgtggtgtgagtattccaggaaagtggtag

SEQ ID NO: 117089 - DNA, 5496 bp, Artificial Sequence
  Description of Artificial Sequence: Synthetic coding sequence
atggcccctgaggctggtgctaccctgcgggcacctaggaggttgagctgggccgcacttctcctcctggctgcattgttgcccgtcgcaagttccgccgctgcaagtgtggatcaccccctcaaacctagacatgtgaagctgctgtccactaagatgggattgaaagttacttgggatccccccaaagatgccacctccaggcctgtggaacactataacatcgcatacggcaagagtcttaagtcgcttaaatacatcaaggtgaatgccgagacatatagtttcctgatcgaggacgtagagcccggcgtagtgtatttcgtgcttctgacggcagagaatcactctggggtgagtaggccagtgtatcgcgccgagtcaccacctggcggggagtggattgagattgatggtttccccatcaagggtcccggaccttttaatgaaacggtcacagagaaggaggtgccaaataagccactccgcgtcagagtacgcagcagcgatgaccggttatctgtggcctggaaggcaccccgcctctccggcgctaaatcacctcgaaggagccgaggcttcctcttgggatacggtgagagcggcagaaaaatgaactatgtgcccctcaccagggatgagaggacgcacgagattaagaaattggcaagtgagagcgtttacgtggtgtcactccagtccatgaatagtcagggcagaagtcaaccagtctatagagccgcactgactaagcggaagataagtgaggaggatgaacttgacgtgcccgacgacatctcagtcagagtgatgtccagccagtcggtgctggtttcatgggtggaccccgtgctagaaaagcagaagaaagtggtcgccagtagacagtacactgtgagatatcgcgagaagggcgagctagctaggtgggattataagcagattgctaacaggcgtgtcctaattgagaatctcatccccgacacggtatacgaattcgccgtgaggatctcccaaggggaaagagacggaaagtggagtaccagcgtctttcagagaacacccgagtctgcacccaccacggcccctgaaaaccttaacgtttggcctgtgaacgggaaaccaacagtggtggctgcctcctgggacgccctgcctgagacagagggaaaagtgaaggcctcaaaggcggatgtcgaacagaacaccgaggataatgggaagccagagaaacccgagccctccagcccatccccccgcgcccccgcaagttcacaacatccaagtgtgcctgcctctcctcaggggcggaatgctaaggacctgctgctggatctcaagaataagatactcgccaatggtggagcccccagaaaaccccagctgagggctaagaaagccgaggagctcgacctgcagtccaccgaaatcacaggcgaggaggagctggggtcccgcgaggatagccccatgagccccagtgacacccaggatcagaaaagaacacttaggccgccttctagacatggtcactcggtggtggccccgggccggaccgcggttagggctcgcatgcccgcgctgcccagacgtgagggggtggacaaacctggattctcactggctactcagccgaggcctggagcccccccctcagccagcgcctcgcctgctcaccatgctagtacccagggaacttcccaccggccgagtctccccgcatccctaaacgacaacgatctcgtcgactcagatgaggatgagcgtgccgtggggtcacttcatccaaagggtgctttcgcacaacctcggcccgcactgagccccagtaggcaatccccaagttctgtccttagagatcgttccagcgtgcaccctggagcaaaacccgccagcccggccaggaggacgccccattccggcgccgccgaggaggacagctctgcatctgctcccccttctcggctgtcccccccacacggcgggagtagcaggttactgcctacacaaccccacctgagcagccccctgagcaagggaggaaaggatggggaagatgcaccagccaccaattctaatgccccgtcgagatcaacaatgtcatcttcagtgtcgtctcatctctcctcaagaactcaagtatccgagggagctgaggccagtgatggggagagccacggagacggcgaccgggaggacggcgggagacaggcagaagctacggcccagactctgcgggctcggcccgccagcggccactttcatcttctgaggcacaagccattcgccgccaacggccggtcgcccagccgctttagtatcgggcgggggccaaggctgcagccaagttcaagcccccagtctactgtaccgagcagggctcacccccgagtccccagccactcagatagccacccgaaactttctagcggaatccacggagacgaggaggacgagaagccgctcccagcgacggtggtgaacgatcatgtgccttcatcctcccggcagccgatttcccgcgggtgggaagacctgaggcgctcccctcaacggggcgcgtccttgcaccgtaaggagcccatccccgagaatcctaaatcaactggcgctgatacacatcctcagggtaagtatagttcactagcctctaaggcgcaggacgtacagcaaagcaccgatgctgacaccgaaggccacagtccaaaggctcagcctggatctactgaccgtcatgcaagtcccgctcggcctccagctgcgcgcagccaacagcacccatcagtgccccggagaatgactcccggaagggctcctcagcaacaacccccaccccccgtcgctacctctcagcatcatcccgggccccagagccgggacgcagggcgatccccaagtcagccccgactgtctctgactcaggctggccgacctcggcccacatcccagggacgctcccacagttcttccgatccttacactgcgtccagcagaggcatgctcccaacagctctccagaatcaggacgaagacgcccaggggtcctatgacgatgacagcacagaagtcgaagctcaagacgtcagagccccagctcacgccgctcgggctaaggaagctgctgctagcttgccaaagcatcaacaggtggaatccccaactggtgcaggtgccggaggagaccatcggagccagcggggacatgccgcatcccctgcacggccgtctcggcccggcggaccgcagtcccgggcacgcgttccctcccgcgccgcccccggtaagtcggaaccaccatccaaacggcctctgtcaagtaaaagtcagcagtccgtctctgctgaagacgacgaggaagaagatgctggattttttaaggggggtaaagaggatctgctaagcagctcagtgcctaagtggccaagtagcagtacacctagggggggcaaggacgcagacggctctctcgctaaagaagaaagagagccggctatagccctggccccccgggggggcagcctggccccagtgaagaggcctctccctcccccccccggcagtagtccacgagcctctcatgttccaagtaggctgcctccacgttccgccgcaacagtgtctccagtggccggcacacatccttggcctcaatatactacgcgggctcccccaggtcactttagtacaacgccaatgctttcgctccgccagagaatgatgcatgcacgatttagaaatcccctgagccgccagccagctcgtcctagctaccgccagggctataacggcaggcccaacgtcgaggggaaagttcttcctggatccaatggcaagcccaacggtcagcggatcatcaacggtcctcaaggcaccaaatgggtcgttgatcttgaccggggcctggtgttaaatgctgaaggccgatatttacaggactcccacgggaatccattgcgtatcaaactcggaggcgatggcaggacaattgtggacctcgagggcaccccagtggtgtcccctgatggcctgcctctgttcgggcagggacgacacggaacaccgctggctaacgcccaggataagcctatcctgtcccttggcgggaagccgctggtgggtcttgaagtcattaaaaaaaccacgcatcccccgacgaccacgatgcagccaacgaccactacaacgcccctgcctacaactaccacccccagaccaaccacagctaccaccaggcgcactacaaccacacgcagaacgaccactcggcggcccactaccactgttcgcactactacacggaccacaaccaccacgactcctacacctaccacccctatccctacgtgcccacctggaaccctggaaagacatgatgacgatggaaatctcatcatgtcgagtaacggtatccctgaatgctacgctgaagaagacgaattctctgggcttgagactgatacggcagtccctaccgaagaggcttacgttatttatgacgaggattatgagttcgagaccagccggcctcccactaccacagagccctctaccacagccactacacccagagtcatcccagaggagggcgccatttcctcgtttcccgaggaagagtttgatctggctggccgcaagaggttcgtggcaccttacgtgacctatctgaataaggacccttccgctccttgttcactgactgacgcactggaccacttccaagttgatagcctcgacgagattattccaaacgacctgaaaaagtctgatctgcccccacagcatgctccaaggaacatcaccgtggtcgccgtagaaggttgccactcgttcgtaatcgtagattgggacaaggcgacacccggagatgtagtgacgggatacttagtgtattctgcctcttatgaagacttcattagaaacaagtggagtacccaagccagcagcgttacccacctgccaattgaaaacctcaagcctaataccaggtactacttcaaggtacaggcgcaaaacccccacggctatggtccaatttcaccctccgtttcattcgtaacagaaagcgataacccacttctggtggtgcgccctccaggtggcgaaccgatctggatcccctttgcctttaaacatgacccatcttacaccgactgccacggccggcaatatgtgaagagaacttggtacagaaagtttgtgggagtcgtactctgtaacagtctgcgctataaaatatatctgtccgacaatcttaaagacacattttattccatcggcgatagctggggtcggggggaagatcattgccagttcgtggattctcatctcgacggccgcacagggccgcaatcatacgtggaggcactgccgaccattcagggctactacaggcagtatagacaagaaccagttaggttcggaaatattggtttcggaacgccctattactacgtgggatggtatgagtgcggtgtgagcatccccggcaagtggtag

SEQ ID NO: 117090 - DNA, 3615 bp, Artificial Sequence
  Description of Artificial Sequence: Synthetic coding sequence
atgtacgtaaccatgatgatgaccgatcagatcccacttgagctcccgccccttctgaatggagaggtggccatgatgcctcacttggtcaacggcgacgcagcacagcaggtgatattggtacaagtgaatcccggcgaaaccttcaccatacgagccgaggatggaactttgcagtgcatacaggggcctgccgaggtcccgatgatgagtccgaatggctctattcctccaatccatgtgcctcctggctatatctcccaagtgatagaggactccacgggcgtgcggcgggtagtcgtgacaccccaatcacctgagtgttatcctcccagctatccatccgcaatgtcaccgacacatcatctacctccttatctgacacaccaccctcacttcatacataactcacatacagcctactatccaccagtgaccggaccgggggatatgccccctcaattttttccccagcatcatcttccacacaccatttatggggagcaggaaatcattccattctacggaatgagcacctacattactagagaggatcaatattccaaacctccacataaaaaattgaaagatcgccaaatcgatcgtcagaaccggcttaatagccctccatcctccatatataaaagcagctgtacgaccgtgtacaatgggtacgggaagggccacagtggcggctcaggcggcggcggttccggatcagggccgggaataaagaagactgagcggagggcacgatctagccctaaatcgaacgactccgacttgcaggagtacgagctcgaagtaaagcgcgtgcaggacattttgagcggtatagagaagcctcaggtcagtaatattcaagcccgggcggttgtgctttcctgggcccctccagtaggcctttcatgtggaccacacagtggtttgtcgttcccatacagctatgaagtggctctgtcagataaggggagagacgggaaatacaaaataatttacagcggggaggaattagaatgcaatctcaaggacctaagacccgcaaccgattaccatgtacgagtgtatgccatgtacaactcagtcaagggatcttgcagtgagcctgttagctttacgacccatagctgcgctcccgaatgcccctttcctccaaagctggctcacaggagtaagtcatctttgaccctgcagtggaaagctccgattgacaatggaagcaaaattacaaactacttgctggaatgggatgaggggaagcgcaatagtggcttcagacagtgtttctttggctcgcagaagcattgcaagcttacaaaactctgccctgctatgggctacacttttaggttggctgctaggaatgatattggcacctctggttattctcaagaggtggtgtgttatacactgggaaacattccacagatgccatctgcacctaggcttgttagggcggggattacgtgggttacactgcaatggagtaagcctgagggttgttctcctgaagaagtaattacttacacccttgagatacaggaagacgagaacgataatctttttcatccgaagtacacgggtgaagacttgacctgcacagtgaaaaacctaaagcggagtacccagtacaagttccgcctgactgcttcaaacaccgaagggaaatcgtgtccttcagaagtcctggtctgcacgacctcacccgaccggccggggccccctactagacctttggtgaaaggtccggtcaccagtcacggtttcagcgttaagtgggacccaccgaaagacaacggtggatctgaaattctgaaatatctgttggaaataacagacggtaactccgaggccaaccaatgggaggtcgcctatagtggaagtgctacggagtacacgttcacacacctgaaaccaggaaccttgtacaagctccgcgcctgttgcatcagcacgggtggccacagtcagtgttctgaaagccttccagtccggaccctgagcattgccccagggcagtgccgtcccccgagagtactgggacgacctaagcataaagaagtccacttggaatgggacgtacctgcaagcgaatcgggctgcgaggtgagcgagtattctgtcgagatgactgagcctgaggacgtggctagcgaggtgtaccatgggcccgaactcgagtgtaccgtgggcaacctgttgcctggcacggtgtacaggttccgcgtgagggccctgaacgatggggggtatggtccttatagtgacgtgagtgaaattaccacagcagcagggcctcctggccagtgcaaggctccatgtatctcttgtactcccgatgggtgtgtgctggtgggatgggagtcaccagatagttcgggagcggatatctccgagtatcggctcgagtggggggaggacgaagaatccttagaattgatttatcacgggactgataccagatttgagattcgggacctgctgccagcagcacagtattgttgtagactgcaggctttcaaccaggccggtgcaggaccatacagcgaactggtcctttgccagacgcccgccagtgcccccgatccagtgtctaccttatgtgtgctggaggaggagccactcgatgcctatcctgacagcccaagcgcatgtctcgtgctgaactgggaagaaccttgcaataatggtagcgagatccttgcatatactatcgatctgggcgacaccagcataaccgtgggaaacactacaatgcatgtgatgaaagacctcctgccagagacaacctataggatccgaattcaggcgataaatgagatcggcgcaggtccattctcacaatttattaaagccaagacccgcccactgccacccctaccaccgcgcttggagtgtgcggccgccggaccccagtctcttaaactgaaatggggcgacagcaactctaagacgcatgctgccgaggatatagtgtatactcttcaattggaagacaggaacaagaggttcatctcaatataccgcggcccatctcacacatacaaggtacagagacttactgagtttacatgctactcttttcgaatacaagccgcatcagaggctggagaaggtccgtttagcgaaacttatacattcagtacaaccaaatccgtgcctccaacaattaaggcccctagggtcactcagctcgaggggaattcatgcgaaattctgtgggaaaccgttccttcaatgaagggggaccctgtgaattacatactgcaagttcttgtcgggagagagtcagaatataagcaggtttacaagggcgaggaagctacttttcagatttctggacttcagacaaacacagattaccgatttagggtgtgcgcttgccgacgctgtctcgatacttcccaggagcttagcggagctttcagcccatccgcagctttcgttttgcagcggtcagaggtgatgcttaccggggacatgggatcactggatgatcccaagatgaagagcatgatgcctacggatgagcaatttgctgccatcattgtgctggggttcgccacactgagcattctgtttgcttttatcttgcaatacttcttaatgaagtag

SEQ ID NO: 117091 - DNA, 216 bp, Artificial Sequence
  Description of Artificial Sequence: Synthetic coding sequence
atgtatgtcactatgatgatgactgaccagattccgttagagctccctcccttgttgaacggtgaggtggcaatgatgccacatctcgttaacggggacgcagcccagcaggtcatacttgtccaggtaaatccgggcgaaacgttcacaataagggccgaagacgggactcttcaatgcattcaggaggtgaatgtgaaacgccattgcctctag

SEQ ID NO: 117092 - DNA, 3615 bp, Artificial Sequence
  Description of Artificial Sequence: Synthetic coding sequence
atgtacgtgactatgatgatgacggatcaaattccactcgagcttcctcctctgctgaatggggaagtcgctatgatgccccacctggtaaacggcgatgccgctcaacaggttattctggtccaggttaatcccggagaaacctttaccatcagagcggaggatgggacattgcagtgcatccagggacctgcagaagtgcctatgatgtcaccaaatgggtcgatacccccgattcacgtgccccccggctacatctcccaggtgattgaggattctactggtgtgagacgggttgtagtgacaccccagagcccggaatgctaccctccgtcttaccctagcgctatgtcgcccacccatcacctgcccccttatttaacccaccacccccatttcatccataacagtcacacggcctactatcctcctgtgacagggccaggcgacatgccccctcaattttttccacagcatcacctgccacatacaatctatggagaacaagagattatcccattttacggtatgagtacctacatcacacgggaggatcagtactctaagccacctcataagaaactgaaggaccgtcagattgatcggcaaaatagactgaacagccctccatcatcaatctacaaaagctcatgtactacagtgtataacgggtatggcaagggccactcagggggaagcggcggtgggggcagcggcagtgggccagggatcaagaaaaccgagagacgcgctaggtcaagtccaaaaagtaacgatagcgacttacaggagtatgagctggaggtcaagagggtgcaggatattctgagtggcatagaaaagcctcaagtttcgaatatccaagcccgagcagtcgtcttgagctgggctccacctgtgggattatcatgcggtcctcactccggactctccttcccatactcttatgaagtggctctttcggataagggtagggacgggaagtacaagatcatttactctggggaagagttggaatgcaacctcaaagatttgcgccccgcaaccgactatcatgtgagggtttatgctatgtacaatagcgtgaagggatcttgctccgaacccgtaagcttcacgacgcactcatgcgccccggagtgtccctttccccctaaactcgctcatcgatccaaatcaagcctaaccttgcagtggaaagcacccatcgataacgggtccaaaattacaaattatctgctggagtgggacgaagggaaaagaaacagcgggttccggcagtgtttctttggctctcagaaacattgcaagttgaccaagctatgccctgctatgggctatacttttaggctggcagcccgcaacgacatcggaaccagcggatattcacaagaggtggtatgttacacattggggaacatccctcagatgccttcggctcctcggctagttcgcgcagggatcacatgggtgacacttcagtggtctaagccagagggctgtagcccggaagaggtcattacctacactctcgagatacaggaggatgagaatgataacctgtttcatcccaagtacactggggaggatctgacgtgtactgtcaaaaatctcaagcgttccacacagtacaagttcaggctcacagcatctaataccgagggaaaatcatgtccaagcgaagtgctagtgtgcacaacgtcccccgacagacccggtcctcctaccaggccgttggttaaaggcccggtgacaagtcacggttttagtgtcaaatgggacccccccaaagacaatggcggatccgagatccttaagtaccttctagagattacggatgggaacagtgaagccaaccagtgggaggtggcatactcgggctcggctacagaatatacctttacccacttgaaacctggcacattgtataagttgagagcatgttgtatctctacaggcgggcatagtcagtgtagtgagagcctccctgtcagaacgcttagcatagctcccggacagtgtcggcccccccgagtgctgggacggccgaaacacaaggaggtgcatctcgagtgggatgtgcctgcatcagaatccggttgtgaagtcagtgagtactccgtcgagatgacagagcctgaggatgtcgcctccgaagtatatcatgggccggaactggaatgtacggtcggcaacctgctccccggtactgtgtatcgcttccgcgtgcgggctctgaatgacggaggctatggcccgtatagtgacgtgtccgaaatcacgaccgctgccgggcctcccggacagtgcaaagcaccctgtatctcatgtacacccgacggatgcgtcctagtcggttgggagagccctgactctagtggggccgacatctccgagtataggctcgagtggggagaggatgaagaaagtctggagctcatttatcatggtacagacaccaggtttgaaatccgcgacctgctgccagcagctcagtattgttgcagacttcaggcgttcaatcaggccggagccgggccatatagcgagctcgttctgtgtcagacacctgccagcgcgcccgaccctgtgagtacactgtgcgtcctggaggaggaacctcttgacgcttaccctgactcgccttctgcgtgcctggtgctgaattgggaggaaccctgtaataatgggagcgaaatcctggcatataccattgatctgggcgataccagcatcaccgtgggaaacacaactatgcatgtaatgaaggacctgcttcccgaaaccacgtaccggataaggatccaggccataaatgagatcggagcagggcccttctctcagttcattaaagcgaagacaagaccactgccccctctccctccccgattggaatgcgctgctgccggccctcagtcactcaaattgaagtggggggactctaactcaaaaactcacgcggctgaggatattgtgtatacgttgcagctcgaagaccgcaacaaacgctttatcagtatctataggggaccatctcacacctataaagtccagcggcttaccgagttcacatgctattctttcaggattcaggcagcgtctgaggctggagagggcccattctctgaaacgtacacattcagtaccacaaaaagcgttccacccactatcaaagcgccaagagtgacgcagcttgagggtaacagctgtgagatactgtgggagacagtaccttcaatgaagggcgatccagtcaactacatcctgcaggtgttggtgggtcgggagagtgagtacaaacaggtctataagggggaagaggcaacgttccagatatcgggactccagactaataccgactaccgatttcgagtgtgcgcttgtcggcggtgtctcgatacaagtcaggagctctcaggagcattctcaccctctgcagcctttgtactccagcgctcagaggtaatgcttaccggagatatgggctccttggatgaccccaaaatgaagtctatgatgccaactgatgaacaattcgccgcaattatcgtgcttggattcgccaccctgtcaatcttgtttgcctttatactgcagtattttctcatgaaatag

SEQ ID NO: 117093 - DNA, 3615 bp, Artificial Sequence
  Description of Artificial Sequence: Synthetic coding sequence
atgtatgtgaccatgatgatgaccgaccaaatacctcttgaactcccaccgctcttgaacggcgaagtcgcgatgatgcctcatctggttaatggcgacgccgcccagcaggtgatcctcgtgcaagttaatccaggggagacgttcaccatccgggctgaggatggaacactccagtgtatccagggccccgcggaagtgcctatgatgagcccgaacgggagtatcccccctatccacgtgcccccgggatatattagccaggttatcgaggattcgacaggcgtgcggcgcgtggtggtaacgccccaatctccagagtgttatccaccttcctacccatctgccatgagtcctacgcatcacctgcccccatatcttactcaccaccctcatttcatacacaacagtcatacggcttactatccaccagtgaccggtccaggcgacatgcctcctcagttcttccctcagcaccaccttcctcataccatttatggagagcaggaaataattcccttctatggcatgtccacctacattacaagggaggatcagtactctaagcccccccataaaaaactgaaggatagacaaatcgataggcaaaatcgtcttaactcaccccccagctccatctacaaaagctcctgtaccactgtttataatggctatggtaaaggacattcaggagggagcggcggtggtggtagcgggtctggtcctggaataaagaagaccgaacgcagagcaagaagtagtcccaagtccaacgactcggacctgcaggagtacgaactcgaggtgaagcgggtgcaagatattctgagcggtattgagaaacctcaggttagcaacattcaggctcgagcagttgtgctctcttgggcccctcctgtgggtctgagctgcggcccccactcgggactgtcatttccttacagctacgaagtggcactatccgataaaggcagggacgggaagtataaaatcatctattccggggaagagctcgagtgtaacttaaaggatctgagacccgctacggactaccacgtgagagtctatgccatgtacaactctgtgaaagggtcctgcagcgagcccgtctcatttaccactcacagctgtgctccagagtgccccttcccccccaaattagcccatagaagcaaatcttcactgactctgcagtggaaagctcctatagacaacggcagcaagatcacgaactacctcttggagtgggacgaggggaagcgaaactcaggatttaggcagtgtttttttgggtctcagaaacattgtaaacttactaaactgtgtccagccatgggatataccttccggctcgccgctcgtaacgacatcgggacctctggttatagccaggaagtcgtgtgttacactctggggaacatccctcagatgccttccgctccacgccttgtgcgcgctggtataacctgggtgaccttgcagtggagtaaacccgaagggtgcagtcctgaggaagtgattacatataccctcgagattcaggaagacgagaacgataatctttttcatcccaaatacaccggtgaagacctgacttgtacagtgaagaaccttaaacgatctacacagtataagtttagattgaccgctagtaacactgaaggcaaaagctgcccttctgaagttctcgtgtgtaccacaagtcctgaccgtcctggcccaccaacacggcctttggtcaaggggcccgtgactagccatgggttctccgttaaatgggacccccctaaggacaacggtggcagcgaaatactgaagtacctgctggagataaccgacggaaactctgaagctaaccagtgggaggtggcgtatagcggctcagcgacggagtacacgtttacccatttaaagcctggaacgctgtacaagcttagggcttgttgtatctcaacaggtgggcatagccagtgctcagagtctctccccgtacggaccctctctatcgccccggggcagtgtcggcctccaagagttctaggacgacctaaacacaaagaagtgcacctggagtgggacgtgcccgcaagtgaatccggatgtgaggtgtccgaatacagcgttgaaatgaccgaacctgaggatgtcgcctccgaagtatatcatggacctgagctggagtgtaccgtgggcaaccttttgcctggtaccgtgtatcggtttcgagtcagggcgctcaacgacggaggatatggcccttacagtgatgtctcggaaatcaccactgctgcagggccccccggacagtgcaaagcgccatgtatttcgtgtacaccagatggctgtgtcctggtgggctgggaatcccctgactcgagtggggctgatattagcgagtaccggctggagtggggcgaagatgaagagagtctagagttaatttaccatggcacagacaccaggttcgagatccgggacttgttgccggccgcgcaatattgttgccgcctccaggccttcaaccaagctggagcgggaccctacagtgagctggttctctgccagacacccgccagcgctccggacccggtgagcaccctgtgtgtccttgaagaggagcccctggacgcctaccctgattcccctagcgcttgccttgtacttaactgggaggaaccctgcaataacggcagcgagatccttgcctatactatagacctgggggacacctccatcactgtcggtaacaccactatgcatgtcatgaaggacctcctacccgagaccacgtatagaatccggattcaggcgattaacgagattggcgctgggccgttctctcagttcatcaaggctaagactcgacccctgccccccctgccaccacgccttgagtgcgctgctgctgggccacagagcctgaagttgaaatggggcgattcaaactccaagacccatgccgccgaggatatagtatacactctgcaattagaggatcggaataaacggtttattagcatttacaggggtccaagccatacatataaggtgcagaggctgactgaatttacctgctattccttcagaatccaggcagcttctgaagcgggggaggggcccttttccgaaacatatacattttccacaactaaatcagtgccccccaccattaaggcacctagagtcactcagcttgaggggaacagttgcgagattctgtgggaaaccgttcctagcatgaaaggcgatcctgtgaactacatcctgcaggttttggtggggcgagaaagcgagtataaacaagtgtataagggggaggaagccactttccagatctctggactccagaccaatacggactacaggttcagggtttgcgcgtgccggcgatgtctcgataccagccaagaactgtcaggagcattcagtcccagcgctgcctttgtattgcagcgaagtgaagtgatgctcaccggcgatatggggtcccttgatgatcccaaaatgaaatcgatgatgcctaccgacgaacagttcgctgcaatcattgtcctggggttcgccactttgtctatcctatttgcgttcatattgcagtatttcttaatgaagtag

SEQ ID NO: 117094 - DNA, 627 bp, Artificial Sequence
  Description of Artificial Sequence: Synthetic coding sequence
atgttcaccaaggaaaaaatttggtctgaggtgatcctggtgcaggtgaatccaggggaaaccttcactattcgcgccgaggacggcaccctccagtgtatacaggggcccgccgaggttccaatgatgagccccaacgggtctatcccaccaattcatgtcccgcccggatatatcagccaggtgatcgaggactccacaggcgtaaggcgggttgttgtgacacctcagtcccccgaatgctatcctccttcttatccatctgcgatgtcccccactcatcatctacccccttacctgacccatcacccacacttcattcacaactcgcatacagcgtattatccacccgttacaggcccaggtgacatgcctccccagttcttcccacaacaccacctccctcataccatttacggagagcaggagattatccccttttacggcatgagtacttatatcacaagagaggaccagtatagcaagccgccgcacaaaaagctcaaggatcgccagatcgaccgacagaatagattaaattcccctcccagcagcatatataaaagttcttgtactactgtctacaacggatatggcaagggccacagcgggggctctggaggatag

SEQ ID NO: 117095 - DNA, 705 bp, Artificial Sequence
  Description of Artificial Sequence: Synthetic coding sequence
atgccctccggctgtcactcctctccacctagtggactgaggggggatatggccagtctggtgccacttagtccctatttatccccgactgtgcttctactcgttagctgcgatctgggattcgtgcgagccgatcgcccaccatctcctgtgaatgtgacagttactcacctacgggcaaattctgccaccgtaagttgggacgttcccgaaggcaatatagtcatcggttattccatatctcagcaacgccagaatggtccagggcagagggtcattcgggaggtgaacaccactaccagggcttgcgccctttgggggcttgccgaggactcggactataccgtgcaagtgcggagtattggcctgagaggagagtcacctcccggcccaagggtccatttcagaacactgaaaggctcagatagactccctagcaattcctcctcacccggagatattaccgttgaggggctggatggtgagcggcctttgcagaccggcgaggtcgtaattattgtggttgtcttactaatgtgggccgccgtgatcggtctgttttgccgacagtatgacataatcaaagataatgatagcaataataatcctaaagagaagggtaagggaccagagcaaagtccacagggacgtccagtaggcacacgccagaagaagagtccctcaattaatacaatagacgtctag

SEQ ID NO: 117096 - DNA, 2478 bp, Artificial Sequence
  Description of Artificial Sequence: Synthetic coding sequence
atggttggcaagtcccagcagacggatgtaatagaaaaaaaaaagcacatggcaattcctaaaagcagctcccctaaggccacacatcggatcgggaatacgtcgggttccaaggggagctatagtgcaaaagcatatgagtcaattcgggtgtcaagtgagcttcagcagacatggaccaagaggaagcacgggcaggaaatgacatcgaagtccctccaaactgacaccattgtagaggaaaaaaaggaggttaagctggtagaggagacagtcgtgccagaggagaagtcggccgatgtcagagaggcagctattgagctccctgaatccgtccaggacgtcgagattccgcccaacatacctagcgtgcagctgaagatggacagaagccaacaaacaagtagaaccggatactggaccatgatgaatatccctccagtcgagaaagtggataaagagcagcagacatacttctccgagtcagagattgtggtgatttcgaggcctgatagcagttcaaccaagtctaaggaagacgcgctcaagcataagtcctcaggtaagatctttgcctccgagcatcctgagttccagccggctaccaatagcaatgaggaaatcggacaaaaaaatatctcccggacttcatttacacaggagactaaaaagggccccccagtcttattagaagacgaactcagggaagaggtcacggtccccgtcgtacaggaggggtccgcagtcaagaaggtagcgtccgcagaaatcgaacccccttccacagagaaatttccagcgaagatccagcctcccctggtggaagaggcgacggctaaagcggagccacgccctgccgaggaaacacacgtccaggttcagccgagcactgaagagacacctgacgccgaagcagctacggcggttgccgagaacagtgtcaaagtgcagccccccccagccgaggaggcaccactagtggaattccccgccgaaatccagcctccttctgctgaggaaagcccttctgtcgagcttcttgccgagatcctcccccccagcgcagaggaatctccatcagaggagcccccagctgaaattttaccgcctcccgcagaaaaatcgccctccgtggagttactgggtgaaatccggagcccgtctgcccagaaagcaccaatcgaggtacaacccttacctgccgagggagccctcgaagaggcccctgccaaggtggagccccctactgttgaggagaccctggctgatgttcagccgttgctgcccgaagaggctccaagagaagaggcacgcgaactccagctgagcactgcaatggagacccctgcggaggaggcaccaacagagttccagtccccactgcctaaagagaccacagcagaggaagcatcagcagaaatccaactgctagccgcaacagagccacccgccgatgaaaccccggccgaagccagatctcctctgtctgaagagacatctgccgaggaagctcacgctgaagtgcagagtcctttggcagaggaaaccaccgcagaggaggcttccgcggagatccagttgctggcggccattgaggctcccgctgacgaaacacccgccgaagcccagagccccttatccgaggagacttcagctgaggaagctccagctgaagtgcaatcaccaagtgctaagggggtatcaatcgaggaggctcccctggaactccagccaccttccggcgaagaaacaacagccgaggaagccagtgctgcaattcaattgctagccgctacagaggcttctgctgaggaggcaccggcagaggtgcaacctccacctgccgaagaagctccagctgaggttcaacctccgccagcagaagaggcccctgcagaggttcagcctccccccgccgaagaagctccagccgaggtccagcctccccccgcagaagaagctcctgccgaagttcagccaccaccagcagaggaggccccagctgaggtgcagcctcctcccgccgaggaggcgcccgccgaggtgcagtctctccctgctgaagaaacacctattgaggaaacactcgccgccgtacattcacccccagcggacgatgtgcccgctgaggaggcctccgtcgacaagcactcgccgccggcagacttgctgttgaccgaggagtttccaattggtgaggccagtgcggaggtttctccgcctccgagtgaacagacacccgaggacgaggccctggtggagaacgttagtactgagtttcagagcccccaggtcgcaggtatccctgccgtgaagctggggtccgtagtgcttgaaggcgaggcgaaatttgaggaggtgagtaaaatcaactcggttctaaaggacctcagcaacaccaatgacggacaggcgccgacactggagatcgagtcagtctttcacatcgagctcaaacagaggccaccagaactatag

SEQ ID NO: 117097 - DNA, 2157 bp, Artificial Sequence
  Description of Artificial Sequence: Synthetic coding sequence
atggtgggcaagagtcagcagactgatgtcattgagaagaaaaagcacatggcaattcccaaatcctcttcccccaaggctacccatcgcattgggaataccagcgggagcaagggtagttacagtgccaaagcctacgagtcaatcagggtctcgtccgaactgcagcaaacatggaccaaaaggaagcacggacaggagatgaccagcaagagcttgcagactgacaccatcgttgaggaaaagaaagaagttaagctggtggaagagacagtagtcccagaagagaaatccgccgacgtacgagaagctgccatcgagcttccggaatctgtccaagacgtcgaaatcccacctaacatcccaagcgtgcagttaaaaatggaccgctcgcagcagacttcccgcactggctactggactatgatgaatatcccacctgtggaaaaagttgataaagagcagcagacttatttttcggaatccgagatcgtcgtcatttccagaccggattccagttccactaaaagtaaggaggacgcactgaaacataagagtagtgggaaaatttttgcgagtgagcaccctgagttccagccagcgactaacagtaacgaggagatcggccagaagaacatatcccggacctcattcacacaggaaacgaaaaagggaccccctgtcctgctcgaggacgagctgcgcgaagaggtaaccgtgcccgtagtccaggaggggagtgcagttaagaaggtcgcatcagccgaaattgagcccccatctaccgagaaattcccagccaagatccaaccccctcttgtagaggaggccacggccaaggcggaaccacgcccagccgaagaaacccacgtgcaagtgcagccctcgactgaggaaacgcccgacgcggaggctgctactgcagtggcggaaaatagtgtgaaggtgcagcctcctccagctgaagaggctccactggtagagttccccgccgagatccagcctccgtccgcagaggagagccccagcgtggaattactggccgagatcctgcctccatctgcagaagaatccccatccgaagaacctccagctgagattctgccaccacccgctgaaaagtccccatctgtggagttgctgggggaaattcgcagcccctccgcacagaaggcccctatcgaggtgcagcccctgccagctgagggggctctggaagaagcacccgcaaaagtggagcctcccacggttgaagaaacactcgcagatgtccaacccttgctgccagaggaggcacctcgagaagaagctagggaactccagcttagcacggccatggaaaccccggcagaggaggctccaactgagttccagtcaccgctccccaaggagacaacagccgaagaggcaagcgccgagatccaactgctagcagcgacagagacctcagccgaggaggccccggcagaagtgcagtcaccctcggccgaggaagctcctgccgaggtacagccccccccagccgaagaagccccagccgaggtacagccacctcctgcagaggaggcccctgccgaagtgcagcctccgccagctgaggaagctcccgccgaggtgcagcccccaccagctgaggaagcacccgcagaggtgcaaccaccccctgctgaggaggcccctgccgaagtgcaaccccctcccgccgaggaggcaccagctgaggtgcaatcattgccagccgaggaaacccctatcgaagaaaccctggctgccgttcattccccccccgctgacgacgtgcccgccgaggaggcctcagtcgacaagcactcccccccagctgacctgctgctgaccgaggagttccctatcggggaagctagtgccgaagtgtcccctccaccttctgagcagactccagaggacgaggcattggtggagaacgttagtactgagttccagtccccacaggttgccgggatccccgccgtcaagctggggtcagttgtgcttgaaggagaggccaaatttgaagaagtgtcaaaaattaactctgtgctgaaggacctgtccaacacaaacgacggacaagcaccgacacttgagattgagtcggtgttccatatagagctgaaacaacggccgcccgaactgtag

SEQ ID NO: 117098 - DNA, 2052 bp, Artificial Sequence
  Description of Artificial Sequence: Synthetic coding sequence
atggagcgcgccgccccttccagacgggtgccattgcccttactcttacttggaggcctggccttgctggctgccggagtcgacgccgacgtgctgctggaggcctgttgtgcagacggtcaccggatggcgacgcaccagaaggactgctcattgccctatgccaccgagtctaaagagtgccggatggtacaggagcagtgctgccatagccagctggaggagctccactgtgccacagggatatccctcgccaacgagcaggataggtgcgccacgccacacggcgacaatgcaagcctggaggcaacctttgtaaaacggtgttgtcactgctgcctgctcggtcgggctgcacaggcgcaggggcagagttgtgaatacagcctgatggtaggatatcagtgcggccaggtgtttcaggcctgctgcgtgaaatcccaagaaacgggtgatcttgacgtcggaggcctgcaagaaactgacaagatcatcgaagtggaggaggagcaggaggacccctaccttaatgaccggtgtcgagggggcggtccttgcaaacagcagtgcagagacacaggcgatgaggtggtgtgttcatgtttcgtagggtaccaactactgtccgatggtgtgtcatgtgaagacgtgaacgagtgcataacaggcagtcacagctgcagactcggggaaagctgcattaacacagtcggctcattcaggtgccagagagatagctcctgtggcaccgggtatgagctgacggaggacaacagctgtaaagacatcgacgagtgcgagagtgggattcacaactgtctccctgattttatttgccagaataccctgggctccttcaggtgtagacctaaactgcagtgtaagtctgggttcatccaagatgctttaggcaattgcatagatatcaatgagtgcttgagtattagtgctccctgccccatcggacatacatgtattaatacagaaggctcatacacatgtcagaagaacgtgcctaattgtgggcggggctatcatctgaatgaggaggggacccgctgcgtggacgtcgatgagtgtgcccccccagcggaaccatgcggaaaaggccaccgttgcgtcaactcaccagggtctttccggtgcgagtgcaaaacaggctattactttgacggtatatcccgaatgtgcgttgatgtgaacgaatgccagaggtatcctgggcggttgtgcggacataaatgcgagaatacactggggagctacctctgctcgtgcagcgtgggttttcggttatctgtcgacggtcgatcctgtgaagatattaacgaatgctccagttccccatgttctcaggaatgtgccaacgtgtatggtagctaccagtgttattgccggcgcggctaccagctgagtgatgtggacggtgttacatgcgaggacatcgacgagtgcgcactccctacaggcggccacatttgcagctaccgttgtatcaatatccccggctcctttcagtgcagctgtccgagcagcggctaccgtctggcaccaaatgggcgtaactgtcaggacatcgacgagtgtgttacgggcattcataattgctccataaacgaaacctgtttcaatatacaaggggggtttcggtgtcttgcgttcgaatgccccgagaactataggaggtcagcagcgacaaggtgcgagaggctgccctgccacgaaaacagggagtgttcgaagctgccactcagaatcacctattatcacctcagcttccccacaaatatacaggcccctgcagtcgtgtttagaatgggaccctcatctgccgttccaggcgattctatgcagttggcgatcacgggaggcaatgaagaggggttctttacaacacgcaaggtcagtccccatagcggggtggtggcattgaccaaacctgtgcctgaaccgcgggacctgctgctgactgtgaaaatggatctgagtcgccacggtactgtgagttcctttgtggccaagttgtttatctttgtgagcgctgaactgtag

SEQ ID NO: 117099 - DNA, 2112 bp, Artificial Sequence
  Description of Artificial Sequence: Synthetic coding sequence
atggagagagccgctccttccaggcgcgttcccttacccctgctcttgttgggcggcctggccctactggccgctggcgtggatgctgatgtactattggaagcctgttgtgcagatggccatcgcatggccacccaccagaaagattgctctctgccatacgctacggagtcaaaggaatgtaggatggtacaggagcagtgttgtcactcgcagctcgaagaactgcactgtgccactggcatttccttggccaatgagcaggacagatgtgcgacacctcacggtgacaatgccagccttgaggcaaccttcgtcaaaaggtgctgccattgctgtttgttgggacgcgctgcccaggcccaaggtcaatcctgtgagtactcattgatggttgggtaccagtgtgggcaggtgttccaggcttgttgcgtcaaatcccaggagacgggggatctcgatgtgggaggcctgcaggaaaccgacaagatcattgaagttgaggaggagcaggaagatccatatttgaatgatcggtgcaggggagggggaccgtgtaagcagcagtgccgggacacaggcgacgaggtggtttgctcttgtttcgttgggtatcagctgctgagcgacggcgtgagctgtgaggacgtgaatgaatgcatcacagggtctcactcttgtcgacttggggagagttgcattaacactgtcggcagtttccgttgccagcgggattcatcatgcggcacaggttatgagctcacagaagacaacagctgcaaggatatagatgagtgcgaatctggcatacacaattgcctccctgattttatttgccagaacacattgggcagcttccggtgccgtccaaagttgcagtgcaagtccggatttattcaagatgccctcggaaattgcatcgacattaacgagtgtctctctataagcgcaccatgccccattggacacacatgtatcaatactgaggggtcttacacatgtcagaaaaacgtgcccaattgtggccgcggttaccatctgaatgaggagggaactcgctgcgtggatgtcgatgagtgtgctccacctgcagagccctgcggcaaaggccacaggtgtgtgaactctccaggttcgttcagatgtgaatgcaagacaggctattactttgatgggatctccagaatgtgcgttgacgtgaacgagtgtcaaagatatcccggccgattgtgtggccataagtgtgaaaacactcttgggtcttacctatgctcctgtagcgtaggtttcaggttaagtgtggacggtcgtagttgtgaggacattaacgagtgtagctctagcccttgctctcaagagtgtgccaatgtgtatggaagctaccagtgctattgcagacggggctaccaactttccgatgtggatggggtgacctgtgaagacattgatgagtgtgctctgccaaccggaggtcacatttgcagctataggtgcatcaacatcccaggaagctttcaatgttcctgtccttcctcaggctaccgccttgctccgaatggccggaattgtcaggacatcgacgagtgcgtgactggaatccataactgtagtatcaatgaaacctgctttaatatccagggagggttcagatgtctggccttcgagtgtcctgaaaactatcggcgctcagctgcaacactgcaacaggagaagacagatactgtaagatgcatcaagagctgcagaccaaacgatgtaacctgcgtctttgaccccgtgcacaccattagtcataccgtcatttcattacctacgtttagggaatttaccaggcctgaagagataatattcctccgggcaattactccaccccatcccgcgtctcaggcgaatatcatcttcgacattacagaaggaaacctccgtgacagctttgatattatcaagcgttatatggatggcatgactgtgggcgtggtgagacaagtcagacccatagtcggaccttttcacgctgtgctgaaattggagatgaactatgtagtcggaggggtggtgagccaccgtaatgtagtgaacgtgcacatcttcgtgtctgaatactggttctag

SEQ ID NO: 117100 - DNA, 1701 bp, Artificial Sequence
  Description of Artificial Sequence: Synthetic coding sequence
atggaaagagcagctccatccaggagggtgcctctccctcttcttttgctaggggggctcgccctcttggcggctggagtagatgcagatgtactactagaggcatgttgcgccgatggccatagaatggctacccaccagaaagattgcagcctgccatatgcgaccgagagcaaggaatgcaggatggtccaggagcaatgctgtcatagccagctggaggagctgcattgtgccaccggcatcagcttagcaaatgaacaggatagatgcgctacgcctcacggtgacaatgcctctctcgaggccacttttgtgaaacggtgttgccattgttgcctactgggtagggctgcccaagcacaggggcaaagctgtgaatactcactgatggtgggttaccaatgtgggcaggtctttcaagcctgctgcgttaagagccaagagaccggagacctcgacgtcgggggcctccaggaaactgacaagatcatagaggttgaggaggagcaggaggatccttacctgaacgacaggtgtcggggtggtggaccttgtaagcaacagtgtcgggatactggggacgaagtcgtatgttcatgttttgtgggctatcagttgctgtccgatggcgtatcttgtgaggacgtcaacgaatgtattacaggcagccactcttgcaggctgggagaatcttgcatcaataccgtaggaagctttcggtgtcagcgagattccagctgcggcacaggatatgaattgactgaagacaattcctgcaaggacatcgatgaatgcgaatctggcatacacaattgcctgcctgacttcatttgccagaatactctgggctctttccgctgtcggccaaagctgcagtgcaagagcggcttcattcaggatgccctcggaaactgcatcgacatcaacgagtgtctgtccattagtgcaccctgccccatcgggcatacctgtataaacacagaggggagttacacctgccaaaagaacgtgccgaattgcggccgcggctatcacttgaacgaagagggtacccggtgcgttgacgttgatgagtgtgccccaccagcagaaccatgcggtaaaggccataggtgtgtcaatagccctggatcatttaggtgcgagtgtaaaaccggctattacttcgacggaatctccagaatgtgtgtcgacgtgaacgagtgccagagatatcctggcaggttgtgcggccacaagtgcgagaacacgctcggttcctatttgtgtagctgctccgtgggcttcaggctttccgtggatggaaggtcctgcgaggatataaatgaatgcagcagcagtccatgcagccaggaatgcgccaacgtatatggttcgtatcaatgctactgccgtagggggtatcagctttccgatgtggatggagttacatgcgaggacatcgacgaatgtgctttgccgacaggcggccacatctgttcttatcgttgtattaatataccgggttcatttcaatgctcgtgtccatctagcggttacagactggccccaaatggtagaaattgtcaagatatagacgagtgcgtgaccggtattcataattgttcgattaatgaaacatgttttaatatccaaggtggatttcggtgcctcgccttcgagtgtccagaaaactacaggcgctccgcggctacttag

SEQ ID NO: 117101 - DNA, 2112 bp, Artificial Sequence
  Description of Artificial Sequence: Synthetic coding sequence
atggaacgtgccgcgccaagcaggcgggtcccactccccttactgctcctgggggggttagccctgctggccgcaggagtggatgcagatgtgctgctggaggcatgctgtgctgatggacatcgaatggctactcaccagaaagactgttctctaccttatgcaacagaatcaaaggagtgccggatggtccaggaacaatgctgccattcacagctcgaggagttacactgtgccactgggatcagtctcgcaaacgaacaggaccgctgtgctacccctcacggggataacgcgagcttggaggctacctttgtgaaacgatgctgtcattgctgcttgctcggcagggccgcacaagcccaagggcagagttgcgaatattctctgatggttggctatcaatgcggacaggtgtttcaagcctgttgtgtgaaaagtcaggaaactggcgacctggacgttggtggacttcaggaaacagacaagattattgaagtcgaggaggagcaggaggacccatacctcaacgaccgctgcagaggaggcggtccatgtaagcagcagtgccgcgataccggcgacgaggtcgtgtgtagctgcttcgtaggttatcagctgttaagtgacggagtgtcctgcgaggatgtcaacgaatgtatcaccggcagccactcttgtcggctcggcgaatcatgtatcaataccgtgggatccttccggtgccaacgggactcatcatgtggtactgggtatgagcttacagaagataattcatgcaaggacatagacgaatgcgagagcgggatccacaattgtttacccgatttcatctgccagaacacactgggctcgttccggtgccgccccaaacttcagtgcaagtccgggtttattcaggatgctctgggtaactgcatagatatcaatgaatgtctatcaatttctgcaccatgccctataggtcacacgtgtattaacaccgaaggatcttatacatgtcagaagaatgtacctaattgcggtcgcggctaccatctcaatgaagagggaacgcggtgtgtcgacgttgatgaatgcgcacctcccgcggaaccctgcggcaagggccaccggtgcgtgaattcccccggatcattccgttgcgagtgcaagaccggatattactttgacgggatcagcagaatgtgtgtggacgttaatgaatgtcaaaggtatcctggacggctctgtggccacaagtgtgaaaatacactcggttcatacttgtgctcttgttctgttggatttagattgtccgtggacggccggagctgtgaagatatcaacgaatgctcttcctccccttgctcacaggaatgcgcaaacgtgtacggttcctaccagtgttactgcaggagaggctatcagctgagtgacgtggatggagtcacatgtgaggacattgatgagtgcgccctgcccacaggcggacatatttgctcatatcgctgtatcaacattcctggctcgtttcaatgttcatgtccatcttcaggctacaggctggcacctaacggccgcaactgccaggacatagatgagtgcgtcaccggtattcataactgttctataaatgagacatgtttcaacattcagggggggttcagatgccttgcgtttgaatgcccagagaattaccgccgctctgctgcaactcagaagagtaagaaaggtagacagaataccccagccggatccagtaaggaagactgcagagttttaccttggaagcagggcctggaggacacacacttggacgcatacctgccatgctgtcgtaggttcactcgaccggaggaaattatcttccttagagccattacccccccgcatcccgccagccaagctaatatcatatttgatatcactgagggcaatctgagggactctttcgacatcataaagcgatacatggacggcatgactgtcggcgttgtgcgacaggtcaggccaattgtgggaccgttccacgccgtcctgaaattagagatgaactatgtggtcggtggtgttgtcagtcatcggaacgtagtcaacgtgcatatcttcgtgtcggaatattggttttag

SEQ ID NO: 117102 - DNA, 2166 bp, Artificial Sequence
  Description of Artificial Sequence: Synthetic coding sequence
atggaaagggctgctcctagcaggcgcgtccctcttccccttttgctgctgggtggattggcgctcctggcagcaggagtggacgcagatgtgctcctggaggcatgctgcgccgacggccatcggatggctacacatcagaaagactgctccttgccttacgccactgagagcaaagagtgccgggctgtcggactcgcttctctctgccaggatttaaatggcgcatgggcagtctggaaggtcggtcgagcatcacaggctgagggtactgcctccgcaagagcccagcgtcggggtatggtgcaagaacagtgctgtcattcccagctggaggaactgcattgtgcaacaggaattagcttggctaatgaacaggacagatgtgcaacgccacacggtgataatgcatcacttgaggccacattcgtcaagcgttgttgccattgctgtctgttagggcgagcagcacaagcccagggacagagctgtgagtattcactcatggtaggctaccagtgtggccaggtttttcaggcctgttgcgtgaagagccaagagaccggtgatcttgatgttggggggctgcaagaaacggacaagatcatagaggtggaggaagaacaggaagacccgtatctaaatgataggtgtcgcggtggcggcccttgcaagcagcaatgccgtgataccggggatgaagttgtctgttcttgttttgtcggatatcagctcctgagtgacggagtaagttgtgaagacgtgaatgaatgtattactggaagtcattcatgtcgattgggagagagctgcatcaacactgtaggatctttccgctgccagcgagactcatcttgcggaactgggtacgagctgacagaggacaactcctgcaaagatatcgatgaatgcgagagtggtatccataattgtctccctgactttatttgtcaaaatactttgggctcattccgctgcagacccaagttgcagtgcaagagcggatttattcaagatgccctcggtaattgcatcgatatcaatgagtgtctgtcaatcagtgcaccttgtcctatagggcacacgtgtatcaataccgaggggtcctacacgtgccaaaagaatgtgcctaactgtggacgtggttatcatctgaatgaggaagggaccaggtgcgttgacgttgacgagtgcgcccctccggccgagccatgtgggaagggccacaggtgcgtcaatagtcctggctcctttaggtgtgagtgtaaaaccggctattacttcgacggcattagccgtatgtgcgttgatgtgaacgagtgtcagaggtatccgggacgtctgtgtgggcataagtgtgagaacacgctgggaagctacttatgtagctgcagcgtcggttttagactgtcagtagacggccgctcttgcgaagacatcaacgagtgtagttcatcaccttgttcacaggaatgcgctaacgtatatggctcttatcagtgctattgtcgcagagggtaccagctctcggatgtggatggtgtgacgtgcgaggatatagacgagtgcgcactgcccactgggggccatatatgcagttatagatgcatcaatatcccaggaagcttccagtgctcttgcccttcctccggatacagactcgcccccaatggaagaaactgccaagacatcgatgaatgcgttactgggatccacaactgttcaatcaacgaaacgtgtttcaacatccaaggcggttttaggtgtctggccttcgagtgtccagagaattaccggaggagtgccgcgacaagatgcgagaggcttccttgtcacgagaatcgggaatgctctaaattacctttaaggatcacatactatcacctctcgttccctacaaatattcaggcccctgccgtggtgtttcgaatggggccatcgagcgcggtcccgggggacagtatgcaactcgctatcacaggcgggaacgaggaggggttctttactaccaggaaggtatccccccatagcggcgtggtagctctgacgaagccagtgcccgagccacgggacctgcttctaacagtgaagatggatctgtcccggcacggtactgtgagctcattcgtggctaaactgtttatctttgtcagcgccgagctctag

SEQ ID NO: 117103 - DNA, 570 bp, Artificial Sequence
  Description of Artificial Sequence: Synthetic coding sequence
atgaactcttatactcgaggctcccgacgacctagcgctaaggcagcctcccctgcggcctccgtgactagccgagttagcccaagtggtcctggggtgcctgtggatgctgatgtcctccttgaagcttgctgtgcggatggacaccggatggccacccatcaaaaagactgctcgttgccatatgccaccgaatctaaagagtgtcgcatggttcaagaacagtgctgtcactcacaactggaggagctccactgcgcgacagggataagcctggctaacgaacaggatagatgtgccaccccccacggagacaatgctagtctcgaggccactttcgtgaaaaggtgctgtcactgctgtctgctcggtcgcgccgctcaggcccagggtcagagctgtgaatacagcctgatggtggggtatcagtgtggccaagtgttccaggcctgttgcgtcaagtcacaggaaacaggagacctggacgtcgggggtctccaggaaacagataaaattattgaggtggaggaggaacaggaagatccttacttaaacgaccggtgtcgctag

SEQ ID NO: 117104 - DNA, 81 bp, Artificial Sequence
  Description of Artificial Sequence: Synthetic coding sequence
atggcaacccatcagaaggattgttccctgccatacgctacagaatcaaaagagtgtcgaatggtccaagagcagtgctag

SEQ ID NO: 117105 - DNA, 1806 bp, Artificial Sequence
  Description of Artificial Sequence: Synthetic coding sequence
atggagcgggctgcgccctccagaagagtgccactcccattactgcttctgggaggattagctctgttggccgccggagtcgacgcagatgtgctgctggaggcttgttgcgctgatggacatagaatggccactcatcagaaggactgtagcctgccatacgccacagagtcaaaggagtgtagaatggttcaggagcagtgttgccatagccaactcgaggagttacactgtgctaccgggattagcctggccaatgaacaggaccgctgtgctaccccacacggtgataatgctagtcttgaggctacgttcgtcaaacgatgttgccactgctgcctgctgggtagggccgctcaggcccaagggcagtcctgcgagtatagtttaatggtcgggtaccagtgtgggcaggtcttccaggcctgttgtgtcaagtcacaggagactggcgacttagacgttggcggtcttcaggagacggataagatcattgaagtggaggaagaacaggaggacccttacctgaacgaccgctgccggggcggtggcccgtgcaaacaacaatgccgggataccggcgatgaggtcgtgtgttcatgtttcgtggggtaccagctgctgtccgacggcgtgagctgtgaagatgtcaatgagtgtatcactggtagtcactcttgccgactgggtgagagttgcattaatacggtgggtagttttcgttgtcagagagattcgtcctgcggcacggggtacgaactgaccgaagacaactcatgtaaggacattgacgaatgtgagtccggtatccacaactgtctgcctgactttatttgccagaataccctggggagtttcaggtgccgacctaagttgcagtgcaaatccggcttcatccaggatgcactcggtaattgcatcgatatcaatgagtgtctaagcatatcagcaccctgccccattggccatacctgtattaatacggaaggctcttatacctgtcagaagaacgtgccgaactgcggaagagggtatcatctgaacgaggagggcactcggtgcgtcgatgtggatgaatgtgctccgcctgccgaaccatgtggaaagggacacaggtgcgtaaacagccccggtagttttaggtgcgagtgcaaaacggggtactatttcgatgggatctcccgtatgtgtgttgatgtgaatgagtgtcaacggtacccaggccggttgtgtggccacaagtgcgagaatactctagggagctacctctgtagctgttctgtggggtttaggctgtccgtcgacgggcgaagctgtgaagacataaacgagtgttccagctcaccttgtagtcaggagtgtgcaaacgtttatggctcttaccaatgctactgtcgacggggctatcaattaagcgatgtagatggcgtgacctgcgaagatattgacgaatgtgcactacccaccgggggccatatttgtagctatcgttgcataaacattcccgggagctttcagtgttcatgtccaagcagtgggtatagattggctcctaacggcagaaattgtcaggatatcgacgagtgtgtgaccggtattcataactgttcaattaatgagacttgttttaacatccagggagggttcaggtgtttggcatttgaatgtccagaaaactacagacgttcggcagcaacacaaaagtctaagaagggtagacagaacacaccagccggctccagcaaggaggattgtcgtgttctgccttggaagcagggccttgaagatacccatttagacgcgtag

SEQ ID NO: 117106 - DNA, 198 bp, Artificial Sequence
  Description of Artificial Sequence: Synthetic coding sequence
atggccactcaccagaaggactgttcactaccttacgcaaccgagtctaaagagtgccgcatggttcaagaacagtgctgtcacagtcaacttgaggagctgcattgcgcgaccggcataagcctagctaacgagcaggatcgttgcgctactccacacggcgataacgcttctttggaggctacgtttgtcaaatag

SEQ ID NO: 117107 - DNA, 546 bp, Artificial Sequence
  Description of Artificial Sequence: Synthetic coding sequence
tgtaggatggtccaggaacagtgttgtcattcacaacttgaggagctgcactgcgctactgggatctcgctggcgaacgagcaggatcggtgtgctacaccacacggcgataatgcgtccctggaagcgaccttcgtgaagcgttgttgccactgctgcttacttggacgtgccgctcaggctcaaggacagtcctgtgaatactcactcatggtgggatatcagtgtgggcaagtgttccaggcctgctgcgtcaaatcacaagaaactggcgatcttgatgtgggcggccttcaggagacaggcggcggtccctgcaagcagcaatgtcgcgatacaggagatgaagtcgtgtgttcatgttttgttggataccaactgctgtccgacggtgtatcatgcgaagatgtcaacgaatgcatcaccggcagtcactcatgtcgcctgggcgaatcttgtattaatacagtgggttcctttaggtgccagagggattcctcatgtggcaccggctacgagctgacagaagataacagttgcaagtag

SEQ ID NO: 117108 - DNA, 420 bp, Artificial Sequence
  Description of Artificial Sequence: Synthetic coding sequence
atggctacacaccagaaagattgcagcctcccatatgcaacggagtccaaagaatgccgaatggtccaggaacagtgctgccacagccagttggaggagttgcattgtgcgacaggtattagcctggcaaatgagcaggaccggtgcgccacccctcacggggacaatgcatcacttgaggccaccttcgtgaagagatgttgccactgctgcctcctgggcagggcagcacaggctcagggacagtcttgtgagtattctctaatggtcggctaccagtgcggtcaggtgttccaggcatgttgcgtaaagagccaggagacgggcgatctcgatgtgggaggcttgcaggagaccgataagataatcgaagttgaagaggaacaggaggacccatatctcaacgatcgctgtcggtag

SEQ ID NO: 117109 - DNA, 519 bp, Artificial Sequence
  Description of Artificial Sequence: Synthetic coding sequence
atggaaagggccgccccctcccgccgcgtgcctctaccgctgctgctgttaggcggcctcgcccttctggctgccggagtagatgctgatgtactgctggaagcctgctgcgcagatggacatcgtatggcaacccaccagaaggattgtagcctgccttatgccactgaaagtaaggagtgccgtatggtgcaggagcaatgctgccattcacagctggaggagctccattgcgccacaggaatatccctggccaacgaacaggacaggtgtgccactccacacggtgacaacgcctcgctcgaggctacgtttgtgaagagatgctgtcattgttgcctgctcggccgcgcagcccaagcacaggggcagtcatgcgagtactcactgatggtgggctaccaatgcgggcaggtgttccaggcttgctgtgtgaagtcccaggaaacaggtgacctcgacgttggagggctacaggagacagggggtggaccctgcaaacaacaatgccgagactag

SEQ ID NO: 117110 - DNA, 3555 bp, Artificial Sequence
  Description of Artificial Sequence: Synthetic coding sequence
atggtcctgttgtgggagcccgctggtgcctggttggccttaggactggcactggcactgggcccttcagtggccgctgctgcaccacgccaggattgtaccggggttgagtgtccccctttggagaactgcatagaagaggccctggagcctggggcctgttgcgccacatgcgtccagcagggctgcgcttgcgaaggctaccagtattatgactgcctccagggcggcttcgttcgcgggcgtgtgcctgctgggcagtcttattttgtcgacttcggtagcacggagtgttcttgccctccagggggaggcaagatttcatgtcagtttatgttgtgccctgaactaccacctaactgtattgaggccgtggtggtggccgactcatgtccccagtgtggccaggtcggctgtgtgcacgccggccacaaatacgctgccggccatacggttcatttgccaccatgccgcgcgtgtcactgtcctgacgccgggggggaactgatatgctaccagcttccaggctgccacggtaactttagcgatgcggaggaaggtgatcctgagcggcactatgaggatccctattcctatgaccaagaagtagctgaggttgaggcagcaaccgccctcggaggagaagtgcaggcaggcgccgtgcaagccggggccggcgggcccccggccgctttggggggcggatctcaacccctgtcaacaatccaggctcccccttggcctgctgtactgcctcggcccacggccgctgcagctctggggcctcctgctccggtgcaggcaaaagctcgacgcgtgacagaggatagcgaggaggaagaggaggaggaggaagaaagagaggaaatggccgtaacagaacagttagccgccggaggccacaggggcctggatggtctccccactaccgctcccgctggcccgtctctgcccatccaagaagagagagcagaggccggcgctagagccgaggccggtgccagacccgaagagaaccttattctggacgcccaagctaccagccgctcgacagggcccgaaggagtaacccacgcaccctctctggggaaggctgccctcgtcccgacccaggccgtccccggctctccacgggatcccgtgaaaccatcacctcacaatatactgtccactagcttgcccgatgcagcctggattcctcccacacgagaggtaccacgaaaacctcaggtcttgcctcatagccacgtagaggaggatactgaccccaattctgtccactctatcccaaggtctagtcctgaaggaagtacgaaagacctcattgaaacttgttgcgctgccggccagcagtgggcaattgacaacgacgaatgcctggagataccggaatccggcactgaagacaatgtatgccgcaccgctcaacgacactgttgcgtgtcttatctgcaagaaaagagctgtatggcgggtgtgctgggagctaaggaaggcgagacttgtggcgcagaagacaacgatagctgcggcataagcctgtataagcagtgctgcgactgctgtgggctaggactgcgcgtgagggccgaaggacagtcctgtgaatctaatcctaatctcgggtatccctgcaatcatgtcatgttaagctgctgtgaaggagaggagccactcattgttcctgaggtgaggcggcctcccgagcctgcggctgcacctcggagagtgtctgaagcagaaatggccgggcgggaagccctttcccttggcacagaggcagagttacccaactccttgccaggcgacgaccaggacgaatgcctgctcctgccaggcgagctctgtcaacatctgtgcattaataccgtgggcagctaccactgcgcttgtttccccgggttctccctgcaggacgacggtaggacatgtcggcccgagggacaccccccgcagcctgaggctccacaagagccagctctcaaaagtgaattttctcaagtggcttctaatacaattccccttccattaccgcagccaaacacttgcaaggacaacggcccatgcaaacaggtgtgtagcacagttggtggatccgccatttgtagctgcttcccgggctacgctattatggccgacggggtaagctgtgaagacattaacgagtgcgtcaccgacctccacacctgcagcaggggtgagcactgcgtgaatactctcggctcatttcactgttataaagcactgacctgtgagcccggctacgccctcaaggatggggaatgtgaagacgtcgacgagtgcgcaatgggaacacacacttgccagccaggcttcctgtgtcaaaacacaaaagggtctttttactgccaggcccggcagcgctgcatggatggttttctccaagaccctgaaggtaactgcgtggatattaatgagtgcacgtccctcagtgaaccttgccgacccggcttctcatgcatcaatacagttggctcctacacatgccagcgaaaccccctcatatgcgcccgtggatatcacgcctccgacgatgggaccaaatgcgtcgacgtgaacgagtgcgagaccggcgtgcaccggtgcggtgagggacaggtctgtcataacttgcccggctcttatcgctgcgactgcaaagcggggttccaacgcgatgcttttgggagggggtgtatcgatgtgaatgagtgctgggcctctcctggtcgactgtgtcagcacacatgtgagaacaccctcgggtcttacaggtgtagctgcgcaagcggcttcctgttggccgctgacggaaagaggtgcgaagacgtcaatgagtgcgaggcccagcgatgttcccaggaatgcgccaatatctacggctcttaccagtgttattgtagacagggatatcagctggcagaggacggccacacttgcacagacatcgacgaatgcgcacagggcgctgggatactgtgcacgtttcggtgcctgaacgtaccagggtcataccagtgtgcttgccccgaacaaggttacacgatgaccgcgaatgggaggtcatgcaaagatgtggatgaatgtgccctcggtacccacaactgctctgaagccgagacctgtcacaatatacagggctcttttagatgcctacggtttgagtgcccacccaactacgtccaggtctccaagaccaaatgcgaaagaacaacctgtcacgatttccttgagtgccaaaactcacctgcacggataactcattatcagctgaacttccagacaggcctcctcgtcccagcccatatctttcgaataggccccgctccagcgtttaccggcgatacgatcgcattgaatattattaagggaaacgaggaggggtatttcgggacaagacggctcaatgcatacacaggcgtagtgtacttacagagagcggtcctggagcccagggatttcgcactcgatgtcgaaatgaaactctggcgccaagggtccgtgacaacctttcttgctaagatgcacattttctttacaacatttgccctgtag

SEQ ID NO: 117111 - DNA, 3696 bp, Artificial Sequence
  Description of Artificial Sequence: Synthetic coding sequence
atggtgctgttgtgggagcccgcgggcgcctggctcgctctgggtctcgccttagcccttggacctagtgtcgccgccgcagcgccccggcaagactgtacgggtgtcgaatgtccacccttagaaaattgcattgaggaggcgctcgagccgggggcttgttgtgccacctgcgttcagcagggatgcgcgtgcgaaggatatcagtattacgattgcctgcaaggaggcttcgtccgtggaagagtgccggcaggccagtcatactttgtggacttcgggtcaactgagtgtagttgtccccccgggggcggaaagatctcgtgtcaattcatgctgtgcccagaactcccccccaactgtattgaagccgtggtggtcgctgacagctgtccccagtgcggccaagtggggtgtgtgcacgcaggccacaagtacgccgcaggccacactgtccatctgcccccgtgtcgggcgtgtcactgtccggacgccggcggcgagctgatttgctatcagctgccgggctgccatgggaatttttccgacgctgaggaaggcgaccctgagagacattacgaggacccatatagttacgaccaggaggttgccgaagtggaagcagcaaccgctctcggcggtgaagtccaagcgggggctgttcaggcaggggcgggaggaccgccagccgccctcgggggtggcagccagccattgtccacaatccaggcacctccatggccggccgtactgccccggccaaccgcagccgccgctttgggcccacccgcgcctgtccaagctaaggcccgcagggtcaccgaagatagcgaggaagaagaagaagaggaagaggagcgggaagagatggcagtgaccgaacagcttgctgccggtgggcatcgtggcctggatggtctgccaacaaccgctccggctgggccatctctgcccattcaggaggagcgcgctgaagccggcgctcgtgccgaagccggggcacgtccagaggagaacctcatactcgatgcacaagctaccagccgatctacgggcccagagggcgtaacgcacgccccatccctcgggaaggcagctttggtgcccacgcaggccgtgcccggaagtcccagagatccagtgaagccatccccacataatatcctgagcaccagcttacccgatgcagcgtggatcccacccacacgcgaggtgcctaggaagccccaggtcctgcctcactctcacgtggaagaggatactgacccgaatagtgtccacagtattcccaggagttctcccgaggggtctactaaggacttgattgaaacctgctgcgccgcggggcaacagtgggcgatcgacaacgacgagtgcttagagatacctgagtcaggcaccgaggataacgtgtgcagaaccgcacaacggcactgctgcgtctcgtacctccaggaaaagtcttgcatggcaggagttcttggagctaaagagggagaaacctgtggggctgaagacaacgattcctgtgggatctccctgtacaaacagtgttgcgattgttgtgggctagggctgcgagtgcgggccgaaggccagtcatgtgagagcaaccccaacctcgggtacccatgcaatcatgtgatgctgtcctgttgcgaaggcgaagagcctctaatcgtgccggaggtgcgacgcccccctgagccagcagccgccccaaggagggtgtcagaggctgagatggctggccgcgaggcactttctctcggaaccgaagccgagctgccaaattccctgcccggtgacgaccaggatgaatgcttattactcccaggcgaattgtgtcagcacttgtgcatcaacaccgtgggcagttaccattgcgcatgttttcctgggtttagcctgcaagacgacgggcgcacatgcagacctgaaggccaccccccccaaccagaggccccccaagagcctgccctcaagtccgaattctcacaggtggcctccaatacaatccccttgcccctcccgcagccgaacacctgtaaagacaacggcccttgcaagcaagtatgctcaactgtaggtggctcagcaatctgtagctgctttcctgggtacgctattatggcagacggcgtctcttgcgaagaccaggatgaatgtctaatgggggcccacgattgtagtcgacggcagttctgtgtaaataccctgggctctttctactgcgtcaaccacaccgtgctgtgtgcggatggttacattctgaatgctcatagaaagtgcgtagatatcaatgagtgtgtgactgacctccacacatgctccagaggggaacactgtgttaacacgctcggatcattccactgctacaaggccctgacttgtgagcctggatacgctttaaaggacggtgaatgtgaggatgtcgacgaatgtgcgatggggacccacacatgtcagcccggcttcctatgtcagaacacgaaaggcagcttttactgtcaggctcgtcagcgttgcatggatgggtttctccaagaccccgaagggaactgtgtagacatcaacgagtgcacaagcctcagcgagccttgcaggcctgggttctcctgcattaataccgtgggatcctatacctgtcaacgcaacccactgatctgtgcccggggctaccacgcctctgatgatggcaccaagtgtgtcgacgtgaacgagtgcgagaccggtgtgcatagatgcggcgagggccaggtgtgtcacaacctgccaggatcctatagatgtgattgcaaggctggctttcaaagagatgcctttggtagaggctgcatcgatgtgaacgaatgctgggcctctccgggacggctttgtcagcacacctgtgagaacactctgggttcctatcgttgctcatgcgcatccgggttcctgctggctgccgatgggaagcggtgtgaagatgtcaacgagtgtgaagcacagcgctgtagccaggaatgtgcaaatatctacggcagctaccagtgctactgtcgacaggggtaccaattggcagaagatggccatacatgcacggacatcgacgagtgcgctcagggagctggcatcctgtgcaccttcagatgcctcaatgtccctgggtcttaccagtgtgcttgtcccgaacagggctacacaatgactgctaacgggagatcctgcaaggacgtggacgagtgtgccctcggaactcacaactgcagtgaggcagagacctgtcacaatattcaggggtccttcaggtgtctgaggttcgaatgccctccaaattatgtccaggttagtaagacaaaatgtgaacggactacctgccatgactttctcgaatgccaaaacagccccgcccggataacgcactatcagctgaattttcagacaggcttgttagttcctgcccacatattccggattggcccagcacccgcattcactggggatacaattgccttaaacatcataaagggcaatgaagagggttactttgggactagacgcctgaatgcctacacgggagtcgtgtacttacagcgcgcagtgctggagccgcgggacttcgcactggacgtcgaaatgaaactctggcggcagggctctgtaaccactttcttagcgaagatgcacatcttttttactaccttcgcgttatag

SEQ ID NO: 117112 - DNA, 480 bp, Artificial Sequence
  Description of Artificial Sequence: Synthetic coding sequence
atggtcttactgtgggaacccgccggagcctggttagcgctcggactcgctctagcactcggccccagtgttgctgccgctgcgccccggcaggactgtaccggcgttgagtgtccaccactggagaattgcattgaggaggcattagaaccaggcgcctgctgtgccacatgtgtgcagcagggatgtgcgtgtgagggttatcaatattacgactgtctgcagggtggctttgtgcggggccgggtgccggctggccagagctacttcgttgacttcggaagtacggaatgttcctgccctccaggaggggggaaaataagctgccagttcatgctgtgccccgaactgccacccaactgtatcgaagcagtcgttgttgccgattcatgtccccagtgtggtcaggttgggtgcgtccacgccggacacaagtacgccgcaggacacacagtgcatcttccaccctgtagggcctag

SEQ ID NO: 117113 - DNA, 3696 bp, Artificial Sequence
  Description of Artificial Sequence: Synthetic coding sequence
atggttctcctttgggaacctgctggcgcttggctggctttgggcctcgcattggcactggggccttccgtggccgcggcagctcccaggcaagactgtacaggcgtggaatgtcctccactggaaaactgcattgaagaagctctcgagcctggagcttgctgtgcaacctgtgtgcaacaggggtgcgcgtgcgagggctaccaatattatgattgtctccagggtggttttgtccggggtcgagtgccagcaggtcagagttatttcgtggattttggcagcactgaatgttcatgccctcccggcgggggtaagatatcctgtcagttcatgctttgcccagagttacctcccaattgtattgaagctgtggtggtcgcagacagctgtcctcagtgtgggcaggtcggctgcgtgcatgccggccacaaatacgctgcaggccatactgtacacctgcctccatgtagggcctgtcactgccccgacgccgggggagaattgatctgctatcaactaccgggctgccacggcaatttctcggatgcagaagagggagatcctgagcgacactatgaggacccctacagctacgatcaggaagtggcggaagtggaagccgcgactgcgctcggaggcgaggtgcaggccggcgccgtgcaagctggggccggaggtccacccgctgcgctcggaggtggttcacaaccactctcgacaatacaggcacctccctggcccgccgtgcttcccaggcctactgccgctgcagctctgggaccaccagccccagtgcaagcgaaagctcggcgcgttaccgaggactcggaggaggaagaggaagaggaagaagaaagagaagagatggccgttacagagcagttggccgctgggggccatagagggttggacgggctccctacaaccgcgcctgccggtccctctctgcctattcaggaggagcgagcggaggctggagcaagagcagaggctggcgcgcggcctgaagagaatcttattctggacgctcaggccacaagcagatcaactggacccgaaggagtgacacacgccccctcactaggaaaggccgccctggtgcccacccaggccgtgcccgggtcgcctcgggaccccgtgaagcctagtccccacaacattctttccacctcgctccccgacgccgcatggatccctcccactcgagaggtccctcggaaacctcaagtgctgccccattcccatgttgaagaggataccgaccccaactcggtacatagcattcctcgaagcagccctgagggaagtaccaaggaccttatcgagacctgctgcgccgctggccaacaatgggctatcgacaatgacgagtgcctcgagatacctgagtctggcaccgaggataatgtttgtcgcaccgcccaacgccattgctgcgtgagctatctacaagaaaaaagttgcatggccggagttctgggagcgaaggagggcgaaacttgtggagcggaggacaacgactcttgcggcatcagcctgtacaagcaatgctgtgattgttgtggtttgggtctgcgcgtgcgtgctgagggtcaaagctgcgagtcaaaccctaatcttggatatccctgcaaccatgtgatgctcagctgttgtgaaggcgaagaaccgctgatcgttcccgaggtgcgacgaccccccgagcccgccgcggccccaagacgcgtgagcgaggccgagatggctgggcgcgaggcgctgtccttaggcactgaggccgaactgccaaattccctccccggggatgaccaagacgaatgcttgcttctccccggggaactttgtcagcatctgtgcatcaataccgtcgggtcatatcattgcgcatgcttcccaggcttcagcctgcaggacgatggaagaacctgccgccctgaaggacatcccccgcagcccgaggcaccgcaggagcctgctctcaagtctgagtttagccaggttgcaagcaacaccataccattacctctgccacagcccaacacatgcaaggataatggaccatgtaagcaggtgtgtagcactgtaggcgggtccgcaatctgttcatgctttcccggatatgcgatcatggctgatggagtgtcctgcgaagaccaggatgagtgcctgatgggagctcacgattgttcacggcggcagttttgtgtgaatacactgggatccttctactgtgtcaaccacaccgtcctctgcgcagacggatatattctcaacgcccatcggaagtgtgtggatattaacgaatgtgtgacagaccttcatacctgtagtaggggagaacactgtgtgaacacccttggttctttccactgttacaaagctttgacctgtgagccaggctacgcactgaaagatggcgagtgcgaggatgtcgacgagtgcgctatgggcactcacacgtgtcagccgggattcctgtgtcaaaacactaagggttctttttactgccaagcgagacagaggtgtatggatggcttcctccaggatcctgaagggaattgtgtggacatcaacgaatgcacctcactttctgagccctgtcggcccggcttttcttgtattaacactgtagggagttatacctgtcagagaaaccccctgatatgtgccagaggataccacgccagtgatgacgggacaaagtgcgtggatgtcaacgagtgtgagactggcgtacacagatgtggagaaggtcaagtatgtcataatctgcctggttcttatcggtgtgattgtaaggctggatttcagcgggatgcctttggaagaggttgcatcgatgtgaacgagtgctgggccagccctggaaggctctgtcagcatacctgtgagaatacattagggtcctacagatgcagctgtgcttccggcttcctcctggcggctgacggcaagcgctgtgaagatgtcaatgagtgtgaagcacagaggtgctcacaggagtgcgcgaacatttatggcagttatcagtgctactgccgccaaggataccaattggcagaggacggacatacctgcacagatatcgacgaatgtgcccagggagctggaattttatgtacctttcggtgtcttaatgttccagggtcatatcagtgtgcctgcccagagcaggggtataccatgacggccaacggccgtagctgtaaggacgtcgacgaatgtgccctgggcactcacaattgctcagaagctgaaacatgccacaacatccagggcagttttcgttgtcttcggttcgagtgccccccaaattatgtgcaggtcagtaagactaagtgtgagcggaccacatgtcatgactttctggagtgtcagaattctccggctcgcatcacacactatcaactaaacttccagaccgggttactggtgcctgcccatatcttcagaattggaccagctccggcattcaccggcgatacaatcgcactgaacattattaaaggcaatgaggaaggctatttcgggacccgacgactgaacgcttacactggagtggtgtatttgcaaagggccgtgctggagccaagagacttcgccctcgacgttgaaatgaagctctggcggcagggaagtgtgaccacattcctagccaagatgcatattttcttcaccacatttgccctttag

SEQ ID NO: 117114 - DNA, 3633 bp, Artificial Sequence
  Description of Artificial Sequence: Synthetic coding sequence
atggaaacctcactttcactcgagtcaggccaccatggtagctaccggcggggtgaccggccaggccttgcatggactatggtgttgctctgggagcccgcaggtgcttggttagccctgggactcgccctcgccttagggccttcagttgcagccgccgctcctaggcaagattgtactggcgtggagtgtccaccactggagaactgcatagaggaggctctggaaccgggtgcctgttgtgccacctgtgtccagcaaggatgtgcctgcgaagggtatcaatactacgattgtttacagggcggctttgtccgtggtcgtgtaccagctggtcagtcctactttgtcgatttcgggtctaccgagtgtagctgccctccgggcggtgggaagatttcttgtcagttcatgctgtgtccagagctgcccccgaactgtatagaagcagtcgtagtggcagattcatgtcctcaatgtggacaggtgggatgcgtgcatgcaggccataagtacgctgccgggcacacagtgcacttgcccccatgccgcgcatgccactgcccggacgcaggcggtgaactgatatgttatcaactgcccggctgtcacggcaacttctctgacgccgaagagggtgatcccgagcgacattacgaggacccatattcctacgaccaggaagtagctgaagtcgaggcagcaactgccctgggcggagaagtacaggcaggagccgtgcaggctggggctggcggtccaccagctgccctcgggggaggttcccagcctttgtccaccatccaggcccctccatggccagccgttctgcccaggcccactgccgcggctgccctgggccctcccgcccccgtgcaggcgaaggccaggagggtcacagaggacagcgaagaggaggaggaggaggaggaagagcgcgaagaaatggccgtcactgaacagctcgccgccggcggacacagagggctggatgggctacctacaacggcacctgctggaccatcccttcctattcaggaggaaagagcggaggcaggcgcccgcgcagaggcaggcgcacgccccgaagaaaacttaatactggacgcacaggcgaccagtagatctaccggaccagagggagtgacacacgccccaagcctcggaaaagcagccttagtgccaacacaggcagtgcctgggtcgcccagagaccctgttaagcccagtcctcacaatatcctgtctacatctctgcctgacgctgcttggatacctcctacccgggaagtgcccaggaagcctcaggtgctgccccactctcacgtggaggaggacactgacccgaacagcgtccacagtattccaagaagttctccggaaggcagcacaaaggatctgatagagacttgctgcgctgcgggacagcagtgggcaattgataacgatgagtgcctcgaaatcccagaatcgggcaccgaagataacgtctgtcgcacagctcagaggcattgctgcgtttcttacctgcaggagaagtcctgcatggctggtgttcttggggccaaggagggagagacatgcggagccgaggacaacgatagctgcggcatcagtctgtataagcagtgttgtgattgctgcgggctgggcctgagagtgagggctgagggacaaagctgcgaatccaaccctaacttaggttatccttgcaaccatgtgatgttgagctgttgcgagggggaagagccattgattgtgccagaggtcagacggccccccgaacctgccgccgcccccaggcgagtgtccgaggccgagatggcagggagagaggcactgagcctggggactgaagcagagttacctaattccctccctggggatgatcaagatgagtgtctgcttttgccaggcgagctgtgccagcacctttgtatcaatactgtcggctcctaccactgcgcttgcttcccgggtttctctttacaggatgatgggcgtacatgtcgacctgaaggacaccccccacaaccggaagcgcctcaggaaccagcactgaagtctgaattctcccaggtagctagcaataccattccccttccactcccacagcctaacacctgtaaagacaacggcccttgcaagcaagtgtgctctaccgtgggcgggagcgcaatctgttcttgttttcccggttacgccattatggcagacggggtgagttgcgaggacataaacgaatgcgtgacggaccttcatacatgtagccggggcgagcattgtgtgaatactcttggttcttttcactgctataaggctctgacatgcgaaccaggctatgctttgaaagatggagaatgcgaagacgtggatgagtgcgctatggggacccacacttgtcagccaggctttctatgccagaatactaagggctcattttattgtcaggcccggcagagatgtatggacgggtttttgcaagatcctgaagggaactgtgtcgacatcaacgaatgtacaagtctgtccgagccttgtaggccgggtttcagctgcatcaataccgttggcagctatacatgtcaaagaaatcctcttatttgcgcacggggataccacgcttcagatgacgggacaaaatgcgtagacgttaacgagtgcgagaccggtgtgcaccgatgcggggaaggccaggtctgtcataacctgcccggttcttaccgctgcgattgcaaggctggatttcagcgggatgcatttggcagaggatgcatcgatgtgaatgagtgctgggccagccccggcagattatgtcagcatacctgcgaaaacacccttgggtcttatcgatgctcatgtgcttctgggtttctgttagccgccgatggaaagcgctgtgaggatgtgaatgagtgcgaggctcagcgctgctcacaggagtgcgccaacatttatggcagttaccaatgctattgccgccagggttatcaactagccgaagacggccacacttgcaccgacatcgacgaatgtgctcagggcgctggcatcctctgtacttttcgctgtctcaacgtcccaggcagctaccagtgtgcctgccccgagcaaggctatacaatgacagctaacgggagatcttgcaaagatgtagacgaatgtgctctagggacccacaactgctctgaagccgagacatgtcataacatccaaggctcattcaggtgcctgaggttcgaatgtcctcctaattacgtgcaggtgagcaagacaaagtgtgagcggactacttgccatgatttcctcgagtgccagaattcgcccgcacgcattactcactaccagttgaactttcagactggcctgttggtgccagctcatatctttcgaatcgggcccgcacccgctttcaccggtgatacaattgcacttaacattataaaaggtaacgaggaagggtacttcgggactcgccgactgaatgcttatacaggtgttgtatacctacaaagagcagttctggaaccgcgcgactttgccctcgacgtggagatgaaactgtggaggcaaggctcggtcacaactttcctggctaaaatgcacatcttcttcaccaccttcgccctgtag

SEQ ID NO: 117115 - DNA, 1347 bp, Artificial Sequence
  Description of Artificial Sequence: Synthetic coding sequence
atgccaggaataaaacggatattgacagtgactatcctagcactgtgtctgccttcccctggcaatgcgcaggctcagtgtaccaatggattcgatcttgatcggcagtctggacagtgcttggacatcgatgagtgtcggaccatcccagaggcttgtcggggcgacatgatgtgtgtgaaccagaacggaggttatttatgcattccaagaaccaatccggtgtaccgggggccgtactctaacccctattctacaccttactccggtccttaccccgcggcggctccgccactgtccgctcccaactacccaactatctcccgcccactcatatgtcggtttggataccagatggacgaatcgaatcagtgtgtggacgtcgacgaatgcgccacggatagtcaccagtgcaacccgacccaaatatgcattaataccgaaggaggatacacctgctcttgcaccgatgggtactggttgcttgaaggacagtgtttggacatcgacgagtgtagatacggatattgccagcagctttgcgctaacgtacccggctcttactcctgtacctgtaacccggggtttacactgaatgaggatggtcgtagttgtcaggacgtgaacgaatgtgctacagagaatccgtgcgtgcagacatgtgtgaacacttacggcagtttcatatgcagatgtgaccctggatatgaactggaagaggatggcgtacattgttcagacatggacgagtgcagcttcagcgaattcctgtgccagcacgagtgcgttaatcagcctgggacgtacttctgtagctgtcctcccggatatattctgttggacgataaccgatcatgccaggacattaatgaatgtgagcatcgaaatcatacttgcaaccttcagcaaacctgctataacctgcagggtggcttcaaatgtatcgatccgatacggtgcgaagaaccctacttacgaatttccgataatagatgcatgtgccccgccgaaaacccaggatgccgggaccaaccattcacaatactgtaccgggatatggatgtggtgtccggccgttcagtccccgccgatattttccagatgcaggccactactaggtaccctggtgcctactatatttttcagattaagagtgggaatgaaggccgggaattctatatgcgccagaccggcccaatcagcgccactcttgtcatgactagacctatcaaaggtccgcgggagatccaactggacctggagatgatcacggtcaataccgtcattaacttccgcggtagttcagtgattaggctgcgaatctatgtgtcacagtaccctttttag

SEQ ID NO: 117116 - DNA, 276 bp, Artificial Sequence
  Description of Artificial Sequence: Synthetic coding sequence
atgcctgggattaagcgcattctgaccgtcacgatcctggccctctgtttgccttccccaggaaacgctcaggctcaatgcaccaacggctttgatctggataggcagagcggacagtgtttggacatcgacgagtgtcgcactatccccgaagcatgccgtggcgacatgatgtgcgtgaaccagaatggcgggtacctgtgtatcccccgaaccaaccccgtatatcgtggaccgtactccaatccctattcaactccttactccgggccttag

SEQ ID NO: 117117 - DNA, 1320 bp, Artificial Sequence
  Description of Artificial Sequence: Synthetic coding sequence
atggttcccagctcaccccgagcgctctttctactcctcttgatcctggcctgcccagaacctcgcgccagtcagaattgcctcagcaaacagcagctgttaagcgcaatcagacagctgcaacagctcctgaagggtcaggaaactagatttgctgaaggcatacgtcatatgaaatccagactcgccgccctacaaaacagtgtcggccgggtgggacccgatgcactgccagtctcctgtcccgccctgaatacacccgctgacggccgtaaatttggttctaaatatcttgtggaccatgaagtccatttcacctgcaaccctgggttccgcttagtggggccatcctccgtggtgtgtctgcccaatggcacatggacaggtgaacagccccattgccgcgggatttccgaatgcagctcgcagccatgccaaaacggcggaacgtgcgttgagggagtgaaccaatatcgatgcatctgccctcccggtagaacaggaaacagatgtcagcaccaggcccaaactgcggcccctgagggcagtgtggcaggagattcagctttcagtagggccccacggtgcgcgcaggtggaaagagcccagcactgcagctgcgaagcaggattccacctttcgggggccgcgggcgatagcgtttgccaagatgtgaacgagtgcgagctgtacgggcaggagggtcgaccacggctttgcatgcacgcttgcgtcaatacgcctggatcatacagatgcacgtgccccggcggctaccgaactctcgcagacggaaagagctgtgaggacgtggatgagtgcgtgggattgcagcctgtctgcccccagggaactacttgcattaacacgggtggaagcttccagtgcgtgagccctgagtgccctgaggggagcggaaacgtgtcttacgtgaaaacgagcccgtttcagtgcgaacgcaacccctgccccatggacagcagaccctgtcgccacctgcctaagactatttcatttcactacctctctctgccaagcaacctcaagactcccattacactgttccgcatggcaacagcctccgcgccaggacgtgccggacccaacagtctgagattcgggattgtcggcggtaacagcaggggccacttcgtcatgcagcggagtgaccgacagacgggggacctcatactggtgcagaacctggaaggcccccagacactcgaggtggatgtcgacatgagtgagtatttggatagatcttttcaggccaaccatgtctctaaagtgaccatctttgtgtctccttacgatttttag

SEQ ID NO: 117118 - DNA, 1182 bp, Artificial Sequence
  Description of Artificial Sequence: Synthetic coding sequence
atggtgcccagctcccctagggctctctttctactcctgctcattctcgcttgtcctgagcctagggcgtcccaaaactgtctgtcaaagcagcagttactcagcgccatccggcagctgcagcaactcctcaaagggcaggaaacaagatttgcggaaggtattcggcacatgaagtccagactagcagcactccagaattcagtcggccgagtaggaccagatgctctgccggtgagctgtccagctctgaatacacccgcagacggccgaaagttcggcagtaagtatctagtggatcacgaagttcacttcacgtgcaacccgggcttccgcttagtgggtccatcgtccgtggtgtgtctaccaaatggtacctggactggtgagcagccacactgtagaggcattagtgaatgttcatctcagccttgtcagaatgggggcacttgcgtcgagggggtcaaccaatatcgctgtatttgtcccccagggcgaacaggcaacaggtgtcagcaccaggcccagaccgatgtcaatgaatgtgagctttacggacaggagggccggccacggctgtgcatgcatgcctgcgtgaatacccctgggtcctaccgctgcacctgtcccgggggctaccgtacattggcggacggcaagagctgcgaagacgtcgacgagtgtgtgggtctgcaacctgtctgtccccagggaacaacatgcataaatacgggaggcagcttccaatgtgtgtcacctgaatgccccgagggctccggtaatgtgagctatgtgaaaaccagcccatttcagtgcgagcgaaacccttgtcctatggacagtcggccttgcagacacctgcccaagaccatttccttccattatttgtctctgcccagcaatctgaagactcccatcaccctgtttaggatggccacagcgtccgcccctggcagagcaggacccaatagcctcaggtttgggattgtgggtggcaattctagagggcacttcgtgatgcagcgctccgaccgtcagacaggcgatctcattctggttcagaatctcgaggggcctcagacactggaagttgacgtagatatgagtgagtatctggatcgatctttccaggccaatcacgtgtccaaagtgaccatctttgtatcaccctacgatttctag

SEQ ID NO: 117119 - DNA, 942 bp, Artificial Sequence
  Description of Artificial Sequence: Synthetic coding sequence
atggaactggacagggcggtcggggtcctaggtgccgcaacactgttactgtcctttctgggcatggcatgggcactgcaggcagccgatacctgtccagaggtcaagatggtagggctggaaggctccgataagttgaccatcctgcggggttgtcctggcctcccaggggctccaggacccaagggggaggccggaacaaatgggaagaggggagaacgcggcccaccaggtcctccgggtaaagcaggccccccaggtcccaacggtgctccaggtgaacctcagccatgtctaaccgggcctcgcacttgtaaagacctcctggataggggtcacttcctcagtggttggcatacgatttaccttccagattgtagacctctgactgtattgtgtgacatggatactgatgggggaggctggacagtttttcagagaagggtcgatggaagtgtggacttttatagggactgggcgacctacaagcaggggttcggctctagactgggcgaattttggctaggaaatgataatattcacgcgctgaccgctcaaggtacttctgagctgcgggtggatttagtggatttcgaagacaattatcagtttgcaaagtatcggtcctttaaggttgccgacgaggcagagaaatacaacctggtccttggcgctttcgtagaagggtcagccggcgactctctcacttttcacaacaatcaatcattcagcacaaaagatcaagacaatgaccttaacaccgggaattgtgcagttatgtttcagggcgcatggtggtacaaaaattgccacgtttccaacctgaacggacgctatttgcggggaacacatggaagcttcgctaatggaatcaactggaaaagtgggaaggggtacaactattcatataaggtgtctgagatgaaagtgcgtcccgcatag

SEQ ID NO: 117120 - DNA, 828 bp, Artificial Sequence
  Description of Artificial Sequence: Synthetic coding sequence
atggaacttgaccgggctgtgggagtgttgggagccgctacactgctccttagttttctcggaatggcctgggccctccaggctgccgacacttgccccggcgaaagaggacccccagggcccccaggaaaggcagggcccccggggccgaatggtgcccccggcgagccccaaccatgcttgacagggccccgcacatgcaaagacctgctggaccggggacactttctatccggatggcatactatttatctcccagattgtagacctctaacagtcttgtgtgatatggacacagacgggggcgggtggacggttttccagcggcgggtagacgggagtgtggacttctatagagactgggctacctacaaacagggcttcgggagtagactgggtgaattttggctgggaaacgacaatatccacgctttaactgctcaaggaacgagcgagctgagagtagatctcgtcgactttgaagacaactaccagttcgccaaatacagatcattcaaggttgcagatgaagctgaaaaatacaatctggtactaggtgcattcgtggaaggatcagccggcgactccctgacattccacaataaccagtccttttccacaaaggatcaagataatgatcttaataccggcaattgtgccgtcatgttccagggcgcttggtggtacaagaactgccacgtgagtaacctgaacggcagatatctaaggggcactcacggatcgttcgccaacggcatcaattggaagtccggtaaggggtacaactatagctataaggtctccgaaatgaaagtacgcccagcctag

SEQ ID NO: 117121 - DNA, 564 bp, Artificial Sequence
  Description of Artificial Sequence: Synthetic coding sequence
atggagttgtctggagcgaccatggccaggggcctggccgtactcctggtgctgtttcttcacattaaaaacctccccgcccaggctgccgacacttgtccggaagtgaaggttgtcgggcttgagggctccgataagctgacaattctgaggggttgtcctggccttcctggggcccccggacccaagggagaggcgggtgtgatcggcgagcgtggcgagcggggtctccctggagcccctggcaaagcaggaccagtggggccgaagggggatgccggacagtcccaatcttgcgctaccggtcctcggaactgtaaagatttactggaccgagggtactttctctctgggtggcacacaatctatctgccagactgccggcccctgaccgtgctctgcgatatggataccgatggaggcggctggactgtgtttcagcgacggatggatggcagtgtggacttttaccgggactgggccgcttacaagcagggattcggtagtcagctcggcgagttctggctgggcaatgacaatattcacgcgctgaccgcacagtag

SEQ ID NO: 117122 - DNA, 981 bp, Artificial Sequence
  Description of Artificial Sequence: Synthetic coding sequence
atggagcttagcggagccaccatggctagaggactggcagtgcttttagtgctcttcctccatatcaagaacctacccgctcaggccgctgacacttgcccagaagttaaagtcgtcggcctggagggcagcgataagctcacaatcctccgtgggtgtcctggtctgccaggcgcccccggcccgaaaggtgaggctggggtgatcggagagcgaggcgaacgcggacttccaggcgctccagggaaggcgggcccggtgggtcctaaaggtgatagaggagaaaaaggcatgcggggcgagaagggggacgctggccaatctcagagctgcgcgaccggaccacgcaactgcaaggacctcctggacagaggctacttcctctccggatggcataccatttacctgcctgattgccggccgctgaccgttctttgcgacatggatacggacggagggggttggactgtgtttcagcgccgaatggatggcagcgtcgatttctatagggattgggctgcttataagcagggattcggctctcaactcggggaattctggttgggaaacgataatatccacgcccttactgcacaggggtcttccgagctgcgcgtggatctggtggactttgaggggaatcatcagtttgcaaaatacaaatcatttaaggtggctgacgaggcggaaaaatataagctcgttctgggtgcctttgttgggggctcagcgggcaactcattgactggacataataataactttttctccactaaagaccaggacaatgacgttagctcaagcaactgtgctgagaagttccagggagcctggtggtacgctgactgccatgcctccaacttaaacggattatatctgatgggcccccatgagtcgtacgccaatgggataaattggtcggctgcaaaaggctacaaatacagttacaaggtttccgaaatgaaggttcggccagcatag

SEQ ID NO: 117123 - DNA, 1083 bp, Artificial Sequence
  Description of Artificial Sequence: Synthetic coding sequence
atggagctgagtggtgcaaccatggctcgcggcctggctgtactgctggtactctttctgcacataaagaacctgccggcccaggcagccgatacatgcccagaagtcaaagtggtgggcctggaaggctctgataagttaaccatcctgaggggctgcccagggcttccaggagcaccgggacctaaaggcgaggctggcgtcataggcgagcgcggcgagcgaggactacctggcgccccggggaaggctggccctgtgggacccaaaggcgatcggggggagaaggggatgcgtggtgagaaaggagacgcaggacagtcccagagttgtgctactggaccgaggaattgcaaagacttactggatcgtgggtatttcctgtctgggtggcatacgatctacttgcccgactgtagacccctgacagtattgtgcgacatggatacagatggaggcggctggactgtcttccaacgccgaatggacgggtctgtagacttctatcgggattgggccgcatataagcagggctttggatcgcagactcattcccacgatgcacacagctgtccttttgccccctcctctgtgaaaccaccccatgcgcacaatcttacccgggggcgaatcatgttcctgaacatgttcactcttggacagaaaagctttacctctttcaacgtgtgttttcttaatacaagcggctttgatcatttcccagtgtcggttgctagacaggtctttccttggaacctcgtatcacgcgaagagagtggaccacttttttctcgctggcattatcggtgctctggaaggctctcagacttttgcgaggattttccacctccagttattgataccggcaggagcagtccgcctcccccatccctgccacatccaccaatgccacattcacaacactttaccctgttggaaaagggccactttggtgtacaaaagacgctgacaaaaaagggagaatccttagtgggaacgttcctgcttcccacaacagccgagtttatgctgtgggcaggctggctgttgggaagagacaagcacctggccctgactaagtag

SEQ ID NO: 117124 - DNA, 900 bp, Artificial Sequence
  Description of Artificial Sequence: Synthetic coding sequence
atggatttgctgtggatactcccaagcctatggctcttgctgctgggaggtccagcatgtctgaagactcaagagcaccccagttgccctggccctagggagttggaagcctcaaaggtggtgctattgccctcgtgccctggggcgcctggttcaccaggagagaaaggtgcgccgggacctcagggccccccaggcccccctgggaagatgggtcccaaaggcgagcccggggatccggtaaaccttcttcggtgtcaggagggccctcggaactgccgtgagttactctcccaaggagccactctttccggctggtaccacttgtgcctcccagaagggagggcgctaccagtgttttgcgacatggatacggaggggggcggttggttggtattccagagacgccaggacggctcagttgacttttttcgcagttggtccagctacagagcaggcttcggaaaccaggagagtgaattctggctcggtaatgagaacttgcatcaactcacgctgcaaggcaactgggaattacgggtggagttggaggatttcaatggcaacagaaccttcgctcattacgctaccttccggttgctcggcgaagttgaccactaccaattggcccttgggaaatttagtgaaggtaccgcaggtgactctctgtccctgcattccggcaggccatttaccacatacgacgctgaccacgacagcagcaatagtaactgtgctgtgatcgtccatggagcttggtggtacgcttcatgttatcgctctaatctaaacggacggtatgctgtctctgaggctgcggcccacaaatatggcatagattgggctagcggacgtggggtcggccacccctacaggagagtgcgcatgatgctcaggtag

SEQ ID NO: 117125 - DNA, 867 bp, Artificial Sequence
  Description of Artificial Sequence: Synthetic coding sequence
atggacctcctgtggatcctgccctccctgtggttactgctgttaggaggccctgcctgccttaagacgcaggagcacccgtcatgtcccggcccgagagagcttgaggcgtccaaagtggtgctccttcccagttgtcccggggccccgggctcgcctggcgagaagggagctccaggaccacagggacctcctgggccgcctggcaagatgggtcctaaaggggagcctggtccgagaaattgtcgagagctcctctcccagggagctacgttgtccgggtggtaccacttgtgtctgccagagggtcgcgccctgcctgtgttctgtgacatggatactgaggggggcggatggctggtgtttcaacgcagacaggacgggagtgtggattttttcaggagctggagctcatatcgggctggattcggaaatcaggagtccgaattctggctgggcaatgagaacctccatcaactgaccctgcagggaaactgggagctgcgggtggaactggaggacttcaatggcaatcgtacctttgcccactatgctacatttcggctgctgggggaggttgaccactaccagcttgccctgggcaaattttccgagggaactgctggagattccctcagtctgcactccgggaggccttttacaacatacgacgctgaccacgactcgtcaaactctaattgtgccgtaattgtgcacggggcttggtggtatgcctcatgctataggtccaacctcaatgggaggtacgccgtttcagaagccgccgcccacaagtatgggatcgactgggcatcggggagaggtgttggccatccctatcggcgagtccgcatgatgctcaggtag

SEQ ID NO: 117126 - DNA, 300 bp, Artificial Sequence
  Description of Artificial Sequence: Synthetic coding sequence
atggacaccgagggaggggggtggctggtgttccaaagaagacaagacgggtctgtggatttcttcagatcatggtcgagctaccgtgcgggcttcgggaaccaggaatcggaattctggttaggcaatgagaatctgcatcagctaaccctgcagggcaattgggaactccgcgtggaacttgaagacttcaacggcaatcggacttttgcacactacgccacgtttcggttgttgggggaagttgatcactaccagctggctttaggaaagttctctgaggggaccgcgggcgaatag

SEQ ID NO: 117127 - DNA, 2094 bp, Artificial Sequence
  Description of Artificial Sequence: Synthetic coding sequence
atggcagagacctcgccagaacctagcggccaactcgttgttcattccgacgcccacagtgacactgtattggcctcgtttgaggaccaacgaaaaaagggctttctttgtgacattaccctgatcgtagaaaacgtacattttagagcccacaaggccctgctggcagccagttctgagtactttagtatgatgtttgctgaagagggagagataggacaatctatttacatgctggaaggcatggtcgccgataccttcggaatcttactggaattcatatacaccggttacctgcacgcatctgaaaagagtacggaacagatcctggctaccgcccagttcctcaaggtgtacgacttggtcaaggcatacacagatttccagaacaatcacagctctcccaagcccactaccctcaatacagccggtgctcccgtcgtcgtcatcagtaacaagaaaaatgatcccccaaagcgaaaacgtggtaggcctaagaaagtcaatactctacaggaggagaaatccgaactcgcagccgaagaagagattcagctccgagttaataacagcgtgcagaacagacagaattttgtggtaaaaggagatagtggtgtactgaatgagcagatcgccgcaaaggagaaggaggaaagtgaaccaacttgcgagcctagtagagaggaggagatgcccgtggagaaggacgaaaactacgaccccaaaacagaagatggacaggcatcccagtctcgctacagtaaaaggagaatatggcgaagtgtcaagctgaaggactacaagctcgtgggagaccaggaggaccatggctcagctaaacgcatatgcggacgaagaaagaggcccggcggaccagaagcgagatgcaaggattgcggtaaagtctttaaatataaccatttcttggcgatacaccagcgctctcacaccggggaacgaccattcaagtgcaacgaatgcggcaaaggattcgctcaaaagcactccttgcaggtccatacaaggatgcacaccggcgaaagaccttacacctgtaccgtgtgtagtaaggcgctgactacgaaacacagtctcttagagcatatgtctcttcacagcgggcagaagtcgttcacttgcgatcagtgcgggaagtactttagccaaaacagacagctgaaatcccactaccgcgtccatacaggccattctttgccagagtgcaaagactgccaccgtaagttcatggacgttagccaattaaagaaacacttacggacccatacgggcgaaaagccttttacatgtgagatctgtggtaagtcatttactgcaaagtcatctctgcaaactcacattcgcatccataggggtgagaagccttattcatgtggaatttgtggaaaaagcttctccgatagctcagcaaagcgtcgtcactgtatcctgcacacaggaaaaaagccttttagctgcccagaatgtaatctacagttcgccaggctcgacaatctcaaggcacacttaaagattcacagcaaggaaaaacacgcatccgacgcaagctccatctccggttcctccaatacagaggaggttaggaatattctccagttacaaccttatcagctctctacatctggagagcaggaaattcagctgctggtgaccgacagcgtgcataatatcaacttcatgcccggtcccagtcaaggcattagcatcgttacagcagaatcatcgcagaacatgaccgcagaccaggccgccaatctgactctgctcacccagcagcctgagcagctccagaatttgatcctatcggcccagcaagaacagaccgaacacattcaaagcctgaacatgatcgagagccagatggggccctctcagacagagccagtgcatgttatcactcttagcaaggagacactagaacacctacacgcccaccaagaacagacggaagagctccaccttgctacttctacatcggatccagctcagcatctacagttaacgcaggaaccagggcccccaccccccactcatcatgtgcctcaacccacccccctcggacaagaacaaagttag

SEQ ID NO: 117128 - DNA, 420 bp, Artificial Sequence
  Description of Artificial Sequence: Synthetic coding sequence
atggggcaaaagggcagtagcgggctgttcagagctgtgtcagcctttggagtggttggcttcgtgaggttcctcgaagggtattacattgttttaatcacaaagaggcgtaaaatggctgatattggcggccacgcgatttataaggtggaggacactaacatgatctacatcccgaacgatagcgtgagggttacccaccccgatgaggcccgttacctccgtatttttcagaacgtagatctcagctcgaatttttattttagctattcatacgatctgagccattccctgcagtacaacctgactgttttacgaatgccacttgagatgctcaaaagcgagatgacacaaaacaggcaggaatccttcgatatttttgaggacgaaggtctgattacccaaggcggtagtggttag

SEQ ID NO: 117129 - DNA, 411 bp, Artificial Sequence
  Description of Artificial Sequence: Synthetic coding sequence
taattattcgaagagctctacgaggaccacggcgacacgctgagcctccagtacggcggcagtcagctggttcatcgagttaagacttacaggaaaatagctccatggacacagcactccaaagacatcatgcagaccctgtccagatactattccaacgccttttccgatgctgacaggcaggattcaattaacctgttccttggcgtctttcacccaactgagggtaagccacacctatgggagctccccactgatttttacctgcaccataagaacaccatgcgactgctcccaactcggaggtcatatacgtactggtggaccccagaagttattaagcacctgccactcccatacgacgaagggttcctcgctcggtctcctgctaatctcgagtgttccaactag

SEQ ID NO: 117130 - DNA, 300 bp, Artificial Sequence
  Description of Artificial Sequence: Synthetic coding sequence
atgactagttcagccagagacttcatgccaaagaccgtgggaatagatcctagtcctttcacagtgcggaaacctgatgagacagggaaatcagttttaggtaataaaagcaaccgggaagaggcggtgcttcagaggaaaacagccgcaagtgccccacctcctcctagcgaggaggcagtgtcctcatcttcagaagacgatagcggaactgaccgagaggaagagggttccgtttctcagagatcaactcctgtgaagatgaccgatgctggggactctgcaaaagtcaccgagtag

SEQ ID NO: 117131 - DNA, 1806 bp, Artificial Sequence
  Description of Artificial Sequence: Synthetic coding sequence
atgactggatacttgcgtatatttcagaacgttgatctttcctctaatttctacttttcttattcatacgacctgtcacactccttgcagtataacctgacagtcctgagaatgcccctggagatgctcaagagtgaaatgacccagaacaggcaggagagttttgatatatttgaagatgagggcctcataacccaaggagggtccgtggaccaggccgacccgtttgcccacgttgctgcattgcatttcgatcagatgttccagagatttgggtctcccataattattctgaacctagtgaaagagagagaaaagagaaagcacgagagaattttgtctgaggaactggttgcagccgtgacatacctgaatcaattcctccccccagagcacactatcgtatatattccctgggatatggcaaagtatactaaatcaaagctctgcaacgtcttagacaggttgaacgtcattgctgaatccgtggttaaaaaaactgggtttttcgtgaacagaccagactcatactgcagtatcttacgtcctgacgaaaagtggaacgaacttggcggctgcgtcattcctaccggccgactccagaccggtatcctcagaactaattgcgttgattgtctggacaggaccaataccgcccagtttatggttggaaaatgtgcactagcgtatcagctctattcgcttgggctgatcgataaacccaacctgcagttcgacacagatgccgttagactgttcgaggagctgtacgaggaccatggagatacactttcccttcagtacggtggctcacaactggtgcacagggtgaaaacctataggaaaatcgctccctggacccagcatagcaaggatataatgcagacactgtcgcgctactactctaacgcatttagcgatgcagacagacaggactccatcaacctgttcctgggcgtgttccatccaacagagggtaaacctcacttgtgggaactccccacagatttttatcttcatcataagaacaccatgcggctgctgcctacacgaagatcatacacctattggtggacacccgaggtgattaagcacctgcccctgccctatgacgaggtaatttgcgcggtaaacttaaagaaactgatcgtcaaaaagttccacaagtatgaggaggaaatcgatattcataatgaattttttcggccgtacgagctgtcgtcctttgacgacacgttttgcctcgcaatgacaagttctgctagagatttcatgcccaagacagtcggcatagatccaagtcccttcaccgtgcgcaaaccagatgaaacagggaagtctgttctggggaataagtcaaaccgggaggaggcagttctgcagcggaagaccgccgcctccgctcctccacctcccagcgaggaagcagtaagctcgtccagcgaagatgactctggcactgacagagaagaggagggcagcgtcagtcaacgaagcaccccggttaagatgacggatgccggtgatagcgccaaggtcaccgaaaacgtggttcagcccatgaaagagctttacgggatcaatctctcagacgggctcagcgaagaggacttttctatttacagtcgaacccccatatccgcttttagtcaggacaacatatacgaggtccagcctccacgcgtggaccgcaagagcacggaaatattccaagcacacatacaggcctcacagggcatcatgcagccgctggggaaggaagactcttctatgtacagagagtacattcggaacagatacctctag

SEQ ID NO: 117132 - DNA, 714 bp, Artificial Sequence
  Description of Artificial Sequence: Synthetic coding sequence
atgaggtactttctggtcggatccaacaacgcagagacaaagtatagggtactgaagatcgaccgcacagagccaaaagatctagtgataattgacgacaggcacgtttacacacagcaggaagttagagagctcttagggagactggacctgggtaatcggacgaagatgggacagaagggtagttcagggcttttccgagctgtgtccgcattcggcgtggtaggcttcgtgcggttcctcgagggttattatattgtgctgatcacaaagaggcgaaaaatggctgatattggcgggcatgcgatatataaagtcgaggatactaatatgatttacatccctaatgactccgtccgtgtgacccaccccgatgaggcgcggtatctgcgcatctttcagaacgtggacctgtccagtaacttctatttttcctactcttatgacctgtcccacagtcttcagtacaacttgactgtgctcagaatgcctctggaaatgcttaagtctgagatgacacagaatcgtcaagagtctttcgacatcttcgaggatgaaggactcatcacccagggtggatcaggggtgtttggaatttgttccgagccctacatgaagtacgtatggaacggtgagctcctcgacattatcaaatcaaccgtacaccgcgattggttgttgtatattatccatggattctgtggccaaagttag

SEQ ID NO: 117133 - DNA, 969 bp, Artificial Sequence
  Description of Artificial Sequence: Synthetic coding sequence
ttgtaccaggtgtccacccacgaacagagtgagagtgctcatgggcggaccggccccagcacagggggacgtcaacggtccaggcatgagcaggcgcgggactcctccaggcatagcgcgagtcaagaagggcaggacacaattagaggccaccctggatcttcgaggggcggtaggcaggggtcccactatgagcagtcagtagattcctccggccacagcgggagccaccactcacacaccacatcccaggagcgttcagacgtcagtagaggacagtcaggcagccgaagcgttagccggcagacacgcaacgagaaacagtcaggggacgggagccgccactccgggtcccgccaccacgaggctagttcacgagctgactcttcacggcatagccaggtgggtcagggtcaatctagtggccccaggacctctaggaaccaaggaagctccgtatcacaggactccgattctcaaggacactctgaggactccgaacggcgcagcggttctgcgtctagaaaccatcacggctcggcgcaagaacaatccagggacgggtcaaggcaccctcggagtcaccatgaggacagggcaggtcacggccactctgccgagtccagtcgccagagtggaacccaccacgccgaaaactcctccgggggtcaggcggctagtagccatgaacaggctcggagttccgcaggcgagaggcatgggagccatcaccaacagtcagccgactcatcccgccactcgggtataggccacggccaggcctcttcggcggttagagattctggtcaccgtggatcctcaggcagtcaggccagcgatagcgagggacactcagaagatagtgacacacagtcggtgtccgcacatggacaagccggaccacaccagcagtcacaccaggaatctactagggggcgatctgccggaagaagcgggagaagtggctag

SEQ ID NO: 117134 - DNA, 969 bp, Artificial Sequence
  Description of Artificial Sequence: Synthetic coding sequence
ctgtatcaagtttcaactcacgagcagtcggaatcctcccatggctggaccggcccatctactcggggcagacaaggatccagacacgagcaggcgcaagacagcagcagacactccgcaagccaggacggccaggatacaattcgtggtcatccaggcagttctagagggggccggcagggctaccaccatgaacactctgtcgattccagcgggcactccgggagccaccattcgcataccacctcccaaggtcggagcgacgcctctcgtggccagtccgggtcaaggtctgcatcgcgcactacccgaaatgaagagcagagtggagacggaagcagacactccggtagtagacatcacgaggcctcaacccatgccgacatttccaggcatagccaggctgtccaaggacagagcgagggctctcggagaagccggcgacaagggtcttcagtgagccaggattccgactcggagggccatagtgaggacagcgagaggtggagcggatcagccagtaggaaccatcgaggctccgtgcaggagcagtctcggcacggctctagacatccacggtcgcatcacgaagaccgggctgggcacgggcactcagcggaccgctccagacagagtggcacaagacacgcagagacatcttccggcggtcaagccgcgagttcccacgaacaggccaggtcgtcccccggagaacgacacggctccaggcaccagcagtctgctgacagtagtagacactcagggatcccacgcggccaggcaagctccgcagtcagagacagccgacactggggatcaagcggcagccaagcttctgacagtgagggccacagcgaagagagcgatacgcagagcgtttctggacatggccaggccggaccacaccaacaatcacaccaggagagcgcgcgggatcgttctggagggcgcagcggacggagtggctag

SEQ ID NO: 117135 - DNA, 12186 bp, Artificial Sequence
  Description of Artificial Sequence: Synthetic coding sequence
atgagtacgcttcttgagaatatctttgctatcataaaccttttcaagcagtacagcaagaaagataaaaacaccgatactttatctaagaaagagctgaaggaactcctggaaaaggagtttagacagattctcaagaaccccgatgacccagatatggtggacgtgttcatggatcacctcgatatagaccacaataagaagatcgatttcacagaattcttgctgatggtctttaaactcgcgcaagcctattacgagagcacccggaaagagaaccttcccatttctggtcataagcacagaaagcattctcaccacgacaagcacgaggataataaacaggaggagaataaagagaataggaagaggccctccagccttgaaagaagaaataaccggaaaggaaataagggacgcagcaagagtccgcgcgaaactgggggcaagcgacacgaaagctcctcagaaaagaaagaacggaaaggttacagccccacccaccgggaggaagaatatggcaagaaccatcataacagttcaaaaaaagagaagaacaagacagaaaatactcggttaggcgataatcggaagaggctgagcgagcgtctggaggagaaggaggataacgaagagggtgtatatgattatgaaaacactggcagaatgactcagaaatggattcagagcgggcacattgctacttactacaccatccaggacgaggcttacgacacaaccgacagtctattagaagagaacaaaatttatgaacggagtcggagctcggacggcaaaagctcgtcccaagtgaacaggagcaggcacgagaacacgagtcaggttccactacaggagagcagaacccgaaagcggagggggtccagagtgagtcaagaccgagactccgagggccattccgaagattctgagcgccattccggcagtgcttctcggaaccatcacggctcagcttgggagcagagcagagatggatctagacaccctcggagtcacgacgaggatcgtgcttctcacgggcattcagctgacagtagtaggcagtccggtaccaggcatgcggagaccagctccagaggccagactgcctcatctcacgaacaggcaaggagttccccgggtgagcgccatgggtctggacatcagcaaagcgcagacagctccagacacagcgctaccggtcgtggccaggccagcagtgccgtatcggacagggggcataggggctcttccgggagccaggcgagcgactcagaaggacattccgagaatagcgacactcaaagcgttagtgggcatgggaaggccgggctgcggcagcagtcacatcaagagagcactcggggtcggtcaggcgaaaggagtgggaggagcgggtccagtttgtatcaagtatctacccacgaacaaccggactcagctcatggaagaacagggactagcacaggtggccggcagggatcgcatcatgagcaggctcgggattccagccgccactccgcctctcaagaggggcaggatactattcgtggccacccaggttcttccagaggggggcgccaaggaagccatcatgaacagtccgttaatagatctggtcactcaggctcccaccactcgcacaccacaagtcagggacggtcagacgcgtctcacggccagtccggttcacgcagtgctagtcgacagacccgcaacgaagaacagtcgggcgacgggacacgccacagcggaagcagacatcacgaggcttcaagtcaggccgattcatcccggcattcccaggtaggccagggccagagctccggccctaggacctctcgaaaccagggaagcagcgtgagccaggattccgatagtcagggccactccgaggactccgaaagatggtccggctcggcaagcaggaaccaccacggcagtgcccaggagcaatctcgggatggatccagacatcctcggtctcatcacgaagaccgggctgggcatggtcattccgctgacagttctcgcaaaagcggaacccggcacacacaaaatagctcatcaggccaggctgcctcatctcatgagcaggccaggtcttcggcaggagagcggcatgggtcacgccatcagctgcagagtgctgactctagccgacatagcggcacgggccatggacaagcttcttcagccgtgagagattctggccacagaggcagcagtggctcccaggccaccgacagcgaaggacactccgaggatagtgacacacaatcagtttccggacatggacaagccggacaccatcaacagtcgcatcaagagtccgcccgggataggtctggagaacggtcccgtaggtctggctctttcctgtatcaggtgagtacacacaaacaatctgagtcatctcatggatggacaggcccctctactggagttaggcagggatcccatcatgaacaagcgcgggacaactcccgacattctgcttcgcaggatggacaggacactatccgtggccaccccggttcgagtagaagaggaaggcaaggttcccaccacgaacagagcgtggatagatccggccattctggatcccatcactctcacactacctcccaggggcgctctgacgcctctcgcggccagagtggatctcgctccgctagtagaaccacccgcaatgaagaacagtcacgagatggttctaggcactctggcagcagacatcacgaagcaagttcccacgctgacattagccgacacagtcaggcgggacaagggcagtctgaaggaagcaggactagccgccgccagggctcttcagtgtcacaggatagtgatagcgaggggcattctgaagattcagagcgttggagcgggagcgcttctcgtaatcaccgtggatcggcgcaggagcagtcccggcacggatccaggcatcctcggtcccaccacgaggatcgggccggccacggacacagcgcggactcttctcgacagtcgggaactccccacgccgaaactagttccggcggccaggctgccagtagccatgagcaagctcgcagcagcccaggtgagcgccacggcagccggcaccagcagtcggcagacagtagccgccacagcggaattccaagaagacaagctagtagtgccgtgcgggactctggccattggggatcatccgggagtcaggccagcgactccgagggtcattccgaggaatcggacacccagagcgtgtctggacacggacaagacggcccacatcagcagtcacaccaggaatcagctcgcgattggagcgggggtaggagcggccgctccgggtctttcatttaccaggtgagcacacatgaacaaagcgaatccgcgcacggacgcacaaggacgtcaacaggacgcaggcaggggtcacaccacgaacaggctagggactcatccaggcattcagcatctcaggagggacaggacacaattcgggcgcatcctgggagtcgccgcggggggaggcaggggagtcaccatgagcaaagtgttgacaggagcggacattcgggtagccaccattcccataccacgtctcaggggcgctccgacgcttctcacgggcagagcggctcaaggtccgcttcccggcagacaaggaaagataagcagagcggggatggatctagacactccggtagccgacatcatgaagccgcttcttgggctgatagctctcggcactcccaagtcggccaggaacagtcttccggttcccggacttcaagacaccagggatccagtgtctcacaggatagcgactctgaaagacacagcgacgacagtgagagactgtctggatccgcttcaaggaatcaccacgggtcctcccgcgaacaaagccgcgatgggtcaagacatccaggattccatcaagaagatcgcgcgtctcacgggcatagtgcagacagttccagacagagcggcacgcatcatactgaatcttcatcccatggccaggcggtatctagccatgagcaggcaagatccagccccggggagaggcatgggagcagacatcagcagtcagccgatagctccaggcacagcgggatcggccaccggcaggccagtagcgcggtgagggattcaggtcatagagggagttccggctctcaagtcacaaatagcgaggggcactctgaagactccgatacacagtcagtgtccgcccacggacaggcaggccctcaccagcagtcccataaggagtctgcccgaggccagagtggagagagttcaggccgttctagaagtttcctgtatcaagtctcatctcatgaacaatctgagtccactcatggacagactgctcctagcacaggggggcggcaaggaagcaggcatgagcaggcccgcaatagttccagacactcggcttcccaagatggccaagacaccattagaggacatcccggttcctcaagaggtggccgacagggatcttaccacgaacagtcagtcgatcgcagcggtcacagtggctaccaccactcccacaccacccctcagggccggagtgacgcgtcccacgggcaatcggggcctaggtccgccagtcggcagactagaaatgaagagcagtctggcgacggttccagacactccggttccaggcaccacgaaccatcaacacgcgctggatcatcccgccactctcaggtcggacagggagagtcagccggcagcaagaccagcaggcgtcaaggctcgtccgtttcccaagatagagattccgaaggtcacagtgaagacagcgagcgcaggtccgaatctgccagccgcaaccattatggttctgcgagggagcagtcccgacacggctcccggaatccaagatcccaccaggaggatagggcgtcccatggccacagtgcagaatcctcgcgccaatcaggcaccagacacgcagaaacctcctctgggggacaagctgctagttctcaggagcaggcccggtcaagtccaggcgagcgccacggcagtaggcatcagcagtcggccgactcgagcactgattccggaactggccggcgacaggacagttcagtggtgggtgattctggtaaccgagggagttctggtagtcaagcctctgatagtgaagggcatagcgaagagtcagacacacagagtgtaagtgctcacgggcaggctggaccccaccagcagagccaccaagaaagcacacgcggtcagagcggcgagcgctcaggcaggtccgggtcctttctgtaccaggtaagcacccacgagcagagcgagagcgcacacgggcgcaccggacctagcacgggggggcgccagcgaagtcgccacgagcaggctagagactcttcaagacattcagcctctcaggaaggacaggatacgatacgcggccacccagggtcatcccggggaggaaggcagggctcacactacgagcaatcagtcgattcttctggccacagcgggtcccatcattcacataccactagccaggaacgatctgatgtgtctcgcggacaaagcggctcccgctctgtgtcacgccagacccggaacgaaaagcaaagcggcgatggatcgaggcatagcgggagtcggcaccacgaggccagctctcgcgccgattctagccgacattcccaggtggggcaaggccagtcttcaggtccccggacctcacggaatcaggggagttcagtgtcacaagactcagactcacaggggcacagtgaagactctgaaagatggtcaggctcagctagcagaaatcatctggggagcgcttgggagcagtctcgtgatggatcacgacaccctgggtctcaccacgaggacagagccggtcatggacattcagccgactcatcccgacagagtggcaccagacacactgaatccagtagcagaggtcaggctgcctcatcgcatgagcaggcccggagctccgcgggtgaaaggcacggatctcatcaccagttgcaaagcgcagacagctcgaggcactccggcatcggccatggacaggcatcgtctgccgtgcgtgatagcggacatcgcggctatagtggtagtcaagcgtccgactctgagggccattccgaggattccgatacccagtctgtgagcgcccaagggaaggccggaccacaccagcagtctcacaaagaaagcgcaaggggccagagtggggagtcttccggtaggtccggttcttttctgtaccaagtgtctacacatgagcagagtgagagcacccacggccagtcagctcctagtaccggtggaagacagggatcccactacgaccaggcacaggatagctcacgccattctgcttcacaggagggccaggatacaatccgtggacacccaggacctagcagaggaggacgccagggatctcaccaagagcaatcagtagaccgttctgggcacagcggcagccatcactctcataccacgtcccagggcaggtccgatgcatccaggggtcagagtggttctcgtagcgccagtaggaaaacttatgacaaggagcagtccggtgacggttccaggcatagcggcagccaccatcacgaagcttctagttgggctgactcgtcgcgccatagtctcgttgggcaggggcagagctctggacctcggacatctcgtccgcgagggtcaagcgttagccaggacagcgacagcgagggacacagcgaagactcagaacgccggtcaggctccgcttcacggaatcatcacggcagtgctcaagaacagagccgtgatggctcccggcatcctcgttctcatcacgaggatcgcgctgggcacggacattctgccgaaagcagtcggcaaagcggcacccatcatgccgaaaattcatccggggggcaggccgcaagctcacacgaacaggcaagatcatccgccggagaaagacacggcagccaccaccaacagagtgctgattcaagccgccacagcggcattggtcatggccaggcatccagtgctgtccgggactctgggcatagagggagtagtggctctcaagcctccgacagcgagggccattccgaggactctgacactcagagtgtgagcgctcatggccaagccggtccacaccagcagagccaccaggagtcgactcggggaagatctgctggcaggagcggaagaagcgggagctttctttatcaagtgagtacccatgagcagtccgagagcgctcacgggcgcacagggacctcgaccgggggccgccaggggtcgcatcataagcaagcccgagattccagtcgtcacagcacatcccaggagggtcaagataccattcacggccaccccgggtcatcttccggaggacgacaggggtcccactatgagcagctagtggaccggagtggccactccgggagccatcattcccatactacatcacaaggaaggtctgatgcctctcacggccacagtggttcccgatctgccagcagacagaccagaaatgacgaacagtctggcgacggatcacgccactcgggctcccggcaccacgaggcatcttcgagagctgattcctcagggcactcccaggtggggcagggccaatcagaaggaccgagaacatcacgcaattggggtagctccttttcccaggactccgatagccagggtcactcagaagattcagaaagatggtccgggtccgcgtcaagaaaccaccatggctcagctcaggagcagctgcgggatgggagtcgccatccccggagtcaccaagaagatcgcgccggacacgggcacagcgcggactcctcgagacagagcggaacgcggcacacccagacctctagtggcggacaggccgcttcaagccatgaacaggcacgctcgagcgccggagaacgccacggtagtcaccatcagcaatctgctgacagttcccggcactccggcatcggacacggccaggcaagctctgccgtcagggacagcggtcacagaggatatagcggctcccaggcctcggataatgagggtcatagcgaagactcagatactcaaagcgtgagtgcccatggccaggcggggtcccaccagcagagccatcaggagtccgccagaggccgatctggcgaaacctccggacactctgggtccttcctgtaccaagtgtcaacccatgagcaaagcgaatcctctcatggatggactggtcctagtacacgtggccggcagggatcacgccacgaacaggctcaggactcgagtcgacactccgcatcccaggacggccaggacaccattaggggacacccgggaagctcaagggggggtaggcaaggctatcaccacgaacacagcgtggacagttctggccacagtggctctcaccactcccacacaacgtctcagggccgaagtgacgcttctcggggccaaagcgggtcacgctcagccagccgaaccactaggaatgaggaacaaagcggtgacggaagccgacattccggctctcggcaccatgaggcatctacccatgccgacataagcaggcattctcaggccgttcaggggcagtccgaaggctcccgccgctccaggcggcagggtagcagtgtgtcacaagattccgatagcgaggggcattcggaggactcggaacgatggtcaggcagcgccagtaggaaccatcatggatcggcccaggagcagctgagggatggctccaggcatccaaggtctcaccaggaagaccgcgcaggtcacggccacagcgcagacagttcaaggcagtccgggacccggcatacccaaacatcttctggcggccaggccgcaagcagccacgaacaagctagaagctcggccggcgagcgccacgggagtcatcatcaacaatccgccgactcatcgcggcacagcggcatcgggcacggacaggcaagctcagccgtcagagatagtggccatagagggtactctgggtctcaagcttccgataacgaaggtcactcggaggactcagacacccagtccgtgtccgcacacgggcaggctgggagccatcagcaaagccaccaggaatctgctaggggtcggtcaggagagacctctggccacagtggctcattcctttatcaggtttcaacgcacgagcaatccgaaagtagtcacgggtggacaggccctagtaccaggggccggcagggctcccgtcatgagcaggcacaagacagttcacgtcactcagcaagccagtacggccaagatacgatccgcggccatccaggctcctcgagagggggacgtcagggataccatcacgaacatagcgtggattcaagcggccactcaggtagccaccattcgcacacaacctcacaggggcggagtgacgcctcccgcggccaatcaggatctaggagtgcgtctcggaccactcggaacgaggaacaatccggtgatagttcccgtcatagcgtctcaaggcaccatgaggcgtcaacgcacgcagacatttcaagacactctcaggcagtccaggggcaatccgaaggaagcagaagatcccgaaggcaaggaagcagcgtctcccaggattcagattccgaggggcacagtgaagattccgagcggtggagcggctctgcgtcccgtaatcatcgcggttccgttcaggaacagagccggcacggaagcagacacccacgatcccaccacgaggaccgagctggacacggccacagcgccgaccgtagtcgtcagagcggcacacgacacgctgagacttcctccggcgggcaggccgctagttcacacgagcaggcacggtcttcacccggggaacgtcatggctccagacatcagcaatcagccgactcgtctcggcatagcgggataccaagggggcaggcaagctctgcggtcagggactccagacactggggatcatctggtagccaagcttcggatagtgaaggccattctgaggagagtgatacgcagtctgtgtcagggcatggccaggcggggccccaccagcaaagtcaccaggagagcgcccgcgacaggtctggcggtagatctggcagaagtggttcctttctctaccaggtcagcacgcacgagcagtccgagtctgcgcatggtagaaccaggacttctacaggacggagacaggggtcacaccatgaacaggcccgggattcatctcggcactctgcaagccaagagggacaagataccatacggggccatccggggtcttcaagaagaggacgacaagggagtcactacgagcaatccgtggaccgatcaggccattctggatctcaccacagccacactactagccagggccgtagtgacgcctcaagaggccagagtggatctaggagcgctagtaggcagacccgtaatgacgagcagagcggagacgggtctaggcactcttggagccaccaccatgaagcctctacgcaggcagacagttcacggcacagccagagtggccagggtcaatcagccggaccaaggacatcccgaaaccaaggaagttcagtgtcacaagattctgatagtcagggtcactcagaggactcagaaagatggagcggcagcgcttcccgcaatcatcgaggctctgcccaggaacagtcccgggacggttcccgacaccccacctcccaccatgaggaccgagccggccacggccactccgcggagtcttctaggcagtcagggacgcatcacgccgaaaactcttccggaggtcaggccgcctccagccatgagcaggcgaggtcatcggccggtgagcggcacggaagtcaccatcagcagtcagcagactctagtcggcatagcggtatcgggcatgggcaagcgagctccgccgtgagagattctgggcatcggggatccagcgggtcacaagcctctgactctgagggacacagtgaggacagcgatacacagtctgtaagtgctcatgggcaagccgggccccaccagcagtcccaccaagagagcacaagggggagaagcgcaggtaggtcgggaaggagtgggtctttcctgtatcaagtgtctacgcatgagcagtcggaaagcgcccacggtcgggctggtcctagtactggcggtcgccagggctctaggcatgaacaggcccgggatagcagcagacacagcgccagccaggaaggacaagatacaattaggggacaccctggctcccgtagaggcgggcggcagggctcttaccacgagcagtcagttgaccgcagcgggcactcggggtcccatcattcccataccaccagccagggtcgctctgatgcctcgcatgggcagtcgggaagtcgcagtgcttccagagagacaaggaacgaggaacagtctggagatggcagcagacactcgggcagccgccaccatgaagcttccacccaggccgactccagtcgtcactctcagtccggacaaggagagagcgcgggttccaggagatctcgacgacagggcagcagcgtgtcgcaggacagcgactcagaagcctacccagaggactccgagcggagaagtgaatcagcatctcgcaaccaccatggctctagtagggaacaatcaagggatgggtctcgccatcccggcagttctcacagggatactgcctcacatgtacagagttctcctgtgcagtctgacagctcgacagcaaaagaacacggtcatttctctagcctgtcgcaagattctgcatatcattccggtatacagagtaggggctcgcctcattcctcttcatcctatcactaccaaagtgaaggcaccgaacgccagaaggggcaaagcggtttggtctggaggcacgggtcttatggaagcgccgattatgactacggagagtccggtttcaggcacagtcagcacggctcggtgagctataatagcaatcccgtcgtctttaaggagagatctgatatttgtaaagcctccgctttcggcaaagatcaccctagatactatgcaacgtacataaataaggacccaggcctgtgtgggcactctagcgatattagcaaacagttagggttttcacagtcccagcgctattactattacgaatag

SEQ ID NO: 117136 - DNA, 969 bp, Artificial Sequence
  Description of Artificial Sequence: Synthetic coding sequence
ctgtaccaggtttcaacccacgagcagcccgatagcgctcatgggaggaccgggacttcaacaggcggaaggcagggtagccatcacgagcaggctagagattcgagccgccattccgcctcccaggagggacaggataccattcggggccatcctgggtcatcccgggggggacgtcaggggtctcaccatgaacagagcgtgaatcgcagcggacattcaggcagccatcattcgcatacgaccagtcagggacggtctgatgcttcccatgggcagagtggaagtcgtagcgcatcgagacagacgcgcaacgaagagcagtccggagatggaactcgccattcaggttcaaggcaccatgaggcttcgtcgcaggccgatagtagccgccactcacaggccggccaggggcagagtgagggcagccgaacctctaggagacagggaagctcagtgtctcaggacagcgattcagaagggcatagcgaggatagcgagcgctggagtggctcagcatccaggaaccaccgtggaagcgctcaggaacagagcaggcatgggtccaggcacccaaggtctcaccacgaggatcgtgccggtcatggacacagcgcagattcttccaggcaaagcggcaccccccatgcggagacctcgtcgggaggccaagcagccagttcccacgaacaagcacgcagttctcctggcgaaagacatgggagcaggcaccagcagtcggcagatagcagtagacattccgggatacccaggaggcaggctagctctgccgtgagggatagcggtcactgggggtccagcggaagccaggcaagcgatagtgagggtcactcagaagaaagtgacactcagtcggtttctggccacggccaggatggacctcaccagcaatctcaccaggaatccgcccgcgactggagtggcggccgtagtgggagatcaggttag

SEQ ID NO: 117137 - DNA, 3402 bp, Artificial Sequence
  Description of Artificial Sequence: Synthetic coding sequence
atgcggagccgcggcagcgatactgagggaagcgctcaaaagaagttcccacgacacaccaaaggccactcgttccaagggcctaagaatatgaagcatagacaacaggacaaagatagtccatctgagtccgacgttatcctaccctgtccaaaggccgagaagccacactcgggtaatgggcatcaagctgaagatctgagccgagatgatctgctgttcctcctctcaatccttgagggggagctgcaggctcgcgacgaggtgatcggcatattaaaggcagagaagatggacctcgctctactggaggcgcaatacggattcgttactccaaaaaaggttttggaggccctccaacgcgatgcctttcaggccaagagcaccccgtggcaggaggacatctatgaaaaacccatgaacgagctggacaaggttgtcgagaaacacaaagaatcatacagacgcattctgggtcagctcctggtagccgagaagagtcgcaggcaaactatcttagagctagaggaagaaaaacgtaaacacaaggaatatatggaaaaaagtgatgagttcatctgcctcctggaacaggagtgcgagcgcttgaagaagcttatcgatcaggaaataaagagtcaggaggaaaaagaacaggaaaaagagaagagagtgacaactctaaaggaggaactgactaagctcaagagcttcgccctgatggtggtggacgaacagcagcggctcaccgcgcagctcaccttgcaaagacagaaaatacaggaactgacgactaatgcgaaagaaactcataccaagttagcgctagccgaggctagagtccaagaagaagaacagaaagcgactaggctggagaaagaacttcaaacgcagaccacaaagttccatcaagaccaagataccatcatggctaaacttaccaacgaggattctcagaatagacagctgcagcaaaagctcgccgcgttgtctcggcaaattgatgaactcgaagaaactaacaggagtctgcgcaaggccgaagaggagttgcaagacattaaagagaagatttccaaaggcgagtatggaaatgccggcataatggctgaggtggaagaactgcgtaagcgagttttggatatggagggcaaggatgaagaactaatcaagatggaggagcagtgccgtgatttgaataagcggcttgagcgagaaacgctgcagagtaaggactttaagctggaagtggaaaagttaagtaagcgaatcatggcacttgagaaactggaagatgccttcaataagtccaagcaagaatgttattcgctgaaatgtaatctggaaaaggaaagaatgacaaccaagcagcttagccaagagctggagagtctcaaggttcggatcaaggaattggaagctattgagtctagactggaaaagaccgagttcactttaaaagaggacctcactaagctcaaaacactcacggtgatgttcgtagacgagcggaaaaccatgtctgaaaagctcaagaaaaccgaagacaaactacaggcagccagctctcagctgcaagtcgagcaaaacaaagtaacaaccgtgaccgagaagctgatcgaagaaaccaaacgcgctctgaagtcaaaaaccgatgttgaggaaaaaatgtacagcgtgacaaaggagagggatgatctgaaaaataagcttaaagcggaggaagagaagggcaacgatcttcttagccgggtcaatatgttgaagaaccgcttacagtcattagaggccatagagaaggactttctgaaaaataaattgaaccaagactcaggaaagagcacgaccgctttgcatcaagagaataataagatcaaggagctgtcccaggaagtcgagcggttgaagctcaagttaaaggatatgaaagcgatcgaggacgatttgatgaagactgaggacgagtatgagaccctcgagcgtcggtatgccaatgagagggacaaggcccaatttctgagtaaggagctggaacatgtcaagatggaactggcgaaatataagttagcagaaaagaccgagaccagtcacgagcagtggcttttcaaaaggttgcaggaggaggaagcaaaaagcggacatctttcgcgtgaggtcgatgccctaaaagaaaaaatccacgagtacatggctacagaagacctcatctgtcatctgcaaggtgatcacagcgtcctgcaaaaaaaactcaaccagcaagagaaccgcaaccgcgatctcggcagagagatcgagaacctgactaaggagctcgaaagataccgccacttctcaaagtctctgaggccatcactcaatggccgcaggatttcagatccccaagttttctcaaaagaggtccagaccgaggcggtggacaatgagccacctgattacaaaagcttaataccccttgagagagctgtcatcaatggacagctgtatgaagaaagtgagaatcaggatgaagatcccaatgacgagggctcggtcctgtcttttaaatgtagccagagcacgccatgtcccgtgaaccgcaagctatggattccatggatgaagtctaaagagggacatctgcaaaacggaaagatgcagaccaagcccaatgccaattttgtgcagcccggtgacctggtgcttagtcatacaccagggcagcccttacacatcaaggtcacaccagatcacgtgcaaaacaccgcaacactcgagataacttctcccactactgagtccccacactcttacacttccacagcagtcattcctaactgcggtaccccaaaacagagaattactatactccaaaacgcaagcatcactcccgtcaaaagcaaaacgtctacggaggatctgatgaacttggagcagggcatgagtccgatcaccatggccacatttgctcgagcccagacccccgagagttgcggttccttgactcccgaacggaccatgtctccaattcaagtgctagccgttacgggatccgcaagcagtccggagcagggcaggagcccagaacccacagagatctcagccaaacatgccattttccgtgtgagtcccgaccggcagagtagctggcaatttcaaaggtctaacagcaatagcagcagcgttatcaccaccgaggacaacaagatccacatacacctgggaagtccttacatgcaggcagtggccagtcccgtccgacctgctagtccttccgctccactgcaggataaccggacccagggactgatcaacggggcactgaataaaacaacaaataaggttacttcgtcaataaccattaccccgacagccacgcctctgccacgccagtcccagatcacagtgagcaacatctataactag

SEQ ID NO: 117138 - DNA, 3408 bp, Artificial Sequence
  Description of Artificial Sequence: Synthetic coding sequence
atgaggtctcgaggtagcgatactgaaggcagcgcccagaaaaaattccctcgccacacgaagggacattcttttcaaggcccaaaaaatatgaaacatagacagcaagacaaggatagcccaagtgaatctgatgttattctcccctgccccaaagcggagaagccacactccggaaacggccatcaggccgaggatctgtcaagggatgatctgctgtttcttctttcaattttggaaggcgaactgcaggcccgggacgaggtgatcggcattctaaaggccgaaaaaatggacctggcgcttctggaagcccagtacggctttgtcaccccaaaaaaggtgctggaggccttacagcgggacgcatttcaagcaaagtccactccttggcaagaagatatctatgagaaaccgatgaacgaactggataaggtggtggaaaagcacaaagaaagttataggcgcatccttggccagcttttagtcgcagaaaaaagtagacgccagacaatccttgagttagaggaggagaaacgcaaacataaggagtacatggagaagtctgacgaattcatctgtctcttggagcaggaatgtgaacgtttgaaaaagctgattgatcaggaaatcaagagtcaggaagaaaaggaacaggagaaagagaaacgcgtcacaactttgaaagaagagttaacgaaactcaagtccttcgctctcatggtcgttgatgagcagcagcggttgacagcgcaactaacactgcaaagacaaaaaattcaggagctgaccaccaacgcgaaggagacccataccaaacttgctctcgccgaggcgagagtgcaagaggaagagcagaaagctacaaggctggaaaaggagttacagacccaaactacgaagttccatcaggaccaggacacaatcatggctaagctaacaaacgaagactctcaaaacaggcagttgcagcaaaagttggccgccttgtcgagacagatcgatgagttggaggagacaaacaggagtttacgtaaagcggaggaagagctccaggacatcaaggagaagatctcaaaaggcgaatatgggaatgctggaatcatggctgaagttgaagagctgaggaagcgagttctggatatggagggaaaagacgaagaactgattaagatggaagaacagtgtagggatttaaacaaaagactggaaagagaaaccctgcagagtaaagactttaaactggaagtcgaaaagctgagtaaacgcatcatggccctggaaaaactggaagacgcatttaataagtctaagcaggagtgttattccctgaaatgcaacctcgaaaaggaaaggatgaccactaagcagctctctcaggagctggaatccctcaaggttaggataaaagaactcgaagccatagaatcccggttagaaaaaaccgagttcaccctgaaggaagacttaactaagctgaagaccctcacggtgatgttcgtggatgagcgtaagaccatgagcgagaaacttaagaagaccgaagataagttgcaggctgcctcatctcaactgcaggtggagcagaataaggtgaccactgtgaccgaaaagctaatcgaagagaccaaaagagctctaaagtcgaagacagatgtcgaggaaaaaatgtatagtgtcaccaaagagcgcgacgacctcaaaaataaactgaaagccgaggaggagaagggcaatgatctgctctctagggtaaacatgctcaagaatagactccagtccctcgaagcgattgaaaaagattttttgaaaaataagcttaatcaagatagcggtaagagcaccaccgcactccatcaggagaataacaaaattaaagagctgagccaggaggtagagcgcctgaagttaaagctgaaagatatgaaagccatcgaagacgatttgatgaaaaccgaagacgagtacgagactcttgagcgtagatacgcaaatgagcgtgataaagctcagtttctgagtaaggaactcgagcatgtcaaaatggaactagctaagtacaagttagccgagaaaaccgaaacaagccacgagcagtggcttttcaagcgcctgcaggaagaggaggctaagtcgggacatctctcccgagaagtggacgccctaaaagaaaagatccacgagtacatggccaccgaagatctgatctgccatttgcagggagatcactcagtcctgcagaaaaagctcaaccaacaagagaacagaaacagagatctcggaagagaaattgaaaatctgactaaggagttggaaaggtacagacacttctctaagtcgctcaggccaagtctcaacggccgaagaatctctgatccgcaagtgtttagcaaggaggtgcagactgaggccgttgacaacgaaccaccagattataaaagcctgattccactggaacgggccgtgatcaatgggcaactctacgaagagtcagaaaatcaggacgaagaccccaatgacgaaggcagcgtgctttcgtttaaatgtagtcagtcaacaccgtgccctgtgaataggaaactgtggataccttggatgaagtccaaagagggtcacctgcagaatgggaagatgcagaccaaacctaatgctaacttcgttcagccaggtgacttggttttatcccacaccccaggtcagcctctacatattaaagtgactccagaccatgttcaaaataccgctaccctcgagatcacaagtccaacaacagaatccccacatagctacacaagcaccgccgtaattcccaattgcgggacccctaagcagagaatcacgattctgcaaaatgcgagtattacccctgtgaagtctaagacgagtactgaagacttgatgaatctcgaacagggaatgtcccctatcacaatggccacattcgcccgtgcccagacccccgagtcttgcggtagcttgacacctgagcgtactatgtctcctatccaggtcctagccgttactggctcagccagcagccctgaacagggccgaagtccagagcccacagagattagtgccaaacatgcgatttttagagtgtctccagacaggcagtcatcctggcagttccaaaggtctaatagcaacagtagctcagtcattactactgaagataataagatccatattcaccttggaagtccctatatgcaggctgtcgcatctcctgttaggcccgcatctccgtccgccccactccaggacaacagaacacaggggctcataaacggcgcgctgaacaaaaccacaaacaaggtgacttcaagcattaccattacgcctacagctacaccgttaccaagacagtcccagataaccgtggaaccgcttctgctgccccactag

SEQ ID NO: 117139 - DNA, 2682 bp, Artificial Sequence
  Description of Artificial Sequence: Synthetic coding sequence
atggtggtggatgagcagcagcgtctgacagcgcaactgaccttacagcggcagaaaatccaagaactgactaccaatgctaaagagacgcacaccaagcttgccttggcggaagctcgggttcaggaggaggagcagaaggctacgcgcctcgagaaggagctgcagacgcagacaacaaaatttcaccaggaccaggacaccataatggctaaattgacaaatgaggacagccagaataggcaattgcagcaaaagcttgctgcccttagccggcagatcgacgagctggaggagaccaatcggagcctgcgcaaggcagaggaggagttacaggacattaaggaaaaaatctctaagggcgaatacggtaacgccggcattatggcagaggtggaagagttgagaaagcgagtgctggacatggaaggaaaggacgaagagttgattaaaatggaggagcaatgcagagacttaaataagcgactggaacgggagactttgcagagtaaagactttaagttagaggtcgagaaactgagtaaaaggatcatggcattggagaaactggaggacgcttttaacaagtcaaaacaggagtgttactccttaaagtgcaacctcgagaaagagcgcatgacaacaaagcagctctctcaagaactcgaaagcctgaaggtaagaatcaaggagttagaggcaatcgaaagtcgcctggagaagacggagttcacactgaaggaggatctgacgaagctcaaaacactgaccgtcatgtttgtggacgagcgtaagacaatgtcggaaaagctgaaaaagacagaggataaattgcaggcagctagcagccagcttcaggtggagcagaataaagtgacgacagtcacggagaagttaatcgaagagacaaagagagccctgaaatccaaaaccgatgtcgaagagaagatgtactccgtgaccaaagaacgagatgacttaaaaaacaaattgaaagccgaggaggagaaagggaatgacctcctgtcacgggtcaacatgctcaagaaccggcttcagtctctagaggcgattgaaaaagacttcctcaaaaataaactgaaccaggattctggtaaaagtacaactgcccttcaccaagaaaataacaaaattaaagaactatcacaagaagtggaaagactcaagcttaagcttaaagacatgaaggccatcgaagacgatctcatgaagaccgaggatgaatatgagactctcgaaagaagatacgccaatgaaagagacaaagcacagttcctcagcaaagaactggaacatgtgaaaatggagctggccaagtacaaattggctgaaaagactgagacgtcgcatgaacagtggctgtttaagagactccaagaggaagaggccaaaagcggacacctctcccgagaggtcgacgcactgaaagagaagattcatgagtatatggccactgaggacttaatatgtcacctgcagggggatcatagcgtgttgcagaagaagttgaaccagcaggagaaccggaaccgtgatctcggccgtgaaatagagaacttgaccaaggaactggaaagatacaggcacttcagcaaaagcttgaggccctctttgaatggccggaggataagtgacccacaagtattttccaaggaggtgcaaacagaggccgtggataacgaacccccggattataaatctctgatcccactggaaagagccgtgatcaacggccagttgtatgaggagtcagaaaatcaggatgaggacccgaatgacgagggaagtgttctttcctttaagtgtagccagtccacaccatgtccagtgaatcgaaaactctggataccttggatgaagtccaaagaaggacaccttcagaatggcaagatgcagaccaaacctaacgcaaatttcgtgcaaccaggtgatttggtgcttagccatacgccaggccaaccgctgcacattaaggttactcctgaccacgtacagaataccgcaacgctagagataacaagtcctaccacagagtccccccattcctacacatcaacagctgtcattcctaactgtggaacccccaagcagcggatcacaatcctgcagaacgcgagtataacgcctgtgaagtcaaagacctctacagaggatctcatgaatttggagcagggaatgtcacctataactatggcaactttcgcccgggcccagacgccggaaagctgcggatctctgactcctgagcgtaccatgtccccaattcaggtgctggccgtaactggaagcgcctctagccctgagcagggcaggagtccggagccgactgagatcagtgccaagcatgctatcttccgggtttctccagacaggcagtcgagttggcaattccagaggtctaacagtaattctagttctgtgataactacggaagataataagattcatatacacctcggaagtccctatatgcaggcagtggcgtcccccgtccgccccgcatcccctagcgcacctctgcaagacaacagaacacagggattgatcaatggagcactgaataagaccaccaacaaggtaacctcttctatcacaattacacccacagcaaccccactgccacggcagtcacaaatcaccgtctccaatatttacaactag

SEQ ID NO: 117140 - DNA, 768 bp, Artificial Sequence
  Description of Artificial Sequence: Synthetic coding sequence
atgcgttccagaggatccgatacagagggatcagcccagaagaaattcccccggcacaccaagggccactcatttcagggccctaaaaatatgaagcaccggcaacaggacaaggatagcccatctgaatctgacgtcatattgccgtgcccgaaagctgaaaagccccactctggcaacggacatcaagcggaggatctgagcagggatgacctgttgttcctattgtcaattcttgaaggtgaacttcaggcccgggacgaggtcatcggtatcctgaaagccgagaaaatggatctggcactgctggaggcacaatacgggttcgtaactcccaaaaaagtcctcgaagctttgcagagggatgccttccaggccaaatcgacgccatggcaagaggacatttacgagaagccaatgaacgaactggacaaagtggtagaaaaacacaaagagtcttatcggcggattttgggccagctactggtggcagagaagagtcggcggcagaccatattggaacttgaggaggagaagcgcaagcacaaagaatacatggaaaagagtgacgaattcatctgcttgttggaacaggagtgtgaacggtggtcactggctcttctgcctaggctggagtgtaatgggatgatcttggcccattgtaacctctgtctgctcggcagtagtgattcgcctgccagtgccttccaggtagcggggatcactggtaccaggcatcatgcccagttagtgttcgtctttctttag

SEQ ID NO: 117141 - DNA, 2640 bp, Artificial Sequence
  Description of Artificial Sequence: Synthetic coding sequence
atggtcgtggatgaacagcagagactgacagctcagcttactctgcagaggcagaagatccaggagttgaccacaaacgctaaagaaacacacaccaagctggcacttgccgaggcgagggttcaagaagaggagcaaaaggcaacaaggctcgagaaggagctgcagacgcagacgaccaagttccatcaagaccaggacacaattatggcaaaactgactaacgaggactctcagaatcgtcaactgcaacagaaactggccgctctctctaggcagattgatgagctagaagaaacgaacagaagtcttcggaaagcggaggaggagctccaggatattaaagaaaagataagcaagggtgagtacggcaacgcaggtatcatggctgaagtcgaggagctgatcaagatggaagaacaatgcagagatctaaataagagactggaaagagagacattacaatcaaaggacttcaaactagaagtagaaaagctctccaaaaggatcatggccttagaaaaactggaggatgccttcaacaagtctaaacaggaatgctactctctgaagtgtaatctggagaaagagaggatgactaccaagcagctgagccaggagctagagtcactgaaagtcagaataaaagagttagaggccattgaaagccggcttgagaagactgaattcacgctgaaagaggatctgacaaagctgaagacactgactgtgatgttcgtggacgagagaaagactatgtctgagaagctcaaaaaaaccgaggacaagcttcaggcggccagttcccagctgcaagtggagcaaaacaaggtgacaacagtaacagagaagctgatcgaagaaaccaagcgtgcccttaagagcaagaccgatgttgaagaaaaaatgtattccgtgacaaaggagcgagacgatctaaaaaataagttgaaagctgaagaggagaaaggcaatgatctcctgtctcgggtgaatatgctgaaaaatcgcctgcaatcacttgaagctattgagaaggacttcctgaagaacaaacttaaccaggactcaggtaaaagtaccacagccctccaccaggagaataacaaaatcaaggaactgtctcaagaggtggagaggttaaaactcaagctgaaggacatgaaagccattgaggacgatctgatgaaaacagaggacgagtacgaaactctggaacggaggtatgccaacgaaagagataaggcccagtttctgagcaaagaactggaacatgtaaagatggagctggccaaatacaaactcgccgaaaagacagaaacaagtcacgagcaatggctgtttaaacgattgcaggaggaggaggcaaaatcgggccacctgagccgtgaagtggatgcattaaaagagaagattcatgagtacatggcaactgaagacttgatttgccatctgcagggcgaccactccgtacttcagaagaagctgaatcagcaagagaacagaaaccgggatcttggccgggagatcgaaaatctgacaaaagagctcgaacgataccggcatttttctaaaagcctgcgcccaagtcttaacggaagaaggatctccgaccctcaggtgttttccaaagaagttcagactgaagccgtggacaatgaacctccagattataagtcgctgattcctttggagagggctgtgattaatggacagctgtacgaagagtccgagaaccaggacgaggatccaaacgacgagggtagtgtgctcagctttaaatgctctcagtctaccccttgcccagttaatcgaaagctctggataccctggatgaagtctaaagaaggacacttgcagaacgggaagatgcagaccaagcccaacgctaactttgttcagccgggagatcttgtgctttcacatacacctggacaaccgctgcatattaaagtgacccctgatcacgttcagaatacagcaaccttggagatcacctccccaacaactgagtctcctcatagctatacatctacggctgtgattcctaattgcgggacccctaagcaaagaattacgatcctccagaatgctagcattactccagtaaagagcaagacctctaccgaagatttaatgaacctagagcaaggcatgagccccatcacaatggcgacatttgctcgggcccagactccagagagctgtggaagtttgacccctgagaggacaatgtcccctatccaagtcctcgcagtcacgggatccgcatcatcccctgagcagggcaggagtccggaacctactgagatcagcgcgaagcacgccatctttcgtgtgtcccccgataggcaaagctcatggcagttccagcgtagtaacagcaattcttctagcgtgataacaaccgaagacaataaaatccacatccacttagggtctccctacatgcaggctgtcgccagccccgtgcggcccgccagtccgtctgctccattacaggacaataggacacagggactcattaatggagctttaaataagactaccaataaagtgacatcctcaattactatcactccaacagctaccccactacctcgtcagagtcagattaccgtctccaacatttataactag

SEQ ID NO: 117142 - DNA, 2688 bp, Artificial Sequence
  Description of Artificial Sequence: Synthetic coding sequence
atggtagtggacgaacagcagcgtctaacggctcagctgaccctgcaacgccagaaaatccaggagttaacaacgaacgccaaggaaacgcatacaaagcttgctctggccgaggccagggttcaggaagaagagcagaaagcaacacgcctggagaaggaactgcagacccagacaacaaagtttcaccaggatcaggatacaataatggctaaactgactaacgaggacagccaaaaccgacagctccagcagaagctcgccgccctcagcagacagattgatgaattggaggaaaccaaccggtctttgaggaaggctgaagaagagctacaagatattaaggagaagatttctaaaggtgagtacggaaatgcaggcatcatggctgaggtcgaagagttaagaaaacgggtgttggacatggaggggaaagatgaggagctgattaagatggaggaacagtgtcgagacttgaacaaaagattggaaagagagactctccagagcaaagatttcaagctcgaagtggaaaagttgagcaaacgaatcatggccctggagaagctggaggatgcttttaataagtcaaagcaggaatgttactccctcaaatgcaatcttgagaaggagaggatgaccacgaagcagttgagccaggagctggagtcccttaaggtgcgaattaaggaactggaggccattgagtcgaggctcgaaaagaccgaatttactttgaaagaggatctcaccaagctcaagacattaactgtgatgtttgtcgacgagaggaaaacgatgagtgagaagcttaagaaaactgaagataaactccaggccgctagcagtcagctgcaggtggaacagaataaggttaccaccgtgactgaaaaactgattgaggagacaaaaagagctttaaaaagcaagacagatgtagaggaaaagatgtactctgtgacaaaagaacgcgacgacttgaagaataagttgaaggcagaagaagagaaaggaaacgatctcctgagtcgcgttaacatgctcaagaaccggctccagtccttggaggccatagagaaggattttctcaagaacaaactcaaccaggactcaggcaagtccaccacagcgttgcaccaagagaacaataagattaaagaactgagccaggaagtggagaggttgaaactcaagcttaaagatatgaaggccatcgaggacgatctgatgaaaacagaggacgaatacgaaaccctcgagcgcaggtacgccaatgaaagagacaaggctcaattcttaagcaaggagcttgagcacgtgaaaatggagctggcaaaatacaaactggccgaaaaaacggagacatcgcatgagcaatggcttttcaaaaggctccaagaagaagaggccaagagcgggcacctgtctcgcgaagtggacgccctgaaagagaaaatccacgagtacatggccacagaagatctgatttgccatttgcaaggagatcactctgtgctacaaaaaaaactcaatcaacaggagaacaggaaccgggatctgggtcgagagattgaaaacctcacgaaagagctggagagataccgtcatttctctaaaagcctgagaccctcactgaatgggcgtcggatttcagacccacaggtgttcagcaaagaggtgcagactgaagcagttgacaatgaaccacctgactataaatcccttattccgctcgaacgcgcagtgatcaacgggcaactgtacgaggaaagcgagaaccaagatgaagacccaaacgacgaggggtccgtactgtcatttaaatgctctcagtctacaccctgtcccgtgaataggaagctatggatcccatggatgaaatcaaaggagggccatctccagaatggtaaaatgcagacgaaacctaacgccaatttcgtccagccaggagatctcgttttgtctcatacacctggccagccactgcacatcaaggtcacccctgaccacgtgcagaacacagccaccctagagatcacgagccctactacagaatctccccatagctatacgtccactgccgtcattccaaattgcggaactcctaaacagagaattactatccttcaaaatgcttccatcacccccgtgaaaagtaagacaagtacagaagacctgatgaaccttgaacaaggaatgagtccgattaccatggctacatttgctagagcacagacccccgagagttgtgggagtctgacaccagaacggaccatgtctccaatccaggtacttgccgtgacaggctcggcaagctccccagagcaaggcagatctcccgagccgaccgagatctccgccaagcacgcaatttttcgcgtgtctcccgaccgccagagtagttggcaattccagcgcagcaattctaacagctcatctgtcattactaccgaagacaacaaaatccatatccacttaggcagtccgtacatgcaggcggtggcatcccccgtgcgaccagcttcgcctagcgcacctctgcaggacaaccggacccaaggcctgataaacggtgccctaaacaagactactaacaaagtcacctcgagtattacaatcaccccaacagctaccccattacctcggcaaagccagatcacagtggaaccactgcttcttcctcattag

SEQ ID NO: 117143 - DNA, 2136 bp, Artificial Sequence
  Description of Artificial Sequence: Synthetic coding sequence
atggcgctggaaaaacttgaggatgcgttcaataaatctaagcaggagtgctattcgctaaaatgtaacctggaaaaagagcggatgaccactaagcagctatcacaggagttggaaagtctaaaagtgagaatcaaggagcttgaagcaatcgagtcccgacttgaaaaaacagaatttacattaaaagaagatttaactaaactgaaaaccctcactgttatgttcgtggatgagcgaaaaaccatgagcgaaaaattgaagaagaccgaggacaagctccaggctgcctcaagtcagctgcaggtggaacagaacaaagttaccaccgtcaccgaaaagctgatcgaggaaaccaaacgggccttaaaaagcaagactgatgttgaggagaaaatgtactcggtgaccaaggaacgcgacgacctcaagaataagctaaaagctgaagaagaaaagggcaatgacctcctgagtagggtgaacatgctcaagaaccgcctccagagcttggaggccattgaaaaagattttttaaaaaacaaacttaatcaggactcaggcaaatccactactgcgcttcatcaagaaaataataagattaaggagctttcacaggaggtcgagaggctgaagctgaagttaaaagacatgaaagccatcgaagatgacctcatgaagacagaagacgaatacgaaacgctggaacggagatacgccaacgaaagggataaggcccagtttctcagtaaggagctcgaacacgtgaaaatggagttggcaaagtacaagttggctgagaaaacagagaccagtcacgagcagtggctctttaagcgtctccaagaggaggaagctaagagtggccacctttcccgtgaagtggacgccctcaaagaaaaaattcatgagtatatggcaactgaggaccttatctgtcatctgcagggggatcattctgtgctgcagaagaaattaaatcagcaagagaacagaaatcgtgatttgggtagggaaatagagaatctaactaaagagcttgagcggtatcggcatttctctaaaagcctaagaccaagcctgaatgggagaagaatttcagatccacaggtcttctcaaaggaagtgcagaccgaagccgtggacaatgaaccaccggactacaaatcccttattcccttggagagagccgtgataaatggacagctgtacgaagaaagtgagaatcaggacgaggatccaaacgatgagggctcggtcctcagtttcaagtgctcgcagtctacaccatgtcctgtcaaccgtaaactctggattccatggatgaagtccaaggaagggcatcttcagaacggcaaaatgcagacaaagcctaatgccaatttcgtgcagcccggcgatttagttctctctcacactccaggccagcctctgcatatcaaggtcaccccagaccacgtgcagaacaccgcaaccctcgaaattacaagtccaacaaccgagagcccgcatagttatacctctaccgctgtgatccctaactgcggcactccaaagcagcggatcacaatactgcagaatgcaagtatcaccccggtcaaatcgaagacatctacggaagatctgatgaacttggaacagggtatgagcccaatcacaatggctacattcgccagagctcagactccggaaagctgtggctcgctcactcccgaacggactatgagccctattcaggttctcgccgtcactggcagtgcctcatcacctgagcagggcagatcccccgagccaaccgagatctctgccaaacatgctatttttcgcgtgtccccggaccgccagtcttcatggcaatttcaaaggtcaaactccaactcctcaagtgtgatcaccacagaggataataagattcacattcacctcgggagcccttacatgcaagccgtggcctcgcctgtgcgccctgcaagtccatctgctccactccaggacaaccggacacaggggctgataaacggggccttaaataagacaacaaacaaggtgacctccagcatcaccattactcctaccgctaccccacttccgaggcagtcccagataaccgtggagcccctactgctccctcattag

SEQ ID NO: 117144 - DNA, 2514 bp, Artificial Sequence
  Description of Artificial Sequence: Synthetic coding sequence
atggtggtcgacgagcagcagcgcttaaccgcccagctgaccctgcagcgacagaagatccaggaactgacaactaacgccaaagagacacacacaaaactagccctcgctgaggcaagagttcaggaggaggagcagaaggctacccggctggaaaaggagctgcagacccagacaaccaagtttcaccaggaccaggatactattatggccaaactaaccaacgaagactcacagaaccgtcagctgcagcagaaactggccgccctatcccgccagattgacgagctggaggagacaaacagatccttgcgcaaggcggaagaggaactgcaggatattaaagagaaaatttcgaaaggggaatacggcaatgccggcattatggcagaggtcgaagagctgcgcaaacgtgttctggacatggaaggaaaggacgaggagttgatcaagatggaagaacagtgtagagacctgaacaagcgacttgagcgcgagacactccaaagcaaggacttcaagctggaagtggaaaagctctctaagcgtatcatggctctggaaaagctggaggatgccttcaacaaaagtaaacaggagtgctacagtctcaaatgcaatctcgaaaaagagcggatgactactaagcagctcagtcaggagctcgaaagcctgaaggttaggatcaaagagcttgaggccatcgagagccgtctggaaaagaccgaatttaccctgaaggaagacctcacgaaattgaaaactctgaccgtgatgttcgtcgacgagaggaagacgatgtccgagaaactgaagaaaacagaagataaactgcaggcagcatcgagccagctacaggtggagcagaacaaagtgaccactgtgactgaaaaactgatagaagaaacaaagcgagctctgaaaagcaagactgatgtggaagagaaaatgtacagcgtgaccaaagaacgtgatgatttgaagaacaaactcaaggccgaggaggagaaggggaatgacctcctgtctagagttaatatgctaaagaacaggctgcagtctctggaagccatcgaaaaggactttctgaaaaataagctgaaccaagattctggtaagtctacaacagctctccaccaggagaacaacaaaattaaggagttgtcccaggaggtggagcgcctgaagctgaagctcaaagacatgaaagccatcgaggacgatctgatgaagaccgaagacgaatacgagacacttgaaaggcgttatgctaatgagagagacaaggctcagttcctctccaaggagctggagcatgttaagatggaactggctaagtacaagctggcagaaaagactgagacaagccacgaacaatggctctttaagcggcttcaggaagaggaggctaaatctggtcatctgtcacgcgaggtagatgcactgaaggaaaaaatacatgaatatatggctactgaggatctgatctgtcatctgcagggtgatcacagtgtcctgcagaagaagctcaatcagcaggaaaatcgcaatcgggacttgggccgggaaatcgagaatttaacgaaagagctggagaggtaccgacactttagtaagtccctgcgccccagcctgaatggacgcagaatcagcgatccgcaggtattctcaaaggaggttcagacagaagccgtcgataatgagccccccgattataagtccttgattcccctggagagagcggtcattaacggtcaactgtacgaggagagcgagaatcaagacgaagatcctaatgatgaggggagcgtgctcagttttaaatgcagtcagtccaccccctgccctgtcaatcgaaagctctggatcccctggatgaaatcaaaggaggggcacctgcagaatggtaaaatgcaaacgaagccaaacgccaatttcgtccagcccggtgatctcgtcctatcgcacaccccagggcagcctttacacataaaggtcacacctgaccatgtccaaaatacagctacactcgaaattacaagtcccactacagaatccccacatagctatacaagtactgctgtgattccaaactgcggtaccccaaaacaacggataacaatcctgcagaacgccagcataacaccggtgaaaagcaagacctccactgaagatctcatgaacctggagcagggcatgtctccaattacgatggctacattcgcacgcgcccagactcctgagtcttgcggttccctgacaccagagcggaccatgagcccaatccaagtgttggctgtgacaggctcagcctcaagccccgagcaaggccgctctccagagcccaccgagatctccgcaaaacacgccatcttcagagtgagccctgacaggcaaagtagttggcagtttcagaggagtaatagcaattcttcatcagtcattactacagaagataacaagattcacattcacttaggcagtccatacatgcaggctgtggcaagtccgtag

SEQ ID NO: 117145 - DNA, 7944 bp, Artificial Sequence
  Description of Artificial Sequence: Synthetic coding sequence
atgtctagtagccactctagggctggccaatccgcagcaggagccgccccgggtggcggggttgatacccgcgatgccgagatgcctgcaaccgaaaaggaccttgcagaggatgccccatggaaaaagattcagcagaatacatttacgaggtggtgcaatgaacatctcaagtgcgtgtcaaagcgcatagctaacctgcagaccgacctgagtgatgggctgagactcattgccctactcgaagtgttaagtcagaaaaaaatgcataggaagcacaaccagcgcccaactttccgtcagatgcagctggaaaatgtcagcgtcgctctggagttcctggatcgtgaaagtatcaaactggtgagcatcgatagtaaagccatcgtcgatggcaacttgaagctgatcctaggtctcatatggacgttgatcttacactattctatctccatgcccatgtgggacgaagaagaagatgaagaagcaaagaaacagactccaaaacaaaggttgctgggttggatccaaaataagcttcctcagctgccaatcaccaactttagccgggattggcagtctgggcgcgccctgggcgcgctggtggatagctgcgcccctggactctgcccagactgggatagctgggacgcctctaaacccgtgacaaacgctcgtgaggctatgcagcaggctgatgattggctcggaatcccgcaggtgattacgcccgaggaaattgtcgaccctaacgtcgacgaacattccgttatgacttacctgagccaatttcctaaagctaagctgaagccgggcgctcccctgagaccaaagttgaacccgaagaaggcacgggcctacggtcctggcattgaacctactgggaatatggttaagaagcgtgctgagttcacagttgaaacacgcagtgcgggccagggagaagtgctcgtgtatgtggaggatcccgcgggccaccaggaggaggcaaaagtgacggccaacaacgataagaatcgaacattctctgtgtggtatgtgcccgaagtcaccgggactcacaaagtgaccgttctgtttgcaggtcagcatattgctaagtcaccatttgaggtgtatgttgataagagccagggcgacgcatcaaaagtgaccgcacaaggccctggcttggagccatctggcaatatagcaaataagactacctattttgagatattcactgccggagctggcacaggcgaagtcgaagtcgtcatccaggaccccatgggccagaagggtaccgttgagccacaactggaggccaggggcgactccacttacagatgctcttatcaaccaaccatggaaggtgtgcacaccgtccatgtgaccttcgctggtgtccctataccccgaagcccatatactgttaccgtggggcaggcatgcaacccctcagcttgtagggccgtaggcaggggtctgcagccaaaaggggtacgggtgaaagagactgccgactttaaggtgtacactaaaggcgccggcagtggggagttgaaagttactgtaaaggggcccaaaggagaggaacgcgttaagcagaaagacctgggggatggagtctacggattcgagtactacccaatggtaccaggaacctacatagttacaatcacctggggcggccagaacatcggcagatcaccatttgaggtgaaagtggggaccgagtgtggcaaccaaaaagtgcgggcctggggaccgggactggagggaggagtggtgggaaagagcgccgacttcgtggtggaggcaattggggacgatgtcggaacactgggcttttccgtagagggcccaagtcaggcgaagatagagtgtgacgacaaaggtgacggatcctgcgacgtccgctattggccccaggaggcaggggagtacgctgtccacgtcctgtgtaacagtgaggatattagactctcgccctttatggctgacatacgggacgccccccaggactttcacccagaccgagtgaaggcccgaggacccgggctggagaaaaccggcgtggctgtgaacaagccagctgagttcactgtggatgccaagcatggtggcaaggcccccttgagggtgcaggtgcaggataacgaaggttgtcccgttgaggcgctcgtcaaagataatggcaacggaacctactcatgcagctacgtgccaaggaaaccagtgaaacacactgcaatggtctcttggggtggcgtctccatccctaatagtccttttagggtaaatgtgggagccgggagtcatcccaacaaagtcaaagtttacgggccgggtgtcgccaaaacggggctcaaggcccatgaaccaacatatttcaccgtggattgtgcagaggcaggacaaggtgatgtcagcattggcattaaatgtgctccaggcgtcgtggggcctgccgaggctgatattgatttcgacattattagaaatgacaatgatacctttaccgtcaagtacactccccgaggcgctggtagttatactatcatggtactgttcgccgaccaagctacccctacctcccccatccgggttaaggttgaacccagtcatgatgcctccaaggtgaaggctgaaggccctggtctgtcccgaactggcgtggagttagggaagcccacacacttcaccgttaacgcgaaagccgcggggaaggggaaattagatgtacagtttagtggcctcactaaaggggatgcagtcagagacgtggatatcattgatcaccacgacaacacctatactgttaaatataccccagtccagcaagggccggtgggcgtgaatgttacatatgggggtgacccaatccctaagagccccttctctgtggcagtctcgccctcactggatctgtccaagattaaggtgagtggattaggcgaaaaggtcgacgtgggtaaggaccaggagtttactgttaaatccaaaggcgccggaggacaggggaaagtcgcatcaaagatcgtcggcccgagcggcgctgccgtaccctgcaaagtcgagccaggtctaggagctgacaactccgtcgttaggttcctgcctagggaagagggcccctacgaggtggaagtgacctacgatggcgtcccagtccctggcagtccatttccacttgaagccgttgctcctaccaagcctagtaaggtgaaggccttcgggccgggcctgcagggtggatcggctgggtcccctgcccgcttcacaattgataccaagggggcggggaccggcggcttaggtctcactgtggaggggccttgcgaagcacaactagaatgtctggacaacggagacgggacgtgcagcgtgagttatgtacccaccgagcctggcgactataacatcaatatcttgttcgccgatacacatatacccggatctcccttcaaggctcacgtagtaccttgttttgacgcttctaaggtcaagtgcagcggcccgggactcgaacgcgcaaccgcaggagaggtcgggcaatttcaggtggattgcagctccgcaggctccgcggagttgacaatcgaaatctgtagtgaggcaggcttgcctgccgaggtgtatatacaggaccacggcgatggcacacacacaattacctatatacctctctgtccgggcgcatacacagtgaccatcaaatacggaggccagcccgtgccaaattttccctccaagctgcaggtggaacctgccgtagacacctctggagtgcagtgctacgggcctggcatcgaaggccagggcgtttttagagaagcaacaactgagttttccgtcgacgcccgcgctctgacccagacaggcggaccccatgtgaaagctcgcgtcgccaatccaagtggcaatctcaccgaaacttacgtccaggaccggggagatggtatgtacaaagtcgagtatactccttatgaagaggggcttcatagtgtcgatgttacttacgatggttctcccgtgccatcgtcgcctttccaggtgccagtcactgaagggtgcgatcctagtagggtgcgcgtgcacggtcctgggatccagagtggcaccaccaataagcctaacaagtttacggtcgaaacaaggggggctggcactggcggacttgggctggctgttgaagggccgtctgaggcgaagatgagctgtatggacaataaggatgggtcttgttctgtggagtacatcccatacgaggctggaacctatagtctcaatgtaacctatggtgggcatcaggtgcccgggtctccctttaaggtgcccgtgcatgacgttacagacgcaagtaaggtgaagtgttctggacctggcttgtcacctggcatggtgagggcaaacttgcctcagtcctttcaagttgatacgagtaaagcgggagtggcacccctacaagttaaggtacagggaccaaagggcctagtggaacccgtggatgtggttgataatgcggatgggacacagactgtaaactacgttccaagcagagagggcccttattcgatcagtgtgctttacggagatgaagaagtgcctagatctcccttcaaagtgaaggtgctacctacccatgatgccagtaaagtaaaggcatcgggtcccgggctgaacacgactggcgtgcccgcatctctcccagtggaatttacaatcgacgccaaggacgctggtgaggggctgctcgcggtccagataaccgacccggagggtaagcccaaaaagacacacatacaagataatcacgatggaacttatactgtggcctacgtgcctgacgtcaccggacgctataccatcctgatcaaatacgggggcgacgaaattcctttctctccgtaccgggtacgcgccgtacccaccggggatgcatcaaagtgtacagtgaccgtgtcgattggtggccacggtctcggcgccggtatcggacccactatccaaattggggaagagacggtgatcactgtggacacaaaagctgcaggtaagggtaaagttacttgcactgtgtgtacacccgacgggtctgaggtcgacgtggatgtcgtagagaacgaggatggcacattcgacattttctacacggcgccccaacctgggaaatacgtgatttgcgtgcgattcggcggcgagcatgtccctaacagcccttttcaagtaaccgctttagctggtgatcagcccagcgttcagccacctctgcgaagtcagcaactggcccctcagtatacgtacgcccagggaggccagcagacctgggcgcccgaaaggcccctcgtcggtgtcaatggcctggatgtcacatccttgcgcccattcgacctggtaataccgtttacgataaaaaaaggggagataactggagaggtccgcatgccgtctggcaaagttgcgcaaccaaccatcactgacaataaggacggaacagttaccgtgaggtacgccccgtcagaggccggactgcacgagatggatatacgctatgataacatgcatatacctggctctccattgcaattttacgtcgattatgttaattgcggacatgtgacggcgtatggtcctggtctgacacacggcgtggttaataaacccgcaaccttcaccgtcaacacgaaggatgcgggtgaaggaggattatctctggcaatcgagggcccttctaaagctgaaatctcctgcacagacaatcaggatggtacttgcagcgtcagttatctccccgtgttgcccggcgactactccattctggtgaagtacaacgagcagcacgtcccaggttctccttttacagcgcgcgtcactggcgacgattccatgagaatgagccacttaaaagtggggagcgcggcagatattcccataaacatctccgagacagacctatcactccttactgcaacagttgttccgccaagtggaagggaggagccctgcctgttaaagcgcctgaggaatgggcatgttggcatttccttcgtcccaaaggaaacaggagagcatctggtacatgtcaagaagaacgggcagcacgtggccagcagccccatccctgtggtgatcagccagtcagaaatcggcgacgcctcccgagtgcgagtcagcggacagggcctgcacgagggccataccttcgaacctgcggagtttattatcgacacaagagatgcaggctatggaggcctgagcttgtccattgaaggacccagcaaagttgacataaacacagaagatctggaggatggaacatgcagggtaacttactgccctaccgaacctgggaactacattatcaatatcaaattcgccgatcagcatgttccaggcagtccattttcggtaaaggtgactggtgagggtagggtgaaggagtctatcaccaggagaaggagagccccgtcggtcgctaacgtcggctcccattgtgatctgagcctcaaaatccctgagatatctatacaggatatgacagcccaggtcacatctccctccgggaaaacacacgaggccgaaatcgtcgaaggggagaatcacacatactgtatccgtttcgtgccggctgagatgggaacccatacagtctcagtgaagtacaagggccagcacgtccccggctcaccgtttcaattcacagtgggaccattgggggagggaggcgctcacaaagtacgggctggcggtcccggactggaaagggctgaggccggagtacctgcagaatttagcatctggacacgagaagccggcgccggtggattagctattgccgtcgagggaccgtctaaggccgagattagcttcgaggaccgaaaagacggcagttgcggcgtggcctatgtggtgcaggagcctggagactatgaggttagcgtgaaatttaacgaggaacacattccagatagcccattcgtcgtcccagtggcttccccttccggagacgcccgacgcctaacggtgtcttcccttcaggaatcaggtctgaaagtgaaccagcctgcatccttcgctgtctctttgaatggcgcaaaaggagcaatagatgccaaggtacatagcccctccggcgcactcgaggaatgctatgtcactgagattgaccaggataagtatgccgtccgcttcattccaagagagaacggagtctatctgatagacgtaaagttcaatggtacacatattcccggctcaccattcaagatccgggtgggtgaacctggacacgggggcgatcccgggctggtgtcagcatacggggcgggcctcgaaggcggagtgaccgggaaccctgccgagtttgtggtgaataccagtaacgcaggagccggggctctgagtgtcacgatagacgggccttcaaaagtcaaaatggattgtcaagaatgtcctgagggctacagagtgacttatacacccatggctcctggcagctatctcatctcgatcaagtacggcgggccttaccacatcggtgggtcgccctttaaagccaaggttacaggacccaggctcgtttcaaatcactcacttcatgaaacatcgagcgtattcgtcgatagtctgactaaggcaacttgcgcccctcagcatggggcccctggtcctggccccgccgacgcttctaaagttgttgccaagggcctcggactttccaaggcctacgttggtcagaaaagtagctttacagtcgattgctcgaaagccggcaataacatgttgctcgtgggtgtgcatggccccagaaccccctgcgaagagattctggtaaagcacgtcgggagccggctctatagcgtttcataccttctcaaagataagggtgagtataccctagtcgtcaaatggggggacgagcatattcctggctctccctaccgggtcgtagtgccctag

SEQ ID NO: 117146 - DNA, 6948 bp, Artificial Sequence
  Description of Artificial Sequence: Synthetic coding sequence
atgcccgccacagaaaaggatctggccgaagatgctccatggaaaaaaattcaacagaatactttcactcggtggtgcaatgagcatcttaagtgcgtgtccaagaggatagcaaacttgcagaccgatctctccgatggattgcgcctcattgctctcctggaggtcctatctcagaagaagatgcatcggaagcataaccagcggccaactttcagacagatgcaactggagaatgtgtccgtggctctggaattcttggatcgggagtcaatcaagttggtaagcatagactccaaggctatcgtggatggtaacctcaaactgatccttggactcatttggacactgatcctgcattattctattagcatgccaatgtgggatgaggaggaagatgaagaggctaaaaagcagacccctaaacagaggcttctgggctggatacagaataagctgcctcaactgcccattaccaactttagccgcgactggcagagcgggagagcgctgggggccctggtcgacagttgtgctcctggtctctgccccgactgggatagctgggacgcatctaagccagtgacaaacgctcgcgaggctatgcagcaggctgacgattggttgggcatcccccaggtcattacaccagaagagatcgtggaccccaacgtggatgagcattcagtgatgacatacctttctcaatttcccaaagcaaagctgaaacctggggcacctttgaggcctaaactgaatcccaaaaaggcgagggcctatggtcctggcatcgaaccaactgggaacatggtcaaaaagagggccgagttcacagtcgagaccaggtcagccggacagggggaggtgctggtctacgttgaggatccagctggacatcaggaagaggcaaaggttacagccaacaatgataaaaacaggacgttcagcgtctggtatgtaccggaagtcaccggtacccataaggtaaccgtcctgtttgccgggcagcacatagcaaaaagtcctttcgaggtttatgtggacaagtcacagggagacgcaagcaaggtaactgctcaagggcccgggcttgagccctctggtaatattgccaataaaacaacctattttgagatctttaccgccggggccggcacgggtgaagttgaggtcgtgattcaagatccaatggggcagaagggtactgtggaacctcagctggaagcccgcggagactctacttaccgctgttcatatcagccaaccatggaaggcgttcacacagtccacgtcacgtttgctggcgtgccaataccccggtctccatacacagtcacagtcgggcaggcctgtaaccctagcgcctgccgggccgtcgggcgcggtttacagcccaagggggtgcgagtcaaggagacagcggatttcaaagtgtacactaagggcgccggctctggtgagctcaaagtgactgtgaaaggtcccaaaggagaagagcgtgtaaaacaaaaagacctcggagacggggtctatggctttgagtactatccaatggtgccagggacgtatattgtaacaataacctggggaggtcagaacatcggacgctccccattcgaggtcaaggtcggaacagaatgtgggaatcagaaagtgcgagcttggggacccgggctggagggcggagtggtgggaaaatcagctgattttgtagtcgaggcaattggcgacgacgtgggaaccctgggctttagcgtagaaggccctagtcaggctaaaatcgaatgtgacgataagggggatggcagttgcgatgtgcggtattggccccaggaggccggcgagtacgctgtgcacgtgctctgtaacagtgaggacatccgcctgagtccatttatggcggacatccgagacgctcctcaagacttccaccctgacagggtgaaggcgcgagggccaggtctggagaaaactggagttgccgtgaacaagcctgccgaatttactgttgacgcaaaacatggaggcaaggctcccctcagagtgcaggttcaggataacgaggggtgtcctgtcgaggcactggttaaggacaacgggaacggcacatattcatgcagctatgttccccggaaaccagtgaagcatacggcaatggtgtcatggggcggggtgtctatacctaattccccgttccgcgttaacgtcggagccggaagccaccctaacaaggtgaaggtctacggaccgggagtcgctaagaccgggctgaaggcacatgaacctacctactttacagtcgactgtgcagaagctggccaaggggatgtcagcatcggcattaagtgtgcacctggagttgtggggcccgctgaggctgacatcgatttcgatattattaggaatgacaatgacacatttacagtaaagtatacaccaaggggggccgggagctatactattatggttcttttcgcggaccaggctacgccaacgtcaccaatcagggtgaaggtggaaccttcacacgacgcatccaaagtgaaggccgagggtcctggcctctccagaactggagtggaattagggaagccaacacacttcactgttaatgcaaaagccgccggaaaggggaaattggatgtccagttctcgggcctgaccaaaggcgacgccgtgcgggatgttgatattatagaccaccacgacaacacctacactgtgaaatacactccagtgcaacaggggcctgtgggcgtgaacgtgacgtacggaggggaccccattccaaaatccccattttccgtggccgtcagccctagccttgatctatcaaagattaaggtgtcgggactgggcgagaaggtggacgtgggaaaggatcaagaatttaccgtcaaaagcaagggcgccggtggccaagggaaagtagccagcaagatcgtgggcccatctggcgctgccgtgccatgcaaagttgagccgggtttgggcgctgataattctgtggtcagatttctgccacgcgaggaaggcccctatgaagtcgaggtgacctacgatggcgttcctgtaccaggaagcccgttccctctcgaggcggtagcaccaaccaagccttccaaggttaaagccttcggccccggcctccaaggcggttccgccgggagtccagctcgcttcactattgacacgaagggagctgggacaggtggcctcggcctgaccgtagagggaccttgtgaagcccagctcgaatgcttggataatggagacggcacttgctccgtgtcttacgtacccacagagcctggtgactataacattaacattctttttgcagacacccatatcccagggagcccatttaaagcccacgtcgtaccatgttttgacgcctcaaaagtcaagtgctccggtcctggcttggaaagggccaccgcaggcgaggtggggcagttccaggttgattgttctagcgctggaagtgcggagctgaccatcgagatctgctcagaagcggggctgcctgcagaggtgtacatacaggatcacggagacggcacacacacgatcacgtatattccattatgccctggcgcctataccgtgaccattaagtatgggggacagccggttccaaactttccaagcaaattgcaggtcgaacccgctgttgacaccagcggtgttcaatgttatggccccgggatagagggacagggtgtgttccgagaggctacaaccgagttctccgtggatgcaagggcactgacccagactgggggtcctcatgttaaagcacgcgtagccaatcccagtggcaatctgactgagacctacgttcaggaccggggggatggtatgtataaggtggagtataccccatatgaagaaggcctgcattctgtcgacgtgacatatgacggaagtcccgttccttcttccccttttcaggtgcccgttacagaaggctgtgatccatcaagggtacgcgttcacggacctggtatacagagcggaaccactaacaaacctaacaaatttactgtggagacccgaggagctggtacaggaggactgggactggccgtggaaggcccatctgaagctaagatgtcttgtatggacaataaggatgggagctgctccgtggaatacattccctacgaggccggcacatatagcttaaatgttacctacggtggacaccaggtccccggatccccgttcaaggtccccgtccacgacgtaaccgatgcctccaaggtgaaatgctcaggaccaggtctgtcgcccggcatggtgcgcgctaatctgccccaatctttccaggtagacacttccaaggctggtgttgcaccacttcaggttaaggtccagggacccaagggtctggtcgagccagtggacgtcgtagacaatgcagacggcacacagaccgtcaactatgtcccatcaagagaagggccttatagcatctctgtgctgtacggagatgaggaggtgccacgctcgccgttcaaagtgaaggtactgcccacccatgatgcctcaaaagtgaaggcctcaggaccagggttgaacaccactggagttcccgctagtctgccagtggagttcactatcgatgctaaagatgccggtgagggtctgctcgctgtccagatcacagatccagaaggcaaaccaaaaaagacccacattcaggataatcacgatggaacttacaccgtcgcatatgtccccgacgtgactggcagatataccattctgattaaatacggtggcgatgaaattcctttcagtccttatagagtacgcgccgtgcccactggagacgcatccaaatgcacagtgactgtgtctatagggggccacggtctgggtgccggaatagggccaacaatccagattggggaggagaccgtgataacggtagataccaaggccgctggaaagggcaaggtcacgtgtaccgtctgcacacccgacggatcagaggtggatgtggatgtcgtggaaaacgaagatggcacatttgatattttctacacagcccctcagcctggaaaatacgtcatttgcgtacgctttggaggcgagcacgtaccaaacagcccctttcaggtgaccgctttagccggagaccagcccagcgtacagccacctttacgatcccagcaactggcccctcagtatacctacgcgcaaggcggccaacagacttgggccccagaacggcccttggtaggcgtaaatgggttagatgttacctctctcagaccctttgaccttgttatccccttcactataaaaaaaggagagatcactggtgaagtccgtatgcccagcgggaaagtcgctcaacccactattaccgataataaagatggaacagtaaccgtccgttacgctccgtctgaagcgggactgcacgaaatggatattaggtatgacaacatgcatattccaggcagtcccttgcagttctatgtggactatgttaattgcgggcacgttaccgcctatggcccaggcctaacccacggcgtcgtgaacaagccagcgaccttcacggtgaatacaaaggatgcaggagagggtggtctcagtctcgcaatcgaaggcccgagtaaagccgaaatcagttgcactgacaatcaggatggcacctgttctgtgtcctatctcccagtgctgcctggtgattacagcatcctggtaaaatacaacgaacagcacgtccctggctcgccttttactgctcgggttaccggggatgactctatgcgaatgagccacttaaaggtcggctctgcagcggacattcctatcaacatctcggagatttcctttgaagaccgcaaagatggttcctgcggagtggcctatgtggtacaggaacccggagactatgaggtgtccgttaaatttaatgaggaacatattcccgactctccattcgtcgtgcccgttgcaagccccagcggcgatgccagaagacttacagtgtctagcctacaggagagcggcctaaaagtgaatcaacctgctagctttgccgtatctctaaatggggcaaaaggagcaatagatgccaaagtgcactctccaagtggagctctggaggagtgctacgtgacggagatagaccaggataagtatgctgtgagattcatccccagagaaaacggggtgtacttgattgatgtgaagtttaatggaacgcatatccccgggtcacctttcaagatccgagttggggaacctggccatggcggagatcccggcctcgtcagtgcgtatggtgccgggttggagggaggggtgactggcaaccccgccgagtttgtcgtcaacacctcaaacgctggagctggggccttgtcggtcaccattgacggacctagcaaagttaaaatggattgccaggagtgtcctgagggctaccgagtgacatatacgccaatggcacccggctcctatcttatctctatcaagtacggcgggccttatcacattggtggctctccctttaaggccaaggtgactggtccaagattagtcagcaaccactcgcttcatgagaccagttcagtcttcgtcgactcattgactaaagctacatgtgcgccacagcacggagcacccggacctgggcccgccgacgctagcaaagtggtggccaaaggcctagggttaagtaaagcatacgttggtcaaaaatctagtttcacggtggattgctccaaagcaggaaataacatgctcctagtaggcgttcacggacctcgcacaccctgcgaagaaattttggtaaagcatgtgggatcgagactgtacagcgtgtcatatttgctgaaagataagggggagtacacactggttgtaaagtggggggacgaacacattccgggctcaccctatcgagtggttgtcccatag

SEQ ID NO: 117147 - DNA, 2343 bp, Artificial Sequence
  Description of Artificial Sequence: Synthetic coding sequence
atgcccagtggaaaagtggcacaaccaaccatcacggacaacaaggacgggaccgttacggtgagatacgccccctccgaggccggcctccacgaaatggatatccggtatgataacatgcatatacccggttcccctctccagttttacgtggactacgtgaactgcggacatgtcactgcctacggccccggtctcacccacggagtggtgaacaagccggctacctttactgtcaacacaaaagacgctggcgaaggggatgacagtatgcggatgtcacatttgaaggttggctccgcggctgatatcccaatcaacatctcggagaccgatctgtcactgctgaccgctaccgttgttccccctagtgggcgcgaggagccatgcctcctgaagcggttaagaaacggccatgtaggcatctcctttgtgccgaaggagaccggtgagcatttggtgcacgtgaagaagaatggtcagcatgtggcgtccagccccattccggtggtgatatctcaaagcgagattggggacgcaagcagagttcgggtgagcggacagggccttcacgagggtcacaccttcgagcccgcggagttcataatagacactcgcgacgctggctatggtggcctcagcctctctatagaggggccttccaaagttgatatcaatactgaggatcttgaagatggtacttgccgggtgacgtactgtccgaccgaacccggcaattatattattaatattaagttcgccgaccagcatgtgccagggagcccgttcagcgtcaaggtcacaggagaaggcagggttaaggaatccattaccagacgccgtagggcccctagcgtcgcaaatgttggcagccattgcgatctttccctcaaaattccagagatctcaatacaagatatgactgctcaggttacttccccttcgggaaagactcatgaagccgagatcgtggaaggggagaatcacacttactgcatccgctttgtgcctgctgaaatggggacccacactgtgtctgtgaagtataaagggcagcatgtgcccggctctccttttcagtttaccgtgggccccctcggcgagggaggggctcacaaagttagagcaggtggccccggactcgagcgggccgaagctggggtgccagctgagttctctatctggacacgagaagccggcgcgggcggactcgccatagctgtggagggtccaagtaaagccgagattagtttcgaggataggaaggacggcagctgtggtgtggcctacgtggtccaggagcctggggactacgaggtaagcgtcaagttcaatgaggaacatatacctgactccccgttcgtggtcccagtagcctctcccagcggcgacgctaggcggttgacagtctcctccctgcaggaaagtggattaaaagttaaccaaccagcctccttcgcagtgtcacttaatggagccaaaggggccattgatgccaaggttcactccccatccggagcactggaggaatgctacgtcacggaaatcgatcaggacaagtatgccgttcgctttatcccaagggaaaacggcgtataccttattgacgttaagttcaacggcactcatatcccagggagcccatttaaaattcgagtcggcgaaccaggacacgggggggatcctgggctggtttccgcatacggtgcaggtctggagggcggagtgaccgggaacccagcagaattcgttgtcaataccagcaacgctggagcgggggcattgagcgtgacaatcgatggaccgtctaaagtgaagatggattgtcaggagtgccctgagggctatcgggtgacatacactcctatggcccctggatcttacttaatttctattaagtacgggggcccctaccacatcggagggtctccttttaaggccaaagtaacaggaccgaggctggtcagtaatcactccctccacgagactagttccgttttcgtcgatagtctcaccaaggctacgtgtgctccgcaacatggcgctccgggacccgggcccgccgatgcttcaaaggtagtcgcaaaaggtctggggctgtctaaggcctatgttggtcaaaaaagctctttcacagttgactgcagcaaggcggggaacaatatgctactcgtcggagtccatggcccaaggactccctgtgaggaaatcttggtgaaacatgtaggttccaggctgtactctgtgtcctatctgttaaaagacaaaggcgagtataccctggtcgtaaaatggggcgatgaacacatccccggttcaccctatcgggtggttgtgccttag

SEQ ID NO: 117148 - DNA, 7920 bp, Artificial Sequence
  Description of Artificial Sequence: Synthetic coding sequence
atgtctagctcgcacagccgagctggtcagtccgcggcaggagctgcaccggggggcggggttgacacaagggatgcagaaatgcctgcaaccgaaaaagacttggctgaggacgcgccttggaagaaaattcagcagaacacctttacgagatggtgcaatgagcatctaaaatgcgtcagcaagcgcatcgctaatctccagactgacctgtctgatggcctgcgattgattgccttgctagaggtcttgtcccaaaaaaaaatgcatcgcaagcataaccagcggcctacctttcggcagatgcagctggaaaatgtgtccgttgcactggaattcctggatagggagtcaatcaagctcgtgagcattgatagcaaagccattgtggatggcaatttgaagctcattctgggactaatttggacattaatcctgcactacagcattagtatgcccatgtgggatgaggaggaagacgaagaggcaaagaaacagacccccaagcagcgtcttctcggttggatacagaataaacttcctcagctgcccattaccaacttcagccgggactggcaaagtggtcgggcgctgggggccctggtagacagttgtgcgccagggttgtgtcccgattgggattcttgggatgctagtaaaccggtgacaaacgccagggaagcaatgcagcaggctgacgactggctcggaatcccacaagttatcacacctgaggagatagtggatccgaatgtcgatgagcacagcgtgatgacctacctcagccagtttccaaaggccaagctgaagccgggggctccgttgcgacccaaattaaaccccaaaaaggcccgagcctatggccccggaattgagcctactggcaatatggtcaagaagcgcgctgagttcacagtggaaactcgctccgccgggcagggtgaggtgcttgtgtacgttgaggacccagctggacatcaagaggaagcaaaagtcaccgcaaacaacgacaagaatagaacttttagtgtctggtatgtgccagaggtgacagggacacacaaggtcaccgtgctttttgccgggcagcacattgcaaagtcaccatttgaggtgtacgtcgacaaaagtcagggagatgctagcaaagtaaccgcacagggaccagggcttgagccatctggcaacatcgcaaacaagaccacctactttgaaatctttaccgcgggcgccggaactggagaagtggaagtggtgatccaggatcccatggggcaaaaaggcacagttgaacctcagcttgaagcacgcggcgactcgacttatcgttgtagctatcagccaaccatggaaggggtccatactgtgcatgttacattcgccggcgtccctatccctaggtcgccctatacggtgaccgtcggccaggcatgcaatccatctgcatgtagggctgtggggcgtggtctgcagcccaaaggcgttcgagtgaaagaaaccgcagactttaaggtttatactaagggagccggaagcggtgaactgaaggttactgttaagggccctaagggcgaggagcgcgttaagcaaaaagatttaggtgacggggtttatgggttcgaatactatcctatggttccagggacctatattgtgacaattacatggggaggccagaatatcggacggtccccatttgaggttaaggtgggaacagaatgcggaaaccagaaggtgcgtgcctggggtcccggcctcgagggaggcgttgtcggcaagtcagccgatttcgtggttgaggcaataggggacgatgtcggaaccctgggattctctgtcgaggggccatcccaggcgaaaattgaatgcgatgataagggcgacggaagctgtgacgtgcgttactggcctcaagaggctggggaatatgcggttcatgtattgtgtaatagtgaggacatacgtctgagtccctttatggctgatattcgggacgcacctcaagatttccaccccgaccgagtgaaggcccggggacccggcctggagaaaaccggagtcgccgtgaacaagccagccgaattcacagttgacgcaaagcacggtggtaaggcccccctcagagtgcaggtccaggacaatgaaggatgccccgtggaggccctggtaaaggataacggcaacgggacatattcttgctcctacgtaccccgcaagcctgtcaaacatacagctatggtgagctgggggggagtgtccatcccaaattctccttttagagtcaacgtgggcgctgggtcacatccaaataaagtcaaggtctacggacccggagttgctaaaaccggacttaaggcacatgaacccacatatttcactgtcgattgcgctgaggccggccaaggtgacgtttccatcgggattaaatgcgctcctggggttgttgggccagccgaggccgacattgacttcgacattattcggaacgacaatgacacatttacagtaaagtacactccccggggcgccggcagctacactataatggtgttgtttgccgaccaggccactccaactagccccataagggtgaaggtggaaccctctcatgatgcttccaaggttaaggcagagggcccagggctcagccggacaggtgttgagctcggcaaaccaacgcactttaccgtcaatgctaaagcagctggcaaaggaaagctcgacgtccagttttctgggctgactaagggcgacgccgtgcgcgatgtcgatattattgaccatcatgataacacgtatacggtcaaatacaccccagtccagcagggacccgtgggtgtgaatgtgacctacgggggggatcctatcccaaagtccccctttagcgtggctgtcagccccagtttggatctctctaaaatcaaggtgagcggacttggcgagaaggtggatgtgggcaaagaccaggaattcactgtgaaatccaagggcgctggaggacagggcaaagttgcctctaaaattgttggcccatctggagccgctgtgccttgtaaggtcgagcctgggctgggggcagacaattcggtggtccgctttttaccccgggaggaaggaccctatgaagtggaggtgacctacgacggcgttcccgtgcccggaagtccattccctttagaggctgttgctcctaccaagcccagcaaagtcaaagcgtttgggccagggttacagggtggaagtgccggttctcctgcacggttcaccatcgatactaagggcgctggaacggggggcctgggacttacggtagaaggcccttgtgaggcgcagctggagtgtctcgacaatggcgatggcacgtgctctgtttcttacgtgccgacagagccaggagattacaacataaacatcctctttgccgatactcatatcccaggcagccctttcaaggcccatgtggtgccatgtttcgacgcttccaaggttaagtgctctggcccgggcctcgaacgagcgacagcaggtgaagttggtcagttccaggtggattgttcctctgctgggtccgcggaattgactatcgaaatctgtagcgaagcaggactgcccgcagaggtgtatatacaggaccacggggacggaacccataccatcacttacatcccactctgccctggcgcatatacagtaactattaaatacggagggcagccagtccctaactttccttctaaactgcaggtggaacctgcagtcgacacaagcggcgtgcaatgctatggcccaggaatcgaaggtcagggggtttttcgagaggctactacagaattttcagtcgacgcccgtgccctgacccagacggggggtccccacgtgaaggccagggtcgctaacccgagcggcaatcttacagagacttatgttcaagatcgaggagacggtatgtataaggtagagtacacaccttacgaggagggcctccacagcgtggatgtgacatatgatgggtctcctgttccctcgtccccatttcaggtacccgtgaccgagggctgtgatccctcacgggttagagtccacggaccaggcatccaaagcgggacaacaaacaaaccgaataagtttactgtggagacaaggggtgctggcacaggcggactgggccttgctgtggagggcccttccgaagcaaaaatgagctgtatggataacaaagacggatcatgttctgtggagtacatcccttacgaggcaggaacctattcattgaatgtcacttatggcgggcaccaagtacctggatctccctttaaagtacctgtgcatgatgtgactgatgccagcaaggtgaagtgcagtggtcccggcctatccccgggcatggtaagagccaacctgcctcagtctttccaggttgacacttccaaggctggggtcgccccattacaggtgaaggtccagggccctaagggtctcgtagagcctgttgatgtggttgacaatgccgatggcacacagacggtcaactatgtgccctctagggaaggcccgtactccattagcgttttgtacggtgatgaagaggtccctcgctcaccatttaaggttaaggtcctgcctactcatgacgcatcaaaggtgaaggcgtcaggcccggggctgaacaccacaggcgttccagcttcgctgccagtggagttcacgattgatgccaaagacgccggcgaaggcctcctggctgtgcagattacggatccggaagggaaacccaaaaagacccacattcaggataatcacgacggaacatatacagtggcctacgtcccagacgtaactggtcggtatactatattgatcaaatatggtggcgacgagattccattctctccatatagagtgagagccgtccccactggcgacgccagtaagtgcaccgtgactggcgcaggcatcggcccgaccattcagatcggtgaagaaactgtaattacagttgataccaaggccgctggcaaaggaaaggtgacctgcacagtgtgcacacctgacggaagtgaagtggacgtcgacgttgtagaaaatgaggacggaacatttgatattttctacacagccccacaacccggaaagtacgttatctgcgtaagattcggcggggaacacgtccccaactccccctttcaagtcacggctctggccggagatcagccttccgtccagcccccgctgcggagccagcagctggcacctcagtatacttacgcccagggagggcagcaaacatgggcgcccgaaagacccctggtaggtgttaatggtctggacgtgaccagtctgcggccatttgatctggttattccttttacaatcaaaaaaggggagataacgggagaggtacggatgccgagtgggaaggtggcacaaccaactatcacggataacaaagatgggacagtgaccgttcggtatgccccctctgaggctggcctccacgagatggatattcggtatgataatatgcatatcccaggctcccccctgcagttttacgtggactatgtgaattgcgggcacgtcacagcatacggtcctggactcacacatggcgttgtgaataaacccgctacgttcactgttaataccaaagacgctggtgaaggcggcctgagtctcgctatcgaaggtccaagcaaggccgagatctcatgcacagacaaccaggacggaacgtgctccgtgagttatctgcccgtcttgccaggtgattactcaattctggtcaaatacaatgagcagcatgtgccaggttccccctttacagcccgggtgactggcgacgatagcatgcgaatgagccatctcaaagtcggctctgctgccgatatcccgataaatattagtgagactgacctgtctctactgaccgctaccgttgtcccgccttcaggtcgcgaagaaccctgcctcctcaagcggctgcgcaatggccacgtggggataagttttgttcctaaggaaacaggggaacacctggtgcacgtcaagaagaatgggcagcacgtagcttctagcccaattcctgtggttatttcccagagtgagattggcgacgcatcacgtgtgcgcgtcagcggacagggcctgcacgaagggcatacctttgaacccgcagaattcattattgataccagagatgctggttatggtggcctcagcctcagtattgaggggccttctaaggtggatattaacacagaagacctcgaagatggcacctgtcgtgttacatactgcccgaccgagccgggaaattacattatcaatatcaaattcgcagaccagcacgtgcctgggagccccttctctgtgaaagtgactggagaaggtcgcgtaaaagaaagtattacccggcgacggagagcaccctctgtggccaatgtcggctctcactgcgacctatccctcaagattcccgagatttccattcaggatatgacagcccaggtaacatccccatctggcaaaacacatgaggcagaaatcgtggagggtgaaaatcacacctattgtatccgttttgtccccgccgagatgggaacccacaccgtgtcagtaaaatacaagggccagcatgtgcctgggagcccttttcagttcaccgtcggtcccttaggcgaagggggggcccacaaagtgcgggccggcggccctgggcttgagagagcagaggcaggggtacctgcagaattcagcatttggactagagaggctggtgcgggtggtctggcaattgccgttgaagggccatctaaggcagagattagctttgaggacaggaaggacggaagttgcggagtggcctatgtggtgcaggaacctggagactatgaggtgtcagtgaagtttaacgaggagcacatcccagatagtccctttgtggtccctgtggcgagcccatctggcgatgcacggaggttaacggtgtcgagcctccaggagtccggcctcaaggttaatcagcccgcctccttcgccgtgtccctcaacggtgccaagggggccatcgatgcgaaggtgcactccccctccggcgccctggaggagtgctacgtgacagagatcgaccaggataaatatgcggttagattcataccccgagaaaacggcgtgtacctgattgacgtgaaattcaatgggactcatatccccggaagcccctttaaaattcgagtgggagagcctggtcacggaggcgatcccgggctggtgtccgcctatggtgcaggtcttgaagggggtgttactggcaatcctgccgaattcgtggtgaacacctctaatgctggtgctggagccttgtcagtgactattgacgggccaagtaaagtgaagatggactgccaggagtgccccgaaggctacagagtgacctataccccaatggcccctgggtcttacctgatttctattaaatacgggggcccctaccatattggcgggtcccccttcaaggccaaagtcaccggccctagattggtgtcaaatcatagtctgcatgagacatcgtcagttttcgtggattcccttacaaaagccacctgcgccccccaacatggggcccccgggcccggaccagccgatgcctccaaagttgtcgcaaaaggattgggactgagtaaggcctacgtgggccagaagtcatctttcaccgtggattgcagcaaagcagggaataacatgcttcttgtcggagtgcatggacctcggaccccttgcgaagaaatcttagtgaagcacgtgggctctcgactgtacagcgtgtcttatttacttaaggataagggcgaatacacactcgtggttaaatggggcgatgaacacattcctggctcaccatatagggtggtggtcccatag

SEQ ID NO: 117149 - DNA, 7809 bp, Artificial Sequence
  Description of Artificial Sequence: Synthetic coding sequence
atgcccgtgacagagaaagatctggccgaggatgcaccatggaagaagattcagcagaataccttcacacggtggtgtaacgagcaccttaaatgtgtgaacaaacgtatcggaaatttgcagaccgatctgtctgacggtctcagactgattgccctactcgaagtactgtctcagaaacgcatgtacaggaaatatcaccagcggcctaccttccgtcagatgcagcttgaaaacgtttcagtcgctctggaattccttgacagggagtctatcaagctggtgagcatagactcgaaagctatcgtagacgggaacttgaaactgattcttggtttggtctggactctcatattgcattacagtataagtatgcccgtttgggaggatgaaggagacgacgatgcaaagaaacagacacccaaacagcgcttactgggatggatccagaacaagatcccttatctaccgatcactaatttcaaccagaattggcaggacggaaaggctttaggggcattggtagattcttgtgcgcccggactttgcccagattgggagagctgggatccccagaaaccagtggataacgctagagaagctatgcagcaggcggatgactggcttggagtcccgcaagtcatcacccccgaagaaatcattcatccagacgtagacgagcactcggtcatgacttatttgtcccagttcccaaaggcaaagctcaaacccggtgcccccctgaagccgaagcttaaccccaagaaagcgcgggcatatgggagaggcattgaacccaccggtaacatggtgaaacagcccgccaaattcacggtagatacgatatctgcagggcagggcgatgtgatggtgttcgttgaagaccccgagggcaacaaagaggaagcacaggtcacccccgattcagataagaataagacctattctgttgagtacctgcccaaagtaacgggactgcataaggtcacagtcctattcgctggccagcacatttctaagtcgccattcgaagtgagtgtggataaggcccagggcgatgcgtctaaggtaaccgccaagggtcccggattagaagccgtgggcaacatcgccaacaaaccaacgtactttgatatttacaccgccggagcgggtgttggcgatattggggtggaggtggaggatcctcagggcaaaaacactgtggaactcttggtggaagacaagggcaatcaggtgtatcgctgcgtctataaacccatgcagccagggccccacgtggtgaagatattcttcgccggagacacaatcccgaagagccctttcgtcgtgcaagtcggcgaagcctgcaaccctaacgcatgccgcgctagtgggcgcggactccagcccaagggcgttcggattcgggagaccaccgactttaaggttgatacaaaggccgctggctctggcgagttgggagttacaatgaagggacctaaaggacttgaagagctggtcaagcagaaagacttcctggacggagtgtacgctttcgaatactacccttctaccccaggaagatactccatcgctatcacgtggggcgggcaccacattcccaaatctccgtttgaagtgcaggtgggaccagaagccggcatgcaaaaggtccgggcttggggccccgggctgcacggggggattgtaggtaggtccgctgattttgtcgtggagtccatcggctctgaggttgggtctctgggtttcgccatagagggcccctcccaagcgaagattgaatataatgatcagaatgacggctcgtgtgatgtgaagtattggcctaaggagcctggggaatatgcggttcatatcatgtgcgatgatgaagacatcaaagacagtccttacatggcttttatccacccagctacgggtggctacaaccctgatctggtgagggcttatggcccaggcctggaaaagtccggctgcattgtaaacaacctcgctgaattcactgtggacccgaaggacgcgggcaaagccccactcaagatttttgctcaggacggcgaggggcagagaatagacatccagatgaaaaacaggatggacggtacctatgcgtgcagttatactccagtaaaagcgatcaagcatacaatcgccgtggtttgggggggagttaatatcccccactccccgtaccgggtcaatattggacagggcagtcaccctcagaaggtgaaggtatttggccccggggtggaaagatctggcttgaaagccaacgagcccacacactttacagtggactgcaccgaggctggagagggtgacgtctctgtgggaattaaatgtgatgcgcgggtactgagtgaagatgaggaagatgtagatttcgatattatccacaacgcgaatgatacatttacagttaaatacgttccccctgcagcaggaaggtacaccatcaaggtgttgtttgcgtcccaagagatccccgcctcgccattccgcgttaaggtcgatccttcccacgacgccagtaaagtaaaggccgagggtcccggcctctccaaggcaggcgtcgaaaatgggaaacctacacacttcaccgtgtatacaaaaggggcagggaaagcacccctaaacgtgcagttcaatagtccattgcccggtgatgctgtgaaggatctggatattattgataattacgattactctcataccgttaagtacacacccactcagcaaggcaacatgcaggtgctcgtgacatacggtggagaccctattccaaaatcccctttcaccgtgggagttgctgcccccctcgacttgagcaagattaaactcaatggtctggaaaacagagtggaagttgggaaagatcaggaattcaccgtggacactcgcggcgccggcgggcagggcaaactcgacgttacgattctttctccaagcaggaaagtggtgccatgtctggtcacaccagtgacaggtcgcgagaacagcacagcaaaatttattcctcgcgaagaaggtctttacgctgtggatgtaacctatgacgggcaccccgtacctggaagcccatataccgtggaggccagcctgcccccagacccctcaaaagtaaaggcacatggccctggtttggaaggggggttggttggtaagcccgccgaatttaccatagacaccaaaggcgccggaaccggaggccttggtctgacggtggagggaccatgtgaagcaaagatcgaatgcagcgataacggcgatggtacctgctctgtcagctacctacctaccaagccaggagaatattttgtgaatatactttttgaggaagtccatatcccaggctccccgttcaaagccgatattgagatgcccttcgaccccagcaaggtcgtggctagtgggcctgggctggagcatggaaaagtgggtgaggccggcctactttcagtagattgcagcgaagcagggccaggagcgcttggcttggaggccgtctccgactcaggcactaaagctgaggtaagcatccaaaacaataaggacggaacttacgccgtgacgtacgtgccactcacagctggcatgtatactttaactatgaagtatggaggcgaattggtccctcactttcctgcccgcgtgaaggttgagccggccgtcgacacctcacgcatcaaagtctttggcccaggtattgagggcaaggatgtcttcagagaggctacgaccgactttaccgtggatagtcgccccttaacgcaggtgggaggcgatcacatcaaagctcacatcgctaacccaagcggcgctagcacagagtgctttgttaccgacaatgccgacggtacatatcaggtggaatacacccccttcgagaagggcctgcatgtggtagaggtaacatatgacgacgtgccaatccccaattccccttttaaggtggctgtgacagaaggatgtcagccttcacgggtgcaggcccaaggtcccggcctgaaggaagcgtttactaataagccaaatgtcttcacagtggtgactaggggagccgggattggtgggctgggcatcactgtcgaaggaccctccgaatctaagatcaactgcagagacaataaggatgggagttgttcagctgagtacatccctttcgccccaggggactacgatgtcaacattacatacggcggcgcccacattcctggcagtcccttccgtgtcccagtcaaagatgtagtagacccatccaaagtgaagatcgcaggacctgggctcgggtccggtgtacgggctcgggttttgcagagcttcaccgtggactccagcaaggctgggcttgcgcctttggaagtgcgagtactcggacctcgcggactggtcgaaccggtcaatgtggtcgataacggagatggcacccatactgtcacctatacaccctctcaggaagggccttacatggtcagtgtgaagtatgccgacgaggagatccctcgctcgccattcaaggtgaaagtgctgcctacatatgacgccagtaaagtcactgcatctggcccagggctctccagctatggcgtgccagcttctctgcccgtggacttcgcaatcgacgcccgcgacgcaggcgaggggctgctggctgtgcaaatcaccgaccaggaaggaaagccaaaacgggccatcgttcatgataacaaagacggtacatacgccgttacttacatccctgataagactggtagatacatgatcggagtcacttacggcggcgatgacattcctctgagcccttacaggatacgggctacgcagaccggcgatgccagcaaatgcctggctacaggccccggcattgcaagtaccgtgaaaacaggagaggaggttggctttgtggtggacgcaaagactgccggcaagggcaaggtcacatgcactgtgctgacgcctgacgggacggaggctgaagctgacgtcattgagaacgaggacgggacctacgatattttctacacagccgctaagcctgggacttatgtcatttacgtgcgcttcggcggagtggatatcccaaacagcccctttaccgtcatggctaccgacggtgaagtgaccgccgtggaggaggcacccgtcaacgcatgtccaccaggcttccggccttgggttactgaagaggcctatgtgcctgtgtctgacatgaacggactggggtttaagccctttgatcttgtgatacccttcgccgtgcggaagggtgagataaccggagaggtacacatgccttctggaaaaacagctactccggaaattgtcgacaataaagatggcactgtgacagtgcgctatgcgcctactgaagtggggttgcacgaaatgcacataaaatacatgggatcccacatcccggagtccccattacagttttatgtgaattatcccaactctggctccgtatcagcatacggacctgggctcgtctatggcgtggctaacaaaactgctacttttacgattgtaacagaagatgcaggagaggggggtctcgatttagcaatcgaaggcccctccaaagctgagattagttgtatcgataataaggatggcacatgtacggtgacctatctccccacactgccaggagactatagtatcctggtgaagtataacgataaacatatacccggaagtcctttcactgctaaaattaccgacgactcacgtaggtgctctcaggtcaaactcggatcggcagcagattttctgctcgacatatccgagaccgatctttcatcactgaccgcgagcatcaaagcccccagcggtagggacgaaccatgcctcctaaagcggctccccaataaccatattggtatcagctttattcccagggaagtcggcgaacacctggtgtctatcaaaaagaatggtaaccacgtggccaactcgccagtgtctatcatggtggtgcagtcagaaataggagatgctcgacgagccaaggtttatggcaggggacttagtgaaggccggaccttcgagatgtcagatttcatagtcgacacacgtgatgcgggatatggtggcatctctttggctgtagagggcccgtccaaagtggatattcagacggaagacctcgaagacggcacctgtaaagtgtcctattttcccacagtgcctggagtgtacattgtgtccacaaaattcgccgatgagcacgtgcctgggagtccatttaccgtgaaaattagcggggaaggaagagtcaaggaatccataacgagaacttctagggctccaagcgtggctacggtgggttcaatttgcgatttaaaccttaagatccctgagattaatagcagcgacatgtcagcacatgtgacaagtccttctgggcgagttacagaggccgagatcgtgcctatgggcaagaatagccattgcgtccgattcgtgccacaggagatgggagttcacactgtgtctgtgaagtatcgaggccagcacgtgacgggatccccttttcagtttacagttgggccccttggtgaaggcggagcccacaaggtcagagctggaggtcctggacttgagaggggggaggccggagttcctgccgagttttctatttggactcgagaggcaggggctggcggtctgtccatagcagttgaaggcccttcaaaagctgagataacctttgacgaccataagaacggttcatgtggtgtgtcctatatcgcacaggaaccaggtaattacgaagtatcaattaaatttaatgatgagcacatcccagagagcccctacttggtgcctgtaatcgctccatccgacgacgctaggcgccttaccgtgatgtcattgcaagaatctggtctcaaagtgaaccagccagccagcttcgctatacggcttaacggtgctaagggaaaaatagacgctaaggtccatagcccaagtggcgccgtagaagagtgtcacgtgagtgaattagagccagataaatatgctgtccggtttatcccccacgagaatggtgtccataccattgacgtcaagtttaacggctcacatgtggttgggtctccattcaaggtcagggtaggagagccaggccaggcaggtaacccagctttagttagtgcctatggcaccggattggagggcggtactactggcatccagtctgagtttttcattaacaccactagggctggccccggcacactgtctgtcactatagaggggccttctaaagtgaagatggactgtcaagagactccagaaggctataaagtcatgtacaccccaatggcacctggcaattacctcatctccgtgaaatacgggggccccaaccacatcgtgggaagcccctttaaagcaaaagtcaccggccagcggctcgtgtctccggggtctgctaacgagacaagctctattctagttgagagcgtcacaagaagtagtaccgagacttgctactccgcaattcctaaggccagcagcgacgcctctaaggtgactagcaagggagctggcctcagtaaggcttttgttgggcaaaaatcatctttccttgttgattgtagcaaggcagggtctaatatgcttttaattggagtgcacggccccactacgccctgcgaagaggtgagtatgaagcacgttggaaaccaacaatataacgtcacatatgtggtgaaggagagaggtgactatgttctagcagttaaatggggtgaggaacatatccccggcagtccatttcatgtgaccgttccctag

SEQ ID NO: 117150 - DNA, 7686 bp, Artificial Sequence
  Description of Artificial Sequence: Synthetic coding sequence
atgccagtcacagagaaagacctcgccgaagacgccccatggaaaaagatccagcaaaacacattcacacgatggtgcaacgaacacctgaagtgcgtcaataaacggatcgggaacctacaaactgatctgagtgacggcctgcggctgattgccttactcgaggttctatctcagaagcgcatgtatcgaaagtatcaccaacgccccactttccgacagatgcagctagagaatgtgtccgtggctctggagttccttgatcgagagtcgattaaattggtcagcatagatagtaaggctatcgtcgacggtaacctgaagttgattctcggcctagtgtggacgctgattctccattacagcattagtatgccagtttgggaggatgaaggcgacgacgacgcaaaaaaacagacacccaaacaacgcctgcttggctggattcagaacaaaataccctacctgccgattactaacttcaaccagaactggcaggacggtaaggccctcggcgccctcgtggattcatgcgcccccggactctgtcctgattgggaatcctgggatcctcagaaaccagtggacaacgcccgggaggccatgcagcaggccgacgactggctcggtgtgccccaagtgatcactccggaggagataattcacccagacgtggatgaacattccgttatgacctacctgtcgcagtttcccaaggccaagctgaaaccaggcgccccactgaaacccaaactgaaccccaagaaagcacgggcctatgggcgggggattgagcctactgggaatatggtgaaacaacctgctaagtttaccgtggatacaatatccgccgggcaaggggacgtgatggtgtttgttgaagaccctgagggcaacaaggaggaggctcaggtcacccctgatagtgacaaaaacaagacatacagtgtagaatacctccccaaagtcaccggcttacacaaggtaaccgtgctctttgccggacaacacatcagtaaatcacctttcgaagtctccgtcgataaggcccagggtgatgctagcaaggttactgctaagggcccaggcctggaagctgtgggaaatatcgctaacaaacctacctactttgacatttacacagccggggccggcgtgggtgacattggggtggaggtggaggatccccagggcaagaatactgtcgaactgttggtggaggacaagggcaaccaggtttaccggtgcgtctacaagccaatgcaaccgggcccccatgtcgttaagatttttttcgctggcgacacaatccccaagtcacccttcgtagtgcaggtaggcgaagcatgtaaccccaacgcttgcagggcttccggtagaggacttcagcctaaaggggttagaatccgcgaaactaccgattttaaggtcgacaccaaggccgccgggtctggcgagctcggcgtaactatgaagggcccaaagggactggaggagctcgtgaaacagaaggacttcctggacggcgtttacgcgttcgaatactacccctctactcccggccggtatagtattgccatcacatgggggggtcaccacattcccaagtccccatttgaagttcaggtgggcccggaggctggcatgcagaaggtcagagcttgggggcctggattgcatggaggaatcgtgggccgctctgcagacttcgtagtggagagcatcgggtctgaggtgggcagtctgggctttgccattgagggccccagccaggctaaaatagagtataacgaccaaaacgatggaagttgtgacgttaagtattggccaaaggaacccggagagtatgcagtccacattatgtgtgatgatgaggacattaaggactcaccttatatggcgtttattcaccctgccacaggtggatataatcccgatctcgtcagggcttacggccctggccttgaaaagagtgggtgtatcgtcaataatctggctgaatttaccgtcgatccaaaggacgccggtaaagcaccattgaaaattttcgcacaggatggggagggacagcggatcgacattcagatgaagaaccgcatggacgggacttacgcctgcagctacacccctgtgaaggccatcaaacacaccatagcggttgtatgggggggagtgaatattcctcacagtccatacagggtgaacattgggcaagggagccacccgcaaaaagtgaaggtctttggacccggggtggagcgatcaggcctgaaggccaacgaaccaactcactttacggtggactgcacggaagccggcgaaggtgacgtgtccgtgggcattaaatgtgatgcaagagtactgtctgaggacgaagaagatgttgatttcgacattatacacaacgccaacgatacattcacagtcaaatacgttcccccagcagctggaagatatacaatcaaagttctgttcgcaagtcaggagatcccagccagccccttcagggtgaaggtagacccctcccacgacgcctctaaagtcaaggccgaaggccctggtctttccaaagctggagtggaaaatggaaagcctactcacttcacagtttacactaagggagccggaaaagcccccctcaatgtgcagtttaacagccctttacctggcgatgccgttaaagacctcgacatcatcgacaactacgattacagccatacggtgaagtatacaccaacgcagcagggaaacatgcaagtgctggttacttacggaggtgatccaatacctaagtctccctttaccgtgggggtcgctgccccattagatctatctaagattaagttaaacgggttggaaaatagagtcgaagtcggcaaagatcaggagttcaccgtggatacgcggggagctggcggccaagggaagctggacgtcacaatcctgtctccgtccagaaaagtagtgccgtgtctggtgacacccgtgactggacgcgagaactcaaccgcgaagttcattcctcgcgaagagggtctctacgctgtggacgtgacctatgacggtcaccccgtccccggctctccttacacagtggaagcctctctcccgcctgacccaagtaaagtgaaagctcatggacctgggctcgagggcggtctggtcggaaagccggcagaatttaccattgacacaaaaggcgcaggcaccgggggcctcgggctgaccgttgaaggcccctgcgaagccaagatcgagtgctccgacaacggcgacggtacatgctctgtatcctacctgcctacaaaacccggagagtattttgtgaatatactcttcgaggaagtccacatacctgggagtccctttaaagccgacattgagatgccattcgatccctctaaggtcgtggcgtccggcccgggtctggaacacggcaaggtgggcgaggcaggcttactcagtgtggattgctcagaggctggccccggcgctctgggcctcgaggctgtgtctgacagcggcaccaaagcagaggtttctatacagaataataaagacgggacgtacgcagtgacctatgtccccctgacggcaggaatgtataccctgacgatgaagtacgggggcgagttggttccacactttcccgctagagttaaggttgagccagctgtcgatacctcccgcataaaagtttttggaccaggcatcgaagggaaggacgtgtttcgcgaagcaactaccgactttacagtcgattcaaggccgcttacccaggtcgggggcgatcatatcaaggctcatatcgcaaacccttcaggggcctcgacagagtgttttgtgaccgataatgcagatggcacctaccaggttgagtacactccatttgaaaaaggcctgcacgtggttgaggttacctatgacgacgtgccgattccgaattctcccttcaaagtagcagttacggaaggctgccaaccctcaagggtccaggcacagggcccaggattgaaggaggccttcactaataaacccaacgttttcacagtggtgactcggggagccggaatcgggggactcggcataacggttgaaggcccttcagagagcaagattaactgtcgtgacaacaaggatggctcctgcagcgcagagtatatccctttcgcgccgggcgactacgacgtgaatattacctacggaggagcacatatcccaggctccccatttcgagtacctgtcaaagatgtcgtggacccttctaaggtcaaaattgctgggcccggactgggctctggcgttcgggcacgcgtcctccagtcattcaccgtcgacagctccaaggccggcctcgccccccttgaagtgagggtgctgggtccgcgcggcctggttgaacccgtcaatgtcgtcgacaatggcgacggcacccacaccgtgacatacacgcccagccaagagggcccttatatggtctccgtgaagtatgctgatgaagagataccccgctctcctttcaaggtgaaggtccttcccacttacgatgctagcaaggtgaccgcctcgggcccaggcctgagtagctacggcgtccctgccagtctccccgtggactttgccattgacgccagggatgccggagaagggcttcttgctgtccagataacagatcaagagggcaaaccaaagagggcaatcgtacacgataataaagacggtacatatgcggtgacctatatccctgacaagacagggcgctacatgattggggtgacttatggaggcgacgatatccctctctctccatatcgcattcgagcgactcagaccggtgacgctagtaaatgtctcgcaaccggacccgggatagcttcaaccgtgaagacgggggaggaggtcggattcgtcgtggacgcaaagaccgctggaaaggggaaagtgacctgcaccgtcctgacacccgacgggaccgaagccgaggctgacgttattgagaacgaagacggtacctacgacattttttacactgccgccaaacccggaacatatgtcatctacgtcaggttcggaggcgtggatatccctaattcaccatttacagtaatggcaacagacggcgaggtgacagctgtagaggaagcccccgtgaacgcctgtccaccaggttttagaccctgggtgaccgaggaagcctatgtacccgtgagcgatatgaacgggttaggctttaaacccttcgacctcgttatcccattcgccgtgcgtaaaggtgagattacgggtgaagtccatatgccttcaggaaagacagctactccagaaatcgtggacaacaaggatgggacagtgacagtgagatatgcccccacggaagtgggactacatgaaatgcacattaagtacatgggttctcatatacctgagtctccactgcaattttacgtgaattatcctaactccggcagcgtgtcagcctatggccccggcctcgtttacggagtggcaaacaaaactgcgacattcaccatcgtgacagaggatgccggcgagggtggcctcgatctggcaattgaggggcctagtaaagcagaaataagctgcattgacaataaagacggaacctgcactgtgacgtacttaccgacgctgcctggggactattctatcctggttaaatataacgataaacatattcccggctcaccctttactgccaagattaccgatgatagcagacgttgctcccaggtcaagctcggatctgccgcagatttcctcttggatatcagcgagaccgatctctcctccctgacagcgagcattaaggcaccctcggggagggacgaaccttgtctgctaaagcggcttcctaataaccatatagggatctcttttatccctcgcgaggtgggtgaacacctggtctcaattaaaaagaatgggaaccatgttgcgaattcaccggtatccatcatggtcgtgcagagtgagatcggggacgctagacgtgctaaggtttatgggaggggcttgtcagagggaagaacctttgagatgagtgactttatcgtggacaccagagacgccggatacggggggatctcactcgccgtggaaggaccgtctaaggtcgatattcagactgaggacctcgaagatggcacgtgtaaagtgagctactttccaaccgttccgggcgtgtacatcgtcagcactaaatttgctgatgagcacgtgccggagatcaacagcagcgatatgtcagctcatgtgacctcaccttccggccgcgtcaccgaagcagagatcgtgccgatggggaagaattctcactgcgtgcgttttgtgccgcaggaaatgggcgtccacaccgtttcagttaaatataggggccagcacgttacagggtctccctttcagttcaccgtgggacctttgggcgaaggtggggctcataaagtgagagcaggcgggcctggccttgagaggggggaagccggtgtgcccgcagagttctccatctggaccagggaggccggcgccggcgggctgtccatcgcggtggagggcccgagcaaggcggagatcacctttgacgatcataagaacggtagttgcggggtgagttatatcgctcaggagccgggaaactacgaagtatctataaaatttaacgacgagcacatcccggagtccccgtatttagtgcctgtcattgcacctagtgacgacgcccggagactgacggtcatgagcctgcaggaatccgggttgaaagtcaaccaacccgccagctttgccattagattgaacggagccaaaggcaaaattgatgccaaggtgcactcaccatctggggcagttgaggagtgccatgtttcggaattggagcctgacaagtatgccgtcaggttcattcctcacgagaacggagtacataccatagatgtgaaatttaacggaagtcacgtcgtgggtagcccttttaaagtacgagttggggaacctggtcaggccggaaaccccgccctggtgtcggcctatggcacaggtctggaagggggtacaaccggtattcaatctgaattttttatcaacactactcgggcgggccctgggacattgtcagtcaccatagaaggcccgtccaaagtgaaaatggattgccaggaaacacccgaggggtacaaagtcatgtacacaccaatggcccccgggaattaccttatctctgtgaaatacggtggtccaaaccacatcgtgggttcgccctttaaagctaaggtaacgggacagagattagtgagtccaggctccgctaacgagacatcatccatcttggtggagtctgtgaccagatcttcaacggaaacgtgctactcagccatccccaaagctagttccgatgcttccaaagtcacatccaaaggcgctggcctgagcaaagcctttgtcggacagaagtcttcgttccttgtcgactgttcaaaggctggctccaacatgcttttaatcggggtccatggcccgacaacaccgtgcgaagaagtctcaatgaagcatgttggcaaccagcagtacaacgtgacttacgtggtcaaggagcggggcgattatgttcttgcagtgaaatggggcgaggagcacataccaggttctccatttcatgtgacggtgccttag

SEQ ID NO: 117151 - DNA, 6453 bp, Artificial Sequence
  Description of Artificial Sequence: Synthetic coding sequence
atgccagttaccgagaaggatttagccgaagatgccccatggaaaaagatccagcaaaacacatttactcgctggtgtaacgagcacctcaaatgtgtaaacaaaagaattggaaacttgcagactgacctgtctgacggactccggttaatcgccctgctggaggttctctcccagaagagaatgtataggaaataccaccaacgcccaactttcagacagatgcagctggaaaatgtgagcgtggcactggagtttctggatcgcgagtctatcaaacttgtgagcatcgattcaaaggccatcgtcgacggcaatctgaaactcatactgggactcgtgtggacactcattttgcactactcaatcagcatgcccgtttgggaggatgaaggggatgatgacgctaaaaagcagacaccaaagcagaggctgctagggtggattcaaaataagatcccatacttgcccattactaattttaaccaaaattggcaggacggtaaagcactcggtgccctcgtggattcatgcgcccccggcctgtgccctgattgggaaagctgggatccgcagaagcccgttgacaacgcccgcgaagccatgcagcaagcggacgattggctcggtgttccacaggtgattacacccgaagaaatcatccacccggacgtcgatgagcattctgtcatgacatacctgtcccagttccccaaagctaaattgaaaccaggagcgcccctgaaacctaaactgaatcctaagaaagcccgagcatacgggaggggaatagagccgacgggtaacatggtgaagcaacctgctaagtttactgtggatacaattagcgccggtcagggagatgtcatggtgttcgtggaagatcccgaggggaacaaagaagaagcacaggtgacacccgattctgataagaacaaaacctacagcgtggagtacctgcctaaggtcactggcctgcacaaagtcacggtgctgttcgccggacaacacattagcaaatcgcctttcgaggtgtctgtggacaaggcacagggagacgcatcaaaagtcaccgccaagggaccgggactcgaggccgtggggaacattgccaacaagcctacttatttcgatatttatactgctggcgcaggagtgggagacatcggagtggaggttgaagaccctcagggcaagaacactgtggagctcctggtggaggacaaagggaaccaggtgtataggtgtgtgtacaagccaatgcagcccggaccccatgtggtgaagatctttttcgcaggggatacaatacctaagtctccgttcgtcgtgcaggtgggggaggcttgcaacccgaacgcttgcagagcttctgggcggggccttcaaccaaagggcgtgagaatcagggaaaccacggattttaaagttgatactaaagccgccgggtctggggagctaggggtgaccatgaagggcccaaagggtctcgaagagttggtcaagcagaaggacttcctggatggcgtatacgcgtttgagtattatccttccacacctgggcggtattctattgcgattacatggggcgggcatcacatccctaagtcccctttcgaagttcaggtgggcccagaggcaggaatgcagaaagtccgagcctggggcccaggactgcacggcgggatcgtgggaagatctgccgacttcgtagtcgagagcattggatccgaggtaggatctctggggttcgccatcgagggtccctcacaagccaagatcgaatataatgaccagaacgacggcagctgcgacgtgaagtattggcccaaagaacctggtgagtacgctgttcatatcatgtgtgatgatgaagatatcaaagacagtccctacatggctttcattcaccccgccaccgggggctataatcctgatctggtgagagcctacggccccggcctcgagaagtctggatgcattgtgaataatcttgcggaatttaccgttgacccaaaagatgccggaaaggcccccctcaaaatctttgcgcaggacggggaaggacagaggatcgatatccaaatgaaaaatagaatggatggtacatacgcctgctcctacacaccagtcaaagccatcaagcacacaattgcggtcgtctggggaggagtgaatattccgcacagcccttacagggttaacataggtcaaggaagccacccacaaaaggtaaaggttttcggacccggcgtagaacgatctggattgaaagcaaatgaacccactcactttaccgtcgactgtactgaggccggcgagggagacgtctccgtgggcatcaaatgcgacgctagggtcctctccgaagacgaagaagacgtagattttgacatcatccacaacgcaaacgacactttcacggtcaaatacgtgccacctgcagccggtagatatacaataaaagttctgttcgcctcccaggagattcctgctagcccattcagagtgaaggtcgacccttctcatgatgcttctaaggtgaaagcagaaggccctgggctaagtaaagcgggcgtggaaaatggcaaacctactcacttcacggtatacacgaagggggccggcaaagctcctctgaacgtgcagtttaactcgcccctgcctggtgatgccgtgaaagatttagacatcatagacaactacgattacagccacacggttaagtacacccctacccagcaaggtaacatgcaggtgctcgttacatatggaggggaccctatcccaaagtctcctttcactgttggtgttgctgcacccctggatcttagtaaaatcaaacttaatggcttagagaacagggtagaggtggggaaagatcaggaattcaccgtcgatacaaggggggccgggggccaagggaagcttgatgtgaccattctgtctccttcaagaaaggtcgtcccatgtctggtcaccccggtgactgggagggagaactctacagccaagttcattccccgcgaggaagggctctatgctgtggacgtcacctatgacggacaccccgtgcccgggtccccatacacggttgaagcctccctgccaccagacccctcgaaggtgaaggctcacgggccagggttggagggggggctcgtgggtaagccagcggaattcacaatcgacacaaagggtgcaggcaccggaggtctcggcctcactgtagagggtccttgcgaggctaagatcgaatgctctgacaatggggacggtacttgcagcgtgagctatctgcctacgaagcccggggagtactttgtaaacatattattcgaagaagtgcatatacccggttcgcccttcaaggctgatatagaaatgccttttgacccatccaaggtcgtggcctccggtccagggctggaacacgggaaagtcggtgaagcgggacttctgagtgtcgattgttctgaggccggacctggcgctcttggactagaagccgtatctgacagtggtacaaaggcggaagtttccatacagaacaacaaggatggcacctatgcagttacatatgtgcctcttactgccggcatgtacacattgaccatgaagtacggtggagagcttgtccctcactttcccgctcgggtaaaggtcgaacctgcagtcgatacgtcccggatcaaggtttttggtcctgggatcgaaggcaaggacgtctttcgcgaggctacgactgacttcaccgtggattctcgacctcttacacaggttgggggagaccacatcaaagcacatattgcaaaccccagcggcgcatccactgaatgttttgtgacagacaatgccgacggcacatatcaggttgaatacaccccctttgagaagggcctgcatgtagtcgaagtgacttacgacgacgtgccaatccctaactcaccattcaaggtcgcagtgaccgaggggtgccagcccagtcgagtgcaggcgcagggacctggattgaaggaagccttcaccaataagccgaacgtgttcacagtggtgacacgaggcgccggaatagggggcctgggcataacagtagaagggccttctgagtccaaaatcaactgccgggacaacaaagatggcagctgctcagctgaatatattcccttcgcccctggggattacgatgtgaatatcacatacggtggtgcacacattcccggaagcccatttagagtacctgtcaaggacgtcgtcgatccttccaaagtgaaaatcgcaggccctggtttaggttcgggcgtcagggccagggtcctccagtcttttactgtggactcttcaaaggccggattagcaccactcgaggtgagagtcctgggcccacggggactggtcgagccagtcaatgtggtggataacggggacggcacacataccgtgacatacacaccttcccaggagggcccctacatggtgtctgtgaagtacgcggatgaggagattccccgctccccctttaaagtgaaggttctgccaacttacgatgcctctaaggtgactgcttccggtccggggctgtcttcatatggcgtgcccgctagtctgcccgtggatttcgccattgatgcaagggatgctggcgaaggcctgctggcagtacagataacagaccaggagggcaaacccaaacgagcaatcgtccatgacaataaggatggtacctatgccgtcacctatatacccgacaagacaggcagatacatgatcggagtaacctacggaggagacgacatacccttgtcaccctatcgcatcagagccacccagacaggagacgcatccaaatgccttgctacaggtccgggcattgcttcaacagtgaagaccggtgaagaggtaggttttgtggtagacgctaaaacggccggcaagggcaaagtgacttgtactgtcctcacacccgatggtaccgaagcagaagctgatgtgattgaaaacgaggatggcacctacgatatcttctataccgccgccaagcccggaacctatgtaatttacgttcggttcggaggagtggacattccgaactccccattcacagtcatggctaccgacggagaagtgacggctgtagaggaagcaccagtgaatgcctgtcctccaggctttcgcccatgggtgacggaagaagcgtatgtgccggtttcagatatgaatggactgggctttaaaccgttcgatttggtcatccccttcgctgtgaggaaaggggagatcacaggtgaggtgcatatgccgtccggaaagaccgccaccccagaaatcgttgacaataaagacggcaccgtgacggtgcggtacgcacctaccgaagtgggccttcacgaaatgcatattaagtatatgggctctcacatccccgagtctccactgcaattttatgtgaactatcccaattccggatccgtatcagcatacggaccgggacttgtctatggcgtggcaaacaagaccgccacattcacgatcgtcaccgaagacgccggagagggtggtctcgaccttgccatcgagggacccagcaaggcggaaatttcatgcatagataataaagatggaacttgtacagtgacctaccttccaacgctgcctggagactatagtatattagtaaagtataatgacaaacatatccccggaagccccttcactgcgaagataacagacgattctcgcagatgttcccaggtgaagctaggttccgccgccgacttccttttggatatcagcgagaccgatttgtcctccctaactgccagcatcaaggctcctagcgggagagacgaaccctgcctgctgaagagactgcccaataaccacataggtatctcattcattccgcgcgaggttggcgaacacctcgtgagcataaagaaaaacgggaatcacgtggcgaattctcccgtgtccatcatggtagtgcagtccgagattggagacgcacggcgggcaaaagtttatggacgcggattatctgagggacggacttttgaaatgtcagattttatagtggataccagagacgccggctatggcgggatctccttagccgttgagggtccctctaaggtcgacatacaaaccgaggatctggaggatggcacttgcaaggtcagttacttccccactgtgcccggcgtgtatatagtctccaccaagtttgcagatgagcatgtgccgggctctccattcactgtcaaaatctccggcgagggaagggtgaaggaatccatcactaggacatccagggcccctagcgtagccacagttggaagcatctgtgatttgaacctcaaaatcccaggcgtgcgggtcatgaactgctcagcccagatcctctggggatggcgagtgcagttccacactggctccagaaaccagcaacagtag

SEQ ID NO: 117152 - DNA, 7737 bp, Artificial Sequence
  Description of Artificial Sequence: Synthetic coding sequence
atgcccgtcactgaaaaagacctggctgaggatgctccgtggaaaaaaattcagcagaatacgttcaccaggtggtgcaacgaacacctgaagtgcgtgaacaagcgcatcggcaacctgcagacagatctcagcgacgggcttcgcctcatagccctcttagaggtgctcagccagaagagaatgtatcgcaaataccaccaaagacctaccttcagacaaatgcagctcgaaaacgtgtcagtcgccttggaatttttggaccgtgagagcatcaagctagtcagtatcgacagcaaggccattgtagacggtaatcttaagctgatcctgggcctggtctggaccttaatcctgcactactccatcagcatgcccgtgtgggaggacgagggcgatgacgacgctaagaaacagacccctaaacagaggctactgggatggattcagaataagatcccctatctgccaataactaattttaatcagaactggcaagacggcaaagctctgggagcgttggtggactcttgtgcccctgggctgtgcccagactgggaaagctgggacccccaaaagccggtagacaatgcccgcgaagctatgcagcaggccgatgattggcttggcgtacctcaagtaatcactcctgaggagattattcatccagacgtggatgaacactcagtgatgacttatctgtcacagtttccaaaggcaaagttgaaacctggggcccctctaaagccaaaactgaatccaaaaaaggcgagagcatacgggcgtggtattgaacccactggcaacatggtcaagcagccagcaaaatttacagtggacaccatatctgccgggcagggtgacgtgatggtcttcgtcgaggaccccgagggaaataaggaggaggctcaggtcacacccgattccgacaagaacaaaacctattctgtcgagtatcttcccaaagtgaccgggctgcacaaggtgacagtcctctttgctgggcagcacatctcaaagagcccttttgaagtgtcagtcgataaagcacagggggatgctagcaaggtgacagcaaaagggcctggactggaggctgtgggaaacatcgcgaataagccaacatattttgacatttatacagcaggggcaggcgtgggggacattggcgtcgaagtggaggatccacagggcaagaacaccgtggaactattggtagaggataaaggaaaccaggtctaccgatgtgtgtataagcctatgcaaccagggccccacgttgtgaaaatcttttttgcaggggatacaattccgaagagtcccttcgtggtgcaggtgggcgaggcctgtaacccgaacgcgtgtagagcgtcggggaggggtctgcagccgaaaggggttaggatccgggagacaactgattttaaggttgataccaaggcagcaggctctggggaactgggtgtgaccatgaaagggccgaaagggctggaagaactggtcaagcagaaggatttcctggatggcgtgtatgcttttgagtattacccgagtactcccggaaggtacagcattgctattacctggggtggtcaccacatccccaaaagcccctttgaggtgcaggtaggtcctgaggctggaatgcagaaggtgcgagcatggggtccgggcctgcacggcggcatcgtgggtcggtcagcagatttcgtggtcgaatccataggatctgaagttggttccctcgggttcgccattgagggcccatcccaggctaagattgagtataatgaccagaacgatggtagttgcgatgtgaagtattggcccaaggagccaggtgagtacgcagtgcatataatgtgtgacgatgaggatatcaaagattccccatacatggcctttatccaccctgccaccggtggctacaaccccgatctcgtgcgcgcctatgggcccggattagagaaatctggctgcattgtgaataacctggcggaattcacagtcgacccaaaggatgcaggtaaagcaccattgaagatctttgcccaggatggggagggacagcgaatcgacatccaaatgaaaaatcggatggatggcacctatgcttgctcatacacacccgtcaaggcaataaaacacaccatcgccgtcgtatggggaggagtgaacatacctcattctccgtatagggtaaatatcggacagggatcgcaccctcaaaaggtcaaagttttcggcccaggagtggagagatcaggtctcaaggctaatgaaccaacccacttcaccgtcgactgtacggaagccggcgagggagacgtgtccgtaggcataaaatgtgatgcaagagtcctgagcgaagacgaagaggacgtggatttcgacattattcataatgctaacgacacgtttactgttaaatacgtcccgccggccgctggcaggtatacaattaaggtgttgtttgcctcccaggagattccagcaagtccattcagggtgaaagtggatccatctcacgatgcatcgaaggtcaaagccgaggggccagggctaagtaaagccggtgtggaaaacggcaaaccaacccattttaccgtgtatactaagggcgcaggcaaagccccgttaaatgttcaattcaactctcctctgcccggtgatgctgtcaaagacctggatattattgacaactatgactactcacataccgttaagtatactccaacccagcagggcaacatgcaggttttagtgacctacgggggtgatccaatcccaaagtcacctttcacggtgggcgtggccgcccctctggacctctctaagattaaacttaatggactggagaaccgtgtggaggtgggcaaggatcaggagtttacggtggacacgcgcggagcagggggccagggtaaacttgatgtgaccattttgtcccctagccgtaaagtagtcccatgcttagtgacccccgtgactggtcgagagaattcgactgccaagttcatccccagagaagaggggctctacgccgtggacgtgacctatgatgggcatcctgtacccggatctccatacacagttgaggccagcctgcctccagaccccagtaaggtcaaagcccacggaccaggcctcgaaggagggctggtaggcaagcccgccgaattcaccatcgacaccaaaggggccgggaccgggggcctgggccttacagttgagggtccttgcgaagctaaaattgaatgttccgacaacggcgacggaacctgcagcgtgagttacttacccacgaagccaggtgaatatttcgttaatatactgttcgaggaagtgcacatccccggaagcccctttaaggccgatatcgaaatgccctttgatcccagcaaagtggtggcttctggccccgggctggaacatggaaaggttggggaagccgggctgctgagcgtggactgtagcgaggctggccccggggcgctgggcttagaggccgtctcagactctggaaccaaagcagaggtctcaatccaaaataataaagacgggacttacgcagtgacctacgtacctctgacagccggaatgtatacattgactatgaaatacggcggggaacttgtaccccacttccccgctcgcgttaaggtcgagccagcggtcgacacctccagaatcaaagtatttggccccggcattgagggaaaagatgttttccgagaagcaacaacagatttcaccgtcgactcgcggcctctaacccaggtgggtggagaccacataaaagcccatattgccaatccctccggcgcttccaccgagtgctttgtcacggacaatgcagatgggacgtatcaggttgaatacaccccttttgagaagggtcttcatgtggttgaggtgacctatgacgatgtgcccatcccaaacagtccatttaaagtggcagtcactgagggatgtcagccatcacgtgtgcaggcccagggccctggcctgaaagaggcctttaccaacaagcctaacgtgttcaccgtggttacgaggggagccgggattggtggcctgggcattaccgtagaaggcccatctgagagcaagattaactgccgggataataaagatgggtcctgttcagcagagtatatcccctttgctccaggcgactacgacgtgaatattacttacggaggcgcccatatcccaggaagccccttcagagttcctgtgaaggatgtcgtagaccccagcaaggtcaagattgcgggccccggcttagggtcaggcgtgagagctagagtgctgcagtctttcaccgttgattcttctaaggcgggtttggcccccctcgaagtcagggtgttggggcccagaggtcttgtggaaccagtcaacgtggtggataacggcgacgggacacataccgttacttatactccatctcaggaagggccatatatggtgtcagtcaagtatgccgatgaggaaatacctcgaagtccattcaaggtgaaggtgctcccaacatacgacgctagcaaagtgacggcatccggacctggtctgtcctcttatggtgtgcccgccagcctgcccgtggatttcgcaattgacgcccgggacgctggggaaggactgttggccgtccagatcacggatcaggagggtaaacctaaaagggccatagtgcacgataataaagatggcacatatgctgtcacgtacattcctgacaaaacaggcaggtatatgataggcgtgacatatggcggagacgatatcccactttccccataccgcatccgggcaacacaaaccggggatgcatcaaagtgcctcgctaccgggcctggaattgcatctacggtcaagaccggggaggaggtgggtttcgtggtggacgccaagactgcgggcaagggtaaggtgacctgcactgttctcacacctgatggcaccgaggcagaagctgacgtgattgagaatgaagacggcacttacgatattttctatactgccgcaaagcccggcacctatgtgatttacgttagattcggcggagtggacatcccaaattctccattcacggtaatggtcactgaggaagcctacgtccctgtttcagatatgaacggcttgggattcaaacccttcgatctcgttattcccttcgccgtgagaaaaggtgaaattacaggggaggtacatatgccctcaggcaagacagccacgccagaaattgtggacaacaaagatgggaccgtcactgttcggtatgcacctaccgaggttgggctccatgaaatgcatatcaagtacatgggatcacacatccctgagtccccgctgcagttctacgtgaactatccgaactccgggtccgtcagtgcttatggtcccggccttgtgtatggggtggctaataagaccgcgacctttactatcgtgactgaagacgccggtgaaggtggcttggatctggccatcgagggcccttcaaaagccgagatctcatgtattgacaataaggacggcacctgtaccgtcacgtatctccccaccttgccaggggactactctattctggtaaaatacaacgacaaacacattcccggcagcccctttactgcgaagataacagatgacagcaggcgttgctcacaggtgaagctggggagtgccgctgatttcttgttggacatctccgagacagatctgtcttcactgaccgcaagtattaaagcaccgtctggtcgggatgagccctgccttctcaagcgcctgccgaacaaccatatcggtatctccttcattccacgggaagtcggggagcatctcgtttctataaaaaaaaacggaaaccacgtcgccaattctccagtgagcattatggttgttcagtctgaaataggcgatgcccggcgggccaaagtgtacgggcggggcctgagtgaaggcagaaccttcgagatgtccgacttcatagtggatactagggacgctggatacgggggcatttctctcgctgttgaaggtcctagtaaagtggacatccagactgaggatcttgaagatggcacctgcaaggtgtcttacttccctacggtccctggagtttacattgtgtctaccaagttcgccgacgaacacgtaccaggcagcccattcaccgtgaagatttcaggagagggtcgggttaaggaaagcataacccgcacatcacgtgctcccagcgtggcgactgtggggagcatctgtgacctgaacttgaaaataccagagataaattccagcgacatgagcgctcatgttacaagcccctcaggccgggtaactgaagccgagatcgtgcccatgggtaagaacagtcactgtgtgcggttcgtgccccaggaaatgggggtacacacggtaagcgtaaagtatcggggacagcacgtgactgggtctcccttccagttcaccgtcgggcctcttggcgaagggggcgcccataaagtgcgggctggagggccagggcttgagcgcggagaggccggggtacctgctgagttcagcatctggacgcgggaggccggcgccggcggacttagcatcgccgtggaaggtccttccaaggccgagattaccttcgatgaccataaaaatgggagttgcggagttagctatatcgcccaggagccgggaaattatgaggtcagcatcaagtttaatgatgaacatattcccgaatccccatacttggtccctgttatcgccccctctgacgatgcccgacgattgacagtaatgagcctgcaggaatccggactgaaggtaaaccagccggccagcttcgccatccggctgaatggcgccaaaggaaaaatcgatgcgaaggtgcactcaccctccggcgctgtggaagaatgtcacgtctctgagctggaaccagacaaatacgcagtgagattcatcccacatgagaacggcgtgcatacaatcgatgtaaaattcaatggatcccatgtcgtgggctcccctttcaaggtgagggtgggagagccaggccaggccggaaatcctgctttagtgtctgcttacggcacggggctggaaggtggcaccaccggaatccaatccgaattttttatcaacacaacccgcgcaggccctggcaccctcagcgtgaccattgagggcccaagcaaggtcaaaatggattgccaagaaactccggagggctataaagttatgtatactcccatggctcccggaaactacctcatatcggtcaagtacgggggccccaaccatatcgtggggtcaccattcaaggctaaagtaacgggccagcggctcgttagcccaggtagtgctaacgagaccagtagcattctggtggagagcgtcacaaggagttccaccgagacttgctatagcgcaatccccaaggcctccagcgacgcctcaaaggttactagcaaaggcgcagggttgtctaaggctttcgtcggacaaaagtccagctttctggtcgattgttctaaagccggcagtaatatgttgctcattggtgttcatggccccacaactccttgcgaagaagtctccatgaagcacgtcggtaaccaacaatataatgtgacctacgtagtcaaagaacggggagattatgtgctcgcagtgaaatggggtgaggaacacatcccaggcagccctttccacgttacagtgccctag

SEQ ID NO: 117153 - DNA, 7269 bp, Artificial Sequence
  Description of Artificial Sequence: Synthetic coding sequence
atgcaagagcacagtactagacgccggtctctcagcctgtgccctgactgggagtcctgggatccgcaaaaacccgtggataatgccagggaagccatgcaacaggcagatgactggttgggagttcctcaggtgattacccctgaagagattattcacccggatgttgatgaacactccgtgatgacatacctctcacagtttcctaaagccaagttgaagcccggcgctcctctgaagcccaagctgaatcccaaaaaggcccgcgcatacggccgcggtattgagcccaccggtaatatggtaaaacagccggccaaattcaccgtagacacaatatctgcagggcaaggagatgtgatggttttcgtggaggacccagagggcaacaaggaggaagctcaggtgacccccgacagcgataagaacaaaacctattccgtggagtatctccccaaggttacaggcttacataaggtgaccgtcctctttgcggggcagcacatctccaagtccccttttgaggtctctgtagacaaagcccagggggacgcctcaaaggtgaccgctaaaggccccggactggaggcggtgggtaatattgccaacaagcccacctactttgacatttacaccgccggagccggcgtgggtgatatcggcgtcgaggtcgaggacccgcagggcaaaaatactgtggagttactggtggaggataagggcaatcaagtctaccgctgtgtgtacaagcccatgcagcccggccctcatgtggttaagatctttttcgcaggggataccattcctaaatcaccctttgtggtgcaggtgggtgaagcttgcaatcccaacgcatgtagggcaagcggtagaggcttgcagcctaagggagtgcggattcgggaaactaccgatttcaaggttgatacaaaggcggcgggatctggggaactaggcgtgactatgaagggaccaaagggattggaggaactcgtaaaacaaaaggacttcctcgacggcgtgtacgctttcgagtactatccatcaactccagggcggtactccattgctatcacttggggcggacaccatatccccaagagcccttttgaagtccaagtgggtccagaggcaggaatgcagaaagtacgggcttggggccctgggctgcatggtggaattgtggggagatccgctgattttgtggttgaaagcattggttctgaggtggggagtctggggttcgctattgaagggccctcccaagccaagatcgagtacaatgaccaaaacgatggaagctgtgatgtaaagtactggccgaaagagcctggtgagtacgctgtgcacattatgtgtgatgatgaagacattaaggattctccatacatggctttcatccatcccgctacaggcggatataatccagaccttgttcgggcatatggtcccgggttggagaagtctggatgtattgtaaacaatctcgcagagttcacagttgatccaaaggacgccgggaaggcccctcttaaaattttcgcccaggacggcgaaggccagagaatagacattcagatgaagaacagaatggatggcacatatgcctgcagctacacacctgtgaaggctataaaacacacaatcgccgttgtctggggcggcgtaaacatcccacacagcccgtaccgggtgaacatcggtcaaggctctcacccgcaaaaagtgaaggtttttgggccaggagttgagaggtcaggactgaaagcaaacgagcctacccacttcaccgtagactgcacagaggccggcgaaggcgatgtgtcagtcggcataaagtgtgatgctcgagtcctttctgaggacgaagaggacgtcgatttcgatattatacacaatgccaatgacacttttactgttaaatacgttccccctgccgccggtagatatacaatcaaggtcctcttcgcctcccaagagatcccagcatcaccgtttcgcgtgaaggtagatcccagccatgatgcatcaaaggtcaaagccgagggcccgggactttctaaagccggcgtggagaatggaaaaccaacacactttaccgtgtatacaaaaggcgcaggtaaggcccccctgaacgtacagtttaatagccccttgcccggtgacgcagtaaaagacttagacataatagataactacgactatagccacacagttaagtacacgccaactcagcaggggaacatgcaagttctcgtcacatacgggggcgaccccatcccaaagagcccattcaccgtgggagtggctgctcctctggatctatcaaaaatcaaactgaacggattggaaaatcgggtcgaggtcggtaaagaccaggaatttacggtcgacactcggggcgccggggggcagggcaagttggacgtcactattctaagcccttccaggaaggtggtgccttgtctcgtcactcctgtgactggcagggagaatagcacggccaagtttatcccccgggaggagggactttacgcagtggatgtcacttacgatggccatccagtgccaggcagtccatataccgtagaggcatctttacccccggacccgtccaaagtcaaggctcatggcccaggattggagggaggacttgtcggcaagcccgccgagttcactattgacaccaagggagcaggaacaggcggcctgggcctgactgtggaggggccttgcgaggcgaagatagaatgttcagacaacggtgatggaacatgctcggtctcatacctgcctaccaaaccaggcgagtactttgtgaacatcctgttcgaggaggtgcatatccctgggagcccattcaaggccgacatcgaaatgccatttgatccttcaaaggtagtggcctctgggcccggtctcgaacatgggaaagttggagaggcgggactactaagcgtggactgttctgaagctggcccaggcgccttaggcttggaggcagtttccgactcgggaacaaaggccgaagtgagcattcaaaataacaaagatggaacatacgccgttacatacgtgccacttaccgcaggcatgtacacactgacaatgaagtacggcggcgaactggtgccccactttcctgcccgcgtgaaagtcgaaccagctgtggacactagccgaatcaaagttttcggacctggcatcgagggcaaggatgtttttcgcgaggcgactactgactttactgtggactctcggcctctcacacaggtcggtggcgatcacatcaaagcacatattgcgaaccctagcggagcctccacagagtgcttcgtcactgataatgctgacggcacttatcaggtggaatatacgccatttgaaaaaggactccatgtcgtagaggtcacctacgatgatgtgccaatcccaaactccccctttaaggtcgccgttaccgaagggtgccagccctctcgcgttcaggcccaggggccaggtctgaaggaggcctttacaaataaacccaatgtgttcacggtggtgacccgcggcgccggcataggcggcctggggataacagtagaaggaccatccgagtctaaaatcaattgccgcgataataaggacggatcttgtagcgccgagtacatccccttcgcccctggggattacgatgtgaatataacctatggaggtgctcatattcccggcagcccctttcgtgttcctgtaaaagatgttgtggacccatcaaaagtgaaaatcgccggcccaggcctgggctcaggagtgagggctcgtgttttacagtccttcaccgtcgactcctccaaggctggtctcgcacccttagaagttcgagttctgggacctcgtggactagtggaaccagtcaatgtcgtggataatggagatgggacgcacaccgtgacatacaccccctcacaggaagggccctacatggtgtcagtgaaatatgctgatgaggaaattcctcgaagtccctttaaagttaaagtgctgcccacctatgatgcctctaaggtcaccgcctcgggccctgggctgtcaagctatggggtcccggcgtcactgccggtcgatttcgcaatcgacgcccgggacgcaggggaaggtcttcttgccgtccagatcactgatcaggaaggaaagccaaaacgggcaatcgtgcacgataacaaagatgggacgtatgccgtgacttatattcctgacaagacaggacggtacatgattggggttacatatggaggggacgacatacctctttcgccttaccgtatccgcgccacccagactggggacgcctccaagtgtctggcaactgggccaggtattgcctccacggtgaaaacaggagaggaggttggtttcgttgtggatgctaaaaccgctggcaagggcaaagttacctgcaccgtccttacccctgacggcacagaggcagaagctgatgtgatcgaaaatgaagacggcacatatgatatcttctacactgcggcgaaaccaggtacatacgttatctacgtgcggtttggcggggtggacataccaaattccccattcacggttatggccactgacggagaggtcacggctgtggaagaggccccagttaccgaggaggcatacgttcccgtaagcgatatgaatggcctgggattcaagccttttgacctggttattcccttcgccgtgagaaaaggagaaataactggagaggtgcatatgccaagcggaaagacagcaacacccgagatcgtcgacaataaagatggcactgtgaccgtcagatacgcgccgaccgaagtggggctgcatgaaatgcacataaagtatatgggatcacacatacccgagagccctttgcaattctatgtaaactacccaaattccgggtctgtgagcgcatacggtccaggattggtatacggtgtcgctaataagacagccacgtttacgatagtgaccgaggacgctggggagggcggcctcgacctcgctatcgaggggccaagtaaggctgaaatttcatgcatcgacaataaagatggcacctgcactgttacatatctccccacactgccaggggactactccatcctcgtgaaatacaacgataagcacatccctggatctccctttactgcaaagatcactgatgattcgcgacggtgcagtcaagtgaagctggggtctgccgctgactttctgcttgacatttctgagaccgacctgtcatcattgaccgcaagtataaaagctccttcgggccgcgatgaaccatgcttgctcaaacggctgccaaataatcacatcggaatctcttttattccgagagaggtcggtgagcatttggtgtctatcaagaagaatgggaaccatgtggctaattccccggttagtatcatggtcgtgcagagtgaaatcggagacgccaggcgcgctaaagtctacggcaggggcttatccgaaggcagaaccttcgagatgtcagacttcattgtcgatactcgtgatgcaggctatgggggcatctccttggccgtagaagggccctcaaaagtggacatacagaccgaggatctggaggatggaacatgcaaggtgagctactttcccacagtcccaggcgtgtacatcgtgtcaaccaaatttgccgacgagcacgtcccgggcagcccattcactgtaaaaatttcaggagaaggcagggtaaaggagagcattacacgcactagccgcgccccctctgtggccactgtgggctcaatttgcgatctcaacctgaagattccagaaattaactcttccgatatgtccgcccatgtgacatccccatctgggcgggtaactgaggccgaaatcgttcccatgggtaagaactcacactgcgtccgcttcgtgccccaagaaatgggtgtgcacacggtttctgttaaatataggggacagcacgtgacaggatctccctttcagtttactgtcgggcctctgggtgagggaggcgcacataaggtcagagccgggggccctgggctggaaagaggagaggccggcgttccggccgagttttcgatctggactagagaagctggtgcaggtggcctttcaatcgcagtggagggaccgtctaaagccgaaatcacatttgatgaccacaagaacggaagctgtggagtgagctacattgcccaggaacctggcaactacgaagtgtctattaagtttaatgatgaacacattcccgagtccccctatctcgtgcctgtgatcgcaccctcagatgacgcaaggaggctgaccgtgatgtctttgcaagagtctggtctgaaggtaaaccagccagccagcttcgctatccgcttaaacggtgccaaaggaaagatagatgcgaaggttcactccccaagcggagctgttgaagaatgccatgtctccgagctggaacccgataaatatgccgtccgatttatcccacacgaaaacggtgtccacaccatagacgtgaaattcaacggatcgcatgtagtgggttctccattcaaggtgagggtgggagaaccagggcaggcagggaatccagccctggtatccgcctatggcactggcctggaggggggaaccacagggatccaatccgagttctttataaacaccactcgcgccgggccaggcacgctgtcggtcacaatcgagggccctagcaaagtgaagatggattgtcaagaaactccggaagggtataaggttatgtatacacctatggcaccaggaaattacctcatctcagtgaagtatggtggccccaaccacattgtcggttcaccttttaaagctaaagtgacagggcaaagactggtctctcccggaagcgccaatgaaacgtcaagtattttagtcgagtcagtgacacggagctctaccgaaacctgttacagcgccatcccgaaggcctcttctgacgctagtaaggtcactagcaaaggagccggactgtccaaagctttcgtcggtcagaagagctcctttctcgtggattgtagtaaggccggtagtaacatgttgctgatcggtgtgcacggccccacgaccccctgcgaggaggtttcgatgaagcacgttggtaatcagcagtataatgtcacctacgttgttaaagagcgcggagattacgtcctggccgtcaagtggggggaggagcacatcccagggtcccctttccacgttacggttccctag

SEQ ID NO: 117154 - DNA, 7776 bp, Artificial Sequence
  Description of Artificial Sequence: Synthetic coding sequence
atgcccgtcacagaaaaagacttggccgaagacgccccttggaagaagattcagcagaatacctttacgaggtggtgcaatgaacacttgaaatgtgtcaacaaaagaatcgggaatctgcaaacagatctgagcgatggcctcaggctgatcgccctccttgaagtgctcagccaaaagcgcatgtacaggaaatatcaccaacggccgaccttccggcagatgcagctggaaaatgtgtcagtagccttggagttcctcgatcgggaaagcatcaagctcgtctcaatagactccaaggcgattgtggacggtaacctgaagctcattctcgggctggtgtggacgttgattttgcactactccatctcaatgccggtctgggaggatgagggggatgatgacgcaaagaagcagaccccaaaacagagactgctcggatggatccaaaataagatcccctatttgcccatcacaaatttcaaccagaattggcaagacggtaaggccttgggggcactggtcgatagctgcgctccaggcctgtgtccagattgggaatcatgggacccacagaagccggtggacaacgccagagaggctatgcaacaagctgacgactggctcggcgtcccgcaggtcatcactcccgaagaaattatccacccagacgttgatgagcactccgtgatgacttacctgtcacagtttccaaaggcaaagctgaagccaggcgcccctctcaaacctaagctaaatcctaaaaaagctcgtgcttacggacgaggcatcgagcccaccgggaacatggttaaacagcccgccaaattcacggtggacaccatctccgctggacaaggcgatgtcatggtctttgttgaagatcctgaaggcaataaagaagaggctcaggtgacacccgacagcgataaaaataagacctacagtgtggagtatctgccgaaggtcaccggcctgcataaagttactgttcttttcgctggccaacatattagtaaatctcccttcgaggtcagtgttgacaaagcacagggggacgcaagcaaggtgacggcaaagggtccaggcctcgaagccgttggcaacatagccaataaacccacttatttcgatatctacactgcaggagctggcgtgggagatattggcgtggaggtggaagaccctcaggggaagaataccgttgagctgctggtagaagacaaaggcaaccaagtctataggtgcgtctataaaccaatgcaaccaggaccgcacgtggtcaagatcttctttgctggagatacaatcccaaagagcccctttgtagtgcaggtgggggaggcctgcaacccaaacgcgtgcagggctagcggacggggcctgcagcctaagggagttcgaattcgggagacaacagacttcaaggtggatactaaagcagccggctctggagagttaggtgtgacaatgaaaggccctaaaggcttagaagagctggtaaagcaaaaagacttcctggacggagtctatgccttcgaatattaccccagtacccccgggaggtacagcatcgctattacctggggaggtcatcacatcccaaagagtcccttcgaagtgcaggttggacctgaggcgggaatgcagaaggtacgggcttggggtccagggcttcatggtggtatcgtcgggcgcagcgcagattttgtcgtggagagcattggctccgaggttggctccctggggtttgctattgagggcccttcacaggctaaaattgagtataatgaccagaacgatggcagttgtgacgtcaagtattggccgaaagagcccggtgagtatgcggtacatatcatgtgcgacgatgaagatattaaggatagcccctacatggcattcatccaccccgctacgggcggttataaccctgacttagtgagagcctatggaccaggtttagagaaaagtggttgcatagtgaacaacttagccgaatttaccgttgaccctaaggatgctggcaaggcccccctgaaaatcttcgctcaggatggagaaggtcagcggatcgacatacagatgaaaaatcgtatggacggcacctatgcgtgcagctatacacctgtcaaggccattaagcatactatcgcagtggtttggggcggggtgaacatccctcactcaccctaccgggtgaatatcggccagggaagtcacccacaaaaagttaaagtattcgggcctggcgtggaaaggtctggactcaaagccaacgaacccacacacttcaccgtagactgtaccgaggccggcgaaggagatgtaagcgtcggtataaagtgtgatgcgagagtcctgtccgaggacgaagaggatgtcgactttgacattatccacaatgcaaatgataccttcaccgttaaatacgtgccccccgccgcgggccggtataccattaaagtcctattcgcgagccaggagattcctgcctccccattccgagtgaaggtggatccatcccatgatgcctcaaaggttaaagcagaagggcccgggctgtccaaggcaggggtcgagaacggaaaacccacccatttcacagtgtacaccaagggtgctgggaaggcacctctgaacgttcagtttaactcccctttgcccggtgatgccgtaaaggatctggacatcattgacaattatgactactcccacactgtgaagtacaccccaacgcagcaaggaaacatgcaggttctcgtaacgtacggaggcgaccctattcctaaatctccttttacggtgggcgtggcagccccgctagatctttcaaagatcaagctcaacggcctagagaacagagttgaagtcggaaaagaccaggaattcacagtggatacaagaggcgcaggtggtcaggggaagctggatgtgaccattctgagcccatcacgcaaagtcgtaccgtgcttggtgacacccgttacagggagggagaactcaacggcaaaattcattcctcgcgaagaaggcctctatgccgtggacgtcacatatgacggacaccctgtgcctggatccccatatacggtggaggcctcactccctcccgacccatcaaaagtaaaggcacatgggccagggctggagggcgggctggtcgggaagcccgctgagttcaccatagacaccaaaggggccggaactggagggctcggcctcacagttgagggcccatgtgaggccaaaatcgaatgttctgataacggagatggtacctgttcagtcagctatctaccaacaaaaccaggggagtactttgtaaacattctattcgaagaggtgcatatcccaggttctcccttcaaagcagacatagaaatgccttttgatccttccaaagtcgtggctagtggtccagggttagagcacggtaaagtcggagaggcgggattgctgagcgtggactgctcagaggcgggacctggcgccctgggccttgaggccgtatctgactccggcacgaaagccgaagtgtccatccagaacaacaaagacggaacttacgcagttacctacgtgcctctgactgctggtatgtacacgctcactatgaagtacggaggcgagcttgtccctcatttcccagcacgggtcaaagtcgagccagctgtcgacaccagccgcattaaagtgttcggaccagggatcgagggcaaggatgtttttcgcgaggcgacgacggactttaccgtggattcccgcccactcactcaggtaggaggcgaccacattaaagctcacatcgcaaatccctcaggggcctctacagagtgtttcgtgaccgataacgccgacggtacctaccaggttgagtacacaccattcgaaaagggcctgcatgtggtagaggtgacttatgatgatgtacccatccctaacagtcccttcaaagtcgcagttactgaaggctgccagccttccagggtccaggctcagggccccggactgaaggaggccttcaccaacaaaccaaatgtgttcactgttgtgacacggggcgcaggaataggcggcttgggcatcactgtcgagggcccttccgagagcaagattaactgccgagacaataaagatggaagctgctctgctgaatacataccctttgctcctggggactatgatgtgaacatcacctacggcggtgctcatattccgggaagtccatttagagttccagtgaaggacgttgttgacccttctaaggtgaaaattgctggcccaggattgggaagcggagtgcgcgccagggttctgcagagtttcacagtggacagctccaaggctggcttagcacccctggaggtgcgtgtccttgggccaagggggctggttgagcccgttaatgtcgtggacaacggggacggcacccatacagttacctataccccctctcaggaaggcccgtacatggtgagcgtgaaatatgcagacgaggagatcccacgatctcctttcaaggtaaaggtgttgcccacttatgacgcttctaaggtcactgccagcgggccagggttgtcctcgtacggggtaccagcgagcctgcctgtggactttgctatcgacgccagggatgccggggaggggcttctcgcagtacaaatcacagatcaggaagggaaacccaaaagagctattgtacacgacaataaagatgggacatacgcggtcacgtacatcccggacaaaaccggaaggtacatgataggagtaacttatggcggagacgatattcctctgagcccttaccgcattagagccacccaaaccggggacgcatccaagtgtctcgccacagggccaggcatagcgtccaccgtaaagactggcgaggaggtgggcttcgtggtagacgctaaaaccgccggaaagggaaaagttacctgtacagtcctcacacccgatgggacggaggccgaagcagatgtaatcgaaaacgaagatggcacctatgacatcttctatacagctgcaaagcctgggacatacgtaatctacgtgaggttcggcggtgtagatattccaaattctccttttacggtcatggccacggatggggaagtgacggccgttgaagaagcccctgtaaccgaggaagcttatgtccctgtcagcgatatgaatggtcttggattcaagccctttgacctggtgattcctttcgccgtgaggaaaggggaaataaccggtgaggttcatatgccatccgggaagactgctacgcctgagatcgtcgataataaggatggcaccgtgacagttagatacgcgcccaccgaagtcggtcttcacgagatgcacattaagtacatgggctctcacattcccgaatctccactccagttttatgtgaactacccaaacagtgggagcgtaagtgcctacggcccaggcctcgtgtatggcgttgctaacaagacggcgacttttaccatcgtcactgaggacgctggagaagggggtctggatctggccatcgagggcccaagcaaggccgaaatcagctgcattgacaacaaagatggaacttgtacagtgacgtacctccccacgctcccaggtgactactcaatcctggttaagtataacgacaagcacattcccggatcccccttcactgcaaaaattacagatgatagtcgccggtgtagtcaggtaaaactcggatcggccgcagactttctgttagatatctcggaaactgacctgtctagtctgaccgccagcatcaaagccccaagcgggcgggatgaaccttgcctgctgaaaaggcttccaaataaccatataggaatctcatttatcccccgcgaggtgggtgaacatctcgtaagcataaagaaaaatggaaaccatgtcgcaaatagcccagtgtcaattatggtcgtgcagagtgaaattggcgatgctaggcgggctaaagtgtacggacgagggctttcagagggaaggacatttgagatgtccgatttcatcgtcgacaccagagatgcaggttatgggggcatctctctggccgttgagggaccaagtaaggtggacatacagactgaggacctggaagacggaacctgtaaggtgagctacttccccacagttcctggcgtgtatatcgtgtcaaccaagtttgccgatgaacacgtgcccgggtccccttttacagtgaagatttcaggagaggggcgagtgaaagagtcaattacacgcaccagtcgggctccgtcagtggccaccgtgggatccatttgcgacctgaatctaaaaatccccgaaattaactcctccgacatgtccgctcacgtgacttcccctagtgggcgagtgactgaggccgagatcgttccgatgggcaagaacagccattgcgtgcgctttgtgcctcaagagatgggtgttcacaccgtatcagtgaagtatcgcggtcagcacgtgaccgggagcccatttcaatttactgtagggccactaggcgaaggcggcgcacataaggtccgggctggcgggcctggccttgagagaggtgaagctggagtgccagctgagttctctatttggacacgcgaggctggcgccgggggtttgagtattgctgtggaggggccctccaaggcggaaatcaccttcgacgatcacaagaatggatcttgtggcgtgtcttacatcgcccaagagcccggtaactacgaagtgagcatcaagttcaacgacgaacatatccccgagtctccttaccttgtgcctgtgatcgcgccgtcggacgatgccaggcgtcttactgtcatgtcgctccaggaatccgggctgaaggtcaaccagccagcctcttttgcgataagacttaacggggccaaaggcaagatcgacgccaaggtgcactcgccaagtggagccgttgaggagtgtcacgtttccgaacttgaaccagacaagtacgccgtacggtttatcccgcacgaaaacggtgtgcatacaattgacgtgaaattcaatggctcgcacgtggtggggagccccttcaaagtgcgggtgggagaaccggggcaggctgggaaccctgctctggtcagcgcgtacggaaccggcttagagggcggcacaactggtatccagagtgagttctttattaataccactcgagccgggccaggtaccctgtcagtcactatagaagggccctctaaagtcaagatggattgtcaggaaacccccgagggctataaagttatgtacacccctatggctcccggaaattatctcatctctgtgaagtacgggggtccgaaccacattgtgggatcgccatttaaggctaaggtcacgggccagcggctcgtgagcccagggagcgcaaatgaaacctcatcgatcctggtagaaagcgtgacgcgcagctcgacagagacttgctactccgccatccccaaagccagctctgacgccagcaaggtgacatccaaaggcgctggcctgagtaaagcatttgtgggccagaagtctagctttcttgtggattgcagtaaggcgggatcaaatatgctcctgatcggagtccatggccctaccactccttgcgaagaagtatcgatgaaacacgtgggcaatcagcagtacaatgtaacgtatgtggtcaaggagcgtggagactatgtcctggccgtgaagtggggagaagagcatattcccggttcaccgttccacgtgaccgtcccctag

SEQ ID NO: 117155 - DNA, 408 bp, Artificial Sequence
  Description of Artificial Sequence: Synthetic coding sequence
tagctggccgttgaggggccttccaaggttgacattcagaccgaggacttggaagatggaacatgtaaagtctcttactttccgactgttccgggcgtgtacatcgtttccactaagttcgccgacgagcacgtccctgaaatcaactcgagcgacatgtccgcacatgtcacatctcccagtggacgcgtaacagaagccgagatcgttcccatgggaaagaactctcactgtgttcgtttcgttcctcaggagatgggcgtgcacaccgtttcagtcaaatacagagggcagcatgtcaccggtagccctttccagttcaccgttggcccactaggtgaaggcggtgctcataaggtgcgagcaggagggcctgggctggagagaggtgaagctggggtcccctag

SEQ ID NO: 117156 - DNA, 7902 bp, Artificial Sequence
  Description of Artificial Sequence: Synthetic coding sequence
atgcctgttacggaaaaggacctggccgaggacgctccctggaagaaaatacagcagaacactttcacccgttggtgcaacgagcacctgaaatgtgtgaataagagaatcggaaatctccagacggatttgtcagacgggctgaggttgatcgccttgttagaggtattgtcacaaaagagaatgtatcgaaaatatcatcagcgcccaaccttccgtcaaatgcagcttgaaaacgtatctgtcgcactagaattcctggaccgcgagagtatcaagctcgtcagcatcgattccaaggccatagtggacgggaacctgaaattgatactggggctggtttggaccctcattctgcattattctattagtatgcccgtgtgggaggatgaaggcgacgacgacgctaagaagcagacgcctaagcagcgactactgggctggattcagaataagataccttacctccccataacgaatttcaatcagaactggcaggatggaaaagccctaggggcactcgttgactcctgtgcccccgggctgtgccccgattgggagagttgggatccacagaaacctgttgataatgccagagaggctatgcagcaggccgatgattggctgggagtgccacaagtaataaccccagaggagataatccatccagacgtggatgaacacagtgtcatgacttacctctcacagttcccaaaagctaagctcaagccgggcgctccactgaaaccgaaactcaatcctaaaaaggcaagagcatatgggcggggtatcgaaccaactggaaacatggtgaagcagcctgccaaattcacagtggatactatttcggccggccagggagatgtgatggtcttcgttgaggaccccgaaggcaacaaggaggaggcccaggttacacctgatagcgacaagaacaagacgtattccgttgagtacttgccgaaagtaactggcctgcataaagtgactgtgctatttgcaggacagcatatcagcaagtccccctttgaggtgtcagtcgataaggctcagggtgacgccagcaaggtgactgccaaaggcccggggctcgaggcagtagggaacattgccaataagcctacctacttcgatatttatactgctggagccggggttggggacatcggggtagaggtcgaagacccgcagggcaaaaacacagttgaacttttggtcgaggataaaggcaatcaggtttaccggtgtgtttataagccaatgcagccaggccctcacgtggtgaagatcttcttcgctggtgacacaatacccaagtctcccttcgtagtgcaagtgggtgaggcctgcaatcctaatgcatgtcgcgcatcagggagaggactccagcccaaaggagttcgtatacgcgaaaccacggactttaaggtggacaccaaggctgcaggatctggcgagcttggtgttacaatgaaaggacccaagggcttagaagaacttgtgaaacagaaggatttcctagacggagtctatgcctttgagtactatccatcaacccccggcagatatagcattgcaattacttggggtggccatcatatccctaagtcccctttcgaggttcaggtcggcccggaggctggcatgcagaaggtgcgagcatgggggccagggctgcacggcggaattgtggggcgctccgctgacttcgtggtggaaagcatcggcagcgaggtgggctccctcggatttgcaatcgagggtccctcgcaagctaagatcgagtataatgatcagaatgacgggtcctgcgacgttaaatattggccaaaggagccgggcgagtacgcagttcatataatgtgcgatgatgaggacatcaaggattcaccatatatggccttcatccatcctgctactggaggctacaatcccgatctggtacgagcttatggacctgggttagaaaagtcaggctgtattgttaacaatctggcggagtttactgtcgaccctaaggatgctggcaaagcgcccctgaaaatttttgcccaagatggcgaaggccagcgaatcgacattcagatgaagaataggatggatggaacatacgcgtgtagctataccccagtaaaggctattaaacatactatcgctgtggtgtgggggggagtgaacataccccactctccatacagagtaaacattggtcaggggagtcatccccagaaggtgaaagtgttcggccctggcgtggagaggtccgggttgaaggcaaacgaaccaacccattttactgttgactgcaccgaggccggtgaaggcgacgtgagcgtgggaatcaaatgcgacgctcgcgtgttgagtgaggatgaggaggatgtggatttcgacatcatccataatgccaacgacacgtttactgtgaaatatgtgccccccgccgccggtcggtacacaatcaaagttctttttgcttcacaggagatcccagcgtcccctttccgcgtgaaagttgacccaagccacgatgcctcgaaagtgaaagcagagggccccggactgtccaaggccggggtggagaacggcaagccaactcatttcacggtatatacaaaaggtgccgggaaagcccccttgaatgtgcaatttaattcgcctcttcctggggacgcagtgaaggacttggatataatcgacaattacgactactcccacacagttaagtacactccaacacagcagggcaatatgcaggttttggtgacatatggcggagacccaattccaaagagcccgtttaccgtaggcgttgctgcacccctggacctttccaaaattaagttgaacggattggagaatcgtgttgaggtcggaaaagaccaagagttcacagtggacactcgaggagccggcggccagggcaaattggacgtcactatactctccccgagccggaaggtcgtcccgtgtctcgtgaccccagtgacagggcgggaaaactctaccgccaagttcatacctcgggaggaggggctctacgctgtcgacgtcacctatgacggacaccccgtgcccggttccccttacactgttgaagcaagtctgccacctgatccctcgaaggtgaaggcacacgggccagggctggaggggggtctagtggggaaaccagctgaattcactatcgacactaagggtgccggaacagggggacttggcctgacggtggaagggccatgtgaggctaaaatcgaatgtagcgataatggcgatggaacatgcagtgtctcctacctgccgaccaaacctggcgagtacttcgtgaacatactattcgaagaggtgcacattcccggatccccattcaaagcagacatcgaaatgcccttcgatccaagtaaggtggtcgcctcgggtcctggtttagaacacggaaaagtgggcgaagctggcttgttgtctgtcgactgctccgaggcaggtccaggcgcccttggcctggaggctgtctccgatagtggaactaaggccgaagtctctatacaaaacaacaaggatggaacgtatgccgttacctatgtccctctgaccgctgggatgtacaccctgaccatgaagtatgggggtgagctcgtgccccatttccctgcacgtgtgaaggtcgagccagcagtggacacctccagaatcaaggtgtttgggcccggaatagagggcaaggatgtgtttagagaagcaacaactgatttcaccgtggactccagaccactgactcaggtggggggagatcacattaaggctcacattgctaacccttccggagctagtacggaatgtttcgttacggacaacgccgatggcacttatcaggtggagtacacacccttcgagaaaggtctccatgtggtggaagttacatacgacgacgtccccatcccgaacagtccgtttaaggtggcagtgaccgaaggctgccagccaagtcgagtgcaggcgcagggccccggcctgaaggaagcctttaccaataagcccaacgtgttcacagttgtcacaagaggcgcaggcattggtgggctgggaattaccgtcgaaggtccatctgagtcaaagataaattgtagggataacaaggatggcagctgcagcgcagagtatatacctttcgctccgggcgactacgacgtaaacataacttacggtggtgcccacatccctgggtcaccctttcgagtgccagttaaagatgtggtcgatccctccaaggtgaaaatagctgggccgggactgggtagtggagttcgtgctagagtcctgcaatcctttaccgtggactcaagtaaagccgggttagcacccctcgaggtccgagtactcgggcccagggctgatgacacagattcccagtcctggcgcagcccacttaaagctctgtccgaatttttcaaaggtgatcctaaaggcgacttcaacaagactggtctggtggaacccgttaatgtagtggacaatggtgacggtacacacactgtgacatatacaccatcccaagagggaccttatatggtgtctgtcaagtacgctgacgaagaaatcccgcggtctccttttaaagtcaaggttctgccaacttacgacgcctccaaggtgactgcttccgggccaggactgtcctcgtacggggtcccagcctctttgcctgttgatttcgcaattgatgccagagatgcaggggagggccttcttgctgtgcagataaccgatcaggaggggaagccaaagcgtgctattgtccatgacaataaggacggcacctacgcggtgacctatatccccgacaagacaggccgatatatgataggggtgacatacggcggtgacgacatcccgttgtcaccctatcgcattagggcgacgcagaccggtgacgcatctaagtgtttagccaccggccccggaatcgcgtctaccgtcaagaccggggaagaggttgggttcgtcgtagatgccaagaccgctggcaaaggcaaagtgacgtgtacagttctgacacctgacgggaccgaggcagaagcagatgtgattgagaacgaagacgggacctacgacattttttataccgccgccaagccagggacgtacgtcatttatgtgagattcgggggcgtggacattcctaatagtccattcactgtgatggcgaccgacggggaggttactgccgtggaagaagctcccgtaaatgcctgtccacctggatttcgaccctgggtcacagaggaggcatacgttccagtttcggatatgaatggacttggatttaaaccctttgacttggtaataccctttgcagtgcgaaagggcgaaatcacaggtgaagttcatatgcctagcggcaaaacggccacaccggagattgttgataacaaggacggtacagtgacggtgcgatatgcacctactgaagttgggctgcacgaaatgcacattaagtacatgggttcacacatcccagagagccctctgcagttctacgtgaattaccctaactctgggtccgtgtctgcctatggtccggggttggtgtatggagtcgccaacaagacagccaccttcactattgtaacagaggacgctggagaaggagggctggacttagctatagaaggtcctagcaaggccgagatttcatgcattgacaataaggatggcacctgtaccgtcacctaccttcccaccctgcccggcgattattccattctggtcaagtacaacgataagcacatccctggatccccattcacagccaagataaccgacgactctagacgatgctcccaggtgaaactcggtagcgcagctgacttcttactggatatctcagaaacagatctgagttctctaacagcctccattaaggctccatccggccgcgatgagccttgtttgctgaaacggctgcccaataaccatatcggcatcagctttataccccgagaggtgggagagcatctggtaagcataaagaagaacgggaaccacgtagcaaattcccctgtgagtatcatggtggtccagtctgaaataggggatgcaaggcgggccaaagtatatgggcgaggcctgagtgagggccgcacgtttgagatgtccgatttcatcgttgacaccagggacgccggatacggaggaatcagtctcgcagtggaaggcccaagtaaagtcgatatacaaacagaagatctggaggatggtacctgtaaagtgagctatttccctacagtaccaggagtctacatcgtatcaaccaagtttgctgacgaacacgtaccggggagcccattcacagtaaaaatctctggggaaggcagagtgaaggaaagtattactagaacatcccgagcccctagcgtcgctacagtgggcagcatctgtgacctgaacctcaagatcccagagatcaatagctctgacatgagcgcacatgtcacctctccaagcgggagggtcaccgaggccgaaatcgtccccatgggcaaaaatagccattgtgtgcgttttgtcccgcaggaaatgggtgtgcataccgtgtctgtgaaatataggggacagcatgtcacaggctcaccatttcaatttaccgtggggccactgggtgaggggggcgctcacaaggtgcgggccggcggtcccggtcttgaaagaggtgaagccggcgtccctgccgagtttagcatctggacccgggaagcgggggctgggggactatctatcgctgttgagggcccttctaaggctgaaatcaccttcgacgatcacaaaaatggatcctgtggcgtgtcctacatagctcaggaacccgggaattatgaagtttccattaaattcaacgacgagcacattccagaatctccctacctggtccctgtcatcgcgcccagtgacgatgccaggagactaacagtcatgagtctgcaggagagcgggctaaaggtgaatcagccagcttccttcgcaattagactcaatggcgccaagggtaaaatcgacgccaaggtgcatagtccatcaggggcagtcgaagagtgccacgtttcagaattggaacccgacaagtacgccgtacgctttatcccccatgagaacggagttcacaccatcgatgtgaaattcaatggctcccatgtcgtaggcagccccttcaaggtgcgggtgggtgaacccggtcaggcaggaaatcctgccctggtttctgcttatggtacgggcctggagggaggcactaccgggattcagtcagaatttttcatcaataccactagagctgggcccggcacacttagtgtgactattgagggcccgagtaaagtgaagatggactgtcaggaaacacccgaggggtataaagtgatgtatacgcccatggcacctggcaattacctcattagtgtgaagtatggagggcctaaccacatcgtcggttcacctttcaaagccaaggtgacgggccagagactcgtgtctcctgggtccgccaacgaaacctccagtattctggtagaaagcgtgaccaggagcagtacagagacttgttattcagctatccctaaggcttctagtgacgctagcaaggtcacctctaagggtgctggcctgtccaaagcttttgtaggtcagaaatcctcctttctcgttgattgctctaaagcgggcagtaacatgctgctcattggcgtgcatggccccactactccgtgcgaagaagtgtctatgaaacacgtgggaaaccagcagtacaatgtgacctatgttgtaaaggagaggggagattacgtgctggcggtcaagtggggcgaggagcatatccctggatcccctttccacgtcacagttccttag

SEQ ID NO: 117157 - DNA, 8178 bp, Artificial Sequence
  Description of Artificial Sequence: Synthetic coding sequence
atgatgaacaattctggatactctgacgccgggctgggcctgggcgatgagaccgacgaaatgcctagtacagagaaggatctggccgaggacgctccctggaagaagatccagcagaataccttcacacgctggtgcaacgaacacctgaaatgtgtcggaaaaagactcactgacctgcagcgggacctgtcagacggcctcagacttatcgccctgctggaagtgctgtcacaaaagcgcatgtataggaaattccacccgagaccaaacttccgccaaatgaagcttgaaaatgtgtctgtggccctcgagtttcttgagagggaacatataaagttggtctccattgactctaaggctatagtggatgggaatctgaagctgattctgggcctcatatggacactcatcctgcactactccataagcatgcctatgtgggaagatgaagacgacgaagacgccaggaagcagacccctaaacagcgtctgctgggctggatccagaacaaagtaccacagctgcctattaccaattttaaccgcgactggcaggatggtaaggcgctcggagcccttgtcgacaactgtgcgccaggcctttgcccagactgggaggcctgggatcccaaccagccagtggagaatgcacgggaggcgatgcagcaagccgacgattggctgggtgtgccccaggtgattgcccctgaagagatcgtggatcccaatgtggatgagcattcagtcatgacatacctcagtcagttccctaaggccaaattgaagcccggagccccggttcgcagcaaacaacttaatccgaagaaagccatcgcctacgggcctggcatagaacctcaaggcaacacagtccttcagcccgcgcacttcacagtgcagactgtcgatgcgggggttggcgaggtgctggtgtacatcgaggaccctgaaggccacaccgaggaggctaaagtggtgcccaataacgataaggatagaacgtacgctgtgagctatgtgcctaaagttgctggattgcataaggtaactgtcctttttgccgggcaaaacatagagagatcacctttcgaagtgaatgttggcatggccctaggcgacgctaataaggttagtgctcggggtcctgggctggagcctgtgggcaacgtcgccaataaacccacatactttgacatttatacagctggcgctgggaccggtgacgttgccgtggtaatcgtggatcctcaaggccgtagagacacggtggaagttgcattagaggacaaaggagacagtacattcaggtgtacatatcgcccagcgatggaaggacctcacaccgttcacgtggcatttgcaggcgcccccatcacccggagccctttccccgtgcacgtcagtgaagcctgcaaccctaacgcgtgtagagcttccggccgaggactccagccaaagggtgttcgagtgaaagaggtagcagacttcaaagttttcaccaaaggtgctggatcgggtgaactgaaggtgactgtgaagggccccaaaggcactgaagagccagtgaaggtcagggaggccggggacggcgtgtttgagtgtgagtattaccccgttgtccctggaaaatatgtggtaaccatcacctggggcggatacgcgattccccgaagtccctttgaagtccaggtttcgcccgaggcaggcgtgcagaaagtgcgggcttggggcccaggcctcgaaactggccaggtggggaaatctgccgatttcgtggttgaggccatcggcaccgaagtaggaaccctgggattttctatagagggcccaagccaggcaaaaattgagtgtgatgacaagggcgacggatcttgtgacgttcgatactggcccaccgaaccaggagagtatgccgtccacgtcatctgtgacgatgaggatattcgagattctccatttatagcacacattttacccgccccacctgattgcttccctgacaaggtgaaagcatttggcccgggtctggaacctacaggctgtatagtagataaaccagcagaatttactattgacgctcgggccgctggtaagggagacctgaagctgtacgcccaggatgcagacgggtgtcccatagacattaaagtaattcccaacggagacggcacttttcgctgctcttatgtgcccacaaaacctattaaacacaccatcatcatctcatggggaggggtgaacgtccctaaatctccattccgggtgaatgtcggggagggcagccacccagagcgtgttaaagtctatggtccgggtgtggagaaaaccggtctgaaagcgaatgaaccgacgtatttcaccgtcgattgcagcgaagcaggccagggggacgtgagtattggtataaaatgcgcccccggtgtcgttggtcccgctgaagccgatattgattttgacattataaaaaacgataatgacacgtttacagtgaaatacaccccacccggtgctggaagatacacaatcatggtactatttgcaaatcaggaaattcctgcaagcccctttcatataaaagtggatccaagtcacgatgcctccaaggtgaaagcagaagggcctggccttaacaggacaggtgtagaggtagggaaacctacccacttcaccgtcttgaccaagggggccggcaaggccaagttagacgtccagttcgctggtaccgcaaaaggtgaggttgtcagggacttcgaaataatcgacaaccacgattactcctatacagtgaaatatactgcagtgcagcaggggaatatggccgtgaccgtgacgtacggtggcgaccctgttcccaagagccccttcgtggtgaacgtggctcccccactggatttaagcaaaatcaaagtgcagggcctgaacagcaaagttgccgttggtcaggagcaggcattttccgtcaacactagaggggccgggggtcagggtcagctggacgtccgaatgacaagtccttctagaagaccgataccttgcaagctggagcctggcggcggcgcggaagctcaggctgtgcgttacatgccgcctgaggagggcccatacaaagtggacatcacctacgacggacaccccgttcccggtagcccatttgccgtcgaaggagtgctgccacccgacccctcgaaggtgtgcgcgtacgggcccgggctgaaaggcgggctggtcggcactccagccccattctccatcgacactaagggggccggcacaggagggctgggtttgacagtcgagggcccttgcgaggcgaagatcgaatgccaagacaatggagacggatcgtgtgcggtgtcctacctccccacggagccgggcgagtacaccattaatatcctgttcgccgaagcacacataccaggtagtccctttaaggcaacaattcgccccgttttcgatccgtccaaggtgagagctagtgggccagggctggagcggggtaaagtgggagaagcggcaaccttcacagtagactgtagtgaggctggggaggccgagttaacaatcgaaatcctgtccgatgccggcgtaaaggccgaagtgcttatccacaacaatgccgatgggacgtaccatatcacctactctcctgctttccccggcacctatacaattacaatcaagtacgggggacatccggtccccaagttcccaactcgcgttcacgtccagccagcagtagatacctcgggtgtgaaggtctcaggtccaggggtggaacctcacggcgtgctaagggaagtgaccactgagtttactgtagacgcccgatctcttaccgctactggcggcaatcacgtgacagccagagtactgaacccttccggcgctaagactgacacctacgtcactgataatggagatgggacatatagggttcaatatacggcctatgaggaaggcgtgcatctggtggaggtgctctatgacgaggtcgccgtacctaagtcaccattccgcgtgggcgtaactgagggatgtgatcccaccagggtgcgcgccttcggccccggcctggaagggggactggtaaacaaagcgaatagattcacagtggaaacacgcggggctggaacaggtggtcttggattagctatcgagggaccctccgaggcgaagatgagctgtaaagataacaaggacggctcttgcactgtcgagtacatccctttcaccccaggtgattacgacgtgaacataaccttcgggggccgccccatacctggctcgccatttcgggtacccgtcaaggatgttgttgacccaggaaaagtgaagtgtagcgggcccggcctcggagctggcgtccgtgctcgggtaccgcagacctttacagtagactgtagccaagcagggcgagcccccctacaggtggcggtcttggggcccaccggcgtcgcagaacctgtggaagtccgcgataacggggatggaactcataccgttcattatacaccggcaaccgacgggccttacacagtggccgtgaagtatgcagaccaggaggtccctagaagtccatttaagattaaagtgctcccggcacacgacgcgtctaaggtgagggccagcggacctggcctgaacgccagcggaatcccagcttccctgcccgttgaatttacgattgatgcgcgggacgccggggagggactgctgaccgtacaaatacttgaccctgagggcaagcctaaaaaagccaatattcgggacaatggagatggtacgtatacagtgagttatttgcctgacatgtccggtcgctacaccataacaattaaatacggaggtgatgagatcccctattctccttttcgcattcacgcccttcctacaggagacgccagtaagtgtcttgtgacagtgtccatcggaggccacgggctgggagcatgcctcgggccacgaattcagatcggacaggaaacagtgatcactgtggatgcgaaggccgccggcgaaggcaaagtgacgtgcactgtaagcactccggacggggcggaactggatgtcgatgtagtggagaatcacgacggtacctttgacatttattacactgcccctgaaccgggaaaatacgtgatcacgattcgatttgggggtgaacacatccctaattcaccatttcatgtgttagcctgcgacccactgccccatgaggaggaaccttctgaggtgccccagttacgacagccgtatgctccgccccggccaggcgcaaggccgacccactgggcaaccgaagagccagtggttcctgtcgaaccaatggaaagtatgctgagaccttttaatctggtgattccgtttgccgttcagaagggcgagctcacgggtgaggttcgcatgccaagcggcaaaacagcccgacctaatattacagacaacaaagacggtaccatcactgtgaggtacgccccgactgaaaagggtctgcaccagatggggataaagtatgacggtaaccacattcctggcagcccactccagttttatgtggacgctattaactctcgccacgtttcagcctatggtcccggactgtctcacggaatggttaataaacccgctacttttactatcgttacaaaggatgccggcgagggcggcctcagcctggcagtggagggcccatcaaaagctgaaatcacctgcaaggacaataaggacgggacttgcaccgtcagttatctgcctactgcaccaggggattactccattattgtgaggttcgacgacaaacatatccctggtagcccattcaccgcaaaaattaccggggacgattctatgcggacaagccagcttaatgtcgggacctccaccgacgtttctctgaagattacagagtctgatttgtcccaactgactgcctcgatccgggctccaagcggcaatgaggaaccctgtctcctaaaaaggctccctaatcgtcacatcggaatcagctttacccccaaggaagtcggcgagcacgtggtgtccgtgcgcaaaagcgggaaacacgtgacaaattctccattcaagatcctggtgggcccctccgagatcggggatgcctcaaaagtccgcgtatgggggaaaggcttatccgagggacacactttccaggtggcggagtttatcgttgatacgcggaacgccggctacggtgggcttggcttaagcattgaaggtcccagtaaggttgacattaactgcgaggacatggaggatggaacttgcaaggtgacatactgtcccacagagccaggtacctacatcatcaacatcaaattcgcagacaagcatgtgccgggatccccatttactgtgaaggttactggagaaggcaggatgaaggagagcattacacgtaggcgacaagctccttccattgcaacaatcggctcaacatgcgacttgaatctgaagatacccggaaattggttccaaatggtcagcgcacaggaacgtttaaccaggacttttacacggtctagccacacctacactaggactgagaggaccgaaatctccaagacacgcggtggtgagacaaagagagaggtgagagtggaagagtctactcaagtcgggggggacccttttcccgcagtgttcggcgatttcttgggtcgtgagcgtcttggtagcttcggatccatcaccagacagcaggagggcgaagctagctcccaggatatgaccgctcaagtgacttcaccttctgggaaagtggaggctgccgaaatcgtggagggagaagactcagcctattcagttaggtttgtaccccaggagatggggcctcataccgtcgccgtgaagtataggggacagcatgtgcctggttctccattccagtttactgtcggtcctctgggtgagggaggagcgcataaagtgagggcgggaggaactggacttgaaagaggggtggctggagtgcccgccgaattctcaatatggactagagaggccggcgctggggggctgagtatcgctgtcgaaggccccagtaaagcagaaattgcattcgaggataggaaggacggcagctgcggagtttcttatgttgtccaggagccaggtgactatgaggtatcgatcaagtttaatgatgagcacatccccgactcgccttttgtagtacctgtggccagcctctcggatgatgcacggcgcttgacggttacaagtcttcaggagacgggcctgaaggtgaatcagccggcttcattcgcagtgcagctgaacggtgccagaggcgtcatagatgcaagagtgcacacgccatcaggggccgtggaggaatgttacgtgtcagaacttgatagcgataaacataccatccgcttcataccccacgagaacggtgttcacagcattgacgtcaaatttaacggggcccatataccaggtagcccattcaagattagagttggtgagcagtcccaggcaggcgatccaggccttgtatctgcttacggccccgggctggaaggaggaacaacaggcgtaagctctgagttcatagtcaacaccctgaacgccggcagcggagccttatctgttacaatagatggccccagtaaggtgcagttggattgtagggaatgtcctgagggacacgtcgttacatacacacccatggcccccggtaactacttaatcgcgatcaaatacggtggccctcagcatattgtcggaagtcctttcaaggcaaaggtgacaggaccccgcctctcaggggggcactcactgcatgaaaccagcacggtacttgtggaaaccgttaccaaatcttccagctctcgcggctcatcttattcttctatccccaagtttagctccgatgcctccaaggtggtaacccgaggacccggtctgtctcaagcatttgttggccagaaaaacagctttaccgtggattgtagcaaggccgggactaatatgatgatggttggcgtgcacgggcccaagacaccctgcgaagaggtgtacgttaagcacatgggaaaccgcgtctacaacgtcacctacaccgtgaaggaaaaaggagattacattctaatcgtgaagtggggggacgaatctgtgcccgggtccccatttaaagtgaaggtgccctag

SEQ ID NO: 117158 - DNA, 8079 bp, Artificial Sequence
  Description of Artificial Sequence: Synthetic coding sequence
atgatgaacaattccggttattctgacgcaggactgggactcggtgacgaaactgatgaaatgccaagcacagagaaagatctggccgaggatgcaccctggaagaaaattcagcagaatactttcactaggtggtgcaatgagcatttgaaatgtgtgggaaagcggctgacagacctgcagagagatctcagcgacggactgcgcctgattgccctgctcgaagtactgtctcagaaaaggatgtatcgcaagttccacccacgaccaaatttcagacagatgaaactggaaaatgtcagtgttgccctcgagtttctggagcgggaacatatcaagctggtgagcattgacagtaaggccatcgttgacggcaatctgaagctcatcttgggccttatctggacactcatactccactacagtatttccatgcccatgtgggaagacgaagatgatgaagacgctagaaagcagacccccaagcagagattgctggggtggatccagaacaaagttccgcagctgcctattactaacttcaatagagattggcaggacggtaaagcactgggagcacttgttgacaactgtgcgccgggactgtgtcccgattgggaggcctgggatccaaaccagcctgtggagaacgccagagaagctatgcagcaggcagacgactggcttggggtcccccaagtgattgcccctgaagaaatcgtggacccgaatgtggatgagcacagcgtaatgacctatttaagccagttccccaaggctaagcttaagccaggtgccccggtacggtcaaagcagttgaaccccaaaaaggccattgcgtacgggccaggaatcgaaccacaggggaatacggtcttgcagccagcccatttcaccgtgcagacagtggatgccggcgtgggggaggttctggtgtacatcgaggacccagagggccatactgaagaggctaaagtggtgcctaacaatgataaggataggacctatgccgtgtcatacgtgccgaaggtggccgggcttcataaggtgacagtcttattcgctgggcagaatatagaacgctcacccttcgaagtgaatgtgggcatggcactgggcgatgcaaacaaggtaagcgccagaggcccagggttggaacctgttggaaatgtcgcaaacaagcctacttattttgatatttacactgctggagccggcacgggcgatgttgccgtcgtcattgtggacccccaagggcgccgggatacagtggaggtggcacttgaagacaagggcgatagcacattcaggtgtacttacaggcccgctatggagggaccgcacacagtccacgtcgcctttgcaggcgcacctattacacggagcccttttccggtgcatgtgtccgaggcctgcaatcctaatgcttgcagggctagtggaaggggtttacagccaaaaggtgtcagagtaaaagaggtggctgatttcaaggtgtttacgaagggcgccggctctggcgaattaaaggtgacagtgaaagggcctaaaggcacggaggagcccgtgaaagtgcgagaagctggtgatggcgtgttcgaatgcgaatactatccggtcgtgcccgggaaatacgtcgtaactatcacctggggcgggtacgccatcccacgaagcccctttgaggtgcaggtcagccccgaagcaggggtccagaaagtgcgcgcctggggaccaggcctcgagaccggccaggtgggcaagtcagctgattttgtcgtggaagccattggcactgaggtggggactctgggttttagcatcgagggcccttcacaagctaagatcgagtgtgacgacaagggcgatggctcttgcgatgtccgctattggccaactgagcccggcgaatacgcagttcatgtgatctgcgacgacgaagatatccgggacagcccatttatcgcacatatacttcccgcacctccagactgcttccccgacaaggtaaaagcctttggtccaggtctggaaccgaccggttgcatcgtggacaagccagccgagtttactatcgatgcccgcgccgccggcaaaggggacctgaagctgtacgcccaggacgccgatggctgtcccatcgacatcaaggtcattcctaatggggacggaacatttcggtgttcctatgtacctactaaaccgattaagcacaccattataatcagctggggcggagtaaatgttcccaagtcacccttcagggtgaatgtcggagagggctctcacccagagcgggtgaaggtgtacggcccaggagtggaaaagaccggcctgaaggcgaacgaacccacatattttacggtggactgcagtgaagccggccagggagacgtttcaattggcatcaaatgtgccccgggcgtggtcggacccgcagaggcagatatcgatttcgatatcataaaaaatgacaatgacacatttactgtcaagtatacacctccgggggccggccgatacactataatggtactgtttgccaaccaggaaatccccgctagtcccttccacatcaaagtggatcctagccatgacgccagcaaagtgaaggcagagggtccaggactgaaccggaccggggtcgaggtcggaaaacccacccacttcacagtgctgacgaaaggtgccgggaaggccaagcttgatgtgcagtttgcaggcaccgctaaaggggaggtcgtgcgcgacttcgagatcatcgataaccacgattactcttatacggtcaaatacacggcggtccaacaggggaacatggccgtaactgtgacatacgggggtgacccagtccccaaaagccccttcgtcgttaatgtggctcctccactcgatctgtccaagatcaaggttcagggtctcaactccaaggttgcggtgggacaggagcaggcgtttagcgtaaatactcggggggccggaggccagggtcagttagacgtacgcatgacaagcccctctaggcgaccaatcccatgtaaactggaaccgggaggaggagccgaagcccaggctgtgcgctatatgccccccgaggaaggaccctataaggtcgacatcacatatgacggtcatcccgtgccagggagcccttttgccgtggaaggggtgctgcctcctgatccttccaaggtctgcgcctatggtccaggtttgaagggcggcctagttgggacaccagcacccttctctatcgacaccaagggcgcgggaactggagggcttgggctgactgtcgaaggaccctgtgaggcaaagatcgagtgtcaggataacggcgacgggtcttgtgccgtctcctatcttccaacagaaccgggagagtataccatcaatatcctttttgctgaagctcatatcccgggcagccccttcaaagccacaatccggcctgtgttcgacccttccaaggttcgtgccagtggtcctgggctggagagagggaaggtgggtgaagcagctacatttacagtagactgctctgaagccggagaggcggagcttactattgagatcttgagcgacgccggagttaaagccgaggtccttatacacaataacgctgacggcacctaccacataacctactcccctgcatttccaggcacgtacaccataactatcaagtatggcggccatcccgtgcctaaattcccaacacgcgtacacgtgcagcctgctgttgacacatctggggtaaaggtgtccggtcccggagtggagccacatggggtcttaagagaggtaactacagagtttactgtggacgcgcggagtctgacagccactggtggcaaccacgtgacagcccgggtgctgaacccatctggagctaagactgatacctacgtcaccgataatggggatggcacctatcgggtgcaatacaccgcctacgaagaaggtgtgcacttggtggaagttctgtacgacgaggtcgctgtgcccaagagtccctttcgggttggggtgacggaagggtgcgatccgacaagggtccgagcttttgggcccggcctggaaggaggactggtgaataaagctaacaggttcacagttgaaacccggggggccggtacaggcggtctgggacttgctattgaggggccctccgaggccaaaatgtcctgcaaagataataaggacgggtcgtgcactgtcgagtacatccctttcacacctggagattacgatgttaatataacttttggggggcgtcctatccccggatctcctttccgagtccccgtcaaagacgtggtagatccaggcaaggttaaatgtagtgggccagggctgggcgccggcgtacgcgctagggtgcctcagacctttactgtggattgctctcaggctggccgcgctcccctccaagtggctgtgctgggccctactggcgtagccgaacccgtagaagtccgagacaacggggacggtactcatactgtacattacacaccagccacggatggtccttacacagtggccgtgaaatatgcagaccaggaagtgcccagatctccattcaaaataaaagtgctccccgctcacgatgcctctaaagtgcgggcttccgggcccgggctgaatgcgagcggcattccggccagcctaccagtggaattcaccattgacgctcgagatgcaggcgagggactgttaactgttcagatcttagatcccgaggggaagcccaagaaggccaacattcgggacaacggcgacgggacgtacacggtgtcctatctgcctgacatgagtggcagatacacgattaccatcaaatacggtggagatgaaatcccatacagcccattccgcattcacgcacttccaaccggtgacgctagcaagtgcctggtaacagtgtctatcggcggtcacggcttaggcgcatgccttggaccaagaatccaaatcggtcaggaaaccgtcatcactgttgacgccaaggccgctggcgagggtaaggttacttgcactgtcagcacgcccgacggagctgagctggatgtggatgtggtggaaaatcatgatggcactttcgacatatattacaccgcccctgaacctggaaagtatgtcattacaatcaggtttggcggcgagcatatacccaatagcccattccacgtgttggccaccgaggagccagtggtcccagtggagccaatggaatccatgcttcgcccctttaacctggtgattccattcgcagttcaaaaaggtgaactcaccggggaggtgaggatgcctagtggaaaaaccgccagacctaacattacagacaacaaggacggtaccatcactgtgaggtatgctcctaccgagaagggcttgcatcagatgggaattaagtacgatggcaaccacatacctggttctcctctgcagttttacgtggacgcaatcaactcgagacacgtgagtgcttacggcccgggactgtcacatggcatggtgaacaagcccgccacattcacaatcgtgaccaaggacgccggcgagggcggcctgagcctggccgtggagggcccgagtaaggctgagataacatgcaaagataataaggatggtacctgcaccgtgagttaccttcctaccgcccctggagactatagcattatcgtgagattcgatgacaagcacatacccgggtcaccgtttacagcaaaaatcactggcgacgacagcatgcggacctcccagctgaacgtgggcacatcgactgatgtctctctgaagattaccgagagcgacctcagccagctgactgccagtattagagcgcctagtgggaatgaggagccatgcttactgaagagactacctaaccgtcatatcgggataagcttcacccccaaagaggtaggtgagcatgtggtgtctgttcgcaaaagcggaaagcacgtgactaattcaccattcaaaattctcgtgggaccatcggaaattggggacgcatcgaaagttagagtctggggaaaaggtctcagcgaaggccacacctttcaggtggcagagttcatcgttgatactagaaatgccggctatggagggctggggctgagcatagagggtccgtcaaaagtcgacatcaactgcgaagatatggaggatggaacttgcaaagtgacttattgtcctacagaacccgggacatacattattaatatcaagttcgccgacaagcatgtacccggatccccctttaccgtgaaagtcacaggggagggaagaatgaaggaatctatcacccggagacgccaagctccttccattgcaacaatcgggagcacgtgtgatctgaacttaaagattcccggtaattggtttcaaatggtgagcgcacaagagcggctgacaaggacgttcactcggagcagccatacatacacccgcaccgaacggacagagatttcaaagaccaggggtggggaaactaagagggaagtgagagtagaagaatctacccaagtagggggggatccctttcctgccgtctttggagacttcctcggaagagagcgattggggtcatttgggagtataacacgccaacaggagggagaagcaagctcacaagacatgacggcacaggtcacaagcccatcaggcaaggtggaggcagccgagatagttgagggtgaagatagcgcctactctgtccggttcgtccctcaggagatgggacctcatacggtggccgtgaaataccgcgggcagcacgtgccaggaagtccttttcaatttaccgtgggccccctaggcgagggcggggcccacaaggtgagagccggtggaacgggactggaaagaggggtggcaggcgtgcccgccgaattttctatttggacccgggaagcgggggccggcgggctgtctattgctgtagagggtcctagtaaggctgagattgcgttcgaggacagaaaagacggatcatgcggagtctcgtacgtcgttcaagaaccaggcgactacgaggtctccatcaaattcaacgatgaacatatcccagactctccctttgttgtgcctgttgcatcgctcagtgatgacgccagaagactgacagtgacaagtcttcaggagacaggccttaaagttaatcagccagcttcatttgcagtccagctcaatggggccagaggggttattgatgcacgcgtccatactcctagcggagcagtggaagagtgctacgtgagtgagctggattcagacaaacatactatcaggttcatcccgcacgaaaacggggttcatagcattgacgttaaatttaatggcgctcacattcctggctcaccgttcaagattcgggtgggggaacaaagccaagctggggacccagggctcgtgagtgcgtatggcccgggtctcgagggcggaaccaccggtgtgtcaagcgagttcattgtcaacacactgaacgccggttcaggagcactgtcagtgaccatcgatggaccatccaaagtccagctggattgtcgggaatgccccgagggtcacgtcgtgacctacactccgatggcccccggcaactacctgattgcaatcaaatatgggggtcctcagcatatcgtaggatccccttttaaggctaaggtcaccggtcctcggttgtctggaggtcactcactccatgagacctccacagtgctcgtggaaaccgtgacaaaatcaagtagctctcggggtagctcctactcaagtatcccaaagttcagttctgatgcctcgaaggtggtgactcgaggcccaggactgagtcaagcatttgtgggccagaaaaactctttcaccgtggattgcagcaaggctggtacgaacatgatgatggtgggagtgcatggacctaagacgccgtgtgaagaagtgtacgttaaacatatgggtaacagagtgtacaatgtgacatatactgtgaaggagaagggagactacattcttatagttaaatggggtgatgagtcagtgcctgggtcccccttcaaggtgaaggttccctag

SEQ ID NO: 117159 - DNA, 264 bp, Artificial Sequence
  Description of Artificial Sequence: Synthetic coding sequence
atgcagctcttcgtcagggctcaggagctgcataccttcgaggtgactggacaggagactgttgcccagatcaaggcccatgtggcatctctcgaaggtatagcccccgaggatcaggtggttcttcttgccggagcgcctctagaagacgaagctaccttgggacagtgcggcgttgaagctctaacgactttggaggtcgctggaagaatgctcggcggcggccagaccggagaagaggaggaggaggatagatcaggctag

SEQ ID NO: 117160 - DNA, 228 bp, Artificial Sequence
  Description of Artificial Sequence: Synthetic coding sequence
atgcaactgttcgtacgggcccaggagctgcacaccttcgaagttaccgggcaggaaactgttgcgcagataaaagcgcacgtggcttccctggaaggaatcgctcctgaggatcaggtcgttctgttagccggcgcacccttagaagacgaggccactctgggtcagtgcggggtcgaggcgttgactaccttagaggtcgcaggccgtatgcttggcggtgagtag

SEQ ID NO: 117161 - DNA, 297 bp, Artificial Sequence
  Description of Artificial Sequence: Synthetic coding sequence
atgcagctgttcgtgcgggctcaggaattacacaccttcgaggtaacgggccaggagaccgtcgcccaaataaaggccctgactactctggaggtggccggcagaatgttaggtgggaaggtgcacggttcactggctagagcggggaaagtcagaggacagacaccaaaagtagccaagcaggagaagaagaaaaagaagacaggcagagccaaaagacgaatgcagtataatcggcgctttgtgaatgttgtgcctaccttcggcaagaagaagggtccaaatgccaacagctag

SEQ ID NO: 117162 - DNA, 330 bp, Artificial Sequence
  Description of Artificial Sequence: Synthetic coding sequence
atgcaattatttgtgcgcgctcaggagctgcacacgttcgaggtcacaggtcaggagaccgtcgctcaaattaaggctcatgtggcttcactcgaggggattgcacccgaagaccaggtcgtgctgttggccggcgcacccctcgaagatgaggcaaccttaggccagtgcggagtggaagcactgacaaccttagaggtcgctggcagaatgttgggtggcaaagtccacggcagcttggccagagctggcaaggtccgtggccagacccctaaggtcgccaagcaggagaagaaaaagaagaagacaggccgagctaagaggagatag

SEQ ID NO: 117163 - DNA, 402 bp, Artificial Sequence
  Description of Artificial Sequence: Synthetic coding sequence
atgcagctcttcgtgagggcccaggaacttcatacgttcgaagtgaccggacaggagacagtcgcgcagattaaagcacacgtcgctagcctagagggaattgctcctgaggatcaggttgtcctgttagccggagcacccctggaggatgaagcgactctgggtcagtgtggcgtggaagccctgaccaccttggaagtggctggtaggatgctgggaggtaaggttcatggttcacttgcccgggctggtaaagtgcggggtcagacaccaaaggtcgccaagcaggagaaaaaaaaaaagaaaacgggtcgagccaagaggcgtatgcagtacaacaggagatttgtaaatgtggtgccaacctttgggaagaagaaaggacccaacgctaatagctag

SEQ ID NO: 117164 - DNA, 228 bp, Artificial Sequence
  Description of Artificial Sequence: Synthetic coding sequence
atgcaactcttcgtgcgggcacaggagctgcacacttttgaggtgacagggcaagaaacagttgctcagatcaaagcgcatgttgcaagtcttgagggtattgcacctgaggatcaagttgtcctgcttgctggtgccccgttggaggatgaagccactctgggtcagtgtggcgtcgaagccctcaccaccctggaagtcgctggcagaatgctcgggggggagtag

SEQ ID NO: 117165 - DNA, 402 bp, Artificial Sequence
  Description of Artificial Sequence: Synthetic coding sequence
atgcagctgttcgtgagagcccaggaactgcacactttcgaggttacaggacaagagacagtcgctcagattaaggcacatgttgcctctctggagggaattgcgcctgaagatcaggtggtgctgctggccggggccccgttggaagatgaggctaccttaggccagtgtggggtggaggcgctgaccacactggaagtcgcaggcagaatgttggggggtaaagtacacggatcactggcacgcgcggggaaggtaaggggacagacacccaaagtagctaaacaggagaagaagaaaaaaaaaacaggtagggccaagcgcaggatgcagtataaccgtcgcttcgtgaatgtcgtccccacctttggaaaaaagaaaggaccaaatgcaaactcttag

SEQ ID NO: 117166 - DNA, 402 bp, Artificial Sequence
  Description of Artificial Sequence: Synthetic coding sequence
atgcagctgttcgtgagggctcaagagctgcacacgttcgaggttacaggccaggagacggtggctcagattaaggcccacgtcgcctcattggagggcatagcccctgaggaccaggtagtcctgctggctggggctcccctggaggacgaggccactctgggccagtgcggggtcgaagctctcacgactttggaggttgccggtcgtatgctcggcggcaaggtgcacgggtctttagctcgggctggcaaggtccggggtcagaccccgaaagtagcaaagcaagaaaagaagaagaaaaaaaccggcagagcgaaaaggcgtatgcagtataatcggcgctttgtgaatgtggtgcccacatttggcaagaagaagggcccgaatgccaactcctag

SEQ ID NO: 117167 - DNA, 1563 bp, Artificial Sequence
  Description of Artificial Sequence: Synthetic coding sequence
atgtccgcgggcgaagtcgaacggctagtctctgagctcagcggtggcaccgggggagatgaggaagaggagtggttgtacggggacgaaaatgaagtggaacgtcccgaggaggaaaatgcttctgccaacccgccaagtgggatcgaggacgagaccgcggagaacggagttccaaaacctaaggtcactgagaccgaagacgactccgattccgacagcgatgacgacgaagatgacgtgcacgtcactatcggagacattaaaacaggtgctccccagtatgggagttacggtactgctcctgttaacttgaacatcaaaacaggcggccgcgtgtacggcacgaccgggacgaaggtgaaaggcgtggaccttgacgctccgggatctatcaacggtgttccgctgctggaggtcgatctggattccttcgaagacaagccttggagaaagcccggcgcggacctaagcgattactttaattatggcttcaacgaggatacctggaaggcctactgcgaaaaacagaaacggattcgcatgggcttagaggttataccagtcacaagcaccacaaataaaattaccgtccaacagggccgaacaggtaacagcgaaaaagagacagcattgccgagcacaaaggccgagtttacaagcccccccagcctgtttaaaacgggactgccgccatcaaggaggttgccgggcgctattgacgtgatagggcaaacaatcacgattagtcgtgtcgaaggcagacggagggctaatgaaaactccaacattcaggtactctcagagcgcagtgccacagaggttgacaacaatttttccaaaccccctcccttcttcccacctggcgccccccctacgcatctcccacctccacccttcctgcccccacctcccacggtgagcacagcccctcctcttatccccccccctgggttcccacccccgcctggcgccccgcctcctagccttattccgactatcgaaagtggccacagctccgggtatgatagtaggtctgcccgggcgtttccctacggcaatgtggcctttccacacctcccaggctcggctccaagctggccttcgcttgtggacacctccaagcagtgggactactatgccagacgcgaaaaagatagggacagagagcgcgacagggaccgcgaacgagaccgagatcgggacagggaaagagagcgcacaagagaaagagagagagagcgcgatcattctcctacccccagtgtctttaattccgacgaggagaggtataggtaccgggagtatgctgagaggggatacgagaggcacagagccagtcgcgaaaaggaagagcggcacagagagagaagacaccgtgagaaagaagaaacacggcacaaatcaagcaggagtaacagtaggagacgccacgaaagtgaagaaggagattctcaccgcagacacaagcataaaaaatctaaacgctctaaggagggtaaggaggctggcagcgaacctgccccagaacaggagtcaactgaggcaacccctgccgagtag

SEQ ID NO: 117168 - DNA, 1785 bp, Artificial Sequence
  Description of Artificial Sequence: Synthetic coding sequence
atgtccgctggcgaggtcgaaagactggttagtgaactctccggcgggaccggtggggacgaagaggaggagtggttatatggagggccatgggatgtgcatgtgcactccgatctcgccaaagatcttgatgagaacgaagtggagcggcccgaagaggagaacgcctccgcgaacccacctagcggtattgaggatgagacggcggaaaatggcgtcccgaaaccgaaggtaacggaaacagaagacgatagtgactctgactccgatgacgacgaggatgacgttcatgtgacaatcggcgacatcaagactggggctcctcaatacggatcttacgggaccgcccctgttaacttgaacataaaaacaggaggacgggtgtacggaaccaccgggactaaggtgaagggggttgacctggacgccccagggtctataaacggtgttcctcttctggaggtcgacttggattcctttgaagataagccctggcgcaagcctggcgcggatttgtccgattacttcaattatggctttaatgaggatacctggaaagcgtattgcgagaaacagaagagaatcagaatgggcttagaagtaattcctgtgacctcgaccaccaataagattacagcagaagactgcaccatggaggtaacgcctggggcagaaatacaggatggaagattcaatctgttcaaggttcagcaaggtagaaccggaaactctgaaaaggagacagccttaccttctactaaagcagaatttacctctccaccgtctctttttaaaaccggcttgccaccgtctagaaacagtacaagcagccagagccaaacttctaccgcttccagaaaggctaattcctcagtcggaaaatggcaggatagatacggaagagccgaaagccccgacttgcggagactgcccggcgctatcgatgtgattgggcagactatcactatttcgagagtggaaggcagaagaagggctaatgaaaacagcaacatacaagtgcttagcgaacgatccgccacggaggttgataataatttttctaagccgccaccatttttccccccaggcgctcctcctacccacctgccgccacccccttttctacccccaccaccaacagtcagtacggccccccccctgatcccaccgcctggtttcccgccgccacccggcgctccacccccgagcctaattccaacaattgagagcggacacagctccggttatgattcgagaagcgctagagccttcccatatggaaatgttgcattccctcatttaccaggaagcgccccgagctggccgtcgctggtcgataccagcaagcagtgggattactacgctagaagagagaaggaccgagatcgcgagcgcgaccgggacagggagcgggatagagatagagatcgtgagagggaaaggaccagggaacgggagagggagcgcgaccacagccctaccccatcagtgttcaattcggacgaagagcgctaccggtatcgcgaatacgccgagcgcggttatgaaaggcaccgtgcgtccagggagaaggaagaacgtcacagagaacggaggcatcgcgaaaaagaggaaacaagacacaagtcctcgcgctccaatagtcgcaggcgccatgaaagcgaagagggggattcccacagaagacacaagcacaaaaagtcaaaacgctcgaaggaaggcaaggaggctggcagtgagcccgcccctgaacaggagtccactgaagctacacctgccgagtag

SEQ ID NO: 117169 - DNA, 1767 bp, Artificial Sequence
  Description of Artificial Sequence: Synthetic coding sequence
atgagtgctggtgaagtcgagcgactggttagcgaactgtctggtggcacagggggagacgaagaggaggagtggctatacggggatgagaatgaagtagaacggcccgaggaggagaacgcttccgcgaacccgccatcaggcattgaagatgaaaccgctgagaatggtgtaccaaagccaaaagtgacagaaaccgaagatgacagcgactctgattctgacgacgacgaggatgacgtgcacgtcacaattggcgacatcaaaactggagccccacagtacggctcatacggcacagcacccgtgaaccttaatataaagactggcgggagggtctacggtaccacaggcactaaagtcaagggcgtcgacttggacgctcccgggagtatcaacggagttccgctgcttgaagtggatctcgatagtttcgaagataagccctggcgaaagcctggagcagacttgagcgactacttcaactacggcttcaatgaagacacctggaaggcctactgtgaaaaacagaagcggattaggatggggcttgaagttattccagtgacctcgaccaccaacaagatcacagcagaagattgcaccatggaggttacaccaggtgcagaaattcaggacggcaggttcaatctgtttaaggttcagcagggccgaacgggcaattccgagaaggaaaccgccctgccttcaaccaaggctgaattcactagcccacctagtcttttcaagaccggtctgccgcctagccgcaatagcactagctcacagtctcagacgtccacggcctcccgaaaagctaacagctccgtcggaaagtggcaggacaggtatggcagagccgaatccccagacctgcgacgccttccgggagcaattgatgtgatcgggcaaaccattaccattagcagagtggaaggccgccgcagagccaatgagaattcaaacatccaggttctatcggagcggtccgccaccgaagttgataataatttcagtaaacctccacctttcttcccacctggggcgcccccaacgcacctgccgcctcccccctttctgcctccacctcctacagttagcaccgcaccacctctgattcccccgcccggcattcccatcactgtgccccccccagggttcccaccccccccaggcgccccacctccttcactgatcccaaccatcgaatccgggcactccagtgggtacgacagtcggagcgcccgcgcttttccctacgggaacgttgcattcccccatctgcctggcagcgccccaagctggccgagtctggttgacacctctaagcagtgggactactatgctcgtcgggagaaagatagagaccgcgagcgagatcgcgaccgcgagcgggatagggaccgtgaccgggaaagagagaggacaagggaaagagaaagagagcgcgaccacagtccaactccaagcgtgtttaactctgacgaagaaaggtataggtatcgggagtacgccgagcgggggtacgagcggcaccgggcctctcgcgagaaggaggaaagacacagagagcggagacatcgagagaaagaagagactcgacacaagagcagccggagcaattcacgccggaggcatgagagtgaggagggcgacagtcaccgacgtcacaagcataagaaatctaaacgaagtaaggaaggcaaagaggccggttccgagcctgctcctgaacaggagtctacagaggctaccccagcggaatag

SEQ ID NO: 117170 - DNA, 366 bp, Artificial Sequence
  Description of Artificial Sequence: Synthetic coding sequence
atggtagatatgatggaccttccaagatcaagaatcaacgctggaatgctggcacagttcatcgacaaacctgtgtgcttcgttggacgcctcgagaagattcatcccaccggtaaaatgttcattctgagtgatggggagggtaagaacgggactatcgagctgatggagcctctcgatgaggaaatttctggaatcgtggaggtcgtcggcagggttactgctaaggccaccattctgtgcacctcttatgtgcagtttaaggaggatagtcatccatttgacctgggtctgtataatgaagcagtcaagattatccacgacttcccacagttctaccccctggggatcgttcagcacgattag

SEQ ID NO: 117171 - DNA, 1413 bp, Artificial Sequence
  Description of Artificial Sequence: Synthetic coding sequence
atgttcccagccgggcccccttcccattctcttcttcgactccccctcctgcagttactgctgctcgtagttcaggccgtaggaaggggcttgggacgggcttcgccagccggtggacctttagaagacgtcgtcatcgagcggtaccatattccaagggcatgcccccgggaggtgcagatgggggatttcgtacggtatcattacaacggaacattcgaagacggtaagaaattcgattcctcatatgatagaaacacgttggttgccatcgtggtcggcgtgggccggctgattactgggatggatcgcggactgatgggaatgtgtgtcaacgaaagacggcgcctgatagttcccccccacctcgggtacgggtccataggtctagctggtctcatcccgccagatgccaccctatattttgacgttgtgctcttagatgtatggaacaaggaagataccgttcaggtgagtacactattaagaccacctcactgtccccgaatggtgcaggacggggacttcgtgagataccactataatggaactctcttagatggcaccagcttcgataccagttacagtcgcaaccatacatataacacgtatattgggcaaggttatatcattcccggcatggaccaaggccttcagggcgcttgcatgggggagagacgccgtattacaatccctcctcatctcgcatatggtgagaacggcactggagacaagatccccggctctgccgtactcatttttaatgtgcacgtgattgacttccataaccctgcagatgtggtggagattcgtacgctctcgcgaccatctgagacttgcaacgaaacaacaaagctcggggacttcgttcgctaccactataattgctccctgttggacgggacacaactgttcaccagccatgattatggggcccctcaagaggccaccctcggggctaacaaagtcatagagggcctggacactggtctgcagggcatgtgtgtcggggaaagaagacagctgattgtaccacctcatcttgcccacggcgagagcggagcacgaggagtgcctgggagcgccgtcctgctttttgaagtcgaacttgtcagcagggaggacgggctccccactgggtatctgttcgtatggcataaggacccgcccgctaacctgttcgaagatatggacctgaacaaggacggagaagtacctcctgaggagttctccacatttatcaaggcacaggtatctgagggcaagggcagattaatgccaggacaggacccggagaagacaattggggacatgttccaaaaccaagatcgcaatcaggatggtaaaattactgttgatgagctaaaactaaaaagcgacgaagatgaggaacgggtccacgaggaactgtag

SEQ ID NO: 117172 - DNA, 1749 bp, Artificial Sequence
  Description of Artificial Sequence: Synthetic coding sequence
atgttcccagctggacctccctcacactccctactgagacttcctcttctccaactgttgctgttagtggtacaggctgtgggcagaggactgggccgggccagccccgcaggcggacctctggaggacgtcgtaatcgaacgctatcatattcctcgcgcctgtccacgcgaggtgcagatgggtgacttcgtgcgatatcactacaacggtacctttgaggatggtaaaaagttcgacagttcatacgataggaataccctggtagccatcgttgtaggggtaggcagattaatcaccgggatggaccggggcctgatgggaatgtgtgtgaacgagcggaggcggctgatcgtgcccccacatctgggttatgggagcatcggcctcgccggcttgataccccctgacgccaccctgtactttgatgttgtgctgttagacgtgtggaacaaggaagataccgtccaggtgtcaaccctgcttcgccctccccattgtccgagaatggtgcaggatggtgacttcgtgcggtaccattacaacggcaccctgctagacggtacctctttcgacacgtcttacagtaaaggaggaacgtacgatacatacgtcggttctggatggctgattaagggaatggaccaagggttgctgggtatgtgtcctggggagcgccggaaaatcattattcccccctttctggcttatggtgagaagggctatggcaccgtaatacctccacaagcatcccttgtattccatgtgctcctgatagacgtccacaatccaaaagacgccgtgcagctggaaacactggagctaccccctgggtgtgtgcggcgggccggggccggcgactttatgcggtaccactataacgggagtctgatggacggtactctttttgacagcagttactctcgcaatcatacgtacaatacgtacattgggcaggggtacatcatccctggtatggaccagggccttcaaggtgcctgcatgggggagaggcgaagaattaccatccctccacatttggcttatggtgagaacgggactggcgataagatccccgggtcagccgtccttatattcaacgtccacgtaatcgactttcacaatcctgccgatgtggtggagatcaggaccctttctaggcctagcgaaacgtgtaatgagactacaaaactgggcgacttcgtccgataccactacaactgctcgcttctggacggcactcagctgttcacaagccatgactacggagcccctcaagaagcaacactcggggccaacaaggttattgagggcttagacacggggttgcaaggaatgtgcgtcggcgagcgtagacaactcatcgtacccccccacttggcacatggtgaaagcggcgcacggggcgtgccgggctctgcagttttgctttttgaagtcgaactcgtgagtcgggaagacggtctgcctaccgggtacttgtttgtgtggcataaggatcctcctgctaacctgtttgaagatatggatctcaacaaggatggggaagtcccaccagaagagttttccacatttatcaaagctcaagtctctgagggaaaaggccgcctgatgcccgggcaagatcctgaaaagaccataggcgacatgttccagaaccaggataggaaccaggacggaaagattaccgtggatgaattgaagttgaagagcgatgaagatgaggagagggtacacgaagaactgtag

SEQ ID NO: 117173 - DNA, 1629 bp, Artificial Sequence
  Description of Artificial Sequence: Synthetic coding sequence
atgtttcctgctgggccgccatcccacagccttctgcgcctgcctcttctgcagctattgctgctcgttgtgcaggccgttgggcggggcttagggcgggcttcccccgctggcggtcccctcgaggacgtggtgatcgagagataccatatcccgcgggcatgcccccgtgaagtccagatgggcgattttgtgaggtatcactacaacggaacctttgaagatggtaagaaattcgattcctcttatgaccgcaacacactggtagcaattgtggttggagtcgggaggctaattactgggatggaccggggactcatggggatgtgtgtcaatgaacggcgcagactgattgtccctccccatttgggctatggctctatcggattagctggcctcatccccccagacgctacattgtactttgacgtggtgctattggacgtgtggaacaaggaggacactgtgcaggtctcgacgctcttacggccaccacactgccctaggatggtgcaagatggagatttcgtgcgctatcattataacgggacactacttgatggaacctcattcgacacaagttacagcaagggcgggacgtacgatacttacgtagggtctgggtggctcattaagggcatggatcagggattgctggggatgtgtccaggggaacgtagaaagattatcatcccaccattcctggcttacggggagaaaggatatggaaccgttatcccaccacaggcatcccttgtcttccacgtgcttctgatcgacgtgcataaccccaaagacgccgtgcaactggaaacgctcgagcttcctcctggctgcgtgcgacgggccggggctggagattttatgcgttatcattacaacggttctctgatggacggcactctcttcgattcttcatactcaaggaaccatacgtacaatacctatatcggccaagggtacatcattcccggcatggatcaagggctgcaaggggcatgcatgggtgagaggaggagaataacaattccgcctcatctcgcatacggggaaaatgggacaggtgataaaataccaggtagcgccgtcttgattttcaacgtgcacgtcattgacttccacaacccagcagatgtagtcgaaattaggacactgtcacggcctagcgagacgtgcaacgagaccaccaaactcggagacttcgtgagataccactataattgtagcctgctcgatggtacgcagctgttcacgtctcacgattacggagcaccgcaagaggccacgctgggggctaataaagtcatcgaagggctggacacaggcctgcagggtatgtgcgtcggggaacgcagacagcttatagtgccaccacacttggctcatggggaatcaggcgctcgaggcgtgcctggtagtgctgtgctcctctttgaggtggaactggtctcccgagaagacgggttaccaaccggatatctgttcgtatggcacaaagacccgcccgcgaacctgttcgaagacatggatctgaacaaggacggtgaggtgccacccgaggaattttcaacctttattaaagcccaggtgtccgaggggaagggtccccacgcgtgggcagggccatag

SEQ ID NO: 117174 - DNA, 246 bp, Artificial Sequence
  Description of Artificial Sequence: Synthetic coding sequence
atgggtgatttcgtacgctaccactataacggcacctttgaggacgggaaaaaattcgattcctcttacgaccggaacacattggtggccattgttgttggcgtgggcaggcttattacggggatggacagggggctaatggggatgtgcgtgaatgaaaggagacggcttatcgtccccccacatctgggatatggctctatagggctggcaggactgatcccgcccgatgcgacactctattag

SEQ ID NO: 117175 - DNA, 1161 bp, Artificial Sequence
  Description of Artificial Sequence: Synthetic coding sequence
tgaatcgacgtgcacaaccccaaagatgcagtccagctcgagacattggaactccctccaggctgtgtgcgcagggcgggagccggcgactttatgagataccattataatggttccttgatggacgggacccttttcgattcctcttatagcagaaaccatacatataacacttacattggacaaggctatatcatccccggcatggaccagggcctccagggcgcctgcatgggagaaaggcgtagaattactatccccccacaccttgcctacggggaaaacggaacagactctataggctttcttcagggctctgcccccctacgtcctttcagaagcggcgaaggacaacccagtctaggtcgcgaagggggctatggtaagaccgaacccgcgtaccctcaggatcccgcagttttgggggcctcagtttcttctcccgtgaagtgggcaagtcacgcagatccacagggggataaaatcccaggatccgctgtgcttatatttaacgtgcacgtgatcgatttccataacccagctgacgtggtggaaattcgtacgctgagccgaccatcagagacatgcaacgaaaccactaaattgggagactttgtgagatatcattataattgttcacttctagatggcacccaactgttcacgtcacatgattatggcgccccccaggaggctaccctaggtgcaaacaaagtcattgagggactcgacacaggcctccagggaatgtgtgtgggagagcggcggcagctcattgtccctccacatcttgcccacggcgagtcaggggcacggggtgtaccagggtccgctgtcctgctctttgaagtcgagcttgtttctagggaagacggactgcccacaggatatctctttgtgtggcataaggaccccccagcaaatctgttcgaggacatggacttgaataaagatggcgaagtcccccccgaagagttctctacttttattaaggctcaggtgagcgaaggcaagggacggctcatgccaggacaggacccagagaagactataggcgacatgttccagaatcaagatagaaatcaggacggtaagataacagtggatgaactgaagctgaagagtgatgaagacgaagaacgcgttcacgaggagttgtag

SEQ ID NO: 117176 - DNA, 1068 bp, Artificial Sequence
  Description of Artificial Sequence: Synthetic coding sequence
atgaggtaccattacaatgggtctctgatggacgggactctgtttgattcatcttacagcagaaatcacacctacaacacatatatcggccaggggtacattatcccaggaatggatcagggcctgcagggcgcctgcatgggagaacggaggcgcattacgatacctccccacctcgcatacggcgagaacggaacggacagtattggctttctgcagggcagcgccccactaagacccttccgctccggggaaggtcagcctagtttagggcgcgagggcggatatgggaagactgagcctgcttatccacaggacccagcggtgttgggcgccagtgtgtcgtcacctgtgaaatgggcatcgcatgccgatccgcagggtgacaagatcccaggatcagcggtgttgattttcaatgtccacgtcattgattttcacaaccccgccgatgtggtggaaatccggacattgtcaaggcccagtgagacttgcaacgaaactacgaaactcggagatttcgtacgttaccattataactgctcactcctggacggcacacagctgttcacatctcatgactacggtgccccacaagaagccactttgggtgctaataaagtgattgaaggactggacaccggtctacaaggaatgtgcgtcggtgagcgaagacagctcatagtccctccccatcttgcacacggggagagcggcgcacgaggggtgcccgggtctgccgtgcttctgttcgaagtggagttggtctctagggaggatggcttacctacaggatatctttttgtgtggcacaaagacccacccgccaatttgttcgaagatatggatctcaacaaagatggcgaggtgccgcccgaggaattttcaactttcatcaaggcccaggtgagcgaggggaagggtcgactcatgccgggccaagatcctgaaaaaacgatcggcgacatgttccagaaccaggataggaaccaggatggcaaaatcactgttgatgagctgaaattaaagagcgatgaggacgaagagagggttcatgaagagctctag

SEQ ID NO: 117177 - DNA, 327 bp, Artificial Sequence
  Description of Artificial Sequence: Synthetic coding sequence
atgggagtggaaatagagaccataagtccaggggacggacgcacattcccaaagaagggccagacttgcgtcgttcactacaccgggatgctgcagaacggaaaaaaatttgactcatctcgagaccggaacaagccctttaaattcagaatcggtaagcaagaagtcattaagggctttgaagagggcgctgcgcaaatgagtcttggccagcgagccaaattaacttgcacccccgatgtcgcatacggggccactggccacccgggtgttatcccccctaacgcaactctcattttcgatgttgaacttcttaacctcgaatag

SEQ ID NO: 117178 - DNA, 243 bp, Artificial Sequence
  Description of Artificial Sequence: Synthetic coding sequence
atgggcgttgagatagaaactatcagccccggcgacggccgcacttttcctaagaagggccaaacatgtgttgtacactacactggcatgttacagaatggcaaaaaatttgattcctcccgcgaccgtaacaagccattcaagttccggatcggcaagcaggaggtcatcaaaggctttgaggagggtgccgcgcagctggggccgctgtcccccttgcctatttgcccacacccctgttag

SEQ ID NO: 117179 - DNA, 429 bp, Artificial Sequence
  Description of Artificial Sequence: Synthetic coding sequence
atgcggctgtcttggtttcgagtgctcactgtactgtccatttgtctgagcgccgtcgccaccgctacaggggcagagggcaaacgtaagctgcagataggggtgaaaaaaagagtggaccattgtcccattaaatctcgaaagggagatgtgctacacatgcactacaccgggaaactggaagatggtacagagttcgatagctccctgccccagaatcaaccttttgtcttttcgttaggaacaggtcaagtcatcaaaggatgggatcagggactactgggaatgtgtgagggtgagaagcggaagctggtgataccatccgagctcggatacggtgaaagaggggcccctcccaaaatcccagggggcgcgactctggtgttcgaagtggaacttctgaaaatcgaaaggaggaccgagctatag

SEQ ID NO: 117180 - DNA, 429 bp, Artificial Sequence
  Description of Artificial Sequence: Synthetic coding sequence
atgcgcctgtcatggttcagggtgctgactgtgttgtctatctgtctgtccgccgtggccaccgctacaggggcagaaggcaagcgcaaactgcagatcggcgtaaagaagagagtggatcattgccctattaaatctcgtaaaggggacgtcctacacatgcactacactggcaaactggaggacggcacagaattcgactcgtctctgccccagaatcaacccttcgtgttttccttgggaacagggcaggtaataaagggttgggatcagggattgctgggtatgtgcgagggtgaaaaacgtaaactggtgatccctagcgaactgggttacggagagaggggggctcctcccaaaattcccggcggggctactctcgtgttcgaggttgagctgttgaagattgaacgacgcaccgagctctag

SEQ ID NO: 117181 - DNA, 429 bp, Artificial Sequence
  Description of Artificial Sequence: Synthetic coding sequence
atgagactcagctggtttagggtgctgacggtgttgtcaatatgtttaagcgctgtggccactgcgacgggcgccgagggcaaacggaagctgcaaatcggtgtaaagaagcgggtagaccattgtccaattaaatcacgcaaaggtgatgtgctccacatgcattataccggtaaacttgaggacggtaccgaatttgactcatctctgccacagaaccaaccctttgtgttcagcctcggtactggacaagtcatcaagggctgggatcagggattgctaggaatgtgtgaaggggaaaagagaaaacttgtgatacctagtgaactgggctatggggagcgaggcgcacctccgaagattcccggaggcgcaacgctggtgttcgaagtcgaactcctcaaaatcgagcggcggacagaattgtag

SEQ ID NO: 117182 - DNA, 309 bp, Artificial Sequence
  Description of Artificial Sequence: Synthetic coding sequence
atgagactttcttggttccgtgttttaaccgtgctgagcatctgcttgtcagctgttgcgaccgccaccggagcagaaggcaagcgcaaacttcagatcggcgttaaaaaacgagttgaccattgtccaatcaaatccagaaagggcgacgtgcttcacatgcattatacaggtaagctagaggatggtaccgagttcgatagctcactgccgcagaaccaaccatttgtattttctttgggtaccggccaggttatcaaggggtgggatcagggattgctagggatgtgcgaaggcgaaaaacgctag

SEQ ID NO: 117183 - DNA, 3144 bp, Artificial Sequence
  Description of Artificial Sequence: Synthetic coding sequence
atggcagtcactttggataaggatgcctactaccgtcgagttaagcgactgtatagtaactggaggaagggcgaagacgagtatgccaacgtcgacgcaatcgtagtgtccgtgggcgttgacgaagagatcgtttatgcgaagtctactgctctccaaacctggctgtttggatacgaacttacagataccattatggttttctgtgacgacaaaataatatttatggcctctaaaaaaaaagtggagtttcttaagcagatcgccaacaccaagggaaatgagaacgcgaacggcgcgcctgcgatcaccttgctcatcagggagaagaatgaatctaacaaaagctctttcgacaagatgatagaagctattaaagagtcaaaaaacggtaaaaaaattggggttttttcaaaggacaaatttcctggggaattcatgaagagctggaatgactgtctgaataaagaaggtttcgataaaatcgatataagtgcagtggtggcctacaccatcgccgtaaaagaggatggcgaactcaatctgatgaagaaggctgcctctattacttctgaagtcttcaacaaatttttcaaagagcgagtgatggagattgtcgacgctgacgaaaaagtcagacattctaagttagcagagtctgtagaaaaggctattgaggaaaagaaataccttgctggcgcagaccccagcacagtcgagatgtgttatcctcccatcatacaatctggaggcaattataaccttaagttctccgttgtctccgataaaaatcacatgcattttggtgccatcacttgcgcaatgggaattagattcaaaagttactgttcaaaccttgtgcggactctgatggtggaccccagtcaggaagtccaggagaactataactttttgctccagttgcaggaggagctgttgaaggaattgcgacacggagtgaaaatctgtgacgtgtataacgctgtcatggatgtggttaaaaagcagaagcccgagctgctgaacaaaataactaaaaatctgggattcggcatggggatagagttcagagagggttccctggtgatcaacagcaaaaaccagtacaaactgaaaaagggtatggtgttttctatcaacctgggtttcagtgatctgactaataaagaaggtaagaaacccgaggagaagacatacgcactgttcattggcgatacagtactcgtggatgaagacggccctgctacagtgttgacgtctgttaagaagaaagtgaaaaacgttggcatcttcctcaagaacgaggacgaggaggaagaggaagaggaaaaagacgaggccgaggatctgctcggaaggggtagtcgggcggctttactgacagagcgtacccggaacgaaatgacagccgaggagaaacgtcgagctcaccagaaggaactggcagcgcagttgaatgaagaagcgaagagacgcctgacagagcagaaaggggagcagcagattcagaaagcccggaaatctaacgtgtcttacaaaaaccctagcttgatgcctaaagagccccatattcgcgagatgaaaatctacatcgataaaaagtatgaaactgttatcatgcctgttttcgggatcgctacccccttccacatcgctaccattaaaaacattagcatgtctgtggaaggagactatacctacctgagaatcaatttctactgccctggctccgccttaggcaggaacgagggcaacatattccccaatccagaggctactttcgtcaaagagatcacttaccgcgcttctaacatcaaagcccccggagagcaaactgtgcccgcccttaatttgcagaatgcctttcgcatcatcaaggaagtgcaaaaaaggtataagacccgagaggctgaagagaaagaaaaagagggaattgtcaaacaggattctctcgtcattaacctcaatagaagcaaccctaagctcaaggatttatatatccgtccaaacattgcccagaaacggatgcagggtagcctggaagctcatgtgaacggctttagatttacttccgtcaggggagataaagtcgatatcctttacaacaacatcaaacacgccctcttccaaccttgcgatggagaaatgattatcgtgctgcattttcacctgaagaacgcaatcatgtttggcaaaaaaaggcacaccgatgttcagttctacactgaagtgggtgagattaccactgatctgggcaaacaccagcatatgcacgacagagacgatctatacgcggagcaaatggagagggaaatgcggcacaaattaaagacagctttcaagaatttcattgagaaagtggaggcgctgaccaaagaagaactggaatttgaggtgccctttagggacctgggtttcaacggcgctccatatcgttctacctgcctcttgcaacctacctctagtgcattagtgaacgccactgaatggccaccattcgtagttactttggacgaagtcgagttgatacattttgaacgggtccagttccatttaaaaaactttgacatggtgatcgtatacaaggactatagcaaaaaagtcacaatgattaacgccatccccgtagcgagcctggacccgatcaaagagtggctgaacagctgtgacctgaaatacaccgagggggtgcaatcgttaaactggactaagatcatgaaaaccattgtggatgacccagagggcttttttgagcagggtggatggtcttttctggagccagaaggcgaaggcagcgacgcggaggaaggagattccgagagtgaaatcgaagatgaaacttttaatccatctgaagacgattacgaagaggaagaggaagactcagacgaagactatagcagtgaagccgaagagtcagactatagcaaggaaagtctcggctctgaagaagagtccggtaaggattgggacgagctggaagaagaggcgaggaaagcagatcgagagagtcgatatgaagaggaggaggagcagagtcgaagtatgagtagaaagcgaaaggcttccgtccactcctcgggacggggctcaaaccggggctccagacattcctcagcccccccaaagaagaaaagaaagtag

SEQ ID NO: 117184 - DNA, 675 bp, Artificial Sequence
  Description of Artificial Sequence: Synthetic coding sequence
atggctgcagcagtcccccagagggcttggactgtcgaacagctaaggagcgagcagcttccaaagaaagatataatcaaatttctacaggagcacggcagcgattccttcctggctgagcacaaactgctcggcaatataaaaaacgtcgcaaagactgctaataaggaccacctggtgacagcatataatcatttatttgaaactaagagattcaagggcacagagagtatctcaaaggtctctgaacaggtaaaaaacgtgaaactgaatgaggataagccgaaggagaccaaatcagaagagactctggatgaaggacctccaaagtatacaaaaagtgtcttaaaaaagggtgacaagactaatttcccaaaaaaaggtgacgttgtacactgctggtacacagggaccctgcaagatgggaccgtctttgatacgaacattcaaacctcggctaagaaaaagaagaacgccaaacctcttagttttaaggtgggcgtcggaaaggtgatccgggggtgggatgaagccttacttaccatgagcaagggggagaaggcacggctcgaaatcgaaccggagtgggcatatgggaaaaaaggacagcccgatgcaaaaattcccccaaatgctaagctgacatttgaggtggaactggtggacattgactag

SEQ ID NO: 117185 - DNA, 1374 bp, Artificial Sequence
  Description of Artificial Sequence: Synthetic coding sequence
atgacaaccgacgagggtgccaaaaacaacgaagagagccctacagcaaccgtcgcggaacagggggaggatatcacctctaagaaagatcgcggagtcttgaaaatagtcaaacgggttggcaatggcgaagagaccccaatgatcggggacaaggtttatgtgcattacaaaggcaaactgtcgaatggcaagaaatttgatagttcccacgacaggaatgagccgtttgtattcagcctgggcaaggggcaagttataaaggcctgggatattggagtggctaccatgaaaaaaggcgaaatctgccacctgttgtgcaagcctgagtatgcttacgggtcagccggatcccttccaaagatacccagcaatgcaacccttttcttcgaaattgaactgctggacttcaaaggagaagaccttttcgaagatggggggattatcagacgaactaaaagaaaaggcgaagggtactcaaaccctaatgaaggagcgacggttgaaatccacctagaaggccggtgcggaggtcgcatgtttgattgccgcgatgtggctttcaccgtgggcgaaggcgaggatcatgatattccgataggcatcgataaagccctggaaaaaatgcagcgcgaggagcagtgcattctgtacttgggacctagatacgggtttggtgaggccgggaagccgaaattcggtatcgaacccaacgccgaattgatttacgaagtgaccctcaagtccttcgagaaagcgaaggagagctgggagatggacaccaaagagaagcttgagcaggcagccattgtgaaggaaaaagggactgtttatttcaaaggaggaaaatatatgcaggccgtcatccaatacgggaagatagtcagctggttggaaatggagtatggcctgtccgaaaaggaaagcaaggcctctgagtctttcctgttggccgcattcctcaatctcgcgatgtgttacctaaagttgagggagtacacgaaagcagtcgaatgctgcgacaaggcactaggactggatagcgccaacgaaaaaggtttgtatcggagaggcgaagctcaattgttgatgaatgaattcgagagcgccaagggcgattttgaaaaagtcctagaggtcaatccccagaacaaggccgcgagacttcaaatctcaatgtgccagaaaaaagccaaggaacacaatgagcgggaccgtaggatctacgcaaatatgtttaagaaatttgcagagcaggatgctaaggaagaagcgaataaagctatggggaagaagacttccgagggtgttacaaacgaaaaagggactgatagccaagctatggaagaagagaagcccgaaggccacgtgtag

SEQ ID NO: 117186 - DNA, 1374 bp, Artificial Sequence
  Description of Artificial Sequence: Synthetic coding sequence
atgacaaccgatgagggtgcgaaaaataatgaagaatcacctacagctaccgtggccgagcagggggaagatatcacgtctaagaaagatcggggggtgctgaaaatcgttaaacgcgtaggaaatggagaagagacccccatgattggggacaaggtgtacgtccactacaagggtaagctgtcaaatggcaaaaagtttgacagttcacacgataggaacgagccgtttgtgttctccctgggcaaagggcaggttattaaagcctgggatattggtgttgctaccatgaagaaaggggaaatttgtcacctgctgtgtaaacccgagtacgcatacggatcggcgggctctctccctaagatcccaagcaacgcgaccctcttcttcgagattgagctgctggatttcaagggagaggacttatttgaagatggtggaatcattaggagaacaaaacgcaaaggtgaaggctacagcaatcctaatgaaggtgccacagtggagattcacctggaggggaggtgcgggggaaggatgttcgactgccgggacgtagccttcactgtcggggagggagaagaccacgatatcccaatcggaattgacaaggccttagaaaaaatgcagcgggaggagcagtgcatactttatctgggacctcgctatggattcggggaagccgggaaacctaagttcggaattgaacctaatgccgagctgatatacgaggtgacactgaaatccttcgaaaaggccaaggagtcttgggagatggacacaaaggaaaagctagaacaggcagccatagtcaaggaaaaagggactgtttattttaaaggcggaaagtacatgcaggcagtcattcagtatggaaaaattgtctcttggttagaaatggagtatggactcagcgaaaaagagagtaaggcgagcgagtctttcttgttagccgcattcctgaacctcgccatgtgttaccttaagctgcgggagtacactaaggccgttgaatgctgtgataaagcgttgggtctggatagcgccaacgagaagggactgtacagacgcggggaggcccagctgctaatgaacgaatttgagagcgccaagggagactttgagaaagtgctggaagtcaatccgcaaaataaagctgcccggctgcagatctcgatgtgtcagaaaaaggccaaggaacacaatgagcgcgatcgcaggatctatgccaatatgttcaaaaagttcgccgagcaggacgcaaaagaggaggcgaataaagccatggggaagaaaacctcagagggagtgacaaacgaaaagggcacagattcccaagccatggaagaggagaagcccgagggacacgtctag

SEQ ID NO: 117187 - DNA, 801 bp, Artificial Sequence
  Description of Artificial Sequence: Synthetic coding sequence
cttcttatgaaggtcccaaggaccatgaagaaggcacctcagccccttctgctcagcagagagaggatcctcccacccaaagacagaggagtgctgaaaatagtaaagcgagtcggcaacggggaagagacccctatgatcggggacaaggtctatgttcactataaagggaagctgtcgaatggcaagaaattcgacagtagtcacgacagaaacgagcctttcgttttctctctcgggaaaggtcaagtaattaaagcgtgggacataggcgtcgctaccatgaagaagggcgaaatctgtcacctcctatgcaagccagaatacgcctacgggagtgcaggtagcttgcccaaaattccctcgaacgccacgctcttttttgaaattgaacttcttgacttcaagggggaagatttgttcgaagatggtggcattatcagaaggacaaagcgtaaaggggagggatacagtaatccaaatgagggagccactgtcgagattcacctggagggcagatgtggcggccgtatgtttgactgtagggatgtggcctttacagtgggtgagggagaagaccacgatattcctatcgggatcgacaaggctctggaaaagatgcaaagagaggagcagtgtatattatatctggggcctcgccctaagaaccctgggaggtggatccccaaaaaaaactggtcccgccttccattaagcaagcgccgcgagccgtatacgtctcgttgcgtcagcccgtatgccatcctgagtattagtaagaatttgtttaaatgctggtag

SEQ ID NO: 117188 - DNA, 1374 bp, Artificial Sequence
  Description of Artificial Sequence: Synthetic coding sequence
atgaccactgacgagggcgcgaagaataatgaggaaagcccgactgctactgttgccgaacaaggggaagacatcacctccaagaaggataggggtgtccttaaaatcgtcaaaagggtgggtaacggagaagagacccccatgatcggcgacaaagtttatgtgcattacaagggcaagctctctaatgggaagaaatttgattcaagccatgaccgaaacgagccttttgttttcagcctcggtaagggacaagtcattaaagcatgggatatcggcgtcgctactatgaaaaagggcgagatctgccatttgctctgcaagcctgagtacgcctatggcagcgccggctcattgccaaagattccaagcaatgccacactattttttgaaattgagctgcttgattttaagggggaagacttgtttgaagatggcggtattatccgccggactaaaagaaagggggagggttactcaaatccgaacgagggggcaacagtggagatccatctcgagggaaggtgcggcgggaggatgttcgactgtagggatgtggcttttactgtcggcgaaggcgaggatcacgacattccaattggcatagataaggcactggagaaaatgcagagggaagaacagtgtatcttatacctcggcccgcggtatggttttggcgaagctggcaagcctaaattcggcatcgagccaaacgctgaactaatatatgaagtcacgctgaaaagttttgagaaggccaaggagagttgggagatggacactaaagaaaaactggaacaggccgccatcgttaaagagaaaggcaccgtgtattttaaaggtggaaagtacatgcaagctgtgattcagtatggtaagatcgtctcttggttggagatggaatacgggctgagcgagaaagagagtaaggcgagtgaaagctttttgctcgccgcctttttaaacttggctatgtgttacctgaagttgcgcgaatacaccaaggccgttgaatgctgtgataaggccctggggttggacagtgcgaatgaaaaaggcctgtaccgacgcggggaggcccagcttctcatgaacgagtttgagagcgctaagggcgacttcgagaaggtgctggaagttaatccacagaataaggcagcccgtctgcagattagcatgtgccagaagaaggctaaagagcataacgagagagatagaagaatttatgcgaacatgttcaaaaaattcgccgaacaggacgccaaagaggaagccaataaggctatgggcaagaaaaccagcgagggggttacaaacgagaagggcaccgactctcaggcaatggaggaggaaaagcctgaagggcatgtgtag

SEQ ID NO: 117189 - DNA, 1374 bp, Artificial Sequence
  Description of Artificial Sequence: Synthetic coding sequence
atgactactgacgagggagcaaaaaacaatgaggaatccccaacagcgaccgtggcagagcaaggagaagacattactagtaagaaggatcggggggtgctaaagattgttaaaagggttgggaacggcgaggagaccccaatgattggcgacaaggtttacgttcattacaaaggcaagctctctaacggcaagaagttcgacagctcccatgatcggaatgaaccctttgtgttcagtcttggaaaagggcaggtgattaaagcttgggatatcggagtggctactatgaaaaagggcgagatctgccacttactgtgcaagcccgagtacgcgtatgggagtgcgggtagccttcccaagataccatctaacgctacattgtttttcgagatcgagttgctggatttcaagggtgaagacttattcgaggacggcggaatcataagacggacaaagaggaaaggcgagggatattctaaccccaatgagggagccactgtggaaattcatctagaagggcgatgcggcggcaggatgttcgactgccgggacgtcgcgttcaccgtcggtgaaggcgaagaccacgacattcccatcggtatagacaaggctctggagaaaatgcagagggaggaacagtgcattctctatttaggccctcgatatggcttcggcgaggcaggaaagcccaagttcggcatcgaaccaaacgccgaactgatctacgaggttacgctcaagtcatttgaaaaggccaaggagagctgggaaatggacacgaaggaaaagcttgagcaagcagctatcgtgaaggagaaagggaccgtgtactttaaggggggtaagtacatgcaggccgtgatccagtacgggaagatcgtgtcatggctggagatggagtacggcttgagcgaaaaagagtccaaggccagcgagagtttcctcctggctgcatttttgaatcttgcaatgtgttatttgaagttgagagagtatactaaggcagtggagtgctgtgacaaagctcttggtctggatagtgctaatgagaaaggtctgtaccggcgtggtgaggcacagctgcttatgaatgagttcgagagcgccaagggagactttgaaaaggtactcgaagtaaacccccagaataaagccgccagactgcaaatatcaatgtgccagaagaaggcaaaggagcacaacgagagagacagaagaatctatgcgaatatgtttaagaaatttgccgagcaagatgcaaaagaagaggccaacaaggctatgggcaagaagacttctgaaggggtcaccaatgaaaaggggacggactcccaggcaatggaagaagaaaagcccgaaggtcatgtgtag

SEQ ID NO: 117190 - DNA, 837 bp, Artificial Sequence
  Description of Artificial Sequence: Synthetic coding sequence
atgttcgactgtcgggacgtggcttttactgtaggcgagggagaggaccacgatattcctataggcatagacaaggcccttgaaaaaatgcaaagggaagagcaatgtatcctctacttgggccctaggtacggattcggggaggcgggaaagcccaaatttggtattgagccgaacgcagagctgatctacgaggtgacgcttaaatcgtttgagaaggccaaggagagctgggaaatggatacaaaggaaaagttggagcaagccgcaattgtcaaggagaaaggaactgtgtatttcaagggggggaagtatatgcaagccgttatccagtatggaaagatcgtttcttggttagagatggaatacggcctcagtgaaaaggaatccaaggctagtgagtcttttctgcttgcggccttcttgaatctcgccatgtgttacttgaaactccgggaatataccaaggcagtcgagtgctgtgataaagccctgggactggatagcgccaacgagaaaggcctataccggaggggggaggctcagctgctcatgaatgaattcgagagcgctaaaggtgatttcgaaaaggtactggaagtgaatccgcagaacaaggccgcacggctccagatctctatgtgtcagaagaaggccaaagaacataatgagcgcgacagacgaatatatgcaaacatgtttaagaagtttgctgaacaggatgccaaagaagaggctaataaggccatggggaagaagactagcgaaggagtgaccaatgagaagggcaccgattcccaagctatggaggaggaaaagcctgaaggccacgtttag

SEQ ID NO: 117191 - DNA, 807 bp, Artificial Sequence
  Description of Artificial Sequence: Synthetic coding sequence
atgaccactgacgaaggggcaaagaataatgaagaaagtccgactgccacagtggccgaacagggcgaggatataacttctaaaaaagatcggggagtgttgaaaatagtgaaacgggtggggaatggggaggagaccccaatgattggcgacaaggtgtatgttcactataagggcaaattgagtaacgggaaaaaattcgatagctcccacgaccggaacgaaccttttgtattctcattgggcaagggccaagttatcaaggcttgggatatcggcgtggcaaccatgaaaaaaggggagatctgccatctgctgtgcaagcccgagtacgcctatggtagcgcaggctcactccctaagatcccctccaacgccacccttttctttgagattgagttattggattttaaaggcgaggatttgtttgaggatggagggatcattcggaggaccaagcgaaagggcgaagggtattccaatcctaacgagggagcgacggtcgaaatccacctcgaaggacgttgtggaggaaggatgttcgactgccgggatgtggcctttacggtgggcgaaggcgaagatcacgatatccccatcggcatcgataaggcacttgaaaagatgcagcgggaagaacagtgcatactgtacctggggcctcgtcctaagaacccaggcagatggatccctaaaaagaactggagtaggctgccgcttagcaagagacgcgagccatacacttcaaggtgcgtgtcgccttacgctatcctgtctatttccaaaaacttatttaaatgctggtag

SEQ ID NO: 117192 - DNA, 1263 bp, Artificial Sequence
  Description of Artificial Sequence: Synthetic coding sequence
atgaccaccgagcagggagaggagacgcccatgattggtgacaaagtttacgtgcattataaaggtaaattatctaatgggaaaaaatttgattcatcacatgaccgtaatgaaccatttgtgttctcccttggcaagggacaagttattaaggcctgggatataggtgtggccaccatgaagaagggcgaaatttgtcacctgttgtgcaaacctgagtacgcttatggctctgctgggtcattgccgaaaattccttcaaatgctaccctattttttgagatcgaactactcgactttaagggagaagatctgttcgaggacggagggatcattcggaggacaaagcggaagggcgaaggatattccaaccctaacgagggggcaaccgtagaaatccatctggaaggtcggtgcggaggtcggatgtttgactgtcgtgacgtggcattcaccgtgggggaaggggaggaccatgacatccccattgggattgacaaagcactcgaaaaaatgcagcgcgaggagcagtgcattctatatcttggtccccgctacggctttggagaggccggcaagcctaagttcggaatcgaaccaaatgcagaactgatttatgaggtcacgttgaagagctttgagaaagccaaagagtcctgggaaatggacacaaaagagaaattggagcaagcagccattgtcaaagagaaaggtactgtgtattttaaaggcggaaagtatatgcaagccgttatccaatatggtaagatcgtgtcatggttggagatggagtacggcctgagcgagaaggaatccaaggccagcgaaagcttcctgttagccgcatttctgaatctggccatgtgttacctgaaactccgcgaatacacaaaggctgtggaatgctgtgacaaggcattgggactggatagtgccaatgagaagggcctgtatcgccggggcgaagcccagttgctgatgaatgagttcgagtccgcaaaaggagatttcgaaaaagtcctggaggtgaatccccagaacaaggctgctaggttgcaaatttccatgtgtcaaaagaaggcaaaagagcataatgaacgggatcgtaggatatacgcaaacatgttcaagaagttcgctgagcaagatgctaaggaagaagccaacaaagcgatgggaaaaaagacctcggaaggagttacgaacgaaaagggtacagactctcaggcaatggaggaggaaaagcctgagggacacgtatag

SEQ ID NO: 117193 - DNA, 984 bp, Artificial Sequence
  Description of Artificial Sequence: Synthetic coding sequence
atgggcgggagtgccctgaatcagggagtcctagagggcgatgatgcccccggccagagtttgtatgaacgactttcccagcgtatgctggatatatctggagaccgcggcgtcctgaaagacgtgatcagggaaggagctggcgacctggttgcccctgacgcctccgtcctcgtgaaatacagtgggtacctcgagcatatggatcgaccattcgacagcaactacttcagaaagacaccccgcctgatgaagctgggagaggacattactctttggggaatggaactgggcctgctgagcatgaggcggggcgagttggcgcgctttctgtttaagcccaactatgcttacggaactcttggttgtccccccttaattcccccgaatacgaccgttctgttcgagatagagctgctggacttcctggattgtgcggagagtgacaaattctgcgctctcagcgccgagcagcaggatcagtttcctcttcagaaggtgctgaaagtagctgccaccgaacgagaattcggcaattatctttttcgacagaataggttctacgatgctaaggttcgttataaaagagccttgctgctcctccggcggcgttccgctcctcccgaagagcagcatcttgtggaagctgcaaagctgcctgtactgctcaaccttagctttacttaccttaagctcgatagacccacaatcgccctttgttacggtgaacaggccctcatcatagaccagaaaaatgctaaagcactgttccggtgtggccaggcatgcctgttgttgaccgaatatcaaaaggccagggatttcctggtacgtgcccagaaagagcagccattcaatcacgatattaacaacgagttgaaaaagctggcatcgtgttatcgcgactacgtcgacaaggagaaagagatgtggcaccggatgttcgcaccatgcggggatggatccaccgccggcgagagttag

SEQ ID NO: 117194 - DNA, 969 bp, Artificial Sequence
  Description of Artificial Sequence: Synthetic coding sequence
atgtcagctagctcctggccccagaacggaatgccaccaagtagcctttacgagcgcttatctcagaggatgttggatatcagtggggatcggggtgtgcttaaagacgtgatcagagaaggtgcgggtgatctggtggccccagatgcatccgtgttggtaaagtactccggctatttggaacatatggatagaccatttgattcgaattattttaggaaaacaccgcgtctgatgaagctcggagaggatattaccctttgggggatggagttaggtttgctttccatgcgccggggcgaactggcccgctttctgtttaaacctaactacgcctatggcactctggggtgtccaccgctgataccccccaatacaactgtgctctttgagatcgagctcctcgacttcctggactgcgcggaaagcgataagttctgtgctctctctgcggagcagcaggatcagtttcctctgcagaaggtgttgaaggttgcggcaacagaacgggagtttggaaactatctgttcagacagaataggttttatgatgccaaggtcagatacaagagagcattattgctcctgcggcgtcgatcagcaccaccggaggagcagcaccttgtcgaggctgctaagctgcccgtgctgctcaacctgtcgttcacttacctcaaactagacaggcctaccattgcgctctgctatggcgagcaagccctcatcatcgaccagaagaacgccaaagccctcttccggtgtgggcaagcttgtctgctacttaccgagtaccagaaggccagggattttctcgtgcgcgctcagaaggagcagcctttcaatcatgacatcaacaatgaactcaaaaagctggcttcctgttatagagactatgtggataaggagaaagagatgtggcatcgaatgttcgccccatgcggcgatggctctaccgctggagaaagttag

SEQ ID NO: 117195 - DNA, 531 bp, Artificial Sequence
  Description of Artificial Sequence: Synthetic coding sequence
atggacctgcctgattctgcgtcacgcgtgttctgtggtagaatccttagtatggtgaataccgatgacgtgaatgcgataatcctcgcccagaaaaacatgctggaccgcttcgagaagaccaacgaaatgttgctaaacttcaacaacttgtcgagcgcgcggcttcagcagatgagtgaaaggttcctgcaccatacccgtacactggtcgaaatgaagcgtgacctagatagcatattccggcgtattcgcactctcaaaggtaagctggcaagacagcatcccgaggcatttagtcacattcccgaagcctctttcctggaggaagaggacgaggatccaatcccccccagcactactaccacaatcgccacgtcagagcagtcaactgggtcctgcgacacttctccggacaccgtctctcccagcctgtctcccggcttcgaggacctatcccacgttcaacctggcagtcccgcgatcaacgggcgttcccagaccgatgacgaggaaatgacaggcgagtag

SEQ ID NO: 117196 - DNA, 1326 bp, Artificial Sequence
  Description of Artificial Sequence: Synthetic coding sequence
atgggcgtgggcgcaggaagggtgtcccagagtggggccccttcccctggtggcgctggacgggcaaatagctgtccaccctcctctatggccagctgcgcagagccttctgagcctagcgctccactgcctgctggagtacctcctctggaggactttgaggttcttgatggagttgaggatgccgaaggagaagaggaggaggaggaggaagaggaggaagaggacgatttgagcgagctgccccctcttgaagatatggggcagcctccggcagaggaagctgagcagcccggagcgttagctcgcgagtttctggccgctatggagcctgaaccggcacccgcccccgcacctgaagaatggctggacatactagggaatggattgttgcgaaagaagactttggtccccggcccacccggcagctccaggcctgttaaagggcaagtcgttaccgtgcacctgcagacatcccttgagaatggcactagagtgcaggaggaacctgagctagtcttcacactcggagattgtgacgtaatccaagccctcgatctctccgtgcctttaatggacgtgggagagacagctatggtgactgctgacagtaaatactgctatggtcctcaaggccgcagcccatacatcccaccccatgccgcattgtgcttggaagtgacactgaagactgcagtcgacggaccagacctagaaatgctgactggccaagagcgcgtggccctggcaaacaggaagcgtgaatgcggaaatgcccactaccagcgcgccgatttcgtgctcgcagctaactcttatgacctcgctatcaaggccatcacgtctagtgccaaggtcgatatgacattcgaggaggaagcccagctcctccagctaaaagtcaaatgccttaataacctggcagcttcgcagctcaaactggatcattatcgggctgcactccgctcttgttccttggtcctggagcaccaaccggacaacatcaaggctctgtttcgaaagggcaaagtccttgctcagcagggggaatactcagaagccatccccatactgagagcggccctgaagttagaacctagcaacaaaacaatacatgctgaactgtccaaactggtgaagaagcacgcagctcagcgaagcaccgagactgctttgtaccggaaaatgctggggaacccttcaaggctgcctgcgaagtgtccagggaagggcgcttggagcatcccctggaagtggctgttcggcgctacggccgtagctcttggcggggtggctctgtccgttgtgattgcagctcgaaactag

SEQ ID NO: 117197 - DNA, 762 bp, Artificial Sequence
  Description of Artificial Sequence: Synthetic coding sequence
atggctagctgtgcagagccctctgagccctcagcgcctctccccgcaggagttcctcctttagaagacttcgaggtccttgacggtgtcgaagacgccgaaggagaggaagaggaggaggaggaggaggaggaggaggatgatctcagcgagctaccgcccttggaagacatgggccaacctccagcggaggaggccgagcagcccggggctcttgcgagggagtttctggctgctatggaacccgagcccgctcctgcaccggcaccagaagagtggcttgacattctggtggacatgacgttcgaggaagaggcacaactgttacaacttaaggtgaagtgcctgaataatttggctgcaagtcagctgaagctcgaccactaccgggccgcgctccgctcctgctccctcgtactcgagcatcagccagacaatatcaaagctctgttccggaaaggcaaagtcttggctcaacagggggagtatagcgaggctatccccatacttagagctgccctaaagctggaaccatccaacaaaactatccatgccgagttgagcaagctagtcaaaaagcatgccgcccagagaagcacagaaaccgccctgtacagaaagatgctcggcaatcccagtaggttgcctgcaaagtgtcccggcaagggtgcatggtctatcccgtggaaatggttattcggcgcaacagccgtggcccttggtggcgtggctctgagcgtggtgattgctgcacggaactag

SEQ ID NO: 117198 - DNA, 1599 bp, Artificial Sequence
  Description of Artificial Sequence: Synthetic coding sequence
atggccaaacgcgtcgccattgtgggagcaggggtctcaggactggcatcgattaagtgttgccttgaagaggggcttgagcccacatgcttcgagcggtccgacgacttgggtggactttggcgattcactgaacacgtggaagaagggagggccagtctgtataaatctgtcgtatctaactcatgcaaggaaatgtcctgttattcagattttccattccccgaggattatcctaattatgtcccaaactcacagtttttggaatatttgaagatgtatgcaaaccactttgacctgctgaaacatatacaattcaaaacaaaggtttgtagtgttaccaagtgcagtgactcagcagtgagcggacagtgggaagtggtcaccatgcacgaggaaaaacaggagtctgccatttttgatgctgtgatggtctgcacaggcttcttgacaaacccatatctgcccctggattccttcccaggtatcaacgcattcaagggtcagtattttcactcaagacagtataagcaccctgatattttcaaggacaagagggtgctcgtgatcggcatgggcaattcaggcacagatatcgccgtggaggcgagtcatctcgccgaaaaagtgttcctatctactacagggggaggctgggttatttcacgtatatttgatagcggttatccctgggatatggtatttatgaccagatttcaaaacatgctacgcaatagcctgcctaccccaatagtgacctggctgatggagagaaaaataaacaattggctgaatcatgccaactacggcctgattcccgaggacagaacacaactgaaagaatttgtcttgaacgacgagttgcctggccggattatcactgggaaagtcttcattagaccttccatcaaagaagtaaaggaaaactctgtgatcttcaataatacaagcaaagaagagcccatcgatataatagtttttgccaccggatacacttttgccttcccgttcctggacgaaagcgtggtcaaggtcgaggacggccaggctagcttgtataagtacatatttcccgcgcatctacagaagccgacactggccatcattgggttgatcaaaccgctggggtccatgattcccaccggcgagacacaggctagatgggcagtgcgcgttctgaagggggtcaacaagttgccacctccttcagtgatgatcgaggagataaacgcaaggaaggagaataagccaagttggtttggcctatgttactgtaaggccctccagtccgactatatcacctatatagatgaactcctcacatacatcaatgctaagcctaacctttttagcatgttgctgaccgacccacacctggccctgacggtgttcttcggaccatgttcaccgtatcagtttaggctgacaggcccggggaagtgggaaggtgcccgtaatgcaattatgacccagtgggatcggaccttcaaggtgattaaggccagagttgtacaagagtccccaagtccatttgagtcctttctcaaagtgttttcatttctcgctctgctggtggcaatttttctgatctttctatag

SEQ ID NO: 117199 - DNA, 1599 bp, Artificial Sequence
  Description of Artificial Sequence: Synthetic coding sequence
atggctaaaagggtagctatcgttggcgcaggggtgtctggcctcgcgtccatcaagtgttgcctcgaggagggcctggagccaacctgtttcgaacgcagcgatgatctggggggtctctggcgattcaccgagcatgtggaagaggggagagccagcctgtacaagagtgttgtttcaaatagctgcaaagaaatgtcttgctacagtgactttccattccctgaagactaccctaactacgtccctaactcgcagtttcttgagtatctgaagatgtacgccaaccattttgacctcctcaagcacattcagttcaaaacgaaggtctgttccgtcaccaagtgttcagactccgccgtgagcgggcagtgggaagttgtcaccatgcacgaggagaagcaggagtcggccatatttgacgctgtcatggtgtgcaccggcttcctcacaaacccatacctgcctcttgactccttccccgggattaatgcctttaaggggcaatactttcattccagacagtataagcatccagacatcttcaaggataaacgggtgcttgtcataggcatgggaaactccggcacggacattgctgtggaggccagtcacctggcagaaaaagtgttccttagcacgacaggtggagggtgggtgatatcccggatcttcgactcaggatatccctgggacatggttttcatgacacgttttcagaatatgttgcggaattcccttccaacgcctattgtaacttggctgatggagcggaagattaacaactggcttaaccacgcaaattacggcctgattccagaagataggactcagttgaaagagtttgtcctcaatgacgaactgccgggacgcattattaccggcaaggtattcattcggccatcgatcaaagaggtgaaagagaattctgtgatcttcaacaatacctccaaggaggagcccatcgatattattgtgttcgccaccgggtacacatttgccttcccttttttagacgagagtgtggtaaaggtggaggatgggcaggcgagtctgtacaaatatatatttcctgcacacctccagaagcccacgctcgctattatcggccttattaaaccgctgggctcaatgattccaaccggggagacacaggcccgttgggcagttcgcgtgcttaaaggggtgaataagctgcctcctccaagtgtgatgattgaagagatcaatgccagaaaagagaacaagccttcctggtttggactgtgctactgtaaagctttgcaaagcgactacatcacctatatcgacgagctgctcacctacatcaatgccaaacccaatctgttttctatgctgttaactgatcctcatctggctctgacagttttttttggaccctgttctccatatcagttcaggcttaccgggcccgggaagtgggagggcgcgcgaaacgctattatgacgcaatgggacaggacgtttaaggtgatcaaggcgcgcgtggtacaggagtccccttcccctttcgagtccttcttgaaggtgttttctttcctagctctgctagtggccatcttcctaattttcttgtag

SEQ ID NO: 117200 - DNA, 1410 bp, Artificial Sequence
  Description of Artificial Sequence: Synthetic coding sequence
atggccaaaagagtagcaattgtcggagccggtgtctcgggcctcgcctccatcaagtgctgcctggaggagggattggaacctacttgcttcgaaagatctgatgatttggggggcctgtggcgattcactactaaagtttgcagcgtgacgaaatgctctgactcggctgtgagtggtcagtgggaagtggttactatgcacgaagagaagcaggagtcggcaattttcgatgccgtgatggtgtgcactggatttctgacgaatccctatttgcctctcgacagcttcccaggcattaatgcatttaaagggcagtacttccactcccggcagtataaacacccagatattttcaaagataagagagtgctggttattggcatgggcaattcaggaaccgatatcgcggtggaggctagtcaccttgctgaaaaagtcttcctcagtacaacaggcggagggtgggtgatatccagaatatttgattcgggctacccttgggacatggtatttatgactcgtttccagaacatgttgcggaactccttgccaacccccatcgtaacttggctcatggagcggaagatcaacaattggctgaaccacgccaactatggtctgattcctgaagatagaacacagctgaaggagtttgtgctcaacgacgaactgcctggccgcataatcaccggcaaggttttcattcgcccatcgataaaagaggtgaaagaaaattctgttattttcaacaacaccagtaaggaagagccaatcgatatcatcgttttcgccactggttacaccttcgcctttccttttttagacgaatctgtggtgaaggtagaggatggacaggctagcctctacaagtacattttccccgcacatttgcagaagccaactttggccatcatcgggctcatcaagcctctgggctctatgatccccaccggcgaaactcaggcaagatgggcagtgcgcgtgctcaaaggggtcaacaaacttccccccccatcagtaatgattgaggaaataaatgcccgtaaagagaataagcctagctggtttgggctttgttactgcaaagccctgcagagcgattacattacatacatcgacgagctgcttacatacatcaatgctaagccaaatctgttcagcatgttgcttacagacccccacctggctctcacagtattcttcggcccttgctccccctaccagtttcgactgaccggtccaggaaagtgggaaggcgcacgcaatgccataatgacccagtgggataggacgtttaaagtgatcaaggcacgcgtggtccaggaaagtccttccccctttgaatcttttctgaaggtattctccttcctcgcactgctggtggccatatttctgatcttcctgtag

SEQ ID NO: 117201 - DNA, 627 bp, Artificial Sequence
  Description of Artificial Sequence: Synthetic coding sequence
atggccaaacgggtcgctatcgttggagctggagtgagcggactagccagcattaagtgctgcttggaagaagggctggaaccaacctgtttcgagagaagcgatgatctcgggggcctgtggagattcactgagcacgtggaagagggaagggcatccctgtataagtccgtcgtgtccaatagctgtaaagagatgagttgttacagcgacttccctttccctgaggattaccctaactatgtgcctaactcacaattcctggagtacctgaagatgtatgccaaccatttcgacctgctcaaacacattcaattcaagaccaaggtttgtagcgtcactaaatgctctgatagtgctgtgtccgggcaatgggaagtggtgaccatgcacgaggaaaaacaagaatctgccattttcgatgccgtgatggtatgtaccggatttttgacaaacccttatttgcctcttgactccttcccgggcataaacgcctttaaagggcagtattttcactcaaggcaatataagcaccccgatatatttaaggataaaagagtgctcgtaattggcatgggcaacagtggcacggacattgctgtagaagcttcgcacttagccgagtag

SEQ ID NO: 117202 - DNA, 1830 bp, Artificial Sequence
  Description of Artificial Sequence: Synthetic coding sequence
atggagggtaaacctatgagaaggtgcacaaacatccggccaggcgagacagggatggacgtcacctctagatgcacactgggggaccccaacaagctaccagagggcgtgcctcagcccgcccgcatgccgtacatatccgacaagcaccccaggcagacgcttgaggtcattaacctgctgaggaaacatcgagagctctgtgatgtcgtgctggtggtgggtgcaaagaaaatatacgctcatagggtcatcctctccgcctgtagtccctactttagagccatgtttactggggaactggccgaatcccgacaaaccgaagttgtgatacgtgacatcgatgagcgagcgatggaacttctgattgactttgcatacacatctcagataactgtggaagagggtaacgtccaaactctgctgcctgcagcgtgtttattgcagctggctgagatccaggaagcgtgctgtgaatttttgaagcgccagctggatcccagcaactgcttggggattagagcctttgccgatacgcattcctgtcgagaactgctcagaatagctgataaatttacacagcacaactttcaagaagtgatggaaagtgaggagtttatgttgctgccagcaaatcagctgatcgacataatttccagcgatgagcttaatgtgcgaagcgaggaacaagttttcaacgccgtcatggcttgggtgaaatactccatccaggagcgccgcccacaactgcctcaggtcctgcagcacgttaggctccctctactgtctcccaaatttttagttggcaccgtcggaagcgatcctctcatcaaatccgatgaagaatgtagagacctggtagacgaggctaaaaattatctgctgctgccccaggagcgcccactgatgcaaggcccgaggaccaggcccaggaaaccaatcaggtgtggtgaggtgttgtttgccgttggtggctggtgttcaggcgatgcaatcagctccgtcgaacgctatgatccccagaccaacgagtggagaatggtggcctctatgagtaaacggcgttgtggcgtgggggtcagtgttcttgacgatctactgtacgcagtgggaggccatgacggttcctcttaccttaacagtgtcgaaagatatgacccgaaaactaaccagtggtccagcgacgttgcacctacttcgacctgtaggacatcagtaggtgtggctgtgctgggtggctttctgtacgctgttggtgggcaggacggcgttagttgcctcaatattgtggagcgttacgatcctaaggaaaataaatggactcgggtggcttcaatgtcaacgaggagactcggtgtcgctgtcgccgtcttaggtggatttctttacgcggtgggagggtccgacggcaccagccctctcaacaccgtcgaacgctacaacccacaggaaaaccgctggcacactatcgcacctatgggtacaagaagaaagcacctgggctgtgccgtttaccaggacatgatttacgccgtcggcggtcgagacgataccacggagctgagcagcgccgagagatacaatccaagaactaaccaatggagtcccgtggtggccatgaccagtcggcggtcaggggtcggtctagctgtagtaaacggccagttgatggccgtgggaggttttgatggcacgacctacctaaaaacaatcgaggtctttgatcctgacgccaatacatggcgtctctatggcgggatgaattaccgccgactggggggaggcgtaggagttattaagatgacacactgcgagagccacatttggtag

SEQ ID NO: 117203 - DNA, 1416 bp, Artificial Sequence
  Description of Artificial Sequence: Synthetic coding sequence
atggccaagaaggtggccgttatcggtgcaggcgtcagcggcctcattagccttaagtgttgcgtagacgagggcctcgagccgacgtgcttcgaaaggacagaagacatcgggggtgtgtggagattcaaggagaatgttgaggacggcagagcgtcaatctaccagtctgtggttactaatacgtctaaggaaatgagttgcttttcagattttcccatgcctgaggacttcccgaattttctgcacaattccaagctgctcgagtatttccggatctttgccaagaagtttgatctgctcaagtatatccaatttcagacaacggtgctctctgttcgtaagtgcccggacttctcatcaagcggccagtggaaagtggtgactcaatcaaatgggaaggaacaatcagctgtgttcgatgcagtcatggtgtgttctgggcaccacatattgccacacatcccccttaaatctttcccaggcatggaaaggttcaagggccagtactttcacagccgacagtacaaacaccctgacggctttgagggaaagcggatcttggtgattggcatgggaaattctgggagtgacatcgcagtggaactgagtaagaatgctgcacaggtgtttatctccacgcgacatggcacctgggtaatgtccaggatcagtgaagatggatacccatgggactcggtgtttcacaccagatttagatcaatgcttaggaacgtgctgcccaggaccgcagttaagtggatgatcgagcagcagatgaacaggtggtttaatcacgaaaactatggattggagccacagaacaaatacataatgaaggaacccgttctcaatgacgatgtgccatcccgattattatgcggcgcaatcaaggtcaagagcaccgttaaagaactcaccgagaccagtgcgatctttgaggacggcaccgtagaagagaacatcgacgtaatcatctttgccactggatatagcttcagtttcccctttctcgaagattcactggtgaaagtggagaacaacatggtttcgctgtataagtacatctttcctgcccatttggataagtccaccctggcatgcatcgggctgattcagccactcggaagtattttcccgactgcagaactgcaagctagatgggttaccagagtcttcaagggcctgtgttcattgcccagtgagcgcaccatgatgatggatattatcaagcgaaacgagaaaagaatcgatttgttcggggagagccagtcccagaccttacaaacaaattatgtggattatctcgacgagctggccttagagatcggcgccaaaccggatttttgcagtctcctgttcaaagacccaaaattggctgttcggctttactttgggccttgcaactcctactag

SEQ ID NO: 117204 - DNA, 1599 bp, Artificial Sequence
  Description of Artificial Sequence: Synthetic coding sequence
atgggcaaaaaagtggctattattggcgctggagtaagcggcctagcctctattcgcagctgtctagaggagggtttggagcccacctgttttgaaaaatctaacgatattggtggactctggaagttctccgatcatgctgaggaaggccgtgcctcaatttacaaatctgtcttctctaactcttccaaggaaatgatgtgttttccagacttcccatttcctgatgacttccccaactttatgcataacagcaaaatccaggaatatatcatcgcattcgccaaagagaagaatctccttaagtacatccagtttaagacttttgtgagctctgtgaacaagcacccggattttgcgacaaccggtcagtgggacgtgactaccgagcgggatggcaaaaaagaatccgccgttttcgacgctgtgatggtgtgtagcgggcaccacgtgtaccctaatcttccaaaggagtcattccccggcctgaatcatttcaaaggaaagtgtttccactcacgcgattacaaggagccgggagtattcaatggtaaacgcgtactggttgtagggctgggaaactccggttgtgatatcgctaccgagctatccaggaccgccgaacaagtgatgatctcatctagaagcggctcctgggttatgtcccgggtttgggacaacggatacccctgggatatgctacttgtcacgcggtttggaacctttcttaagaacaatctgccaacagccatatcagattggctgtacgtcaagcagatgaacgctaggttcaagcacgagaattacgggcttatgcctttgaacggcgtgctgagaaaggaacccgtatttaacgacgagctgcccgctagcatactgtgtggcatcgtgagtgtaaaacccaatgttaaggagtttaccgagacatccgcaatatttgaggacggcactatatttgaagggatcgattgcgtgatctttgcaacaggctattcattcgcatatcccttcctggatgaatccatcatcaaaagcagaaataacgagattattctcttcaagggggtcttcccaccgctccttgaaaaatcaaccatcgctgtcattggattcgtacagagcctcggcgccgctatcccaaccgtggatctgcagtccagatgggcagctcaggttatcaaaggtacttgcacactcccctcaatggaagacatgatgaacgacatcaacgaaaagatggaaaaaaaacggaaatggtttggcaagtctgaaacaatacagacagactatattgtgtatatggacgagcttagcagcttcattggagctaagccgaatataccttggctctttctgactgacccgaaattggctatggaggtgtatttcggaccatgctcaccttatcaattccggttggtggggcccgggcagtggcccggcgctcgcaacgctatcctcactcagtgggacaggtctttgaaacctatgcagactagggtggtgggcagactgcagaaaccttgtttcttcttccactggctcaaactcttcgccattcccattctgctgatcgccgtgtttctcgtccttacctag

SEQ ID NO: 117205 - DNA, 1599 bp, Artificial Sequence
  Description of Artificial Sequence: Synthetic coding sequence
atggggaagaaagtggccatcatcggcgcaggggtatccggactcgcaagtatcagatcttgccttgaagagggtctggaacccacttgcttcgaaaaatctaatgatattggcggtctgtggaagttctcagaccatgcagaggaagggcgcgcaagtatctataaatcagtatttagtaatagtagcaaggagatgatgtgcttccccgacttccccttccctgatgatttcccaaatttcatgcacaattctaagatccaggagtacatcatcgcattcgccaaggaaaagaacctcttgaagtacattcagttcaaaacgtttgtgtcaagcgtgaacaagcacccggattttgcaaccaccggccaatgggacgtcacaactgaaagggacggcaagaaagaatctgccgtttttgatgcagtcatggtgtgctccggtcatcatgtctaccccaatcttcccaaggagtcctttccaggtctaaaccatttcaaaggcaaatgcttccattctagagattataaagagcctggcgttttcaatggaaagcgggtactggttgtgggcctgggcaacagcggctgcgatatagcgactgaattgtcccgaactgccgagcaggtaatgatatccagcaggtcaggcagttgggttatgagcagagtttgggacaacggttacccgtgggacatgctcctggtcacccgatttgggaccttcctgaaaaacaatctccctacagcaatttccgattggctctacgtgaagcaaatgaacgcccgcttcaagcatgaaaactacgggctgatgccactgaacggagtcttgaggaaagagccagtgtttaacgacgagctgccagcttctatcctgtgcggcatcgtcagcgttaagcccaacgtgaaagaattcacagaaacaagcgcgatcttcgaggacggaaccatctttgagggtattgactgcgtcatttttgccactggttacagtttcgcttacccattcctcgacgaatccattatcaagtctagaaataacgaaattattctattcaaaggagtctttcccccgctgttggaaaaatccaccattgcagtgataggattcgtccagagccttggcgctgcaatcccaactgtggacctgcaaagtagatgggccgctcaagtgattaagggcacatgcaccctgccatccatggaagacatgatgaacgacatcaacgaaaagatggaaaaaaagcgtaagtggtttggaaagagcgaaaccatacaaactgactacatcgtttatatggatgagctgagttcttttattggggccaaaccgaatattccttggttgtttctgactgacccaaaactggccatggaggtttactttgggccgtgctctccttaccagttcagactggtggggccaggacagtggcccggagcccgaaatgccatactgacccagtgggacaggtctctcaagccaatgcagactcgcgtcgtaggaaggttgcagaagccatgcttcttctttcattggttaaagctgtttgccatcccgattttactgatcgccgtctttttggtcctgacatag

SEQ ID NO: 117206 - DNA, 1410 bp, Artificial Sequence
  Description of Artificial Sequence: Synthetic coding sequence
atgggcaagaaagtcgcgatcattggtgccggggtctccggcttggcgtccattaggtcatgtcttgaggaagggttggagccaacttgttttgagaagagcaacgatatcgggggcttatggaagttcagtacgtttgtcagttccgtgaataaacatcctgacttcgcgaccactggccagtgggatgttactaccgaacgggacgggaagaaagagagcgctgtgtttgacgctgtgatggtttgctccgggcatcacgtatatcctaacctgcccaaggagtccttcccaggtttaaaccattttaaggggaaatgctttcactctcgcgactataaagaaccaggtgtctttaatggcaaacgcgtccttgtagtgggcttagggaattccggatgtgatatcgccactgaactgtcccggacagcggagcaagtgatgataagctcacgctccggctcgtgggtaatgtctcgagtgtgggacaacggctacccttgggatatgctcctggtaacccgattcgggacttttctcaagaacaacttgcctactgccatctcggattggttgtatgtcaaacagatgaacgctcgattcaaacacgaaaattatggtttgatgcctttaaacggcgttctccgaaaggaacccgtcttcaatgatgagctgcccgcttccattttgtgcgggattgtttcggtgaaaccgaatgtgaaggagtttacggaaacgagcgcaatcttcgaggatggaactatctttgaaggcatagactgtgtgatcttcgccaccggatactcattcgcatatccctttctggacgagtccattattaagtccagaaacaacgagatcatactctttaaaggcgtattcccgcctctgctagagaagtccaccattgcggttatcgggtttgttcagtccttgggggcagccattccaaccgtggatctgcagagccggtgggctgctcaggtaatcaagggcacctgtacactgccttctatggaggatatgatgaatgacattaacgagaaaatggagaaaaaacgtaagtggtttggtaaatcggagaccatccagaccgactatatcgtgtatatggacgaactttcttcctttatcggtgccaaacccaacattccttggctgtttcttaccgaccccaaactggcgatggaagtgtacttcgggccctgcagtccatatcaatttcggcttgtcggccccgggcagtggccaggagctaggaacgctatcctgacacagtgggaccgatccctgaagccaatgcagacgcgggtcgttgggagactccagaagccatgcttcttcttccattggctgaagttgttcgccatcccaatcctccttatagcagtctttctggtcctgacgtag

SEQ ID NO: 117207 - DNA, 1539 bp, Artificial Sequence
  Description of Artificial Sequence: Synthetic coding sequence
atgccagcctccactaggtcccagaagaggcagggcatggactctctgctcgagcctctgaaaatgaacatggatcacgccgaggagggacgagcaagcatctataagagcgtatttagtaacagcagtaaagagatgatgtgtttcccagactttccctttcccgacgattttcctaactttatgcataacagtaaaattcaggagtatatcatagcctttgcgaaagaaaagaatctgctgaagtatattcagtttaaaacctttgtgtcatcggtgaataagcaccctgattttgccactaccggccaatgggatgtgacgaccgagcgggatggaaagaaagagagtgccgtcttcgatgccgttatggtgtgctctggacaccatgtgtatccgaatctccctaaggaatctttccctggactgaaccattttaagggcaagtgctttcacagccgagattacaaggagcccggggttttcaatggtaaaagagtcttagtggttgggttgggaaattccgggtgtgatatagccacagagctctcgcggacagcagaacaggttatgatcagctcacggtccggatcttgggtaatgtccagggtttgggacaacggatacccctgggatatgctgctggtgacacgctttggtacctttcttaagaacaacctacccaccgcaatcagtgactggctctacgtcaagcagatgaacgcaagattcaaacacgaaaactatgggctgatgccactgaacggcgttttgaggaaggagcctgtcttcaatgatgagctgcctgcctccatattatgcggtatcgttagtgtgaagcccaacgttaaagaattcacagaaacctctgccatttttgaggatggaacgatcttcgagggaattgactgcgtgatctttgccacggggtacagcttcgcctacccttttcttgatgaatcaattattaagtcccggaataatgagatcatcttgttcaaaggtgtgttcccccccctattagaaaagtcgactattgccgtgatagggttcgtgcagtccctgggcgcagcaatccccaccgtggacctgcagtcaagatgggccgcccaggtgatcaagggtacatgtacactcccctcaatggaagatatgatgaatgatattaacgaaaagatggaaaaaaaaaggaagtggtttgggaagtctgaaactatccagaccgattacatcgtgtacatggacgaattgtcatcgttcattggcgctaagcctaatatcccctggttgttcctgactgatcccaagctggccatggaggtttactttggcccttgcagcccctaccagttccgactggttggaccaggccagtggccgggagcccgaaacgctattctaacccagtgggaccggtctcttaagccaatgcagacgagagtggtgggaaggctacagaaaccttgttttttttttcattggctcaagctttttgcaatacctatcctattaatcgccgtcttccttgttctgacttag

SEQ ID NO: 117208 - DNA, 1677 bp, Artificial Sequence
  Description of Artificial Sequence: Synthetic coding sequence
atggccaagaaagtggcagttatcggcgcaggggtctctgggctttctagtattaaatgctgcgtggatgaggacctggaacccacgtgttttgaacgatctgacgacatcgggggtctctggaaattcacagagtcgtcaaaggatgggatgactagagtgtacaagagtctggttaccaatgtgtgcaaggagatgtcatgctacagtgactttccctttcatgaggattatcccaactttatgaaccacgagaaattttgggactaccttcaggaattcgctgaacacttcgacctgctgaaatacattcagtttaagacaacggtgtgctccattactaaaaggccagacttcagtgagactgggcagtgggacgtggtgacagagacggagggcaagcaaaatagggcagtctttgacgctgtgatggtgtgcacaggtcatttcttgaatcctcacttgccgctggaggcattcccagggatccataagtttaaaggccaaatcctgcactcacaggagtacaagatcccagaggggttccaaggcaagagggtcctggtcattggcctgggcaacacgggcggagacattgcggtcgaattaagccgaacagcagcacaagtgctgctgtccacacgtacgggaacctgggtgttagggagaagtagcgattggggatatccttataacatgatggtgaccagacgttgctgctcgttcatcgctcaagtgttgcctagtcggtttcttaactggattcaggagcggaagctcaataagagatttaaccacgaggattatggcttaagcatcaccaaaggcaaaaaagctaaattcatagtcaacgacgaactccctaactgtatcctctgtggggcgataaccatgaagacctccgttattgagtttactgagacctccgccgtcttcgaagacgggacagtagaagagaatatagatgtagtgattttcacaactgggtacactttttcatttccgtttttcgaagagccccttaaaagcctgtgcacaaagaagatctttctctataaacaggtctttcccctcaacctggagcgtgctaccctggccatcattggcttgattggccttaaaggaagcattctgagtgggacggaattgcaggctcgctgggtcactcgcgtattcaaaggactgtgtaagataccacctagtcagaagctgatgatggaggctactgagaaggagcaactcataaaacgaggcgtattcaaggacactagcaaagacaagttcgactatatcgcatacatggacgacattgcagcttgcatcggaacgaaaccttcgataccactcctttttctaaaggaccccaggctagcctgggaggtcttcttcggcccttgcaccccctatcagtaccgattgatgggacctggaaaatgggatggagccagaaacgcaattctgacacaatgggatcggacactcaaacctctcaaaacacggatagtgccggacagcagtaagcccgctagcatgagtcattacctgaaagcatggggggcaccggtgctgctcgcttctttgttgctcatttgtaaaagctcgcttttccttaagctcgtgagagacaaactgcaggacaggatgtctccatatttagttagcctgtggcgaggctag

SEQ ID NO: 117209 - DNA, 1602 bp, Artificial Sequence
  Description of Artificial Sequence: Synthetic coding sequence
atgaccaaaaaaagaatcgctgtcattgggggcggggtctcgggtttatcctcaatcaagtgttgtgttgaagaggggctggagcccgtctgtttcgaaagaaccgatgatatcggtggactttggcggtttcaggaaaacccagaagagggacgtgccagtatctacaagtctgtgattattaatactagtaaggagatgatgtgcttttccgactatcccatcccagatcattatcccaacttcatgcacaacgcacaggtactggagtattttcgaatgtatgctaaagagttcgatttactcaagtatatacggttcaaaaccaccgtttgttctgtcaaaaagcagcccgactttgcaacttctggacagtgggaagtagtgaccgagtctgaaggtaaaaaagagatgaatgtatttgacggcgttatggtgtgtacagggcatcataccaacgcacacctccctctcgagtcttttcctggcattgaaaaatttaaaggacagtattttcactcgagagactataagaaccccgaggggttcaccgggaagcgcgtaatcatcataggcattgggaattcggggggagacctagccgttgagatcagtcagacggcaaagcaggtgttcctgagcacccgcaggggggcatggatactcaatagagtcggcgactatggataccctgccgatgtcttgttctcatctcgtttaactcattttatctggaaaatttgcggacagtctctggccaataagtacctggagaaaaagatcaatcagagatttgaccacgagatgttcggtctgaagcccaagcacagggcattaagccagcacccaacactgaatgacgacctcccaaaccgcatcatcagcggtttagtcaaagtaaaaggcaatgtcaaagagttcacagagaccgctgctattttcgaggatggaagtagagaggatgacattgatgctgtcatattcgctacagggtattcgttcgactttccatttctcgaggactccgtgaaagtcgtgaaaaacaaaattagtctgtataagaaggtgtttccgcctaacctcgagagacctacgctggcgataatcggtctgatacaaccccttggcgcaatcatgccaatttccgaactccaggggcggtgggctacacaggtgtttaaaggcctcaagactttaccatcacagtccgaaatgatggccgagattagtaaagcgcaggaggagattgataagcgatatgtagagagccaacggcatacaattcaaggcgactatatcgacaccatggaggagctggccgatcttgtcggagtgcgtcccaacctgctgtcattagcattcacagaccccaagcttgccctccacctcctgctcggaccctgtacaccgatccattacagagttcagggccccggcaaatgggacggcgcccggaaagccatactcacaacagatgaccgtattaggaaacctctgatgacgcgtgttgtggagcggtcctcttctatgactagcactatgactattggcaaattcatgctagctctcgccttctttgctatcatcatcgcatacttttag

SEQ ID NO: 117210 - DNA, 858 bp, Artificial Sequence
  Description of Artificial Sequence: Synthetic coding sequence
atgacgaaaaaaagaatcgctgtaatcgggggtggggtctctggcttgtcttctattaaatgctgcgtcgaggaaggccttgaaccagtgtgcttcgagcgaaccgacgacatagggggtctgtggaggttccaggagaaccctgaggaagggagagcttccatttataaatccgtgatcattaatactagtaaggaaatgatgtgttttagcgactatccaattcccgaccactatcctaatttcatgcataatgcccaagtgcttgagtatttccgaatgtacgccaaggagttcgacctcttgaagtatattcggtttaaaaccaccgtttgttccgttaagaagcaaccagacttcgctaccagcggccagtgggaggtggtaacagagtcggaaggtaagaaggaaatgaacgtatttgatggagtgatggtgtgcactggccaccacaccaacgcccatctaccgctggagagtttccctgggattgagaagtttaagggccaatatttccatagcagagattacaagaatcctgagggatttactgggaagcgtgtcatcataatcggaattggtaattcaggaggcgacttggctgtggagatttctcaaactgccaagcaggtgttcctgagtactcgccgcggggcatggatcctaaaccgagtcggcgattacggatatcccgctgatgtgttattctccagtaggctgactcacttcatttggaagatttgtgggcagagtctcgcgaataaatatttggaaaaaaagattaatcaacgattcgatcacgaaatgtttggcctaaagcccaagcatagatccaaggatattgcgctcaccgagtag

SEQ ID NO: 117211 - DNA, 1395 bp, Artificial Sequence
  Description of Artificial Sequence: Synthetic coding sequence
atgaccaagaagcgcatagcggtgatcgggggcggtgtcagcggcctctcctctattaagtgttgcgtcgaggaagggcttgaacctgtgtgttttgagagaaccgatgatatcggcggactgtggagattccaggagaacccagaggagggtagagcatcaatttataagtcggttatcattaatacttcaaaagagatgatgtgcttctccgattaccctatacccgatcactaccctaacttcatgcacaatgctcaggtgttggagtatttccggatgtatgcaaaggagtttgatctgctgaaatacatcagattcaaaacaaccgtgtgctcagttaaaaagcaacccgactttgcgactagtggtcagtgggaggtggtgactgagtccgaagggaaaaaggagatgaacgttttcgacggcgtaatggtctgtacggggcaccacaccaacgcccatctgcctctggagtccttccccggaattgaaaaattcaagggacagtacttccattcccgggactacaagaacccggaaggctttaccggtaagcgagtgatcataattgggattgggaattctgggggcgacctggccgtcgagatttcccagactgctaaacaggtttttttgtccacgcgaagaggggcctggattttgaacagggtgggggattacggataccctgcagatgtcttgttctcctctcggctcacccattttatttggaagatatgtggacagtccctcgcaaacaagtacctggaaaagaagatcaatcagaggtttgaccatgagatgttcggtctcaaacctaaacaccgcgcccttagtcagcaccccactttgaacgacgatctgcctaatagaatcatcagcggactcgttaaggtgaaaggtaacgtgaaagagtttactgaaaccgctgccatctttgaggatggctctagggaggacgacatcgacgccgtgatcttcgctaccggctattcttttgattttccattcctcgaggactcggtaaaggtcgtgaagaacaagatcagtctgtacaaaaaagtgttccctcccaacttggaaagaccaactttggctattatcggcctgatccagcctttgggcgctatcatgcctattagcgagctgcaggggagatgggccacacaagtctttaagggattgaaaactctcccttctcagtctgagatgatggctgagattagcaaagcccaagaagagatcgataaatccctaactatgcgcaagacatcagataaacctaaactcaagaatatactgcagatccccgactacttgaagactgtcaagatcatcaacaaagaatctttacggaactgccccggaataaagggtcccaaggagacttag

SEQ ID NO: 117212 - DNA, 579 bp, Artificial Sequence
  Description of Artificial Sequence: Synthetic coding sequence
atgacaaagaaaaggatagccgtcataggggggggagtctccgggcttagctctatcaagtgttgcgttgaggagggactggagcccgtgtgcttcgaacgcactgatgacataggagggttgtggcggtttcaagaaaacccagaggaagggcgggcatcaatttataagtctgtgatcatcaacacttctaaagagatgatgtgctttagcgactaccccatacctgatcactacccaaactttatgcacaacgcccaagtgttggagtactttcgaatgtatgctaaggagttcgacctgctgaagtatattaggttcaagaccacggtgtgcagtgttaagaagcagccagactttgctacgtccgggcaatgggaagtcgttaccgagagcgaagggaaaaaggagatgaatgtcttcgacggagtgatggtgtgcaccggccatcatacgaatgcccatttgcccttggagagctttcccggcattgaaaagttcaaaggccaatacttccactctcgcgactacaaaaaccccgaagggttcacaggaaagcgagtaatcattataggctag

SEQ ID NO: 117213 - DNA, 438 bp, Artificial Sequence
  Description of Artificial Sequence: Synthetic coding sequence
atgaccaaaaagcgcattgcagttatcggaggcggagtgtccggcctttctagcatcaagtgctgtgtggaggaaggcctcgagcccgtttgtttcgaacgcaccgatgatatcggcggtctctggaggttccaggagaaccctgaagagggacgcgctagcatctataagtctgtgataataaataccagcaaggagatgatgtgttttagcgactacccgattcctgaccactaccccaatttcatgcacaacgcccaggttctggagtattttaggatgtacgccaaggagttcgatctgctgaagtacatccgcttcaaaaccacagtgtgttcggtcaagaagcaacccgactttgccaccagcggacaatgggaggtagttacggagtctgaagggaagaaggaaatgaacgtttttgatggagtgatgtag

SEQ ID NO: 117214 - DNA, 3810 bp, Artificial Sequence
  Description of Artificial Sequence: Synthetic coding sequence
atggaagctactggcgtattaccttttgtacgaggggtggacctctctggaaacgatttcaaaggcggttacttccccgaaaacgtgaaagctatgactagcctaagatggctaaaactgaaccgaaccggactctgttacctgccggaagaactcgccgctctgcagaagctcgagcacctttcagtgtctcacaataatctgacaaccctgcacggcgaactgtcatccctgccgtccctgagggcgatagtggcgcgggctaactccctgaaaaactcaggggtccctgacgacatattcaaactggatgaccttagtgtgctggacctctcacacaaccagctaaccgagtgcccacgcgaactggaaaatgccaagaatatgctcgtgctgaacctgtcccacaactccatcgataccatcccaaaccagctctttatcaacctcaccgacctactgtacctggatctgtccgaaaacaggctggagtccctccccccccagatgagaaggttggttcacctgcagacactggttctgaatggcaatcctctgctacacgcccagctgaggcagctccccgccatgacagctcttcaaactctccatttgagatctacccagcggacccagagcaatctgcctacatcactggaggggttgtcgaatcttgccgacgtggacctgtcctgcaatgatctgaccagggtgcctgagtgtctatacacgctgccctcactgcgcagactcaatctgtctagcaaccagatcactgaactctcattgtgtatcgaccagtgggttcatgtggaaacgttgaatctctctagaaatcaacttacatcactgccaagcgccatctgtaaactaagcaaactcaaaaaactctatctgaactcaaacaagttggacttcgacggattaccttccgggattggcaagctgacaaaccttgaggagttcatggctgccaataacaacttggaactagtgccagaaagcctctgccgctgccccaaattacggaaattggtgctcaataaaaaccatctggtgacgctccccgaagccattcatttcctcacagagatcgaagtgcttgacgttcgtgaaaacccaaacttggttatgccacctaaaccggcagaccgggccgccgagtggtacaatatcgacttctcattgcagaatcagctccggctggcgggcgcctcgcctgcaactgttgccgccgccgcagctgccggcagtggcccaaaggaccccatggctaggaaaatgaggctgagaagacggaaagactccgcccaggacgatcaggccaagcaagtgttgaaggggatgagcgacgtggcccaggagaaaaataaaaaacaggaggaatctgcagacgcccgcgccccctcaggaaaggtcagaaggtgggatcagggcctggagaagcctcgtttggactatagtgagttctttaccgaggacgtcggtcagcttcctggcctcacaatttggcagattgaaaatttcgtgcccgtgctggttgaagaagcgttccatggcaagttttacgaggccgactgttatatcgtcttgaaaacctttttggacgactccggcagtctgaactgggagatttactactggatcggcggcgaggccacattggataagaaagcttgttctgccatccatgccgtgaacctgaggaattacctgggtgcggagtgccgtactgtgcgcgaggagatgggtgatgagagcgaggagttcctgcaagtcttcgataacgacatttcttacatcgagggaggcaccgcctcaggtttttacactgtggaggacacgcattatgtgactcggatgtatagggtatacggtaagaagaatattaagcttgaaccagttccactgaagggaacatctttagacccgaggtttgtgtttctgttggatcgcggactcgacatttacgtttggaggggcgcccaagcaaccctgtccagcactaccaaggcccgcctgttcgcggagaagatcaataaaaacgagagaaagggaaaggccgaaatcactcttctagttcaaggacaggaactcccggagttctgggaggcactcggtggagagccttccgagataaagaagcacgtacccgaggatttttggccacctcaaccaaaattgtacaaggtaggtctgggcctgggctaccttgaacttccccagatcaactacaaactctcagtcgagcataaacagaggcccaaggtggaattaatgccaagaatgaggctcctccaaagtctgttggacacacgatgcgtatatatcttagactgctggagcgacgtgttcatctggttggggaggaaaagcccacgccttgttcgagcagctgcgctcaagttagggcaggagctatgtggaatgctgcataggcccaggcacgccacagtgtcgcgctctctcgaaggcaccgaagcccaggtttttaaggcaaagtttaagaattgggacgacgtcctgaccgtcgattacacgaggaatgcagaggccgtgctgcaatcccccgggctgtcggggaaggttaaaagagacgctgaaaaaaaggatcagatgaaggcagatttaactgcactgtttctcccacggcaaccgccgatgtcactggcagaggctgagcaactgatggaagaatggaatgaggacttggacgggatggagggttttgtactcgagggcaaaaaatttgcccggctgcctgaagaggagttcggtcacttttacacccaagattgctatgtcttcctgtgccggtactgggtacccgtggagtacgaggaggaagagaaaaaggaggacaaggaggagaaggccgaggggaaggaaggggaggaagccactgccgaggccgaggagaagcagccagaagaggactttcagtgtattgtgtacttctggcagggtagggaggcttctaatatggggtggttaacttttaccttttcactccagaagaagttcgaatccttgtttcccggcaagttggaggttgtacgaatgacccagcaacaggaaaatcccaagtttctttcacatttcaagagaaaattcatcattcacaggggtaagaggaaggccgtacagggcgcccagcagccttcactctaccagatcaggacaaatgggtccgcgctttgcactaggtgcatacagattaacaccgattcgtctctgctcaacagcgagttctgttttattttgaaggtacccttcgaaagtgaagataatcagggcatcgtctacgcctgggttggtagggcaagcgatcccgatgaagcaaagctcgcagaagacattcttaacaccatgtttgacaccagctactccaagcaagttatcaacgaaggcgaagagccagagaatttcttttgggtgggcattggcgcgcaaaaaccttacgacgacgatgcagagtatatgaagcacacgcgattatttaggtgtagtaacgagaagggatattttgccgtgacagagaagtgcagcgacttttgccaggatgatctcgcagatgacgacattatgctactagacaatggtcaggaagtttacatgtgggtgggtacgcagaccagccaggttgagatcaagttgagtctcaaagcatgtcaggtttatattcagcacatgaggtctaaagaacatgagcggccgagaagactccgactcgtgcgaaaagggaacgagcagcatgccttcacacggtgctttcatgcctggtcagccttttgcaaggccctggcatag

SEQ ID NO: 117215 - DNA, 3552 bp, Artificial Sequence
  Description of Artificial Sequence: Synthetic coding sequence
atgacttcactgcgatggttaaaacttaacaggacaggtctgtgctatctccctgaagagctcgccgctctacagaagctggaacacctgagcgtgtctcacaataaccttacaactttacatggcgaactctcctctttaccttccctgagggccattgtggcacgggccaactctttgaagaacagcggagtgcctgatgacatttttaaactcgatgacctcagtgtccttgatttgtcacacaatcagctcacagagtgtccgagagaactggagaatgctaagaatatgctcgtcctcaacctgagccacaatcggcagctccccgctatgaccgcactgcagacgcttcatctccgatctactcagagaactcagtcaaatctgcctacttcactggagggtctgagcaacttggccgatgtcgatctctcctgcaacgacctaacccgggtacctgagtgtctgtacacactcccatccctacgtagactcaacctctcttcaaaccagataacggagctgagcctgtgcatcgaccaatgggtccatgtcgaaaccctcaatctctcgcgtaaccaacttacgagtctgccctctgcaatatgcaaactcagcaaactgaagaagctctacttgaactctaacaagctggactttgacggtctccccagtggcatcggaaagctcaccaacctggaagaattcatggcggccaataataatctggaattagttccagaaagtctatgccgctgtcccaagctgcggaaattggtcttgaacaagaatcacttggttactcttcctgaggctatccatttcctcactgaaatcgaagtcctggatgtgcgcgagaatcctaacctggtaatgcctccaaaaccggccgatcgcgcagcggagtggtacaatattgatttctcactgcagaatcagctccgtctggctggtgcgtccccagctactgtggccgcagcggcagcagggagcggaccaaaggatcctatggcccgtaaaatgagacttcgcaggaggaaggatagcgcgcaggatgatcaagccaaacaggtgttaaagggtatgagcgacgtggctcaagagaagaataagaaacaagaagagagcgccgacgcccgcgccccaagcggaaaggttcgccgctgggatcagggcctcgaaaaaccccgtctggattacagcgagttcttcaccgaagatgtgggtcagctgccagggttgaccatctggcaaattgagaactttgtcccggtcctggtggaagaggccttccatggcaagttttatgaggcggactgctacattgtgcttaaaacctttctggacgactccggcagtctgaactgggagatttattactggattggcggagaagctacgctggacaagaaagcgtgtagcgccatccacgcagtcaatctgcggaactatctgggtgccgaatgcaggaccgttagggaggagatgggtgatgagtctgaggagtttctacaagtcttcgacaacgatatcagctatatcgaggggggcacggccagcgggttttatactgtagaggacacacactatgtaacgaggatgtaccgggtttatggcaaaaaaaacataaagctcgagcccgtacccctgaaggggaccagtttggatccaagatttgttttcctcttggacagaggactggatatatatgtgtggcggggagcacaggcaactctaagctctacaacaaaagctcggctgtttgctgagaaaataaacaaaaacgagaggaaagggaaggctgagattacactgctcgttcaaggccaggagctgcccgagttttgggaggccctgggaggcgagccatcagagatcaaaaagcatgtgcctgaggacttctggcctcctcagccgaaactgtacaaagtcgggctgggcctcggctacctcgagctgcctcagataaactataagctgtcggtggagcataaacaacgacctaaggtagaacttatgccacgcatgcggctgctgcagtcgctcttggatactcgctgcgtgtatatcttggactgctggtcagatgtcttcatctggctcgggcggaaaagtccgagactggtgagggctgccgcgcttaaattgggacaggaactttgcggcatgttgcatcgaccccggcatgccacagtctcaaggtccttggaagggacagaagcccaagtatttaaggcgaagttcaagaattgggatgacgtcttgacagtcgattacactaggaatgctgaagcagtgctacagtctcccggcctgtcaggcaaagtaaagagagacgccgagaaaaaggatcaaatgaaagccgatttgacagccctgtttcttcctcgtcaaccccctatgtcgctggcggaagccgagcagctgatggaagagtggaacgaggaccttgatggcatggaggggtttgtactggagggcaaaaagtttgcgaggctgcctgaagaagaatttggacatttctacacacaggattgttacgtcttcctctgcagatactgggtgcctgtcgagtacgaggaagaagagaagaaagaggataaggaggaaaaagccgagggcaaggagggcgaagaggcgaccgctgaagctgaagagaagcagcctgaagaggatttccagtgcattgtgtatttctggcaggggcgggaggccagcaatatggggtggctgacattcaccttctctctgcagaaaaagtttgagtccctattcccagggaaattggaggttgtgcggatgacacaacagcaggagaatcccaagttcctgtctcattttaagagaaagtttatcatacataggggaaagcgcaaggctgtgcagggcgcccagcagccatcactgtaccagatacggaccaacggctccgctctttgtactagatgcatccagatcaataccgacagtagtctgctcaactcggagttttgtttcatacttaaagtgcccttcgaatctgaagacaatcagggtatcgtgtatgcctgggttggccgggcctctgaccccgatgaggcaaaattggccgaggacatcctgaataccatgttcgacacctcttattccaagcaagtaattaatgagggggaggagcccgaaaattttttctgggtcggaattggggcacagaagccctacgacgacgatgcagagtatatgaaacacacaagactatttagatgcagcaatgagaaaggttattttgctgttactgagaaatgttcagacttctgccaggacgacctggctgatgatgatattatgttgctggacaatggtcaagaggtgtatatgtgggtggggacacagacctcacaggtggagatcaagttaagcttgaaggcctgccaggtctacattcagcacatgcgcagtaaggagcatgagagaccacggcggctaaggctcgtaagaaaaggtaatgagcaacacgcttttacccgatgttttcacgcttggagcgctttttgtaaagccctcgcctag

SEQ ID NO: 117216 - DNA, 3447 bp, Artificial Sequence
  Description of Artificial Sequence: Synthetic coding sequence
atggaagcgaccggcgtgctgcctttcgttagaggtgttgatctgtcgggcaacgacttcaagggtggatatttcccagagaacgtgaaggcaatgacctccctgcggtggcttaagctgaataggacaggcctgtgttaccttcccgaggagctggccgctttgcagaaactggaacatttgtctgttagccataataacctaaccacccttcacggtgaattgagcagcctcccaagcctccgagccattgtggcaagggcgaactccctgaaaaacagtggagtgcctgacgatattttcaaactggatgatctcagcgtcttggacttgtcccataatcagctgacggagtgtcccagagaattggagaatgcgaagaacatgctggttttgaatctgtctcataattcaatcgacacaataccgaaccagttattcatcaacctgacagacctgctctatctggacctgtccgagaatcggctagagagcttacctccccagatgcggaggttagtacatttacagactctggttctcaacggaaaccctttactccacgcccaactgcgccagcttcctgccatgactgccctgcagacgttgcatctgcgctcgacacagaggacccaaagtaacctgccaacgtccttagaaggcctgagtaatctcgcagacgtcgatctaagttgcaacgatttgacgcgggtgccggagtgtctgtacactcttccctccctgcggaggcttaacctttcatcaaatcagataaccgaactctctctgtgcatagatcagtgggtgcacgttgaaacactcaatctgtccaggaatcagctcacatccctgccctccgccatctgcaaactcagcaaactcaagaagctttatttgaattccaataagttagactttgatgggttgccctcagggattgggaagctgacgaacctggaagagtttatggcagctaacaataatttggagctggtgcccgaaagtctgtgccgctgtcctaaactgcgaaagttggttctgaacaaaaaccacctcgtgaccctcccggaggcaatccacttcctcactgagatcgaggttttggacgtcagggaaaatcccaacctggtgatgcctccaaagcctgccgatagggccgccgagtggtacaacattgactttagtctccaaaatcagctccgcctcgctggcgcttctccggccacagtggctgccgcagcagccgcgggctcagggcccaaagatcctatggccaggaagatgagattacgtcggagaaaagattccgcacaagatgatcaggcaaaacaggtgctcaaaggaatgagtgacgtggcacaggaaaagaataaaaaacaagaggagtctgccgacgcgcgagcccctagcggaaaggtgcgaaggtgggaccaaggactagagaagcctcgcctcgattatagcgagttttttacagaagacgtcggacaactgccagggctgactatctggcagattgagaacttcgtccctgtgctcgtggaagaagcttttcatggcaagttctacgaagctgactgctacatagtgctgaagacatttttagatgacagtggctcactgaactgggagatatactattggatcgggggtgaggccactctggacaaaaaggcttgctccgcaattcacgctgtcaatctgagaaactatctgggagctgagtgccggacagttcgcgaggaaatgggcgacgaaagtgaagagttccttcaggtgtttgacaatgacattagctacatcgagggaggaacagctagcggattctacactgttgaagacacacattatgtgactcggatgtatcgcgtgtacggaaagaaaaacattaagctggagccagtccctctcaagggcaccagcttggatccacgattcgtgttcttactggaccggggactggacatttacgtgtggcggggcgctcaagccaccctgagttcaaccaccaaggcccgtctctttgctgagaagataaacaaaaatgaacgcaaagggaaggctgaaatcaccctactggtccagggacaggaactccctgagttctgggaggcactcggaggcgaacctagtgagattaagaagaattgggatgatgtgctgactgtggattataccagaaatgctgaggccgtccttcagtccccggggctctctggcaaggttaaacgcgacgctgaaaagaaggatcaaatgaaagctgatctcaccgctctgtttttgccccggcagcccccaatgagcttagcagaagccgaacagctgatggaggaatggaacgaggatctggacgggatggagggcttcgtcttggaagggaagaaatttgcccgcttgcccgaggaagaatttggccatttttatactcaggattgctatgtgttcttatgccgttactgggtcccagtggaatacgaggaagaggagaaaaaagaagacaaagaggaaaaggccgagggcaaagaaggtgaagaggccacggcagaagccgaggaaaagcaacccgaagaagattttcagtgtatcgtctacttctggcaaggacgagaagcttcgaatatgggttggttaacctttacttttagccttcaaaaaaagttcgagtctctgttccccggcaaactggaagttgtacgcatgacccagcagcaggaaaaccctaaatttttatcgcacttcaaaagaaaatttatcattcaccgaggcaagagaaaggcagtacaaggcgcccagcagccctcgctctaccagatccgtactaacgggtccgctttgtgcactcgctgcatccagataaatacggactcctctctgcttaattccgaattctgctttatcctaaaagtaccatttgaatctgaggataatcagggaattgtgtatgcctgggtggggagggccagtgatcccgatgaagcaaagctggccgaggacattctgaatactatgtttgatacatcgtactccaaacaagtgatcaacgagggagaggaacccgaaaatttcttttgggtgggcataggagctcagaagccctacgacgacgacgccgaatacatgaagcacacccggctgttcagatgttctaacgaaaaaggatacttcgctgtgacagagaagtgtagtgatttttgccaggatgatctagccgacgacgacatcatgctgctggataatggacaggaggtgtatatgtgggtggggacgcagacatctcaggtagaaatcaaactctccttaaaagcatgccaagtttacattcagcacatgcggtccaaggagcatgaacgccctcggcggctgcgccttgtgcggaagggtaacgaacagcatgcctttacacgctgtttccatgcttggagcgcattttgcaaggctctcgcttag

SEQ ID NO: 117217 - DNA, 1284 bp, Artificial Sequence
  Description of Artificial Sequence: Synthetic coding sequence
atgttttttacatgtgggccaaatgaggcgatggttgtctcagggttttgccggagtccgcccgttatggtggcgggaggacgagtgtttgtgctgccctgtattcagcagatacagaggatatcactgaataccttaactctgaatgtgaaatctgagaaagtgtacaccagacatggtgtaccaatctcagtgactggtattgctcaggttaagattcaaggacagaacaaggaaatgctggccgctgcctgccagatgttcctcggaaagaccgaggcagagattgcacacatcgcattggaaaccctggaaggccaccaacgggccatcatggcacacatgaccgtggaagagatctacaaggaccgacagaaattcagcgagcaagtcttcaaagtcgctagcagcgaccttgtgaatatgggtatatcggtggtgtcatatactctgaaggatatacacgacgaccaggattaccttcattcgcttggcaaagccaggacagcccaggtccagaaagatgctcgtatcggggaagcggaggcaaagcgggacgccggcatacgggaggctaaggcaaaacaggagaaggtgtcggcccagtatctgtcagaaatcgagatggccaaggctcagcgagattatgagttaaagaaagctgcatatgatatagaagtcaatactcgcagagcccaagctgatttggcatatcagctgcaggtcgcgaaaaccaagcaacagatagaggaacaaagagtgcaggttcaggtcgtggaacgtgctcagcaagtcgccgtgcaggaacaggagattgctaggcgggaaaaggaacttgaagccagggttagaaaacctgcagaggcggaacgttacaagctggagcggctggctgaggcggagaagtcacagctgataatgcaggcagaagctgaggcggccagcgtgaggatgcggggagaagcagaagccttcgcaatcggggcccgggcccgggccgaggccgaacagatggctaagaaggcagaagcctttcagttgtatcaggaggccgcacagctagacatgctgcttgaaaaactcccccaggtagccgaagagatttcaggtcccctcactagcgccaataaaatcacccttgtaagctctggatcagggacgatgggagcagcaaaagtgacaggggaggtgttggatatcctaacccgactgccagagtcagtcgagagactgaccggggtgagcatcagccaggtcaaccacaagccactgaggactgcttag

SEQ ID NO: 117218 - DNA, 1284 bp, Artificial Sequence
  Description of Artificial Sequence: Synthetic coding sequence
atgttctttacatgtggtcccaacgaggctatggtcgtgagcggcttctgtagatctccacctgtgatggtcgctggagggcgcgtcttcgtgctaccgtgcattcagcagatccagagaatttctctcaacacactgaccctcaatgtgaagtctgagaaggtgtatactcgccatggtgtgcctatcagtgttaccggaatagctcaagtcaagattcagggacaaaataaggaaatgttggctgccgcttgccagatgtttctgggtaaaacagaagccgaaattgcacacatagccctggagacactggaagggcatcagcgagcgatcatggcccacatgaccgtggaagagatctacaaggacaggcagaagttttctgaacaagtctttaaggtcgcgagctccgatttggtcaatatgggcattagcgttgtgtcttacacgctgaaggacattcatgatgaccaggactacctgcacagcctggggaaggctcgcaccgcgcaggtgcagaaggatgccagaatcggcgaggccgaagctaaacgggacgcaggtataagagaggccaaggctaaacaagagaaagtctctgctcagtatctgtccgaaattgaaatggctaaggctcagagggattacgaactgaagaaggcagcatatgacatagaagtgaacacaagaagggcacaggcagacctggcctatcagctgcaggtggcaaagacaaaacagcagattgaagagcagagagttcaggtccaggttgtcgaaagggctcagcaagtggcagttcaagaacaggaaatcgctcgtagagagaaagaacttgaggccagggtgagaaagcctgcggaagccgagaggtataaactggagagactcgcggaggcagagaagtcacaactgatcatgcaggctgaggcagaagcagcatcagttaggatgcgcggagaagcagaggcttttgctatcggtgcaagggcgagagctgaagcagagcagatggccaagaaggccgaagccttccagctgtaccaggaagctgctcaactcgacatgttgctggagaagcttccccaggttgccgaggagatttctggccccctcacctcagctaacaaaatcactctggtgagcagtggttccgggacaatgggtgctgccaaggtgaccggggaggttcttgatatcttaaccaggctgcccgagtccgtggagcgtctgacaggcgttagcatctcacaggtcaaccataagcctctgcgcaccgcctag

SEQ ID NO: 117219 - DNA, 1284 bp, Artificial Sequence
  Description of Artificial Sequence: Synthetic coding sequence
atgttcttcacatgtgggcccaatgaggcaatggtcgtgagcggtttctgtagatcaccacccgtgatggttgctgggggaagggtctttgtgctgccttgcatccagcagattcagcgtatctccctcaacacattgacacttaacgttaaaagcgaaaaagtctatacacgccacggcgtgcccatcagcgttacgggcatcgcccaagtaaaaatccaggggcagaacaaggaaatgttagccgcagcttgtcagatgtttcttggcaagacagaagctgagatcgcacacattgccctggagacgctggaaggccaccagagggccattatggcccacatgacagttgaggaaatctataaggacaggcagaaattctccgaacaggtctttaaggtggcttcctctgatctggtcaatatggggattagcgtagtgtcctatactctgaaggatattcacgacgaccaggactacctgcacagtctgggcaaggcccgcaccgcacaagtccagaaggacgcgcgcattggggaggcagaggccaaacgcgatgccggtataagagaagcaaaggcgaagcaggaaaaagttagcgcacagtatcttagcgagatcgagatggcaaaagcacagcgcgactacgagctgaagaaagcagcttatgacatcgaggtgaacacacgccgggcgcaagctgaccttgcataccaattgcaggttgcaaagacgaagcagcaaattgaggaacaacgggtgcaggtgcaagtggttgaaagggcccagcaggtcgccgtgcaggaacaggaaatagcgcgccgcgaaaaagagcttgaggccagggtgcgaaaacctgctgaagctgaaagatataaactggagaggcttgctgaagcagaaaaaagccaattgattatgcaggccgaggcagaggcagcatccgtgcgcatgcgaggagaagcggaagcttttgccatcggtgcccgggctcgcgccgaggcagagcagatggcaaaaaaggctgaggcttttcaactgtaccaggaagcagcgcagctggatatgctccttgagaagctgcctcaggtggcagaggagatctcaggccctctgactagcgcaaacaagatcacgctggtatccagtggctccggcactatgggtgctgctaaggtcaccggcgaagtgctagacatcctcacccgcctgccagagtctgtcgaacggttgactggagtgtctatttcccaggtcaaccacaagccactccgcacagcctag

SEQ ID NO: 117220 - DNA, 438 bp, Artificial Sequence
  Description of Artificial Sequence: Synthetic coding sequence
atgggagtcgaggggaccggccggggaggatgtcgtctgggcggcccagatggaaagggtaagggttgggctcctgtagatgcgaccgcacggctgccccacccccaacgcctcagtctgcctctgctccagctgcaacctgaaccatgtttctccttagtggcacaaatgaggccctggtggtcaccagactacttacactctctgggaaaggctcggacagctcaagtgcagaaagacgctaggatcggcgaagccgaggcaaagagggatgcaggaatccgcgaggcgaaagcaaagcaagagaaggtgagcgctcagtacctgtctgaaatcgaaatggccaaagctcagagggattatgagctgaagaaggccgcctatgacatcgaagtcaatactcggagagctcaagccgacctagcctatcaattgtag

SEQ ID NO: 117221 - DNA, 579 bp, Artificial Sequence
  Description of Artificial Sequence: Synthetic coding sequence
atgttctttacctgcggccctaacgaagcaatggttgtctccggattttgcagaagcccgccggtaatggttgctgggggccgcgtgttcgtgctaccctgcatccagcagatccagcgtatcagcctcaacaccttgacccttaatgtcaaaagtgaaaaggtgaagatccagggccagaacaaagaaatgctggctgctgcttgccagatgttcctcggtaaaacagaagctgagatcgcccatatagcactggagacattagagggacaccaaagggccatcatggctcatatgaccgtggaggagatttataaagacagacagaaattttcagagcaggtattcaaagtggcctcatctgatctggtgaatatgggcatctcagtggtgagctacaccctgaaggacatccatgacgaccaggattatttacacagcctggggaaagccaggactgcacaggttcaaaaagatgcccgaatcggcgaagcagaagccaaaagggacgccggcattagagaggcaaaagccaagcaggagaaggtgtccgcccagtatctatcagagattgagtag

SEQ ID NO: 117222 - DNA, 579 bp, Artificial Sequence
  Description of Artificial Sequence: Synthetic coding sequence
atgttctttacctgtggtccgaacgaagcaatggtcgtgtctggtttttgtcgctcaccccccgtgatggtagctgggggtcgcgtatttgtgctgccctgcatccagcagatacaacggatcagtctcaacaccctcaccctgaatgttaagagtgagaaggtaaaaattcaaggccagaacaaagagatgctggccgccgcttgccagatgtttctaggcaagaccgaagctgaaatcgctcacatcgctttagagactcttgaaggacatcagagggccatcatggctcacatgactgtggaagagatttataaggacagacagaaattttccgagcaggtgtttaaagtggcctcttcagacctagtgaacatggggatctctgtggtttcgtacacgctcaaggacattcacgacgatcaggactacctccattctttaggcaaagccaggaccgcccaggtgcaaaaggatgcccgaattggcgaggccgaggccaagcgggacgccggtattcgggaggccaaggcgaagcaagagaaagtgtcggctcaatacctgagtgagattgaatag

SEQ ID NO: 117223 - DNA, 717 bp, Artificial Sequence
  Description of Artificial Sequence: Synthetic coding sequence
atgagaccttggtggtctcctgtgaaaatccagggacagaacaaggaaatgctcgccgccgcttgccagatgtttttgggcaaaactgaagcggagattgcacacattgctctagagacgctcgaagggcaccagcgcgcaatcatggctcatatgaccgtcgaggaaatctacaaagaccgccaaaaattcagcgaacaagtgttcaaggtggcctcatcggatctagtcaatatgggtatcagcgtggtgagctacacacttaaggacattcacgacgaccaggattacttgcatagcctcggcaaggcgagaacggctcaagtgcagaaggacgcccgaatcggcgaggcagaggccaagcgcgacgcggggattagggaagctaaggctaagcaggagaaggtgtccgcacagtatctaagcgagatcgagatggcaaaagcccagagagactatgagcttaagaaggctgcatacgacattgaagtaaatactaggcgggcgcaggctgatctggcctaccagctccaggtggccaaaacaaagcaacagatcgaagaacagcgtgttcaggtgcaggtggtcgagcgcgctcagcaagtggcggtgcaggaacaagagatcgcaagacgagagaaagagcttgaagcacgggtccggaaaccggccgaggcggaacggtataagcttgagagacttgcggaagctgaatag

SEQ ID NO: 117224 - DNA, 579 bp, Artificial Sequence
  Description of Artificial Sequence: Synthetic coding sequence
atgttcttcacctgcggaccaaacgaggccatggtggtctccggcttctgccggtctccgcccgtgatggttgcaggggggcgcgtcttcgtcctcccatgcattcagcagatacagcgaataagcctgaataccctcaccctgaatgtgaagtccgagaaagtgaagatccagggtcaaaacaaggaaatgcttgccgctgcctgtcagatgtttctgggcaaaaccgaggctgagatagctcacattgccctggagactctggaagggcaccagcgtgctatcatggcgcatatgaccgtcgaggagatctacaaggaccgccagaagttctccgaacaggtcttcaaagtggcatccagtgatctcgttaacatgggaatcagtgtggtgagctatactttaaaagacattcacgacgaccaggattatcttcactctctcgggaaggccagaactgcgcaggtacagaaggacgccagaatcggagaggccgaagcaaagcgtgacgcggggatacgtgaggcaaaggcaaagcaggaaaaagttagtgcacagtacctcagtgaaatcgagtag

SEQ ID NO: 117225 - DNA, 579 bp, Artificial Sequence
  Description of Artificial Sequence: Synthetic coding sequence
atgttctttacatgcgggcctaacgaggctatggtggtcagcgggttctgtagatcaccaccggttatggtagcaggaggtcgcgtctttgtgctgccttgtattcagcagatccagcgaatttctctcaacactcttactctgaacgtgaagtcagaaaaagttaagatccagggacagaacaaagaaatgctcgccgccgcatgccagatgtttctggggaagactgaagccgaaattgctcacattgccctggaaaccctcgaagggcatcagagggctatcatggcccatatgactgttgaggagatctacaaagatagacagaaattttcagagcaggtctttaaggtcgcctcctcagatctcgtaaatatggggatctctgttgtcagctacacactgaaggatatccacgatgaccaggattacctccattcacttgggaaggcaaggactgcccaagtccaaaaagatgcccgaattggggaggctgaagccaagcgagatgcaggcatcagggaagccaaggccaagcaggagaaggtgagcgcacagtatttatctgagatagagtag

SEQ ID NO: 117226 - DNA, 438 bp, Artificial Sequence
  Description of Artificial Sequence: Synthetic coding sequence
atgggcgtagaggggaccggcaggggtggctgcaggctaggtggcccggacggcaaagggaaaggttgggcaccggtcgatgcaaccgctagactcccccatccacagcgactgtctctgccattgctgcagcttcagccagagccctgtttcagcctcgtggcccagatgcggccctggtggagcccagactacctgcacagtctcgggaaggctcggactgctcaggtgcagaaggacgcgagaattggcgaggcagaggctaaacgggatgccggaattcgggaggccaaggcaaaacaggagaaggtgtccgcacagtacctgtcagaaatcgagatggcaaaggctcagcgtgattatgaattaaagaaagcagcctacgatattgaagtgaataccagaagggcccaggctgatctggcttatcaactgtag

SEQ ID NO: 117227 - DNA, 273 bp, Artificial Sequence
  Description of Artificial Sequence: Synthetic coding sequence
taggccaagaaagccgaagcctttcagttataccaggaagcggcccaactcgacatgctgctggaaaagcttcctcaggtggcagaggaaatttccggtcccttgaccagtgcaaacaagattaccctcgtgagttcagggtctgggactatgggagcagcaaaggtcactggtgaagtgctggatatcctaacaagactgcccgaatcagtcgagagattaactggagtgagtatcagccaggtaaatcataaaccgctgcgaaccgcctag

SEQ ID NO: 117228 - DNA, 708 bp, Artificial Sequence
  Description of Artificial Sequence: Synthetic coding sequence
atgttcttcacttgtggtcccaacgaagcaatggttgtgtccggtttttgccggtccccccccgtaatggtcgctggaggcagagtattcgtgctgccttgcatccagcagatccagcgcatcagtttgaatactctgacactgaatgtgaagtcagagaaggtgtataccagacacggtgtaccgatttctgtcacaggcatagcccaggtgaaaatccagggacagaataaggaaatgttagcggccgcatgccagatgttcttgggaaagaccgaagcagaaattgcccatattgctctggagactctggagggtcaccagcgcgctataatggcccatatgacagtggaggaaatttataaggaccgccagaaattttctgagcaggtgtttaaagtggctagcagcgacctggtgaatatgggcatatctgtggtatcctacacattgaaggacatccatgatgatcaagactacttgcactccctgggcaaggctcggactgcacaggtgcagaaagatgcacgcatcggcgaagcagaggcaaaaagagacgccgggatcagagaggcaaaagcgaaacaggaaaaagtttccgcacaatacctgagcgaaatagagatggccaaagcacaaagggattatgagttgaaaaaagccgcgtatgacattgaggtgaatactagaagggcccaagctgactag

SEQ ID NO: 117229 - DNA, 717 bp, Artificial Sequence
  Description of Artificial Sequence: Synthetic coding sequence
atgcgaccatggtggtcacctgtcaagatccaagggcaaaataaagagatgcttgccgccgcctgtcaaatgtttctcggtaaaacagaggccgagatagcgcacatagctctggagacacttgagggccaccagcgcgccatcatggcgcacatgaccgtggaggagatttacaaagataggcagaaattcagcgagcaggtgtttaaagtggctagcagtgatctcgtcaacatgggcatctctgtggtatcgtatacactcaaggatattcacgatgatcaggactacctgcacagtctgggaaaggcaaggactgcacaggttcagaaggatgcaagaattggagaggcagaggccaagcgcgatgctgggattcgggaagctaaggctaagcaggaaaaggttagtgctcagtacttatccgagatcgaaatggcaaaagctcagcgcgactacgagctcaaaaaggccgcctacgacatcgaagttaacacccgccgggcccaggccgacctggcttatcaacttcaggtcgccaaaactaagcagcagattgaggagcaacgcgttcaggtccaggtcgtggagcgggcacagcaagtagccgtccaggagcaagaaattgcgcgccgggagaaggagctcgaagctagggtgcggaagcccgctgaggccgagcgctataaactggagaggttggccgaggccgaatag

SEQ ID NO: 117230 - DNA, 417 bp, Artificial Sequence
  Description of Artificial Sequence: Synthetic coding sequence
gtgaaaatccagggacagaacaaggaaatgctagcggcagcctgccagatgtttttgggtaagaccgaagctgaaatagcacatattgcactggaaaccctagaagggcaccagcgcgctattatggctcacatgacggtggaagagatttataaagacagacaaaagttttcagaacaagtttttaaggtggcctcgagtgaccttgtgaatatgggcatcagcgtcgttagctacactctgaaggatattcatgatgaccaggattatctgcattctctgggcaaggctagaacagcccaggtccagaaagacgcacggatcggtgaggccgaggccaagagggatgcaggcattcgagaggctaaagctaagcaagaaaaggtctcggcccagtaccttagtgagattgaatag

SEQ ID NO: 117231 - DNA, 558 bp, Artificial Sequence
  Description of Artificial Sequence: Synthetic coding sequence
atgttctttacctgcgggcccaatgaggccatggtggtgagcggattctgtcgcagcccacccgtgatggtggctggaggtagagtgttcgtcctcccgtgcatacagcagatccagcgaatttcactgaatacgttgacactgaacgtgaagtccgagaaggtgtacacacgacacggcgttcctatctcagtaactgggattgcccaagtcaagatccagggccagaacaaggaaatgctggccgcggcatgtcaaatgttcctgggaaaaacagaagctgagatcgcccacattgctctcgagacactggagggacaccagcgggccataatggcacacatgactgtggaggagatttacaaggataggcagaaatttagtgaacaggtattcaaagtcgcgagcagcgatctggtgaacatgggaatctccgtggtctcgtatacgctgaaggatattcatgacgaccaggactatcttcacagccttgggaaagcacgtactgcgcaagtgcagaaggatgcacgaattggggaagctgaagccaagcggtag

SEQ ID NO: 117232 - DNA, 348 bp, Artificial Sequence
  Description of Artificial Sequence: Synthetic coding sequence
atgggagtggaagggacaggacggggcggctgtaggctcggaggcccagatgggaagggtaaagggtgggcaccagtcgatgcaaccgcccgacttccccatccccaacgtcttagcctgcccctgttacagttgcagcccgagccctgcttcagcctggtggcccagatgcgaccgtggtggtcccctgattatttacacagtctgggtaaggctcgaacagcccaggttcagaaggatgcacgaatcggcgaggcagaagccaagagggatgctggtatccgcgaggcaaaggctaaacaggaaaaggtgtccgctcagtatctctccgagatcgagatggcatag

SEQ ID NO: 117233 - DNA, 561 bp, Artificial Sequence
  Description of Artificial Sequence: Synthetic coding sequence
gtggctaagactaagcaacagattgaggaacagagagtgcaagtccaggtcgtcgaacgtgctcagcaggtggccgtccaggagcaagaaattgccagaagggagaaagaactagaggcccgcgtgcgtaaacctgccgaagcggaacggtataagctggagcgcctcgcggaggcggagaaatctcagctgattatgcaggcagaagcagaggcggctagcgtgcgaatgagaggagaagctgaagctttcgctatcggggcccgcgcaagagccgaggcagagcagatggcaaagaaggccgaggcttttcagctttaccaagaagcggctcagctggacatgctgctggagaaacttccacaagtcgccgaagaaatcagtggcccacttacctctgcgaacaagatcacgttggtgagtagcgggtcaggaaccatgggtgccgccaaagttaccggtgaggttctggatatccttaccagactgccagagagcgtcgagcgattgaccggtgtgtctatttcacaggtcaaccacaaaccattacgcaccgcatag

SEQ ID NO: 117234 - DNA, 438 bp, Artificial Sequence
  Description of Artificial Sequence: Synthetic coding sequence
atgggagtggagggaaccgggcggggtggttgcaggctggggggacccgatggcaagggcaagggctgggcgcccgtggacgctactgctcgtctgccccatccacagaggctgtccctgcccctcttacagctgcagcctgaaccctgctttagtctggtcgcccagatgagaccctggtggagccctgactacctgcacagtctgggcaaggctcggactgcgcaggtccaaaaagacgccagaatcggcgaggccgaggcgaagagggacgcgggaattcgcgaggccaaagccaaacaggagaaagtcagcgcacagtatctgtccgagattgagatggccaaggctcaacgagactatgagctaaagaaagctgcttacgatatagaagtcaatactagaagagctcaagctgacctcgcttatcagctttag

SEQ ID NO: 117235 - DNA, 558 bp, Artificial Sequence
  Description of Artificial Sequence: Synthetic coding sequence
atgttcttcacatgcgggcccaatgaggcaatggtagtgagtggcttttgtcgctctcctcccgtcatggttgcaggaggacgggtctttgtgcttccttgcatccagcagattcaaagaatttctctgaataccctgaccctgaacgtgaagtctgaaaaagtatacacccggcacggcgtccccatatccgtcaccggcatcgcccaggtgaagatccaaggacagaacaaggagatgctagcagctgcatgtcagatgttcctgggtaagacagaggcagaaatagcgcatatcgcacttgaaactctggaaggccaccagcgggctatcatggctcatatgactgtggaggaaatatataaggatcggcaaaagttttccgaacaggtcttcaaggttgccagctccgatctagttaatatgggtatttcggtagtaagttacaccctaaaggatatccacgatgaccaggactacctgcacagcctgggcaaggccagaacggcgcaggtccagaaggatgcaaggatcggagaggctgaggccaagcgatag

SEQ ID NO: 117236 - DNA, 633 bp, Artificial Sequence
  Description of Artificial Sequence: Synthetic coding sequence
atgttctttacctgcgggcctaacgaggccatggtcgtgagtgggttctgccgctcaccccctgtcatggtggcggggggtcgcgtctttgtgctgccctgcattcaacagatccagagaatttcactgaacactttaacgctaaatgtcaagagtgaaaaggtgtacacccgacatggagtgcccatatcagtcaccggcatcgcccaagtgaaaattcaggggcagaataaggaaatgttggcggcggcatgccaaatgtttttaggcaagacagaagcagaaatcgcccatatcgccctcgagacacttgaaggtcaccaacgcgctataatggcccatatgaccgtcgaggagatatacaaagaccgccagaagtttagtgagcaggtgtttaaagtggcgtcctctgatcttgtgaacatgggaatctctgttgtaagctacacactgaaagacatacatgatgatcaggactatctccactctctcggcaaagcgcgtacggcacaggtgcagaaagatgctagaattggggaagctgaggccaagcgggatgcaggaattcgggaggcaaaagctaagcaggagaaggtcagcgcccagtatctgagcgaaatcgaaatggcctag

SEQ ID NO: 117237 - DNA, 633 bp, Artificial Sequence
  Description of Artificial Sequence: Synthetic coding sequence
atgtttttcacttgtggccctaacgaggcaatggtggttagcgggttctgccgctcccccccagttatggtggctgggggacgcgtgtttgtactcccttgcatccagcagattcagagaatctccctcaacacacttacgctcaacgttaagagcgagaaagtttacaccagacacggtgtacctatcagtgttacaggaatagcccaggtaaagatccaaggtcaaaacaaagaaatgctcgcagccgcatgtcaaatgttcctgggcaaaactgaggcagagatcgcccatattgcactggagactctggaggggcaccaacgagcgataatggcacatatgacagtggaagaaatttacaaggataggcaaaagttttctgaacaggtttttaaggttgctagctccgacctggtgaatatgggaatcagtgtggtgtcatatacactcaaagatattcacgacgaccaggattacttacactcgcttggcaaggccagaacagcccaggtccagaaagacgcacggatcggggaagccgaagccaaacgggatgctggtataagggaagcgaaagccaaacaagaaaaggtgagtgcccagtatctctccgaaatcgagatggcatag

SEQ ID NO: 117238 - DNA, 759 bp, Artificial Sequence
  Description of Artificial Sequence: Synthetic coding sequence
atgttcttcacttgcggacctaatgaagccatggtcgtttccggcttctgccggtccccacccgtgatggtagccggcggacgggtgttcgtactcccttgtattcagcagattcaacggatttccttgaacactcttactcttaacgttaagtcagaaaaggtttataccagacacggcgtgcccatctctgtgacaggcatcgcccaagtcaagatccaaggccaaaacaaggaaatgcttgctgctgcttgccagatgttcctcggtaaaaccgaagctgaaattgctcatatagctttagaaacccttgaaggtcatcaaagagctattatggcgcatatgaccgtggaggagatctataaggatagacagaaattttccgagcaagtcttcaaggtcgcgagctccgacttagtgaacatgggcatttccgtggtgagctacaccttgaaggacatccatgatgatcaggattatctgcattccctggggaaggcccggactgcgcaggtgcagaaggacgcccgaataggcgaggccgaggctaagcgggatgctggcatcagagaggcaaaagccaagcaggagaaagtgtccgcccaatatctttcagagattgaaatggccaaagctcaaagggactacgagctgaagaaggccgcttacgatatcgaagttaatacacgcagagcccaggctgatctggcttatcagctgcaggtagccaagacaaagcaacaaattgaggagcagtag

SEQ ID NO: 117239 - DNA, 444 bp, Artificial Sequence
  Description of Artificial Sequence: Synthetic coding sequence
atgcgcccctggtggagtccagtgaaaatacagggccagaacaaagagatgctagccgccgcatgccaaatgtttctaggaaagaccgaggccgagattgcccacattgccttggaaacactggaggggcaccaaagagctataatggctcacatgactgtggaggagatctataaggaccggcagaaattcagtgagcaggtgtttaaggtggcgtcgtcagatcttgtcaacatgggcatcagcgttgtcagttacacgctaaaggacatccacgacgaccaggactatctgcactctttgggtaaggctcgcactgcccaggtgcagaaagacgcacgcatcggcgaagcggaagctaaaagggacgcagggattagggaggcaaaggcaaagcaggagaaggtatcagcccagtaccttagcgaaattgagatggcttag

SEQ ID NO: 117240 - DNA, 549 bp, Artificial Sequence
  Description of Artificial Sequence: Synthetic coding sequence
gttaagattcagggccagaacaaagagatgctggcagctgcctgtcagatgttcctcggcaagaccgaagcagaaattgcccacatagcgctggaaacacttgaagggcaccagcgtgcgatcatggcacatatgactgtcgaggagatctacaaagatagacagaaattttctgagcaggttttcaaggtggcatcgagcgatctggtgaacatggggatctctgtggtttcatatacacttaaggacattcacgatgatcaggactatctgcatagcctgggaaaggcccggactgcccaggtgcagaaggatgccagaattggagaggcagaagccaagcgcgacgcaggcatccgagaggccaaagctaagcaggagaaagtgtcagcgcaatatttgtccgagatcgaaatggctaaagcccagagagactacgagctgaagaaagccgcctatgatatagaagtgaacacccggcgcgctcaggctgacctagcttatcagttacaggtcgccaaaacgaagcagcagatcgaggaacagtag

SEQ ID NO: 117241 - DNA, 348 bp, Artificial Sequence
  Description of Artificial Sequence: Synthetic coding sequence
gtgaaaattcagggacagaacaaggagatgctcgcagccgcgtgtcaaatgttcctgggtaagactgaggcagaaattgctcatattgctctcgaaacactagagggtcaccagagagctattatggctcacatgaccgtcgaggagatttacaaagataggcagaagtttagtgagcaggtcttcaaggtggcctcttcggatctggtgaacatggggatctcagtggtttcttacacactgaaagacatccacgatgaccaggattacttgcactcactggggaaagcacgcactgcccaagtgcagaaagacgcgcgtatcggggaggccgaagctaaaagatag

SEQ ID NO: 117242 - DNA, 708 bp, Artificial Sequence
  Description of Artificial Sequence: Synthetic coding sequence
atgttcttcacatgtgggcctaacgaggccatggttgtctccggattttgtaggtccccacctgtaatggtggccggagggcgcgtgtttgttctcccatgcattcaacagatccaaagaatatcactgaacacattgactttgaatgtgaaatccgaaaaagtttacactcgtcacggagtccccattagcgtgaccggcatcgcacaagtcaagattcaaggtcagaataaagagatgctggcagctgcctgccagatgtttctgggcaaaacagaagctgagatcgctcatatagcactggaaacattagaaggacaccagagagctattatggcccacatgacagtcgaggagatctacaaggataggcaaaaatttagcgaacaggtattcaaggttgcgtctagtgacttggttaatatgggcatttccgttgtgagctatacgctcaaagacatacatgatgatcaagactacttgcactctttgggcaaggctagaactgctcaggtgcaaaaggatgctaggatcggcgaggccgaagcgaaaagggatgccggaattagggaggccaaggcaaagcaagagaaggtgagtgctcagtacctttcagaaattgagatggcgaaagcccagcgggactacgaacttaagaaagccgcatatgacatcgaggtcaatactcgccgggcccaggcagactag

SEQ ID NO: 117243 - DNA, 1284 bp, Artificial Sequence
  Description of Artificial Sequence: Synthetic coding sequence
atgttctttacatgtggaccaaatgaagcgatggtggtcagtggattctgtcgcagcccccccgtgatggttgccggtggcagagtatttgtgctgccctgtattcagcagatacagagaatcagcctcaacactctgacgctcaacgtgaagagcgagaaggtgtacactcgtcacggggtaccgatcagcgtaacaggcattgcccaggtgaaaattcagggtcagaataaagagatgctagctgccgcctgtcagatgtttttgggcaagactgaagctgagatcgcccacatcgcactggaaactctggaagggcaccagcgggctataatggctcatatgactgtggaagagatctacaaagaccggcagaagttctccgaacaggtgtttaaggttgctagctctgacctcgtcaacatgggcatatctgtcgtttcctacacactcaaagacatacatgacgatcaagactatcttcattcacttggcaaggcgagaacagctcaggtgcagaaagatgctaggattggtgaagcagaggcaaagcgagacgcgggtattcgggaagctaaagccaaacaggaaaaagtgtccgcccaatacctgtcagaaatcgagatggcaaaggctcagagggactacgaacttaaaaaggccgcctacgacatagaggtgaatacacgacgtgcgcaagcagacttggcgtaccaactccaggtcgccaagaccaagcagcaaatcgaagagcagagagtgcaagtccaggtcgttgaacgcgcccaacaggtggctgtgcaggaacaggagatcgccaggcgggaaaaagagcttgaagcacgggtccgtaagccggctgaggcagaaaggtacaagctggagcggctggccgaagccgagaagtctcagctgattatgcaagctgaagccgaggctgcgtctgtgagaatgcggggcgaggctgaggccttcgcaattggagctagggccagggcagaagccgagcaaatggcaaagaaagccgaagcattccagttataccaggaggccgctcagttagatatgctcttggaaaagctgccccaagtggctgaggagatttctggccccttaacgtcagctaataaaatcacacttgtttccagcggtagcggcactatgggagctgcgaaagtcacaggggaagtcctggacattttgacgaggctccctgagtccgtcgaacgcctaactggcgtgagtatttcacaggttaatcataaaccgctaagaaccgcctag

SEQ ID NO: 117244 - DNA, 498 bp, Artificial Sequence
  Description of Artificial Sequence: Synthetic coding sequence
gtcaagatccaaggccagaataaagaaatgttggctgcagcctgccagatgtttcttggcaagacagaggcagagattgcccacatcgccttggaaacactggagggccaccagagggctattatggcccatatgacagttgaggaaatctataaagaccgccagaaattctccgaacaggtatttaaagttgcatcaagtgatctcgtgaacatgggcattagcgtggtgtcctacaccctgaaggatattcatgacgaccaagactacctgcacagcctaggtaaagcccgtactgcgcaagtccaaaaggatgccaggatcggcgaagccgaagccaagcgggatgccggcatccgcgaagctaaggctaagcaggaaaaagtcagcgcccaatacctgagcgagatagaaatggccaaggctcagagggactacgaattgaaaaaggccgcctacgacatcgaagtgaatactcgtcgagcccaggccgactag

SEQ ID NO: 117245 - DNA, 438 bp, Artificial Sequence
  Description of Artificial Sequence: Synthetic coding sequence
atgggggtagaggggaccggccgcggaggctgcagacttggaggccccgatgggaagggcaaaggttgggcacctgtggacgctactgctcgactcccccaccctcagcggctgtccctccccttgttgcagctacagcctgagccatgtttttcactcgttgcgcaaatgcgtccttggtggtcccccgattacctgcacagtctcggcaaggcaagaacagcacaagttcaaaaggacgcacgcatcggtgaagcagaggcaaaaagagacgcaggcatcagggaagctaaagcaaaacaagaaaaagtctctgcgcagtacctaagcgagatcgaaatggctaaggcccagagagactacgagctgaaaaaggctgcctacgacatcgaggtgaatactcgccgagcccaggccgatctagcatatcagctgtag

SEQ ID NO: 117246 - DNA, 759 bp, Artificial Sequence
  Description of Artificial Sequence: Synthetic coding sequence
atgtttttcacctgcggccctaacgaagccatggttgtgagcggcttttgtagatccccacccgttatggtggccggaggccgggtgtttgtcctgccatgtattcagcaaatccaaagaatatctctcaacacccttacccttaatgtgaagtcggagaaagtttacacacggcatggcgtgccaatctccgttacaggtattgctcaagtcaagattcagggtcagaataaagaaatgctggcggcagcctgccagatgttccttgggaagaccgaggccgagatcgctcatattgcgctcgagacgctggagggacaccaacgcgctattatggcacacatgactgttgaggaaatttacaaagaccgtcagaaattttctgaacaagtgttcaaagtggcctcctctgacctggtgaatatgggaatttcagtggtcagctatacccttaaggacatccatgacgaccaggactatctacactctttgggcaaagcaaggaccgcccaggtgcaaaaggatgcccggatcggagaggcggaagcaaagcgagacgccgggatccgggaggcaaaggcaaaacaggagaaggtgagcgcccagtacctcagtgagattgagatggctaaagcccaacgcgactacgaacttaaaaaggctgcctacgatatcgaggtgaatacaagaagggcacaagccgacctggcctaccagctacaggtagccaaaaccaagcagcaaattgaggagcaatag

SEQ ID NO: 117247 - DNA, 759 bp, Artificial Sequence
  Description of Artificial Sequence: Synthetic coding sequence
atgttctttacctgtgggccgaatgaagcaatggtcgtgagtggattctgccggtctccacctgtgatggtcgcgggaggtcgagtattcgtgctgccctgtattcagcaaattcagaggatatcattgaatactttaacactcaacgtcaagtctgaaaaggtctacacacggcatggcgtaccgatttctgtgacaggaatcgcccaagtcaaaatacaggggcagaacaaagagatgctcgccgccgcctgtcagatgtttcttggcaaaaccgaagcggagatagcgcatattgcccttgagacactggaaggccaccaacgtgctatcatggctcacatgaccgtggaagagatctacaaggataggcagaagttctcggagcaggttttcaaggtggcatccagtgatcttgtgaacatggggatcagtgtggtttcatacacactcaaggatatccacgacgaccaagactatctgcactcactgggaaaggcccgcacagcccaggtgcagaaggacgccagaatcggagaggctgaagccaaaagagatgctgggatccgcgaggccaaagctaagcaggaaaaagtcagcgcacagtatctgtccgagattgagatggccaaggctcaacgggactacgaactcaagaaggcggcgtatgatattgaggtgaacacacgccgggcacaggccgatctggcttaccagttacaggtggccaaaaccaagcagcaaatagaggagcagtag

SEQ ID NO: 117248 - DNA, 249 bp, Artificial Sequence
  Description of Artificial Sequence: Synthetic coding sequence
gactacttacattcactgggaaaggccaggacagctcaagtccaaaaggacgccaggatcggtgaggccgaggctaaacgagacgcgggcataagggaagcgaaggccaaacaggaaaaagtgagcgcccagtacttatctgagatcgagatggccaaagcacagagggactatgagctgaagaaggcggcatatgacatcgaggttaacacaaggcgggcccaggctgatctggcataccagctgtag

SEQ ID NO: 117249 - DNA, 558 bp, Artificial Sequence
  Description of Artificial Sequence: Synthetic coding sequence
atgtttttcacgtgtggacccaacgaagccatggtagtcagcggtttctgtcgcagtccccccgtaatggtggctggaggcagggtctttgttcttccctgcattcagcagattcagagaatttcccttaatacacttacacttaatgtgaaaagcgaaaaggtgtacacaaggcatggtgttccaatcagtgttaccggaattgcgcaggtgaagattcagggtcagaacaaggagatgttggcagctgcctgccaaatgtttctaggaaagactgaggctgagattgcacacatcgctcttgagactctggaaggacaccagcgggcgatcatggctcatatgactgtggaagaaatttacaaggatcgccagaagttctcagagcaggtgtttaaggtggcatccagcgacctcgtcaacatgggaatatccgtggtaagttacaccctaaaagatattcatgatgatcaggactatctgcacagtctgggcaaagcaaggacagcccaggtccaaaaagacgccaggatcggagaagccgaggcaaagaggtag

SEQ ID NO: 117250 - DNA, 759 bp, Artificial Sequence
  Description of Artificial Sequence: Synthetic coding sequence
atgttctttacgtgtggtcctaatgaagccatggtcgtgagcggcttttgcaggagccctccggtcatggtagcaggaggccgcgtcttcgttcttccctgcattcagcagattcagcgtatctcacttaacacattaacattgaacgtcaagagcgagaaggtgtacaccaggcacggcgttcctatttccgtgactggcatcgcccaggtgaagatccagggacagaataaagaaatgctggccgctgcttgtcaaatgtttctcggcaagacagaagccgagatcgctcacatcgctctggaaactctcgaagggcatcagagagccataatggcccatatgacagtggaggagatctacaaggaccgccagaagttcagcgaacaagtatttaaagtggcctcctcagacttagtgaatatgggcatttctgtggtaagttacacactcaaagatatccacgacgaccaggattacttacattctctcggcaaggcgcggactgcccaagtgcaaaaggacgccaggattggggaagccgaagccaagagagatgctggaatcagggaagcaaaggccaagcaggaaaaggtatctgcacagtacctgagcgagattgagatggctaaagcccagagggactacgagttgaaaaaggcggcctatgatatagaagttaatacacgccgggcccaggccgatcttgcatatcagctccaggttgctaaaacaaagcagcagatcgaagagcaatag

SEQ ID NO: 117251 - DNA, 558 bp, Artificial Sequence
  Description of Artificial Sequence: Synthetic coding sequence
atgttttttacatgcgggcccaacgaggccatggtggtaagtggtttctgccgcagcccccccgtcatggtggctggcggcagggtgtttgtgctgccctgcattcaacagattcagcgaattagtcttaacacactgaccctgaatgtgaagtctgagaaggtgtatactcggcacggcgtccccataagtgttacgggcatcgcgcaggttaagatccaagggcagaacaaagaaatgttagccgctgcctgccagatgttcctgggcaagaccgaagccgaaattgcacatatagctctggagacactggaaggacaccagcgcgccattatggcccacatgaccgtcgaggaaatttacaaggacagacagaagttttctgagcaagtgttcaaggtcgcctcctcggatctggtgaatatggggatttctgtggtgtcatacacgctcaaggatatccacgatgaccaggattaccttcattctttaggaaaggccagaactgctcaagtccagaaggatgccagaatcggcgaggcggaagcgaaacgttag

SEQ ID NO: 117252 - DNA, 717 bp, Artificial Sequence
  Description of Artificial Sequence: Synthetic coding sequence
atgcggccatggtggtcacccgttaagattcagggccagaacaaggaaatgctggcggcggcatgccagatgttcctcggtaagacagaagcagaaatcgctcacattgccctagaaacactggaaggtcatcaacgcgccatcatggcgcatatgacagttgaggagatttataaagatcgtcaaaagtttagtgagcaggttttcaaggtcgcatcctccgacttagtgaacatgggcatctctgtggtgtcttacacactcaaggacattcacgatgaccaagactacctccactcactgggcaaggcaagaacagctcaggttcagaaggatgccagaattggcgaagccgaagcaaagagagacgcgggaatccgggaggcaaaggcaaaacaagaaaaggtctcagcacagtatctgtcggagattgaaatggctaaagcgcaacgggactacgagcttaagaaagccgcgtacgatatcgaggtgaacactcggcgcgcacaggcagatctggcctatcagcttcaggttgcgaaaaccaaacagcagatcgaagagcagcgggtgcaggtgcaagtagtagagcgcgctcaacaagtggcagttcaggagcaagaaatagcgcgacgggagaaggaactggaggctcgtgtgcggaagcctgcagaagccgagcgatacaagctggagagattggccgaagccgaatag

SEQ ID NO: 117253 - DNA, 1284 bp, Artificial Sequence
  Description of Artificial Sequence: Synthetic coding sequence
atgttcttcacgtgtggcccaaatgaggccatggttgtgagtggattttgcagatcccctcctgtgatggttgccggcggtagagtgttcgttctcccatgcattcaacagatccaaaggatttctctcaacacattgaccctgaatgtgaaatctgagaaggtctatactcgccatggggttcccatctctgtcaccgggatagctcaggtgaaaatacagggacagaacaaagaaatgctggccgctgcctgtcaaatgttcttgggaaagacagaggctgagattgctcacattgcgctcgagacactggaaggacaccagagagctattatggcccatatgacagtggaagaaatatacaaggataggcaaaagttctctgagcaagtgttcaaggtggcaagctcagatcttgtgaatatgggaatcagcgtggtgtcatatacgcttaaagacatccatgatgatcaagactatctgcacagtttagggaaggcgcgaaccgcccaggtccaaaaggatgctcgtatcggggaggccgaagctaaaagggacgcaggtattcgggaagctaaggcaaaacaggagaaagtgagcgcccagtatcttagtgaaatagagatggccaaggcacagcgagattatgagctgaagaaggcagcatacgatatcgaagttaacacacggcgggcacaagccgaccttgcataccagctccaggtcgcgaagaccaaacagcagattgaggaacagcgcgtgcaagtgcaggtagtcgagagagcccagcaggtagctgtgcaggaacaggagattgccaggcgggagaaagaactggaggcgcgagtcagaaagcccgccgaggcagagagatataaactggaaaggctggccgaagcggagaagagtcaactgataatgcaggccgaggctgaggcagcatcagtgcgtatgcgaggagaggctgaagcgtttgctataggggcacgcgcccgagcagaggctgagcagatggccaagaaagctgaagcttttcagctgtatcaggaggccgcccaactcgacatgctactggaaaagctcccgcaagtggcagaggaaatcagcggccccctcacctctgcgaataaaatcacactggtgagttccggatcaggcacaatgggcgcggcgaaggtcacaggagaggttctcgatatcctgacgcgcctgcctgagtccgtcgagcgcctcaccggagtctctatttcccaagtaaatcataaacccctgaggaccgcatag

SEQ ID NO: 117254 - DNA, 579 bp, Artificial Sequence
  Description of Artificial Sequence: Synthetic coding sequence
atgttcttcacctgcggccccaatgaagctatggtggtgtctggcttctgtcgttctcctcccgtcatggttgctggaggtcgcgtcttcgtgctgccttgcattcagcagattcagcgcatttctctgaacaccctcactctgaatgtcaaatcggaaaaagtcaaaatccagggacaaaataaagagatgctcgcagcggcttgtcagatgtttcttggcaagacagaggctgagatagctcatattgcccttgaaaccttggaagggcaccagcgggcgatcatggcgcacatgacggttgaagaaatatacaaagacaggcagaagttctctgaacaagttttcaaagtagccagcagtgacctggtaaatatggggatcagcgtggttagttatactctgaaagacatccatgacgaccaagactatctgcactccttaggtaaggctcgtactgcacaggtacaaaaggatgcccggattggcgaggccgaggccaagcgggacgccggaatcagagaggcaaaggccaaacaggaaaaggtaagcgcccagtatttgagtgagatcgaatag

SEQ ID NO: 117255 - DNA, 708 bp, Artificial Sequence
  Description of Artificial Sequence: Synthetic coding sequence
atgttcttcacctgcggccctaacgaggctatggtggtgtcaggattttgtcggtcgcctccagtcatggtggccggcggtagggtcttcgtcttgccatgtatccagcaaattcagcgcatttcacttaatacgctcacgttaaatgtgaaaagcgaaaaggtctacactcgccatggggtgcctatttccgttacagggatagctcaggtaaaaattcaaggacagaataaagaaatgctggcagccgcttgccaaatgttcttagggaagaccgaggcagagatcgcgcacatagctctggagaccctcgagggacaccagagagcgatcatggctcatatgaccgtcgaggagatttacaaagaccggcaaaagttctccgagcaggtcttcaaggtggcgagctccgacctcgtgaatatgggcatcagcgtggtgtcgtacacactgaaagacatacatgatgaccaggactacctgcactcactgggaaaagctcggacagcccaggtccagaaagacgcacggatcggtgaggccgaagctaagcgggatgcggggataagagaggctaaagctaagcaggaaaaggtgtctgcacagtacctgtctgagatcgagatggctaaggcccagagggactacgagctaaaaaaggccgcttatgatatagaggttaacactcgtagggcgcaagccgattag

SEQ ID NO: 117256 - DNA, 183 bp, Artificial Sequence
  Description of Artificial Sequence: Synthetic coding sequence
gtggctaagacaaagcagcaaatcgaagagcaaagagtgcaggttcaggtggtggaacgcgcccagcaggttgcggtccaagaacaggagatcgcccgcagagagaaggagctagaggcccgtgtgagaaagcctgccgaagccgagcgctataaacttgagaggcttgctgaggccgagtag

SEQ ID NO: 117257 - DNA, 717 bp, Artificial Sequence
  Description of Artificial Sequence: Synthetic coding sequence
atgagaccctggtggtcacctgtgaaaattcagggccagaacaaggaaatgcttgcagccgcttgtcaaatgttcctgggtaagactgaagcagagatcgctcacatcgctcttgagaccctcgagggccatcagcgagcaattatggctcatatgaccgtggaggagatatacaaggaccggcagaagttttccgagcaagtgttcaaagtggcatcaagtgatctcgtgaacatgggaataagcgtggtctcttacacactgaaggacatccacgacgaccaggattacctgcattcattggggaaagcccgtacggctcaagtccagaaagatgcccgcattggtgaagcagaggctaagagagatgccgggattcgcgaggcaaaagccaaacaagagaaggtctcggctcaatatctctcagaaatcgagatggccaaagctcagagagactacgagctcaaaaaagctgcatacgacatcgaggtgaatacccgcagggctcaggcggacctagcataccagctgcaggtagccaaaaccaagcagcagatcgaggagcaaagagtccaggttcaggtggtggaaagagcgcagcaagtggccgttcaagagcaagaaatcgctcggcgcgagaaagagctggaagccagggtgcggaaacccgctgaagctgaaaggtataaattggagagactggccgaagccgagtag

SEQ ID NO: 117258 - DNA, 708 bp, Artificial Sequence
  Description of Artificial Sequence: Synthetic coding sequence
atgttctttacatgcggccccaacgaggcaatggtagtgtccggcttctgcaggtccccccccgtaatggtggcagggggccgggtgtttgtcctgccctgtattcaacaaattcagcgcatctctctcaacacccttactctcaacgtgaagagcgagaaagtctatacgcggcacggcgtacccatttccgtgaccggtatagcgcaggtcaagatacaaggccagaacaaggagatgctcgcagccgcatgccagatgttcttgggtaaaactgaggccgagatcgcacatatcgcactcgagactcttgagggtcaccaaagagccattatggcgcatatgaccgtggaggaaatttacaaggatagacagaagttctctgagcaggtgttcaaagtcgccagctcggacctcgtgaatatgggcatcagcgttgtatcatatactctaaaagatattcatgacgatcaagactacctgcactccttagggaaggcccgcaccgcacaggtgcagaaggatgccaggatcggcgaggccgaggcaaaacgtgacgccggaatcagggaggctaaggccaagcaggaaaaagtgagtgctcagtacctgagcgaaattgaaatggccaaggcccagcgggactacgagctcaaaaaggcagcctacgatatcgaggttaacactaggcgcgcccaggccgactag

SEQ ID NO: 117259 - DNA, 1074 bp, Artificial Sequence
  Description of Artificial Sequence: Synthetic coding sequence
gtgaaaatccaaggccaaaataaagagatgctcgccgcagcgtgtcagatgtttctcggcaaaactgaggccgagattgcccacatcgccctggagactcttgaggggcaccaacgagcaatcatggcgcacatgacagtggaagagatttataaagaccgccagaaatttagcgagcaggttttcaaggtcgcaagttccgaccttgtaaacatgggaatatccgtagtctcgtataccctcaaagacatacatgacgaccaggactacctgcactcgctgggaaaggctaggactgcgcaggtgcagaaggacgcacgcataggtgaggcagaagccaagcgagacgcagggattagggaggctaaggccaaacaggaaaaggtgagcgcacagtacttatccgaaatagagatggccaaggcccagcgagactacgagcttaaaaaagccgcctatgacatagaagtaaacaccagacgagcccaggcagatctcgcctatcagctgcaagtggccaagaccaaacagcagatcgaggaacagagagtacaggtccaagtggtagaacgtgcccaacaggtggccgttcaggagcaggaaattgcccggagggagaaggaactggaggcccgggttcgaaaacccgccgaagccgagcgttacaagttagagaggctggcagaagcggagaagtcacaactaattatgcaggccgaagccgaagccgcctccgttagaatgaggggcgaggcagaagccttcgcgatcggagcacgcgcgcgagctgaggcagaacagatggcaaagaaggccgaagctttccaactgtaccaagaggcagcccagctcgacatgctccttgagaagcttccgcaggtggcagaagaaataagtggccccttgaccagcgccaacaagattacactggtgtcatccggaagtgggaccatgggggccgccaaagtcactggagaggttcttgatatcctgactcgcctgccggagtccgtggagagacttaccggagtctccatttcccaggtcaaccataagccactccgcacagcctag

SEQ ID NO: 117260 - DNA, 36 bp, Artificial Sequence
  Description of Artificial Sequence: Synthetic coding sequence
gtggccaagaccaagcagcagatagaggaacagtag

SEQ ID NO: 117261 - DNA, 759 bp, Artificial Sequence
  Description of Artificial Sequence: Synthetic coding sequence
atgtttttcacttgcggacctaacgaagcaatggttgtgtccggattttgcagatctcctccagtgatggtggctggtggccgagtgttcgtcctgccctgtattcagcagatacaaaggatcagcctgaatacgttgactttaaacgtgaagtcggagaaagtgtacacgcgtcacggcgtgcccattagtgtgacgggaatcgcacaggtaaagatacaggggcagaataaggagatgttggcagctgcttgccagatgttcctgggtaaaacagaagccgaaattgcacacattgccttagagacattggagggccaccagcgtgccataatggcacacatgacagtggaggagatatataaggacagacagaagttcagcgaacaggtttttaaagtggcttcatcagatctggtgaacatgggcatttcagtggtgtcatacactttgaaagacatccacgatgaccaggactatctccacagcctgggtaaagcgcgtacagctcaagttcagaaggacgcccgtataggcgaggccgaggccaaaagagacgccggtataagagaggcgaaagctaagcaggagaaggtctccgcgcagtacctctcagagatcgagatggctaaagcccagagagattatgaactgaagaaggctgcatacgacattgaggtgaacacaagaagggcccaggctgatctggcataccagcttcaagtcgcaaaaacaaaacagcagattgaagagcaatag

SEQ ID NO: 117262 - DNA, 708 bp, Artificial Sequence
  Description of Artificial Sequence: Synthetic coding sequence
atgttcttcacatgtggaccaaacgaagctatggttgtaagcggcttttgtcggtctcctcccgtgatggttgccggggggagagtatttgtgctgccatgcattcagcagatccagagaatttcgctcaatactctcacgcttaatgtcaagagcgaaaaagtctacacgaggcatggcgtgccaatctctgttacagggatcgcgcaagtcaaaatccaggggcagaacaaagagatgctagcggcggcctgccaaatgtttctggggaagaccgaggctgagatagctcatattgccttagagactctggagggacatcaaagggctattatggcccatatgacggtcgaggagatctacaaagatcgccaaaagttcagcgaacaggtcttcaaagtagcctcttcagatctggtgaacatggggatctctgttgtatcatacactttaaaagatatccacgatgatcaggactatcttcattctctaggaaaagccaggaccgcacaggtccaaaaagacgcacgtatcggggaagccgaagcaaagagagacgccggcatccgcgaagctaaggcgaaacaggaaaaagttagtgctcagtatctgagcgaaattgaaatggccaaggctcagcgagattatgagcttaaaaaggcagcatacgatatcgaagtaaatacacggagggcacaagctgactag

SEQ ID NO: 117263 - DNA, 558 bp, Artificial Sequence
  Description of Artificial Sequence: Synthetic coding sequence
atgttctttacttgcgggcccaatgaagcaatggtcgtgtccggcttctgccggtcaccaccagtcatggttgccggcggcagagtatttgtccttccatgcatccagcagatacaaagaatttcgctcaatactctgaccctgaatgtcaagagcgagaaggtttatacacgacatggcgtccctatctcagtaaccggaatagcccaagtgaagattcagggacagaacaaagagatgcttgcagcggcctgtcagatgttcctgggaaagaccgaggctgaaattgcgcatatcgctcttgaaacgttggaagggcaccagcgagccatcatggctcacatgacagtggaggagatctacaaggaccgacaaaaattttccgaacaagtattcaaagttgcttccagcgacctggtgaacatggggatcagcgtagtgtcttacacccttaaggatatccacgacgaccaggactatctacattctttggggaaggccaggactgcccaggtgcagaaagatgccagaatcggtgaagctgaggccaagagatag

SEQ ID NO: 117264 - DNA, 438 bp, Artificial Sequence
  Description of Artificial Sequence: Synthetic coding sequence
atgggcgtggaggggaccggcaggggcgggtgcagattgggaggacccgacggaaagggcaaagggtgggcccccgttgacgcaacagcccgtcttccccaccctcagcgactctccctgccattactgcaacttcagcccgagccgtgctttagcctggtggcccaaatgcgcccctggtggtcccccgattacctgcattcactcggcaaggcccggacagcccaggtccagaaagatgccaggattggggaagctgaggctaagcgggacgctggtatcagggaggccaaagcgaaacaggaaaaggtctctgcgcagtatctgagtgagattgagatggcaaaggcccaacgcgattacgagcttaagaaggctgcttatgacatagaggtaaatacccgtagggctcaagccgatttggcgtatcagctttag

SEQ ID NO: 117265 - DNA, 717 bp, Artificial Sequence
  Description of Artificial Sequence: Synthetic coding sequence
atgcggccctggtggtcgcccgtgaaaatccagggacaaaacaaggaaatgcttgcagccgcatgtcagatgttcctgggaaaaacagaggctgaaatagcccatatagccctagagactctcgaggggcaccagagggctataatggcacacatgaccgtcgaggaaatatataaggatcggcagaagttttcagagcaagtgttcaaagtcgcatcctcggacctcgtcaatatgggtatctccgtggtgtcgtacacactcaaagacattcacgatgatcaggactatctccactctttggggaaagcgcgcactgcccaggtccaaaaggacgcacgtattggcgaggctgaggccaaaagggacgctggaattcgtgaagctaaggctaagcaagagaaagtttcagctcagtatctgtcagaaattgaaatggcaaaagcccaaagggactacgaattgaaaaaggccgcctacgacatcgaagtcaatactcgaagagcccaggctgatctggcatatcaactgcaagttgctaaaacaaaacaacaaattgaggagcagcgtgtgcaggtccaggttgtagagagggcacagcaggtggccgtccaggaacaggagatcgcccggcgagaaaaggaactcgaagcgagggtgcgcaagcccgcagaagcagagaggtataagctggagcggttggcagaggcagagtag

SEQ ID NO: 117266 - DNA, 1140 bp, Artificial Sequence
  Description of Artificial Sequence: Synthetic coding sequence
atgttcttcacctgtggtcctaatgaagcaatggtagtgtccggattttgtaggagtccccctgtgatggtggccggcgggcgcgtgttcgttttaccatgcattcagcaaatccagcgaatttcactgaacaccctgaccttgaatgttaaatccgagaaagtgtataccaggcatggcgtgcccatcagcgttaccggcattgcacaggaaatatataaggacaggcagaagttctccgagcaggtgttcaaggtggcctctagtgacctggtgaacatgggcatctctgtggtatcttatactttaaaggatatccatgacgatcaagactatctgcattccttgggaaaggccaggactgctcaggtgcagaaggacgcaaggatcggcgaggccgaggcaaaacgggacgctggtattagagaggcaaaggctaagcaggagaaggtgtctgcccaatatctgagcgagatcgaaatggccaaagcccaaagggactacgagcttaaaaaggcagcttacgacatcgaagtgaacacccggcgagcccaagctgatctggcctatcagctccaagtggccaagaccaaacagcagattgaggaacagcgcgtccaagttcaagtcgtagagagggcgcagcaggtcgccgtacaggagcaggaaatcgctcgaagggagaaggagcttgaggcaagagttagaaagccagccgaggccgaacgctataaacttgagcgtctcgccgaggccgaaaagagtcagctaattatgcaggctgaggcggaggccgctagcgtgagaatgcggggggaggcggaggcgttcgcgatcggcgcacgcgccagagctgaagctgaacaaatggccaagaaagcagaagccttccagctgtaccaagaggctgctcagcttgacatgctgctggagaagctcccccaggtggccgaggaaatatcaggcccactgacatctgctaataaaattaccctggtgagctccggatccggaaccatgggcgctgcaaaggtgaccggagaagtactggatattctcactagattacccgaaagcgtcgagcgactgactggagtcagtattagtcaggttaaccataagccgctgcggaccgcctag

SEQ ID NO: 117267 - DNA, 558 bp, Artificial Sequence
  Description of Artificial Sequence: Synthetic coding sequence
atgttcttcacctgcggtcccaatgaggccatggtggtgagcggcttctgccgctccccccctgtgatggtcgctgggggtcgagtctttgtgttgccttgcattcagcagatacagcgtatctcattgaacaccctcacgcttaacgtcaaatctgagaaagtgtataccagacatggtgtcccaatttcagttacagggatcgctcaggtcaagattcaagggcagaataaggagatgttagccgccgcatgtcagatgttcttgggcaaaacagaggccgagatcgcccacatcgccctggagactctggaggggcaccagagggctattatggcccacatgactgtagaagaaatttacaaagaccgtcagaaatttagtgaacaggtgttcaaggtggcctcatctgacctcgtcaatatgggaataagcgtggtcagctacactctcaaagacattcatgacgatcaggattaccttcactctctcgggaaagcccggactgcccaggtccaaaaagacgcccgtatcggtgaagctgaagctaaaagatag

SEQ ID NO: 117268 - DNA, 696 bp, Artificial Sequence
  Description of Artificial Sequence: Synthetic coding sequence
gtaaagatccagggccagaataaagaaatgttggctgcagcctgtcaaatgtttttgggaaaaaccgaggccgaaatcgctcacatcgccctggagacactagagggtcaccaacgtgccataatggcccatatgactgtggaagaaatatacaaggacagacagaagttcagcgagcaggtttttaaggtggcctcgagcgacttggtcaacatgggtatatccgtcgtgagctacactcttaaggatatccacgacgatcaagattatctccacagtctaggtaaagcgaggaccgcacaggtgcagaaagatgcccggatcggagaggccgaggccaaaagggatgcaggaattcgagaagccaaagcaaagcaggaaaaggtgagtgcccagtatttaagcgagatagaaatggctaaagctcaaagagactatgagctgaaaaaggccgcatacgatattgaagtgaacacaaggcgcgcccaagccgacctagcttaccaactgcaggtggcaaagacgaagcagcagatcgaggagcaaagagtgcaggttcaggtggtcgaacgcgcccaacaggtggccgtgcaggaacaagagatcgctcgacgggagaaggaactggaagcacgtgttcgcaaacctgctgaggccgaacgctacaaactggaacgcctcgctgaggccgaatag

SEQ ID NO: 117269 - DNA, 633 bp, Artificial Sequence
  Description of Artificial Sequence: Synthetic coding sequence
atgttttttacctgtggacccaatgaggcaatggtcgtttccggtttttgtagatctccaccagttatggtcgctggtggacgagtattcgtgctgccttgtatccagcagattcagagaatttccctcaacactctgaccctgaacgtaaaatctgaaaaagtttacaccagacacggtgtccccatttccgtcactgggatcgctcaggtgaaaatccagggccagaataaggagatgttagccgccgcctgccagatgtttctgggtaaaactgaagccgagatcgcccatatcgccctggaaacactcgagggccaccaaagagcgatcatggctcatatgacggtcgaagagatttacaaagaccggcaaaaattctccgagcaggtgttcaaagtagcctctagcgatctggtgaacatggggatctccgtggtgtcgtatacgcttaaggacatccacgatgaccaggactatctacacagcctcggtaaggcacgcactgcacaggtacaaaaagacgctagaataggtgaagctgaggccaagagagatgctgggatcagagaggccaaggccaagcaggaaaaagtgtccgcccagtatctgagtgaaattgagatggcctag

SEQ ID NO: 117270 - DNA, 579 bp, Artificial Sequence
  Description of Artificial Sequence: Synthetic coding sequence
atgtttttcacatgcgggcctaacgaagcaatggtagtaagtggtttttgtaggtccccgcctgtgatggtggctggtgggagagtattcgtccttccatgcatccagcagatccaacgaattagcttaaatacactaaccttgaatgtgaagagcgagaaagttaagatccaagggcagaacaaggagatgctagcagccgcatgccagatgttcctgggcaagaccgaggcagaaatagcacacatcgccttggaaaccttagagggccatcagcgggcaatcatggctcatatgaccgtggaagagatctataaggatcgacaaaaattcagcgagcaggtgttcaaggtggctagttctgatttggtgaatatgggaatttcagtggtgtcttatactctcaaagacattcatgatgaccaggattacctgcatagtctgggaaaagcgcgaaccgcacaggttcagaaggacgccagaataggggaagcggaagcaaagcgcgacgcgggcattcgcgaagctaaggcaaaacaggagaaagtgtccgcgcagtacctgtccgagattgaatag

SEQ ID NO: 117271 - DNA, 1140 bp, Artificial Sequence
  Description of Artificial Sequence: Synthetic coding sequence
atgttctttacctgtggccccaatgaagccatggtggtctccgggttttgccggtcacctcctgtgatggtggcaggaggtcgcgtctttgtgctgccctgtatccagcaaatacagcggatctccctgaataccttaacactcaatgtcaaatctgagaaggtctatactcggcacggagttccgatttctgtcaccgggatcgcccaggagatatataaggatagacaaaagttctcagaacaagtgttcaaagtggcctcaagcgacttagtaaatatggggatatcggtggtgtcctatacactgaaagacatacatgatgatcaagactacttgcactctctcggtaaggcaaggacagcccaggtccagaaggacgctcggataggagaagctgaagcaaaacgcgacgctggaattcgtgaagctaaagcaaaacaggagaaggtttccgctcagtacctgtcagaaatcgagatggccaaggcacagagagactatgaactcaagaaagctgcatacgacatagaggttaacactaggcgagctcaggccgatcttgcttaccagctgcaggtcgccaaaaccaagcagcagattgaggaacagcgcgtgcaagtacaggtcgtagaaagagcccagcaggttgccgtccaggagcaggagattgcccggcgagaaaaggagcttgaagcccgggtgagaaaacccgccgaggctgagcggtataagttggagcgactggcggaagcagaaaaatctcagctgatcatgcaggctgaggccgaggctgcttctgtgcgcatgcgaggcgaagctgaggcctttgccatcggggccagggcccgggctgaggctgaacagatggcaaagaaagcagaggctttccagctgtatcaggaagcagcacagctggacatgctgttggaaaaactgccacaggtggcggaggaaattagcggacccctgactagcgctaataagattacactcgttagtagtggtagcggcacgatgggcgctgccaaggtgacgggggaagtgctggacattttaacacgactcccggaatcagtggaacgcttgacgggtgtgtccataagccaggtaaatcacaaaccgctgcgcactgcctag

SEQ ID NO: 117272 - DNA, 1140 bp, Artificial Sequence
  Description of Artificial Sequence: Synthetic coding sequence
atgtttttcacatgcggacctaatgaagcgatggtcgtgagtggcttctgccggtctccccctgtgatggtggccggcggacgtgtgttcgtcttaccctgtattcagcagattcagagaatatccttgaacacactgacactgaacgtgaagtctgaaaaggtgtatacccggcacggggtccctatctcggtaaccggtatagcccaggagatctacaaggatagacagaagttttctgagcaggtgttcaaggtggccagttcggatcttgtaaatatgggcatttctgtggtcagctacactctgaaggacatccatgatgatcaggactatttacatagcctcggcaaggcgcggacagcacaggtccagaaagatgcccggatcggcgaagccgaagctaaacgggacgccggtatccgcgaggctaaggcaaagcaggaaaaagtgagtgcgcagtatctgagcgagatcgaaatggcaaaagcccagagagattatgaactgaagaaagctgcgtatgatatagaagtcaacacccgaagagcacaagcagatttagcctaccagctccaagtagctaaaacgaagcagcagatcgaagagcagcgcgtccaggtccaagtcgtcgaaagggctcagcaagtcgctgtccaggaacaagagatcgcgagacgagagaaggagttggaagcaagggtacgaaagcccgccgaggcagaaaggtacaagctggagaggttggccgaggctgaaaaaagccagctgataatgcaggccgaggccgaagctgcaagcgtccgtatgcggggagaagccgaggccttcgctattggcgcacgcgccagagccgaagccgagcagatggcgaaaaaggcggaggcctttcagctgtaccaggaagcggcccagttggacatgttgctggagaaactgccccaggtagcagaagaaattagtgggccgcttaccagcgccaataagataacattagtgtcctctggatccggcaccatgggcgcagccaaggtgaccggcgaggttcttgacattctcacaagactgcccgagtcagtggagagactgacaggagttagcataagtcaggtgaatcataagccccttaggacggcttag

SEQ ID NO: 117273 - DNA, 1140 bp, Artificial Sequence
  Description of Artificial Sequence: Synthetic coding sequence
atgttctttacctgcgggcctaatgaagccatggtagtgtcaggcttctgtcggtcgcctcctgtgatggtggcaggggggagagtattcgtcttaccctgcattcagcagatacagagaatctcactgaacacacttacattgaatgtgaaatcagaaaaggtgtacacacgtcatggagtgcccatatccgtaaccggcatcgcacaggagatttataaggaccggcagaagttcagtgagcaggtctttaaggtagcctcatccgacctagtgaatatggggatcagcgtcgtcagctacacactcaaggatatacacgatgaccaagattaccttcacagcctggggaaggcccgtaccgctcaggtccaaaaggacgcacgaatcggagaggcggaggccaaacgggatgctggcatcagggaagccaaagccaaacaagagaaggttagcgctcagtatctcagtgaaattgaaatggccaaggcccagagagattacgagctcaagaaagcggcttacgatatcgaggtgaatacccgacgggcccaggcagacctggcctatcagctccaagtggctaagactaagcagcaaatcgaagagcaacgagttcaagttcaggtggttgagcgtgctcagcaggttgctgtgcaggaacaggaaatcgctaggcgggagaaagaattagaagcccgtgtgaggaagccggctgaagctgagcgatataaactggagcgccttgccgaagcagaaaagtcacaactaatcatgcaggcagaagccgaggccgcctccgtcaggatgcgtggtgaggctgaggctttcgctattggagcaagagccagggccgaggccgaacaaatggctaagaaagccgaggcattccagttataccaggaggcggcacagctggacatgttgcttgagaagctgccgcaggtcgccgaggagatcagcggtcctctaacaagtgccaataagattactctggtttcctctggaagtggtacaatgggtgctgcgaaagtgacaggcgaagtgctcgatatcctgaccaggttgccagagtccgttgaacgtctgaccggagtcagcatcagtcaggtcaatcacaagccactgcggacagcatag

SEQ ID NO: 117274 - DNA, 1140 bp, Artificial Sequence
  Description of Artificial Sequence: Synthetic coding sequence
atgttttttacatgtggccccaatgaggccatggttgtatcggggttttgccggagcccccctgtgatggtggccggtggtagggtgtttgtgctgccatgcattcagcaaatccagcgaatttccctcaatacgttgactcttaatgtgaagtcagagaaggtatatacacgtcatggcgtccctatatctgtgactgggatcgcacaggagatatacaaggacaggcagaaattttccgaacaggtgttcaaggtggcctctagcgatttggttaatatgggcattagcgtcgtgtcgtacactttgaaggacatccacgatgatcaagactacctgcactctttgggaaaggctcgtaccgcacaggtccaaaaggatgcacgcattggcgaagcggaggctaaacgcgacgcaggaattagggaggcaaaggcgaagcaggaaaaggtatccgctcaatacctgagcgagatcgagatggccaaagcccaacgggactacgaactgaaaaaggccgcttatgatatcgaagtgaacacaagacgggcacaagccgatctggcctatcagcttcaggtggcgaaaactaagcagcagatcgaggagcaacgcgtgcaggttcaggtcgtggagcgggctcagcaggtggcagttcaggagcaggaaatcgcccggagggagaaggaattggaggccagggtacgaaagcctgctgaagctgagagatataaacttgaacgactcgccgaggctgagaagtcacaactgattatgcaggcagaggccgaggccgcatcggtccgtatgcgcggcgaggcagaggcgttcgcaatcggcgcacgagcccgcgctgaagcagagcagatggcaaaaaaggctgaagcattccagttataccaggaagctgcacaactggacatgctcctcgaaaaattgcctcaagtagccgaggagatttctggccctttgacatctgctaacaaaattacactggtcagctctggaagcggaacaatgggcgcagccaaggtgaccggggaagtcctggacatcctcacccggttgcccgagtccgtggagaggttgacgggtgtcagtatttcccaagtcaaccacaaacctctaaggaccgcctag

SEQ ID NO: 117275 - DNA, 861 bp, Artificial Sequence
  Description of Artificial Sequence: Synthetic coding sequence
atgggcatcagcgtggtgagctacactctcaaagacatccacgatgaccaggattacttacacagcctggggaaagctaggaccgcccaagtgcagaaggacgccagaattggggaggctgaggcaaagagggatgctgggatacgggaggccaaagcgaagcaggaaaaggtgtcagcgcagtatctgtctgagattgaaatggcaaaggcacagcgagattacgaactaaaaaaggctgcctatgacatcgaggtgaatactcggcgagctcaggcggaccttgcctatcagttgcaggtggccaagacgaagcagcagatcgaggagcagcgggtgcaggttcaggtcgtggagcgggcccagcaggtagcagttcaggaacaagagatcgctcgaagggagaaggagctcgaggcacgcgtccggaagcctgctgaggccgagcgttacaagttagaacggctcgctgaagcagagaagtcccagttaatcatgcaggccgaggctgaagcggcttccgtaagaatgcgcggggaggccgaagcatttgccatcggagctagagcaagggctgaagctgagcagatggccaaaaaggccgaggctttccagctctatcaggaagccgctcagctcgacatgcttcttgagaagttgccccaggtcgcggaggaaatctctggcccactgactagcgccaataaaatcactctggtgagctcggggtcgggtacgatgggggcagccaaggtcacaggtgaggttctcgatatcctgacacgcctccccgaaagcgtggagaggctgactggggtcagcatctctcaggtcaatcacaaacccttgagaactgcatag

SEQ ID NO: 117276 - DNA, 1452 bp, Artificial Sequence
  Description of Artificial Sequence: Synthetic coding sequence
atggggaattgtcacacagtggggcccaacgaagcgctggtggtcagcggcggttgctgtgggtcagactacaagcagtatgtgtttggggggtgggcctgggcctggtggtgtatttcagatacccagagattatcgctggaagtcatgaccatcttgtgcagatgcgaaaacatcgaaactagcgaaggcgtcccgctcttcgtcactggagtggctcaggtcccttgtccctgcctgctggactgcaagtggggtaactccaagggcttttggaaactttgccaagtgtgccaaattagcttggagattatgacactccagccccggtgtgaggacgtggaaaccgcagagggggtcgccctcaccgtcactggggtcgcacaggtgaaaatcatgaccgagaaggagctcctggccgtggcctgcgaacaattcttgggcaagaatgtccaggacatcaagaacgtggttttgcagacactggaaggccacctgcgcagtatacttggaaccttgaccgtcgaacagatctaccaggacagagatcagttcgccaaattagtgagagaggtggcagcgcccgacgtcgggagaatgggcatagagattctgtccttcaccatcaaggatgtgtacgataaggttgactatttatcttcattaggcaagacccaaactgctgtggtccagcgcgacgctgacattggcgttgccgaggccgagcgcgacgctggaatccgagaggccgagtgcaaaaaggagatgctggacgtcaaattcatggctgacacaaagattgctgactcaaagagggccttcgaattgcagaaatcagccttttcagaagaagtaaatattaagacggccgaagcgcagctagcttatgaactccagggcgcccgtgagcaacagaaaatcaggcaagaagagatagagatcgaagttgtgcagcgaaaaaaacagatcgccgtcgaagctcaggagatcctgcgaaccgacaaggagctgattgccaccgtgaggcggcctgccgaagctgaagcccacagaatccagcagattgccgaaggggagaaagtcaaacaagtgctgttggcccaagccgaggcggagaaaataaggaagataggagaggccgaagctgctgtgattgaggccatggggaaagccgaggccgagcgcatgaagctgaaggcggaagcataccagaaatatggagacgctgcaaaaatggccctggtactagaggcacttccgcaaatcgctgcgaagattgccgctcccctaaccaaggtggacgagatcgtggttctttctggcgacaactctaaggtcacttcagaggtcaaccgtctcctcgccgagctcccggcttcagtccacgccctgaccggggtagatctgagcaagatccctctgattaaaaaagccacaggggttcaggtttag

SEQ ID NO: 117277 - DNA, 1287 bp, Artificial Sequence
  Description of Artificial Sequence: Synthetic coding sequence
atgggtaattgccataccgtggggccgaacgaggccttggtagttagcgggggttgctgtggcagcgattacaaacaatacgtttttgggggatgggcatgggcttggtggtgtatatctgatacacagcggatcagcttagagataatgacgttacagcctcgttgtgaagatgtggagacggccgaaggcgtggccctaaccgtgaccggagtcgcccaagttaagataatgacggagaaagaactgcttgcggtggcttgcgagcaatttctcggaaaaaacgtgcaggatatcaagaacgtggtgctgcagacattggagggacaccttcgcagtatcctgggcaccctcaccgtggaacagatctaccaggaccgcgaccagtttgctaaactcgtccgagaagtggccgcacctgatgtgggaagaatgggcattgaaatcttatctttcacgatcaaggatgtttatgataaagtggattacctgtcttctctgggtaaaacacagaccgccgtggtgcagcgggacgcagatattggcgtggccgaagcggaacgtgacgcaggaatacgggaagccgagtgcaagaaagagatgctcgatgtcaaattcatggcagacactaagatagcggatagcaaacgggccttcgaactccagaaatccgcgttctctgaggaggtgaatataaagaccgccgaggcacaactagcgtacgagctacaaggtgcccgcgaacagcagaaaatacgacaagaggaaatagagatcgaggtcgtccagaggaagaaacagattgctgtggaggctcaggaaattctccgcaccgacaaggaattgattgctacggtccgaagacctgccgaggcagaggcccatcggatacagcagatagcagagggagagaaagtgaaacaggtgctcctggctcaggcagaggcagagaaaatacgtaagattggtgaggcagaggcagctgtaattgaagctatgggcaaagctgaagccgagcgtatgaaactcaaggctgaggcctatcagaaatacggcgatgccgcaaagatggctctggtattagaagcgctgccacagattgcagccaagatagcagccccattaaccaaagttgatgagatagtcgtattaagcggagacaacagtaaggtgacttctgaagttaatagactcctggccgagctcccggcctccgtgcacgctctgaccggggtggatctgagtaagattcccctcatcaaaaaggcgaccggggtgcaggtgtag

SEQ ID NO: 117278 - DNA, 2982 bp, Artificial Sequence
  Description of Artificial Sequence: Synthetic coding sequence
atgcctgccctcgctcgggatgggggccagctccctttgttggttgtgttttcagccatgatcttcggcaccatcacgaaccaggatctgcctgtgatcaagtgcgtcctcatcaaccacaagaacaacgattccagtgtgggaaaatcatcgtcgtatcccatggtgtcggaatcccccgaggatctgggctgtgctctacgcccacagagcagcgggactgtgtacgaggcagctgctgtagaagtagatgtgtcggcctctattaccctccaagtattagtagacgcacccgggaatatctcttgcctgtgggtgtttaaacactcctccctaaattgccagccccatttcgacctgcagaatcgaggggtggtatccatggtgattctgaagatgacagaaactcaagccggcgagtatttgctgttcatccagagcgaggccacgaactataccattctgttcaccgttagtatcagaaataccctcctttatactctgcgccgaccctacttccgcaagatggagaatcaggatgcgctggtgtgcatcagtgaaagtgtgccggaaccgatcgtcgagtgggtgctctgcgacagccaaggcgaaagctgcaaggaggagtccccggcagtagtgaaaaaggaagagaaggtcttacatgagcttttcggaactgatatccgctgttgcgctcgtaatgaactgggcagagagtgcacacggctttttacgattgatctgaatcagacccctcagacaactctaccacagctgttcctgaaggtcggcgagcctctctggattaggtgcaaggccgtgcacgtgaatcatgggttcggcttgacgtgggagttggagaataaggccctcgaagaaggcaactacttcgaaatgtcgacctactcaaccaaccgcactatgatccgcatactttttgcattcgtttcttccgtggctaggaatgacacggggtattacacctgctcctcaagcaagcacccttcccagtcagccctggtgactatcgtggagaaagggttcattaacgccactaacagttccgaagattatgaaattgaccaatacgaggagttttgtttttccgtcagatttaaagcctatccacagatcagatgtacatggacattctcacgtaagtcgtttccatgcgagcaaaaaggactggataatggctactccatttctaagttctgcaatcacaagcaccaaccaggagagtacatcttccatgcagagaatgacgacgcccagtttaccaaaatgttcacacttaacatccgacgcaaaccccaggttcttgctgaggcgtccgctagtcaagccagctgcttctctgacggatacccactgcccagctggacatggaagaaatgttccgacaagtctcctaactgtactgaggagataaccgaaggagtctggaacaggaaagctaacaggaaagtgttcggacaatgggtcagctcatcaactttgaacatgtccgaagctatcaaaggcttcctggtgaagtgctgtgcatacaacagtctgggaacctcctgtgagaccatcttacttaattccccggggccattcccatttatccaggataatataagcttttacgcaacaataggggtgtgccttctgtttattgttgtccttacactgctcatatgccacaaatacaaaaagcaatttcgatatgagagtcagttgcagatggtgcaggttactggaagctctgacaacgagtacttctacgtggacttccgggagtatgagtatgatctgaagtgggaatttccccgggagaatctggagtttggaaaagtgctggggtcgggcgcctttggcaaagtcatgaacgcaactgcctacggcattagcaagactggtgtcagcatccaggttgccgtgaagatgttgaaggagaaggccgattctagcgagcgcgaggccctgatgtccgaactgaagatgatgacacagttgggttcacacgagaatatcgtaaacctgctgggagcttgcaccctcagcggtcctatctatctcatcttcgaatattgctgctacggtgacctcctgaactaccttcgtagcaaacgcgagaaatttcataggacttggactgaaatctttaaggagcataactttagcttctatccgaccttccagagccatccaaattcgtctatgccaggttcaagggaagtacagatacatccagattcagatcaaattagtgggctccacggaaactcatttcactccgaagatgaaatcgagtacgaaaaccagaagagactggaggaggaagaagacctgaacgtactaacgtttgaggacctgctgtgcttcgcctaccaggtggccaaagggatggagttccttgagttcaaaagttgtgttcaccgcgatctcgccgctcgcaacgtgttggttacgcacggcaaggtggtgaagatctgtgactttgggctcgccagggacatcatgagcgactccaattacgtcgtgagggggaacgctcgactgccagtgaaatggatggcccctgagagcctgtttgagggtatctatactataaaaagtgatgtgtggagctatggaatcctgttgtgggaaatcttttcacttggtgtaaacccttatcccggaatccccgtagacgctaatttctacaagctgatccagaatggcttcaagatggaccagcctttctacgccacagaggaaatctatatcattatgcaaagttgttgggctttcgatagcagaaagaggccttcttttcctaacttgacatcattcctgggttgccagttagccgacgctgaggaagcaatgtaccagaacgtcgacgggcgggtcagtgagtgccctcatacttaccaaaataggcgcccttttagccgcgagatggacctagggctgctctcacctcaggcccaggtagaggactcctag

SEQ ID NO: 117279 - DNA, 2991 bp, Artificial Sequence
  Description of Artificial Sequence: Synthetic coding sequence
atgccggcgctggcccgagacggaggccagcttcctctcctggttgtgttctccgcaatgatcttcggaaccattactaatcaggacctgcccgtgatcaaatgtgtgctgatcaaccataagaacaacgatagctcagtgggaaagagcagctcttatcccatggtgagtgaaagccctgaagatctcggctgcgctctgcggcctcagtcgtctggcacagtgtacgaggcagccgccgtcgaagttgatgtgtcagcatctattactttacaggtccttgtcgatgcacccggaaacatctcgtgcctctgggtctttaagcatagtagtcttaattgccaaccccattttgatctgcagaacaggggagtggttagcatggtgatcctgaaaatgactgaaacacaagctggcgaatatctgttgtttatccaatccgaagccactaactacaccattctcttcaccgtctccatccgcaacaccctgttatataccctcagacggccgtatttccgcaagatggaaaaccaagacgcactcgtctgtatttccgagtctgtcccagagccaattgtcgagtgggtactgtgcgactcacagggtgagagttgcaaggaagagtcccctgctgtggtgaagaaggaggagaaagtgcttcatgaactcttcggcaccgatattaggtgctgcgcacgcaacgaactaggaagagaatgtaccaggctcttcacgatcgacttaaaccaaacaccccaaaccaccctcccccagcttttcctgaaagttggggagcctttgtggataagatgcaaagccgtccatgtgaatcatggctttgggttgacctgggaacttgaaaataaagcactggaagaggggaactattttgagatgtcaacatattctactaaccgaaccatgattaggatactgtttgccttcgttagctcagtggcaaggaatgacactgggtactatacttgctcgtcctcaaaacacccttcgcaatcggccctggtgacgattgttgagaagggattcatcaacgctacaaactcgagtgaagactacgagattgaccagtatgaggaattttgtttctccgtgcggtttaaagcctatcctcagattagatgcacctggactttctctaggaagtcgtttccatgcgaacagaaagggctggacaacggttactctatatctaagttctgcaaccacaagcaccagcccggagaatacatctttcatgcagagaacgacgatgctcagtttaccaagatgttcacactgaacatcagaaggaagccgcaggtgctggcagaggctagcgctagtcaggcctcttgtttctctgatggctatcccctgcccagctggacctggaagaaatgcagtgataagagtccgaattgcacagaggaaatcaccgaaggggtgtggaataggaaggccaaccgaaaagtgtttggtcagtgggtgtcttcctccactctgaacatgtctgaggctatcaagggatttctggtgaagtgttgcgcttataacagcttgggaactagctgtgagacaatactattaaattcacctgggccttttccgttcatccaggacaacatctccttctatgctactattggtgtttgtttactgttcattgtggtgctgacactgctgatatgtcataagtacaaaaagcagttccgttacgagtcccaacttcagatggtgcaggtcaccggttctagcgacaatgaatatttctacgtcgacttccgggaatacgaatatgacctgaaatgggaattccccagagagaacctggagttcgggaaggtattaggatcaggcgcttttggcaaggtgatgaacgctactgcttacggcatctccaaaaccggcgtgtcaattcaggtggcagtaaaaatgcttaaggaaaaagcggatagctccgaacgggaagctttaatgagcgagctaaagatgatgactcagctaggaagccatgagaacatcgtgaacttgctgggtgcctgtacactcagtgggcccatttacttaatttttgagtattgctgctatggcgatctgctaaattatctgaggtccaaaagggagaagtttcaccggacatggacagaaatttttaaagaacacaactttagcttctatccaacgtttcagtcccatcccaatagtagcatgccagggtcgcgtgaagtgcagatccaccccgattctgaccaaatcagcggactgcatggaaactccttccattccgaggacgaaatcgagtacgaaaaccagaaacggctcgaagaagaggaggatcttaatgtgctgacattcgaggacctcctttgtttcgcttatcaggtagccaagggcatggaatttctagaattcaaaagttgcgtgcaccgtgatttggccgcacgcaatgtgctggtaactcacggcaaggtggtcaaaatctgtgattttgggctggcgcgagatattatgagtgattccaattacgtggtccgcgggaatgtgaggctggctcgacttcctgttaaatggatggcccctgaaagcctgtttgagggtatctacaccattaaatctgatgtgtggtcctacgggatcctcctttgggagattttctctctgggtgtgaatccatacccgggcattcctgttgacgcaaacttttataagctgatacaaaatggttttaaaatggaccagcctttctatgccacggaagaaatttatatcattatgcagtcgtgttgggcctttgactctcggaaacggccttcctttccaaatctaacttcttttcttggctgtcaactggccgatgccgaggaggctatgtaccaaaatgtggacgggcgagtaagcgaatgtcctcacacctaccaaaatagacgaccattcagcagggagatggatcttggactgctgagtcctcaggcacaagttgaggattcatag

SEQ ID NO: 117280 - DNA, 2859 bp, Artificial Sequence
  Description of Artificial Sequence: Synthetic coding sequence
atgcccgccctcgcacgcgatggaggccagctacctctgctagtggtgttctcagcaatgatatttgggaccattaccaaccaggacctccctgtgatcaaatgcgtgctgatcaaccacaagaataatgactcgagcgtgggaaaatctagttcatatcccatggtttcggagtcacccgaggatctgggttgtgcactaaggccacagagcagtggaaccgtgtatgaagcggccgccgtggaggtcgacgtgtccgcttcaattacgctgcaagtgcttgtggatgcacccgggaatatcagctgtctctgggtttttaaacactccagcttgaactgccaaccccacttcgatctacagaaccgaggggtagtttccatggtaatcctcaagatgacggaaactcaagcgggcgagtacctgctgtttattcaatctgaggccaccaactacaccatcctttttacggtcagcattagaaataccctgctctacaccctgcgacggccatactttcgcaagatggagaatcaggatgccctcgtctgcatctcggagtctgtacccgagccaattgtggaatgggtattatgcgattcccagggcgaaagctgcaaagaagaaagccctgcagtggtaaaaaaggaggagaaagtgttgcacgaactgttcggtaccgatattcggtgctgtgcgcggaatgagctgggacgagagtgcacccgcctgtttaccatcgatctgaatcagacacctcagacgacgctgcctcaactgtttctgaaggttggcgagcctctctggattcgatgcaaggctgtgcacgttaaccacggtttcggtcttacatgggagctggagaacaaggctctggaggaaggcaattattttgagatgagcacctactctaccaatcgtaccatgatcaggatactgtttgctttcgtatcgtccgtagccaggaacgacaccgggtattacacctgctcctcttctaaacatccctcccagagcgcactggttaccatcgtggaaaagggctttattaatgccaccaattcctctgaagattatgagattgaccagtatgaggaattttgtttcagcgtccgtttcaaagcctatccgcagattcgctgcacttggaccttctcgagaaagtcatttccctgcgagcagaagggtctggacaatggatacagcatcagtaagttctgtaatcataagcaccagccaggcgaatacatctttcatgccgagaatgacgatgcccagttcacaaagatgtttacactgaacatacgaaggaagccccaggttttggctgaggctagcgccagccaggccagttgcttcagcgatggctatcctctgcctagctggacctggaaaaaatgctcagacaaatctccaaactgcaccgaggagattacagagggggtgtggaatcggaaagccaatcggaaagtcttcgggcagtgggtttcatcttccactcttaatatgagcgaagccatcaagggtttcctggtgaagtgttgcgcttacaattcactgggaaccagttgcgagacaatcctcctaaacagtcctggaccctttccctttatacaggataatattagtttctacgctacaataggagtctgtttgctcttcattgtcgtgctgaccctgctcatttgccacaaatacaaaaagcaatttaggtatgaatcccaattacaaatggtccaggtgaccgggagctctgataacgagtacttctacgttgactttagggagtacgagtacgacctgaagtgggagtttcctcgggagaacctggagttcggcaaggtcctgggcagtggggcctttggcaaagtgatgaacgcaactgcatacggaatttcaaaaacaggagttagtattcaggtggccgtcaagatgctaaaggaaaaggccgattctagcgaaagagaggctctcatgagcgaactgaagatgatgacacagttgggttcacacgagaacatcgtgaatctccttggggcctgcacactgtccggtccgatatacctgatttttgagtactgctgttacggcgacttgctgaactacctcagatctaaacgggagaaattccaccgaacatggacagagatctttaaggagcacaacttttcgttttaccccacttttcagtcccatcccaacagctcaatgccaggttcgagagaagtgcaaatccatcctgattcagatcagatctctggtctgcacggcaatagcttccatagcgaagatgagattgagtatgagaaccagaagcgcctggaggaagaggaggatctgaatgtgctcactttcgaggatctgctgtgttttgcgtatcaggtagccaaaggcatggaatttctcgaattcaaatcggcgcgcctaccggtgaaatggatggcaccggagtctctcttcgagggaatctacacaatcaagagcgacgtgtggagttacggaattctgctgtgggagatttttagcctgggcgtcaacccttatcccgggattccagtcgacgcaaacttctacaagctcattcagaatgggttcaaaatggatcagcccttctacgccaccgaagaaatttacataattatgcagtcctgctgggcttttgacagtcgcaaacgtccctccttccctaatctgacttctttcttaggctgccaattggctgacgccgaagaagcgatgtaccaaaacgtggatggtcgcgtctctgaatgtccccatacctaccagaaccggaggccctttagccgcgaaatggacctgggcctgctctccccacaggctcaggtggaggattcttag

SEQ ID NO: 117281 - DNA, 2253 bp, Artificial Sequence
  Description of Artificial Sequence: Synthetic coding sequence
atgtggaatctgctgcatgaaactgatagtgccgttgcgacagccaggagacctcgctggctgtgcgcaggggcactggtgctggccggcgggttttttctgctggggtttctttttggctggtttataaagagttccaacgaagccacaaatattactcctaaacataacatgaaagcctttttagacgaattgaaggccgagaacattaagaaatttctctacaatttcacacagataccccatctagctggaaccgagcagaacttccaattggcaaagcagattcagtcccagtggaaagagtttggactcgactccgtggagctcgctcactacgacgtgcttctgtcctaccctaataagacccatcccaactatatttctatcatcaatgaggacggcaacgaaatctttaacaccagcctgttcgagcctccaccacctggatatgagaacgtatcggacattgtgccaccattctctgcatttagcccacagggaatgcccgagggagaccttgtatatgtcaactatgctcggactgaggacttcttcaaattggagagggacatgaagattaattgctcagggaagatcgtgattgccaggtatggaaaagtttttaggggcaacaaagtcaaaaacgctcaactggctggagccaaaggggtaattctctacagtgacccagccgactatttcgcccccggggtgaaatcttaccccgacgggtggaacctcccagggggcggtgttcagcggggaaatatcctgaacctcaatggcgccggggaccctttaacacccggatatccagcaaatgaatatgcttatcgcaggggaattgccgaggcagttgggctaccttcaatcccagtgcacccaattggttactatgacgctcagaaactccttgagaagatgggggggagcgccccaccggactcatcttggaggggatccttgaaggttccctacaacgttgggccagggtttacaggcaatttttcgactcagaaggtcaaaatgcatatccattcaacgaacgaagtgacccggatttataacgtgatagggacactgcgcggtgcagttgagcccgatagatatgtcatactgggtggccatagagatagttgggtgttcggaggcatcgatccacagtccggtgcggccgtggtccacgaaatagtccgaagtttcggcaccttaaagaaggagggttggaggcctagaagaaccattctgttcgcctcctgggatgccgaggagttcggcctcctcggttccaccgagtgggccgaggaaaattccaggttgctccaggaacgaggagtcgcatatatcaatgcggattcttctatagaaggtaattacactctaagggtggactgtacccccctgatgtactccctggtgcataaccttacgaaggaattgaaaagtcccgatgaaggttttgaaggaaagtccttgtatgaaagttggaccaagaagtccccatcgccagaattttctggaatgcccagaatctccaagctcgggagcggcaatgatttcgaagtgtttttccagcgactgggaatagccagtggacgcgctaggtacaccaaaaattgggagaccaacaaattctccgggtacccgctgtaccactccgtgtacgagacctacgagctggtggagaagttctatgaccccatgtttaagtatcaccttaccgtggcacaggtgcgtggggggatggttttcgagcttgcaaatagcatcgtactgcccttcgactgcagagactatgctgtggtcttgcgcaaatacgccgacaaaatctattctatttccatgaagcatccacaagaaatgaaaacttacagtgtctcttttgactcactgttttcagcagtgaagaattttaccgagatcgcaagtaaatttagcgagagactgcaggacttcgataagtccaaccccatcgttctcagaatgatgaacgaccagcttatgtttttagaacgagcttttatcgatcccctagggctgccagaccgacctttttaccgtcacgtgatatacgccccaagctctcacaataagtatgccggcgaatccttcccaggcatttatgacgctctgttcgatatagaatctaaagtggacccttctaaagcctggggtgaggtaaagagacaaatctacgtcgctgcctttacggtgcaggccgcagcggaaacactgtccgaggtagcatag

SEQ ID NO: 117282 - DNA, 2208 bp, Artificial Sequence
  Description of Artificial Sequence: Synthetic coding sequence
atgaccgcgggctctagctacccactctttcttgcggcctacgcttgtacaggctgcctagcagaacgcttaggttggtttatcaaatcatctaacgaagcaaccaacatcacacctaagcacaacatgaaggcattcctggatgaactgaaggcggagaacattaagaaattcctgtacaattttactcagataccccacctggcaggaacggaacaaaactttcagctcgctaagcaaatccagagccagtggaaggaatttggcctggattctgtcgagttggctcactatgacgtgctgctcagctaccccaacaagacccatcccaattacatctcaattatcaatgaagatgggaatgagatcttcaacacctcgctcttcgagccaccaccacctggctacgagaatgttagtgacatcgtcccaccattttcagccttcagtcctcaaggcatgccagagggcgatctggtgtatgtgaattatgcaagaactgaagactttttcaagctagagagagatatgaaaatcaactgttcaggcaaaatcgttatagcgaggtacgggaaggtgttccgcggtaataaggtgaagaatgctcagctggccggagccaaaggtgttatcctatacagtgacccggccgattacttcgcccctggcgtgaagagttatcccgatggctggaaccttccaggagggggagtgcaacggggaaacatcctgaatctaaatggcgccggcgatcctttaacacctgggtacccggcaaatgaatatgcttacagacggggaattgctgaggcggttggactgccatcgattcccgtgcaccccattggatattacgatgcccagaagctgctggaaaaaatggggggctcagcacctcctgattcctcctggagaggctcactgaaagtgccctataatgtgggccccggctttaccggtaacttctccacacagaaggtcaagatgcatatccattctactaatgaagtcactcgtatctataacgtcattggcaccctgcgaggcgctgtggagcctgatagatacgttatcctgggcggccacagagatagctgggtgtttggggggatcgatccgcagtcaggggcagcggtggtccacgagattgtgagaagctttggtaccctcaaaaaggaaggctggaggccccgacggacaatcttatttgcatcctgggacgccgaggaatttggactcctgggcagtaccgagtgggccgaagaaaacagtcgcctgctgcaggagagaggtgtagcctatatcaacgcggactcgagtatcgagggtaattacaccttacgtgtcgactgtacgccattgatgtattccctagttcataatttaaccaaggagctgaaatcacccgatgaaggcttcgaagggaagtcgctctatgagtcttggaccaagaaaagtcccagccccgaattttctggtatgccgaggatcagcaaactcgggtctgggaacgatttcgaggtgtttttccagcgcctggggatcgcctcagggagggcgcggtacacaaaaaattgggagaccaacaaattcagtggttaccccctgtaccatagcgtctacgagacttacgagttggtggagaaattctatgatcccatgttcaaatatcacctcaccgtggcccaggttagaggcgggatggtctttgagctcgcaaactctatagtactcccatttgactgccgggactacgccgtggtcctccggaagtacgcagacaaaatatactcaatttcgatgaaacatccccaggaaatgaaaacatacagcgtctccttcgactccctattttcagctgtcaaaaatttcaccgaaatcgcaagtaagttcagcgaaagattgcaggatttcgacaagtctaaccctatcgttctgcggatgatgaacgatcagctcatgtttctggagcgagcttttatcgaccctttggggttacccgatagacctttttataggcatgtaatctatgctcccagctcacacaataaatatgctggggaaagttttcctggtatctatgatgctctgttcgatatcgagtctaaggtagacccttctaaggcttggggagaggttaagcggcagatctacgtggcggcattcactgtccaggccgctgcggaaaccttgtcggaggtggcttag

SEQ ID NO: 117283 - DNA, 1329 bp, Artificial Sequence
  Description of Artificial Sequence: Synthetic coding sequence
atggggggctcggcccccccagattcaagctggaggggatctctgaaagtgccttacaacgtgggtcctgggttcaccggtaatttttctactcagaaagtcaagatgcatatccatagtaccaacgaagtaacaaggatctataacgtcattgggactttgcgcggagcagtcgagcctgaccgctatgtgattctgggcggccaccgcgactcatgggtcttcggagggatcgacccacagtcaggggccgccgtcgtacatgaaatcgtaagaagtttcggcactctcaagaaggaaggctggagaccccggcggactatcctttttgcttcctgggatgctgaggagtttgggttactggggtctacggagtgggccgaggaaaactcccggctgctgcaagaacgcggggtcgcctacattaatgccgacagcagcattgaaggcaattatacattgcgtgtagattgcaccccactgatgtatagcctggtacataacctaactaaggagctcaagtctccagatgagggcttcgaagggaaatccctatacgaaagctggacgaagaaatccccctccccagagttctctggcatgccacgcatcagcaagctcggatccgggaatgatttcgaggtattctttcagcgcctgggcatcgcttcgggcagggccagatataccaaaaactgggagaccaataaatttagcggctacccactctatcattccgtgtatgagacatatgagctcgtggagaaattttacgatcctatgttcaagtaccacctgacggtagcacaagttcgcggtgggatggtgttcgagctggcgaattctattgtgctgcctttcgactgcagggattacgcagtggttctgcggaagtacgcagacaagatctactctatcagcatgaaacacccacaagagatgaagacttactctgtgtcatttgactctctgttctccgctgtgaaaaactttaccgagatcgcgtccaagttctccgagaggctgcaggattttgataaatctaatcctattgtgttaagaatgatgaatgaccagctaatgttccttgaacgcgcattcattgatccccttggcctacctgatagacctttctaccggcacgtgatttacgcaccatcttcacacaataagtatgccggagaatcatttcccgggatctatgacgcgctgttcgacattgagagcaaggtcgatcctagcaaggcctggggagaggtcaaacgccaaatctatgtggctgcctttaccgtccaagctgctgcggagaccctcagcgaggtggcctag

SEQ ID NO: 117284 - DNA, 2160 bp, Artificial Sequence
  Description of Artificial Sequence: Synthetic coding sequence
atgtggaacctcctacacgagactgactcagccgttgccacagctcgccgaccacgctggctgtgtgctggtgctttggtgctggccgggggattcttcctcttgggctttcttttcgggtggtttattaagtcctccaacgaggcaactaacataactccaaaacacaatatgaaagcatttctggacgagctgaaggctgagaatatcaaaaaatttctgtataacttcactcagatcccacacttggccggaacggaacagaacttccagttggcgaagcaaatccagtctcaatggaaggaatttggcctcgacagtgtggagctggcacactatgacgtgctgctgtcttaccctaataaaacccaccccaattacattagcatcattaacgaggatggtaacgaaatttttaataccagcttgttcgaacccccaccaccggggtatgagaatgttagcgacattgttccccccttctcagctttctcccctcaggggatgcctgagggagatttagtgtatgtgaattatgctaggactgaagatttctttaaacttgaaagggacatgaagattaactgcagtgggaaaattgttattgccaggtatggtaaggtcttccgaggcaataaggtcaaaaatgcccagctggccggtgccaaaggagtgatattgtattccgatccggctgattatttcgccccaggagtgaagtcttaccctgatggttggaatttgcccggaggcggtgtacagcggggaaatatcctcaatctgaatggcgcaggcgatccactgacaccaggatatccagccaatgaatacgcctaccgcaggggaattgctgaggctgtcggcctccccagcatacccgtgcatccaatagggtactacgatgcccagaagctgctggagaaaatgggaggcagcgcaccacccgacagctcctggcgaggaagcctgaaggttccctacaacgtgggaccaggcttcacaggaaactttagtacccaaaaggtcaaaatgcacatccacagtacaaacgaggtcacaaggatttacaatgtgattgggactttgcgcggcgcggttgaaccggacaggtatgtgattcttggcggacatagggattcctgggtgttcggcggaattgatcctcagagtggtgctgccgtcgtgcatgaaatagtgagatctttcggtacactgaagaaggagggctggcgcccccgccgaaccattctctttgcatcatgggacgccgaagagttcggactcctgggatcaaccgaatgggctgaggagaactcacgccttctccaggaaaggggcgttgcctatatcaacgctgacagcagtatagaaggcaactatacccttcgggtcgattgtaccccactgatgtatagtcttgttcataacttgaccaaggagctaaaatccccagatgagggatttgaggggaaatctctgtacgagtcatggacaaaaaaatctcccagtccagaattctctggcatgcccagaatcagtaagcttggatccggaaatgatttcgaggtgttcttccagaggctgggcatcgcgtccggccgcgctcgctataccaagaattgggaaacaaacaaattctccgggtaccctttataccatagcgtgtacgagacatacgagcttgtggagaaattttacgacccaatgtttaagtaccacttaacagtggcacaggtgaggggtggaatggtcttcgaattagcaaactccattgtgctcccatttgattgcagggattatgccgtagttctgcggaagtacgctgataagatctatagcattagtatgaaacacccacaggaaatgaagacgtatagcgtttcctttgactcattgttctccgctgtgaagaacttcacagagatagcctccaagtttagcgaacgcctgcaggattttgacaagagcaagcatgtcatttacgctccttcctctcacaacaaatacgccggtgagtcgtttcccgggatctacgacgcgctattcgatattgaatctaaagttgatcccagcaaggcctggggagaggtgaagcggcagatttacgtggccgcattcactgtccaggccgcagccgaaacattaagtgaagtcgcatag

SEQ ID NO: 117285 - DNA, 1638 bp, Artificial Sequence
  Description of Artificial Sequence: Synthetic coding sequence
atgtggaacctgctccacgaaacagatagtgcggtggccacagcgcgtagaccccgttggctctgtgctggcgctctggtcctcgcagggggcttcttcctcctagggtttcttttcggctggttcatcaaaagctcaaatgaggccactaacatcacaccgaagcacaacatgaaagccttcttggatgaacttaaggctgaaaatataaaaaagttcctgtacaactttacccagatcccccatttagccggtaccgagcagaactttcagctagcaaagcagatccagtcccagtggaaagaatttggtctcgactcagtggagctggctcattacgatgtgctgctaagctatcccaataagactcaccctaactatatatcaatcattaacgaggacggcaacgagatctttaatacgagtcttttcgagccccccccacccggatacgaaaatgtgagtgacatcgttccacctttttcagctttttctcctcagggaatgccggagggcgacctcgtttacgtcaactatgcccggacagaggacttttttaagctggagcgggacatgaaaatcaactgttcaggcaaaattgtcatcgcacgctatggcaaggtgtttaggggaaataaggtgaagaacgctcagctggccggcgctaagggggtgattttgtatagtgatccggccgactacttcgctccgggagtgaaatcgtaccctgatggatggaatctacctgggggaggcgttcagcgtggaaatatattgaatttgaacggggctggggaccctttgactccaggctatcccgctaacgaatacgcttatcgccgagggattgccgaggctgtgggactgccaagtattcctgttcaccctattgggtattacgacgcccagaaactacttgaaaaaatgggagggtctgctcccccagacagcagttggagagggtccctcaaggtcccttataatgtgggcccaggcttcacagggaacttctcaactcagaaagtcaaaatgcacatccacagcaccaatgaagtgacccgcatatacaacgtcatcggcaccctgcgtggagctgtggagcccgacagatacgtgattctgggcggacatagggactcatgggtgttcggggggattgacccccagtccggcgcagccgtcgtccacgaaatcgtccgctcattcggaactctgaagaaagaagatatattagggtggagaccccgccgtactattctgttcgcttcgtgggatgcggaggaatttgggttactgggatcaacggaatgggcagaggagaatagtagactgcttcaagagcgcggcgtggcttacatcaatgcagactctagtattgaaggtaactatacacttcgtgtggactgcacgcctctcatgtactctctggtacacaacctcacaaaggagctgaaaagcccggatgagggttttgaggggaagagtctctacgagtcttggactaagaagtccccctcacccgagttctccggaatgccccgaatcagtaagttaggctccgggaatgatttcgaagttttcttccagcggctgggtattgcgtccggacgggcccgttatacaaaaaagaaaaagtag

SEQ ID NO: 117286 - DNA, 2115 bp, Artificial Sequence
  Description of Artificial Sequence: Synthetic coding sequence
atgacggccggatctagttatccactttttctagcggcctatgcctgcactggctgtcttgccgaaaggcttggctggttcatcaaatcgtccaacgaagctaccaacattactccaaaacacaacatgaaggcgttcctggatgaactgaaggcagaaaatatcaaaaagttcctctacaactttactcagatccctcacctcgcgggcaccgagcagaatttccaactggcgaagcagattcagagtcagtggaaggagtttggacttgacagcgtggaattggcacactatgatgttttgcttagttacccgaacaagacacatccgaattacatcagtataataaatgaggatggcaacgagatatttaacacttccttgtttgaacctccccccccaggttacgagaatgtttccgatattgttccccccttcagcgcattttcaccacagggcatgcctgaaggagaccttgtgtacgtcaactacgcccgtactgaggacttctttaaactggagagggatatgaagatcaactgctcaggaaagattgtaatcgcgcgatacggcaaagtgttccgaggaaataaagtgaaaaatgcccagctcgcaggtgctaaaggcgtgatcctgtatagcgatccagctgactactttgctccgggcgttaagagctatccagatggatggaacctccctgggggcggcgttcaaagaggtaatatactaaatctgaacggcgctggggaccctctgaccccaggctatccagctaatgaatacgcctatagaagggggatagccgaagcagtggggctgccttccattccggttcacccgatcggatactacgatgcacaaaagttacttgagaagatggggggctctgctccacctgatagctcctggagggggagcctgaaagtgccctataatgttggcccagggttcacaggaaacttcagtacacagaaggttaaaatgcacatccatagcactaacgaagtgacgagaatttacaatgtgataggtacactgaggggggcagtggaaccggaccgctacgttattctgggagggcatcgcgatagctgggtcttcggcggtatagacccacagagtggagctgccgttgttcacgaaattgtgaggagtttcgggactctcaaaaaagagggttggcgacctcgacgaactatcctctttgcttcctgggacgccgaagaatttggcctactgggatctaccgagtgggccgaagagaatagtcggctgcttcaggagagaggagtggcctatattaacgccgatagttctatcgaaggcaattacacactgcgggtagactgtacccccctgatgtactctctagtgcataaccttaccaaagagttgaagagccccgacgaaggattcgaaggcaaaagcttatacgagagctggacaaagaaatcacccagccccgagtttagtggaatgccacggatatctaaactcggcagcggcaacgattttgaggtgttcttccaacgtctgggaatcgccagtgggagggcacgctacaccaagaattgggaaacaaacaaattctctggctatccactgtaccactctgtttatgaaacatacgaactcgttgaaaagttctacgaccccatgtttaagtaccacctgacagtcgcccaggtccgggggggtatggttttcgaacttgccaactctatcgtgcttccctttgattgtcgagattacgctgtcgtgctgaggaaatacgctgataagatctacagcatcagcatgaagcatccacaggagatgaagacgtattctgtgagcttcgacagcttgttctcagccgtgaagaacttcaccgaaattgcgtccaagttcagcgagagactgcaggattttgataagtccaagcacgttatttacgccccctcgagtcataataagtacgccggcgagtcctttccagggatatatgatgctctgttcgatatcgaatccaaggttgatccatccaaggcgtggggagaagtcaaaagacaaatctacgtggcggcatttaccgtgcaggctgcagccgaaacattgtcggaggtagcttag

SEQ ID NO: 117287 - DNA, 774 bp, Artificial Sequence
  Description of Artificial Sequence: Synthetic coding sequence
atggctcagcggatgactactcagctgctgctcctcctggtgtgggtagctgtcgtgggggaggcacagacccgcatcgcctgggcgcgcaccgagttgcttaacgtgtgtatgaatgcaaaacaccacaaagaaaagcctggtcccgaagacaagctgcatgaacaatgtcggccgtggagaaagaatgcctgctgctctacgaacactagccaggaggctcataaagatgtttcatatctatatcgattcaactggaatcactgcggtgaaatggccccggcctgtaaacgccacttcattcaggacacgtgcttatacgagtgttcgcctaatctaggaccctggattcagcaggtcgatcagtcttggcggaaggagagagttctgaacgtgcccctatgtaaggaggactgcgagcaatggtgggaagactgtcgcaccagctatacatgcaagtctaactggcataaggggtggaattggaccagcggctttaataaatgcgctgtgggcgctgcttgtcaaccgttccacttctatttcccaacccctaccgtgctctgcaacgaaatatggactcacagctacaaagtgtccaattattctagaggcagcggacgttgtattcaaatgtggtttgaccccgcccaaggcaaccccaacgaggaagttgcccgattctacgctgccgcgatgtccggggcaggcccctgggcagcgtggcccttccttctatcattggctttaatgctgctgtggctgctctcctag

SEQ ID NO: 117288 - DNA, 774 bp, Artificial Sequence
  Description of Artificial Sequence: Synthetic coding sequence
atggcccagaggatgaccactcagctcctgttactgctggtatgggttgctgtcgtgggagaagcacagacccgtatcgcatgggctagaaccgagttgctgaacgtctgtatgaacgcaaaacatcacaaggagaagcccgggcctgaggataaattgcacgagcaatgcaggccctggagaaaaaacgcttgttgtagcactaatacgtcacaggaagcacataaagacgtgtcttacctgtaccgtttcaattggaaccactgcggtgagatggcacctgcgtgtaaacgacactttatacaagacacctgtctgtacgagtgttcaccaaatctagggccctggatccagcaggtagatcagagctggaggaaggagagggttctcaatgtgccactctgtaaggaagattgcgagcagtggtgggaggattgccggacatcgtatacttgcaagtctaactggcacaagggatggaactggacctccgggtttaacaaatgcgcggtgggggcggcctgccagccttttcacttctactttccgacaccaactgttctgtgcaatgaaatctggacgcactcttataaagtgtccaattacagccggggctctgggcgatgcatccagatgtggtttgatcctgcacagggtaaccctaacgaagaagtggcccggttctatgcagcagctatgtccggagcgggcccatgggccgcgtggccgtttctgctctctctcgctctgatgctcctctggcttttgtcatag

SEQ ID NO: 117289 - DNA, 774 bp, Artificial Sequence
  Description of Artificial Sequence: Synthetic coding sequence
atggcacagcggatgactacgcagttgctactactgcttgtgtgggtggcagtggtcggagaagctcagactcgtattgcttgggccaggaccgaactgctcaacgtgtgcatgaatgccaagcatcataaagagaagcctggcccggaagataagctgcatgagcagtgcaggccttggagaaaaaacgcttgctgctctacaaatacctctcaggaggctcataaggacgtgtcctacctctatcggtttaattggaatcactgtggcgaaatggccccagcatgcaaacggcatttcatacaggacacctgcttgtatgagtgctcacccaatctcggcccttggattcagcaggtggaccagagttggaggaaggagcgggtgctcaacgtgccactgtgtaaagaggattgtgagcagtggtgggaggactgccgaacctcctatacctgtaagtctaactggcacaagggctggaactggacttccggttttaataagtgcgctgtaggcgcagcatgccagccatttcacttctatttccctacacccacagtgttatgtaacgaaatatggacacactcctacaaggtatcaaattactcccgcggcagcgggaggtgcatccagatgtggttcgacccagcacaaggaaatcctaacgaggaggttgcccgcttctatgctgcagctatgtctggagctggaccctgggccgcatggccttttctcctctccctcgctctgatgcttctctggctgctctcctag

SEQ ID NO: 117290 - DNA, 774 bp, Artificial Sequence
  Description of Artificial Sequence: Synthetic coding sequence
atggctcagcgcatgacgacacagcttctgctgctcctcgtgtgggtggccgtggttggcgaggctcaaacccgcattgcatgggcccgcaccgaactgttaaacgtgtgtatgaatgcaaagcatcataaggaaaaacctgggccagaagataagctgcatgagcagtgccgcccttggcggaagaatgcgtgctgcagtaccaacacttctcaagaggcacataaggacgtgagctacctctatcgttttaattggaatcactgcggggaaatggccccggcttgcaaacgccactttattcaggatacatgtctctatgagtgctctcccaatctcggcccttggattcagcaggtggaccaatcatggagaaaagaacgggtgctcaatgtgccgttgtgcaaagaagactgcgaacagtggtgggaagactgccggacttcctacacatgtaagagcaattggcataagggttggaactggacaagcggctttaataagtgtgccgtcggcgccgcgtgccaaccatttcacttttacttccccacaccgacggtgctgtgcaacgagatttggacgcactcatacaaagtctcaaactactcacgaggtagtggtaggtgcattcaaatgtggttcgatcctgcccagggcaaccctaatgaggaagtggctaggttctacgctgctgcgatgtccggtgctggaccctgggcggcctggccctttctgcttagcctcgcccttatgcttctgtggctgctcagctag

SEQ ID NO: 117291 - DNA, 768 bp, Artificial Sequence
  Description of Artificial Sequence: Synthetic coding sequence
atggtgtggaaatggatgccattactgttactattggtgtgcgtggcaacaatgtgctccgcccaggatcgcactgatctgcttaatgtctgtatggatgccaaacaccataagacaaaacctgggccagaagacaagttgcacgaccaatgcagtccctggaaaaagaacgcctgctgcaccgcttctacatctcaggagcttcataaagatacaagtcgactctacaatttcaattgggaccactgcggcaaaatggaacctgcctgcaagagacatttcatacaggacacgtgcctgtacgagtgttctccaaatctagggccttggattcagcaggtgaaccaaagctggaggaaagaaaggttcctggatgtcccattatgtaaagaagattgccaaaggtggtgggaagattgtcacacttcccacacgtgcaagagtaattggcaccgagggtgggattggacttctggagtgaacaaatgtccggccggagcactctgtcgaacattcgaatcatattttcccaccccggccgccctctgtgaggggctttggagccactcatataaagtctctaactacagtcggggaagtggacggtgcatccagatgtggtttgatagtgctcagggaaaccctaacgaggaagttgccaggttttacgcagctgctatgcatgtgaacgcaggcgaaatgctgcacgggacagggggcctgctactgtccctggcacttatgctccaactctggctgctggggtag

SEQ ID NO: 117292 - DNA, 729 bp, Artificial Sequence
  Description of Artificial Sequence: Synthetic coding sequence
atgctgccagccgcaaccgaggtccagctgcgcctccaaggccaaaaagacatggtgtggaagtggatgcccctactcctgcttctcgtgtgcgtcgctacaatgtgcagcgcccaggatagaaccgacctgctcaacgtgtgcatggacgccaaacatcacaagacaaagccgggaccggaagataaactgcatgaccagtgcagtccttggaaaaaaaacgcctgttgcaccgcttctacgagtcaggaattgcacaaagacacatccagactctacaactttaattgggaccactgcggcaagatggagcccgcttgcgcaacatctagcaggactccagtatccatgagcgcccaccctggggctctggaccctgccggcgaatccgaactcgccaaaaatgcaagctggatgtgtccttatgcaaagcggaccgtgagcgccggaggcaggattgtgactccacccacaagagccagagctacgggtacggaggatggaactgggccccaagaactgaccagcgcccaactgggacttagtgccgcgccattatcccccacaagccccctgcagctccccttcgttaaagcatctggcgtgacccacactcgaagcgcaactaccgcggagggggccgctgccgctagcagatgtgggttgattcagcctagggcaacaccaacacggaaatggcgtggttctatgctgcagccttgtatgtag

SEQ ID NO: 117293 - DNA, 516 bp, Artificial Sequence
  Description of Artificial Sequence: Synthetic coding sequence
atggtgtggaaatggatgcctctcctactgcttctggtctgtgtggccaccatgtgctcggcacaggacagaactgatttactgaacgtgtgcatggatgcaaaacaccataagacgaaacctggccctgaagacaaacttcatgaccagtgtagcccttggaaaaagaacgcctgctgcaccgccagcaccagtcaagaactgcacaaggacacttctcgcctgtacaacttcaattgggaccattgcggcaaaatggagccagcttgcaagaggcatttcatccaagatacctgtctgtacgaatgtagtcctaaccttggtccctggatccagcaggtgaatcagtcctggcggaaggaacgattccttgatgtgccattatgcaaagaagactgccagagatggtgggaggactgtcataccagccacacctgtaaatccaattggcaccgtggatgggactggacatctggggtgaataaatgtcctgcaggagccctgtgcagaacatag

SEQ ID NO: 117294 - DNA, 2010 bp, Artificial Sequence
  Description of Artificial Sequence: Synthetic coding sequence
atggcactgcttctggtaagcttactggctttcttgagcctaggatctggttgtcaccatcggatctgccactgcagtaaccgcgtgtttctttgtcaggagtccaaagttacagagattccgtcagacctgccccgcaatgcgatcgagctgcggtttgttctgaccaaactgcgggttatccagaaaggcgctttttcaggatttggcgatctggagaaaatcgagatcagccaaaacgatgtgcttgaagtgatcgaggcagacgtgtttagcaaccttccaaagctgcacgaaatcaggattgaaaaggctaataacctgttgtatataaaccctgaagctttccagaacttgcctaacttgcagtacctcctgatatcaaataccggtattaagcacctgccggacgtacataaaattcattcgctacaaaaggtgctgctgtggttgaacaagaatggaattcaggagattcacaactgcgcatttaatggtacccaactcgatgaactgaatttgagcgataataacaacctagaagagctccccaatgatgtatttcacggcgccagtggcccggttatattggatatttcccggacaaggatccatagcctgcctagctacgggcttgaaaacttgaagaaactacgggcgcgtagcacctacaatctgaagaagttgcccacccttgagaaattggtcgctttgatggaagccagcctgacctacccaagtcactgctgcgcttttgcgaattggcgacgtcagatcagtgaactgcacccaatctgcaacaagtcgatactccgccaagaggttgattacatgactcaggctaggggccagcggtcaagcttagcggaggataacgagagttcctactcacgcggattcgacatgacctacaccgagtttgattatgatctctgcaacgaggtggtggacgtgacctgctcccccaagcctgacgccttcaacccttgtgaggacatcatggggtataacatcctgcgagtactgatctggtttatatccatattggcaattaccggcaatataatcgttctagtaatccttacaacatctcagtataaactgacagtcccgcgcttccttatgtgtaacctggctttcgctgatctctgtatcggaatttatctcctgctgatagcctcagtcgatatccacacaaagagccagtaccacaattacgctatagattggcagacgggagcaggctgcgacgctgccggcttttttacagtcttcgcgtcagaactgagcgtgtacaccctgacagcaatcaccctggaaagatggcatacaatcacacatgccatgcagctggattgcaaggtgcagttgaggcatgcagcttccgtgatggtcatgggttggatctttgccttcgcagcagctttatttcccatctttggcatctcatcatatatgaaggtgtctatctgtctgcccatggacatagactcacccttgtcccagctttacgtgatgtcactgctggtcctcaacgtgctcgccttcgtggtgatttgcggatgttacatccatatatatctcaccgtgagaaatccgaatattgtgtctagctcctcagacacacgaatcgctaaaagaatggctatgctgatattcacggacttcctctgcatggctcctataagctttttcgcgatctccgcaagcctaaaggtgcccttgattacagtgagtaaggctaagatcctgttagttttgtttcaccccatcaattcttgcgccaacccatttctgtacgctattttcactaagaatttcagacgcgattttttcatcctcctgagcaagtgtggctgttatgagatgcaggcccaaatttataggacagaaacttcatcaacagtccataacacccacccgcgaaatggccattgttcgagtgcccctcgcgtaactagcggtagcacgtacatactcgtgcccctctcgcacctggctcagaattag

SEQ ID NO: 117295 - DNA, 1902 bp, Artificial Sequence
  Description of Artificial Sequence: Synthetic coding sequence
atggcccttctgctggtcagtctgcttgcctttctgagtctgggctctggctgccaccacagaatttgtcattgctctaaccgagtgttcctttgccaggaatcaaaagtgactgaaatccctagtgatctgcccagaaatgcaattgagctacggttcgttctgaccaaattgcgcgtcatccagaagggtgccttttccgggttcggtgacctggaaaagattgagatttcacagaatgacgtgctcgaggtgatagaggccgacgtctttagcaatcttcccaagcttcacgaaattcgcattgaaaaggccaataatcttttgtacattaatcccgaagcctttcagaatctgcccaacctacaataccttctcatcagcaacaccggcatcaagcatctgcccgacgtgcataaaattcactcattacaaaaagtgctactggatatccaggacaatatcaatatccacaccattgagcgaaattcctttgtcggcctttccttcgaaagcgttattctatggctaaacaagaacggcattcaagaaatccacaattgtgctttcaatggaacccagctggacgagctgaatctgtcggataataataacttggaagaactgcctaatgacgtttttcacggagcctccggccccgtgattttgtcagagttacatccaatctgcaacaagagtattctcagacaggaagtcgactacatgacccaagcacggggccagcgatctagtctcgctgaagacaatgagtcctcgtactcccggggattcgatatgacatacactgaatttgactacgatttgtgcaatgaggtggtggacgtcacctgcagtccgaagcctgatgctttcaacccctgcgaagatattatggggtataacatcctacgtgttctgatttggtttattagtatcttggccattaccggcaacatcattgtcctcgtaatcctcactacttcccagtacaaactaacagtgccccggttcctgatgtgcaatttggctttcgccgatttatgtatcggcatctacctcttgttaattgcgagtgtggacatccatacaaaatcccaatatcacaattatgctatcgactggcagactggcgctggatgcgatgctgccggcttctttacggtatttgcttccgagctctcagtctacacattgactgccattaccctagaacgttggcacacaattacacacgccatgcagttggactgtaaggttcagctgcgacatgccgcttccgtgatggtcatgggatggatttttgccttcgcagccgccctatttcccattttcggaatttccagttacatgaaggtttccatctgtctcccgatggatattgactctcccctgagtcaactgtatgtcatgagcctcctggttcttaacgttcttgctttcgttgtaatttgcggatgttacattcatatatacctcactgttcgtaatcccaatatcgtgtcttcgagctctgacactcgcatcgcaaagcgaatggccatgctgatcttcactgattttttatgtatggctccaataagctttttcgccatctctgcaagtctgaaggtgccattgataacagtctcaaaggccaagattttgttggtcctgtttcaccccatcaacagttgcgccaacccgttcctgtacgcgattttcaccaagaactttagaagggattttttcatcctgctgagcaaatgcggctgttacgaaatgcaggcccagatctatcgcacagagacatcgtcgacagtgcataatactcaccccagaaacgggcattgcagctcagcccccagggtcactagcggctcaacttacattctcgtgcctttatcccacctcgcacagaattag

SEQ ID NO: 117296 - DNA, 2088 bp, Artificial Sequence
  Description of Artificial Sequence: Synthetic coding sequence
atggctctcctgctggtatcccttttggcttttctttccctgggtagcggctgccaccacagaatatgccattgctccaacagggtgttcctgtgtcaggagtcaaaagtgacggagattccttctgatctgccgagaaatgccatcgaactgcgcttcgttcttacgaagctgcgcgtcattcagaaaggagcatttagcgggtttggagaccttgagaagatcgagatctcccagaatgatgtgctggaggtcattgaagctgacgtattcagcaatctcccaaagctacatgagatccgaatcgagaaagcaaacaatctcctgtacatcaaccctgaagcatttcagaacctgccaaacctccaatatctattaatttcaaataccggtattaagcatttgccagatgttcacaaaattcatagcttgcaaaaagtgttattggacatacaggataacataaatatccacactattgagcgaaattcatttgtcggtctctcttttgagagcgtcatcttgtggttaaataagaatggtatccaggagattcacaattgcgcttttaacggaactcagttggacgagcttaatttaagcgataacaataatctggaggaactgccaaatgatgtctttcatggcgcttcggggcccgtaatcctcgacatttctagaactagaattcactctctcccttcttatggactagagaatctaaagaaactgcgcgctcgaagcacgtacaatctcaaaaaactcccaaccctcgaaaagctcgttgcattaatggaggcttcactgacatacccctcccactgctgtgcctttgcgaactggcgtcggcagatctcagaactccaccccatttgtaacaagagcattctgaggcaagaggtcgactatatgacacaggccaggggtcagcgaagctctcttgccgaagacaacgagagttcatactctaggggctttgatatgacctacacagagttcgattatgacctttgtaatgaggtggttgatgtgacctgctccccaaaaccagacgccttcaatccctgtgaggacataatgggctataacatactcagggttctgatatggtttatttccattctcgcgataactgggaacataatcgtcctggtaatccttacaaccagccagtataagctcactgtgcctcgattcctcatgtgcaaccttgctttcgctgatctctgcatcgggatctacctcctgctcatagctagcgtcgatattcacacaaagtcccagtaccataattacgctatcgactggcagactggcgctggatgcgatgctgctggtttcttcactgtgttcgctagtgaacttagcgtctacacactgacggccatcaccctggaaagatggcacacaatcacccatgcaatgcagttggactgtaaggtgcagttgcggcatgccgcctccgtcatggtgatggggtggatcttcgctttcgccgcggccctcttccctatcttcggcataagctcgtatatgaaggtttcaatctgtcttcccatggatattgacagtccactgtctcagctgtatgtaatgtctctccttgtgctgaatgtgttggcatttgttgtgatctgcggttgttacatccacatatatttgaccgtcaggaacccaaatatcgtttccagctctagtgacaccaggattgctaagcgcatggcgatgctgattttcacggattttttatgcatggccccgataagctttttcgcgatcagcgccagcctgaaagtgccactcattaccgtttcaaaagctaaaatcttactggtgctctttcatcctatcaattcatgtgctaacccctttctctacgccatcttcaccaagaacttccgaagagatttcttcatcctcctgagcaaatgtggctgttacgagatgcaagcccagatttacagaacggagaccagttccactgtgcacaatacacacccccgcaatggacattgttctagcgctccccgggtgacttccggctccacttacatcctcgtccctttgtcacacttagcgcagaactag

SEQ ID NO: 117297 - DNA, 1296 bp, Artificial Sequence
  Description of Artificial Sequence: Synthetic coding sequence
atggaggcctcactcacatacccttcccattgctgcgcttttgcgaactggcgccgtcaaatcagcgagttgcaccctatttgcaacaagagtatcctccgacaggaggtggattatatgacgcaggcacgcggtcagagatctagcctggccgaggataacgagtcatcatactctagaggatttgacatgacttacaccgagttcgattacgacctgtgcaacgaagtggtggacgttacctgtagtcctaagcccgacgcctttaacccatgcgaggacattatggggtacaacatcttgcgcgtgctgatttggttcatcagcattcttgcaataaccgggaatattatagtcctggtgatcctcactactagccagtataagttgactgtacctcgatttttgatgtgtaacctggcatttgctgacctatgtataggcatttacctgctgctgatagcttctgtggatatccatactaagtcccagtatcacaactacgcaatagattggcagaccggcgctggatgcgatgccgcaggattcttcacagtgtttgcctccgaactgtctgtttatacactgacggccattactttggagagatggcacaccatcacccatgccatgcagctggattgcaaggtgcaactgcgccacgccgctagtgttatggttatggggtggatcttcgcattcgctgctgccctgtttccaatatttggaatatcatcatacatgaaggtgtccatatgtctcccaatggacatcgactcacccctgagccagctgtacgtcatgagcttgctcgtcctcaatgtactggctttcgtagtaatatgcggatgttacatccatatctatcttacagtccggaaccctaatatcgtgagcagcagctcggatactagaattgcgaaacggatggccatgctcattttcactgatttcttatgtatggccccaatttcattcttcgccatcagtgcatctcttaaagtgccactgattaccgtctctaaggcaaaaatcctactagtgctgttccaccccatcaactcatgtgccaacccttttctgtatgccatcttcacaaaaaattttaggcgcgacttcttcatcctattatccaaatgtggctgttacgaaatgcaggcccaaatttatcggactgaaacaagcagcactgtgcacaatactcacccgcgcaacggacattgctcttccgcccctcgagtgacaagcggctctacctatatcctggtgccgctctctcatctcgctcaaaactag

SEQ ID NO: 117298 - DNA, 3417 bp, Artificial Sequence
  Description of Artificial Sequence: Synthetic coding sequence
atggcccccacactgtttcagaaactgttttccaaacgcactggtttgggagcacccgggcgcgatgcacgggatcctgactgcggtttctcttggcctctgccagagtttgatcctagtcaaatccggctaatagtctatcaggactgcgagcgtcgcggccgaaacgtactgttcgattcgagtgtgaagcggcgaaatgaggacatctccgtgtcgaagctgggtagtgatgcccaggttaaggtgtttgggaaatgctgtcagctcaagcctggcggcgatagctcctcttccttggattcttctgtcacttcctcctctgatatcaaggaccagtgcttaaagtaccaggggtcacgttgtagcagtgatgcaaacatgctcggcgagatgatgtttgggtcagtggccatgagctataaaggcagtacgttaaaaattcaccagataaggtcaccccctcagttgatgcttagtaaggttttcaccgctcgtaccggcagctcaatttgtggcagtcttaatacactgcaggactcacttgagtttatcaatcaggacaacaatacactgaaggccgacaacaataccgtcataaacggactgctaggaaatatcgtgcactcgaaccccatggacatgccaggtcgcgagcttaatgaggatcgggattcgggaatcgcacgctccgcttccctgtcaagcctcctgattaccccatttccatctcctaactccagccttacccgatcctgcgcctcttcttaccagcgaaggtggcgccgaagccaaaccacatctctcgaaaacggcgtgtttccccgctggagtattgaagagtcatttaatctgagtgacgagtcatgcgggcctaatcctgggatcgtccggaagaaaaagatcgcgataggcgtgatcttcagcctgagcaaagatgaggacgaaaacaacaaattcaatgaatttttcttcagtcacttccctcttttcgaaagccacatgaacaagcttaagtctgccatagagcaggctatgaaaatgagccgtaggtccgctgacgctagccagcgatctctggcctacaatagaatcgtcgatgccctaaacgaatttcggactaccatttgcaatctgtacacaatgcctcggattggggaacccgtgtggcttactatgatgtcagggacgccggaaaagaatcacctctgttatagatttatgaaggaattcactttcttgatggaaaacgcctccaagaatcagttccttcccgctctgattactgcagtgctgaccaaccatctagcatgggtccctacggtgatgcccaacggtcagccaccgataaagatctttttagaaaaacatagctcacaatccgtcgatatgttagctaagacacatccttataacccactctgggcccaattgggggacctgtatggtgcgattgggtctccggtccgactggcgcgaaccgtggtggtgggaaaaaggcaggacatggtgcaacggctcctatacttcctgacctactttattcggtgtagcgaattacaggagacacacttgctggagaacggagaagacgaagctattgtgatgccaggaaccgtgataactactacactcgagaaaggcgagattgaggaaagtgagtatgtgctcgtgactatgcataggaacaagagtagcttgctgttcaaggaatccgaagaaatcagaaccccgaactgtaactgcaaatattgctcacatccattactgggacaaaacgtggaaaatatatctcagcaagaacgtgaagatattcaaaatagtagcaaggaactgctcggtattagtgatgagtgtcagatgatctcacctagtgattgccaggaagagaatgctgtggacgtcaaacagtaccgggacaagttgagaacctgtttcgacgccaaattagaaactgttgtctgtacaggctcagtacccgttgataagtgcgcactctccgagagcggcctggagagtaccgaggagacatggcagtctgagaagctgttagatagcgactcccacaccgggaaagccatgaggagcaccggaatggtagtggagaaaaaacccccagataagatcgttcctgcgagtttcagctgtgaagccgcacagaccaaggtgacctttctaatcggggactcaatgtctcccgattctgacaccgaattgcggtctcaggctgtcgtggaccaaattaccaggcaccacactaagccattaaaggaggagcgcggggccatcgaccaacaccaggaaactaagcagaccacgaaggaccagagcggagaatccgatactcagaatatggtctccgaagagccctgtgaactgccttgttggaatcattcagatcccgaatccatgagcttattcgacgagtactttaacgatgatagtattgagacccgaaccattgatgatgtgccgttcaagacaagcactgatagtaaggatcactgttgcatgttggaattcagcaagattttgtgtaccaagaataataaacagaacaacgaattttgcaaatgcatcgagacagtaccacaggactcctgcaaaacttgtttcccgcagcaagaccagcgcgacacactcagtatcttggttccacacggtgataaggaatcttctgacaaaaagatagcagtgggaaccgagtgggacatcccgcgtaatgaaagttccgattccgctctcggcgattctgagtccgaagacaccggacacgatatgacacgccaggtgtcctcctactatggcggcgagcaggaggactgggccgaagaggacgaaattccctttccaggtagcaagcttattgaagtctctgcggtacagcccaacatcgctaacttcgggcggtccctcctcgggggatactgctcctcgtatgtgcccgactttgttctacaaggtatagggtctgatgaaagatttcgccagtgcctgatgagtgacctgtctcacgccgtccagcaccctgtgctggatgagcccatagcagaagcagtctgtatcatcgccgatatggataaatggacagttcaggtagcgtcctcccagcgaagagttaccgataacaaactgggaaaggaggtcctggtgagctcactggtctctaacctgctccattcgaccctgcagttgtataaacacaatttgagtccaaacttctgcgtgatgcatctcgaggatcgactccaggaactgtactttaagtccaagatgctgagtgaatacctgcgtgggcagatgagagtccatgttaaggaactaggagtggtgctgggtatcgagagttctgatctcccactgctcgctgccgtggcgtccacccatagcccatacgtggcccagatcctgctgtag

SEQ ID NO: 117299 - DNA, 3501 bp, Artificial Sequence
  Description of Artificial Sequence: Synthetic coding sequence
atggcacccactttatttcagaagctcttttcaaaaaggaccggactgggggcgcccgggcgcgacgccagagatcctgattgtggatttagctggcccctgccagaattcgacccatctcagatccgcctgatcgtctatcaggattgcgaacggagagggcggaatgtgctctttgattcctccgtgaagagaaggaatgaagatatctcagttagcaaattggggagtgacgcgcaggtgaaggtttttggcaaatgttgtcaactgaaacctgggggggattcttctagttcactggactcttcagtaacttctagctctgatatcaaggaccaatgcctgaagtatcaagggtctaggtgtagctcagatgcgaatatgctgggcgaaatgatgtttggcagtgtagccatgtcttacaaaggctctacgctgaaaatccaccagattcgaagccctccacagttgatgctgtctaaggtcttcaccgcgcgcaccggctcatctatctgtgggagcctgaacacgctccaggatagtcttgaattcatcaaccaggacaacaacaccctgaaggccgataacaacaccgtgatcaacggacttctaggtaatatcggcctctctcagttctgtagcccaagaagggcttttagcgagcaggggcctttgagattgattaggtcagcatctttttttgccgtgcattctaacccgatggatatgcccggacgggagctaaacgaagatcgtgacagcgggatagctaggagcgccagtctcagttcactgctaatcactcccttcccctcccctaatagcagcctcaccagatcatgcgctagcagctaccagaggagatggagacgctcccagaccacgagcctggagaatggcgtattcccacgttggtcgattgaggaaagcttcaatctctccgatgagtcctgcggccctaaccccggcattgtgcggaaaaaaaaaatcgcaattggggtcatattttctcttagcaaagacgaagacgagaacaacaagttcaatgaattcttttttagccattttcccttattcgagtcccacatgaataagttgaaatcagcgatcgaacaagcaatgaaaatgtcacggaggtccgcagacgcatctcagaggtctctcgcgtacaatagaatcgtggacgcattgaacgaatttaggacaaccatctgcaacctgtacactatgccccgtatcggcgaaccagtgtggctgactatgatgtctggaacaccggagaagaatcacctgtgttaccggtttatgaaggagtttacttttctcatggaaaacgcttctaagaaccagtttctgccagccttaatcacagctgtcttgacaaatcatctggcatgggtgcccaccgtgatgcccaacggccagccccctattaaaatttttctggagaaacattcttcccagagcgtggatatgctcgcgaaaacgcacccatacaacccgctgtgggcccagctcggtgatctttatggggccatcgggtcaccagttcgccttgcacggaccgtggtggtggggaaaaggcaggacatggtacagcgcttactttactttcttacttacttcatcagatgcagcgaactgcaggagacccacctgctcgaaaatggggaagacgaagccatcgtgatgcccggaaccgtgatcactactaccctggagaaaggagaaatcgaggagtcagagtatgtccttgtcactatgcacaggaataagtcgtcattgctgttcaaggagtccgaggagatcagaacaccaaactgcaattgtaagtattgtagccacccactgttgggacagaatgttgagaatatatcacagcaggaaagggaagacatccagaattcgtctaaggagttactggggattagtgatgagtgccagatgattagcccaagtgactgccaggaggagaatgcagttgacgtgaagcagtatcgcgacaaattacggacatgcttcgatgcaaagctggagaccgtcgtgtgcactggcagcgtgcccgttgataaatgcgctctgtcggaatctggattagagtccacggaggaaacttggcaatctgaaaagctactggactctgattcgcatactggcaaagccatgcgaagcacaggaatggtggtggagaaaaagcctccagacaagatcgttcccgcctcattcagctgtgaggccgcgcagacaaaggtaacatttttgatcggagactctatgagcccagactcagataccgagttgcgaagccaagcagtggtcgatcagattacacgccaccacaccaagcccctgaaggaagaaagaggggctatagaccagcatcaggaaacgaagcagacaacaaaggatcagtccggagagagcgatacacagaatatggtgtcagaagagccttgcgagttgccttgttggaaccattccgaccctgagagtatgtctttgtttgacgagtactttaatgacgacagtattgaaacacgtacaattgacgacgttccttttaagaccagcaccgactccaaggatcactgttgcatgcttgagtttagtaagatattgtgcactaagaacaacaaacagaataatgagttttgtaagtgcatcgaaacagtccctcaggactcttgtaagacctgcttcccccagcaggatcagcgagacaccctgtctatcctcgtaccgcatggagataaagaatccagcgataaaaaaatagctgtgggaaccgagtgggatatcccccggaacgaaagctcagattccgctctgggagattcggagagtgaagatactgggcacgatatgacccgtcaagtgtcctcctactatgggggtgagcaggaggactgggccgaggaggacgagatccccttccctggctccaagctcatagaagtgtctgccgtacaacccaacattgctaacttcggcaggtcacttctgggtggttattgctcctcatatgttcccgacttcgtgcttcaaggtatcggatccgacgagcgattccggcagtgcctgatgagcgacctcagtcacgctgttcagcaccccgtgctggatgagcccatcgctgaggccgtgtgcataatcgccgatatggacaaatggaccgttcaggtcgccagctctcaacgcagggtcaccgataacaagttaggcaaagaggtccttgtgtctagcttggtgagcaacttgctacattccactcttcagctgtacaagcataacttgtcccccaacttctgtgttatgcacctcgaggatagactccaggagctttactttaaatctaaaatgctctcagagtatctgcgcggccagatgcgggtgcacgtgaaagaactgggtgtggtgctgggcatagagtcatccgacctgcccctccttgctgccgttgccagtacacatagtccctacgtcgctcagatattgttatag

SEQ ID NO: 117300 - DNA, 1527 bp, Artificial Sequence
  Description of Artificial Sequence: Synthetic coding sequence
atggctccaacactgtttcaaaaactgttcagtaaacgcacgggactgggcgcacctggacgagacgcccgtgatccagactgtggcttttcttggccgctgcccgagttcgatcccagccagatcaggctgatcgtctaccaggactgcgaaaggaggggacgaaatgtgctgtttgatagtagtgttaagcgccggaatgaggatattagcgtgtctaaactgggttctgatgcccaggttaaggtctttgggaaatgttgtcagctgaagccaggcggagactcctcctcgtccctggattctagtgtcacatcctcctcagatatcaaggaccagtgtcttaagtaccagggctctagatgctcctcagatgccaacatgctcggcgagatgatgtttggatccgtggctatgtcctacaagggctctactcttaaaattcatcagatccgtagccctccgcagctcatgctgagcaaggtgttcacagcaaggacaggatcaagtatctgtgggtcccttaacacgctccaagacagtctcgaattcattaaccaggacaacaacactctgaaggccgataataacaccgtgatcaacgggctgctcggaaatattggcctatcgcaattttgtagcccccgacgagccttcagcgagcagggaccactaagactgataagaagcgctagctttttcgcagttcacagcaatcccatggatatgcccggtagagagttgaacgaggatcgtgacagcgggatcgcacggtctgcctccttgtcctcgctgctaatcacgcccttcccttctcccaacagtagcctgacaagaagctgtgcctctagctatcagcgccggtggcgcagaagtcagactacctccttggagaacggagtgttcccacgatggtcgattgaggaatcattcaatttgagcgatgagtcttgcggcccgaacccgggtattgtccgcaagaagaagatcgccatcggagtaatcttttcactcagcaaggatgaggatgaaaacaacaaatttaacgagtttttcttctctcatttccctttgtttgagtcacacatgaataagctgaaatctgccattgagcaagcaatgaaaatgtcacggcggtccgccgatgcttctcagaggtccctcgcatacaaccggatcgtagacgccttgaacgagttccgcacgactatttgtaacctgtacactatgcccaggatcggcgaacctgtgtggcttacaatgatgtcaggcacacccgaaaagaaccatctgtgttatcgctttatgaaggaattcacatttctgatggagaatgctagtaaaaaccagtttcttcccgctcttatcacagccgtactaacaaatcacctcgcgtgggttcccaccgttatgcctaacggtcagcctcccatcaagatcttcctagagaagcattcttcacaatctgtcgatatgctggccaaaactcatccttacaacccgctgtgggcacaactcggcatgtag

SEQ ID NO: 117301 - DNA, 2757 bp, Artificial Sequence
  Description of Artificial Sequence: Synthetic coding sequence
atggatatgcccgggcgagagttaaatgaagatcgcgattcaggtatcgcccggagtgcaagcttgtccagtttattgattactcctttcccaagcccaaatagctcactcacgcgcagctgcgcctcaagttatcagagaagatggcgccgatctcaaaccacctctctggagaatggcgtctttcccaggtggtctatcgaagaatcctttaatttatccgatgagtcttgcgggcctaatcctggcatcgtgcggaaaaaaaagatcgctatcggtgtaatattttctctcagcaaggatgaagacgagaataataaatttaatgagttctttttctctcatttccctctgttcgagagtcacatgaataagttgaagtccgcaatcgagcaggctatgaaaatgtctaggaggtcagctgacgcctcccagaggagcctggcatacaaccgaattgtagacgcgctcaatgaatttcgaaccacaatctgtaatctgtacacgatgccacgcatcggtgagccggtgtggctgacaatgatgtccggtactcctgagaaaaatcacctttgttatcggtttatgaaagagttcacgtttctcatggaaaacgcaagcaagaaccaatttctgccagctctcattacagcagttttgacaaaccacctcgcttgggttcccacggtcatgcccaacggtcaaccccccatcaagatatttctggaaaaacatagctcccagagcgtagatatgctcgctaaaacccatccttacaatccactctgggctcagctgggagatttgtacggggctatcggcagccctgttagactggcccggacagtcgtggttgggaagcgccaagacatggtccaaagactgctgtactttctgacttactttatcaggtgctctgagttgcaggagacacatcttctggaaaacggcgaagacgaagccatcgttatgcctgggacggtaatcacaactacattggagaagggcgagattgaggagtccgagtacgtgctggtgctcttattcaaagaaagcgaagagatccgtactccaaattgcaactgtaagtactgttcacatccgctcctggggcagaacgtggagaatatctctcagcaggaaagagaagacatccagaacagctcaaaggagctcctcgggatctcggatgagtgtcagatgatctccccctccgactgtcaggaggagaatgctgttgatgtcaagcagtatcgtgacaagttgagaacctgctttgatgcaaagctggagaccgtggtctgtaccggctctgtacctgtggacaaatgcgccctgtcagagtctggcttagaatcaacagaagaaacttggcaaagtgagaaacttctagatagtgactcacacactgggaaggccatgagaagcacggggatggttgtggaaaagaagccaccagacaaaattgtacctgccagtttcagttgtgaggcagcacagactaaggtcaccttcctgattggtgattctatgtctcctgatagcgacacagaactgcgctcccaagccgtggtcgatcagatcacaaggcatcataccaagccactcaaagaggagcgcggtgccattgaccaacatcaagagacaaaacagacaactaaggaccagtctggggagtccgacacccagaacatggtaagtgaagagccatgtgaactcccatgctggaatcattccgaccccgaatcgatgagtctgttcgacgagtatttcaacgacgattctatcgaaactagaacaatcgatgatgtgccgtttaagactagtacagactcaaaagatcactgttgtatgctggaattcagtaagatcctatgtaccaagaacaataagcaaaataatgaattctgtaagtgtatcgagacagtcccacaggattcgtgtaaaacctgttttcctcaacaggaccagcgcgacaccctatcaatattagtcccccatggcgataaagagagttcagacaagaaaattgcggtgggcacagagtgggacattcctcgcaacgaatccagcgacagtgccctgggtgactctgagtctgaggacaccggtcatgacatgacgaggcaggtatcgagctactacgggggggagcaggaggattgggcagaggaagacgagatcccattccctggaagcaagcttatcgaagtgtcagcagtccaacccaatattgctaattttggaaggtctcttctcggtggctactgttcaagctatgtgcctgactttgttctacagggaatcggctcagacgaacggtttcggcagtgcctcatgtcagatttgtcccacgccgtgcaacaccctgtgctggacgagcccattgcagaggctgtttgtatcattgcggacatggataagtggactgtccaggtcgcgagttcccagagacgcgtgaccgacaacaagctggggaaggaagtgctagtctcctctcttgttagcaacttgctgcactccaccctgcagctgtataagcacaacctgtcccccaacttttgtgttatgcacctggaggacagattgcaagagctgtattttaagagcaaaatgctgagcgagtatctgcgagggcaaatgcgcgtgcacgttaaagaactaggcgtggtccttggaatcgaatcatcagaccttcccctactggctgcggtcgccagcacacatagtccttacgtcgcccagattctgctgtag

SEQ ID NO: 117302 - DNA, 3345 bp, Artificial Sequence
  Description of Artificial Sequence: Synthetic coding sequence
atggcgccaacacttctccagaagctgttcaacaagcgcgggtcttccggctcttctgccgcagcctccgcacaaggcagggccccaaaggaagggcccgcatttagttggagctgtagcgagttcgacttgaacgagatcaggttaatcgtctatcaggactgcgatcgcagaggcaggcaggtgctcttcgactcaaaggcagtccagaagatcgaggaggtgaccgctcagaaaaccgaagacgttcccattaaaatctccgcaaagtgttgtcaaggatcttcttcagtctcttcatcctcttctagtagcattagttcacacagctcatcaggggggtcttcccaccatgccaaagagcaactcccaaagtaccagtacacccgccccgcgtccgacgtcaatatgcttggtgagatgatgttcggctcagttgcaatgagttacaaaggctcaaccctgaaaatccactatattcgcagtcctccccagttgatgatctcaaaagtcttctccgccaggatgggcagtttttgcggctctacaaacaatcttcaggactcattcgagtacatcaatcaggatccaaatctcgggaaactaaataccaaccagaattctctgggaccttgccggaccgggagcaacctggcccatagtaccccagttgatatgccctctagaggacagaacgaagacagagatagcggaatagcccgatctgcatccttaagttccctcctgattacacccttcccgtccccatccagctcaacttccagctcttctagttatcagagacggtggctgcggtcccagacaacctccctcgagaacggcattattccaaggcgcagtaccgacgagaccttttcattggccgaggaaacatgctcctccaaccctgcaatggttcgccggaaaaagattgcaatatctatcatcttttccttgtgcgagaaagaggaagcccagcgcaactttcaggacttcttcttcagccacttccctctcttcgaaagccatatgaataggctgaaatcagctatcgaaaaagcaatgataagctgcagaaaaatcgccgagagtagcttgcgggttcagttctacgtgtctagactaatggaggcacttggagaatttcgcggcaccatttggaatctgtacagcgtgccacgaatcgcagagccggtctggcttaccatgatgtctggcactctagagaagaatcaactgtgccaacgatttcttaaggaattcacacttcttatcgagcagatcaacaagaaccagttcttcgccgctttgttgactgccgtgcttacataccatttggcatgggtgcctaccgttatgcctgtggaccacccaccaatcaaagcgttctctgagaaacgcacatctcagtctgttaatatgcttgcaaaaacccatccctacaaccccttgtgggcccagctgggagacctgtatggcgctatcggttctccagtgcgcttgactaggaccgtagtcgtaggcaaacagaaagacctagttcagcggatcctgtacgtgcttacttactttcttcgctgcagcgaactccaggagaatcaactcacctggagtggcaaccatggcgagggcgaccaggtcctgaatggctcgaaaatcatcactgccttagagaagggtgaggtggaggagagcgagtatgtggttatcacagtgcggaatgaaccagctctggtgccccctatactcccgcccaccgccgctgagcggcacaacccatggccgacgggatttcctgaatgccctgaaggcactgatagccgcgacctgggcctcaaacctgacaaagaagcaaacagacgcccagaacagggatccgaagcttgttcagcgggctgtttagggccagctagcgacgcaagttggaaaccacagaacgccttttgcggcgatgagaagaataaagaagctccgcaggatggctccagcaggttgccgtcatgtgaagttctaggagcgggcatgaaaatggatcaacaggcagtctgcgaactacttaaagtcgaaatgcctactcggctgcccgatcgttctgtggcttggccatgtcctgatcgacaccttagggagaaacctagccttgagaaggtgacatttcagataggcagtttcgcgagccccgagtcagactttgaaagccggatgaaaaaaatggaggaaagagttaaagcctgcgggccaagcctggaggcatctgaggcagctgacgtagcccaagatccacaggttagtcgctcacccttcaaaccagggtttcaggaaaacgtgtgctgtcctcaaaaccgcttgtccgaaggcgacgaaggcgagtccgataaaggatttgcagaggacaggggctcccgcaacgatatggccgctgacattgcagggcaactttctcacgcagcggatcttggcaccgctagccacggtgccggcgggacaggtggcaggcggctggaagcgaccaggggcctgtatgtgaaggccgctgaaggacccgtcttggagcccgttgcaccacgttgcgtgcagagaggtccggggcttgtggcaggagcaaatattccgtgcggcgacgacaacaagaaggccaactttagaaccgaaggggatatcccccggaatgaatcgagtgattctgcgcttggagactccgacgatgaggcctgtgcttcagccatgttggatctggggcacggaggcgaccgcaccggggggagtctcgaagtggagctccctcttcctcgatcccagagcatcagtacccaaaacgttagaaatttcggtcgttcgttgctggcaggatactgtccaacttatatgcccgacctggtgcttcatgggactggctctgatgagaaacttaaacagtgcctggtagcggacttggttcatactgtgcaccacccagtcttggacgagccgattgctgaagcagtttgtatcatcgctgatacagataagtggtctgtacaagtggccacgtctcagcgtaaagttaccgacaacatgaagctgggacaggacgtgctggtgagcagccaggtgagcagcctgttgcagtctatattgcagctgtataagctgcacctgcctgcagatttctgcattatgcatctggaagatcgtctccaggagatgtacctgaaatctaaaatgctttccgaatacctgaggggtcatacaagggtccacgtgaaagagctgggagtggtcctcggtattgaaagtaatgatctgccgctcctcaccgcaattgcatcgacacattccccatacgtggcccagatactcctgtag

SEQ ID NO: 117303 - DNA, 3414 bp, Artificial Sequence
  Description of Artificial Sequence: Synthetic coding sequence
atgtgcggaggcacagcgaacaccactaaccagccagagagttggcaggactctgccaggtgcgtgagtgacgctgtacccggagccggtaggatttaccgagccctgttgtgcacaaagatcaagaagcataccggagtggacagaagcactgaccatacagaactcgataattcctggagctgctctgagttcgaccttaacgaaatcaggctgatcgtttatcaggattgcgaccggcggggcagacaggttctgttcgacagtaaggctgtgcagaagatcgaggaggtaacagctcagaagacagaagatgtgcctatcaagatctcagccaaatgttgccagggatcatctagcgttagctccagttctagctcctcaatctccagccactcctctagcggagggagcagtcaccacgctaaagaacagctccccaagtatcaatatacgagacccgcctcagacgtcaatatgttgggcgagatgatgtttggcagcgtggccatgtcctacaagggttcaacactgaaaattcactatatccggtccccaccccaacttatgatcagcaaggttttcagtgcacgaatgggctccttttgtgggtcaaccaataacctgcaggactcctttgagtacattaatcaggaccccaacctgggcaaactgaatacaaatcagaactctcttggaccttgcaggacgggaagcaatttagcacactccacacctgtagatatgccctcacggggccagaacgaggatcgcgactccggcatcgcacggtcagcctcgctgagtagcctattgatcacaccatttccaagtcccagcagctccactagttcttcgagctcttaccagcggaggtggctgcgctcacaaacaacgagcctagaaaacggcatcattccaagacgtagcactgatgagacttttagtctggcagaagagacatgttcgagcaatcctgcaatggttaggcgcaagaaaatcgccatctccattatcttcagcctttgtgagaaagaggaggctcagagaaattttcaggatttttttttctcccactttcccctgtttgaatctcacatgaatcggctgaagagcgccattgagaaagctatgattagctgcaggaaaatcgccgaaagttccctgagagttcagttctacgtgagccgcctgatggaagccctgggagaattccgaggcaccatctggaacctctactccgtgcctcgcatcgcagaacctgtatggctcacaatgatgtcaggcactttggagaagaatcagctgtgtcagcgcttccttaaggagttcacacttttgatcgaacaaatcaacaaaaaccagttcttcgctgctcttttgacagctgtgctgacataccacctggcctgggtaccaacagtgatgcccgtggaccatcccccgatcaaggcattctccgagaaaagaacatcacagtccgtgaacatgttggcgaaaacccacccctataatcccctgtgggcacagcttggagacttgtacggagccattgggtcacccgttcgactaacccgcacagtcgtcgttggaaagcagaaagacctggttcagaggattctgtatgtgttaacctattttcttcgctgttctgaactgcaggaaaaccagctgacctggtcgggaaaccacggagaaggcgatcaggtgctgaacggttctaagattatcaccgcccttgaaaaaggcgaagtggaggagagtgagtacgttgtgatcacggttcgaaatgaaccagctttggtgcctcctatcctgccacctaccgcagccgagaggcacaacccctggcccaccggattccccgaatgcccagaaggcacggattcgcgggacctcggactcaagccagataaggaagctaaccgacgccctgagcagggatccgaggcctgctccgctggctgtctcggaccagcttccgatgcctcttggaaaccacagaatgccttctgtggggacgagaaaaataaagaggccccccaagacggtagtagcagactccccagctgcgaggttctcggagctggtatgaaaatggatcaacaagccgtctgcgagctgctaaaggtggaaatgccaaccaggctccccgacaggagcgtggcctggccatgtccagaccgccacttaagagaaaaaccttccctcgagaaagtgacgttccagattggttcttttgcaagccccgaatccgattttgaatctcgcatgaagaagatggaggaacgggtgaaagcttgtggccccagtctagaggccagtgaggccgccgacgtggcacaagacccgcaagtgtccaggtccccgtttaaacccggattccaggaaaacgtctgctgccctcagaataggctcagtgagggagatgagggcgagtccgacaaaggcttcgcggaggatagaggcagccgaaacgatatggccgcagatatcgcggggcagctgtcgcacgccgccgatctgggtacagccagtcatggagctggcggtacagggggtcgaagacttgaagcaacgagaggcttgtatgttaaggcggcagaaggacccgtgttggagcccgttgcccctcggtgcgtgcagcgcggtcccggcctggtggccggggccaacataccttgtggtgatgataataagaaggccaatttccggactgagggggacatcccaaggaacgagtcctctgattctgcattgggggacagtgacgacgaggcatgcgcaagcgccatgctcgatttggggcatggcggagataggacgggaggtagcttggaggttgagctgccactgccccggtctcagtccataagtacccagaacgttaggaattttggtcggtccctcctggcaggatactgccccacgtatatgcccgacctggtgctgcatggcactggctccgatgaaaagttgaagcagtgtcttgtcgccgacctggtgcataccgtgcaccaccctgtgctcgatgagcccattgcagaggcagtgtgtatcatcgccgataccgacaagtggtccgtgcaggttgctacctcccagcggaaggtcactgacaatatgaagctcggccaggatgtgcttgtcagttcccaagtcagcagcttattacaatccatcctccaactctacaaacttcatctgcctgccgacttttgtatcatgcacctggaggatagattacaagaaatgtatctgaagtccaagatgctttctgagtatctccggggccataccagagtccatgtgaaagagctgggcgttgtgctgggaatcgagagcaacgatctccccctgctgacagctattgcatctactcattctccgtatgtggcgcagatattgttatag

SEQ ID NO: 117304 - DNA, 2022 bp, Artificial Sequence
  Description of Artificial Sequence: Synthetic coding sequence
atgtgcggcgggactgccaacaccaccaatcaaccagaaagctggcaggactcagccaggtgcgtcagtgatgcggtccccggggccggaaggatctatagggccttattgtgtacaaagatcaagaaacacacgggtgtcgatcgcagcacagatcatactgagctagacaactcctggtcttgctctgagttcgatcttaacgagattcgccttattgtgtatcaggactgcgaccggcggggtcgtcaagtactgttcgactcaaaagccgttcagaaaatcgaagaggtgaccgcgcagaagaccgaggacgtgccgatcaagatttccgccaaatgttgccaaggctcctcctctgtgagctctagctcaagcagttcaatctctagccattcttcgagcggtggttccagccaccacgctaaagaacagctgcccaagtaccagtacacccgtcctgcaagcgatgtgaatatgctgggagagatgatgttcggtagtgtcgccatgagctacaaagggagcaccctgaaaatacattacatccggtcgcccccacagttgatgatatcaaaggtattttccgctcgcatgggcagcttttgcggcagtaccaataacctgcaggacagctttgagtacattaaccaggaccctaacctggggaagctgaataccaatcagaatagcctcgggccgtgtaggacaggctccaacctggcgcattcaacacctgtggatatgcctagccggggccagaatgaagatagagattcaggcatagcgcggtccgcatccctgtcttccctgctcatcacacccttccctagtccgtcttcttcaacatcatcctccagtagctatcagcggcggtggctccgttctcaaacaacttccctggagaacggaatcatacctcggcgcagcaccgacgaaactttttctctcgccgaggaaacctgtagcagtaaccccgcaatggttaggaggaagaagattgcgatcagtatcattttttctctgtgtgaaaaagaggaggcacagcgcaacttccaggatttcttcttcagtcacttcccactgtttgaaagtcacatgaaccgccttaagtctgctattgagaaggctatgatttcttgcagaaagatcgccgaaagcagcctgagagttcagttttatgtaagtcgcctgatggaagcactgggagaattccgtggaaccatatggaacttgtattccgtgcctcgtattgctgaaccggtatggctcacaatgatgagcggtaccctcgagaaaaatcagttatgtcagagatttcttaaagaattcaccctcctgatcgagcagatcaacaaaaatcagttctttgcagcccttctgaccgccgttttgacgtaccacctggcctgggtaccaacggtgatgccagttgaccaccccccaataaaagcttttagcgagaagcgcaccagccagagcgtgaacatgcttgctaaaacacacccctacaaccctctctgggcccagttaggtgacctttatggggcgatcggctcccccgtgcgcctgacccgaacggtggtcgtgggaaagcagaaggacctggtgcagcgaatcctgtacgtgttgacgtactttctccgctgctcagaactccaagagaatcagctgacttggtccgggaaccacggcgagggagaccaggtgctgaacggcagcaagattatcaccgctcttgagaagggggaagtggaggagagcgagtacgtggttatcaccgtgcgcaatgaaccggcactggtgcctccaatcctcccaccaaccgcagctgagcggcataacccctggccaacgggctttcctgaatgtcccgaggggactgactctcgggacctgggcctgaaacctgataaagaagccaatcgacgacccgagcaaggctccgaggcatgctcggccgggtgcctcgggcccgcttccgacgcatcatggaagccacaaaatgcattttgcggatag

SEQ ID NO: 117305 - DNA, 660 bp, Artificial Sequence
  Description of Artificial Sequence: Synthetic coding sequence
atggatccggccccaggggtcttagatccgagagctgccccccctgccctgttggggacacctcaggctgaagtgctcgaggatgtcctgagggaacagttcggacccctgccacagttagccgcagtgtgcagactgaagaggctgccgtctggggggtattcctccacggaaaatctgcagctcgtgcttgaacgtcgacgtgttgccaatgccaaagaaagagaacggattaagaacttaaatcgagggttcgccagactgaaagccctagtgccattcctgccgcagtctagaaagccgtccaaagtggatatcctgaaaggagccaccgaatatatacaggtcctcagcgatttattggaaggcgctaaagactcaaagaagcaggacccggatgaacaaagctatagtaacaacagctctgagagccacactagctcagctcgtcaactctcgagaaatataacgcagcacatcagctgtgccttcggcttaaaaaatgaggaggagggtccatgggccgacggcggtagcggtgagccagcgcacgcctgccgccatagcgtcatgtcaaccacggaaataatcagccccactaggtctcttgatcgctttccagaggtcgagcttctctcacataggttgccccaggtgtag

SEQ ID NO: 117306 - DNA, 1035 bp, Artificial Sequence
  Description of Artificial Sequence: Synthetic coding sequence
atggtgcgagctagacatcaaccgggaggattgtgtttactgttgctcctcctatgtcaatttatggaggatcgctccgctcaagctggtaactgctggctgcgccaggccaagaacgggagatgccaagtgttatacaagaccgagcttagcaaagaggaatgttgctcaacgggccgactgtccaccagctggacagaggaagatgtcaatgacaataccctttttaagtggatgatatttaacgggggggcccctaactgtattccttgcaaagagacttgcgagaacgtggactgcggacccggaaagaagtgtcgaatgaacaagaagaataaaccaagatgcgtgtgtgccccagattgctctaatattacctggaagggccccgtgtgtggcctagacggcaagacctataggaacgagtgtgctttgttaaaggccagatgcaaagaacagcccgagttagaggtccaataccagggaagatgtaagaagacctgcagggacgtcttttgcccaggatcctctacttgcgtggtggatcagaccaataacgcctactgtgtaacctgcaatcgaatatgtcctgaacccgcatcctccgagcagtacctgtgcgggaatgacggtgttacctactcctcagcctgccatctgcgaaaggctacttgtctgttggggcggagcattggcctcgcttatgagggcaagtgtattaaggcaaagtcttgcgaggacattcagtgcacaggaggtaagaaatgtctctgggatttcaaagtggggcgcggccgatgtagtctgtgcgatgaactttgccccgatagcaaatctgacgagccagtctgcgccagcgataacgctacttatgcttcagaatgcgctatgaaggaagccgcttgttcttcaggggtcctgctggaggtgaagcatagcggctcgtgtaactccatatcggaggatacagaagaagaggaggaggatgaagaccaagactattcttttcccatatcttctatactggaatggtag

SEQ ID NO: 117307 - DNA, 954 bp, Artificial Sequence
  Description of Artificial Sequence: Synthetic coding sequence
atggtgagggccaggcaccagccagggggactatgtcttctgctgctgctattgtgtcagttcatggaggaccgaagcgcacaagcagggaattgctggttgcggcaagcaaagaacgggcgttgccaggttctgtataaaaccgagctttcaaaggaggagtgctgtagtaccggccgcctgagcacaagctggacagaagaggatgtgaatgataacacgttatttaaatggatgatcttcaatggaggggcccccaactgtatcccttgcaaggagacttgcgaaaatgtggattgcggtcctgggaaaaaatgcagaatgaacaagaagaataaacctagatgcgtgtgcgccccagattgctccaacattacgtggaagggacccgtttgcggcctggatggcaagacttaccggaacgagtgtgccctcctgaaagctcgttgcaaagagcagcccgaacttgaagtgcagtatcaggggcggtgcaagaagacctgccgcgatgttttttgccccggcagttctacctgtgtcgttgatcagaccaataatgcgtattgcgtgacctgcaatcggatttgccctgagcctgccagcagtgagcagtacctgtgcggcaacgacggcgttacctactcaagtgcctgtcacctcaggaaggcaacatgcctgctgggaaggagcatcggactggcctatgaaggcaagtgcattaaagcaaaatcttgtgaagatatacagtgcaccggaggaaagaaatgtctgtgggactttaaggtaggccgcgggaggtgtagtctgtgcgacgaattatgtcctgacagtaagtccgacgaacctgtctgtgccagtgacaacgccacgtatgctagcgagtgcgcaatgaaggaagcggcatgcagcagcggtgttctgttggaagtgaagcactcaggatcttgtaattag

SEQ ID NO: 117308 - DNA, 1023 bp, Artificial Sequence
  Description of Artificial Sequence: Synthetic coding sequence
atggtgcgcgccagacaccagcccggagggctgtgtctcctgctgctcctcctatgtcagttcatggaggaccgctccgcacaggccggaaattgctggctgagacaagccaaaaatggacggtgtcaggtactttataaaacagaactgtccaaggaggagtgctgttcgaccggccgcttaagcacatcttggacagaagaagatgtgaatgacaatactctgttcaagtggatgatttttaacggcggcgctcccaattgtattccctgcaaggagacttgtgaaaacgtggactgtggtcccggcaagaagtgcagaatgaacaagaagaacaagccacgatgtgtttgtgcaccggattgcagtaacatcacttggaaaggtcctgtgtgcggcctggacggtaaaacttaccggaatgaatgtgccctgcttaaggctcgttgcaaagagcagccagaactggaagtgcagtatcagggccggtgtaagaaaacctgccgtgatgtgttctgccctggatcttctacatgcgtcgtggatcaaactaacaacgcctattgcgtgacctgtaaccgcatatgccccgagccagccagttctgaacaatacctctgtggaaatgatggggttacttactccagcgcatgtcatctgcgtaaagccacttgcctgttgggacggtccatcggccttgcttatgagggcaagtgcataaaagctaaaagctgcgaggatattcagtgtacagggggcaagaaatgcctgtgggacttcaaagtcggccggggacgttgctcactttgtgacgagctctgtcccgacagcaagtcagacgaacctgtgtgcgcctcagacaatgctacatacgcatctgaatgcgcaatgaaagaagccgcctgtagttcaggggtgttgctggaggtcaaacattctggctcctgtaattacacagaggaggaggaggaggatgaggaccaggactacagtttccccatctcttcaattcttgagtggtag

SEQ ID NO: 117309 - DNA, 927 bp, Artificial Sequence
  Description of Artificial Sequence: Synthetic coding sequence
atgtggaagcgttggcttgcactagctctggccttggtggcagtcgcttgggtccgtgccgaagaggaactgcgcagcaaaagcaaaatctgcgccaatgtgttctgcggagcaggccgggagtgcgccgtcacagaaaaaggagaaccaacatgcctgtgcatcgagcagtgcaaaccgcataaaaggccagtgtgtggctcaaacgggaaaacttaccttaaccattgcgaattacaccgtgatgcctgcttgacaggaagtaagatccaggttgattacgatggccattgcaaggagaaaaagtcagtatcgccctcagcatcccctgtcgtgtgttatcagtctaaccgtgacgagctgcgaaggcgtattatccagtggcttgaggcagagataatcccagacgggtggttttccaaggggtcaaactactcagaaatccttgacaagtatttcaagaattttgacaacggagactcgcgcctggacagctccgagtttctgaagttcgttgaacagaatgagacggctataaacatcacgacttatccagatcaggaaaacaacaaacttctcaggggattgtgtgttgacgccttgatcgagctttcagatgagaatgctgattggaagttgtcctttcaggagtttctcaagtgcttgaatcctagtttcaatccgcctgagaagaagtgtgctctcgaagacgaaacgtatgccgatggcgcagagacagaagttgactgcaatagatgcgtttgtgcctgcggcaattgggtatgtactgccatgacctgtgatgggaaaaaccagaaaggagcacagacgcagacggaagaagagatgactcgctatgtgcaggagctccagaaacaccaggagaccgccgagaaaacgaagagagtgtccactaaagagatttag

SEQ ID NO: 117310 - DNA, 423 bp, Artificial Sequence
  Description of Artificial Sequence: Synthetic coding sequence
atgtggaaacggtggctcgcactcgccttggcgctggtcgcagtggcctgggtgcgtgcggaagaagaactcagaagcaaaagtaaaatttgtgcaaatgtcttctgcggcgcgggtcgggagtgcgcagtgaccgaaaaaggagagccaacctgtctctgtatcgaacagtgtaaaccccacaaacgcccggtctgtggctccaatggtaagacttatttgaaccactgcgagctccaccgggatgcctgcttaactggctcaaagattcaagtggactatgatggccattgtaaggaaaaaaaatccgtgtcaccttcagctagcccggtagtctgttatcaaagcaatagagacgagctgcgaagacgaataatccagtggttggaggcggagatcatacctgatggatggtttagttag

SEQ ID NO: 117311 - DNA, 756 bp, Artificial Sequence
  Description of Artificial Sequence: Synthetic coding sequence
atgtgctttgtcgaaccagctggaaacgttcagtctcaacgaaagggcaacccccctgttagtgcgctgagcaatgcaaatctgactggaagcaagatacaggtcgactatgacgggcattgcaaggagaagaaatccgtttcaccttcagcatccccggtcgtgtgttatcagagtaatcgggatgagcttcgcagacgcataatacagtggctggaggcagagatcatcccggacgggtggtttagtaagggttctaattattccgagatactggacaaatatttcaagaacttcgataacggcgatagccgtcttgattcttcggagtttctcaaattcgtcgagcaaaatgagaccgccatcaacattacaacttatccagaccaagaaaataacaagctgttgcgcgggctctgcgtggatgccctcattgagctgtctgatgagaatgccgactggaagctttcattccaggagttcttgaagtgtttaaaccccagctttaatcctccagaaaagaaatgtgcactggaggacgaaacctacgcagatggggccgagacagaggtagactgcaatcggtgtgtgtgcgcgtgcggaaactgggtctgcacagctatgacatgcgacggcaaaaaccaaaagggtgctcagacccagactgaggaggagatgaccaggtacgtgcaggagctccagaagcaccaggagacagccgagaagacaaaacgcgtgtctacaaaggaaatttag

SEQ ID NO: 117312 - DNA, 792 bp, Artificial Sequence
  Description of Artificial Sequence: Synthetic coding sequence
atgcgaccaggggcccctggcccactgtggccacttccctggggagctctggcttgggcggtaggcttcgtctccagtatggggtctgggaaccctgctcctggaggagtctgttggttgcaacaaggtcaggaggcaacatgcagcctagtcctgcaaaccgacgtgactcgggctgagtgttgtgcttctggtaacattgataccgcttggtcaaatctgacccaccctggtaacaaaatcaacctgcttgggttcctgggtctggtgcactgtttgccctgcaaggatagctgcgacggcgtggagtgtggtccaggaaaagcatgccggatgctgggaggcagacccagatgtgagtgcgcacccgactgcagcggcctccctgcaaggttacaagtgtgcgggtccgacggcgctacttatagagacgagtgtgaactaagagcagcacgctgtcgcggccaccccgatctctctgtgatgtatcggggaagatgccgcaagtcctgcgaacacgtggtgtgcccacgaccacagtcatgtgtggtggaccagactggctctgctcattgcgtggtctgtagggcggctccctgccccgtgccctcttctccaggccaggagctgtgtggaaataataatgttacctacatatcgtcgtgtcacatgcgccaggccacttgcttcttggggaggagtattggtgtgcgacacgcaggctcatgtgcaggcacccccgaggagcctccagggggagagagcgctgaggaggaggagaattttgtatag

SEQ ID NO: 117313 - DNA, 1614 bp, Artificial Sequence
  Description of Artificial Sequence: Synthetic coding sequence
atgctgaacaccttgcaaacaaatgccggctacctagaacaagttaagagacagcggggcgacccacagacccagctggaggcgatggagctttatctggcccggagcggcctacaggtggaagacttggacagactgaatataattcacgtcactgggaccaaaggcaaagggagcacctgtgcattcacagaatgcatcctcagatcctacggtctcaaaactggattcttctcctcaccacacctggtgcaggtgagagagcggatcaggattaacggtcagcctatctcccccgagcttttcacaaaatatttctggcgcctgtaccatagattagaggagacaaaggacgggagctgtgtgagtatgcccccttatttcagattcttgaccctgatggctttccacgtattcctgcaggagaaggtggatctcgcagtcgtggaggttggcattggcggcgcgtacgactgcacgaatattatcaggaaacccgtggtttgtggcgtcagctccttgggaattgaccatacaagcctcttgggagatacagtggagaaaattgcttggcagaagggcgggatttttaagcagggggttcctgcattcaccgtgctgcagcctgagggacccctggccgtcctacgagatcgggcgcaacagatcagctgccccctttacttgtgtccgatgctggaggcacttgaagagggggggccaccactgaccctgggcctcgaaggcgagcatcagcgaagcaatgcagctttggccttgcagttggcgcactgctggcttcagcggcaagaccggcacggcgcaggtgaacctaaagccagccggccgggattgctctggcagctgccactagcacccgtattccagcccacgagccacatgaggctaggtctgagaaacaccgaatggcctggccggactcaagtgctgcgccgcgggcccctgacttggtacctcgatggagcgcacaccgcaagctctgcccaggcatgcgtgaggtggttccgacaagcattgcaaggcagggagcgaccctcaggaggccctgaagtgcgcgtgcttctattcaacgccactggtgatagagacccagctgccctgttgaagctgctgcagccttgccaattcgattatgccgttttctgcccgaacttaacagaggtatcatctacagggaatgccgaccagcagaactttaccgtgactctcgaccaggtgctcttgaggtgtttagagcatcagcaacactggaaccatctggacgaggagcaggcctcccccgatttatggagtgctcctagtccagaacccgggggctccgccagcctgctcctggcgcctcacccccctcacacctgctccgcctcctctttagtcttctcatgcatttcccacgcattacaatggatttcccaaggccgggatcctatctttcagcccccgagccctcccaaagggctcctgacacaccccgtcgcccactctggcgcatctatacttcgcgaagccgctgccattcatgtcctggtgaccggctccctgcacctcgttggcggcgtgctcaaactgcttgaaccagctctgagccaatag

SEQ ID NO: 117314 - DNA, 1128 bp, Artificial Sequence
  Description of Artificial Sequence: Synthetic coding sequence
atgagccgggcgcggagccacctacgggccgcgctctttctggcagctgcttccgcaaggggtattaccacacaggtggcggcacggcggggactctccgcatggcctgttccacaggagcccagtatggagtatcaggacgccgtcagaatgttaaacaccttacagaccaatgcgggttatttagaacaggtgaaaagacagcgaggcgacccccagacccagctggaggctatggaactctacttggctagatccgggctacaggttgaagacttagacagacttaatataattcatgtgaccgggaccaagggtaaaggttcaacttgcgcctttaccgagtgcatccttagatcttacggcttaaagacgggtttcttctcatcccctcacctggtgcaagtcagggagcgtattaggatcaatgggcagccaatcagtccggagctctttacgaaatacttttggcggctttatcaccggctcgaagagaccaaggatggatcctgcgtttctatgccaccatacttcaggtttctgaccctgatggctttccatgtgtttttacaagagaaagtcgatctggccgttgttgaagttggtatcggcggtgcttacgattgtacgaacattattaggaaacccgtcgtgtgcggcgtgagttcgctcggcattgatcatacttcgctgctgggggacaccgtggaaaagatcgcctggcaaaagggcggaatcttcaaacagggcgtccctgcttttactgtactccagcccgaggggcccctcgccgtgctgagagatagagcacaacagattagcgtcctgggctcacaacggcatccgggtcaggggagctgcggctcctgcccatggcacctctgcagcagtcctcaccccacttgcgggagcggctttggcacgagatcgggacgggccggcagaaggtgttgcggcgcaggtccaagtcctggaacgtggaccgtgcgcacaccgcccgctgcacgtcggcccgcatgtgctggctctgcaaggcggtgtcgggctgctcgggggcgtgccgtggctcctcgtttcgagtcctgcagtagtatgctccccggcaccggcactaggcggccatgttag

SEQ ID NO: 117315 - DNA, 1128 bp, Artificial Sequence
  Description of Artificial Sequence: Synthetic coding sequence
atgagtcgcgctcggtcccatctgcgagccgccctgttcttagccgctgcatccgctcgcggtattactactcaagtcgccgccaggaggggcctctccgcctggcctgtacctcaggaaccttcgatggagtaccaagacgctgtgcgtatgcttaatacacttcagactaacgcaggatacctcgagcaagtgaaaaggcagcggggcgatccgcagacccagctagaggccatggagctgtatttggccaggtctggactgcaggtggaggatctggacagactaaacatcatccatgtaaccggcaccaaaggtaaagggagcacatgtgcgttcacggaatgtattctgcggagctatggactgaaaaccggcttcttttccagtccccatttggttcaggtcagggagcgaatcagaattaatggacaaccaattagcccagaactattcaccaagtatttttggaggctctaccatcgcctagaggagaccaaggacggttcctgcgtcagcatgcctccctactttagatttctgacgcttatggcttttcatgtgttcctgcaggaaaaggtagatctcgccgtggtcgaggtggggattggaggcgcctatgattgcactaacatcatcaggaagccagtggtgtgcggggtttcaagcctgggcattgaccacacatctctccttggggatactgtggaaaaaattgcatggcagaagggggggattttcaagcagggagtcccagctttcacggtgctgcagccagaaggccctcttgccgtcctgcgggaccgtgcacaacagatcagtgtactgggctcacagcgccacccaggtcaggggtcgtgtgggtcatgcccatggcatctctgtagttctccacaccctacctgcggaagcggctttggaactcgaagtggccgcgccggacggagatgctgtggcgccggtcctagcccaggaacgtggaccgtgaggactcctcccgccgctcggagaccagcctgtgcagggtctgctagacgatgtagagccgcacggggaagggcagtggcccctcgattcgaaagctgttcaagcatgctgcccggtacggggaccaggaggccatgttag

SEQ ID NO: 117316 - DNA, 1764 bp, Artificial Sequence
  Description of Artificial Sequence: Synthetic coding sequence
atgtcacgtgccaggtcgcacctccgggcagcccttttcttggccgctgcctctgccagggggatcacgactcaggtggccgccaggcgcggattgtctgcttggccagtccctcaagagccgagcatggaataccaggatgccgtgcgaatgctgaatactctacagactaatgccgggtacctggaacaggtcaaacgccagcgtggagatccacagacacagcttgaggctatggagctctatttagcaagaagcggtttgcaagtcgaggatctggatcgccttaatatcattcacgtgaccgggacaaagggcaaaggaagcacgtgcgccttcacggagtgcattttgaggtcctacgggctgaaaaccggatttttttcatccccccatctagtccaggtaagggaacgcatcaggatcaatggccagccgatatcccccgaactgtttactaaatacttctggaggctctatcaccggctcgaagagacgaaggacggtagctgtgtatctatgccaccttacttccggttcctgacactcatggccttccacgtatttctgcaggagaaggttgacctggccgtggtggaggttgggattggaggagcctatgactgtaccaatattatacggaaacctgttgtctgtggggtgagttccctcgggatagaccatacgagcctgctgggcgacactgtggaaaagatcgcttggcaaaaggggggtatcttcaaacagggagttccagcttttaccgtgctccagccggaggggccactggctgtgcttagagatcgggctcagcagatcagttgcccgctttacctctgccctatgctcgaagctttggaagaaggtggtccccctctcactctggggttggagggtgaacatcaaaggtcaaatgcagcgctcgctcttcaattggctcactgctggctgcagcgtcaagatagacatggtgccggtgagcccaaggcttctcggccaggcctactgtggcagctgcccctggctccagtgttccagccgacttcgcacatgcggctcggcctgagaaacaccgagtggcctgggaggacacaggttttgagacgcggcccacttacctggtacctcgacggggctcacactgcgtctagcgcacaggcttgcgtgagatggttccggcaagcccttcagggccgcgagcgcccatctggaggcccggaagtaagagtcctcttatttaatgctaccggcgaccgcgatcccgctgccctgctgaagctgcttcaaccctgccagttcgattatgcagtcttttgtcccaacctgactgaggtatctagtacagggaacgcagaccagcagaattttactgtgacactggatcaagtgctgctgcgctgtctcgaacaccagcaacactggaaccacttagatgaggaacaggcatccccagacctgtggtctgcaccctcccccgagcctggaggatctgcatccctgctgctggctcctcatcctcctcacacctgttctgcctcttcactcgtgttttcgtgtatctctcacgcactgcagtggataagccaggggcgcgaccctatctttcagcccccctcaccgccaaaggggttacttactcatcctgtagcccatagtggtgccagcattctacgggaggcagccgccattcatgtgctggttaccggctcactgcacctcgtgggcggtgtgttgaaactacttgagccagcgctgtcacagtag

SEQ ID NO: 117317 - DNA, 1686 bp, Artificial Sequence
  Description of Artificial Sequence: Synthetic coding sequence
atgtcccgggccaggtctcacctgcgagcagctttgttcttggccgccgctagtgcccgcggaatcactacacaggtggcggctaggcggggtctgtccgcctggcccgtgcctcaggagccttcaatggagtatcaggatgccgtccgcatgcttaacacactgcaaaccaatgccggctacttggagcaggtgaagaggcagcgaggcgacccacagactcagttggaagcaatggaactgtacctggcacgtagtgggctgcaggtcgaagatctggaccgccttaacattatccacgttaccggtacaaagggaaaggggtctacttgtgcattcactgagtgtatcctgcgctcctacggcctgaagactggctttttctcttcaccacatctggtccaggtccgcgagcgaattagaattaacggccagcctattagccccgagttattcacaaagtatttttggcgcctctatcacaggttagaggaaacaaaagtggatttagccgttgtggaggttggcatcggcggcgcctacgattgtactaacattatccgtaagccggtcgtgtgcggggtgtcatctcttggcattgatcacacttctctattgggggatactgtagaaaaaattgcttggcagaaggggggaattttcaaacagggagtcccagccttcactgtgctgcagcctgaagggcctctggccgtcctgcgggatcgggcacagcaaatctcttgcccattgtacctctgcccaatgttggaggcgctagaggaggggggcccacctctgacgctggggcttgaaggagaacaccaacgatcaaatgccgccctggccctgcaactagcacactgctggctccagagacaggatagacatggggccggtgaacctaaagcttccagaccaggacttctgtggcaactgcctctagcacctgttttccaacccacctcacatatgcgcctcggacttcgcaacacagagtggccaggaaggacccaggtgctgagacggggcccccttacctggtacctcgatggggctcatacagccagcagcgcccaggcctgtgtgagatggttccgtcaagccctgcagggtcgcgagcggccttctggtgggcccgaggtgcgggtgctgctctttaacgccactggagatcgcgatcctgccgctctgctgaagttgttgcagccatgtcagttcgactatgccgtgttctgccccaacctgaccgaggtctccagtactggcaatgccgaccagcaaaacttcactgtcaccctagatcaagttctgctcaggtgcttggaacatcagcagcattggaatcacctagacgaagagcaggcgtcacctgacctctggagcgctccgtccccagagcccggcgggtccgcgagcttgctgctggccccccacccaccccatacctgtagtgcatccagcctggtgttcagttgtatctctcatgcattgcagtggatatcacaaggtagagacccaatttttcagccccccagcccacctaagggccttttgactcaccccgtggcccactctggagcaagcattctccgggaagcggcagctattcacgttctcgtgactggcagcctgcacctggtgggtggggtgttgaagctgcttgagcctgcactgtctcagtag

SEQ ID NO: 117318 - DNA, 585 bp, Artificial Sequence
  Description of Artificial Sequence: Synthetic coding sequence
atgctgaacacactgcagactaatgctgggtaccttgaacaggtaaagcggcagagaggtgatccacagacccaactggaggccatggagttgtatctagcccgctcaggactgcaagtcgaggatcttgaccggcttaatatcatacacgtgaccgggactaaaggtaaagggtcgacttgtgcatttacagagtgtatcctgcggtcctacggtctgaaaaccggcttttttagctctccccaccttgtgcaggtgagagaaaggattcgcataaacggtcagccaatatcaccagagctattcaccaagtatttttggcgcctgtatcacagacttgaggaaactaaggtagatctggccgttgtggaagtcggcatcggtggagcctacgattgtaccaacattattagaaaaccagtcgtttgtggtgtgtcctctctcggcatcgaccacaccagcctgctgggtgacacggtggaaaaaattgcctggcagaagggtgggattttcaagcagggtgtgccggcgtttacggtcctgcagcccgagggaccactggcagtgctgagggatcgcgcctag

SEQ ID NO: 117319 - DNA, 798 bp, Artificial Sequence
  Description of Artificial Sequence: Synthetic coding sequence
atgttgaacacccttcagactaatgccggatacctcgaacaggttaaaaggcaacgcggggatccgcagacacaactggaagccatggaattgtacctggctcggtcgggcctccaagtggaagacctggacagactgaatatcatccacgttactgggacgaaggggaaggggagcacctgtgcatttactgagtgcattctcaggagttacggcctgaagactggctttttttccagcccccacctagtccaagtgagagaaagaatcagaattaatggccagccgatttctcccgaactatttacaaagtatttttggagactctatcatcgcttggaggagacgaaagatgggtcctgtgtttcaatgccgccatattttcggttcctgacactcatggccttccatgtgtttttgcaggagaaggtggacctagccgtggtggaagtaggaatcggaggcgcttatgattgcacaaacatcatacgaaaaccagttgtttgcggggtcagctctctggggattgaccacacatccttgttgggagataccgtggagaagatagcgtggcagaaaggcggaatctttaaacagggagtgccagccttcaccgttctgcagcctgagggccctttggccgtcctgagggatcgggcccagcagatctcggtgctgggatcacagcgccaccctggccagggaagctgtgggtcctgtccatggcatctttgtagctctcctcacccaacctgcggctccggttttggaaccagaagtggtcgagccgggaggtag

SEQ ID NO: 117320 - DNA, 1392 bp, Artificial Sequence
  Description of Artificial Sequence: Synthetic coding sequence
atgcattcagcctcgagcatgcttggggccgtgaagatggaggggcacgaaccctctgattggtcttcctactacgccgagccagaggggtacagttcagtcagtaatatgaacgccgggctgggtatgaatggcatgaacacatacatgtcaatgtcagcagcggccatgggatcaggcagtggtaacatgagcgccggctctatgaacatgtcttcgtacgtgggcgccggcatgagtccatcactggctggcatgtcaccaggggcgggcgcaatggctggcatgggtggatccgctggagcagcgggagtggctggtatgggcccacacctgagccctagtctcagccccctcggggggcaggccgctggtgctatgggcggtctggctccctacgccaatatgaattcgatgtctcccatgtatggtcaagccggtctcagcagggccagagatcctaaaacttatcgccgcagttacactcacgctaagcctccatactcttatattagtttgatcaccatggccatacagcaatctcccaataagatgctgaccctgtctgagatttaccagtggatcatggacttgtttccattctataggcagaaccagcagcggtggcagaattcaattcggcatagtctgagtttcaacgactgcttcttgaaagttcccaggtcccccgacaagccagggaaaggaagcttctggacactccatcccgatagtgggaatatgttcgagaatgggtgttacctgagacgtcagaagaggtttaaatgcgagaagcagctggcccttaaagaggccgctggcgccgctgggtcaggcaagaaggcggccgccggggctcaggcctctcaagcacaattgggagaagccgcgggcccggctagcgagacaccagccggcacggaatctccccattcgtcggctagcccatgccaagagcacaagcgaggagggctaggcgaactcaaaggtacccctgccgctgcactgtcgccgcctgaaccagcgccaagccccggccaacagcaacaggcggccgctcaccttttggggccccctcaccatccaggactgccgcccgaggcccacctgaagcccgaacaccactacgcctttaaccatccattttctatcaataacttgatgtcttccgagcagcagcatcatcatagccaccatcaccatcagccccacaagatggacctgaaagcgtacgagcaagttatgcactaccctggttacggaagcccaatgcccggatcactcgcgatggggcccgtgaccaacaaaactggactcgatgcctctcctctagcagccgatacaagctattatcaaggagtctacagtcggcctatcatgaattctagctag

SEQ ID NO: 117321 - DNA, 1374 bp, Artificial Sequence
  Description of Artificial Sequence: Synthetic coding sequence
atgctcggggccgtgaagatggagggacatgagccctcagactggagcagttactatgcagaacccgagggatactcctctgtaagtaatatgaacgccggcctcggaatgaatgggatgaatacctatatgagcatgagcgcggccgcaatggggagcggaagtggcaatatgtctgccgggagcatgaacatgtcctcttacgtcggagctggaatgtccccctcactggccgggatgtctccgggcgctggagccatggctggcatgggtggctccgccggggcagctggagtcgccggaatgggccctcacctcagcccttctctaagcccgctggggggccaggcagcgggagcaatgggcggactcgcaccgtatgctaacatgaatagtatgagcccgatgtatggtcaggccggtctgtcccgggctagggaccctaaaacttatcgccgatcttacacgcatgctaaacccccctactcatacattagcctcattacaatggcaatccagcagtccccaaacaagatgctcaccttatcggagatttatcaatggatcatggatctcttcccattttaccgccagaaccagcagcggtggcagaattcaattagacattccctgtccttcaacgactgctttctcaaggttcctcgatccccggataagccaggaaaggggagcttttggactctacacccagatagtggaaatatgttcgaaaatggatgctaccttcgtcgacaaaagaggtttaagtgtgaaaagcagcttgccctgaaggaagcagcaggcgccgccggcagcggcaagaaggctgctgccggcgcacaggccagtcaagcacagctgggcgaagccgcaggacccgcttcagaaacaccagccggaaccgagtcaccacacagctctgcatcgccctgccaggaacacaagcgaggtggcttgggcgagctgaaaggcacccccgctgccgcgttgtcccctcccgagcccgctccctctcctgggcagcaacaacaggccgcggcacatctgctgggcccgcctcaccaccctggcctgccccctgaagcacaccttaaacctgagcaccactacgcatttaaccacccttttagtataaataacttgatgtcctctgagcagcagcaccatcacagtcaccaccatcatcagccccacaagatggacctgaaggcttacgagcaggtaatgcactatcctggatatggcagccccatgcctggaagtttagcaatgggacccgtcactaacaaaactggcctcgatgcctctccacttgcagccgacaccagttactaccagggtgtttattcccgacccattatgaatagttcttag

SEQ ID NO: 117322 - DNA, 1374 bp, Artificial Sequence
  Description of Artificial Sequence: Synthetic coding sequence
atgttaggcgcagtcaagatggaaggccatgaacccagcgactggagtagttactacgctgagcctgagggctattcaagcgtcagcaatatgaacgccggactggggatgaacgggatgaatacctacatgagtatgtccgccgctgcaatgggaagcgggagcgggaacatgagtgcagggagtatgaatatgagcagttatgtgggcgctgggatgtctccttctctagctggtatgagtccaggcgccggtgctatggcaggtatggggggatcggccggagcggctggagtggccgggatgggccctcatctgtccccctccctcagtcccctcggtggccaagcagccggcgcaatgggaggtctcgctccatacgccaacatgaacagcatgagtcctatgtacggtcaagctggtctctctagggcccgcgatcccaagacctataggagatcatacacccacgcgaagccgccttatagttatataagcctgatcactatggcaatacagcagtcgcctaataaaatgcttacgctgtcggaaatttatcagtggataatggacttgttccctttctacaggcagaatcagcagcgatggcagaactctatcaggcactcacttagttttaatgactgtttcttgaaggtgccccggtctccggataagcccggtaagggtagtttctggacacttcatccagattcaggtaatatgttcgaaaacgggtgctacctgcggaggcaaaagaggtttaaatgtgagaaacagctggcactgaaagaggccgccggagcagctggtagcgggaagaaggcagcagcaggtgctcaggcctcccaggcacagctcggcgaggctgctggaccagcatcggaaactcccgccggcactgagagtccacactcgagtgcttcgccctgccaagaacacaaaaggggtggcctgggcgagttaaagggcactccagctgcggctttatcaccgcctgagccggccccgtcacccggacagcaacagcaggccgccgcacacctgctcggcccaccacaccaccctggactgccacctgaggcacatctcaaacccgaacatcactacgcgttcaaccaccccttttccattaataatcttatgagttccgagcaacaacatcaccatagccaccaccaccaccaaccacacaagatggatctgaaagcctacgaacaggttatgcattaccctggatacggaagcccaatgccaggcagcctcgccatggggcctgtgacaaacaagaccgggctcgatgcatcaccactcgcggccgacacatcatattaccaaggcgtctactcgcgtcctattatgaactcctcttag

SEQ ID NO: 117323 - DNA, 1032 bp, Artificial Sequence
  Description of Artificial Sequence: Synthetic coding sequence
atgctgggcgcagtaaagatggagggacacgaaccttccgattggagttcctactatgctgaaccggagggatattcttccgtgtccagagcacgagatccaaagacctaccgaaggagctatacccacgcaaagccaccgtattcttacatatccctgatcactatggccatacagcagagcccgaataagatgctgacactttccgaaatctaccagtggatcatggatctgttccccttctaccggcagaatcaacagaggtggcagaattctatcaggcattctctgtctttcaatgactgctttcttaaggtgcctcggtccccggacaagccagggaagggctcattctggactctccacccagacagtggcaatatgttcgagaatgggtgttatttgcgacgacagaagagatttaaatgtgaaaagcagctggcgctcaaggaggccgccggggctgctggatctgggaagaaagccgccgctggcgcccaggcctcacaggcccagctgggggaagctgccggcccagcaagtgaaacgcccgccggtacagaaagtccacattcttctgcttctccctgtcaggaacacaagagaggcgggttaggcgagctcaaagggaccccagcagctgctctctctcccccagaacctgcaccgtctcctggacagcagcaacaggccgctgcccacttactagggccccctcaccaccctggcctcccaccagaagcacacctcaaacctgaacaccactacgcattcaaccatccgttttccatcaataatttaatgagcagcgaacagcaacatcaccatagtcatcatcaccaccagccccacaaaatggacctaaaagcctatgagcaggtcatgcattaccctgggtacggaagtcccatgcctggtagtctggccatgggcccagttactaacaaaaccggcctcgatgcctctccgcttgccgccgacacttcgtactatcaaggagtctacagtcgtcctattatgaattcctcgtag

SEQ ID NO: 117324 - DNA, 1053 bp, Artificial Sequence
  Description of Artificial Sequence: Synthetic coding sequence
atgctggggtctgtcaaaatggaggcccacgacctggccgaatggtcctattacccggaagcaggagaggtatattcaccagtgacgccagtgcccactatggccccattgaactcctacatgacactgaacccactgtcttccccatacccgcctggtggtttgccagcttctcctttaccatctggccccctggcgcctccagcccctgctgcgccactcggaccaacttttccagggctgggcgtgtccggaggaagctccagcagcggatatggcgctcccgggcctggcctggtccacggtaaggagatgcccaaaggctaccgcagaccactggctcatgcgaaacctccgtattcttatatttctctgattacaatggcgattcagcaggcccccggaaagatgctgaccctgagcgaaatctatcagtggatcatggatctttttccatactatcgggagaaccagcagagatggcagaatagcattagacactcactctccttcaacgattgctttgtaaaggtagcccgatctcctgataagccggggaagggaagctactgggctcttcacccatcttcaggaaacatgtttgagaatggttgttacctccgcaggcagaagcgctttaagctggaagaaaaggtaaagaaagggggcagtggggccgccaccactacgagaaacggcaccggaagtgctgcttccacaaccaccccagccgctacggtcacctcccccccccaaccaccacctccggctcctgaaccagaggcccagggcggtgaggacgtaggagcactcgactgcggatctcctgcctccagcaccccttacttcaccggacttgagctccctggagaacttaagctggacgccccttataactttaaccacccattcagcataaataatttgatgagcgagcaaactccggcacctcccaagttggatgtggggttcggggggtatggggcagagggcggcgagccaggagtgtattatcagggtttgtactctagatcgctcctgaatgcttcctag

SEQ ID NO: 117325 - DNA, 1662 bp, Artificial Sequence
  Description of Artificial Sequence: Synthetic coding sequence
atgcaggcccggtatagtgtcagttcacctaattcactcggtgtggtgccttatcttgggggggaacaatcttactaccgtgcagccgctgcagccgctggaggtggatacaccgctatgccggccccaatgtccgtatactcccaccctgcccacgccgagcagtaccccgggggaatggctagggcctacggcccatatacaccacagccacaaccgaaggacatggtcaagcctccttactcgtacatagccctgattacaatggcgattcagaacgcccctgataaaaaaatcacacttaatggtatatatcagtttatcatggaccgatttcctttctatcgggacaataagcaagggtggcagaatagcattcgacacaatttgtctctaaacgagtgtttcgtcaaggtcccaagggacgacaagaaaccaggtaaaggaagctactggacactggatcctgacagctacaatatgtttgagaatgggtcctttctgcgacgacggcgccgtttcaaaaagaaggacgccgtgaaggacaaggaggaaaaagataggctccacctgaaagaacctccacctccagggcgacagccacctcccgcaccgcctgaacaagccgatggaaacgccccaggcccccagccccctcccgtgaggatacaggacataaaaaccgagaacggtacttgcccgagccctcctcaacccctgagcccagccgcggcactgggttcaggcagcgccgccgctgtgcccaaaattgagagcccagactccagttcttctagcctttctagtgggtcctcccctccaggatctcttccttctgcacggcctctgagtttggatggagcagacagcgccccgccacccccagctccctccgccccccctccacaccattctcaaggcttcagcgttgataacattatgacctcgctacggggctccccccagagtgccgccgcggagttgtcaagcgggctgctagcctccgcggccgccagtagcagagccggcatagccccacctctcgcccttggggcctacagccccggtcagagttctctgtacagctcaccttgctcccagaccagctcagcaggttcttctggcgggggtggcggaggtgccggtgcagctggaggggcagggggtgctggcacttaccactgcaatctccaggcaatgtctttatatgccgcaggagagcgaggtgggcatctgcagggcgcccctggtggtgcaggcggcagcgccgtcgatgatccacttccggattattctctgccaccggttacatcaagtagctcaagcagcctgagccatggtggaggcgggggaggtggcggtggtggacaggaggccggacaccatcccgcggcacatcagggcagacttacaagctggtatttgaaccaggccgggggggacttagggcacctcgcttcggctgccgccgccgctgccgccgctgggtatcctggacaacagcagaacttccacagcgttcgcgagatgtttgaatcgcagcggattggcctcaacaattctcccgtgaatggcaatagcagctgccagatggcgttcccatccagccagtcgctataccggacctcaggagctttcgtgtacgactgcagcaagttttag

SEQ ID NO: 117326 - DNA, 639 bp, Artificial Sequence
  Description of Artificial Sequence: Synthetic coding sequence
atgcaggcccgttatagcgtcagcagcccaaattctctgggggtcgttccgtatctcggtggtgagcagagttactatagggccgctgccgcagcggccggtggaggttatacagccatgcctgcaccaatgtcagtgtatagccacccggcccacgccgagcagtatccagggggtatggctcgcgcatatggaccttatacccctcagccacagccgaaggacatggttaagcccccctactcctacatcgccctgattacaatggctatccagaatgctcctgacaaaaaaataacgctgaacggaatttaccagttcatcatggaccgttttcctttttaccgcgacaacaagcaggggtggcagaatagcattaggcacaatttatcattgaacgagtgcttcgtcaaagtcccacgcgacgataaaaagcccgggaaggggagctactggacgctggaccctgactcttataatatgtttgagaatggcagcttcttgcgccgccggaggaggttcaaaaagaaagacgccgttaaggacaaagaggaaaaagatcgaccccaggccacgcgagcttcctcgagaacatctacaaggtgtgggagatgttcgtcacatcgcggatcagcctag

SEQ ID NO: 117327 - DNA, 1488 bp, Artificial Sequence
  Description of Artificial Sequence: Synthetic coding sequence
atgacactcggctcctgctgctgcgagatcatgtcaagcgagagctctcccgccgcccttagcgaggcagacgcagacatagatgtggttggtggcggtagtggggggggcgagctgccagccagatcaggccctcgtgcccccagggacgtcttaccgcacggccatgagcctcccgccgaagaagcagaggccgacttagccgaggacgaggaggagtctggaggatgtagtgacggtgagccgcgtgccttagcctcccggggtgctgcagccgctgccggctcaccaggaccaggcgctgctgccgctagaggagctgccgggcccgggcccggacccccctctggaggtgccgctacccgctctccattagtgaaacctccgtacagttatatcgccctgattacaatggcgatccttcagtccccaaagaaacggttgaccttgagcgagatttgcgagttcatatccggtaggtttccatactacagggagaaattccccgcttggcagaattccattagacacaatctttcgctgaacgactgcttcgtcaaaattcctcgcgagccgggtaacccaggtaaaggaaactattggactttggatcccgaatccgcggacatgttcgacaacggctcctttctcagacgccgcaaacgcttcaagcgtcaaccactgccaccccctcatccacacccacaccctcatccagaactgcttctgcgcggcggggccgctgcagccggtgaccccggagctttcctgccgggattcgcagcctatggcgcgtacggctacggatatgggctggctctacctgcctatggtgcccccccgccaggcccggcgccccaccctcaccctcacccgcatgcctttgccttcgcagcagccgctgcagccgccccatgtcaactgtcggtacccccggggagagctgcggcacccccgccaggaccaccaacagcaagcgttttcgctggcgcggggtcagcccctgcgccggcacctgctagcgggagtggaccaggcccgggaccagctggactgcctgctttcctaggcgcagagctcggctgtgcgaaggctttctatgcagcctcactgagccctcctgccgctgggactgcggctgggctgcccacggcactcctgcgccagggactgaaaaccgatgccggcgggggcgcaggtggtggcggcgccggcgctggccagcgaccttcattctccatagatcatatcatgggtcacggcgggggaggcgctgctccacctggagccggcgagggctctcccggccctccattcgctgctgcagcgggccctggcggtcaagcccaggtgttggcaatgctgactgccccagccctggctcccgtggcaggccacataaggctgtcccaccccggggacgcactgctgtctagtggctctaggttcgcttcaaaggtggctggattgagtgggtgtcacttctag

SEQ ID NO: 117328 - DNA, 1437 bp, Artificial Sequence
  Description of Artificial Sequence: Synthetic coding sequence
atgacactgagcggaggaggcagcgccagcgatatgagcggccagaccgttttgaccgcagaggacgttgatatcgatgtagttggagagggcgatgatgggctggaagagaaggactctgatgctgggtgcgattcaccagccggaccgcctgagttaagactggatgaagcagacgaggtgccgcccgcggcgccccatcatggccagcctcagcctccccatcaacaaccccttactttgcccaaagaggcggctggggccggcgcgggacctggtggagatgtgggagcgccggaggccgacgggtgcaagggcggcgttggcggcgaggagggcggagcatctggtggaggacccggggccggaagcggaagcgcgggcggacttgccccatccaaaccgaaaaatagtttagttaagcccccatacagttacatagcccttataacaatggcgattctccaatcccctcaaaagaagttaactttgagtggtatctgtgagtttatttctaacagattcccttattatagagagaagttcccagcttggcagaactcgatcagacacaatctctcactgaacgattgttttgtgaaaattcctagggaaccaggaaaccctgggaaaggcaactactggacgcttgatcctcaatcagaggatatgtttgataacggatcatttctcagacggagaaaaagatttaagaggcatcagcaggagcatctgcgcgaacagacagctctcatgatgcagtcgttcggtgcttactcactggcagcagccgcgggagcagccggaccgtatggacgcccctacggattgcatccagccgcagctgccggtgcctatagccaccccgccgcggccgcggctgccgcagccgccgccgcactgcaatatccatatgctcttccacctgtggccccagtcctgccgccagcagtacctctcctgccttccggggagctcgggcgcaaggccgctgctttcggttcacagcttggccccggcctacagttgcaactcaatagcctcggcgccgcggccgccgctgccggaacagctggggcagcgggaaccaccgcttcattgattaaatctgaaccttccgctcgtccatcatttagtatagagaatattatcggaggagggcccgccgcacctgggggatccgcggtaggggcaggagtggctgggggtacgggaggttccggcggaggctcaacagcacagtccttcctacgtcctcccgggactgtccagtctgcagcactgatggcgacgcatcagccactgtcactctcccgaacgacagcaacgatcgctcccatcctgtcggtgcctttatcgggccaattcctccagcctgccgcatcagcggcagccgcagcagcagcagctgcgcaggctaagtggcctgcccagtag

SEQ ID NO: 117329 - DNA, 1320 bp, Artificial Sequence
  Description of Artificial Sequence: Synthetic coding sequence
atgaacctgccccgcgccgaaagattgaggagcacgccacaaagatccctgagggacagtgacggcgaggacggcaagatcgatgttctcggagaggaagaggacgaggatgaggaggaagctgcctcacagcaattccttgaacagtcacttcagcctggccttcaagtggcgcgctggggaggcgtggccctgccacgagaacacattgagggtggagggggaccatccgacccatcggaatttggcaccgaatttcgagctcccccgcggtccgctgccgcatctgaagacgccagacagcctgctaaacccccttcaagttatatcgccttgattactatggcaatactgcagtccccgcacaagagattgaccctgagtggcatatgtgcattcatttctgaccgctttccctattatcgaagaaagttccccgcatggcaaaatagcatacgccataacctgtcattaaacgactgttttgtgaagatcccaagggagcccggtaggccaggaaaaggcaactactggagcctggatccagcatcccaagacatgttcgataacgggtcgtttctcagaagacgtaaacgatttcagaggcatcagccaactcctggagctcatctgccacatccgtttccattgcccgcggcacacgcagctctgcataaccctaggccaggtcccctccttggggctcccgccccgcctcagcctgtgcccggggcctatccaaacacagggcccggtcgtaggccttacgcactgctgcaccctcacccaccccgttatctcctgcttagcgctcccgcgtacgctggcgcacctaagaaggcagaaggcgctgacctggcgactcctgcacccttcccttgttgctccccgcacttggtgctcagtctgggacggagagcacgtgtgtggagacgccatagagaagccgacgcatccctgtccgccctaagggtaagctgtaaaggctccggcgaaagagtgcaagggctgcggcgggtttgcccaaggccacggggagccaccgcgccgtgcagttccgatcgtcaggcatgtagaacaatcctgcagcagcaacagcgtcatcaggaggaagactgtgcgaatggttgcgccccaaccaaaggagccgttttgggtgggcatttaagcgctgcgagtgccctactccgctatcaagcggttgcagagggctctgggctcactagcctcgcggctcccttaggaggagagggaacaagcccggttttcctcgtgtctcctacaccttctagcctcgcagagtcggcaggcccctcttag

SEQ ID NO: 117330 - DNA, 1227 bp, Artificial Sequence
  Description of Artificial Sequence: Synthetic coding sequence
atgaacctgcctagggccgagaggccacgctcaacacctcagcgctcgctgcgcgactcggacggagaagatggtaaaatagacgtgctgggagaggaagaagacgaagatgaagtagaggacgaagaagaagaggctagccagaagttcctggagcagagcttgcagccaggactgcaggtagcccgatgggggggcgttgcgctaccgcgcgaacatatcgaagggggaggacccagcgatccctcggagtttggcacagagtttcgggcccctccgcggagtgcggccgccagcgaagacgcccgacagcccgccaagcccccttacagttacatcgcgctgataacaatggcaatcctccagagcccgcacaagaggttgacgctttctgggatttgcgcgtttatttctggtcggttcccatattatcgacgaaagttccccgcatggcagaactcaatacggcacaacctgtcgctgaatgactgtttcgtcaagattcctcgggagccaggtcaccctgggaaaggtacttattggtcacttgacccagcctcccaagatatgtttgataacggtagcttccttcggaggagaaagcggttcaagagacaccagttgaccccaggggcacacttgcctcatcccttcccgctccccgccgcacacgcagccttgcacaaccccaggccagggcccctgctcggggcccccgctctcccccagcccgttcccggtgcctaccccaacaccgcccccggtcggcgaccctatgcgttactgcaccctcacccccctcggtacttacttctgtctgcccctgcctatgcgggtgcccctaaaaaggcagaaggcgccgacctggctacacctggtactctgcccgttttacagcctagccttggaccacagccatgggaagagggcaaaggactggccagccccccgggaggcgggtgtatttccttcagcattgagagtatcatgcaaggcgtacgaggggcaggtaccggggctgcacagtctctgtctcctacagcctggagctattgtccccttctgcagagacccagcagtcttagcgataacttcgcggctacggcagccgcttcgggcggtggactgcgccagcggctgcgctctcatcaagggcgcggtgctggcagagcccctgttgggcgcgtgggcgccgccgccgtgagcggcggcggtaggggtctttag

SEQ ID NO: 117331 - DNA, 1251 bp, Artificial Sequence
  Description of Artificial Sequence: Synthetic coding sequence
atgaatctgcccagagccgaacgcccacggagtacaccccaaagatccttgcgggactccgacggcgaggacggcaagattgacgtactcggggaggaggaggacgaggacgaggttgaggatgaggaagaagaggccaggcagcagtttctcgaacaatctctgcagcccggtctccaggttgccagatggggcggagtcgcgttgccccgcgagcatattgaaggcgggggcggaccgagcgatcccagcgaattcggaaccaagtttagggcccccccacggtctgcggccgcatccgaggatgcaagacagcccgcaaaacctccctattcctatattgcactgatcacaatggcaattttgcagaaccctcacaagcgactcaccctttcagggatatgtgccttcattagtggtcgttttccttattatcgacggaaatttccggcctggcagaatagtattagacataatctcagcctgaatgattgcttcgtgaagatcccgagagagccaggtcaccctggtaagggcaactattggtcacttgatcctgcctctcaggatatgttcgataatgggtcgtttctacgcaggaggaagcggttcaagagacaccagttgacaccaggcgctcatctgcctcatccatttcccctcccagcagcccatgccgccctccacaatccacatcccggtccccttcttggggcaccagctccaccccagccagttccaggcgcatacccaaacacagctcccggcagacggccctacgccttgctccacccacatcccctccgatacctcttactctcggctagagtgtacgctggcgcaccaaagaaagcagagggtgcggatctggctacacctgcgccttttccttgttgctcaccccatctcgttttgtccctgggacgccgagcccgggtctggagacgccacagggaagccgatgctagtctgtctgctctacgggttctctgtaaaggctcaggagagcgggtgcagggacttagacgtgtgtgtccccggccacgaggcgcaactgccacatgttctagtgaccaccaggcttgttgtattcccaaacctctgcctctgtgctgtaagtgcccccctcccctccttcttggacaattctgctcaaacagctcatccattaggcggacagccccaacggcggcccttccgccaagggctcgatgttgggctgggacatgccgacccaggagaagatgttag

SEQ ID NO: 117332 - DNA, 1254 bp, Artificial Sequence
  Description of Artificial Sequence: Synthetic coding sequence
atgaacttacctagggctgagaggttgcggtccactcctcagcggagcctacgcgattcagacggggaagacggcaagatcgatgtcctcggagaagaagaggacgaagacgaggtggaggacgaagaagaggccgccagtcagcagttcttggagcagagtctccagcctgggctccaggttgcccggtggggcggggtcgccctgccacgcgaacacattgaaggaggcggcggtccctccgaccctagcgaatttggcaccaagtttcgggccccacccaggagtgctgccgcttctgaggatgctaggcaaccagccaagcctccatacagttacattgctctcattaccatggccattttacagaaccctcataaacgactcacccttagcggcatctgcgctttcattagcggcaggttcccctattatagacgaaagtttcctgcatggcagaactccatcagacataacttatcccttaacgactgtttcgttaagatcccacgcgagcctggccatcctggtaaggggaattactggagtttagatccggcatcacaagatatgtttgacaatggctcattccttagaaggcgaaaaaggtttaagcgccaccaactgactcctggagctcacctgccgcatcccttccccctaccggccgcccacgcagcactgcataatcctcgtccaggccccttgctcggggcccctgcccctcctcagcccgtacctggcgcgtatcctaataccgcaccaggccgccgaccatatgcactgctgcacccccatcctctgcggtacttgttgctctccgccccggtgtatgctggcgcacccaagaaagcagagggcgcagcactggccacaccggcaccatttccttgctgtagtccccacctagtactatcattgggaagacgcgcccgcgtgtggagaaggcaccgtgaagcagacgcatcacttagcgcgctgcgcgtcctttgcaagggctctggagaaagggtgcagggcctacgacgcatttgtcctcgccctagaggggcaactgccacttgtagctcagatcaccaagcctgttgcatccctaggcctctccccctgtgctgcaagtgtccccctcccccattgctagggcaattctgttcaaactcaagtagtatccggcgaaggaccgctcccactgccgccctgccgccacgcgcccgctgttgggctggaacatgtcgacctagacgcccctgctag

SEQ ID NO: 117333 - DNA, 1122 bp, Artificial Sequence
  Description of Artificial Sequence: Synthetic coding sequence
atgactgcagagtccggcccaccaccaccacagcctgaggtgctggccacagtgaaagaggagagaggcgaaaccgcagcaggagccggggttccaggagaagctacgggcaggggagccggcggccgcagaagaaagaggccactgcaacggggaaaacctccttacagctatatcgctttaatcgcgatggcaatcgcacatgcaccagagcgcaggctgaccttgggagggatttacaaattcataactgagcgcttcccgttttatcgagataaccctaagaagtggcagaatagcattagacataaccttactctcaatgattgttttctgaaaattcctcgtgaggccgggcggcctggtaaaggcaactactgggcactcgacccaaacgccgaggacatgtttgaatccggcagtttccttaggcgcaggaaacggttcaaacgcagcgatttaagtacttacccagcttacatgcacgacgcagccgctgccgctgccgccgcggccgccgctgccgccgccgcggccattttccctggtgctgtaccagccgcacgacccccatacccaggggccgtttatgcaggctatgctcccccaagcctggctgcacccccccccgtttactatccagctgctagcccaggtccgtgccgggtgtttggcctagtgcctgagaggccattgagccctgaactggggcccgctccctccggcccaggtgggagttgtgcattcgcaagcgcaggcgctccagctacaacaactggctatcaaccagccggatgtacaggagcgcggcctgccaaccccagcgcctacgccgcagcatatgccgggccagacggggcttacccccagggcgcgggatcagcaatatttgctgctgcggggcggttggcaggtccagcatccccacctgcggggggaagctctggcggcgtggagaccacggttgatttctatggtcgtacatcccccggacagttcggggccctgggtgcatgttacaatcccgggggccagctcgggggggcgagtgccggcgcttaccatgctcggcatgcagccgcttatccgggaggaattgaccgctttgtgtctgctatgtag

SEQ ID NO: 117334 - DNA, 960 bp, Artificial Sequence
  Description of Artificial Sequence: Synthetic coding sequence
atggccgggagatccgacatggatccgcccgctgctttctcaggtttccctgcattgccggctgtagcaccctccgggcctccgcctagccctctcgccggcgcagaacctggccgtgagccagaggaggctgctgccggtcgcggggaagccgcacccacccccgccccgggtcccgggcgccgccggagaagacctctgcaaagaggtaaacctccctactcctatatagctcttatcgctatggcccttgctcacgcccccggacggcgccttactctggctgccatctatagattcataaccgaaagattcgcattctacagagatagcccacgcaaatggcaaaactccattagacacaatctgactctcaacgactgtttcgtgaaggtcccgcgcgaacccggcaaccctggtaagggcaactattggacattagatcccgctgccgcagatatgttcgacaacgggtcttttttaaggcgtcgaaaaaggttcaagcgggccgagctgcccgcacatgctgctgccgcacccggtccacccctgcctttcccctatgctccctatgctcctgcccctggaccggccctcctcgtgccacccccttctgccggccccgggccaagtcccccggcccggctgttctctgtggactctctcgtgaaccttcagcccgaactggctggcctaggagccccagagcccccctgctgtgctgctccagatgccgccgccgcagccttccccccgtgtgcagccgccgcctcacccccgctgtactcccaggttcccgacagactcgtgttaccagcaactagacccggacctggacccctccctgctgaacctcttctggcgctggctggcccagctgctgccctcggccccctgtcaccaggcgaggcatatctgcgccagcctggattcgcttctgggctggaacgatatttgtag

SEQ ID NO: 117335 - DNA, 1335 bp, Artificial Sequence
  Description of Artificial Sequence: Synthetic coding sequence
atgaccacagagggggggccccctccggctccccttagacgcgcctgcagtccggtacccggcgccctgcaggccgcgctgatgtctccacctcctgcagctgctgctgcagccgcagcagcccccgagaccacttccagcagttcttcctcatcctccgcttcttgcgccagctctagttccagctccaattcggccagtgcgccatctgctgcatgtaaatccgcaggtggcgggggcgcaggtgctgggtccggtggcgccaaaaaggcaagtagcggtctgcggagacccgagaaaccaccttactcttatattgccttgatagttatggctatccaatcaagtccatcaaagagactcaccctcagtgaaatctaccagtttctgcaggctcgctttcccttttttcgcggtgcctaccagggctggaagaactcagtcaggcacaatctgtctctaaatgaatgttttatcaagctgcccaagggactggggcgacctggaaaggggcactattggaccatagaccccgccagtgaatttatgttcgaggaagggtcgttccggagacgacctaggggatttcgcaggaaatgtcaagccttgaagccaatgtaccaccgggtcgtgtcaggcttaggctttggtgcgtctctgttgcctcagggcttcgacttccaggcaccacccagcgcgccactgggatgccactcccaggggggatacggaggactggacatgatgcctgccggatatgacgctggagcaggggctcctagccacgcccatccacaccatcaccatcaccaccatgtgcctcacatgagtcccaaccccgggtctacatacatggcctcctgcccagttcccgccggacccggtggcgtgggggcagctggaggcggaggcggtggagattacggtcctgactctagctctagccccgttcctagcagtcctgctatggcaagcgccatagagtgccatagtccttacacctcccccgccgcacactggtccagtccaggggcaagcccatatctgaaacagcctcccgctctgaccccttcgagtaatcctgcagcttccgccgggctgcactcttcaatgagctcttattcgctggaacagtcttatctgcaccagaatgcacgggaagacctgtccgtcggcttaccccgctatcagcaccacagcaccccagtatgtgacaggaaagattttgtcctcaatttcaacggaataagctcgtttcatcccagtgctagcggtagctactaccatcaccatcaccagtcagtctgccaggatattaagccctgtgtgatgtag

SEQ ID NO: 117336 - DNA, 1470 bp, Artificial Sequence
  Description of Artificial Sequence: Synthetic coding sequence
atgctggatatgggagatagaaaagaagttaaaatgattcctaagtcatctttcagtatcaatagtctggtgcccgaggccgttcaaaatgacaatcatcacgcgagccacggccaccacaatagccaccacccacagcaccatcaccatcatcaccatcaccaccatcaccctccaccccctgccccccagccccctcccccaccacaacagcagcagccgccccctcctcctccccccgctccccagccgccccaaacacgtggagccccggcagcagatgacgataaggggccccagcagttgttattgccaccaccccccccgccaccacctgctgcagccttggatggggccaaagccgacgggttgggcggcaaaggagagccgggcgggggcccaggcgagctcgctcccgtcggcccagatgaaaaggagaagggcgcgggcgctggcggcgaagagaaaaaaggtgctggggagggtggtaaggatggggaagggggtaaggaaggagagaagaagaatggtaagtacgagaagccacccttctcttacaatgcccttatcatgatggccatccggcaatcacccgaaaagcggctcacgctaaatggcatctacgagttcattatgaaaaatttcccctattatagagaaaataagcaggggtggcagaatagcatcagacacaatttgtccctcaataaatgctttgtgaaagtcccccgccattatgatgatccaggaaaagggaactactggatgctggatccctccagcgatgatgtgttcattggcgggacgactggcaagctgcgcagaaggtccactacaagtagagcaaagttggcattcaaacgaggggcacgtttaacctcaacaggtttgacgttcatggacagagctgggtcgctgtattggcccatgtcccctttcctgtcactacaccaccctagagccagttccactttgagctataacggcaccacaagtgcttacccctcccatccaatgccctatagttctgttctgacccagaattccctgggcaacaatcactcctttagcaccgcaaatggtctctccgtcgatcgtctggtgaacggtgagatcccatatgcaacacaccatcttacagcggccgctctggccgcgagcgtgccgtgcggtctcagtgtaccgtgctctggcacctattccctcaacccctgttccgttaatcttctcgcagggcagacatcatatttcttcccccatgttccccacccctctatgacttcccagtcaagcaccagtatgtccgcacgagcggcgagtagttccacgagcccccaggcacctagcactctgccttgtgaatcactgcgccctagtctgcccagctttacaaccgggttatcaggcggtttatcagattactttacacaccaaaaccaggggtctagttccaacccactaattcattag

SEQ ID NO: 117337 - DNA, 1470 bp, Artificial Sequence
  Description of Artificial Sequence: Synthetic coding sequence
atgcttgacatgggtgatcggaaagaagtgaagatgatccccaagtcatccttcagcattaacagcctcgtgccggaggctgtgcaaaacgacaatcatcatgcttcccatggccatcataacagccatcacccacaacatcatcaccaccaccaccaccaccatcatcaccctcctccccccgcaccgcagccccctcccccgcctcagcagcagcagccacctccgccgccaccaccagctccgcagccgcctcaaacacgtggagcgccagcagcggatgacgacaagggcccacagcagcttctgcttccccctcctcctcccccaccacccgcagccgcattagacggggctaaagcagatgggttgggcggcaagggtgagccaggaggcggaccgggagaacttgctcctgtcggcccggatgaaaaagagaagggcgcgggagccgggggcgaggagaagaaaggggcgggtgaggggggtaaggatggggaaggaggaaaagagggagagaaaaagaatggtaaatatgagaaacctcccttttcatataacgccttgataatgatggctattcgtcagagcccagaaaaacgattgaccttgaatgggatttacgaatttattatgaagaattttccctactatcgagaaaacaagcagggatggcagaactctatccggcacaacctgagtcttaacaagtgctttgtgaaggtgccccgtcactacgacgacccaggcaagggcaattattggatgctggacccctccagcgacgacgtgtttatcggggggacaacaggaaagttgcgccgacggagcactactagccgcgccaaacttgcgtttaagaggggagcccggctgacaagtacaggcctcaccttcatggatagagccggtagcctttactggccaatgagtcccttcctatcattgcatcaccctagagcctcatccacccttagctataacggcaccacttcagcatacccttctcatcctatgccctacagcagtgttctgacacagaatagcctgggcaataaccactctttctccacagcaaacggattgtccgtcgatcggttggtgaacggggagataccatatgctacccatcatctgaccgccgccgccttagctgccagtgttccatgcgggctgagtgtgccatgctctgggacatattcactgaacccttgttccgtgaacctactcgccggacagacctcctatttttttcctcacgtcccacatccctctatgacttctcagagctccacctccatgtccgcccgggcagcaagttccagcactagccctcaggctcctagcacactcccatgtgaatccctgcgcccatcgctccccagcttcacaacaggattgagtggcggtctgagtgattactttacacaccaaaaccaggggagctctagcaaccctctgatacactag

SEQ ID NO: 117338 - DNA, 1137 bp, Artificial Sequence
  Description of Artificial Sequence: Synthetic coding sequence
atgagtagctttgatctccctgcaccaagcccaccacggtgtagccctcagttcccaagtattgggcaagaaccacccgagatgaacctgtattacgagaactttttccacccacagggtgtgcctagcccccaaagacctagtttcgagggtggaggcgaatacggcgcaactcctaatccatatctttggtttaacgggccaaccatgacccctcctccttatctgcctggaccaaacgcttccccctttctgcctcaggcttacggggtccagcgacccttgttgccctctgtgtcaggactgggtgggtccgacctcggctggctgccaatccccagtcaggaagaattaatgaagctggttaggcccccctactcgtattcagctctgattgctatggctatccacggggccccggacaaacggctcacactctctcagatctaccaatatgtggcagataacttccctttctacaataagagtaaggcaggatggcagaattccatcaggcataatctgtctctgaatgactgctttaaaaaggttcctcgcgacgaagacgaccctgggaagggaaactactggacccttgaccccaactgtgaaaaaatgtttgataacggaaacttccgtcggaagcgtaagagaaagtctgatgtaagctctagcaccgcgtccctggccctggagaaaactgaatctagcctgcccgttgactctcccaaaaccaccgagcctcaggacatcttagacggcgcctccccgggtggaacaacgtccagcccagaaaagcggccctctcctcctccctcaggcgctccttgtctcaactcatttctttcaagtatgacagcttacgttagcggcggatccccgacgtctcaccccctggtgacccccggtctgagtccggaaccaagcgataagacaggacaaaacagcctgacattcaattcattttccccactaactaatctgagcaatcacagcggtggaggcgactgggccaacccgatgccgacaaacatgctgtcctatgggggctcagttctgtcgcagttctctccacacttttacaattctgttaacacaagcggtgtgctgtatcccagagaggggaccgaggtgtag

SEQ ID NO: 117339 - DNA, 852 bp, Artificial Sequence
  Description of Artificial Sequence: Synthetic coding sequence
atgtccagctttgatctccctgcccccagccccccacgctgttcaccgcaattcccctctattggacaagagcctcccgaaatgaacttatactacgagaactttttccaccctcagggcgtaccgtctcctcagcgcccgagcttcgagggcggtggcgagtacggtgcaacacccaatccttatctctggttcaacggccctacaatgacacccccaccatacctgcctggccccaacgcctctccattcttgccccaggcatatggagtgcagcgccctctcctcccctccgtgtccgggctaggtgggtctgatctgggctggctgcccatcccatctcaagaagaactgatgaagttagtgcgacctccttactcatattctgctctaatcgctatggccatccacggagcgccagataagagactgacactcagccagatttaccagtacgtagctgataactttccattttacaataagagcaaagctggctggcaaaactctatccggcataatctgagtctaaatgattgttttaaaaaagtgcccagagatgaggacgatcccgcttatgtgtcaggtggctctccgactagccacccactggtgacgccagggttatcaccagaaccttcggacaaaactgggcagaactcactcaccttcaatagcttttcacccctcaccaaccttagcaatcacagtggcggaggcgattgggcgaatcccatgccgacaaatatgctgagttatggcggaagcgtcttgtcccagttctccccccacttttacaactccgtgaatacatccggggtgctgtaccctagggagggcacagaggtgtag

SEQ ID NO: 117340 - DNA, 1266 bp, Artificial Sequence
  Description of Artificial Sequence: Synthetic coding sequence
atggcagaaagttggctgcgcctgtctggggcggggccggcagaggaggctgggcctgagggtggcctggaggagcccgacgcgttagacgatagtctgacttctctacagtggctgcaagagttttctattctgaatgctaaggctcctgctttgcctcccggtggtaccgaccctcacggttatcatcaggttccggggtccgctgccccaggtagcccattagcggcggatccagcctgtctgggacaaccccacacccccgggaagcccacgtccagctgtactagtcgatctgcaccccccggccttcaggcgccccctccggacgacgtggactatgcaaccaatcctcacgtcaagccaccttacagctacgcaacactgatctgtatggccatgcaggcctctaaagctacaaagatcactctgagtgctatttacaaatggatcaccgataacttctgttacttccgacacgcagatcccacttggcagaattcaattcgccacaatctttccctcaacaaatgtttcatcaaggtgccacgggaaaaggatgagcctggtaagggcggcttctggaggatcgatccgcagtatgccgaacggctgctgagcggagccttcaagaaaagaaggctgccccccgtacacattcatcccgctttcgccagacaggcagcccaggaaccgtctgcggtcccacgggccgggccactgactgtgaacacggaagcccagcagctattacgcgaatttgaggaggcaacaggagaagcaggttggggagccggagaggggcgcctcggccacaaaaggaaacagcctctgcctaagagggtcgccaaggtgcctcggccaccatcaactcttctgcctacccccgaggagcaaggcgagctggagccactaaaaggaaactttgattgggaagctatcttcgacgctggcactctgggtggagagctgggggcacttgaggccctagaactgagccctcctctttctcctgcttcccatgtggatgtcgatctcacgattcacggccggcacatagactgccctgcgacatggggcccttctgtggaacaggcagccgacagcctagatttcgatgaaacctttttagcgacctcattcctccagcacccatgggacgagagcggatcaggatgtctccccccagagcctctgttcgaagccggtgacgccaccctggctagcgacctccaggactgggctagtgtgggtgctttcttgtag

SEQ ID NO: 117341 - DNA, 987 bp, Artificial Sequence
  Description of Artificial Sequence: Synthetic coding sequence
atggcagcagcagccgctgctttgagtggagcaggaaccccccctgctggaggcggagccggcgggggtggggctggtgggggagggtcgcctccaggaggttgggcagtggctaggctcgagggcagagaatttgaatacctgatgaaaaagcggtcagttacgatcggacgcaacagcagccaaggatccgttgatgttagtatggggcactcctccttcatttcgagacgccacctggagatcttcacaccacccgggggaggcgggcatggcggagctgctcccgagcttcctcccgcccagccccggccagacgctggcggagacttctacctcagatgcttgggtaagaacggagtattcgttgatggtgtgtttcaacgccgaggcgcaccccccttacagctgccccgggtctgtacgttccgcttcccctctacaaatattaagataaccttcactgcgttatccagcgaaaagcgagagaaacaggaagctagcgagtccccagtgaaagccgtccagccccatattagcccattgaccattaacatacctgatactatggcgcatctcatcagccccctgcccagccccacagggacaatcagtgcagccaatagctgccctagctcccccagaggagccggtagctcaggctataaggtggggcgagtcatgccaagcgatctgaatctcatggccgataactcccaaccggaaaacgagaaagaggctagtgggggggattctccgaaggatgactcaaaacctccttattcctacgcccagttgattgtacaagctattaccatggctcctgataagcagctgacccttaatggaatatatacccacatcacaaagaattacccctactaccggaccgctgacaaaggttggcaacggggggagagctttgcccacgtgggaaacacacgaattagaatcggcttgccagcccacaaagcaccccaaagatag

SEQ ID NO: 117342 - DNA, 1983 bp, Artificial Sequence
  Description of Artificial Sequence: Synthetic coding sequence
atggccgcagctgcggctgctctctcaggggcgggcacacctcccgccggcggcggtgctggaggaggcggtgcgggcggcggcggttccccacccggtggttgggccgtagctagactggaaggaagagaattcgaatatctgatgaagaaacgaagtgtaacaataggcagaaacagcagtcagggcagtgtggacgtgagcatgggacattcaagttttatatctaggagacatcttgaaatttttacaccccctggaggaggcggtcatggtggagccgctccagaactgccaccagcgcagcctcgccccgacgctggtggcgatttctaccttcgttgtctcgggaaaaacggggtgtttgtcgatggcgtatttcagcggcgtggagctccacccttacagctgccaagagtatgtacattcaggttcccatctactaatatcaagataacttttaccgcgttgtcttccgaaaagcgagagaagcaggaggctagtgaatctcctgttaaagcagtgcagccccatatctcaccgctgaccataaacatccccgatacaatggcccacctcatttctccacttccttcccctaccgggactatttcggcagcaaactcctgccccagcagccctcgcggggccggctccagtggatataaggtagggcgggtcatgcccagcgacctgaatctcatggctgataattcccagcctgaaaacgaaaaggaagctagcggtggagacagccctaaggacgactcaaagccaccttactcttacgctcagttgatcgtgcaggccatcaccatggcccctgacaaacagctgactttaaatgggatatatactcatattactaaaaattacccatactaccggacggctgacaagggctggcagaactccatcaggcacaatttaagtttaaatcgatatttcattaaagttcctcggtctcaggaagaacccggcaaggggtcattctggcgcattgaccccgcgagcgaaagcaagctcatcgaacaagcctttcggaagcggcggcccaggggcgtgccctgcttccgaactcccctaggtcccctctcatccagatctgcacctgcgagcccaaaccacgcaggggtgctctccgcccatagcagcggagcacagacgccagaatctctttccagggagggtagccctgcaccgttggaaccagagcccggggccgctcagcctaaactggcagtgatccaggaggctcgattcgctcagtccgctcccggaagcccgttgagcagccagcctgttttgataacggttcagcgacagcttccgcaggccatcaagcccgttacatacaccgtcgccacccccgtgaccactagtaccagccagccccccgttgtgcaaacagtgcatgtggttcatcagattcctgctgtttcggttacatccgtggccggattggccccagcaaacacatacacagtaagtgggcaagccgtggtgacccctgcggccgtcctcgctcctcctaaagcagaagcacaggaaaatggagatcaccgcgaggtgaaggtgaaagtggagcccattcctgccattggtcatgcaaccctcggcacggcatctaggatcattcaaactgcccagacgacccccgtgcagactgtcaccatcgtccagcaggcccccctggggcagcaccagctgcctatcaaaaccgtgacacagaacggtacacacgtcgcatctgtgcctaccgccgttcacggccaggtaaataacgcggctgcctcccccctgcatatgcttgccactcatgcctcggcaagcgcctccctgcccaccaaacggcacaacggcgatcagccagagcagccagagctgaagcgcattaagactgaggatggggagggcattgtcattgctctgtcagttgatactcctccagccgctgtgcgcgaaaagggcgtccagaactag

SEQ ID NO: 117343 - DNA, 1833 bp, Artificial Sequence
  Description of Artificial Sequence: Synthetic coding sequence
atggctgccgcccgtcgcgcgctcggcgcaggaacgccccgtgcaaggggtcgaggtagaggcgctggcggtggcggatcccgtcgcgccctcgggcgcggggcacccggaggcccgcgcgtacgtgtttctgatgaggaggcgcttggcgaccatagacctcagctggtggcaggactgggcggacgagagcacggcccgctcgagctgcatttgcccgcccctccccgtgacctgcacgcccccggcagaaggggccacggcggggcggctcccgagttgccacctgcccagcccaggcctgatgccggcggcgatttctacttgagatgcctcggcaaaaatggagtgtttgtggatggggtttttcagcgtaggggtgccccgccgctgcaacttccccgcgtgtgtacgttccgctttccaagcactaacatcaagatcaccttcacagccctttcttctgaaaagcgggaaaaacaggaggctagcgaaagtcccgtgaaggccgtccagcctcacatctcgcctctgacaatcaacatcccggatacaatggcccacctaatctccccattacccagcccaacggggaccatcagcgctgctaattcatgcccttcatcaccaaggggcgctggttcttccggatacaaggtcggccgtgtcatgccttcggatctgaatctcatggccgataattcccagcccgagaatgaaaaagaggctagtggtggtgatagccctaaagacgacagtaaacccccctacagctacgcccaactgattgttcaggcgattacaatggccccagacaagcaacttaccctgaacggtatctatacacacattacaaaaaattatccttactacagaacagccgacaagggttggcaaaactcaattcgacataatctcagcttgaataggtacttcattaaggttccgaggagccaagaagagcccggtaaaggcagcttctggcgaatcgatcccgccagcgaaagtaagcttatcgaacaggcttttagaaagaggaggcctcgaggcgtcccttgcttccgcacccctctcgggccactgtcctcccgaagcgctcccgcctccccgaaccacgcgggcgtgctgtctgcgcattcgagtggggcacagacaccagaaagcttgagccgggaaggctctccggccccactggaacccgaaccaggtgcggcccaacctaaactggcagttatacaggaggctaggtttgcacaatcagcccctgggtcaccgctgtcctctcaaccagtgctaattaccgtgcagaggcagctgccgcaggctataaagcccgtgacctacactgtagctaccccggtaactacttcaacgagtcagccaccagtggttcaaactgtgcatgtcgtacaccaaatccctgcggtgagcgtaacttctgtagctggcctggcccccgcaaatacatataccgtgagcggccaggctgtggtaacccctgcagctgtgttagcccctcctaaggccgaggcacaggagaacggtgatcatcgcgaagttaaagtaaaggtggaacctatccccgcaatcggccacgcgactctcggtaccgctagcaggattattcagaccgctcagacaactcccgtgcagacagtgaccatcgttcagcaagccccactaggtcagcaccagctcccgatcaagaccgtcacccagaacggtacacacgttgctagcgtgccgaccgccgtgcacggccaggtgaataacggaccgctgggtctccgtcgtcccccatgcgcatcctcagattggtcttgcctgagctag

SEQ ID NO: 117344 - DNA, 1038 bp, Artificial Sequence
  Description of Artificial Sequence: Synthetic coding sequence
atgtcccatctgttcgatccaaggctacccgctctagcggcgtcacctatgctgtatctgtacgggcctgaacgccctggcctacccctcgccttcgccccggccgccgcccttgctgcttccggccgcgccgagactccacagaaaccgccatatagctatatcgccctaatagctatggccatccaggacgcgcctgaacagagggtgacattgaatggcatataccagttcataatggaccgatttcccttctatcacgacaaccgacaaggatggcagaatagcatccggcacaatctctctttgaacgattgcttcgtcaaggtgcctcgagaaaagggaagacctgggaaaggctcgtattggactcttgaccctagatgcctggacatgtttgaaaacgggaactatcgccggcgcaagcgcaaacctaaacctggcccgggagcgcctgaggctaagcggccgagagcagagacgcaccagaggtctgctgaggcacagcctgaggccggcagcggtgccggaggcagcggacccgcaataagtaggttgcaggccgctcccgctggaccttcacccttgctggacggccctagcccgccggctcctctgcattggccaggaacagcaagtccaaacgaggacgccggggacgccgcacagggcgcggccgcggtggccgttggccaagccgctcggacaggagacggacccgggagcccccttcgaccagccagcagatccagcccaaaaagcagcgacaagagcaagtcctttagcatagattctattctcgccggaaaacaaggtcagaagcctccatcaggcgacgagcttctcgggggcgctaagccgggcccaggcggccggctgggcgccagccttttagccgcaagtagtagcctccgtcctccattcaatgcgtcactgatgctcgatccacatgttcagggcggcttctatcagctgggcattccattcctatcctatttccccctccaggtccccgacacagttctgcactttcaatag

SEQ ID NO: 117345 - DNA, 1131 bp, Artificial Sequence
  Description of Artificial Sequence: Synthetic coding sequence
atgatggcatcatacccagagccagaggacgccgctggggccctgttggccccagagacggggcgcaccgtgaaagaacccgagggccccccccccagccccggcaagggagggggggggggaggaggcaccgcccccgagaaaccagacccagctcaaaagccaccttactcttatgttgctcttatagcgatggcgataagggaaagcgccgaaaagaggctgacactgagcggcatataccagtatatcatagcaaagttccctttctacgagaaaaataagaagggttggcaaaactccattcgccataatttatctctgaacgagtgcttcataaaggttcccagagagggcggcggggagcggaaagggaactactggacactggaccctgcctgcgaggacatgttcgaaaagggaaactaccgcaggagaaggcgcatgaaacgccccttccggcctcccccagctcattttcagcctggaaaggggttgttcggcgccgggggagctgctggtggttgtggcgtggcaggcgcaggagctgatgggtacgggtacctagcccctccaaaatacctgcagagcggatttcttaataactcttggccattgcctcagcccccttctccaatgccctatgcatcttgccaaatggctgctgcggctgctgccgctgcagccgccgccgctgcagcgggaccggggtcacccggagcggctgccgtggtgaaggggctagctgggcccgccgcctcatatggcccatacaccagggtgcagagtatggccctgcctcccggcgtagtcaacagctataacggcttaggcggaccaccagccgcgccgcccccccctccacatcctcacccccatcctcatgcacaccatcttcacgcagcagcagcccctcccccagcaccccctcaccacggggcagcagcccctccgcccggacagctgagcccagccagtccggcaactgctgctccccccgctcccgcacccacttcggctcccggcttgcagtttgcttgtgccaggcagccagaactggccatgatgcattgcagctactgggatcatgatagcaagacaggtgcactacatagccgtctggacctgtag

SEQ ID NO: 117346 - DNA, 810 bp, Artificial Sequence
  Description of Artificial Sequence: Synthetic coding sequence
atgatggcctcataccccgagcccgaagatgccgccggtgcactgctggcacccgaaactgggaggacagttaaggagcctgagggacccccacccagtcctggcaagggcggaggagggggcggaggcacagccccagagaaacctgaccccgcccagaaacccccttacagttacgtggccctgatcgccatggctatcagagagtccgcggagaagaggcttacactctccggcatttatcagtatattattgcaaaatttcccttttatgaaaaaaataaaaagggatggcagaatagtatcaggcataacctatccctgaatgaatgcttcatcaaggtcccacgcgagggggggggggagcgaaagggcaactattggactctggaccccgcctgcgaggatatgtttgaaaaaggcaattaccggaggaggcgtagaatgaaaaggccatttcgccctcctcccgcccatttccagcctggcaagggcctttttggcgccggaggcgcagcaggcggctgtggtgtggccggagcaggggccgacggatacggatatctggccccgccaaagtacctccagtcagggttcctcaacaattcttggcctttacctcaacctccgtctccgatgccgtacgcctcctgtcagatggccgcagccgctgccgcagccgccgccgccgccgccgccgctggtcccggtagcttagcccgccctctgtggagtagaggttggagagctaggcccccaaggacaggcaggacccacgcttgcagagcctggcggtgcccacctgcgtag

SEQ ID NO: 117347 - DNA, 2406 bp, Artificial Sequence
  Description of Artificial Sequence: Synthetic coding sequence
atgaagacctctcccagacgccccctcattctaaagcggcggcgactgcctctccctgtgcaaaatgccccctccgagactagcgaggaggaaccgaaacgtagtccagcccaacaggagagtaaccaggctgaagccagcaaggaggtcgcagaatctaattcttgtaagttccctgccgggatcaagatcattaaccaccccaccatgccaaatacccaagtggtggcaatccccaacaatgccaacatacattcaataatcactgcactgaccgctaaggggaaggaatcagggtcgtctggtcctaataaattcatcctcatcagttgcggcggcgcaccaacacagcctccggggttaagaccgcagacacagacgtcctatgatgcgaagagaactgaggtcacactggagacactgggacctaagcctgcggcacgcgatgttaacttgccacgccccccaggagcactgtgcgaacagaagcgcgaaacatgcgccgacggcgaggccgctggatgcacaattaataattcgctctctaacatccaatggctccggaagatgagtagcgatgggctgggatcaaggagtatcaagcaggagatggaggagaaagagaactgtcatttggagcagagacaggtgaaagtggaagaaccttcccgcccttcagcaagctggcagaatagtgtgtcggaacgccctccatattcatacatggccatgattcagtttgctattaattctacggagcggaaaagaatgacattgaaggacatatatacttggatcgaagaccacttcccctacttcaaacacatcgcaaagcccggatggaaaaatagtatcaggcataatctctcactgcacgacatgttcgtgcgagagacgtcagcaaacggcaaggtctccttctggacaattcacccatcggctaacagatacttgacgctggatcaggttttcaagccgctggatccagggagccctcaacttcccgagcacctcgagtctcagcaaaagaggccaaatcccgagctgcgcaggaacatgactataaagacagagttgcctcttggagccaggcgaaaaatgaagcctctacttccccgggtatccagctacttggtgcctattcaatttcctgtgaaccagtctctggtactgcagccaagtgtcaaggtccccctgccactcgctgcttccctaatgtcctcagagctggcgcggcattctaagcgcgtgaggatcgcacctaaggtgtttggcgagcaggtcgtgtttgggtatatgtctaagtttttctccggtgacctgcgggactttgggactccgataactagcctctttaattttatctttctgtgcctgtcggtgctcctcgccgaagaggggatcgctccgttgtcttccgcaggccccggcaaggaggagaagcttctctttggagagggtttctcacctttgctacctgtccagactatcaaggaggaggagatccagcccggtgaagagatgccgcacctcgccaggccgattaaagtagagagcccccccttggaagaatggccctcccccgccccgtcatttaaagaggagagtagccattcctgggaggactcttcccagtcccccaccccgcggcccaaaaaatcttattctggtttgcgctccccaactaggtgtgttagcgaaatgttagtgattcaacatcgagagcggcgtgaaagaagccggtccaggaggaaacagcacttgttgccaccttgcgtggatgagccggagctcctcttttcagaagggccatccaccagcaggtgggccgccgaactcccttttcccgcagactcgtctgatccagcaagtcagctgtcctactcccaagaggtaggggggccatttaaaactcctattaaagaaactctccctatctcctctactcctagcaagtctgtgctgccgcgcacacctgagtcttggcgcctgacacctcccgccaaggtcggcggcctggatttttcacctgtccagactagccaaggggcaagcgaccccttgcctgacccgctgggtctgatggacctgagtacgacccccctccagtcagccccacccctggagtcacctcagaggctgctttccagcgagcccctagatctcatatccgtccctttcggcaatagtagcccaagtgatattgatgttcctaaacccgggtctcccgaacctcaggtaagcggcttagccgccaaccgctccctcaccgaaggactggtcttggacactatgaatgacagtctctctaagatattacttgacatcagtttccccgggctggatgaggatccgctcgggcccgataatatcaattggtcacagtttatccctgagcttcagtag

SEQ ID NO: 117348 - DNA, 2292 bp, Artificial Sequence
  Description of Artificial Sequence: Synthetic coding sequence
atgaagacctcacctaggagaccccttattttaaaaagaaggcgacttcccctccctgtacaaaacgcgccatctgaaacatctgaggaagaacccaaacggtccccggcccagcaagaaagcaatcaagcagaggcatcgaaggaggtcgccgaaagtaactcatgtaagttccccgccggcatcaaaattataaaccaccccacgatgccaaatacgcaggtcgtggcaattcctaacaacgccaatatacattccattatcaccgcccttacagccaaggggaaagagtctggttcatccggcccaaacaagtttattcttatctcttgcggcggggcaccgactcaaccgccaggccttcggcctcaaacccagacttcatacgacgccaagagaacagaagtgactctcgagacccttggcccaaaacctgctgccagagacgtcaacttaccgagaccccccggggctctgtgtgaacagaaacgcgagacgtgcgctgacggggaagccgcagggtgcacgattaataactccctaagtaatattcagtggctgaggaaaatgtcgagcgatggccttggaagccggtctattaagcaggagatggaagagaaggagaactgccacttggagcagcgccaggtgaaagtagaggagccttccagaccaagcgctagttggcagaacagcgtctctgagcgacccccttatagctacatggccatgattcagttcgcgatcaatagcacggagagaaaacggatgaccctgaaggatatttatacatggatagaggatcattttccatatttcaaacatattgctaagccgggctggaaaaactctatccggcacaacctatctctccacgatatgttcgttcgagaaacctcagcaaacggcaaagtgtctttttggaccattcacccatcagccaacaggtatttgactctggaccaggtttttaaaccccttgatcccggctcacctcagctgcccgaacacttggagagccagcagaaacgaccaaaccccgaactgaggcggaacatgactatcaagactgagcttccactcggagccagacgcaagatgaagccacttctccctcgggtgagtagttacctcgtgcctatccaatttcccgtaaaccagagcctggtgctccaaccaagtgtgaaagtccccctgcccctcgcggcctctttgatgagctcagagttggcaaggcactccaagcgagttagaattgcacctaaagtcctcctggctgaggaaggtattgctcctctgtccagtgctgggcctggcaaggaagaaaagctgctgtttggagagggcttcagcccactgctgccagtacaaaccatcaaggaagaagagatccagccaggtgaggagatgccgcacttggcacgccctattaaagtagaatctccacctctggaggagtggccttcaccagcgccctcattcaaggaggagtcttcccacagttgggaggattcttcccagtcccccacaccccgacctaagaagagctacagcggccttcggagtcccacaagatgcgtgtcagagatgctggttatccagcaccgcgagagacgagagaggagcaggtctcggagaaaacagcacctcttgccaccatgtgtcgacgagcctgagcttctcttctctgaaggcccttccacaagtaggtgggccgccgaactgccttttcctgccgacagtagtgaccccgcatcacaactcagctattcccaggaggtgggcgggccgttcaaaacgcccatcaaagagactctccccatcagctccactccctccaagagtgtgttacctaggactcctgaaagctggaggctgaccccacccgctaaggttggcgggctagactttagcccagtccagaccagccagggtgcgagcgatccactccctgaccctcttgggctcatggatctgagcaccactccactacagagtgctccgcccttggagtcaccccagcgactcctgtctagcgagcctctggatctaatttccgtgccattcgggaatagctccccatcagacatcgatgtgcctaaacctggttcccctgaaccacaagtctccggcttggccgccaatcgttctctgacggaaggtttagttctagatactatgaacgacagcctgagcaagattctcttggacatttcctttccgggacttgacgaggacccgctaggaccagataacattaactggtcccagttcatcccggaactgcagtag

SEQ ID NO: 117349 - DNA, 2247 bp, Artificial Sequence
  Description of Artificial Sequence: Synthetic coding sequence
atgaagacctcgccaagaagacctctcattttaaaaaggcggaggctgcccttacccgtccaaaacgcgccaagcgagacatccgaagaggaacctaaaaggtcaccagcccagcaggagagcaatcaagccgaggcaagtaaggaggtggctgagtccaactcttgtaagttccctgcgggaattaaaatcatcaaccacccaactatgcccaatacacaggtcgtggccattcctaacaatgctaatatccactccattatcaccgctctgacggcaaagggcaaggaaagcggatcgtcgggacctaataaatttatcttgattagctgcgggggcgctccgactcagcctcctgggttgcgccctcaaacccagacctcctatgacgcaaaaagaaccgaggtcacgcttgaaaccctcggcccaaagcccgccgcaagagatgtaaatctcccgcgtccccctggcgctctctgtgagcagaaacgagagacgtgtgccgatggagaagccgcggggtgcacgatcaacaatagcctgtctaacatccagtggctgagaaagatgagctctgacgggctaggctctaggtccattaagcaagagatggaagagaaagagaactgccaccttgaacagcgtcaggtgaaggtagaagagccttccaggccgtcagcttcctggcagaactcagtgtcagagagaccaccctactcttatatggcaatgattcaattcgccatcaattcaaccgaaagaaaaaggatgactttaaaagacatctatacctggatcgaagatcattttccatacttcaagcatatcgctaagcctggttggaagaacagcattagacacaacctgagcctgcacgatatgtttgtgcgcgagacatccgctaacggcaaagtctcgttttggactatacatccatccgccaatcggtatctgacgctcgatcaggtatttaagcaacagaaaaggccgaatccagagcttcggaggaatatgacgatcaagactgaactgcctctgggcgcccgtcgaaagatgaagccactcctccctcgggttagcagttacctggtgcctatacagttccccgtcaaccagtcactagttcttcagccatccgtaaaggttccgttacctctggccgccagcctgatgagttccgaattggctagacactctaaacgtgtgagaatagcgcctaaggtgctcctagcagaagaaggcatagcccccttatccagcgcaggaccagggaaggaagaaaagctactttttggagagggatttagccccctattgcctgttcagaccattaaggaggaggaaatccagcccggagaagagatgccccacctggcccgtcccatcaaggttgaaagtccaccccttgaggagtggcccagcccagctccttccttcaaggaggaaagtagccatagctgggaggactcgtcacagagtcctacaccgcggccaaaaaaatcatactcagggttgcggtcacccactaggtgtgtctcggagatgctggtaatacagcatagagagcgcagagaacggtccaggtcccgacgcaaacaacatctgcttcctccatgtgtggatgaacctgagttacttttctccgagggcccttcaacaagccgttgggccgcagaacttccattcccagccgattctagtgacccagcctcccagctgagctacagccaggaggtgggggggcccttcaaaactcctattaaagaaacactgcccatatctagtacaccttccaagagtgtgctgccaagaacccccgagagctggagactgacccctcctgcgaaagtcggcggcttggatttctcaccagtgcagactagtcagggcgctagcgaccctctgcctgaccccttggggctgatggacctatccactacacctttacaatccgccccacctctagagtctccacagcgcctattatcgagcgagcctttggacctgatttctgtgcctttcggtaacagctccccatctgatatcgacgttcctaagccaggtagtccagagccgcaggtgtctggtctggccgccaatcggtcattgactgaggggctcgtactggacactatgaatgatagtttaagcaaaattctcctggacatctcctttcctggactggatgaggacccactcggcccagacaatatcaactggtcccaatttattccggaactacaatag

SEQ ID NO: 117350 - DNA, 531 bp, Artificial Sequence
  Description of Artificial Sequence: Synthetic coding sequence
atgggagctcctgctacacgtcgttgtgttgaatggcttctgggactttattttctgagccacatcccaatcaccctgttcatggatctccaagccgttctgcctagggagctgtacccagttgagtttagaaaccttttgaagtggtatgccaaagaattcaaggaccccctgctgcaggaaccccccgcctggttcaaatctttcctgttttgtgaactggtcttccagctgccttttttccctatcgccacatacgcctttttgaagggcagctgcaagtggattcggaccccggccattatctatagcgtgcacaccatgacaaccctgattcccattctgagcactttcctatttgaggatttctccaaggcttcaggtttcaaaggccagcgacccgagacactgcatgaacgcctgactctggtctccgtctatgcaccttatttgctcattcctttcattctgttgatattcatgctgcggtctccatactacaagtatgaagagaaacgcaagaagaagtag

SEQ ID NO: 117351 - DNA, 1473 bp, Artificial Sequence
  Description of Artificial Sequence: Synthetic coding sequence
atggggcctgtaatgccaccttcaaagaagcctgagagctcaggcatttcagtcagcagcggattgtcccaatgttacggcgggtctggtttcagtaaagccctgcaagaagatgatgatttggatttttcgctgcctgatattcgcctggaagagggcgccatggaggatgaggagctgacaaacttgaactggctccatgagagcaagaacctgctcaaatcttttggggagagtgtcctcaggtccgtctcaccagtgcaagacctcgatgacgataccccgccatctccagcccattcagatatgccgtatgatgctaggcagaacccgaactgcaagcctccatacagctttagttgcctgattttcatggccattgaggacagccccacaaaacgactacccgtcaaagacatatataactggatcctggagcactttccttacttcgccaacgccccaactggatggaaaaactccgtgaggcataacttgagcctgaataagtgttttaagaaagtggacaaagagaggtctcagagtatcggaaaagggagcctttggtgtatcgacccagagtatcggcaaaatctgatccaagccctaaagaagactccataccacccacatccccacgtgttcaacaccccaccaacttgcccccaggcctaccagtccacaagcgggcctcctatttggcctggctccactttcttcaagagaaacggcgccctccttcaggatcctgacattgacgcagctagcgcaatgatgctgttaaacaccccgcctgaaattcaggctgggttcccccccggggtgattcagaatggagccagggtcttaagtcgcggcctgttcccaggcgtgagacctctgcctatcacacctattggggtgactgccgccatgcggaatggcattacctcttgtcggatgcggacagagagcgagccatcatgcggatcccccgtggtgagcggtgatcctaaggaggatcataattatagctctgctaagtcatctaacgcgcggtctactagccccacctctgactccattagtagctccagctcaagtgccgacgatcactatgaatttgccactaagggctctcaggaaggctccgaagggtctgagggatccttcaggagccatgaaagcccgagcgataccgaggaggacgacaggaagcactcacagaaagaacctaaagatagcctgggggattctggatatgcctctcagcacaagaagcgccaacacttcgccaaggcgcggaaggtcccatcagatacactcccactgaagaaacggcgcacagagaaaccacctgaatctgacgatgaggagatgaaggaggctgccggatctctccttcatcttgcgggaatacggtcctgcctgaacaacatcacaaacaggactgccaaagggcaaaaggagcagaaggaaacgaccaagaattag

SEQ ID NO: 117352 - DNA, 1473 bp, Artificial Sequence
  Description of Artificial Sequence: Synthetic coding sequence
atggggcccgtcatgcctcctagtaaaaaacctgagtccagcggtatctctgtgtccagcggcctgagtcagtgctacgggggctctgggtttagcaaggccctacaggaggacgatgatctagatttttcactgcccgacatccgactggaggaaggggcaatggaggacgaagagttaacaaacctgaactggctccatgagagcaagaatttgttgaaatctttcggtgagagtgtcctgagatctgttagtcccgtgcaggatctggacgacgatactccaccctcccctgcgcattcagatatgccatatgatgcccggcaaaacccaaattgcaagccaccctactcctttagttgtttgatttttatggctattgaggactcgcctacaaaacggctccctgttaaggacatctacaattggatccttgaacactttccctatttcgcaaacgccccaacgggctggaaaaatagcgtgcgacacaacctgtcgctgaataagtgcttcaagaaagttgataaagaaaggtctcagtccatcgggaaaggtagtttgtggtgcattgatcctgagtatagacagaacctgattcaggcgcttaagaaaacaccctatcacccgcaccctcatgtgttcaatacgcctcctacttgcccccaggcttaccaaagtacctctggcccacctatatggccaggctcaacattctttaaaagaaacggtgctctcctgcaggaccctgatatcgacgccgccagtgccatgatgctacttaataccccaccggagattcaggcaggctttccgcctggcgtgatccagaacggagcccgcgtattgagccgggggctttttccaggtgtgcgccccctccctatcacacccatcggggtgaccgccgcaatgcgcaatgggattaccagctgtagaatgcgtaccgagagcgaaccctcatgtggcagccctgtggtttcaggcgatcctaaagaggaccataactactcatctgcaaagtcatctaacgcacggtctacatcccctacttctgactctatctctagcagcagctcttccgctgatgatcattacgaatttgcaactaaggggtcccaggagggatccgagggaagcgagggaagcttccgttctcatgagagtccaagcgacaccgaggaagacgaccggaagcacagccagaaggagcccaaagactcactcggcgattccggatatgcctcccagcataaaaaacggcagcactttgccaaggctcggaaggtgcctagcgacaccctgcccttaaagaagcggagaaccgaaaaaccaccagagtcggatgatgaggaaatgaaggaagccgcagggtcacttttgcacctggcaggaattagaagctgtctgaacaacataaccaataggacggccaaaggacagaaggaacagaaggaaactaccaagaattag

SEQ ID NO: 117353 - DNA, 165 bp, Artificial Sequence
  Description of Artificial Sequence: Synthetic coding sequence
atgggcccagtgatgcctccaagcaagaaacccgagtctagcggcatttcggtgtcatcaggcctgtcccagtgttatggcgggtcaggcttctctaaggctctccaggaggatgatgatctggactttagcctccctgatatccgtttggaagagggtgcttag

SEQ ID NO: 117354 - DNA, 282 bp, Artificial Sequence
  Description of Artificial Sequence: Synthetic coding sequence
atggggccggttatgccacctagcaaaaagccagagagcagcgggatctccgtctcatcaggcctgtctcaatgttatggcggatctggattcagcaaagcactccaggaggatgatgatctggactttagtctcccggatatccgcttagaggagggcgccatggaggacgaggaactgacaaacctcaactggttgcatgagtccaagaatctgctgaagtcttttggggagagcgtgttgcgtagcgtctctcccgtgcaagacttggacgacgactag

SEQ ID NO: 117355 - DNA, 1407 bp, Artificial Sequence
  Description of Artificial Sequence: Synthetic coding sequence
atggggcccgtgatgcccccatccaaaaaacccgaatccagcgggatatctgtcagctcagggctctcccagtgttacgggggctcagggttttcaaaagcgctgcaggaagacgacgacctggatttttccctgcccgacatcaggcttgaagaaggggccatggaggacgaggaactaaccaacctcaattggcttcatgagagcaaaaacctcctcaagtccttcggcgagagcgtcctgcggtccgtttccccagtccaagacctggatgacgatacacctccctctccggctcattcagacatgccttatgacgctcgacagaatccaaactgtaagcccccatactccttctcatgtctcatcttcatggcgattgaagactccccgaccaaacgcctgccagttaaagacatctacaactggattctggagcatttcccctattttgcaaatgcccctacaggctggaagaacagcgtccgccataacctctccctgaacaagtgctttaaaaaggtggataaagaaaggtcccagtctatcggtaagggaagtctctggtgtatcgacccagagtaccggcagaatctgatccaggcattgaaaaagaccccctatcacccccatccccacgtgtttaacactccgccaacctgtcctcaggcatatcagtccacctcagggccccctatatggccgggctctactttcttcaagcgtaatggggccctattgcaggtccccccaggggtgattcagaacggggcacgcgtgctttccaggggattgtttcctggagtgcgccctctgccaattacgcctatcggcgtgaccgctgctatgagaaacggaatcaccagctgcaggatgcgcaccgagtccgagccctcctgcggcagccccgttgtgagcggtgatcccaaagaagatcataattacagcagcgccaagtcttcaaacgccaggtctacaagtcccacaagtgactcaatcagctccagtagctcctccgctgatgaccactacgagttcgcaacaaaaggaagtcaggagggatccgaagggagcgaaggaagtttccggtcccacgaatccccctctgataccgaggaggacgatcgaaagcactcgcagaaggagccaaaagattctctcggcgatagcgggtatgcctcacagcataaaaaaaggcagcacttcgcgaaggctcgaaaggttccctccgatacgcttcctcttaaaaaacgtcgcacagagaagccgcccgagagcgatgacgaagagatgaaggaggctgcgggctccttgctccacctggcggggatcaggtcttgtcttaataacatcacaaacagaactgcaaaagggcagaaggagcagaaagaaaccacaaagaactag

SEQ ID NO: 117356 - DNA, 627 bp, Artificial Sequence
  Description of Artificial Sequence: Synthetic coding sequence
atgggacccgttatgccacccagcaagaagcctgagagctccggtattagcgttagcagtggtctatctcagtgttacggcggttcggggttctctaaggcattgcaggaggatgacgatttggatttctctctgcccgatatacgtcttgaggagggagcaatggaagacgaggaattgaccaacctgaactggttacacgagtctaagaacctcttgaaaagtttcggcgaaagcgtgttgagaagtgtcagcccagtacaggacctcgacgatgacactcctccatcgcctgcacattctgacatgccgtacgacgcgcgacagaatcccaactgcaagccaccctacagcttttcttgcctcatctttatggcgatcgaggacagccccacgaagcggctgcccgttaaagatatttacaactggatcctggagcacttcccatatttcgcaaacgcgcctaccggatggaaaaattccgtcagacataacctgtcactcaataaatgctttaagaaggtggacaaggagcgcagccagagtattggaaagggatctctctggtgcatcgatccagaatataggcagaaccttatacaggcactcaaaaagaccccttattag

SEQ ID NO: 117357 - DNA, 1407 bp, Artificial Sequence
  Description of Artificial Sequence: Synthetic coding sequence
atgggccccgttatgcccccttccaagaaaccagaatcctcaggcatctccgtttcctccggtctgtctcagtgttacggcggatccggctttagtaaggcgctgcaggaagatgacgacctcgattttagcttgcccgacatccgcttggaggagggagcgatggaggatgaggagctgacaaacctcaactggctgcacgagtctaagaacctgctcaaatccttcggagaaagtgtccttcgcagcgtgtctcctgtacaggacctggacgatgatacaccacccagccccgctcactcagacatgccatacgatgcacgccagaatcctaactgcaagccgccttactcattttcctgcctgatattcatggccatcgaagacagccctacaaagagactgccagtgaaggacatttataattggattttagagcactttccatattttgccaatgccccgaccggctggaagaattccgtgaggcataacttatcccttaacaaatgttttaagaaggtcgacaaagaacggtcccaatctatcgggaaggggagcctgtggtgtattgatcccgaatatcgacagaatctcatccaggcccttaagaagaccccgtaccacccccatccccatgtcttcaacacgcctccaacgtgccctcaggcctatcagtcgacgtccggaccaccgatctggcccggcagcaccttctttaagcgcaacggggccttgttacaggtccctccgggggtgatacagaacggggccagagtgctgtccagaggacttttccctggcgtacgcccattacctataacacctattggcgtcacggccgccatgcgaaatggaataacttcctgtagaatgcgcaccgagtcagagccctcttgcgggagccccgtggtgtccggcgaccccaaggaggatcataactattcctccgctaagtcttccaatgccagatctacttcaccaacctctgactcaatctcatctagttccagttctgccgatgatcactacgaattcgccacaaaggggagccaagagggctcagagggatcggagggtagctttcggtcacacgaatcacccagtgatacagaagaggacgataggaaacattctcagaaggaacccaaggattcgctaggcgactccggctacgcctctcagcacaagaaacggcagcacttcgctaaggcccgcaaagttccttcagatacactgccgttaaaaaagaggcgaacagagaagcctccagagtccgacgatgaagagatgaaagaagccgccggatcactcctccatttggccgggatccgcagctgtctgaacaatatcactaaccgcacagccaaggggcagaaggaacagaaagaaacgacaaagaattag

SEQ ID NO: 117358 - DNA, 777 bp, Artificial Sequence
  Description of Artificial Sequence: Synthetic coding sequence
atgatagaaagtgacacatctagcatcatgtcaggcattatccgaaattcgggacagaatcaccatccatcaccgcaggagtatcgcctcctggcaaccactagcgacgacgatcttccaggggacctgcagtcactgagctggcttactgcggtggatgtgccacgcctgcaacaaatggcatcaggacgcgttgatctcggcggcccatgcgtcccacacccgcacccgggcgccctggccggcgtcgccgacctgcatgtgggcgcaacccccagccctttgctgcatggtcctgccggaatggcaccccgtgggatgcctggattgggacccatcacgggccaccgtgatagtcagatgagccagttcccagtgggcggtcagcctagcagtggccttcaggaccctcctcatctttattctcccgcaacacagccccaattccccctcccgcctggcgctcagcaattgtctgacaggcacggacctgaggaacagcaggaccgccaaccagcatgcgaacgcgacctgcagttacatgagggggcccttcccttgctccaggacgggccccgccgggtggaggagcttggggctgcccagccagtgtcagaacaagtcctcagagaaggaggtgagcaggatgagaggttgctccctcagggactacccgtgggctccgagccaggaccgcataggcaggatggtggaggggacgcccaagtcgaagaggaggggccagggtgtcatccaccggagtacgggcaaccctag

SEQ ID NO: 117359 - DNA, 1554 bp, Artificial Sequence
  Description of Artificial Sequence: Synthetic coding sequence
atgatcgagtccgacaccagctcaattatgagtgggattatacgaaattccggccagaaccaccacccttccccccaggagtatagacttcttgcgactactagcgacgatgacctgcccggagacttgcagtcactcagttggcttacagcggtggatgtcccccgcctgcagcagatggcatcagggagagtcgaccttggaggaccttgcgtgccacatccacatcctggcgccctagctggcgtggccgatctgcatgtcggcgctaccccaagccccttactgcacgggcctgccggcatggctcctcgcgggatgcctggcttgggaccaattaccgggcatcgggactcaatgtctcagtttcccgtgggaggccagccttctagtgggcttcaggatcctccccacttatacagccccgcgacacagccacagttccccctgccgccaggcgctcagcagtgtccccccgtcggtctctacggcccgccgtttggtgtgcggcccccctaccctcaacctcacgtagcagtccattcgagtcaggagcttcatccaaagcactaccccaaaccaatttatagctacagttgcctaatcgccatggctctgaaaaatagcaaaaccggtagccttcctgtttcggagatatacagcttcatgaaggagcatttcccatatttcaaaactgctccagacgggtggaagaattccgtgaggcataatttgtccttaaacaagtgcttcgaaaaggtcgagaacaagatgagcggcagttccaggaaggggtgcctgtgggcgctcaacttggcccgaatcgacaagatggaagaagaaatgcacaagtggaaaagaaaggaccttgcagccattcacagatctatggctaatcctgaagaattagataagctgatctcagaccgacccgaatcatgccggaggcctgggaaaccgggggaaccggaggccccagtcctgactcacgctacaactgtcgcagttgcccacggctgcttagccgtgtctcagttacctccccagcccttgatgactctttcgctgcagtcagtccccttgcatcaccaagtccagccgcaggcccacctagcccccgacagccccgctcctgcccagaccccccccttgcatgctctgccagacctttctcctagcccacttcctcaccctgccatgggcagggcaccagtagacttcatcaatatcagcaccgacatgaacaccgaggtcgatgctctggatccgtcgatcatggactttgccctgcagggtaatttgtgggaggagatgaaggacgaggggttttcattggacaccctgggcgcttttgcggactctccattgggctgcgatctgggggcctctggccttacaccagcttcgggagggtccgatcaaagctttccagatctccaggtgacgggcctctatactgcctacagtactcccgacagcgtggcggcctcagggacttcaagcagctcccaatacctgggtgcccaaggtaacaaacccatcgccctcctttag

SEQ ID NO: 117360 - DNA, 1014 bp, Artificial Sequence
  Description of Artificial Sequence: Synthetic coding sequence
atgcccggtttgccatgtccagctctgccttgtccagccccacctccagccccaagctgtctaatcgccatggccctgaaaaattctaagaccgggtcacttccagtgagcgagatttactcgtttatgaaggagcatttcccctattttaagaccgctccggacggatggaagaatagcgtgagacataacctgagtctcaacaaatgtttcgaaaaggtggagaataagatgtcagggagttcaaggaagggctgtttgtgggctttgaatctggctagaattgataaaatggaggaggaaatgcacaaatggaaaaggaaagatctagctgcaatccatcggtccatggccaatccggaagaactagataaactgattagcgatcggcctgaatcatgccggcgacccggtaaacctggggagcccgaggccccagtcctgacgcatgctaccacagttgctgtggctcacggctgccttgctgtctcccaactaccaccccagccactcatgaccctttccttgcagtcggttcctctgcaccatcaagtccagcctcaagcccacctggccccagattctccggctcccgcgcagaccccgccactccatgcactgcccgacctgagtccgtcaccactgccccatcccgctatggggcgagcgccagttgactttatcaatatttctactgatatgaataccgaggtggatgcgctggaccctagcatcatggatttcgcactgcaggggaatctttgggaggagatgaaggacgagggcttctcactggatacccttggcgctttcgctgattccccacttggctgcgacctgggggctagtgggcttacaccagccagcggagggagcgatcagtccttccctgatctgcaagtgaccggtttgtacaccgcctattctacccccgactctgtcgctgcctccgggacctcaagctcatcacagtacttgggcgcgcaggggaacaaaccgattgccctcctgtag

SEQ ID NO: 117361 - DNA, 1680 bp, Artificial Sequence
  Description of Artificial Sequence: Synthetic coding sequence
atggccgctaagttacgcgcgcatcaagtggacgtcgatcccgactttgccccacagtcgcgacctcggtcatgtacttggcctctgcctcagcccgatctcgccggcgatgaagatggggccctgggtgctggggtcgccgaaggggcagaggattgcgggccggagaggcgtgccacagcacccgcaatggcccccgcccccccactcggcgcagaggtagggcctttgaggaaagccaaatcaagtcggaggaacgcgtggggtaacttgagttacgccgacctgatcactaaagcaatcgaaagcgcaccagacaaacgcttgaccctctcccagatttacgactggatggtgcggtacgttccatacttcaaagataagggtgatagtaattcatccgctggatggaagaactcaattaggcacaatctgtccctgcacaccagattcattcgtgttcagaatgagggtaccggaaagagctcctggtggatgctgaacccagaggggggtaagacagggaaaactcctagacgcagagccgtgtccatggataacggagcaaaattcctgcgtatcaagggcaaggcgtccaagaaaaaacaattgcaggcacctgagaggagcccggacgacagttccccctcagcgccagccccaggtccagtgccagccgccgctaagtgggccgcctcacccgcctctcacgcttctgacgattatgaggcttgggctgactttagggggggcggccgccccctcctgggcgaggctgccgaattagaagatgacgaggcactggaagctttggccccctctagcccccttatgtacccaagcccggcttctgccctttcccctgccctaggcagccgctgtccgggcgagctccccagactggccgagctcgggggcccactgggccttcacgggggaggcggtgcaggactcccagaggggcttctggatggcgcccaggacgcttatggcccgagagcccgcgcccaggcccgcccaggtgccggctgcgccggaggggccggggccgggggtcgaagccgaagactccccaggcagagaggggggcctgtacgcgctgcaagggccttggctcagtgcctttcaccgcctcaccagccctatgacgctgctaggcggggcggaagacgtggacccggcacagcggggcctaggagaagactgcgcggaccggctcgaagaccacccgctggaagaagcgccggcgcactgcggtgccggcgacgcagggccgccggccgccgtgcgcgtccgcttccagggaggcctggacctcggcacgtgcagcgtgagccccgggtgcgtcgtggtgttcaccatccccagcggctgcacggacagcggcgaaacggcctgcagctccggtttggccccgcaagtgccgcagcagggcccggacggggacctgcaccccagcccgagttaggtgccggcctcagagcagcatccaggctcagagcccccaggcctgtcccgcgcgggcccctttcctcacacccagatagtcgggttcctgctcctgattctagttctccaggtggagggccttccccggcacgagatcccagccgccgccccgccgccggggaaggcgaaggcggagctggggcccctcactgctcttgtcctcatagctag

SEQ ID NO: 117362 - DNA, 2034 bp, Artificial Sequence
  Description of Artificial Sequence: Synthetic coding sequence
atgatgcaagagtctggaactgagacgaaatcgaacggctcggccatccagaatggaagtggagggtccaaccatctgcttgaatgcggggggttaagagagggtaggagtaacggcgagacgccggctgttgacatcggagccgcagatttggcccatgctcaacagcagcagcagcaggccctgcaggtagctcgacagctgcttctgcaacaacagcaacagcagcaagtgagtggactcaagtctccgaaaagaaatgataaacagcccgcactacaggtgcccgtgtccgtcgcaatgatgacacctcaggtaataaccccccaacagatgcagcagatcctacagcagcaagtgctgtcaccccagcagctgcaggtgctcctgcaacagcaacaggctctcatgttgcaacaacagcagctgcaggagttttataaaaagcagcaagagcagctacagctgcagctgttgcagcagcagcacgccggcaagcagcctaaggaacagcagcaggttgccacccagcagctcgcctttcaacagcagcttctgcaaatgcagcagctccagcagcagcatctcctatctcttcagagacagggactgctgacaatccagcccgggcaacccgctctgcctttacaaccgttagcccaggggatgattcccacagagctccagcagctgtggaaagaggtgacctcggcccacaccgccgaggaaactacgggtaacaatcattcttctctcgatctgaccaccacttgcgtgtcaagctccgcccccagtaaaacttcactaattatgaacccccacgcatctaccaatggccagctgtccgtgcacacccccaagagggagtctctgtcccatgaggagcacccccatagccatcccctctatgggcacggtgtatgtaagtggcctgggtgtgaagctgtgtgtgaggatttccagtcatttcttaaacatctgaattctgagcacgccttagatgatcgcagcacagctcaatgcagagtgcagatgcaggtagtccagcagctggaactgcaactggctaaggataaggaacgcctgcaggccatgatgactcacctgcatgtgaaaagcacggaacctaaggcagcaccccagccgttgaaccttgtgtctagcgtcaccctgtctaagtcggcatctgaagccagccctcagtcactccctcataccccaaccacacccacagcccccctgacccctgtgacccagggcccttctgtgattacaaccacgagcatgcacactgttggcccaattagaaggcggtattctgataagtataatgtgcccatcagctccgctgatatagcacagaaccaggaattctataaaaatgcggaagttagaccacccttcacatacgcaagtctaatacgccaagccatcctggagagccccgaaaagcaactgacactcaatgagatttacaactggtttacccgcatgtttgcttatttcagacgcaacgccgcaacctggaagaacgcggtgagacataacttatcgttgcacaagtgctttgtgcgggtcgagaacgtcaagggtgccgtatggacggtagacgaagtcgaatttcagaagaggaggccccaaaaaatatcaggcaatccaagcttgattaaaaacatgcagagctcccacgcatattgcactcccctgaacgctgcattgcaggcctccatggcagaaaactcaatacccctgtatacaacggctagcatgggaaatcccactctggggaacctggcgagcgctatcagagaggagctcaatggagccatggaacatactaatagcaatgagagtgatagctctccaggccgtagtccaatgcaagctgtgcatccagtgcacgtgaaggaggaaccattggaccctgaggaagcagagggacctctcagcctcgtgacgaccgcgaaccacagcccagattttgatcatgacagggattacgaagacgagcccgtgaacgaggacatggagtag

SEQ ID NO: 117363 - DNA, 1077 bp, Artificial Sequence
  Description of Artificial Sequence: Synthetic coding sequence
atgatgaccccacaggtgatcacaccgcaacaaatgcaacagatccttcaacagcaggtgctgtcgccgcagcaactgcaagttctgctccagcagcagcaggcattaatgctgcagcagcagcagctacaggagttttacaaaaagcagcaggagcaattacagctccagctattgcaacagcaacatgcagggaaacagcccaaggaacaacagcaggtagcaacccaacaactcgcatttcagcagcagctgctccaaatgcagcagctgcagcagcagcatctcttgtcacttcagcgacagggacttctgaccatccaacctggccagccggcactgccactccagcctctcgcgcagggaatgattcccactgagctccagcaactttggaaggaagtaacaagcgctcacacagccgaggagacgacagggaataatcacagtagccttgatctgactactacctgtgtgtcgagctcagcccccagcaagacgagcctgataatgaacccccacgccagcacaaatggtcaactcagtgtacatacacctaagagggagagcctgtcgcatgaggaacacccccactctcatcccttgtacggccacggagtgtgtaagtggccaggatgtgaggcagtgtgcgaagattttcagagttttctgaagcaccttaactctgagcatgccctggacgacaggtccactgctcaatgtagagtgcagatgcaggtcgtacagcaactggaattgcagctggctaaagacaaggagaggttacaggccatgatgacccacttacacgtcaagtctactgagcccaaagccgctccgcagccactgaacctggtgagtagcgtcacgttgagcaagtccgcatctgaagcgtcaccacaaagcctccctcacaccccaaccacccccacaccccctgacagcagacaccccaggccactctgtcatcataatcaccaacacgcccacggaggcacacacccccaagccgtcctgcgtcagattcagagggcgcacttcgtgtctcgttactgtgcagaaccccggatcttgtag

SEQ ID NO: 117364 - DNA, 1509 bp, Artificial Sequence
  Description of Artificial Sequence: Synthetic coding sequence
atgatgcaggagtccggtacggaaacaaaatctaacggtagtgctatccaaaacggctccggaggctctaatcacctgcttgaatgcggaggattaagggaggggaggagcaatggagaaactcctgctgtggatattggcgctgcagacctggcgcacgcacaacaacaacagcagcaggccctgcaggtggctcgccagctcctgttgcaacagcaacagcagcagcaggtgagcgggctgaaatcccctaagcgaaacgacaagcagcctgccttacaggtcccagtctctgttgccatgatgacacctcaggtgataacgccacagcagatgcaacagattctgcaacagcaggtgctttctccccaacagctgcaggtgctgttgcaacagcaacaagcacttatgctgcagcagcagcaactgcaggagttttataaaaaacagcaagagcagcttcagttgcagcttctccagcaacagcacgccggaaagcagccaaaggagcagcagcaagtggcgacccagcagttggcatttcagcaacagttgttgcagatgcagcagctgcagcagcaacacttgttatcactgcagcgacaggggctacttaccattcagcccggacaacccgcactccccttgcagcctttggctcagggtatgatccctacagaattgcaacagctctggaaagaggtcacatctgcacataccgctgaggaaacaacgggcaataatcattcctctctcgatctaactaccacttgcgtttcttccagcgccccctccaaaacttctctgataatgaatccacacgcctcaaccaatggccaactgtccgtgcacacccctaagcgagagagcctaagccatgaggaacatcctcacagccaccctctgtacggacacggggtgtgtaaatggcccgggtgcgaagccgtctgcgaggacttccagtcttttttgaagcatcttaatagcgaacacgcattagatgacagaagcacagcccaatgccgggtccaaatgcaagtggtgcagcagctcgaactgcaactagctaaagacaaagaacggctgcaggccatgatgacccatcttcatgtgaagtccaccgaaccaaaagccgccccgcagcctctgaacctcgtgagcagtgtgacgctgtcaaagtctgccagtgaagcatcaccccagtcattaccccacactcccaccacgcctactgcccccctcacacccgtaacacagggcccatctgtaatcaccacaactagcatgcatactgtcggacccatacgaagaaggtacagcgataagtataatgtgcctatatctagtgccgacattgcccagaatcaggagttctataaaaatgccgaggttagacccccattcacatacgcctctctcattcgccaggccatcctggagtctccagagaagaagaagaaagaacggcaaacactgggaaccatgcctatccactcaactcagcagtag

SEQ ID NO: 117365 - DNA, 1470 bp, Artificial Sequence
  Description of Artificial Sequence: Synthetic coding sequence
atgatgacgccacaggttatcaccccccaacagatgcagcaaattctgcagcagcaggtgttatcaccacagcagttacaggtgttgctacagcagcagcaggccctcatgctgcagctgcagcaactatggaaggaggttactagtgctcacactgcggaggaaaccaccggaaataaccacagctcgctcgatcttacaacgacgtgtgtttcatcctcagcgccaagcaagacatcgctaatcatgaatccgcatgcctcgactaatggacagctgtcggtgcacaccccaaagcgagaatcactatctcacgaagagcacccccactctcatccgctgtacgggcatggtgtctgcaagtggccgggctgtgaggccgtttgcgaggatttccagagctttctgaaacacttaaatagcgaacacgcgctggatgatcggagcactgcccaatgtcgggttcagatgcaggtcgttcagcaacttgaactgcagctcgccaaggacaaagagcggttgcaggcgatgatgacgcacttacacgttaaatcaacggaaccaaaggcagctcctcagcctttgaatctggtctccagtgtaactttgtcaaaatccgcctccgaggcctccccccagtcacttccccacacacccaccacaccgaccgcccctctcacgcccgtcacgcagggaccgagcgtcataacaaccacatccatgcataccgtgggcccaatcaggaggaggtattccgacaagtacaacgtgcccattagcagcgctgatatcgcgcagaatcaagagttctacaaaaacgcggaggtccgtcctccctttacatatgcatctcttattcgtcaagccattctggaatcacctgagaaacagcttaccttgaacgagatatataattggttcaccagaatgttcgcatattttcggcgcaatgccgcaacatggaagaacgctgtccgccataacttgtctctgcacaaatgttttgttcgagtggagaatgtgaaaggcgcggtatggaccgtcgatgaggttgaattccagaagcggaggcctcagaagatctctggaaatccatcattaattaagaatatgcagtcttcacacgcctattgcaccccgctgaatgcagcactacaggcgtcaatggctgaaaacagcatccctctgtacaccacggcttccatgggaaacccaaccttgggcaatctggccagcgcaatacgagaagagctgaacggcgctatggaacacaccaactctaatgagagcgacagcagtcctggccgcagccctatgcaagctgtgcatccagttcatgtcaaggaggagcctctcgaccccgaggaggctgaaggccctctgtcgttagttactactgctaaccactcacccgattttgaccatgatcgggactatgaagacgagcctgtgaacgaagacatggaatag

SEQ ID NO: 117366 - DNA, 2034 bp, Artificial Sequence
  Description of Artificial Sequence: Synthetic coding sequence
atgatgcaagagtcagggactgagaccaaatcaaatggtagtgcgatccagaatggcagcggaggcagtaaccacctgttggagtgtggcgggctccgagagggaagaagtaatggagaaacacccgcagtggacatcggcgctgcggatcttgcccatgctcagcagcaacagcagcaagctctgcaggtggcaagacaactgctcctgcagcagcagcagcagcagcaggtgagcggcctaaagtctcctaaaaggaatgataagcagccagccctgcaggtgcccgttagcgtggctatgatgactccccaggtcataaccccccagcagatgcaacagatcctccagcaacaagttttgtccccacaacagctccaggtgttacttcaacagcagcaagccctcatgttgcagcagcagcagctgcaggagttctataagaagcagcaggagcagcttcaattacaactgcttcagcaacaacacgccggcaagcaacctaaagagcagcagcaggtggctacgcagcaacttgcattccagcagcagctgctgcagatgcagcagctccaacaacaacatctcctgtctttgcagcgacagggcctgctgacgatccagccaggacaacccgctctgccccttcagcccttagctcaggggatgattccaaccgaactgcagcagctttggaaagaagtgacttctgcccacactgctgaggaaaccacagggaacaaccattctagcctggatttaaccactacgtgtgtcagcagctcagcacctagtaagacatccctaattatgaatccccacgcatccactaatggccaactgtccgtgcatacacctaagcgggaaagcctgtcccacgaggagcatccccatagccaccctttgtacggtcacggagtgtgcaaatggcctggctgcgaggcagtttgtgaggacttccagtcttttctcaagcacctgaatagcgagcacgcccttgatgatcggtcaacagcccaatgtagagttcagatgcaggtcgtccagcagctcgagctccagctagcgaaggataaggaaagattgcaagccatgatgacccacctgcatgtgaaatccacagagcccaaggcggccccccagcctctgaatctcgtgtcgagcgtcacactctccaaaagtgcatctgaagcctctccacagagtctaccgcatactccaactacccccaccgcacccctgacccccgtgactcaaggcccatctgtgattaccactaccagtatgcacaccgtcggacctattaggcgccggtactctgacaagtacaacgtgccgatctccagtgcagatatcgcccagaaccaggaattttataagaacgcggaggtcagacctccattcacttacgccagccttattaggcaggctatattggaaagtccagagaaacagctcactcttaacgaaatctataattggttcacccgtatgtttgcctacttccgaaggaacgcagcaacgtggaaaaacgctgtgaggcacaatctctccctgcacaagtgcttcgtgcgggtggaaaacgtcaagggcgccgtgtggacagtggatgaagtggagtttcagaagcgacggcctcagaagatctctggcaatccctctcttatcaaaaacatgcagtcctcccatgcatattgtacacccttgaacgccgcacttcaggcaagcatggctgagaactctatacctctgtataccacggcctccatgggtaaccctactttaggtaatctcgctagtgccattagagaggaactaaatggagcgatggaacacactaacagcaacgaatccgactcgtcccctggcagatcccctatgcaggccgtccaccctgttcacgtaaaggaggaacccctcgacccagaggaagctgagggtccactatctctagtgacaaccgcgaaccacagtccagattttgaccacgatcgcgattatgaggacgagcccgtgaacgaggacatggagtag

SEQ ID NO: 117367 - DNA, 1806 bp, Artificial Sequence
  Description of Artificial Sequence: Synthetic coding sequence
atgatgcaggagtccgggacggaaactaagtccaacggctcggctattcaaaacggaagcgggggtagcaatcacctgctcgagtgtggaggacttcgcgagggacgctcaaacggagaaaccccagcagtcgacataggagcagcagatctcgctcacgctcagcaacagcagcaacaggccctgcaagttgctcgtcagttgttgctccaacaacaacagcagcaacaggtgtctggactgaagtcaccaaaaaggaacgacaagcagcctgcactgcagcagcagcaagtggctacacagcagttggccttccaacagcagttacttcagatgcagcaactccagcagcagcatttactgtcactccaacgtcaaggtctgctgactatccaacccggccagccagcgctgcctcttcagcccctagcccaggggatgattccgacagagctccagcagctgtggaaagaggtcacctccgctcacactgccgaagagaccacaggtaacaatcactcaagtctggatcttactactacctgtgtgtcatctagtgctccaagcaagacctcccttatcatgaacccacacgcctccaccaacggccagctgtccgtgcatactcccaaacgcgaatccttaagccacgaggagcacccccacagtcaccctttgtacggccatggggtatgtaaatggcctggttgcgaggctgtttgtgaagattttcagagttttctcaaacatcttaattcagaacatgccctagacgatcgatccaccgcacagtgccgggtccagatgcaggtcgtccagcagttggagctccagttggcaaaagataaggaacgcctgcaagctatgatgacacatctgcacgtgaagtctacagagcccaaggcggcccctcaacctctaaacctcgtctccagtgtaacattgtccaaatccgcctcggaggcctccccacagtctctgccgcatacgcctacaacacccacagcgccccttaccccagtgacacagggcccctcagtcattactaccacatccatgcacacggtcgggcccattcggcgccgctattcggacaaatacaacgtgcctatatcatcggccgatatcgcccaaaatcaagagttttacaagaatgccgaagtgagaccacccttcacgtacgcctcgctgatcagacaggccatacttgagtctcctgaaaagcaactaacgttgaatgagatttacaactggttcacaaggatgtttgcatatttccgccggaatgcagcgacctggaagaatgcagtgagacacaatctgtcgctgcacaaatgcttcgtccgggtggagaacgtgaaaggcgcagtgtggactgtagacgaagtggagttccagaagcgcagacctcagaaaatcagcggaaaccctagcttaattaagaacatgcaatccagtcacgcttactgtactcccctgaacgccgccctgcaggcgtctatggcagagaattctatccccctgtatacaaccgcttccatggggaacccaacactcgggaatttggcctccgcaattagggaagagctcaacggtgccatggagcatactaattcgaatgagtcagacagcagcccaggtagaagcccaatgcaggcggtgcaccccgttcacgtcaaggaggaacctctggacccagaggaagccgagggtcccctgtcgttagtgacaacagctaaccactctccggattttgatcatgatcgggactatgaagacgaacccgtcaacgaggacatggaatag

SEQ ID NO: 117368 - DNA, 675 bp, Artificial Sequence
  Description of Artificial Sequence: Synthetic coding sequence
atgatgactccccaggtgatcacccctcagcagatgcagcagattctgcagcagcaggtgctgtctccacagcagctgcaagtgctgcttcaacaacaacaagcacttatgctccagcagcaacagctgcaagagttctataaaaagcagcaggaacagctccagctccagctgctgcaacagcagcacgccgggaaacagccgaaggaacagcaacaggtcgctacgcagcaactcgccttccagcaacagctattacagatgcagcagctgcagcagcagcatctgttgtcgctccagaggcaggggctgttaaccatccagcctgggcagcccgcattgccattacagcccctggctcaaggaatgatacctaccgaacttcagcagctatggaaggaggtgactagcgctcacacggccgaagagaccactggaaacaaccattcaagtttggacttgaccactacatgcgtgtcaagctccgctccctcaaagacttcgctgatcatgaacccacatgcaagcacaaatggtcaactgtccgtgcatactcccaaaagagaatctctatcacatgaggagcatcctcatagtcaccccttgtatggccacggcgtttgtaagtggcccggatgcgaggccgtatgtgaggacttccagagctttctctag

SEQ ID NO: 117369 - DNA, 2040 bp, Artificial Sequence
  Description of Artificial Sequence: Synthetic coding sequence
atgtttcagtgtgtttttagtagctcagtgttgcaaccccattctacatcatgcttattcaaacatctattctaccactccgctacgcccgccagccaaaagcagcccgagcctatttattcaaagaaaactgagattcaacgccagacagtgcgagccccatttgccaaattgttcatttttagcgctctgcaggtggcccgccagctgttgctacagcagcagcagcagcagcaagtgtccgggctgaagtctcctaaacgcaatgataaacagcccgccctccaagtgcctgtgagcgtcgcaatgatgactccccaggtgattacgccgcagcagatgcagcagatactccagcaacaagtgctcagcccacagcagctgcaggtgctgctccagcagcagcaggcactcatgctgcagcagcagcagctgcaggaattttataagaagcaacaggagcagctgcagctgcagctgctgcagcagcagcacgcagggaaacagcctaaagaacagcagcaagtggccacgcaacagctggccttccagcagcagttgctgcagatgcagcagcttcagcagcagcacctgctgtcactgcagagacagggccttcttaccattcaacctgggcagcctgcactaccactccaacctctggcgcaggggatgatcccaaccgagctacagcagttgtggaaggaagtgacatcagcccataccgccgaagaaactacgggtaataaccactcctccctggaccttacaaccacatgtgtatcttcatccgctccatcgaaaactagccttattatgaacccccatgcgtccactaacggccagctgtccgtccacactccgaagagggagtctttgagccacgaagagcaccctcacagccaccctctctatggtcacggagtgtgtaagtggccgggttgtgaagcagtctgtgaggacttccagagctttctcaaacatctcaattcggagcacgctctggacgacaggtccactgctcagtgtcgagtgcagatgcaggtggtccagcagctggaactccaactagctaaggataaggagagactgcaggctatgatgacgcatctgcatgtgaagtctaccgaaccaaaagccgcgccacagcccctaaacctcgtcagctctgtcaccctgtccaagtctgcatcggaggcatctccgcaatctctcccacacactccgaccacacctacagctccgctgacgcctgtcacccagggaccttccgtgataaccacaacttccatgcataccgtaggccccatcaggcgccgctattctgataagtacaatgtaccaatcagttccgcggatattgcacagaatcaggagttctacaaaaacgcagaagttagacctccttttacttatgctagcttgatccgccaggccattctggaatcacctgagaagcaactgacgctgaacgagatttacaattggtttacccggatgtttgcctacttcaggagaaacgccgctacctggaagaatgctgtgaggcataacctgagtcttcacaaatgttttgtcagagtcgaaaacgttaaaggcgccgtttggaccgtggatgaggtcgagtttcaaaaacgtcggccgcagaaaattagcggaaacccctcactaatcaaaaacatgcagagttcacatgcatattgtactcccctgaatgccgcacttcaggcatcgatggcagagaattccatccccctctacaccaccgcatctatgggaaaccctacactgggcaacctggcgtccgcgatcagagaggagctgaacggggctatggaacacacgaactcaaatgagtctgattcctcaccaggtcgctcaccaatgcaggcagtccaccccgtacacgtgaaggaagagcccttggatccagaggaagcagaggggcccttgtcacttgtaactaccgcaaaccactcgccagattttgatcatgatagggattacgaggatgagccagtcaacgaggacatggagtag

SEQ ID NO: 117370 - DNA, 372 bp, Artificial Sequence
  Description of Artificial Sequence: Synthetic coding sequence
atgatgactccccaggttatcactccccagcagatgcagcaaattctgcaacaacaggtgctgtcccctcagcagctccaggtcctccttcagcaacaacaggctctcatgttgcagcagcagcagctgcaagaattctacaagaaacaacaggaacaactgcagttgcagttgctgcagcagcagcacgcgggcaaacagccaaaggagcagcagcaggtggccactcagcagctggccttccagcaacagctgctgcagatgcagcagttacaacagcagcatctcctgtcattgcaaaggcaggggctgcttacaatccagcctggccagcccgcgcttccactccagcccctggcgcaaggcatgtag

SEQ ID NO: 117371 - DNA, 2034 bp, Artificial Sequence
  Description of Artificial Sequence: Synthetic coding sequence
atgatgcaggagtcagggacagaaaccaagtccaacgggtccgccattcagaatggtagcggagggagtaatcacctgttagagtgcggcgggctgagggagggccgctcgaacggggaaacaccggccgtggacatcggcgccgcagatctggctcacgcccagcagcagcagcaacaagcccttcaagtggccaggcaactgctgttacagcagcagcagcagcagcaggtctctgggctcaaatcacccaaaaggaacgacaagcagcctgcgctccaagtgccggtgagcgtcgccatgatgactccacaggtgatcacaccacagcagatgcaacagattctccagcagcaggttctgtcccctcagcaactgcaggtcttactgcagcagcaacaggctcttatgttgcagcagcagcaactccaggagttctacaaaaaacagcaggagcagcttcagctccaactgctacaacaacaacatgcaggcaaacaacccaaggagcagcagcaggtggcaacacagcagttagccttccagcagcagttactgcagatgcaacaattgcaacagcagcacctgctctctcttcagaggcaggggttactcaccatccagcccgggcagccagccctgccattacaacccctcgcacaaggtatgatcccaactgagctgcaacagctgtggaaggaggtgacgtccgcccatacagccgaggaaacaaccgggaataaccacagttctctggacctcactactacatgtgtcagttcctcagcccccagcaaaaccagcctcattatgaatcctcacgcatctacaaatggtcagctgtcggtgcacactccaaagagggaatccttgtcccacgaagaacacccgcattcccacccgttgtatgggcatggcgtctgtaagtggccgggctgcgaagccgtctgtgaagacttccagtcgttcctcaagcatctgaactctgagcacgctctcgatgaccggagcacagcccagtgtcgcgtgcaaatgcaggtggtacagcaactggaactgcagctcgcaaaggacaaggagcggttgcaagccatgatgacacacctgcacgtgaagtctacagagccaaaggctgcacctcaaccactcaatttggtgtctagcgtgacactcagtaagagcgcgtcagaggcctcaccccagtctctgccacacactcctacaacacccacagccccactcaccccagttactcaagggcctagtgtcattactaccacctctatgcatacggtagggcccattcgccgacggtactccgacaaatataacgtcccaatttcctccgcggacattgctcagaaccaggagttttataagaatgcggaggttaggcccccattcacttatgccagccttataagacaggccattttggagagcccagaaaagcagctgacgctgaatgaaatctacaactggttcaccagaatgtttgcctatttcaggagaaatgccgcaacctggaaaaatgcggttagacacaacctcagcctgcataagtgttttgtgagagtggagaacgtcaagggagccgtttggaccgtcgacgaagtggaatttcagaaacgaaggcctcagaagatatccgggaacccaagcttaattaagaacatgcagtcaagccacgcttattgcacgcccttaaatgccgcgctgcaggcaagcatggcagagaattccattccattgtacacaacagccagcatggggaatccaactttaggcaacctcgcgtccgcaattagggaagagttgaatggcgccatggagcacacgaactctaatgaatccgacagttcccctggtcggtccccaatgcaggctgtccaccccgtgcatgtcaaagaggaacctctggatccagaagaggccgaaggaccactctccctggtgactactgccaatcacagccccgactttgaccatgatcgcgattacgaggatgagcccgtcaacgaagatatggaatag

SEQ ID NO: 117372 - DNA, 345 bp, Artificial Sequence
  Description of Artificial Sequence: Synthetic coding sequence
atgatgcaagagtctggcacggaaactaagtcaaatggaagcgcaatacagaacggcagtgggggtagtaaccatctgctggaatgcggaggcctccgcgaaggcaggtctaatggcgagaccccagctgtcgatatcggggctgccgatctggctcatgcacagcagcagcaacaacagtggcatctcatcaatcaccagccttctcggagccccagttcgtggctcaagcggctgatcagcagtccctgggagctggaggtactccaggtacccctgtggggtgccgtcgccgagacgaaaatgtctggccctgtctgccagccaaacccgtctccattctag

SEQ ID NO: 117373 - DNA, 669 bp, Artificial Sequence
  Description of Artificial Sequence: Synthetic coding sequence
atgatgcaggagagtgcaacagaaaccatttccaacagcagcatgaaccagaatggtatgtctaccctgtcatcccagctagatgccggctcacgagacggtaggtcaagcggcgacacatccagcgaggtgtctacagttgaactccttcacctccagcaacaacaggcccttcaagctgctaggcagctcctcctgcagcagcagacatcgggcctaaaaagtcctaaaagcagcgacaagcaaagaccactacaagtcccagtttctgtggccatgatgaccccacaggtcatcacaccccagcagatgcagcagatactgcagcagcaagtgctgtcaccacagcagctacaggccctgctgcaacagcaacaggccgtaatgctgcagcaacagcaactgcaagaattttacaagaaacagcaggaacagttgcatttgcagttactacaacagcagcagcagcagcaacagcagcaacaacaacaacagcaacaacagcaacagcaacagcagcagcagcaacagcaacagcagcagcagcagcagcagcagcagcagcagcagcaacatcctggtaaacaggcaaaagaacagcagcaacaacaacaacagcagcaacaactcgctgcccaacagctagtttttcagcagcagctcctgtag

SEQ ID NO: 117374 - DNA, 2148 bp, Artificial Sequence
  Description of Artificial Sequence: Synthetic coding sequence
atgatgcaagaaagcgcaacagaaaccatctcgaattcgtctatgaatcagaatggcatgtctaccttgtcttcacaacttgacgcaggcagccgagacggcaggtcttcgggggacaccagtagtgaagtatcgacagtagaattattgcatctgcaacagcaacaggccttacaggccgccagacaactcctgttgcagcagcaaactagtggcttaaagagtccaaaatcatcagataaacagagaccactgcaggttccggtaagcgtcgctatgatgacaccccaggtgatcacaccccagcaaatgcagcagatccttcagcagcaggtgctctcaccacagcagttacaggcgctgctgcagcaacagcaggctgtgatgctgcagcagcaacagttacaggaattttacaagaagcaacaggaacagctgcatttgcagctgctgcagcagcaacaacagcagcaacaacagcagcaacagcaacagcaacagcagcaacaacagcagcagcagcagcagcagcaacaacagcaacagcagcagcagcagcagcagcagcagcagcacccagggaagcaagccaaagagcagcagcagcagcaacaacagcagcagcagttggccgcacagcagcttgttttccaacagcaacttctacagatgcagcaattacagcagcagcagcacctcctgtccctgcaaagacagggacttatctccattccccccggccaggcagccctgccggtgcaaagcctgcctcaggccggtttgtccccagccgagatccagcagttatggaaagaggtgaccggcgtccattctatggaggacaacggtatcaaacacgggggcctggacctaacaacaaataactcctcttccaccacctccagcaacacatccaaggccagcccacccataacccaccattctatagttaatggccagtcttccgtgctgagtgccagacgagactcctcctctcatgaagagaccggcgcgtcacacactctatacggccatggagtatgcaaatggcctgggtgtgaaagtatctgtgaagactttggacagtttcttaaacatctgaataatgagcatgctttagatgacagaagcaccgcccagtgccgcgtccaaatgcaagtggtacaacagttagaaattcagttgtccaaggagcgcgagagacttcaggccatgatgacccaccttcatatgagaccttccgagcctaaaccctccccaaagccccttaatctggtctcctccgtcacaatgtcaaaaaatatgctggaaacatccccccaatcactcccgcagacccccacgacaccgaccgccccagtcactcctattacacaaggcccatctgtcatcacccctgctagtgtgcccaatgtgggagccatcaggcgcaggcatagtgataaatacaacattcctatgtccagtgagatcgctccaaactatgagttttacaagaacgcggatgtgcggcccccgttcacatacgcgactcttatccgacaggcgatcatggagagtagcgacagacaactcacgctgaatgaaatctacagctggttcacccggacgtttgcctactttaggcggaacgccgccacttggaagaatgcggtaaggcacaatctgtcattacataaatgttttgtccgcgtagaaaacgtcaaaggtgcagtgtggacagtcgacgaagtggaatatcagaaacgccggagccagaagatcactgggagccctaccctggtcaaaaatattcccacgtccctcggctatggcgctgcattaaacgcctctttacaggccgccttagctgagtcctctttaccacttctgtcgaaccctggattgattaacaatgcatcttcagggctgctgcaggcggttcacgaagatctaaacggctccctagaccatatagattcaaatggaaatagttcacccggatgtagcccacagccgcacatacattctattcatgtgaaggaagaacccgtgattgccgaggacgaggactgtcctatgtctctggtgacaactgccaaccactctccagaacttgaggatgatcgggagattgaagaagagccactctctgaagatctggagtag

SEQ ID NO: 117375 - DNA, 1299 bp, Artificial Sequence
  Description of Artificial Sequence: Synthetic coding sequence
atgatgcaggagagcgccacggagactatcagcaacagcagtatgaaccagaacggaatgagcaccctcagtagtcagttagacgcaggatcgcgggacggtaggagctcaggggacacgtcatctgaggtgtccacagtcgaactcctgcacctccagcaacagcaggccctgcaggctgcgcggcaactgctgttacagcagcaaacatcaggactaaagagtccaaagagctccgacaaacagaggccgctacaggtgcctgtatctgtggctatgatgactccacaggtgatcacacctcagcagatgcagcaaatccttcagcagcaggtgctgtcaccccagcagctgcaggcgctgctccagcagcagcaagctgtaatgttgcagcagcagcagctgcaggagttttataagaaacaacaagaacagctgcacctgcagctgctgcaacagcagcagcagcaacagcagcagcagcaacagcagcagcagcagcagcagcaacagcaacagcagcagcaacagcagcaacagcagcagcagcagcagcagcagcagcaacaacaacaccctggtaagcaagccaaggaacaacagcagcagcagcaacaacagcaacagcttgcagcccagcagttagtcttccagcaacagctcctacagatgcaacaactccagcaacagcagcacctcttgagtctgcagcggcagggcctaatctcaatccctccggggcaggccgcccttcccgtccagagtctgccacaggcaggactgagccccgccgagatccagcagctctggaaagaggttacgggtgtgcactcgatggaggacaatggtatcaagcatggaggtcttgacttaaccacaaacaactcgtctagtaccaccagcagcaatacctctaaagcttcacccccgatcactcatcactccatcgtgaatggccaatcctctgtcctatctgctcggcgcgactcgagcagtcatgaggaaactggagcgagccacaccctatacggtcatggtgtctgtaaatggcctggctgtgagagcatatgtgaggacttcgggcagtttctcaagcatctcaacaatgagcacgcgttggacgaccggtccaccgctcaatgtcgcgtgcagatgcaggtagtccaacagctggagatccagctcagcaaagaaagggaaagattgcaagcgatgatgacccatctgcacatgagaccctcagaaccgaagccctcccccaaacccgttagcgcctactgtttcatcaactcaaagtag

SEQ ID NO: 117376 - DNA, 1371 bp, Artificial Sequence
  Description of Artificial Sequence: Synthetic coding sequence
atgcaggaaagcgccacagaaaccatctcaaattcatcaatgaatcagaatggaatgtctacactgtcctctcagctcgacgccggctcacgtgatggtagaagcagcggtgacacaagcagtgaagttagcactgtggagcttctgcatctgcagcagcagcaggccctccaggccgcaaggcagttacttcttcaacaacaaacaagtggactgaaatctccgaaatcatccgacaagcaacggcctctccaggagctccttcctgaaaccaaactttgtatttgtggacacagttcaggtgacggacatcctcacaacacctttgccgtaccagtgagtgtggcaatgatgaccccacaggtaatcacaccgcagcagatgcagcaaatcctccaacagcaagtgctctcaccccaacagcttcaagcactgctgcaacagcaacaggctgttatgctgcaacagcagcagcttcaagaattctacaagaaacaacaggaacagctgcatctgcagctactccaacagcaacagcaacagcagcagcagcagcagcagcagcagcaacagcagcagcaacaacagcagcaacagcaacagcagcaacagcagcaacagcagcaacagcaacaacagcagcagcatccgggcaagcaggccaaagagcagcagcagcagcaacagcagcagcagcagctcgctgcccagcagctagtctttcagcagcaattgctgcagatgcaacagcttcagcaacagcaacatctcctcagcctgcagcggcaggggttaatctctatcccacccggtcaagccgctctgcctgttcaaagcttacctcaagccggactgtccccagctgagatccaacagctctggaaggaggtaacaggtgtccatagcatggaggacaacggcataaagcacggaggcctggacctgaccactaacaacagttcaagtacaacgagcagtaacacttctaaggcctccccgcccatcacccatcactccatagttaatggtcagtcgtccgtcctcagtgcccgcagggattcatcttcgcacgaggagactggtgcgagtcacaccctatatgggcatggcgtttgtaagtggcctggttgcgaatccatatgcgaggattttggtcaattcttaaagcatctcaacaatgagcatgcactggacgatagatccaccgcccagtgcagagtccagatgcaggtagtgcagcagttagaaatccagttgtcaaaggagcgcgagagactccaggcaatgatgacgcaccttcatatgcgccccagtgagccaaagccctcccccaagcccgtgagtgcctactgttttatcaatagcaaatag

SEQ ID NO: 117377 - DNA, 1872 bp, Artificial Sequence
  Description of Artificial Sequence: Synthetic coding sequence
atgatgaccccccaagttatcacaccacaacagatgcagcagatcttgcagcagcaggtgctgtccccacagcagctgcaggcactgttgcaacaacagcaggccgtgatgctgcagcaacagcagttgcaggagttctacaagaaacaacaggaacagctccatctacagctgctgcagcagcaacagcagcagcagcagcagcagcaacagcagcagcagcaacagcaacagcaacagcaacagcaacagcagcaacaacaacagcagcagcagcagcagcaacagcagcaacagcaccctggcaaacaagctaaagaacagcagcagcaacagcagcagcagcagcagctcgctgcccagcagctggtattccagcaacaattgttgcagatgcagcaattgcagcagcaacaacacctcctcagtctccaaaggcagggattaatttcaatccctccaggacaggctgctctgccggtccagtccctgccacaggccggactgtctccagctgagattcagcaattatggaaggaagtgacaggtgtgcattctatggaagacaacgggatcaaacacggtgggttggatctcacaactaacaatagcagctctacaacctcctcaaacacatccaaagcttcaccccctataacacaccattctatcgtcaacggtcagagttcagtgcttagtgcccgcagagattcgtccagccacgaagagacaggcgcaagtcacactttgtacggtcacggcgtgtgcaagtggcctggttgcgagagtatttgcgaagattttggccagtttctcaagcacctgaacaacgaacatgctttggatgatcggagcactgcacagtgtcgagttcagatgcaagtggtgcaacaactcgagatccagctctctaaggaacgcgaacgtctgcaggctatgatgactcacttgcacatgcgtcccagcgagccgaaacccagccctaaacctctcaatctggtgtcctccgttaccatgagcaaaaatatgttggaaaccagtccacaaagtttgccacagaccccaactacgcccactgcccccgtgactccaattacacaggggcccagcgtaattacacccgcttccgttcccaacgttggggctatcagacgaagacactcagataaatataacattcctatgagttccgagatcgcaccaaattacgagttctacaagaatgccgacgttcgccctccttttacctacgctaccctgatccgccaggcgatcatggagagctcagatcggcagcttaccctgaatgagatctactcctggttcacaagaactttcgcgtattttcgtcggaacgcagcgacttggaaaaacgccgtgcgacataacctctctcttcataagtgtttcgtaagagtggagaacgtgaagggggctgtgtggactgttgacgaagtggagtatcaaaagagacggagccagaaaattaccggctcccccacattggtgaagaacatccccacaagcctgggatatggcgcagctcttaatgcttcgctgcaagccgcattggcagagtcatccctgccgcttctgtcaaatcctggccttatcaacaacgctagttccgggttgcttcaggcagtacatgaggacctaaatgggagtctggatcacatcgattccaatggcaacagctcaccaggctgttcaccacaaccccatatccatagtattcacgtgaaagaagaaccagtaatagcagaagatgaggactgccccatgagccttgtgaccacagccaatcactcacccgagctggaggatgatcgggagatagaggaggagccgctatccgaagacctcgagtag

SEQ ID NO: 117378 - DNA, 1593 bp, Artificial Sequence
  Description of Artificial Sequence: Synthetic coding sequence
atgatgacacctcaggtgattactccacagcaaatgcagcagatcctccagcaacaggtcctctctccccagcagctgcaagctctgcttcagcagcagcaggctgtgatgttgcagcagcaacagcttcaagaattttacaaaaaacagcaagagcaactccacctgcagctgctgcagcaacagcaacagcagcagcagcaacagcagcagcaacagcagcaacagcagcagcagcagcagcaacaacagcagcagcagcaacagcaacagcaacagcaacagcagcaacagcagcacccagggaagcaagctaaagaacaacagcagcaacagcagcagcagcagcagctggcagctcagcaactggtgtttcagcaacagctcctgcagatgcagcaactgcagcaacagcagcatttgttgagcttgcagagacagggtctcatctcaattccacctggccaggctgcactacctgtgcaatccctgcctcaggctggccttagtccggccgagattcagcaactttggaaggaggtaaccggcgtgcactccatggaagacaacggaataaaacacggggggttagacctgaccaccaataatagttcgtcaactacaagtagcaacactagcaaagcctccccacccatcacccaccattctattgtaaacggccagagcagcgtccttagtgcccgcagagatagttcctcccacgaggagaccggagctagccacacgctgtacggccacggtgtctgtaagtggccaggctgcgaatcaatctgcgaagatttcggacagtttctgaaacatctgaataacgaacatgcgctcgatgaccgctccactgctcagtgtagagtccagatgcaggtggtccagcagttggagatacaactgtctaaagagagggagcgtctgcaagcaatgatgacccatctgcatatgcggcctagcgaaccgaagcctagtccgaaacctgcgataatggaaagcagcgaccgacaactgacattgaatgagatttatagttggttcacaaggaccttcgcttactttcgccggaacgccgcgacctggaaaaatgccgtccggcacaacctttcactccataagtgttttgtgcgcgtggaaaacgtgaagggcgcagtctggactgtcgatgaggtcgagtatcagaagcgacggagtcagaaaattactggctccccgactcttgtgaaaaatattcctaccagtctgggttatggggccgcgctcaatgccagcctgcaggcagcgctggccgaaagctccctgcccctgctcagtaaccctggactgataaataacgctagtagcggcttacttcaggctgtccatgaggacctgaatggctcactggaccacattgattctaacgggaacagctcaccaggttgttctccgcaaccacacatccactcaattcacgtcaaggaagagcctgtcatcgccgaagacgaagattgtccaatgtcgttagtcaccaccgccaaccacagcccagaactggaggatgatagagaaatcgaagaggaacctttgtctgaagacctggagtag

SEQ ID NO: 117379 - DNA, 2148 bp, Artificial Sequence
  Description of Artificial Sequence: Synthetic coding sequence
atgatgcaggagtccgcaactgaaacgatttctaattctagtatgaatcagaatggaatgtcgactctctcatcccagttagacgctggatctagagatggtcgcagctccggggatacaagctccgaagtctcaactgtggaactgctgcacctgcagcagcagcaggcactacaggcagccagacagttactgttgcagcagcagacatctggcctgaagagtccaaagtcttccgacaagcagagacccttgcaagtccctgtcagcgtggccatgatgacaccccaagtgatcaccccccaacaaatgcagcaaattttacagcagcaggtcctgagtccgcagcaactgcaggctctgctccagcagcagcaggcagtaatgctccagcaacaacagcttcaggaattctataagaagcagcaggagcagctgcacctccagctgttgcagcagcagcagcagcagcagcagcagcagcaacagcaacagcagcagcagcagcagcagcagcagcagcaacagcagcagcagcagcagcagcagcagcagcagcaacagcaacagcagcatcctggaaaacaggccaaggaacagcagcagcagcagcagcagcagcaacaactggctgctcagcagctcgttttccagcagcagctcctccagatgcaacagctacagcagcagcagcatctgttgtcgttacagagacagggcctcatctcgatcccgccaggtcaggctgcgctccctgtacaaagcctcccccaggctggcctgagcccggccgaaattcagcagttgtggaaggaagtgactggcgttcacagcatggaagacaacggaattaagcatggtggccttgatctgacaactaataattctagctcaactaccagtagcaatactagcaaggcttccccacccatcacacatcacagtatcgtgaacggacagtccagcgtcctttcagcacgcagggatagctcctcccacgaggaaacaggtgcctctcataccctttatggccacggtgtgtgcaagtggccggggtgcgaatcgatctgcgaagactttggtcaattcttgaagcatctgaacaacgagcatgcgctcgatgaccgctcaactgcccagtgtagagtacaaatgcaggtggttcagcaactcgagatccagctctccaaagaacgcgaacggttacaggccatgatgactcacctgcacatgcgtccatccgagcccaagccaagcccgaagccactgaaccttgtctcctctgtgaccatgtctaagaacatgctggagacctccccgcagtccctcccccaaactcccacaactccaaccgcgcctgtcactcctataacccagggcccgtcagttatcacccctgcctcagtgcctaacgtcggtgccatccgccggcggcactccgataaatacaatatccctatgtcctcggagattgcccccaattacgagttttacaaaaacgctgacgtgcgcccacctttcacttacgcgacactgattaggcaggctattatggagagctcagatcggcagctgaccctcaatgagatctactcctggttcaccagaacattcgcctacttcagacgcaacgccgccacatggaagaacgcagtacggcataacctttccttgcataagtgttttgtcagagtggagaacgtcaaaggggccgtgtggaccgttgatgaagtagagtaccaaaagagacggtctcaaaagatcaccggttcaccaacactggtcaaaaatatcccaacttccctcggctacggagccgcactgaacgctagcctgcaagcagcactggcagaaagttctctgcccctcttaagcaatcccggtctgattaacaatgcctcctcagggctgcttcaggccgtccacgaggatctgaatggaagtttggatcatattgactcaaacgggaatagcagcccagggtgttccccccagcctcacattcactcaattcatgtgaaggaggaacctgtcattgctgaagacgaagattgtccgatgtctctcgtcaccacagccaatcactcccccgagcttgaggacgaccgggagattgaggaagaacccctctctgaggacctagaatag

SEQ ID NO: 117380 - DNA, 1149 bp, Artificial Sequence
  Description of Artificial Sequence: Synthetic coding sequence
atgatgacgcctcaggtcattacccctcaacagatgcagcaaatccttcagcagcaggtcctctctccccagcaactgcaagctttattgcagcagcagcaggccgtaatgctgcaacaggatttccttgatagtgggttagaaaacttcagggctgcgctggaaaaaaatcaacaacttcaagaattctacaagaaacagcaggaacaactccatctgcagctactacagcagcagcagcaacagcagcagcaacagcagcagcagcagcagcaacaacagcaacagcagcagcaacaacagcaacagcagcaacagcagcagcagcagcagcagcagcagcagcaacatcccggaaagcaggccaaggaacagcagcagcagcaacagcagcagcagcagttggctgctcagcagctcgtgttccaacaacaactacttcagatgcaacaactccagcaacagcagcatctcctctctctacagagacaaggcttaattagcattcccccagggcaggcagccttacctgttcagagcctgcctcaggccggattaagtccagccgaaatacagcagctgtggaaggaagtcacgggggtccacagtatggaagacaatggtataaagcacggtggactggatctaacaaccaataatagctctagtaccactagttctaacacctcaaaggcgtcaccccccatcacacaccattcgattgtgaacggccagagctctgtcctgtctgccaggcgcgactcatccagtcacgaagaaaccggcgcctctcacactctgtacggccatggtgtatgcaaatggcctggctgcgaatccatctgcgaagatttcgggcaattcctgaaacatttgaataatgaacacgccttagatgataggtccaccgcacagtgccgcgtccagatgcaagtcgtacagcaacttgagattcagctgagtaaggaaagagaacggctccaggctatgatgacccacctacatatgcgccctagcgaaccgaaaccctctcccaaaccaaacatctgcaaagtcacataccgctgcatttggatgttcctgcgcttctcaaattatgccgaggtcctactgtacatccctgagaagctgacaccagtcgcactctag

SEQ ID NO: 117381 - DNA, 2199 bp, Artificial Sequence
  Description of Artificial Sequence: Synthetic coding sequence
atgatgcaagagtcggctacagagacaatatctaactcatctatgaaccagaatggcatgtctacactgagtagccaactcgatgccggttcccgggacggaaggagcagtggagatactagttcagaagtttctacagtggagctgctgcacttacagcagcaacaggcgctccaggctgcccgccaactcctgctgcagcagcaaacctcaggcttaaaatctccgaagtcgtccgataagcaaaggcctctccaggtacctgtgtccgttgccatgatgactcctcaggtcatcacaccccagcagatgcagcagatcctccaacaacaagtccttagtccccagcagttgcaggcactgctgcagcagcaacaggcggtcatgctccagcaggactttctggattccggattggagaattttcgagccgccctcgagaagaatcagcagctccaagagttttacaagaagcaacaagagcagttgcatttgcagctgctacagcagcagcagcagcagcagcaacaacagcagcagcagcagcagcaacaacagcagcaacagcagcagcagcaacagcagcagcaacagcaacagcaacagcagcagcagcagcaacaacatcctggcaaacaggctaaagaacaacagcaacagcagcagcagcagcagcagctggccgcacagcagctagttttccagcaacagttattacagatgcagcagcttcagcagcagcaacacctgctttcgctgcagaggcagggactcatctcaattccgcccggccaagctgctctgcccgtccaatccttgcctcaggctggtctcagccctgccgagattcagcagctttggaaagaagttactggggtgcactcaatggaggacaacggcatcaagcacggaggtcttgatttgaccaccaataattctagctcaacaacctcctctaacaccagcaaggcatccccaccaatcacccaccatagcatagtgaatggacaatccagcgtgctgagcgcaagacgcgactcttctagccacgaagaaaccggtgcatctcataccctgtatggtcatggtgtttgtaagtggccaggatgtgagagcatttgtgaagactttggacaatttctcaaacacttgaacaatgagcacgcactggatgaccgcagcacggcacaatgccgggttcagatgcaggtggttcagcagttggagatacagttgagcaaggagagagagcgtctgcaggctatgatgacccatctccacatgcgacccagcgaacctaaacctagccctaagcccctaaatttggtgtcaagcgtgaccatgtcaaagaacatgttagagacctctccacaaagcctgcctcaaacccccacgacacccacagctccagttacccctatcactcaaggaccttctgttattacccctgcgagcgttcccaatgtgggtgctatccgccggcgccactcggataagtacaatatacctatgtccagcgagatcgccccaaactacgagttctataagaacgcagacgtacgccccccctttacgtacgcaacacttatccgccaagcgataatggagagttcagacagacagcttacgctaaatgagatttactcttggttcactcgaacctttgcatacttccgccgcaatgctgccacatggaagaatgcggtgaggcacaacctctcactgcataagtgttttgtgcgcgttgagaatgtgaaaggtgcggtttggaccgtagatgaagtagaatatcagaagcggcgaagccagaagatcactgggagccccaccctcgttaaaaatatcccgactagcctgggctacggggcggccctcaacgccagtctgcaggctgcgctcgccgaatcctccctcccacttctctctaaccccggacttatcaacaatgcatcatccgggttgctccaggctgtccacgaggacctgaatgggagtttggaccacattgacagcaacggaaatagctctcctggctgttcaccacagcctcatatacatagcatccatgtcaaggaggaaccagtgatagccgaagacgaggattgtcccatgagcctggttacaaccgcaaaccatagcccggagctggaggacgaccgcgagatagaggaggagccgctttccgaggacctcgagtag

SEQ ID NO: 117382 - DNA, 2223 bp, Artificial Sequence
  Description of Artificial Sequence: Synthetic coding sequence
atgatgcaggaaagcgcaacagagaccatcagtaattcgtcaatgaaccagaacggcatgtccacgctctcgagtcagctcgacgctggatctcgcgacggccgctcatctggggacacctccagtgaggtgtctactgtggagttgttgcacctgcagcagcaacaagccctgcaggcggctaggcagttgctgctccagcagcagacctcaggcctgaagtctccaaaaagttctgacaagcagagacccctccaggaactgctacccgagacgaagctgtgtatctgtggccattcatctggcgatggccacccacataacactttcgcggttcctgtcagcgtggccatgatgacgcctcaggtgatcaccccccagcagatgcagcagattctccagcagcaggttctgagtccacagcagctccaagccttactacagcagcaacaggccgtgatgctacagcagcaacaacttcaggaattctataagaagcaacaagaacaactgcacctccagttgttacagcaacagcagcagcaacagcagcagcaacagcagcaacagcagcaacagcagcagcagcagcagcagcagcagcagcagcagcaacagcagcagcaacagcagcagcagcaacagcaacaccccgggaagcaggcaaaagagcaacagcagcagcagcagcagcaacagcagctcgcagcccaacaactggtgtttcaacagcagttgctgcagatgcagcagcttcaacagcagcagcatctgctgtcccttcagaggcagggacttatcagcattcccccggggcaggctgcattacctgtgcagtctcttccacaggcagggttgtctcctgcagagattcagcagctgtggaaggaggtgactggcgtgcacagcatggaagacaacggcatcaaacatggtggtctcgacctcactacaaataatagcagctccacaactagtagcaatacttccaaagcctcgccacccattacgcaccacagtatcgttaacggccaatcttccgttctctccgccaggcgtgatagctcctcacacgaggaaacaggtgcctctcacaccctgtatgggcacggggtgtgcaaatggccaggctgcgagtccatttgcgaggattttgggcaattcctgaagcacttgaataacgagcacgcattggatgaccgctctacggcacaatgcagggtgcagatgcaggtcgtgcaacagcttgaaatacagttgtccaaagaaagggaacgcctccaggctatgatgactcacctccatatgcgaccatcagagcctaagccatcccccaaacctctaaatctcgtgagtagcgtgaccatgtctaagaacatgctagaaacctcacctcagagtcttccccagactcctacgaccccaaccgcgcctgtaacacctatcacgcagggacctagtgtgatcactccagcctcagtacctaatgttggggcaatacgacggcggcattcggataagtacaatatcccaatgtcctccgagatcgcccctaattacgagttctacaagaatgctgacgttcggcccccctttacttacgccaccctgattcgtcaagccatcatggagtcatcagatcgacagctcacactgaacgaaatctacagctggtttacccggaccttcgcatacttcaggaggaatgcagctacttggaagaatgctgtgcgtcacaatcttagcctgcataaatgctttgtcagagtcgagaacgttaagggggcagtctggaccgtagatgaggtggaataccagaaaagaagaagccaaaagatcaccgggtcaccgactcttgtcaaaaatatacccaccagcctcggatatggtgcagccctgaatgcgtctttacaagccgccctagctgagagcagcctgcccctcctgtccaaccctggcctgataaataatgcatccagcgggctcctgcaagcagtgcacgaagacctgaacgggtcactggatcatatcgactcaaatgggaatagctcccctggctgttcaccacaaccacacatccacagtatccacgttaaggaagaaccagtcatagctgaggacgaggattgtcctatgagcttggtgaccacagctaaccactcccccgaactcgaagacgacagagagattgaagaagaacccctgagcgaagaccttgaatag

SEQ ID NO: 117383 - DNA, 1191 bp, Artificial Sequence
  Description of Artificial Sequence: Synthetic coding sequence
atgcccaatccccggcctggcaagccgtcagcaccaagtctcgctctaggcccaagtcctggcgcatctccatcatggagggctgcccccaaggcctctgacctgttaggagcccgcggacctggaggcacatttcaggggagagatctacgcggaggcgcccatgcaagcagcagctcccttaaccccatgcccccttcccagctgcagctatctaccgtagacgcccacgcccgtacaccagtcttgcaggtccatccattggagagccccgccatgatctctctgacgccgcctactactgccaccggagtcttctctttgaaggcgaggcctgggcttcccccaggtataaatgtggcttccttggagtgggtgtcacgcgagccagcgctgctgtgtacgttccccaatccctctgccccaaggaaagatagtaccctttcagccgtgccacagtccagctacccgctcctcgctaatggtgtgtgcaaatggcctgggtgtgagaaagtgtttgaagaaccagaggacttcctgaagcattgtcaggctgaccacttattggatgagaagggccgagcccagtgtctgctgcagcgagagatggtccagtccctggagcagcagctcgtactggagaaagagaagctaagcgccatgcaggcccaccttgctggtaagatggcactcactaaagcttcaagcgtcgcgagcagcgacaaaggctcatgctgcatcgtggccgccggatcgcagggacctgtggtgccagcctggtcaggaccgagggaggcacccgattcactgttcgccgtccgacggcatttatggggctctcatggcaattctactttcccggaattcctacataatatggactacttcaagttccataatatgcgcccgccgttcacttatgctaccctcatcaggtgggccattctggaagcccccgagaagcaacgcacgcttaacgaaatttatcattggtttacccgcatgttcgccttcttccggaatcaccccgccacttggaagaatgccatcaggcacaacctatcgctgcataagtgtttcgtacgtgtggaatctgagaagggagccgtgtggacagtggacgaactggaatttaggaaaaaaagaagtcagcgcccgtcccggtgctcaaaccccactccaggaccctag

SEQ ID NO: 117384 - DNA, 1296 bp, Artificial Sequence
  Description of Artificial Sequence: Synthetic coding sequence
atgcctaatccccgccctggcaaaccaagcgcgccgtcactggcgctgggcccctcaccaggggcaagccctagttggagggcagcgccaaaggcttctgacctgctaggggccagaggccctggcggaacatttcaggggcgggaccttagaggcggtgcccacgcatccagctcctctctgaatccaatgccacctagccagctgcaactacctacgttgcccctggtgatggtcgctcccagcggtgcccgacttgggccattgccacacctacaggctctcttgcaggacagaccccattttatgcaccagctaagcacagtcgacgctcacgctcgtactcccgtcctgcaagtacatccattggagtcgcccgccatgattagtcttacacctcccactacggccacaggggtattctccctgaaggctcggccggggctcccgcctgggatcaatgtggcttctctggagtgggttagccgagagccagctttgttatgcaccttccctaatccatccgctcctcgcaaagacagcactctgtctgccgtgccgcagtcttcatatcccctactcgcaaatggcgtttgtaagtggcctggctgcgaaaaggtgtttgaagaaccagaggattttctcaaacactgccaggcagaccatctgcttgatgagaagggccgcgcacaatgcctgcttcagcgggagatggtccagagcctagagcagcagctcgtgctcgaaaaagagaaattgtctgctatgcaagctcacctcgccggaaaaatggctcttacaaaagctagttctgtcgcctccagcgacaagggcagctgctgtatcgtggccgctggcagtcagggccctgttgtgcccgcctggagcggcccccgggaggctcctgattctctgttcgcagtgaggcggcacctgtggggcagccacggtaatagtacctttccagaatttctgcataatatggactacttcaaatttcataacatgcggccaccattcacctacgcaacattgattcgatgggcaattttagaagctcccgaaaaacagagaactctgaacgagatctaccactggtttacccgaatgttcgcatttttccgcaatcaccctgctacctggaaaaatgccataagacacaatctgagcctgcacaaatgtttcgtgcgagtggagtctgaaaagggtgccgtttggaccgtcgatgaactggagtttaggaagaagaggtctcagagacctagccgatgttcgaatcctaccccgggtccctag

SEQ ID NO: 117385 - DNA, 1215 bp, Artificial Sequence
  Description of Artificial Sequence: Synthetic coding sequence
atgccaaaccctagaccagggaagccttccgcaccctctctggccctgggaccatcacctggggccagtccaagctggagggctgcccctaaggccagcgacctgctgggagctcgaggacccgggggcacatttcagggtagagatttgaggggtggcgcgcatgcatcaagtagctcgcttaacccaatgccgccatctcagctgcagctccccactctcccactcgtaatggtcgcgccctccggggctagactcggccctttgcctcatcttcaagcattgctccaagatagacctcactttatgcaccagctgtctactgttgacgcccatgctcgaacaccagtgttacaagttcatcccctggagagtccggctatgattagcctgacaccaccgaccaccgcaacaggcgtattctctctgaaagcacgtccaggcctgccgcctgggattaatgtggccagtctcgagtgggtctcccgcgaaccagcactgctctgcacatttcctaaccccagcgccccaaggaaagactctaccctgagcgccgtaccgcaatcgtcttatcctctcctagccaacggggtctgcaagtggcccggatgcgagaaggtgttcgaagagccggaggatttcctcaagcattgtcaggctgatcacctgctggacgaaaaaggtagggcacaatgcctattgcagcgagaaatggtgcagtctctggaacagcaggcctcttcagacaagggatcatgctgcatcgtggctgctgggtcacaggggcccgtcgtacccgcttggagcggtcctagagaggcccctgatagtctgttcgccgtacggcgccacttgtgggggtctcacggtaattcaacatttccagagtttttacacaatatggattatttcaagttccacaacatgaggcctccatttacctatgctactctgattagatgggccatcctcgaagcgccagaaaagcagcggaccctcaacgagatttaccactggttcacccgaatgttcgctttttttaggaatcatcctgccacttggaagaatgccattcgtcataacctgtcgctccataaatgttttgtccgtgtcgaatccgagaaaggggccgtctggactgtcgatgaactggaattccggaaaaaaagaagtcaaagaccaagtcggtgtagtaaccctacacctgggccatag

SEQ ID NO: 117386 - DNA, 1191 bp, Artificial Sequence
  Description of Artificial Sequence: Synthetic coding sequence
atgcccaatccccggccaggaaaaccatcggcaccttcactggccttgggtccctctccaggggccagtccttcctggagagccgcaccgaaagccagcgacctgctgggcgcaagaggtcccggaggtacttttcaggggcgagacttaagaggaggagcacatgcatcctccagctcacttaaccccatgccacctagccaacttcaactcagtactgtcgacgcgcatgcccgcacccccgtgctgcaggttcaccctcttgaatcgcctgccatgatcagtctaacaccacccacaactgcaacaggagtgttctcactgaaagcaaggccgggtttacccccaggcatcaacgtcgcctccctggagtgggtcagccgtgagccagctcttctctgcacctttccgaatccttctgctccacggaaggattccacgctgagtgcagtacctcagagctcctaccctctgctcgcaaacggagtttgcaaatggccagggtgcgagaaggtgtttgaagagcccgaagacttcctaaagcactgccaagcggaccaccttctggatgaaaaaggccgagcccagtgtctgctgcaacgggaaatggtccagtccctcgagcagcaactagtccttgagaaggagaaactaagtgctatgcaagcccacctggccgggaagatggccctaaccaaagcgtcaagcgtggccagttccgataaaggaagttgctgtatagttgccgcaggttcgcagggaccagttgtacctgcctggtcgggccctagagaagctcccgacagtcttttcgccgtacgccgccatctttggggatcacacggcaactccactttccctgaatttctgcataacatggattattttaagttccacaacatgaggccaccgttcacctatgcaacattgatcaggtgggcgatcctggaggcgccagagaaacaacgaactttgaacgagatctaccactggttcacccgcatgtttgccttcttcagaaatcacccagcaacttggaagaacgccatccgacacaacctgtctctccataaatgtttcgttagagtggagtcagagaagggggccgtgtggaccgtcgacgaactggaatttaggaagaagcgctctcagaggccctcacggtgttcaaatccaactcctgggccttag

SEQ ID NO: 117387 - DNA, 2043 bp, Artificial Sequence
  Description of Artificial Sequence: Synthetic coding sequence
atgatggtggagtctgccagcgaaacgattaggagcgcacccagcggtcagaacggagtaggctctctgtccggacaggcggacggcagttccgggggcgccaccggtacaaccgcttctggtacagggcgagaagtaacaaccggggccgactctaacggcgagatgagccccgccgaattactacatttccagcaacaacaggccttgcaagtcgctaggcagtttcttttacaacaggcttcgggcctctcctccccaggaaataacgacagcaaacaaagtgcaagcgccgttcaagtaccggtgagtgtggccatgatgtccccccagatgttgacaccccaacagatgcagcagattctgagtccccctcagctacaggctctgctacagcagcagcaggccctgatgctgcagcagctgcaggaatactataaaaaacaacaggagcagctgcacttgcaattactcactcagcaacaggctggcaagccccagccaaaggaggctctgggaaacaaacaacttgccttccaacagcagctgctgcagatgcagcagcttcagcagcagcacctgctcaaccttcagagacagggccttgttagcctacagcccaaccaggcctccggtccgctccagacattacctcaggctgccgtgtgtcccacagatctgccgcagttgtggaagggggagggcgctccaggccagccagctgaagattccgtcaaacaggaaggcctggaccttacaggcactgcggccacggcaacttcatttgccgcgcctccaaaggtctcacccccactctctcaccacacgctccccaacggccagccaacagtcttgacttctagacgagactcctcctctcatgaagagactccaggctcgcatcctctgtacggccatggtgaatgcaagtggcctggctgcgaaacgctgtgcgaggacctggggcagtttataaaacacctaaatacggagcacgccttggacgacagatcaactgcccaatgtagagtccagatgcaggtcgtgcagcagctcgagatccagctggcaaaagaatcagagcgactgcaagctatgatggctcatcttcatatgcgtcccagtgagcccaagccctttagccagccgctaaatcctgttccgggatcatcaagcttctccaaagtgacagtttcagccgctgacagcttccccgatggcctcgtacacccccctacctccgcagccgcgccggttactcccttacgtccacccggtctcggctctgccagcctgcatggcgggggaccagccaggagacggtccagtgataagttttgcagcccaatatccagtgagttagcccagaaccatgaattttacaaaaacgctgacgtgcggcccccatttacttatgcctctttgatacggcaggccattctcgaaaccccagacagacaattaacccttaacgagatctacaactggttcacacgaatgttcgcttatttccgaagaaacactgccacatggaagaatgccgtaagacacaatctctctctgcacaagtgctttgtccgcgtggagaatgtgaagggtgctgtctggaccgtggacgagcgggaatatcagaaacgcagacccccaaaaatgaccggctctccaactctcgtgaagaatatgatcagtggactatcttacggggccctcaatgccagttaccaggcagccctggctgagagcagttttcctctgcttaatagccccggtatgctgaatcctggctccgctagttcactgctgccactatcccacgatgatgttggagccccagtggagcctctgcccagcaacgggagcagctctcctccaaggctctcccctccgcagtatagtcaccaggtgcaggtcaaagaggaaccagccgaggctgaggaggatagacagcctggaccacctctaggggcacccaacccaagcgcgtctgggccacccgaggatcgcgatttggaggaagagcttcctggagaggagctgtcttag

SEQ ID NO: 117388 - DNA, 2037 bp, Artificial Sequence
  Description of Artificial Sequence: Synthetic coding sequence
atgatggtggagtccgcttccgagacaatcagaagcgcgccaagcggccagaatggagtcggatccttatccgggcaggcagatgggagttctgggggagccacgggtactaccgccagcgggacaggtcgtgaagtgaccaccggagctgactcaaatggcgaaatgagtcctgccgagctgctacacttccaacagcagcaagcgctccaggtcgctcgccaattcctgctacagcaggcgtctggcctgtcaagccctgggaacaacgactcaaaacagagcgcctctgcggtccaggtccccgtgtcagtcgccatgatgtccccacagatgctgactccccagcagatgcaacagattctctccccaccacagctccaggctctgctccagcagcagcaggccttgatgttacagcaggaatactataaaaaacagcaagaacagctccatctgcagcttctgacacaacagcaggcgggaaaaccccagcctaaagaggcactgggaaataagcaactggcctttcagcaacaactgttgcagatgcagcagctccagcagcagcacctgctcaacctgcagcgacagggtctcgtgtccctccaacccaatcaagctagtgggcctttacagaccctccctcaggctgccgtgtgtcccaccgacttacctcaactctggaaaggggaaggggcgcctggacagcccgcagaagactctgtcaagcaggaggggctcgatctgactgggacagctgcgacagctaccagcttcgcagcaccccctaaggtatcacctccccttagtcaccacactctcccgaacggccagcctacggtcctgacctcccggagagacagttctagccacgaggagaccccagggagccacccattgtacggccatggcgagtgtaaatggcccgggtgcgaaactttgtgtgaggatttgggacaatttattaagcacttaaacaccgaacatgccctggacgatcgctctaccgctcagtgtcgggttcagatgcaggtggttcagcagcttgagattcagttagcaaaagagtccgagaggttacaggctatgatggctcatttacatatgcgcccatccgaacctaaaccattctcacagccgctgaatcccgtgcccgggtcctcgagttttagcaaagtaaccgtatcagcggcggattcgttccccgatggtctcgtgcatcccccgactagcgcagctgcccctgttactcctttgaggcctcccggactggggtctgcttcgttacacggtggcggtcccgcccgccgaaggtcttccgacaagttctgctcccctatttccagtgagctggcacagaatcacgagttttataaaaatgcagacgttagaccaccatttacctatgccagcctgatcagacaagctattttagagacacccgaccggcagctaacgctcaatgagatctataattggtttacaagaatgtttgcctacttcaggcggaacacagcaacgtggaaaaacgcagtgcggcataacctcagcttgcataagtgtttcgtccgggtagagaacgtcaagggggctgtatggactgtagatgagagagaataccagaagaggaggcctccaaaaatgacaggctctcccacgctcgtgaagaatatgatctctggcttgagctatggggccctgaatgcatcataccaagccgctctcgccgagagcagtttccccttactaaattccccaggcatgctaaaccccggctcagcctcctccttgctgcctctctcacacgatgacgtgggcgcccccgtggaacctttgccatcaaatggctctagcagccccccccggctaagtccgcctcagtacagccatcaagtccaagtgaaggaggagcctgccgaggcagaagaggaccgccagcccggcccacccctgggtgctccaaacccgagtgcctccggcccgccagaggaccgagacttagaagaagagctgcccggggaagaactctcttag

SEQ ID NO: 117389 - DNA, 2043 bp, Artificial Sequence
  Description of Artificial Sequence: Synthetic coding sequence
atgatggtcgaatctgccagcgaaaccattcgatctgcccccagtggacagaatggagtgggctcgctgtcaggtcaggctgatgggtcttctggaggcgcaaccggaaccacagcctctggaacgggacgagaggtgactacgggagcagactctaatggcgaaatgtctcctgccgagctgcttcactttcaacagcagcaggccctgcaagttgccagacagtttcttttgcagcaggcctccggactctcttctcccggaaacaacgattccaaacagtccgcctcagcagtgcaggtgcccgtgtccgtcgccatgatgagtccccagatgctcacgcctcagcagatgcaacagatactgagcccgccccagcttcaggcccttctgcagcaacagcaggccctgatgttacagcagttacaggagtattacaaaaagcagcaggaacagctgcatcttcaactgctcacacagcagcaggcaggtaaacctcaacctaaggaagcactcggcaataagcagttggcgtttcaacaacagctactgcagatgcagcaactgcagcagcagcatttgctcaacctccagcgacaggggcttgtcagtttgcagccaaaccaagccagcggacccctgcagactctgcctcaagccgctgtctgtcctacggacctcccacagctgtggaagggcgaaggcgctcctggacagcctgccgaagacagcgtcaagcaggagggactggatctgacaggcaccgccgccactgcaactagcttcgccgccccccctaaggtttcaccccctttgtcccatcataccctgccgaatggtcagccaactgtactgacctcgaggcgcgattcatcctctcatgaggagacccctggaagtcacccactgtacggtcacggagagtgcaaatggccagggtgtgagaccttatgcgaggaccttggccagttcattaaacacctgaacaccgagcacgcccttgatgataggagtaccgctcagtgccgggttcagatgcaggtcgttcagcagctcgaaatccagctcgctaaagaaagtgaacgcctgcaggcaatgatggcacatctgcacatgcgaccatctgaacccaagccctttagccaacctctgaacccggtccccggttcttcttcctttagtaaggttacagtttctgctgctgacagcttccccgacggccttgtacatccacctacgtcagcagcagctcctgtgactccccttcggccaccggggctcgggtctgcctctttacacggagggggcccagccagacggagatctagcgacaagttttgttcccccatctcctccgagctggctcagaaccatgagttttataaaaacgccgatgtccgaccaccattcacctatgcctcgctcatccggcaagctatcttggagactcctgaccggcaactcacactaaacgagatctataactggttcacaaggatgttcgcctacttcagaaggaatacagcaacttggaagaatgccgtgcgacataacctgtctcttcacaagtgttttgtccgcgtggagaacgtgaagggggcagtgtggaccgtagacgagcgtgaataccaaaagcgaagaccacccaagatgacgggctccccaacactggtaaagaacatgatctcaggcttatcctacggcgctctaaatgcaagctaccaagctgcacttgctgagtcttcctttcccctgcttaattcccccgggatgctgaatcccgggtccgcatcctctcttttgccactctcccacgacgatgttggtgcccccgtcgagcctctccccagtaacggcagttctagcccacccaggctgtcgcccccccaatatagtcaccaggtgcaggtaaaagaggaaccagccgaagccgaggaagatcgacagcccggtccacctctgggtgcaccaaatccatctgcgagcggtccgcctgaagaccgagatcttgaagaagagctcccaggtgaggagctcagctag

SEQ ID NO: 117390 - DNA, 2004 bp, Artificial Sequence
  Description of Artificial Sequence: Synthetic coding sequence
atgatggtggagagcgcgtcagaaacaatcaggtcggccccaagcggacaaaatggcgtgggctcactgtcaggacaggccgacggaagtagtggtggagccactggaaccacagctagtgggacgggccgcgaagtaacaaccggcgctgactccaacggggaaatgagtccagccgaactgctacatttccagcagcagcaagctctccaagttgcaagacagtttttgcttcagcaggcatctgggttgagtagcccgggcaataatgactcaaaacagtcagcatctgctgtccaggtcccagttagcgtggcaatgatgagcccccaaatgctgacgccccagcagatgcagcaaatcctgagccccccacaactgcaggctttactgcaacagcagcaagcactgatgctgcagcaactacaggagtactacaaaaaacagcaggagcaactgcatctccaactgttgacccaacagcaggccgggaaaccacagcctaaagaagcgcttggtaataagcagttagccttccagcagcagctcctccagatgcaacaactgcagcagcagcacctgctgaacttacagagacaaggactggtttcgttacaacctaaccaggcctctggtcctctgcaaactttgccccaagccgtatgccccacagacctgccacagctttggaagggcgaaggggctccaggacagcccgccgaggactccgtaaagcaggaggggcttgacttaactggcaccgccgcgacagccacctcttttgctgcgccgcccaaagtgtctccaccattgagccaccatactctgccgaacggacagccaacagtgctaacctctcgccgagacagtagctcccacgaagaaacaccgggctctcaccctctgtacggccacggtgaatgtaagtggcctggctgtgagacgctatgcgaggacctgggtcaattcattaagcaccttaatacagagcatgcccttgatgataggtcaacagcccaatgtcgagtacagatgcaggtggtgcagcaattagagattcagctggccaaagagagtgagcgcttgcaggccatgatggctcacctgcacatgagaccatctgagccgaaacccttctctcagcctgtcacagtatctgcagccgattctttccccgatggtttggtccatcccccaacaagtgcggcggctccggttacgcctctcagacctccgggcttaggtagcgccagcctccacggtggcgggcctgccagaagacgctcttccgacaaattttgctcacccatttcttcagagttggcccagaaccatgagttctacaaaaacgccgacgttcgtcccccctttacatacgccagccttattagacaggcgattcttgagacccctgataggcagctgacactgaatgaaatatacaattggttcacccgaatgttcgcttactttcgacggaataccgctacttggaaaaatgccgtacgtcacaacctctcactacacaagtgcttcgttagagtggagaacgtcaaaggtgcggtttggactgttgacgagagggaataccagaaaaggaggccccccaaaatgaccggctctcctactctggtgaagaatatgatctctggattgagttacggcgcactaaatgcgtcttaccaagctgctcttgccgagagttctttccctctgttaaactccccggggatgttgaacccaggctctgcctcttcgctattgccgctgtctcatgacgacgtgggggctccagtcgagcctctaccttccaacggctcttcatctcccccaaggctctccccacctcagtactctcaccaggtccaggtgaaagaggagcccgccgaggccgaagaagataggcagcctggaccccctctcggggcccctaacccatccgccagcgggccaccagaagaccgggatctggaagaggaacttcccggcgaggagctgagttag

SEQ ID NO: 117391 - DNA, 2007 bp, Artificial Sequence
  Description of Artificial Sequence: Synthetic coding sequence
atgatggtggagtcagcaagcgagacaattcgctcagccccttctggccaaaacggggtggggtctctgagcggccaggctgacggaagcagcgggggagcaaccggcaccaccgcctcaggtaccgggagagaggtaacaacaggtgctgacagcaatggtgaaatgtcgccggcagaactgctgcactttcaacagcaacaggccttgcaggtcgcgcgccagtttctcttacagcaggcaagcggcctgtcttcacctggaaataatgacagcaaacagtcggcttccgcggtccaggtgccggtctcagtggccatgatgtcaccacagatgctgacaccacagcagatgcagcagattttatctccccctcaactccaggcactactgcagcagcagcaggctctcatgctacaacagctgcaagagtattacaagaagcaacaagaacagctgcacctgcagctgttgacgcagcaacaagcaggcaagccacaacctaaggaggctcttgggaacaagcaactcgcgttccagcaacagcttctgcagatgcagcagctgcaacagcagcatcttctgaacctgcagcgccagggactggtgagtctgcagccaaaccaggcctctggcccactccagacactgccccaggctgcagtgtgcccaacagacttgccacagctatggaagggcgaaggggccccaggacagcctgccgaggatagtgttaaacaggagggactggacttgaccggtaccgccgctactgccacaagcttcgccgcacctcccaaggttagccctcctctgtctcatcacacactacctaatggacagcctaccgtgcttacatccaggcgcgacagctctagtcacgaggagactcccgggagccacccattgtacggtcacggcgagtgtaagtggcctgggtgtgaaactctgtgcgaggatctgggacagtttatcaagcacttgaacaccgaacacgctttggatgatcggagtacagcacagtgtagggtacagatgcaggtggtgcaacagcttgaaatccaattagccaaggagagtgaaaggctgcaggcaatgatggctcatctccatatgaggccctctgagcctaagcctttttcacagccagtgaccgtgtccgctgctgactccttccccgatgggctagtgcaccctcccacctctgctgctgcccctgtcaccccgcttaggcctcccggactgggaagtgccagtctgcacggagggggaccagccagacgacgctccagtgacaagttctgcagccccatctcatcagaactggctcaaaaccacgagttctataaaaacgcagatgttcgccctccctttacctatgcctctttgatccgtcaggcaattctagaaacgccagacagacagttgacactaaatgaaatctataattggtttacacgcatgttcgcttactttcgcaggaataccgccacatggaaaaacgccgttagacacaatttatccctgcataagtgcttcgtgcgtgtggaaaatgtcaagggcgctgtgtggacagttgatgagcgcgaataccagaagcgtaggcctcccaagatgacaggttccccgacattggttaagaatatgatctctgggctgtcgtacggagcactcaatgcttcataccaggctgccctggccgaaagctcctttccgttgctcaattctccaggaatgcttaatcccggtagcgcctcaagtctactgcctctcagccacgacgacgttggagcacccgtagagcccttgccctccaacggatcctcgagtcccccccgtctgagtccgccccagtacagccatcaggtccaagtgaaagaagagcctgccgaggccgaggaggacaggcagcctggaccccccctgggcgcgccaaatccctctgcttccggaccccccgaggacagggacttagaggaggagttgccaggagaggagctgtcatag

SEQ ID NO: 117392 - DNA, 1212 bp, Artificial Sequence
  Description of Artificial Sequence: Synthetic coding sequence
atgaaactcgaggtgttcgtgcccagagccgcgcatggagacaagcagggctctgacctggagggtgccggcggctccgatgcaccaagccccctgtctgcagctggggacgatagtcttggctctgatggggactgcgctgctaactctcctgccgctggcggaggcgcccgggacacccaaggcgacggagaacagtctgccgggggcgggcctggagccgaagaagcgattccagcggcagctgccgctgcggtcgtggcggagggtgctgaagcaggcgccgccggaccaggagccggaggggctggaagtggcgaaggagcgaggtctaagccctacacccgcagacccaagccaccctattcatatatcgctctgatcgccatggcaatccgggactcggctggtggcaggttgacactcgccgagattaacgagtatctgatgggtaagtttccttttttccgaggatcatacactggatggcgaaactccgttagacataacctgagcctgaatgactgctttgtcaaagtgctgagagatccgagccgaccttggggtaaagacaactactggatgctgaacccgaatagcgaatacacatttgcagatggggttttccgccgcagaaggaagcgactctcccacagggccccggtcccggcaccaggtctgagaccagaggaggctcccggattgcccgccgcaccaccacctgcccccgccgcaccagcatctcccagaatgcgtagccccgctcgtcaagaggaacgggcttccccagccggcaaattcagcagtagtttcgccatcgattcaatcctacggaaaccatttcgctcacggagactcagggacacagcacccgggactaccttgcagtggggtgcagccccctgtccccctttgcccgcctttcccgccctcctccctgctgctccttgcagggcccttctgcccctatgcgcatacggagccggggagcctgcgaggctcggggccagagaagccgaagtgcctcctactgcccctcccttgcttttagcccctctgcccgctgccgctcccgccaagcccctcaggggcccagccgctggtggcgctcatctctactgccccctccgtctccccgcggccctgcaagccgccagcgtgaggagaccagggccacacctgccttaccccgtggagaccctcctggcctag

SEQ ID NO: 117393 - DNA, 1626 bp, Artificial Sequence
  Description of Artificial Sequence: Synthetic coding sequence
atgagtcagttagtggaatgcgtccctaatttcagcgagggaaagaaccaggaggttatcgacgccatctcaggagccatcacccagactcctgggtgcgttttactagatgttgatgccgggccttcaacaaacaggaccgtctatacctttgtcggacctcccgagtgcgttgttgagggagctcttaatgccgctcgcgtggcctctcggttgatcgatatgtctcggcaccagggagaacatcctcgtatgggagccctggacgtatgtcccttcatacctgtgaggggagtgtccgtggacgagtgcgtgttgtgcgcccaggcatttgggcaacggctggccgaagaattagatgttccagtctacctgtacggggaagccgccagaatggactctcgaaggaccttgcctgcaatccgtgcaggcgagtatgaagcactcccaaagaagctccagcaggcagattgggctccagactttggaccctcaagttttgtccccagctggggcgcaaccgcaaccggcgctcgcaaatttctgatcgccttcaacatcaacctgcttggcaccaaagagcaggcccaccgcatcgctttaaaccttcgcgagcaggggagggggaaggaccagcccggccgcctcaaaaaggtccagggtattgggtggtatttggatgaaaaaaacttggcgcaggtcagtactaacctgctcgacttcgaggtgaccgccctgcacaccgtctatgaggaaacctgcagggaggcccaggagctttctcttcccgttgtgggctcccagctggtgggtctggtgcctctcaaagctcttctagacgccgccgccttttactgcgagaaagagaatctgttcatactcgaagaagagcagcgcatcaggctggtagtgagtcgcctagggttggacagcctctgccccttttctcccaaggaacgcatcattgaatatttggtgccagagaggggccctgaacgtgggctcgggtcaaagagcctgagggcattcgtcggcgaagtcggggccagatccgccgctccagggggtgggagcgtggccgccgctgccgccgcaatgggagctgccttgggttctatggttggcctcatgacttacggccggagacagtttcaaagtctggacacaacgatgcgtcggcttatcccccctttccgggaagcctctgccaaactgacaaccctcgtggacgcagacgcagaggcgttcacggcctatcttgaagctatgcggctgcctaaaaatacacccgaagagaaagaccgacgcacagctgctctgcaagaagggctccgccgggcggtatctgttccactgacgctggccgagaccgtggcctctctgtggccagcacttcaagaacttgctcggtgcgggaacctggcctgccgcagcgatttacaggtggccgcgaaggcgctcgaaatgggtgtcttcggagcttatttcaacgtgctcatcaacttgcgtgatattacggacgaggcctttaaggaccaaatccaccacagggtcagttcattactccaagaggccaaaacgcaggctgctcttgttttggattgtttggagactaggcaggagtag

SEQ ID NO: 117394 - DNA, 1488 bp, Artificial Sequence
  Description of Artificial Sequence: Synthetic coding sequence
atgagtcagcttgttgagtgtgtgccaaatttctccgaaggaaaaaatcaggaagtgattgacgccattagcggtgcaattacacagacgcctggttgcgtgcttttggatgtcgacgcaggtcctagtaccaataggacggtctatacgtttgtgggaccccccgagtgcgtggtcgaaggcgcgttgaatgccgcaagagtggcctctagattaatcgacatgagccgccaccagggagagcatcccaggatgggtgctctggatgtctgcccctttattcccgtgaggggtgtgtcagtggacgagtgtgtgctgtgtgcgcaggcattcggacaacgcctggccgaagagctggacgtgccagtctatctctacggcgaagctgctagaatggacagtcgaagaacactgcctgcgatccgagctggagaatacgaagcactgccaaaaaagcttcagcaggcggactgggcccccgatttcgggcccagctctttcgtgccctcttggggtgccactgctactggggctcgcaaatttctgatcgccttcaatattaacttattaggcactaaggagcaggcgcacagaatcgctcttaatctgcgcgagcagggaaggggcaaggaccagcctggacgcttgaagaaggtccaaggtattggatggtacttggacgaaaaaaacctggcacaggtatcaacaaacctactggatttcgaggtcacagccctgcacaccgtgtatgaggaaacatgcagagaggcgcaggagctatcactccccgtggtgggctcccaactggtgggactcgttccactgaaagcactcttagacgcagctgccttttattgcgagaaggagaacctgttcatcctggaggaggaacaacggatcagactcgtagtcagcagacttgggctggactccctctgcccctttagccccaaagaacggatcatcgagtatcttgtccctgagagggggcccgaaagaggcctaggctcaaaatcactgcgagcatttgtcggagaggtcggggcccgctcagctgctcctggcggcggcagcgtggctgctgcagccgccgccatgggagccgccctcggcagtatggtcgggttgatgacttacggtcgacgacaatttcagtccctcgatacaactatgcggcgcctgatcccacccttcagggaggcctccgctaagcttaccactctggtggacgccgatgccgaggctttcacagcgtatttggcccatggcggcccaacaggcggcagcgaggccgggagcctgtgcgccgccgacgccgggggagacggtggcctcgccgttgcagggcctgcgggaacaggaccggtgtgggagcccgggttaccggtgagaccgcccggcggaggccaatcacctggagacgggcgggtgtggcgaatcttccagcgggcccatcagccagagggccatcataggcggggcatatag

SEQ ID NO: 117395 - DNA, 1719 bp, Artificial Sequence
  Description of Artificial Sequence: Synthetic coding sequence
atgtctcaactagtcgagtgcgtccctaacttttctgagggcaagaaccaagaggtgatcgacgctatttccggcgcaattacccagacccctgggtgcgtcttgctggacgtcgatgctgggccctccacgaatcgaaccgtgtacaccttcgtcggtcctccagaatgcgtcgttgagggagccctcaatgctgcaagggttgcctcccgccttatagatatgtcaagacatcaaggagaacatccacgaatgggcgctctagatgtctgcccgttcatcccggtcaggggtgtttctgtggacgaatgcgtgctgtgcgcacaagcattcgggcagagactcgctgaagagcttgacgtgccagtttatttgtatggtgaagctgccaggatggacagccgacgcacgctgcccgcgatccgagctggcgaatacgaagccctgcctaagaagctgcagcaagcggactgggcccccgattttggtccgtcatccttcgttccttcttggggcgcaaccgccaccggcgccaggaaatttttgatcgccttcaatatcaatttattaggcaccaaagaacaggcacatcgtatcgctttgaaccttcgcgagcagggccgtggcaaggaccaacccggtcgcctcaagaaagtccagggtatcggttggtatctggacgaaaagaacctcgcacaggtgtccacaaacctcctggactttgaagtcactgccctccataccgtgtacgaggaaacctgtagggaagctcaagaactaagcctgcctgtggtgggttcgcagttggtgggcttggtgcctctaaaggctctgctggatgccgctgccttttattgcgagaaagagaacttgttcatccttgaggaagaacagcgcatacggctagtggttagtcggctggggttagactcgctgtgtccctttagccctaaggaaagaatcatcgagtatctggtgcctgagagaggccctgagagaggcctggggtccaaatccctgagggcatttgtgggtgaggtgggggctcgctctgccgccccgggcggagggtccgtggccgcggcagcagccgccatgggcgcagccctgggaagtatggtgggccttatgacttatggccggaggcagtttcagtcactggacacaaccatgcggcggctgatccctccttttagggaagctagtgcaaaactgaccactctcgtagacgccgatgccgaagctttcacggcctatctcgaagccatgaggctccccaagaacacaccggaggagaaggatagaaggaccgctgcgcttcaggaaggcctgagaagggcagtgtccgtcccgctgacactcgcagaaactgtagcttcactgtggccagccctgcaggagcttgcccggtgcggcaatctcgcatgccgctcagatctgcaggtagccgctaaggctctcgaaatgggggtcttcggcgcctacttcaacgtgctgattaatttgcgggacattacggatgaagcctttaaggatcaacctccggcgggctctcaggacccggggtgtactggtgctggactgctaggggaccccgcgggagtgaccgtcagagaagctagtccgggaagcgtggcccctccgtcacctatcccccgtggacagtcttgcgatcttgagacgccaggaactgctgggccaagcactcttgagggctag

SEQ ID NO: 117396 - DNA, 1488 bp, Artificial Sequence
  Description of Artificial Sequence: Synthetic coding sequence
atgtcccagctggtcgaatgtgtacctaacttttcggagggaaagaatcaggaggtgattgacgccatctctggggcaataacccagacgccaggctgcgttctgctcgacgtggatgccggaccgagcaccaataggaccgtctacactttcgtgggacccccagaatgcgtggtggagggggcattaaacgcagcgagggtggccagcaggctgatcgatatgagcagacatcaaggcgagcaccccagaatgggggccctggacgtgtgtcccttcattcctgttcgcggggtgagcgtggacgagtgcgtcctctgtgctcaggcattcggccagcggctagccgaggaacttgacgtccccgtctacctctacggtgaagcggcaaggatggactcccgcagaactttgcctgcaatcagggcaggcgaatacgaggccctccccaagaagttgcagcaggcagattgggctccggatttcgggccctccagcttcgtgccttcctggggcgccacagctactggagcacgtaaattcctgattgcctttaatatcaaccttttggggacaaaagagcaggcccaccgaatagctctcaacctgcgggagcagggcagaggaaaggatcaacccgggaggctgaagaaggtacaggggataggttggtacctagatgagaagaacctggcccaggtgtctaccaacctgttggattttgaagttacggcccttcacacagtgtatgaggagacatgtagggaagctcaggagctgtcgctccccgtggtagggtcacagctcgttggactggtgccgcttaaagcacttctcgacgccgccgcattctactgcgaaaaagagaatctcttcattctagaggaagaacagaggattcgtctggtcgtaagccggcttgggcttgactcgctctgtcccttctcccccaaggaacggattattgaatacctggtgcctgaaaggggtccagagcgcgggctgggttccaagagccttagagccttcgtcggggaggttggtgctcgaagtgccgctcccggtggtggatcggtggccgcagccgcagcagcaatgggcgcggcactggggtcaatggtgggcctgatgacgtacgggaggcgtcaatttcagtctcttgacacaacaatgagacgcctgattcctccattcagggaagcgagtgcgaaattgacgaccctagtagacgcagatgccgaagcattcaccgcctaccttgcgcacggcggacctactggagggagcgaggcagggtcattgtgcgcggccgatgccggaggagacggtggtctggctgtggctgggccggcaggaactggtccggtgtgggaacccggcctccccgtacgaccacctggcggaggccagtcccctggcgatggccgggtgtggcgtatcttccagcgcgcccatcagccagaggggcatcacaggcgtggaatctag

SEQ ID NO: 117397 - DNA, 1626 bp, Artificial Sequence
  Description of Artificial Sequence: Synthetic coding sequence
atgagtcagctggttgagtgcgtccccaacttcagcgagggaaagaaccaggaggtgatagacgccatctctggtgccatcacccagacccccggatgtgtgctgctggacgtggacgcaggcccatctaccaatagaacagtgtacacctttgtgggccctcctgagtgcgtggtggaaggcgctctgaatgccgcaagggtggcgtcccgcctgattgatatgagcaggcaccaaggtgaacaccctagaatgggagccctcgatgtgtgcccattcattccggtccgcggtgtaagcgttgacgaatgcgtgctgtgcgctcaggcttttggccaaagactggccgaagagctggacgttccagtgtatctctatggcgaagcagctcgaatggatagccggagaacactgccagctatccgtgccggagaatacgaggctctccctaagaagctccagcaggccgattgggcacccgactttggtcccagctcatttgttcccagctggggggcaactgccactggagcacgaaaattcctgatcgcattcaacatcaatctcctcgggacaaaagagcaggctcaccgcattgcactcaacctgagggagcaggggcgaggcaaggaccagcccggtcggctgaaaaaagtgcaaggaatcggctggtacctggacgaaaaaaacctggcccaggtgtcaaccaatctcctggacttcgaggttacagcccttcacacagtgtacgaggagacatgtcgtgaagcccaagagctgtcattaccagtggtgggtagccaactggtgggcttggtacccctgaaggctcttctagacgcagccgccttctattgcgaaaaggaaaacctcttcatacttgaggaggaacaaaggataaggctggtggtcagtagactgggattagattccctgtgcccattttcaccaaaggagcggattattgagtatctcgtgcctgagcggggacccgaaagaggactgggatctaaaagtctgagagcttttgtgggcgaagtaggagcacgctctgctgctcccggcgggggcagcgtggccgcagcggcggctgccatgggcgctgcattggggagcatggttggtctgatgacatacggcagaaggcagttccagagcctggacaccaccatgcggaggttaataccaccattccgagaggcctctgctaagctgacaaccctcgtggacgccgacgcagaggctttcaccgcatatttggaggctatgcggttgcctaagaacactccagaagagaaagataggcggacagctgccctgcaggagggactaaggcgcgccgtctccgtccctcttacattagccgagactgtggcctctctttggcctgccctccaggaattggctcgctgcgggaacttggcctgtagatcggatctgcaggtcgctgccaaggctctggagatgggagtgtttggggcatatttcaatgtgctgattaatctcagggatattacagacgaggcttttaaggaccaaatccaccacagggtgagctctctgctacaagaggccaaaacacaggccgccttggtccttgactgtctcgagacgagacaggagtag

SEQ ID NO: 117398 - DNA, 1719 bp, Artificial Sequence
  Description of Artificial Sequence: Synthetic coding sequence
atgagccagttagtggagtgtgtgcccaattttagcgaaggcaaaaaccaggaggtgatagacgctatcagcggggccatcacccagacaccaggctgtgtgcttttagacgtggatgctggccctagcaccaaccgcactgtttacaccttcgtgggcccgcccgaatgcgtggtggagggcgccctaaacgcagcccgggtggccagccgcctgattgacatgtccaggcaccagggggagcatccaagaatgggagccctcgacgtctgtcctttcatccccgtgcgcggggtctcggtagacgaatgcgtactgtgcgcccaggcgttcggccaaaggctggccgaagagctggatgtaccagtgtacctctatggtgaagctgctcgcatggacagccgcaggacgctgccagctatccgtgcaggggagtatgaggcacttccgaagaaattgcagcaagctgattgggccccggattttggcccatcttccttcgttccatcttggggtgcaaccgccaccggggcccggaagttcttgattgcctttaacataaacctattaggtactaaagagcaggcccaccgaattgccctgaacttgcgagaacaggggcgcggaaaggatcagcccggtcgcctgaaaaaggtgcaaggtataggctggtatctggacgagaagaatctcgcccaggtgtctacaaatctgctggatttcgaggtaactgccctgcacacggtgtacgaggagacatgccgtgaggcccaggagctctctttaccagtggtgggatctcagcttgtagggctggtccctctgaaggccctgctcgacgcagccgccttctactgcgaaaaagagaacctctttatcttggaggaggagcaaagaattcgattggtagtctctcgactcggactagactccctgtgtccattcagtcctaaggaaaggatcattgagtacctggtgccagaacggggacctgagagagggcttggaagtaagtccctccgagcgttcgttggggaagttggagcacgcagtgctgctccaggcggtgggagcgtggctgcagccgctgctgccatgggagccgctttgggctccatggtgggattaatgacatatggccgccggcagttccagtcactggatacaacaatgcggagactgataccaccttttcgagaagcctcggccaagttgaccacactcgtagatgctgatgccgaggcttttactgcctaccttgaggccatgcggctgcctaaaaatactcctgaagaaaaggatcggcgcactgccgcactgcaagaggggctccgaagggcagtctctgtcccattaaccctcgctgagaccgtggcttccctatggccagctctgcaggagttggcaaggtgcggcaatctcgcgtgcagaagtgacttacaggtggccgccaaggccctcgaaatgggggtttttggtgcttacttcaatgtcctcattaatctcagggacataacagacgaagctttcaaagaccaacccccagcgggttcacaggatcctggatgtaccggagccggactcctgggcgatcccgcaggcgtcaccgtgagagaggcttcccctggttccgtcgccccacctagtcccatcccacgcggccagtcctgcgaccttgagacacccggcacagctggcccttcaacactagaggggtag

SEQ ID NO: 117399 - DNA, 1779 bp, Artificial Sequence
  Description of Artificial Sequence: Synthetic coding sequence
atgagttggggcacagaactctgggaccagttcgacaacctggagaagcacacgcagtgggggatcgatatcttggagaagtatatcaagttcgttaaagaaagaaccgaaattgaactttcgtacgccaaacagcttagaaacctaagtaagaagtaccaacctaaaaaaaacagcaaggaagaagaagaatataaatatacttcttgtaaagccttcatcagcaaccttaacgaaatgaatgactacgcaggacaacatgaagtaatcagtgagaacatggccagccagataatagtggatttggcaagatacgttcaggaactcaagcaggagcgtaaatcaaatttccacgacggaaggaaggctcagcagcacatcgagacttgctggaaacagctggagagctccaaacggaggttcgagagagactgcaaggaagctgaccgcgctcaacagtactttgaaaagatggatgctgacatcaacgtgacaaaagcagacgttgaaaaagcgcgccaacaagcacaaattaggcaccagatggctgaggacagcaaagcagactacagttcaatcctgcagaagttcaaccacgaacagcatgaatattatcacactcatatacccaacatctttcagaaaattcaggaaatggaagagagaaggatcgtcagaatgggtgagtctatgaaaacttatgctgaagtagaccgtcaggtcatccccatcattggcaaatgtcttgatggaatagtcaaagccgcggagtccatcgaccagaaaaacgacagtcagttagtcatagaggcgtataagtccgggtttgagccaccgggagatatcgagtttgaagactatactcaacccatgaagcgcactgtctccgataatagcttatccaattcccgcggcgaggggaagcctgacctgaaattcggtgggaagtccaagggcaagttgtggccattcatcaagaagaataaaagtcccaagcagcagaaagaaccccttagtcatagatttaatgagttcatgacatccaaacctaagatccattgcttcaggagtctgaaaagagggcactctcttcttaagggtgcgactccagaggacttttctaatttgccccccgagcagagaaggaagaaactccaacagaaagtggacgagctgaacaaggaaattcagaaggaaatggaccagcgcgatgccattaccaaaatgaaggacgtgtatctgaaaaacccccagatgggggatcccgcttctcttgaccataaactagccgaagtatcacagaacattgaaaagttaagggtggagactcagaagttcgaagcttggctggcggaagttgaagggcgactaccagcccggagcgagcaggcaagacgacagtccggtctatacgatagccagaacccccccactgtaaacaattgtgctcaggaccgtgagagtcccgacgggtcctatactgaggagcaatcacaggagtctgagatgaaggtgctggccacggatttcgacgacgagtttgacgacgaggagcctctgccggcaattggaacctgcaaagccttgtatacatttgaggggcagaacgaaggaacaatctctgtggtggagggcgaaaccctttacgtgattgaggaagacaagggggacggatggaccaggatacggaggaatgaagatgaggagggatacgtccccacgtcctatgttgaggtttgccttgataagaatgcgaaaggcgccaaaacctatatctag

SEQ ID NO: 117400 - DNA, 1854 bp, Artificial Sequence
  Description of Artificial Sequence: Synthetic coding sequence
atccggtggaccgacgagttgtgggaccaattcgataacctcgaaaagcacacgcagtggggcattgacattctggagaagtacatcaaattcgttaaggagcgcaccgaaatcgagctgtcctatgccaagcagttgcggaatctgtccaagaagtatcagcctaagaagaatagcaaggaagaggaggagtataaatatactagctgcaaggcctttatctctaatctgaatgagatgaacgattacgccggtcaacacgaggtgatttctgaaaatatggcatctcagattattgtagatttggcacgatacgttcaggaactgaaacaagagcgcaaatccaattttcacgatggaagaaaggcgcagcaacacatcgagacttgctggaaacagctggagagcagtaagcggcgctttgagagagactgtaaggaggcagaccgtgctcagcaatactttgaaaagatggacgccgatattaatgtgactaaagccgatgttgaaaaggcgcgccaacaggctcaaattagacatcagatggctgaggacagtaaggctgactactcatctatcttacagaaatttaatcatgaacagcatgaatactatcatactcacattccgaacatctttcagaaaatacaagagatggaagagcgccgcatagtgaggatgggggagtccatgaagacatacgctgaggttgaccggcaagtgatcccgattatcggtaaatgtctggatggcatcgtcaaggccgccgagtcaattgaccagaaaaacgatagccagcttgtcatcgaggcctataaatcaggcttcgaaccacccggcgatatcgagttcgaggattacacccaacctatgaaaaggaccgtgagtgacaattctttaagcaatagtcgcggagaggggaagcctgacctgaagttcggagggaaaagcaaaggcaagttgtggccatttattaaaaaaaacaagctaatgagcctgcttacatccccccaccagcccccaccccctcctcccgcctccgccagtccttctgccgtccccaacggtccccagagccctaaacaacagaaggaacccctgagtcacaggttcaatgagtttatgactagtaaacccaaaattcattgtttcaggagtttaaaaagagggccgagctttaagcagggggctacccctgaagacttctcgaacctgccgccagaacagcggagaaagaaactgcagcaaaaggtagacgagttgaataaggagattcaaaaagagatggaccagcgcgacgccatcactaagatgaaagacgtgtatctcaagaacccacagatgggcgaccccgcaagcctggaccataagcttgcagaagtgtcgcagaacattgagaagctgagggtggagacccagaagttcgaggcttggttggctgaagtggaaggacgcctccctgctaggagtgaacaggcccgacgacagtccgggctctacgattcccagaatccccctactgtgaacaactgtgcacaggatcgggaaagcccggacggtagctacaccgaagagcagtctcaggagagcgaaatgaaagtcttagccacagatttcgatgatgagtttgacgatgaggagccactgcctgccattggcacatgtaaggccctctacactttcgaaggccagaacgagggaactattagtgtggtcgagggagaaaccctctacgtcatcgaagaggataaaggcgatggctggacgagaatcagacgcaacgaggatgaagagggctatgtgcctactagttacgtcgaggtgtgtctggataaaaatgccaaagattcctag

SEQ ID NO: 117401 - DNA, 1854 bp, Artificial Sequence
  Description of Artificial Sequence: Synthetic coding sequence
atgagctggggcactgaattgtgggaccagtttgacaatctcgaaaagcacactcagtgggggattgacattctagaaaaatatatcaaattcgtaaaagagcgcactgagatcgaactcagctacgccaaacagctcaggaatctcagtaagaagtatcagccaaagaaaaattctaaggaagaagaagagtacaaatatacgtcttgtaaggccttcatctccaacttgaacgagatgaacgactatgctggacagcacgaggtgatatctgaaaacatggccagtcaaatcatagtggatctggccagatatgttcaggaactcaagcaggagcgcaaaagcaactttcatgacggacggaaggctcagcagcacatcgaaacctgctggaaacaattggagtcctccaagcgccggttcgaacgagattgcaaagaggctgaccgagcccaacagtatttcgaaaagatggacgccgatatcaacgtcacaaaagccgatgttgagaaagcacgccagcaagctcaaattaggcaccagatggccgaggactctaaggccgactattcctcaatactgcagaaattcaaccacgagcagcatgaatattaccatacccacatccctaacatcttccagaaaatccaggaaatggaggaaagaagaatcgttcgtatgggagaatctatgaagacttacgctgaagtggataggcaggtaatcccaattatcggaaagtgcctcgatggaatcgtgaaagccgccgaatcgatcgatcagaagaacgatagtcagctggtaatcgaggcctataaatcgggttttgagcctcccggggatattgaatttgaggactacacccagcccatgaagaggactgtgtctgataacagcctcagcaattcacgaggcgaagggaagcctgatctgaaatttggcggaaaatcaaagggcaagctttggccattcatcaaaaaaaacaaattgatgtccctcctgacctcacctcaccaacccccaccccctccacccgctagcgcctctcctagcgccgtaccgaacggtccacaatcccctaaacagcaaaaggaaccacttagtcatcgatttaatgagttcatgacctcaaagcctaagatccactgtttccgctctctgaaacggggccactcattgctgaagggcgcgacgccagaggacttttcaaacttaccaccagaacaaagacgaaagaaattacagcagaaagtggacgagctgaacaaggaaatccagaaagaaatggaccaacgggacgccattacaaagatgaaagacgtttatctcaagaacccccaaatgggcgacccagctagtctcgaccacaagctagccgaagtttcccagaacatagagaaattgagagtcgaaactcaaaagttcgaggcctggttagccgaagtggaaggtcgactgccagcccggtctgagcaggccagacgccagtccggactgtatgactcccagaatccaccgacggtcaataactgcgcccaggatagggagagtcctgatggctcatacactgaggaacagtcccaagagtccgaaatgaaggtgctggcgacagatttcgacgacgagtttgatgacgaggagcctctgccggctattggcacttgcaaagcgctttacaccttcgagggccagaacgaaggaacgattagcgttgtagaaggcgagactctgtatgtaatcgaggaggacaagggcgatggctggacaaggatccgacggaatgaagacgaggagggctatgtacctactagctacgtggaagtctgtttggataagaatgcgaaggattcgtag

SEQ ID NO: 117402 - DNA, 1827 bp, Artificial Sequence
  Description of Artificial Sequence: Synthetic coding sequence
atgagctggggaacggagctttgggatcagttcgacaaccttgagaagcacacccagtggggaatcgatatactagagaaatatattaagtttgtcaaggagcgcacagagatcgagctcagttatgctaagcagctgcggaatctgtcaaaaaagtaccagcctaagaaaaacagtaaagaagaagaggaatataaatatacgagctgtaaagcttttatctcgaatttaaacgagatgaatgattacgccggtcagcatgaggtaattagtgaaaacatggcctcccagattatcgtcgacctggctagatatgtgcaagaactgaagcaggaacgcaagagtaactttcacgacgggcggaaagcccagcaacacattgaaacatgctggaagcagcttgagtcctctaaaaggagattcgagcgagactgtaaggaagccgatcgggcacagcagtacttcgagaagatggatgcagatattaacgtgaccaaggccgatgtagaaaaagccagacagcaggcgcagattcgtcatcaaatggccgaagattccaaggcagattattcctccattctgcaaaagttcaaccacgagcagcatgagtactatcatacccacatcccaaatatttttcagaaaatccaggagatggaggaacggaggattgttaggatgggggaatccatgaagacctacgccgaggtggataggcaggtcatccctatcattgggaaatgtcttgacggaattgtcaaggcagcagagtcaatagaccagaagaacgacagccagctggtcatcgaggcctacaagtccgggtttgagcccccgggcgacatagagtttgaagattacacacagccgatgaagcgaaccgtgtcagacaacagcctgagtaattcccggggcgaaggtaaacctgatttaaagttcggtgggaaaagtaaaggcaagctttggcccttcattaagaagaacaagccccccccccctccgcccgcttccgcttccccttctgcagtgcctaatgggccccaatccccgaagcagcagaaagaaccactgtcccacaggttcaacgagtttatgacctccaaacccaaaatccactgctttcgttcactcaagagggggcatagtctcaccctccagggggctacccctgaggacttttcgaatctcccccctgagcagcgacggaagaagctgcaacagaaggtcgacgaacttaacaaagaaatccagaaggaaatggaccagcgggacgccattacaaagatgaaagacgtttacctgaaaaatccccaaatgggtgatccagccagtttggatcataaattggccgaggtctcccagaacattgagaagctcagagtagaaacccaaaagttcgaggcctggctagccgaagtggagggtagattgcccgcccgttctgagcaggccaggcgccagagcggcctctatgattcccagaaccctcctaccgtgaacaattgcgcacaggacagagaatcccctgacgggtcttacacagaagaacagtctcaagagtctgaaatgaaagttttagccaccgactttgatgacgaatttgacgacgaggagccactgcctgccataggaacttgcaaagcgctttataccttcgaggggcagaatgagggcaccatttctgtagtggaaggggagacactgtacgtcattgaggaggataagggagacggctggacgagaatcagaagaaacgaagatgaggagggctacgtgcctacaagttatgtcgaggtttgccttgacaagaacgctaaagacagttag

SEQ ID NO: 117403 - DNA, 738 bp, Artificial Sequence
  Description of Artificial Sequence: Synthetic coding sequence
atgaagcgcactatcgggaagccaacttatgcatttgaggccagagattatgtgcttagcctgaaactgggagcgacccccgaggatttcagcaatcttccacccgagcagcgacgcaagaagcttcagcagaaagtagacgagctgaataaggaaattcaaaaggagatggaccagcgggacgccataactaagatgaaagatgtttaccttaagaacccgcaaatgggcgatcctgcatcactggaccataagctggctgaagtctcacagaacatcgagaagctgagggtcgaaacacagaagttcgaggcgtggctcgcggaagttgaagggcggctgcccgccagatcggagcaggcgcgacggcagtcaggactttacgacagccaaaatcctccaacagtgaataactgtgcacaggacagggaatcaccagacggaagctatacggaagagcagtctcaggagagcgagatgaaggtgttggccacggattttgacgacgagttcgacgacgaggagcccctgccagcaatcggcacctgtaaggccttgtacacattcgaagggcagaacgaaggcactatcagtgtcgtggagggcgaaaccctgtatgtgatcgaggaggacaaaggggacggttggacgcggatccgacgaaatgaagatgaggaaggctacgtgcctacctcgtacgtggaggtctgtcttgataaaaacgctaaggactcttag

SEQ ID NO: 117404 - DNA, 1854 bp, Artificial Sequence
  Description of Artificial Sequence: Synthetic coding sequence
atgtcctggggtacagagctgtgggaccagtttgataacctagagaagcatacccagtggggtatcgatatactagaaaagtacatcaaatttgtgaaggagcgaacggagatcgaactctcatacgctaagcagctgaggaatctgtcgaagaagtatcagccgaaaaaaaacagcaaagaggaagaggaatacaaatacacgagctgtaaagcattcatcagtaatctgaatgaaatgaacgactatgctggccagcacgaagttatttccgaaaacatggcctcgcaaataattgtcgatctagctcggtacgtccaggagctgaagcaagagcgcaaaagcaacttccatgacggccggaaggcgcaacagcatatagagacctgctggaaacagctggaatccagtaaaaggcggttcgaaagggactgtaaagaagcagatagagcccagcaatacttcgagaagatggatgcagacattaatgtgacgaaggccgatgtggagaaggcacggcagcaggctcagatcaggcaccagatggcagaggacagtaaagcggactacagttctatattgcaaaagtttaaccacgaacagcacgagtattaccatactcacatccctaatatctttcagaagatacaggaaatggaagagcgtcgtatagtccgaatgggtgagtccatgaagacttacgccgaagtggacaggcaagttatacccatcatcggaaaatgcctcgatggaattgttaaggctgccgaatcgatcgaccagaagaatgactctcagctggtcattgaagcctataagtcggggtttgaacccccaggcgacattgagttcgaggactatactcagccaatgaaacggaccgtgtcagacaattccctgagcaacagccgcggggagggcaagcctgacctgaagttcggtggaaagtctaaaggaaaattgtggcccttcattaagaaaaataaactcatgtcacttcttacaagtcctcaccagcccccacctcccccgcctgcatccgccagcccttccgctgtgccaaacggccctcagtctcctaagcagcagaaggaacccctgagccaccgctttaacgaatttatgacaagcaagcccaagatacactgtttccgcagtctgaaacgtggactgtctttgaagcttggagccaccccagaagacttctcgaacctcccacctgagcaacggcgtaagaagctgcagcagaaagtggatgaattaaataaggagattcagaaggagatggatcagagagacgctatcactaagatgaaggatgtctacttgaaaaacccacagatgggtgacccagcctctctagatcacaaactcgccgaggtttcccagaatatcgagaagttacgcgtagaaacccagaagttcgaggcctggctggctgaggtggagggcaggctgcctgctagaagcgagcaggcccggagacagtctggactctacgactcccaaaatcctcccaccgtcaataattgcgcccaggatcgggagtcgccagatgggagctatacagaggagcagtcgcaagaaagtgagatgaaggttctggctacagactttgacgatgagtttgatgacgaggagccgctgcccgccatcggcacgtgtaaagccctatatacatttgaaggccagaacgagggaacaatctccgtcgtggagggcgagacgctgtacgtcatcgaggaggataaaggtgacggctggactaggattcggaggaatgaggacgaggaaggctacgttcctacttcgtacgtcgaggtatgtctggacaagaacgccaaggattcctag

SEQ ID NO: 117405 - DNA, 1722 bp, Artificial Sequence
  Description of Artificial Sequence: Synthetic coding sequence
tgactgtcttacgcaaaacaactgagaaatctgtcaaagaaatatcagccgaaaaagaacagtaaagaagaagaggagtataaatatacatcatgcaaggccttcatctccaaccttaatgagatgaatgactatgccggccagcacgaggtgatctccgagaatatggcgtcacaaatcattgttgacctcgcacgctacgtacaggagctgaagcaggaacggaagagtaacttccacgatgggcggaaagcccaacaacacatcgaaacctgctggaagcagctggaaagcagcaaaagacgttttgagagggactgtaaggaagcagatagagcacagcaatactttgaaaaaatggatgccgacatcaacgtcacgaaagccgatgtggaaaaagcccggcagcaggcacagatccgacaccagatggcggaagactctaaggcggattactcaagcatccttcaaaaattcaatcacgaacagcatgaatattaccatacacacattcctaatatcttccaaaaaatccaagaaatggaggagcggaggatagttcgcatgggagagagcatgaagacctatgcagaggttgatagacaggtcatacccatcatcggaaaatgtcttgacggcatagtgaaggctgcggaatctatcgatcagaaaaatgatagccagttggtaattgaagcatataagagtgggttcgaacctcccggcgacattgagtttgaagactacactcagccgatgaaacgcaccgtatcggacaacagcctgagcaactcgcgaggcgaagggaagcctgatctgaaattcggtggaaagagtaagggtaaactctggcccttcataaagaagaacaaaccccctcctcccccacctgcctcagcttcccctagtgccgtgcctaatggaccccagagcccaaagcagcagaaggagcctttgagccacagatttaacgaatttatgaccagtaaaccaaagatccattgttttcgttcccttaagcgcgggcattccctgctgaaaggcgccaccccggaggattttagcaacttgccccccgagcaacgcagaaaaaagctgcagcagaaggtggacgagctgaataaggagattcagaaagagatggatcagcgcgacgcaattactaagatgaaagacgtctatctcaagaaccctcaaatgggcgatccagcctctctggaccataaattagccgaggtgagtcagaacatcgaaaagttacgagtggaaacacagaaatttgaagcgtggctggcagaggtggaaggtcggctgcctgcccgatctgagcaagcgcgccggcaaagcggtctgtatgacagccagaaccctcccaccgtcaacaattgtgctcaggatcgcgagtctcccgatgggagctatacagaagaacagagccaggagtccgaaatgaaggtgcttgccacagacttcgacgatgaattcgatgatgaggagcccctccctgctataggaacctgtaaagccctttatacgttcgaggggcaaaatgaaggtactatttcagtggttgaaggtgagaccctgtatgtgatagaagaggacaagggggacggttggactagaatcaggcgaaacgaagatgaggaggggtacgtgcctacctcctacgtggaggtgtgcctagataaaaacgctaagggggctaaaacatacatctag

SEQ ID NO: 117406 - DNA, 3495 bp, Artificial Sequence
  Description of Artificial Sequence: Synthetic coding sequence
atggcgggcggtgaagatagaggggatggcgaaccagttagcgtggtaaccgtcagagtacagtaccttgaagacactgacccatttgcctgcgccaatttccctgagcctcggcgagcaccaacttgttctttagacggggccctcccacttggcgcacaaatcccagccgttcacagattgctcggggcccccctgaagttagaggattgcgctctgcaggtttcaccctccggatactatctagacaccgaactctcacttgaggagcagcgcgaaatgctggaaggcttctacgaggaaatctctaaaggccggaaacctacccttatcctgagaacacagttgagtgttagagtgaacgcgatcctggagaagctgtattctagcagtggtcccgaactgaggcgctccctgttttcactgaagcagatctttcaggaggataaggaccttgttccagaattcgtgcattctgaggggttgagttgcctcattcgtgttggggctgccgccgaccataactaccagagctacatattgagagcactagggcaactgatgctgtttgtggatggaatgctaggagtcgtggcacattctgataccatccagtggctctatacactttgtgccagcctttctagactggtagtgaagacggctctcaagctgctactagtgtttgtggagtattctgaaaataatgcaccgctgttcataagagcagtcaattcagtggcgagcaccacaggcgccccaccttgggccaaccttgtcagtattctagaggaaaaaaacggggctgatcctgagctgctcgtatacacagttactctcatcaacaagacgttagcggccctccctgaccaggatagcttttatgatgtcaccgatgcactggagcaacagggaatggaggctctcgttcaacgacatctgggcacggcagggaccgatgtggaccttaggacccagcttgttctgtacgaaaacgctctgaaactcgaggatggcgacatagaggaggcacctggcgccggaggtaggcgcgaacgccggaagccaagctccgaagaaggaaagcgctctaggcgctctctggagggaggaggttgtccggccagagccccggagcctggacccacgggccctgccagccccgttgggcctactagtagtactggcccagcacttctgacgggaccagcttcttccccggtgggaccccctagcggcctgcaagcatctgtcaacctgtttccaactatctcggtggccccttcagcggacacctcttcagaacgatcaatctataaagcccggtttctcgagaacgtcgctgcagcggagacagagaaacaggtagcactcgctcaagggcgggcagaaacactggcgggtgccatgccaaatgaggccggcgggcaccccgacgcccgccagctgtgggactctccagagaccgcgccagccgcaagaaccccccaatcacctgccccatgtgtgctgctgcgagcccagcgaagcctggccccggagccgaaggagcccttaatcccagcgagtcctaaagctgagcccatctgggaactccccaccagagcccctagactctccataggggacctggacttctccgaccttggcgaggatgaggatcaggatatgttgaatgtcgaaagcgtcgaggccggaaaagacatcccagctccctcacctcccctgccattgctgagcggcgtgcctcccccacctcctctgcctccaccacccccaatcaaagggccgtttccgcctccacctcctctacccttggcagccccactccctcattcagttcccgactcaagcgccctgcctaccaaacggaagactgttaagcttttctggcgcgaactgaagctggcaggcgggcacggggtgtccgcttcccgcttcgggccgtgcgccactttgtgggcctctctcgaccccgtgagtgtcgataccgctcgcctcgaacatctgtttgaatcccgggctaaggaagtactgccgagcaaaaaggcaggcgaggggagaaggaccatgactactgtgttagaccctaaacgatctaacgccatcaatatcggtctgaccactcttccacctgtgcacgtcatcaaagccgccctgctgaatttcgacgaatttgccgtgtctaaggacggtatcgagaagttgctgaccatgatgccaacagaagaggagcggcagaagatcgaggaggcccaattagctaatccggatatccccctgggaccggcagaaaacttcctgatgacccttgccagtattggagggctggccgctaggctccagctgtgggcgttcaagctcgattatgactccatggagcgggagatagctgagccattgttcgacctcaaggtgggcatggagcagctggtgcagaacgcgaccttccgttgcatcctcgctactttgctcgctgtgggcaacttcctgaacgggagtcagtcatcaggattcgaacttagctatctagagaaagtgtctgaggtcaaagataccgtacggaggcagagcctgctgcatcacctctgctccctcgtcctccagactaggccggaaagcagcgacctgtattcggagatccccgccctgacaaggtgtgccaaggtggattttgaacaactcacagagaatctgggacagctggagcgccgcagtcgcgctgccgaagagagtctcagatcactggcaaagcacgagctggcacccgctctgagggccaggctgacccactttctggaccagtgcgccagaagagtggcaatgctccgcatcgtccaccgaagggtctgtaaccgctttcatgcttttcttctgtatctgggatacacccctcaggctgcgagagaggtaaggattatgcagttctgtcataccctgagggagtttgcattggagtataggacctgcagggagcgtgtgttgcagcagcaacagaagcaggccacttatcgggagcgaaataagacaaggggaaggatgatcacagagacggaaaaatttagtggggtggctggagaggcaccctcaaatcctagcgtccccgtggctgtttcatcgggccctggacgcggcgatgcagactctcacgccagtatgaagtctttgctcaccagtcgaccagaagacacaactcataacagacgaagccgggggatggtgcagtcctcaagcccaattatgccaaccgtgggacctagcaccgcaagcccagaggaacctcctgggagctccctgccctctgacacgtctgatgagattatggatttgttagtgcagtccgtgaccaagtcttccccacgggcgctcgcggcacgagaaaggaaacgttcacggggaaaccgcaagtccttgcgccgtaccctgaagtcaggacttggagacgatctcgtgcaggcactcggcctatccaaaggacccggcctggaagtttag

SEQ ID NO: 117407 - DNA, 4320 bp, Artificial Sequence
  Description of Artificial Sequence: Synthetic coding sequence
atggctaccctcgcttgccgggtccagttcttagatgacaccgatccctttaactcgaccaatttccctgagccgtctcgtccacccctcttcacgttccgggaggacctagccctcggtacacagctggctggtgtgcaccgactactgcaggcacctcacaagctggacgactgcaccctgcagcttagtcataatggtgcatatctggatcttgaagccactctcgccgaacagcgagacgaactggagggattccaagacgacgcaggacgcggaaagaagcatagcatcattctgagaacccagctgagcgtgagagttcatgcgtgcatagagaaattgtacaactcttcaggccgggacctcaggcgcgccctgttttcgttgaaacaaatctttcaagacgacaaggacttagtgcatgaattcgtggtagccgagggcctgacatgcctgatcaaagtaggtgcggaggccgatcaaaattaccagaattacatcttgagagctctggggcagataatgctgtacgtcgacgggatgaatggggtgatcaatcggaacgaaacgatccagtggctgtacactctgattggatccaagttcagactggtggtcaagaccgcgctcaagctgctcttagtatttgtcgagtactccgagtcaaacgcacccctgctgatccaggcggtaaccgctgttgatactaaaagaggtgtgaaaccatggtccaatataatggagatactggaagagaaagacggggtggacaccgaactcttagtttacgctatgaccttagttaacaagacgctctccgggctgcctgaccaggataccttctatgacgtggtggattgtttggaagaactcggaatagccgccgttagccagaggcaccttaacaagaagggaacagatctagatctcgtggaacagttgaacatctatgaagtagcactgcgccacgaggacggcgatgaaacaacagagccaccaccctccggttgtcgggacagacgtcgcgcctctgtgtgctcatcgggtggtggcgaacaccgagggctagaccgtaggaggtcgcgcagacacagtgtgcaatccatcaagtctaccctgagcgcacctacgtcgccatgtagtcagtctgctccatcattcaagcctaaccaagtacgggatctgagggagaaatattcgaattttggcaataactcataccatagtagcaggccctctagcggcagctccgtccccacaactcccacgtccagcgtctcccctccccaggaagctcgcttggaaaggtcctcccccagtggactattgacttcaagctttcgacagcaccaagaaagcctggctgctgaacgggagcgccgacgccaagagcgcgaagagaggctccagaggatcgaaagagaggaacgaaacaagttttctcgcgattatctcgacaaaagagaggaacagcgccaggcgcgggaagaaagatataaatacctcgaacaactggctgctgaggagcatgagaaggaactgaggtcccgttcagtgagtcgcggaagagcggatctgtcacttgatttgacgagccctgcagccccagcatgtctggcccccctctcccactccccaagctcatcagacagtcaggaggccttgaccgttagtgcttcctctcccgggacacctcaccaccctcaagcttcagctggtgacccagagccggaatccgaggctgagcccgaggctgaggcaggcgctggacaggtcgctgatgaggccggccaggacatcgcgtccgcccatgagggcgccgagacagaggtggagcaggcattggaacaagaacccgaggaacgtgcttctctcagcgagaaggagagacagaatgaaggagtgaatgagagagacaactgtagcgcgagtagcgtcagttcctctagctccacactcgagagggaggagaaggaggataaacttagtcgcgaccggacaactggtctgtggcccgcgggggttcaagacgccggggtcaacggccagtgtggcgacattctaacgaacaagaggttcatgctggatatgctgtacgcccataatcgtaaatcccccgacgatgaagagaaaggtgatggagaggcagggcgtacccagcaggaggccgaagcagttgcctccttggccacccgaatctcaaccctgcaggccaatagccagacccaagatgaatcagtgcgacgggttgacgttggctgtctggacaatagggggtctgtcaaagccttcgcagaaaaattcaatagcggtgatctgggacgtgggtccatttctcccgatgccgaacccaacgacaaggtaccagaaacagcacccgtccagcccaaaacagagtcagattacatctgggaccagttgatggctaacccacgggaactccggatccaagacatggactttactgacctcggcgaggaggatgatatcgatgtattggatgtagacctaggtcatagggaggccccaggcccaccaccccccccaccaccgacctttctcggtctgcctccaccgcctccaccgccattgcttgattccatccctccccccccggtgccgggcaacttgctagtgccaccaccccctgtctttaacgctccccagggcctaggatggagccaagtgccccgcggccagccaacatttacaaaaaaaaagaaaaccatacgactgttttggaacgaagtgcggcctttcgactggccctgcaagaataatcgaagatgtcgagagttcctgtggagcaagctggagcccataaaggtggataccagccggcttgagcatctgttcgagagcaagagtaaagaattgagcgttagtaagaaaacagccgctgacgggaaacgtcaggagatcatagttctggactcgaagcgctcaaacgcaattaatattggccttaccgtactaccccctcctcggactatcaaaattgccatcctgaattttgacgaatacgctctgaataaagaaggtattgagaaaatcctgactatgatccctacggatgaagaaaagcagaaaatccaggaagcacaacttgccaatcccgaaattcccttaggttctgccgagcaattcctcctcaccctgtccagcattagtgaactaagcgctcgccttcacctatgggcatttaagatggactacgaaaccaccgagaaggaagtcgcggagcctcttctggacctgaaggaagggatcgatcagctggagaacaataagacactcggttttattctgtcaactctattagctatcggaaacttcttaaacggcaccaacgcaaaggcattcgaactgagctaccttgagaaggtccccgaagtgaaagacaccgtgcacaaacaatctttgctacaccacgtctgcaccatggtcgttgaaaacttccccgattctagcgacctgtacagtgagattggtgcaattaccaggtcagcgaaagtggatttcgatcagctgcaagacaacctgtgtcagatggaaaggcgttgtaaagcttcatgggaccacctgaaagcaatagcgaagcatgagatgaaacccgtgctcaaacagaggatgagcgagtttcttaaggattgcgccgaaaggatcatcatcttgaaaatagtgcacaggcgtatcatcaatcggttccacagctttctcctcttcatgggccacccaccttacgctatcagagaagtaaacattaataagttttgccgcatcattagtgagttcgctttagagtaccgtacgacgagggaacgggtgttacaacaaaaacagaaaagagccaatcatcgtgagcgcaataagacccgaggcaagatgataacggacagtgggaaattttccggatccagtccagcccctccatcacagccccagggcctgagctacgctgaggatgccgctgaacacgagaacatgaaagccgtcctcaaaacttcatcccctagcgttgaggatgctacccccgccctcggtgtacgcactcggagcagagctagcagaggttctacctcttcctggacaatggggaccgatgattcacctaacgtcactgacgatgcagccgatgagattatggacagaattgtgaaatcggcaacacaggtgccaagccagagagtggtaccacgggaaagaaaacggtctagggcaaacagaaagtctttgagaaggacgctcaaatccggcctcacgcccgaggaagcccgggccctgggactggtagggacctccgaacttcagttgtag

SEQ ID NO: 117408 - DNA, 4269 bp, Artificial Sequence
  Description of Artificial Sequence: Synthetic coding sequence
atggcgactcttgcatgtcgtgttcaattcctggacgacactgatcccttcaactccacaaacttcccagagccttcccggccaccattgttcacttttcgagaggatttggccctggggactcagctggctggggtgcacagattactccaggcacctcataagttggacgactgtacccttcagttatctcacaacggagcttacctggatctcgaagcaacgttggccgagcagcgggacgagttagaaggcttccaggatgacgccggacgaggaaagaaacactccattattcttcggacccagctgagcgtgcgagtccacgcctgcattgagaagctgtataattcatcaggacgggatctgcgccgggccctgttctccctgaagcagatttttcaagatgataaagatctggtgcacgagttcgtggtcgctgaaggcctcacgtgcttgattaaagtgggggccgaagctgaccagaattaccagaactatattctgagagctttgggtcaaattatgctgtacgttgatgggatgaatggcgttattaataggaacgagactatccagtggctatatactttaatcggctctaagttccgtctggtggttaagaccgccctcaaactcctattagtcttcgtcgagtatagcgaaagcaacgctccactcctcatccaagccgtgaccgcagttgatacaaagagaggggttaagccatggtccaatattatggagatcctggaggagaaggacggagttgacacagaactgctcgtatacgccatgactctggtgaataagacactgtccggcctgccggaccaggatacattctacgatgtcgtcgattgtttagaggagctgggcattgctgcagtgagccagcggcacctaaataaaaaaggcacggacctcgacttggtggagcagttaaacatttacgaagtggctctgaggcatgaagatggagatgagactaccgagcctccaccctccgggtgccgagatcgtcggcgcgctagcgtgtgctcttctgggggaggggaacatcgcggtctcgaccgtagaaggagtcggcgtcactccgtacagtccataaagtccacccttagcgctccaacaagcccatgctcgcagtccgccccttcattcaaacccaatcaggtgcgagatttacgggagaaatactcaaattttggcaacaacagttatcattccagccggccgtccagtggctcatccgtgccaacaacacccacgagctccgtgtctccaccccaggaggcacgtctggagcggtcttcaccgtccggacttcttaccagttcttttcggcagcaccaggagagcttagccgcagagagagaaagacgccggcaggaacgagaggaacgcttacaaaggatcgagagagaggagcgcaacaaatttcgatataagtatctcgaacaactggctgccgaggagcatgagaaagagctgcgttcacggtccgtctctcggggacgtgcggacctttcactggatttgacttccccagccgctcctgcctgcctagctccactctcacactcccctagcagtagcgactcacaggaagcccttacagtttcagcatcctctccgggcaccccccaccatccccaagcaagcgcgggggatcccgagccggaatccgaggccgagccagaggcagaggccggagcaggccaagttgctgatgaagctggacaggatattgcgtccgcacacgaaggcgctgagacagaggtggaacaggccctggagcaggaaccagaagaacgcgccagcctgtcagagaaggagcggcagaatgaaggggtcaatgagcgtgataactgcagcgcctcttcagtgtcttcatcaagtagtacgttagaaagggaagaaaaggaagacaagttatcacgcgatcggaccaccggcctgtggcccgccggggtgcaggacgccggcgttaacggccaatgcggagatatcctgaccaacaagcgctttatgctggatatgctgtacgcccataaccgtaaatctcctgacgacgaagagaagggtgacggggaggccggtcgaactcagcaggaggcggaagctgtggcatcactcgctacgcgaatttccactttgcaggcgaactctcagactcaggacgaatccgtccggcgagtcgacgtgggttgcctggacaaccgcggctcagtcaaggcgttcgcggagaaatttaattcaggggacttaggaaggggatctataagtccggacgctgagcccaacgacaaggttcctgagacagccccggttcagcctaaaacagagtccgattatatttgggatcagttgatggccaaccctagggaattgcgaattcaggatatggactttactgatctgggcgaggaagacgacatcgacgtattggacgtcgacctgggtcatagagaagcccctgggccacctccccctccccctccaacatttttggggctcccaccacctcctcctccacctcttctcgacagcatccccccacctcccgtcccagggaatcttctagtgccaccacccccggtctttaacgctcctcagggtctggggtggtctcaggtgccccgagggcagcccacatttaccaagaaaaaaaagaccatacgtctcttctggaacgaggtcagaccatttgactggccgtgcaagaataatcgtcgctgtcgcgagttcctgtggagcaagctggagccaatcaaggtggatacttcgagactggaacatctgtttgaatccaagtcaaaggagctttcagtgtcaaagaagaccgccgcggacgggaagagacaggagatcattgtgctggactccaagcgatccaatgcaataaacataggtctcacagtgctgccgcccccgaggaccattaaaattgccatactgaatttcgatgagtacgccctaaacaaggagggcatcgagaagattctgacaatgataccaacagatgaagaaaaacagaaaattcaggaggcacaactggccaacccagagatccctttggggtccgctgaacagtttcttctgacactgtcctcaataagcgagctgtccgctcggctgcatctttgggccttcaagatggattacgagacaaccgaaaaggaagtggccgagcccttgctggatcttaaagagggtatcgaccaattagaaaacaacaagactctgggcttcatcctatcaacactactcgccattggaaatttccttaatggcactaacgctaaagctttcgaacttagttacctcgagaaagtccccgaggttaaagacacagtgcataagcagagcttgctccatcatgtctgcactatggtcgtggagaatttcccagacagctcagatctttatagtgagatcggcgccattactcggagcgcgaaggttgattttgaccagctccaggacaatctctgtcagatggagcgccggtgcaaagcctcatgggatcacctgaaagctattgccaaacacgaaatgaagcctgtgctgaagcagagaatgagcgagttcctgaaagattgcgctgaacgcataatcatccttaagatcgtgcaccgccgcataataaatcgatttcatagttttctcttgtttatgggtcatcccccttacgccattagggaagttaatattaataagttctgtcgaatcatcagtgagttcgccttggaatatcggaccacaagggagagggtgctccagcaaaaacagaagcgggctaatcacagggagcgaaataaaaccagaggtaagatgataacagatagtgggaagttttccggcagctccccggcccctccatcacaacctcagggactgtcctatgccgaggacgccgccgaacacgaaaatatgaaagcagtcctcaaaaccagttctccatcagtggaagacgctactccagcgctgggagttagaactcgttcgagagcgtcccgagggagcactagttcctggacgatgggcacggacgatagccccaacgttaccgatgacgccgctgatgaaattatggatagaattgttaagtctgccacacaggtcccgtcgcagagggtggttccccgggagcgcaagcgttcaagagccaacaggaaatccctcagacggaccctcaaaagcggcctcacccctgaagaagctcgcgcccttggtctggtgggcacctctgagttacaactctag

SEQ ID NO: 117409 - DNA, 4206 bp, Artificial Sequence
  Description of Artificial Sequence: Synthetic coding sequence
atggctacactcgcctgtcgcgtgcaatttctggacgataccgatcctttcaacagcaccaattttccggaaccatctcgccccccgctgttcacctttagggaagaccttgcactaggaactcagctggccggcgttcatagactactgcaggctccacacaaattggacgattgcacactgcagctcagtcacaacggtgcctatttggacctggaggccacactggccgaacagcgagatgagctggaagggttccaggacgatgcgggtcgcggcaagaaacacagtatcattctgagaacccagctttctgtgagggtgcacgcctgtatagagaagctgtacaattcttctggccgggatcttagacgagcacttttctccctaaagcaaattttccaagatgataaagatctcgtgcatgagttcgtagtagctgagggccttacgtgcctgatcaaagtcggggcagaagccgatcagaactaccagaactacattttgcgagctctggggcagatcatgctctacgtcgacgggatgaacggagtgattaaccgaaatgaaactattcagtggctatatactctcataggaagtaaattcagattggtggtcaagactgccctgaaacttctgctagtttttgtggagtatagcgaatccaacgccccactccttatccaggctgtcaccgctgtggacactaaacgaggtgtcaagccttggtccaatataatggaaattctcgaggagaaagatggggtggacaccgagcttctagtgtacgcaatgactctagtgaacaagacgctctccgggctacccgaccaggatacattctatgacgtggtggactgcctcgaagagctggggattgccgcagtgagtcagcgccacctgaacaagaaagggaccgacctcgatttggtagaacaactgaacatctatgaagtcgctttgagacacgaggatggcgacgagactactgaaccacctccaagtgggtgcagggacaggcgtagggctagcgtctgtagcagtgggggcggggagcaccgagggttggatcgccgacgctcccgacgtcactcagtgcaatcaataaaaagcacgctaagtgctcctactagcccatgctcacaaagtgcaccttctttcaagcccaatcaggtgagggacctgcgcgagaaatcctccccttcaggattactgacgtcatcctttcggcagcaccaggagtcccttgccgctgagagggaacgccgccgccaggagagggaggaaaggctgcagcgaatcgaacgagaagagaggaataagttctcacgggattatctggacaagcgagaggagcagcgtcaagcccgagaagaaagatataaatatcttgagcaactggctgcagaggagcacgagaaggaactgcgaagtcgctctgtcagcagagggcgggccgacctgtctcttgatctaacgagcccagcggcgcccgcatgcctcgcacccctttcccattctcctagctcttccgattcacaggaagcactcaccgtgtcagccagcagcccgggcacaccccaccatccccaggcaagtgcaggcgatcctgagccagagtccgaggctgagccggaggccgaagcaggagccggccaggtagccgacgaggccggccaggatattgcgtccgcacacgaaggcgctgagacagaggtcgaacaggctctggagcaggaaccagaggagcgagcctccctttcagagaaggagcggcagaatgagggggtaaatgaaagggacaattgctctgccagctcggtgtcttcctcatcttccaccctggaaagagaggagaaagaggataagctgtccagggatagaaccacaggcctttggccagctggcgtgcaagatgccggagtcaatggccagtgtggggatattctcaccaataagagatttatgctcgacatgctctatgcccacaaccgcaagtctccggacgacgaggaaaaaggcgatggcgaggcgggccggacacaacaggaagcagaagccgtggcaagcttggctacacgcatctccactctgcaagcaaattctcagacccaggacgagagtgtcagaagggtggatgtggggtgtctcgacaacaggggtagcgtcaaggcgtttgctgagaaatttaactcaggcgatctcggcagaggttccatttcccccgacgccgagcctaatgacaaagtgccagaaaccgcaccggtgcagccaaagacggagtctgattatatatgggaccagctcatggctaaccctcgggaactacggatccaggatatggattttacagatctaggcgaggaggatgatatcgacgtcctggatgtcgatttaggacatagagaggcgcctgggccgcccccaccccctcctcctacttttctgggtctgcctcccccccctccgcccccgctactagactctatacctccgccccccgtgccaggaaaccttctggtcccgccgccccctgtctttaatgcaccccaaggcctgggttggtctcaggtcccgagaggacaaccaacattcaccaagaagaaaaagactatcagactgttctggaacgaagtgaggcctttcgactggccatgtaagaataaccgcagatgcagggagttcctgtggtcaaaactggaaccgatcaaggtggacacctctcgacttgagcacctgtttgagtctaaaagcaaggagctcagcgtgtccaaaaaaaccgccgctgacggaaaacggcaagaaatcatcgttctggacagtaagcgctccaatgcgataaacattggcctcaccgtgctgccacccccgcgaactatcaaaattgctatcttaaacttcgatgaatatgccttaaataaggaggggatcgagaaaattctcactatgatccccaccgatgaggaaaaacagaagatccaggaggcacagctggccaatccagaaatccccctgggcagcgccgaacaatttctgctgacgctgtcaagcataagcgaactctccgcccgcctccatctgtgggccttcaagatggactatgagactaccgagaaggaggtggccgagcctttgctggacctgaaagagggcatagatcaattggagaacaataaaacccttggtttcatcctctctacccttcttgcgatcgggaattttttgaacggcaccaacgcaaaggcttttgaactgtcctatctggagaaggtccctgaggtgaaagacacggttcacaaacagtcattgctgcaccacgtatgtactatggttgtggagaactttccagacagcagtgacctgtactccgagattggagccatcacacgctctgctaaagtggacttcgatcagttacaggataacctgtgtcagatggaaaggagatgcaaagcgtcttgggatcatctgaaggcgatcgctaagcatgagatgaaacccgtcttaaagcagagaatgtctgagtttctcaaggattgtgctgagcgtataattatactcaagatcgtgcaccgtcggatcataaatagatttcactcctttttgcttttcatgggacaccccccgtacgctataagggaggtcaacatcaataaattttgtaggatcatttctgagtttgctcttgagtacagaaccactagggaaagggtgctacagcagaaacagaagagggccaatcacagagaacggaacaagacccgcggcaaaatgatcacagattcgggcaagttttctggcagtagtcccgctccacctagtcagccacaggggctgtcatacgctgaagacgcggctgaacacgagaatatgaaggctgtgctcaaaaccagctccccctcggtggaagatgccacgcctgctctcggagtgcggacccgctcaagagcatcccgagggtccacatcctcatggacgatgggaaccgacgactctcccaatgttacagacgacgccgccgacgaaattatggaccggatcgtcaaatccgccacacaggtaccatctcaaagagtcgtgcctcgagaaaggaaacgctctcgcgcaaataggaagtcgctgcggcgtactctgaagtcaggcctgacgccagaggaggcacgagctctggggctcgtgggaacgtccgaacttcagctgtag

SEQ ID NO: 117410 - DNA, 1053 bp, Artificial Sequence
  Description of Artificial Sequence: Synthetic coding sequence
atggagactaattcatcactgcctacgaatatcagcgggggtactcctgccgtctctgctggctaccttttcctggatattatcacttatttggtgtttgccgttacttttgtcctcggcgtgctaggcaacggtctggtgatttgggtggccggcttcaggatgactcatacagtcactacaataagctatctgaacctggctgtggcagacttttgttttacttctaccttgccttttttcatggtaaggaaggcaatgggggggcactggccctttggctggtttctgtgcaagtttgtgtttacaattgttgatatcaacttgttcggcagcgtcttcttaattgcactgattgcactggatagatgtgtgtgcgtacttcatccagtctggacccagaaccacaggactgtctctttggccaagaaggtgatcattgggccttgggttatggcactgctgctcacccttccggtgatcattcgggtgacgacagttcccgggaaaaccgggactgtggcctgtacgtttaatttcagcccctggactaacgatcctaaggaacgaataaatgtggccgttgcaatgttgaccgttcggggaatcatcagatttataatagggttttccgcccctatgtctatcgtcgccgtcagttatgggctcattgctaccaaaattcacaagcaagggctgattaagagttccagaccactcagagtgttgtccttcgtggcggccgcatttttcctgtgttggtcaccataccaggtcgtggctcttattgctaccgttaggattcgagagctgcttcagggcatgtacaaagaaattgggatcgcagtcgacgtgacctcagccctggcatttttcaatagttgccttaatcccatgttatacgtgtttatgggccaggactttcgggaacgcctcatacacgccctgcctgcttctttagaacgtgcactgactgaggatagcactcagactagcgataccgccacaaattctacgcttccaagcgctgaggtggagctgcaggccaagtag

SEQ ID NO: 117411 - DNA, 1053 bp, Artificial Sequence
  Description of Artificial Sequence: Synthetic coding sequence
atggagaccaattcaagcctccctaccaacatatcgggagggaccccagctgtatctgccgggtacctgttccttgatattattacatacctcgtgttcgctgtgacttttgtgcttggcgtgctcggtaacgggctggtgatatgggtcgcgggcttccggatgacgcatactgtaacaaccatctcttacctgaatctcgctgttgcagacttttgcttcacttccacacttcctttttttatggtgcggaaggcaatgggcggccactggcccttcggctggtttttatgcaagtttgttttcacaattgtcgatatcaacctcttcggcagcgtgttcctgatagccttgatcgcactggaccgttgtgtgtgcgtgctgcaccccgtctggacgcagaatcaccggaccgtgagccttgctaaaaaagtgattattggtccctgggtgatggcgctgctcctcacactcccagttataatccgcgtgacgactgtacccggcaagaccggtaccgtcgcctgcacttttaatttctccccatggactaacgacccgaaagagagaattaacgttgccgtggccatgctaaccgtgagaggaattatcagattcattatcggcttcagcgccccaatgtcaatcgtggcagtctcctatggattgatcgcaactaagattcacaaacagggactgatcaaatcatctcggcccctgagagtgctgtcttttgttgcagcagcgttttttctgtgctggagtccataccaggtggttgccctcatcgcaacagtgcgcatcagggagcttttgcagggaatgtacaaggagattggcatcgcagtggatgttacgtcggctctggccttctttaactcatgccttaatcccatgctctacgtatttatgggccaggatttcagggagagactaatccacgcacttcccgcttcactggagagagcgctaacagaggactcgacacagacttctgacaccgcaaccaattctaccttaccaagcgctgaggtcgagctgcaggctaaatag

SEQ ID NO: 117412 - DNA, 1056 bp, Artificial Sequence
  Description of Artificial Sequence: Synthetic coding sequence
atggaaacaaatttctccacacccctcaatgagtacgaggaggtgtcgtatgaaagtgctggctatacagtactgcgaattttacccctcgtagtgctgggtgtgacctttgtgctgggggtcctcggaaatggactagttatatgggtggcaggatttaggatgacaagaactgtgaccaccatctgctacttgaatctcgcgctcgccgacttttccttcacggccacattgccattcctgatcgtctctatggccatgggtgagaagtggccatttggctggttcctttgtaagctgattcatattgtcgtggacatcaatctgttcggctcagtgttcttgatcggattcatcgctttagaccgatgcatttgcgttctgcatcctgtctgggcacagaaccatcgcaccgtgagccttgctatgaaggtgatcgtgggtccatggatcctcgcacttgttctgactctgcctgttttcttgttcctgactacagtgaccatcccgaacggagacacttactgcacctttaattttgctagctggggcgggacccccgaagagcgccttaaggtcgcgattaccatgctcaccgcgcggggaataatccgtttcgttatcggattctctttaccaatgagcattgtggctatatgctacggcttaattgccgctaaaatccacaagaagggcatgatcaaaagttccaggcctctcagagtgttgaccgcagttgttgctagcttcttcatctgctggttccccttccagctcgtggccctattaggcaccgtgtggcttaaggagatgctattctacggaaagtataagattattgacatccttgtcaaccccacctccagtctagcattcttcaacagctgccttaaccctatgctgtacgtcttcgttggtcaggattttcgcgagcggttgattcactccctgcctacatcactggaacgagcgttgagcgaggactcagcacctacaaatgatacagccgcgaactctgccagtcccccggcggagactgagttacaggctatgtag

SEQ ID NO: 117413 - DNA, 1056 bp, Artificial Sequence
  Description of Artificial Sequence: Synthetic coding sequence
atggagacaaatttctcaaccccactcaatgaatatgaggaagtcagctacgagagcgcgggctacaccgtcctcagaatcctgccgctggtcgttctgggcgtgacattcgtgctcggggttttggggaacggtctggtaatctgggtggcaggttttcgcatgacccggacagtcactacaatttgttatctaaatcttgctctggctgacttttcatttacagcgacactgccttttctaattgtatccatggcgatgggcgaaaaatggcccttcggctggttcctgtgtaagctcattcacattgtggtcgatatcaatctgtttggatccgtcttcctgattggtttcatagccctggataggtgcatttgcgtgctacatcccgtttgggctcaaaaccaccgtaccgtgtccttggcaatgaaggtgatcgtcggcccatggatcctggctcttgtccttaccctgcccgtcttcctcttcctcaccaccgtcacaattcccaatggagacacctattgtacttttaactttgcatcctggggcggaacgccagaagaacggctgaaggtggccatcacaatgctcactgcgcggggaataatccggtttgtgattggcttctccctccccatgagtatcgtggccatctgttacggcttgattgccgccaagatccataagaaagggatgatcaaaagctcccgtcctctccgcgttctgaccgccgtggtcgccagtttttttatctgctggttccctttccagttggttgcactgctgggcactgtctggttgaaggaaatgttgttttacggcaaatacaaaatcatcgacatcctcgtcaacccaactagctctttagctttttttaacagctgcctgaaccccatgttgtacgtattcgtgggccaggacttcagggaaaggctgattcactcccttccaacctccctggaacgtgctcttagtgaggattctgcccctacgaatgataccgctgcaaattccgcctctcctcctgccgaaaccgaactccaggcaatgtag

SEQ ID NO: 117414 - DNA, 1062 bp, Artificial Sequence
  Description of Artificial Sequence: Synthetic coding sequence
atggagacgaatttcagcataccactcaacgagaccgaggaggtgctacccgagccggctggacacaccgtcctctggattttctctttgctggtccacggtgtaacctttgttttcggcgtcctcggtaacgggctcgtgatctgggtggcagggtttcggatgactcggactgttaacactatctgctacctaaatctcgccctggccgacttctccttcagcgctatactgccctttcggatggtgtccgtggctatgcgggagaaatggccgttcggaagctttctctgcaaattagtgcacgtgatgatcgatattaatctgttcgtcagcgtgtacctgatcacaatcattgccctcgatcggtgcatctgcgttctgcacccagcttgggctcagaatcataggaccatgtctctggctaagagagtgatgacgggcttatggattttcactattgtgctgacactgccaaacttcattttctggactacaataagcacgaccaacggagatacctattgtatcttcaatttcgcattctggggagataccgctgtggaaagacttaatgtgttcatcaccatggcgaaggtctttcttattttgcattttattattgggtttagtgtgccaatgtctatcattaccgtctgctacggaatcatcgctgctaagatccataggaatcacatgattaagagcagcaggcctctgcgggttttcgccgccgtcgtggcttcctttttcatttgttggttcccctatgagctgattggcattctaatggcggtgtggttaaaggagatgctgttgaatgggaagtataagataattctcgttctcatcaaccctacatcttccctggcattcttcaatagctgcctgaaccccatattgtacgtgttcatgggtaggaattttcaggaaaggctcatcagatccttaccaacctcactcgaaagagctctgactgaggtgccagactcagcacagactagcaataccgataccacaagtgcgtcaccccccgaagaaaccgagctccaagccatgtag

SEQ ID NO: 117415 - DNA, 816 bp, Artificial Sequence
  Description of Artificial Sequence: Synthetic coding sequence
atgtttcgcgatttcggtgagccaggcccttcctccggaaatggcggtggatacggcggaccagctcaaccgcccgcagccgcacaagcagcccagcagaaatttcaccttgtgccgagtattaatactatgtctggctcccaggagctgcagtggatggtgcagccacactttctgggtccaagctcctacccgcgcccactgacctatccacaatatagtccgccccagccacgacctggtgttatcagagctctaggtccaccgccaggagttcggagacgcccttgcgagcagataagtcctgaggaggaggaacgaagaagggttagacgtgagaggaacaagctcgctgctgctaaatgccgtaacaggcgcaaggaactaactgactttctccaagccgaaaccgacaaattggaagacgagaagtcgggactgcaacgcgagatcgaagagctccagaaacaaaaggaacggctagaactcgtcttagaggctcatcggccaatctgcaaaataccagaaggggccaaggaaggggataccggcagcacgtctgggacaagctcaccaccagctccatgccgccccgtgccttgcatcagcctctcccctggaccagtactcgaaccagaggccctacatacgccaacactaatgacaacaccctcactgacaccttttaccccgagccttgtgttcacttacccctccacacccgagccctgcgcaagcgctcacaggaaaagctcctctagtagtggcgacccatccagtgacccactgggtagccccacacttttggccctgtag

SEQ ID NO: 117416 - DNA, 510 bp, Artificial Sequence
  Description of Artificial Sequence: Synthetic coding sequence
atgtttcgggatttcggggagcctggccctagtagcggaaacgggggggggtacggcgggccagcgcaacctcctgcggctgcacaggctgcccaacaggaaactgacaagctagaagacgaaaaatcaggattgcaaagggagatcgaagaactgcagaaacagaaagagcgattggaactggtgctggaagcccaccgacccatctgcaaaatacccgaaggcgccaaggagggggacacgggtagtactagtgggacctcttccccccccgctccatgtcgtcctgtcccatgtatttcgctgagccccgggccagtattggagcctgaggctctacacactcccactttgatgactacaccatccctgacgccttttacaccatccctcgttttcacctacccaagtacccccgagccctgcgcctccgcccaccgcaagagcagttcttctagcggggatccatctagtgacccgctcggcagccctaccctcctcgcactgtag

SEQ ID NO: 117417 - DNA, 351 bp, Artificial Sequence
  Description of Artificial Sequence: Synthetic coding sequence
atgttccgcgacttcggcgaacctggcccatcaagcgggaacggaggaggctatgggggaccagcccagccacctgccgcggcccaggcagctcaacagaagtttcacctggtccccagcatcaataccatgtctggctcgcaggaacttcaatggatggttcaaccgcattttctgggaccctcctcttaccctaggcccttgacgtatccacaatactcaccaccccaacccaggcccggagttatccgggcactgggtccacctccaggcgtgcgacgcaggccatgcgaacagatttcacctgaagaagaggagtcgtggcagccccgggatttcgttgacccgtag

SEQ ID NO: 117418 - DNA, 981 bp, Artificial Sequence
  Description of Artificial Sequence: Synthetic coding sequence
atgtatcaggactacccgggtaactttgacaccagctcccgaggttcttcagggagccccgcccatgccgaatcttattcatcgggggggggtggccaacagaaattcagagtcgatatgccaggaagcggaagcgcatttatcccgacaatcaacgctatcactacatcacaagatctgcaatggatggtgcagcccactgtcatcacatccatgagtaatccctatccccgatctcatccgtacagtcctcttcccgggctggcttctgttcctggccacatggccctgccccgtcctggcgtaataaaaaccatagggacaacggtcggtcgaaggagacgagatgaacagctcagccctgaggaggaggagaagcgcaggatacggagggaacgcaacaaactagcagcagccaagtgtaggaatcgccggagagagctaactgagaaactgcaggccgaaaccgaggagttagaggaagagaagtccggcttgcagaaggagatcgctgaactccaaaaagaaaaggagaagctcgagtttatgctcgtagcccacggcccggtttgtaagatcagtccagaagaacgccgatcaccaccagcccctgggctccaaccaatgcggtccggcggcggaagcgtgggggctgtggttgtgaaacaagagccattagaagaggatagcccatcatcctcaagtgcaggactcgacaaagcccagaggtccgtgatcaagcctatatccattgctggagggttttatggcgaggagcctttacatacgcctatcgtagtgacgtctactccagcagtgactcccgggacttcaaatctcgtgtttacctacccaagcgtcctcgaacaggagtctccagcgtcccccagtgagtcatgttcaaaggcccacaggcgcagctcctcctcgggagaccagagttccgattctctgaactcacctaccctgctggcgttatag

SEQ ID NO: 117419 - DNA, 864 bp, Artificial Sequence
  Description of Artificial Sequence: Synthetic coding sequence
atgccgggaagcgggagtgcatttatccccacgattaatgcaattacaacaagtcaggacctgcaatggatggtgcagccgaccgtaataaccagtatgtcaaacccgtatccaaggtcccatccctactcccctcttcccgggctggcaagcgtaccaggacatatggctctgccacggccgggagtgattaaaacaatcgggactacagtagggcggcgccgccgcgacgagcaattatcacctgaggaagaggagaaaaggcggatacgccgtgagcgcaataaattagcagctgcaaagtgcagaaacagaagaagagagttaacggagaagctacaggcagaaaccgaggagctcgaggaagaaaagagtggccttcaaaaggagatagccgagctgcaaaaagagaaggaaaagctcgagtttatgctcgtcgcccatggacctgtgtgcaaaattagcccagaggagaggcgctcgcccccggccccaggcctccagcccatgagaagtggcggcggctctgttggggctgtggtggtcaagcaggagcctctggaagaggactctcccagcagctcttctgctggcctggataaagcgcagaggtcagtgatcaaacctatttcgattgctggaggtttttatggcgaggagcccttgcacaccccaatcgtggtcacctctactccagctgtcacacccggaactagcaacctggttttcacatatccatctgtcctcgagcaggaatcccccgcttctccttcagagtcttgctccaaagcccacaggcggtcctcctcaagtggcgaccagagcagcgattctctcaatagccctacacttcttgcgctatag

SEQ ID NO: 117420 - DNA, 972 bp, Artificial Sequence
  Description of Artificial Sequence: Synthetic coding sequence
atggctgagaagtttgattgccattactgccgcgaccctctgcagggcaaaaaatacgttcagaaggatgggcaccattgctgtcttaagtgctttgataaattttgcgcaaacacatgcgtcgagtgtaggaaacctataggagcagatagtaaagaggttcattacaagaataggttttggcatgacacttgcttccgatgcgccaagtgcttgcaccctttggccaacgaaactttcgtggcaaaagacaataagattctctgcaataaatgtactacaagagaggactcccccaaatgtaaggggtgtttcaaagctattgtggctggggaccagaatgtggaatacaagggcacggtgtggcataaggactgtttcacatgcagcaactgcaaacaggtcataggcacaggttccttttttcctaagggagaagacttttactgtgtcacgtgccacgagacaaagtttgccaagcattgcgtaaagtgcaataaagccattacgagcggggggattacttatcaggaccagccctggcatgctgattgtttcgtgtgcgttacttgttctaaaaaactggccgggcagcggtttacggccgtggaagatcagtactactgtgtggactgctataaaaacttcgtggcgaaaaagtgcgcaggatgtaagaatcctatcactggcaagaggaccgtaagccgggtatctcacccagtaagcaaagccaggaagccccccgtgtgtcatggaaagagactccctctcacgcttttccctagtgcaaatctgagggggcggcaccccggaggggagaggacctgtcccagctgggtggttgtcctgtatcgcaagaatagatcactcgctgccccccggggtccgggcctggttaaagcacccgtgtggtggcctatgaaggataatcccgggaccacaacggcatcaacagccaaaaatgcaccctag

SEQ ID NO: 117421 - DNA, 774 bp, Artificial Sequence
  Description of Artificial Sequence: Synthetic coding sequence
atggccgaaaaatttgattgccattactgcagagaccccttacagggtaagaaatatgtccagaaggatggccatcattgctgcttgaagtgcttcgacaagttctgcgcaaatacctgtgtcgagtgcagaaagcccattggcgccgatagtaaagaggtccactacaagaaccgcttttggcatgatacctgcttcagatgtgctaagtgcctgcatcctctcgctaacgaaacctttgtggccaaagataacaagattctctgtaacaaatgtactaccagagaagactcccccaagtgtaagggctgcttcaaagcaattgtcgccggtgatcagaacgtcgaatacaaggggaccgtctggcacaaagactgtttcacctgctcgaattgcaaacaggtgattggaacgggcagtttcttccccaaaggcgaggacttctactgtgtgacctgccatgagaccaaattcgccaaacattgtgtaaagtgcaacaaagctattaccagcggaggaattacctaccaagatcagccatggcacgcagattgttttgtgtgcgtgacttgctccaagaagctggctgggcaacggtttaccgccgtagaggaccagtactactgcgtcgactgctataagaacttcgtggccaagaaatgcgcaggctgcaaaaatccaattaccggatttggaaagggatcaagtgtagtcgcctacgaagggcagtcgtggcacgattattgctttcactgcaagaaatgtagcgtgtag

SEQ ID NO: 117422 - DNA, 633 bp, Artificial Sequence
  Description of Artificial Sequence: Synthetic coding sequence
atggcctcccacagacacagcggcccatcaagctacaaggtgggtacaatggcggaaaagttcgactgtcactactgcagagatcccttacagggaaaaaagtacgttcagaaggacgggcatcactgctgcttaaaatgctttgacaaattttgcgcaaatacctgtgtcgagtgcaggaaacccattggcgcagacagcaaagaagtccactacaagaacaggttttggcatgatacttgctttcggtgtgccaaatgtctgcaccctctggctaacgagacattcgtggcgaaagacaataagatcttgtgcaataagtgcaccactcgcgaggattctcctaagtgtaaaggttgctttaaggccatcgttgccggagaccagaacgtggagtacaaagggactgtttggcacaaggactgcttcacttgctcaaactgtaagcaggtgattggaacgggctccttctttcccaagggggaggacttctattgcgtgacctgtcatgaaaccaaatttgccaagcactgtgtaaagtgtaataaaggactcgtcaaggcccccgtctggtggcccatgaaggacaaccccgggactacgacagctagtaccgcaaaaaacgcgccttag

SEQ ID NO: 117423 - DNA, 891 bp, Artificial Sequence
  Description of Artificial Sequence: Synthetic coding sequence
atggcgagccaccgccattccggcccttcgtcctacaaagtaggaacaatggcagagaagttcgattgtcactactgccgcgacccactccaggggaagaaatacgtccagaaagacggccaccactgctgtttgaaatgcttcgataaattctgtgccaatacctgcgttgagtgtcggaagcccattggcgccgattcaaaagaagtccactacaagaacaggttctggcacgacacatgctttcggtgtgctaagtgcctgcaccccttggcaaatgaaacattcgtagcaaaggacaacaagatcctgtgtaacaaatgcaccactcgggaggactctccgaaatgtaagggatgttttaaagccattgtggctggcgatcaaaacgtcgaatataagggcactgtctggcataaagattgtttcacttgctcgaactgtaagcaagtgattggaacagggtccttttttcccaagggcgaggacttttactgcgtgacatgtcatgagaccaaattcgcgaaacattgcgtgaagtgtaacaaggcgattactagcggtggcatcacctaccaggaccagccgtggcacgcagattgctttgtctgcgtgacctgtagcaagaagctggccggccagagatttaccgccgtggaggaccagtactactgcgtggattgttacaagaacttcgtcgccaagaagtgcgccgggtgtaaaaatcctattaccggctttggaaagggtagcagcgtggtggcctacgagggacagtcatggcacgattattgttttcactgtaaaaagtgtagtgtgaatctggccaacaagagattcgttttccatcaggagcaggtgtattgcccagactgcgcgaagaaactctag

SEQ ID NO: 117424 - DNA, 843 bp, Artificial Sequence
  Description of Artificial Sequence: Synthetic coding sequence
atggctgaaaagttcgactgccattactgccgcgaccctctgcagggaaaaaaatacgtgcaaaaggacgggcatcattgctgtcttaaatgcttcgacaagttttgtgccaacacatgtgtcgagtgccggaagcccattggtgctgacagcaaggaggtgcactacaagaatcgcttttggcacgacacttgctttcgatgcgcaaagtgcctgcacccactcgcaaacgagacgtttgtggctaaggacaacaagatcctgtgcaataaatgtaccactcgtgaggactctcctaaatgtaaagggtgctttaaggccatcgtggcaggcgatcaaaatgtggagtacaagggaacagtgtggcataaagattgttttacctgctccaattgtaagcaggtgatcggtaccggcagtttttttcctaagggcgaggatttctactgtgtgacgtgtcatgaaacgaagttcgcgaagcactgtgtcaaatgcaacaaagctatcacttctggcggcattacctaccaggaccagccctggcacgccgattgtttcgtgtgtgtgacctgcagtaagaagctcgccggtcagagatttactgccgtggaggaccagtattactgtgtcgactgctacaaaaattttgtagcaaagaagtgcgcaggctgcaaaaaccctattacaggatttggaaagggaagcagcgtcgtggcatatgaggggcagagctggcatgactactgcttccattgcaaaaagtgcagcgtgaaccttgccaataagagattcgtgttccaccaggaacaagtgtactgccctgattgcgctaagaagttatag

SEQ ID NO: 117425 - DNA, 843 bp, Artificial Sequence
  Description of Artificial Sequence: Synthetic coding sequence
atggccgagaagtttgattgccattattgcagggaccccctgcagggaaagaagtacgtgcagaaggacgggcaccattgctgcctgaaatgtttcgacaaattctgcgccaatacatgtgtggagtgtagaaagcctatcggggcagacagcaaggaggtccattacaaaaaccgattctggcatgacacctgcttcaggtgcgccaagtgcctgcatcccttagccaatgaaacgttcgtagctaaggacaacaagatcctgtgtaataaatgcaccactcgggaggactcccctaaatgcaaaggctgtttcaaggcaattgtagccggcgaccagaatgtagagtacaaaggcaccgtgtggcacaaggactgcttcacctgctccaattgtaagcaggtgatcgggacagggtcctttttccccaagggcgaggacttctactgtgtgacttgccacgaaacaaagtttgcaaaacattgcgtgaagtgtaacaaggccattacaagcggcggtattacataccaagatcagccttggcatgccgactgctttgtatgtgtgacttgcagtaagaaactcgccggacagaggttcaccgccgttgaagaccaatattactgtgtagattgctataaaaacttcgtagcaaaaaaatgtgcaggatgcaagaatcctatcactggctttggtaagggctctagtgtagtggcatacgaaggccagagttggcatgattattgcttccactgtaagaagtgctcagtgaatctcgcaaacaagcgctttgtgtttcatcaggagcaggtgtactgtcctgattgcgcgaagaagttgtag

SEQ ID NO: 117426 - DNA, 972 bp, Artificial Sequence
  Description of Artificial Sequence: Synthetic coding sequence
atggcagaaaagttcgattgtcattattgcagggaccccctccagggcaaaaagtacgtgcagaaggacggccaccactgctgtctgaagtgcttcgacaaattttgtgccaatacatgcgtggaatgccgaaaaccaatcggggccgatagcaaggaggtccactacaagaataggttctggcacgacacctgtttccgctgcgcaaaatgtctacacccccttgccaacgagactttcgtggcaaaagacaacaagatcttgtgtaacaagtgcacaacacgcgaggacagccccaagtgcaagggatgcttcaaggctatcgtggcaggcgatcagaacgttgaatataagggaacagtgtggcataaggactgcttcacctgtagcaattgtaaacaggtaataggaactggtagttttttccccaaaggtgaggatttttattgtgttacatgccatgaaacgaagtttgccaaacactgtgttaaatgtaacaaagcaatcacatcagggggaatcacctaccaagatcagccatggcacgcagactgttttgtatgcgtgacctgtagcaaaaaactggccggtcaacggttcaccgcagtggaggaccagtactactgtgtagattgctacaagaacttcgtggctaagaagtgtgctggatgtaaaaacccgatcaccggaaaacgaacagtgtccagggtgtcccacccagtttcaaaagccaggaagcctccagtatgtcatggcaaaagactgccgctcacgctgttcccttcagccaatctgcgtggaaggcatcccgggggggaaagaacatgcccctcgtgggtcgtagttctgtaccgcaagaataggtctttggcagctccacggggccctgggctcgtgaaagcaccagtgtggtggcctatgaaagacaatcctgggacaactacagcctctaccgccaaaaatgccccctag

SEQ ID NO: 117427 - DNA, 615 bp, Artificial Sequence
  Description of Artificial Sequence: Synthetic coding sequence
atggctgagaaatttgactgccattactgcagagatccccttcagggcaagaagtacgtgcaaaaggacgggcaccattgttgcctgaagtgcttcgataagttctgcgccaacacatgcgtggaatgccggaagccaatcggcgccgatagtaaggaagtccactacaagaatagattctggcacgatacctgctttcggtgcgctaagtgcctgcacccactggccaatgagacctttgtggccaaagacaataagattctgtgcaacaaatgtaccacgagagaggattcgcccaagtgtaagggctgtttcaaagctatagtagcgggggaccagaatgtagaatataagggcacggtctggcacaaggactgtttcacttgctccaactgcaagcaggtcatcggcaccggctctttttttccaaaaggggaggatttctattgtgtgacttgccacgagaccaaattcgcaaagcactgtgttaagtgcaataaggccatcaccagcggcggcataacgtatcaggaccagccgtggcatgctgactgcttcgtctgcgtcacttgcagtaaaaagttagcgggccagcgatttacagccgtagaatag

SEQ ID NO: 117428 - DNA, 624 bp, Artificial Sequence
  Description of Artificial Sequence: Synthetic coding sequence
atggccgagaagtttgattgccactactgtcgggatcctctgcaagggaagaaatacgtgcaaaaggacgggcatcactgctgcctgaaatgtttcgacaagttttgcgccaatacttgcgtcgaatgccggaaacctattggagctgatagtaaggaggtgcactacaagaaccggttttggcacgacacctgctttaggtgcgccaagtgtctgcaccctcttgctaacgaaacctttgtggcaaaagataacaaaattctgtgtaacaaatgtactacccgggaagactcaccaaaatgtaagggatgctttaaggctatagtggcaggggatcaaaatgtcgaatacaagggaacggtctggcataaggattgcttcacatgtagtaattgtaagcaggtaattggtacgggttcattcttccctaagggagaggacttttactgtgtgacctgtcatgaaactaagttcgctaagcattgtgtaaagtgtaacaaggcgattaccagcgggggtatcacctatcaggatcaaccatggcacgctgactgtttcgtctgcgtgacctgctctaagaaactcgccggtcagcggtttacagccgttgaggatcaatactag

SEQ ID NO: 117429 - DNA, 426 bp, Artificial Sequence
  Description of Artificial Sequence: Synthetic coding sequence
atggcagaaaagtttgactgtcattactgtagagaccccctccagggtaaaaagtacgtgcaaaaagacggacaccactgttgtctgaaatgttttgataaattttgcgcaaatacttgcgtggagtgccgcaagcctatcggagctgactctaaagaggtgcattacaagaacagattttggcacgacacatgtttccgttgcgccaagtgcctgcaccctcttgccaatgagacgttcgtggccaaggacaataaaatattgtgtaataagtgtactacccgtgaggactcccccaaatgcaaggggtgcttcaaggccatcgtagccggtgaccaaaacgtcgagtacaagggaacggtttggcacaaggactgtttcacatgctcaaactgtaaacaggtgataggaaccggatccttctag

SEQ ID NO: 117430 - DNA, 624 bp, Artificial Sequence
  Description of Artificial Sequence: Synthetic coding sequence
atggctgagaagtttgattgtcattactgtcgtgatcccctacaggggaaaaaatatgtacaaaaagacggacaccactgttgcctcaagtgcttcgataagttttgcgccaacacctgtgtcgaatgccgcaagccaattggggctgactctaaagaggtccattacaaaaatcgcttctggcacgacacctgcttcaggtgtgcaaagtgcttgcatccccttgccaatgagactttcgtggccaaagataacaagatcctttgcaataagtgcacaacaagagaagattcccctaagtgtaaaggatgtttcaaggctatcgtggcgggagatcagaacgtggagtacaaaggaacggtctggcataaggactgtttcacctgttcaaactgtaagcaggtaattggtacaggctcttttttccccaaaggagaggacttctactgtgttacgtgccatgaaaccaaatttgcaaaacattgcgtaaagtgtaataaagccatcacttcaggcggcatcacctatcaggatcagccctggcacgctgattgttttgtatgcgtgacctgcagtaagaaactggctggtcaacggtttacagccgtcgaagatcagtactag

SEQ ID NO: 117431 - DNA, 963 bp, Artificial Sequence
  Description of Artificial Sequence: Synthetic coding sequence
atgagccattttatactccggcaccttggctcgtgcttccagccctaccctgcctttgctgagtatattctgagcgcaacccaccccgcgtccggcccatcttcctacaaagtgggaactatggccgagaagtttgattgtcattattgcagagatcccctgcagggcaaaaaatacgtgcagaaagacggccatcattgttgcctgaaatgctttgataagttctgtgccaacacgtgcgtggagtgtagaaaaccgatcggcgctgatagcaaggaagtgcactataaaaaccgcttttggcatgacacctgttttcggtgcgcaaagtgcctgcatccgttggctaacgaaacgttcgtggccaaagataacaagattctgtgcaataaatgtacaacacgggaagacagcccgaaatgcaaaggatgcttcaaagccatagtcgccggagaccagaatgtcgaatacaaagggactgtatggcacaaggattgttttacatgcagcaattgcaagcaagtaatcggcaccggctccttctttccaaagggcgaggatttttactgtgtcacctgccacgaaaccaagtttgctaagcattgcgtcaagtgtaataaggccataacatccggaggtatcacctaccaggatcagccgtggcacgctgactgtttcgtgtgcgtgacctgttctaaaaagctcgccggacagcgtttcaccgctgttgaagaccaatattactgcgtagattgttacaagaactttgtagcaaagaagtgtgccggctgtaaaaaccccattaccgggtttgggaaaggatcatcagttgttgcctacgagggtcagtcttggcacgattactgcttccactgcaaaaagtgttctgtcaatctggccaacaagcgcttcgtgtttcatcaggagcaagtgtattgccccgattgcgccaaaaagctgtag

SEQ ID NO: 117432 - DNA, 618 bp, Artificial Sequence
  Description of Artificial Sequence: Synthetic coding sequence
atggcagaaaaattcgactgtcactactgccgggatccactacaaggcaaaaaatatgtgcagaaggacggtcatcattgttgtctgaagtgcttcgataagttctgtgccaatacttgtgtggaatgtcggaaacctataggagccgacagcaaggaggtgcattacaagaaccgcttttggcacgacacctgtttcaggtgtgccaagtgtctgcacccactcgctaatgaaaccttcgttgccaaggataataagatcctgtgtaacaagtgcaccactagggaagattctccaaaatgtaaaggctgcttcaaggcgatagtggctggagatcagaatgtcgagtacaaaggtactgtctggcacaaggattgctttacctgtagcaactgcaagcaggtgattggaacaggttcattttttccaaagggggaggacttctactgtgtgacctgccatgagacaaagttcgccaagcattgcgttaagtgcaataaggcgatcacctccgggggaatcacttatcaggaccaaccctggcatgccgactgtttcgtatgcgtgacctgcagcaaaaagctggctggacagagattcacagccgtggaggactag

SEQ ID NO: 117433 - DNA, 468 bp, Artificial Sequence
  Description of Artificial Sequence: Synthetic coding sequence
atggctgaaaaatttgactgtcactattgcagagatcctctgcaggggaaaaagtacgtgcagaaggacggccatcattgttgcctgaaatgttttgacaagttttgcgccaatacctgtgtggaatgcagaaagcccataggagcagactcgaaggaggtgcattataagaacaggttttggcatgatacatgtttccggtgcgctaagtgcctccaccccctcgcaaatgagaccttcgtcgccaaggataacaagattttgtgtaataagtgtacaacccgggaggattcccccaagtgcaagggatgttttaaggccatcgttgctggcgatcaaaacgttgaatataaaggaaccgtctggcataaagactgttttacgtgtagcaactgtaaacaggtcatcggaacaggctcctttttccctaagggcgaagatttttattgcgtaacttgtcatgagtag

SEQ ID NO: 117434 - DNA, 843 bp, Artificial Sequence
  Description of Artificial Sequence: Synthetic coding sequence
atggccgagaaatttgattgccactattgccgcgacccacttcaggggaaaaaatatgtgcagaaagacgggcaccactgctgcttgaagtgcttcgataaattttgtgccaatacttgcgttgagtgccgcaagcccattggagcagattcaaaagaagtgcactacaaaaatagattttggcatgacacatgttttcgctgcgccaagtgtctacaccctctcgccaacgagacctttgtggccaaagacaacaagattttgtgcaataaatgtactacacgagaagacagccccaaatgtaaaggatgctttaaagctattgtggcaggggatcagaatgtggagtacaaaggcacagtgtggcacaaggactgttttacctgtagcaactgcaagcaggtgatcggtaccgggtcattctttccgaagggagaggacttctattgtgttacatgccatgaaaccaagttcgctaagcattgcgttaagtgtaacaaggcgatcacctccggggggataacctaccaggaccagccctggcatgcagactgtttcgtctgtgtgacatgctctaaaaagctggccggacagcggttcacagctgttgaagaccaatattactgtgttgactgctataaaaattttgttgccaaaaaatgcgccggctgcaagaaccccataacgggcttcggtaaaggaagctcagtggtagcgtacgagggtcagagctggcacgactattgctttcactgtaagaagtgttctgttaacctggccaacaagcgttttgtattccatcaggaacaagtctactgccctgactgcgctaaaaaactatag

SEQ ID NO: 117435 - DNA, 783 bp, Artificial Sequence
  Description of Artificial Sequence: Synthetic coding sequence
atggccgagaagtttgattgctgcctcaaatgtttcgacaaattttgtgcgaatacttgcgtcgagtgccgaaaaccaatcggagctgatagtaaagaggttcattacaagaaccggttctggcatgatacatgttttcgctgcgcgaaatgtcttcaccctttagcaaacgaaactttcgtggcgaaggataacaagattctctgtaacaagtgtactaccagggaagactcaccaaaatgtaaaggctgcttcaaggcaattgtagccggagaccagaacgtggagtataagggcacagtgtggcacaaagattgtttcacgtgcagcaactgcaagcaagttatcggaacaggcagtttttttcccaagggagaggacttttactgcgtgacatgtcatgaaacgaagtttgctaaacattgcgtcaagtgcaacaaagcgatcaccagtgggggaataacttatcaggaccagccatggcatgcggactgtttcgtttgtgtcacatgtagtaagaagttagccggccagcggtttacagccgtcgaagaccagtattattgcgtcgattgctataagaactttgtcgctaagaaatgcgcaggctgtaaaaaccctataaccggcttcggaaaagggtcaagcgtcgtcgcttatgagggtcagagctggcatgactattgcttccactgcaaaaaatgttccgtcaatctggcaaacaagcggttcgtgtttcatcaagaacaagtgtattgcccagattgcgccaagaaactgtag

SEQ ID NO: 117436 - DNA, 930 bp, Artificial Sequence
  Description of Artificial Sequence: Synthetic coding sequence
atgacattttacgtcgccagcctggcgcttgagctcatctggatgttaagctcccccgcagggccatcaagctacaaagtcggcacgatggcagaaaagttcgattgccattattgtagagacccactccaggggaagaaatatgttcagaaggatggccatcactgctgcctgaagtgtttcgataaattttgcgccaacacctgcgttgagtgtagaaaacctattggcgcagattctaaggaggtgcactacaaaaacaggttctggcacgatacttgcttcagatgtgcgaagtgtctccaccccctggccaacgaaaccttcgttgccaaagataataagatcttgtgtaacaagtgcaccacacgtgaagacagcccaaaatgcaaaggctgctttaaggctatcgtagccggggatcaaaatgttgaatataaagggacagtttggcacaaagactgcttcacctgctctaattgtaaacaggtgattgggaccggcagtttcttccccaagggtgaggacttttattgcgtgacttgccacgagacaaaatttgcgaagcattgcgttaagtgcaataaagctataacctccggcggtattacataccaggatcagccctggcatgcagactgttttgtatgcgtaacttgctcaaaaaaactggctggacagagattcacagcagtcgaagaccagtactattgcgttgactgttacaagaattttgtcgcaaagaagtgtgccggttgcaagaaccccatcacaggattcggtaagggcagcagtgtggtcgcctacgagggacagagctggcatgactactgttttcactgcaagaaatgtagcgtcaatctggcgaataaaagatttgtgtttcatcaagaacaagtgtattgtcccgattgcgccaagaagctgtag

SEQ ID NO: 117437 - DNA, 828 bp, Artificial Sequence
  Description of Artificial Sequence: Synthetic coding sequence
atggcctctcatagacatagcggtccatcttcgtataaggtgggtacaatggctgaaaagttcgactgtcactactgtcgggatccgttgcaaggcaaaaagtacgtgcagaaagatggccatcattgctgtctcaaatgctttgacaagttctgcgcgaacacgtgtgtggaatgccgcaaaccgatcggtgccgactctaaggaggtgcattacaagaatcggttctggcacgacacatgctttaggtgcgctaagtgcacaacgagggaggatagcccaaagtgtaagggatgcttcaaggccatcgtcgccggggaccagaacgttgaatacaagggcacagtgtggcacaaagactgtttcacctgctccaactgcaaacaagtcatcggcacaggttccttcttccctaaaggagaagacttctattgcgtgacttgtcacgagactaaattcgccaagcattgcgttaagtgtaataaagctattacttccggaggcattacctatcaggaccagccttggcacgccgactgttttgtgtgcgtgacatgctcaaagaaattggccgggcagcgattcaccgccgtagaggatcaatactattgcgtggattgttacaagaattttgtggccaaaaaatgtgctggctgcaaaaacccgatcactgggtttggcaaaggatcatctgtggtggcttatgaaggccagtcttggcacgactactgtttccactgcaagaagtgttcggttaatctggccaacaaacgctttgttttccatcaagaacaagtctattgcccagattgtgctaagaagttgtag

SEQ ID NO: 117438 - DNA, 843 bp, Artificial Sequence
  Description of Artificial Sequence: Synthetic coding sequence
atggccgaaaagtttgattgccattactgtcgggacccactacaaggcaaaaaatatgtgcaaaaggacggccaccattgctgcttgaagtgtttcgacaagttttgcgcaaatacctgtgttgaatgtcgaaaacccatcggggcggactccaaggaagtacattacaaaaaccgcttctggcatgacacttgttttcgctgtgccaaatgcctccaccccctcgctaacgagacgttcgtggccaaagataacaaaatcctgtgtaacaagtgtactactcgagaagactcgcccaagtgcaaaggctgctttaaagctatcgtggccggtgatcaaaacgtcgagtataaaggtacggtgtggcacaaggactgcttcacctgtagtaattgtaagcaggtgattggcactggcagcttcttccccaagggagaggacttctactgtgtgacatgccacgagaccaaattcgctaaacactgtgtcaaatgcaacaaagccatcaccagtggcggaattacttaccaagaccagccatggcacgcagattgtttcgtgtgtgtgacctgtagtaagaaattagcagggcagaggtttacggccgttgaagaccagtattactgcgtggattgctacaagaattttgtggctaaaaagtgtgccgggtgtaaaaatcctataacagggttcgggaagggatcgtccgtggttgcatacgaaggccagtcctggcacgattactgctttcactgcaaaaaatgcagcgtaaacttagccaacaaacgtttcgtgttccaccaggagcaggtgtattgccctgactgtgcgaagaaattgtag

SEQ ID NO: 117439 - DNA, 840 bp, Artificial Sequence
  Description of Artificial Sequence: Synthetic coding sequence
atgacagagcggtttgactgtcatcattgcaatgagtccctcttcggaaagaaatacatcctcagggaagaaagtccctattgcgttgtttgtttcgaaaccctgttcgccaatacctgcgaggagtgtggaaagcccatcggttgtgactgcaaagatctgagctacaaagaccgtcactggcatgaggcgtgcttccattgctctcagtgtcgcaacagcttggtggataaaccattcgctgccaaggaggatcagctcctgtgtaccgattgctacagtaacgagtatagctctaaatgccaggagtgtaaaaagacaataatgcccgggactcgaaagatggagtataagggctcgagctggcacgagacctgctttatctgccaccgatgccaacagcccataggtaccaagtcattcatccctaaggacaaccaaaatttctgcgtgccgtgttatgaaaagcaacacgctatgcagtgcgtccagtgtaagaagccaattaccaccggtggagtgacttacagagaacagccctggcacaaagaatgtttcgtgtgtacggcttgccgtaagcagttgtccggccagcgctttaccgctcgagacgatttcgcctattgcctcaattgtttttgtgacctgtacgcaaagaagtgtgcgggctgcaccaatccaatctccggtctgggtggaacaaagtacatttccttcgaagaacgtcagtggcacaatgattgcttcaattgcaagaaatgctccctgagcttggtgggcagggggttcctgaccgaacgcgatgacattctgtgccccgactgtgggaaagacatctag

SEQ ID NO: 117440 - DNA, 456 bp, Artificial Sequence
  Description of Artificial Sequence: Synthetic coding sequence
atgacagagagattcgattgtcaccattgcaacgagagcttgttcggaaagaagtacatacttcgtgaggaatctccatactgcgtcgtttgttttgagactcttttcgccaatacctgcgaagagtgcgggaagccgataggatgtgattgtaaggtgcccgcaagatggagtactcgcgctgcagccggaatgcggccagcatctagcgctaccgctgccagttcacagttagagcccagagtctccagccccaaaactatccgaatcagtgtgtgtccagccatgagaaataacatgccttgttccgcatttagcgctaagtccccttcacctcgagagggatccctcaccggcagtagccccggtacccgctcagcgtcatgtgctccccctgccggttcttcgtgcctagggtctgcctcgcagctggcaatgacactgccaacagcctag

SEQ ID NO: 117441 - DNA, 1170 bp, Artificial Sequence
  Description of Artificial Sequence: Synthetic coding sequence
atgactcgaagaggcttctcgagggccggagcagcccagcgtagcacacggccagctgcagaaccccaaccacctgccgcacgcgcactgcagccaaggcccggcgtgcccggtcccctcagatgcagagagtatctacagccacccgccccacggagggaggctgaaggactatctcaccaaggatctgaagtcggcgccgagagcggagcaaggcccaaggagcggggcgcagagcccgagctggggaggctttggctacgcactgttagctcctggagactaggttggcactttgacttcggagtagccgagaagcccggagtaaagatgacagagcgctttgattgtcatcactgtaacgaaagcctcttcggtaaaaaatacatcctcagggaagaatcaccatactgcgtcgtctgttttgaaacacttttcgctaatacctgcgaagagtgtggaaagccaattggctgtgactgtaaagacttaagctacaaggaccgccattggcacgaggcgtgcttccattgttctcagtgcaggaatagtctggttgataaaccgttcgcagccaaagaggatcagcttttgtgcactgactgctactctaatgaatacagttcaaaatgccaggagtgcaagaagacaatcatgcccggaacaaggaaaatggaatacaagggatcttcctggcacgaaacctgcttcatctgccaccggtgtcagcaacccatcggtacaaaatccttcattcccaaggacaaccagaacttctgcgtgccatgctacgagaagcaacacgcaatgcagtgtgttcaatgtaagaagccgatcaccacagggggcgtcacttacagagaacagccatggcacaaggaatgcttcgtgtgtaccgcttgcaggaagcagctgagcggacaaaggttcaccgccagagatgatttcgcttactgtctcaactgtttttgcgacctgtacgctaaaaaatgcgccggatgtaccaaccctatctctgggttgggtgggaccaaatatattagttttgaggaacgtcagtggcacaacgactgctttaattgcaagaagtgcagtctgagtctggtgggacggggatttctgacagaacgtgatgacattctttgtcctgattgcggaaaggatatatag

SEQ ID NO: 117442 - DNA, 840 bp, Artificial Sequence
  Description of Artificial Sequence: Synthetic coding sequence
atgacagagagatttgattgccaccactgtaatgagtcactgttcggtaaaaagtacatactgcgggaggagagtccatactgcgtggtctgttttgagacgcttttcgctaatacgtgtgaagaatgcggtaagccgatcggctgcgactgtaaagaccttagctacaaggaccgtcactggcacgaggcatgtttccactgctcacagtgtagaaacagtttggtggataaaccattcgcagcgaaggaggatcagttgctgtgtactgactgctacagcaacgagtacagctctaagtgtcaagaatgcaagaagactattatgccgggcacaaggaaaatggaatacaagggttcttcatggcatgagacatgtttcatatgtcacagatgtcagcagcccattggaaccaaaagtttcatcccaaaggataatcaaaatttctgcgtgccttgttacgagaaacagcacgcaatgcagtgcgtgcaatgtaagaagcctattacgacagggggcgttacatatcgagagcagccctggcataaggagtgctttgtctgtaccgcgtgcagaaagcaattgagcggccagaggttcactgcccgggatgacttcgcttactgtctaaattgtttctgtgacctctacgccaagaagtgtgccggatgcaccaaccccatatccggtctagggggcacgaaatacatctcattcgaggagcggcaatggcacaacgattgcttcaactgtaaaaaatgttcgctgagtttggtggggaggggtttcctgactgagagggatgatatcttgtgtccagactgtggaaaagatatctag

SEQ ID NO: 117443 - DNA, 840 bp, Artificial Sequence
  Description of Artificial Sequence: Synthetic coding sequence
atgactgaacggttcgactgccatcactgtaacgagtctctgtttggaaaaaaatacatactgagagaggagagtccctattgcgtggtatgcttcgagaccctattcgccaatacttgcgaagagtgcggaaaacctatcggatgtgactgtaaggatcttagctacaaggatagacactggcacgaggcctgcttccactgttcccaatgccggaattctctggtagataaacccttcgccgctaaagaggatcagctcctttgcacggactgttactcaaatgaatatagctctaaatgtcaggaatgtaagaagacgatcatgcccgggactcggaagatggagtataaggggtcatcttggcatgagacatgctttatctgtcatcgatgtcagcaacccatcggcaccaagtcatttatccccaaggacaatcagaatttttgcgtgccatgttatgaaaaacaacacgccatgcagtgcgttcaatgtaagaaacctattacgacaggcggggtgacctacagagagcagccctggcataaagaatgcttcgtgtgcactgcatgtaggaagcaattatcagggcaaaggttcacggcacgcgacgacttcgcctattgcctcaactgtttctgcgacttgtacgcgaaaaagtgtgccggatgcactaatccgatttctgggctgggggggacaaaatatatcagcttcgaggaacgacaatggcataacgattgctttaactgcaagaagtgctcactgagcctggtaggccggggattcctgactgagcgcgatgacatcctatgccccgactgtgggaaggatatctag

SEQ ID NO: 117444 - DNA, 840 bp, Artificial Sequence
  Description of Artificial Sequence: Synthetic coding sequence
atgactgaaagatttgactgccaccactgtaacgaatccttattcggtaagaaatatattttacgcgaagagtcaccatattgtgtggtctgcttcgaaacactgttcgccaacacttgcgaggaatgtgggaaacctattggctgcgattgtaaagacctctcctataaggacagacactggcacgaggcttgcttccactgttcccaatgcagaaattccctggttgataagccatttgcagccaaagaggatcagctgctgtgtaccgactgttattccaatgaatactcctcaaaatgtcaagaatgtaagaagactatcatgcccggtaccaggaagatggaatacaaaggttcctcgtggcacgagacctgcttcatctgtcatcgatgccaacaacccataggaactaaaagctttatcccaaaagataatcagaacttttgcgtaccttgctatgaaaagcaacatgcaatgcagtgcgtgcaatgcaaaaaacctattaccaccggtggcgtcacataccgagagcagccatggcacaaggaatgcttcgtctgtactgcttgtaggaagcaactctcaggacagaggttcaccgcccgagacgacttcgcctattgcctcaattgtttttgcgatctttatgcaaaaaagtgtgccggctgcactaacccaatttccggcctgggcggaactaagtacatctcatttgaggagaggcagtggcacaacgattgcttcaattgcaaaaagtgtagcctaagtctggtgggacgcggctttcttacagagcgggatgacatcctttgccctgactgtgggaaagacatatag

SEQ ID NO: 117445 - DNA, 840 bp, Artificial Sequence
  Description of Artificial Sequence: Synthetic coding sequence
atgactgagcggtttgattgccaccactgcaacgaatcactgttcggaaaaaagtatatcttacgcgaggagtccccttactgcgtcgtgtgttttgaaaccttatttgcgaatacatgcgaggagtgtggtaagcccattggttgtgactgcaaagatcttagttataaggaccgccactggcacgaagcgtgcttccattgctcacaatgtcggaattcactggtggacaagcccttcgcagccaaagaggatcagctactctgcaccgactgctattctaacgaatatagttcaaagtgccaggagtgtaagaaaaccatcatgcctgggaccaggaagatggaatacaaaggctcttcctggcatgagacatgttttatttgtcacaggtgtcagcagccaattggcaccaagtcatttataccaaaagataaccagaatttctgcgtgccgtgctatgaaaaacagcacgcgatgcagtgtgttcagtgcaagaaacctattacaactgggggagtcacatatcgagagcagccttggcataaggagtgcttcgtgtgtaccgcctgcaggaaacagctgtccgggcagcgatttactgcgcgggacgactttgcctattgcctgaattgcttctgtgacctctacgccaagaagtgtgcaggatgcaccaaccctatctccggcctggggggcaccaaatatatcagtttcgaggagagacagtggcacaacgactgtttcaactgcaagaaatgctccctttcactcgtaggccgtgggtttttgaccgagcgggacgatattctgtgcccagactgcggtaaggatatctag

SEQ ID NO: 117446 - DNA, 840 bp, Artificial Sequence
  Description of Artificial Sequence: Synthetic coding sequence
atgaccgagcggtttgactgccatcactgcaatgagtctctattcggtaaaaagtacatcctgagggaagaatcgccctactgcgtggtgtgttttgagacccttttcgcgaatacctgcgaagagtgtgggaaacctatcggctgcgattgcaaggacctctcatacaaggaccgacactggcatgaggcctgctttcattgtagtcagtgtaggaattctctggtggataaaccgttcgccgcaaaagaagaccagctgttgtgtacagattgctattctaatgagtatagttctaaatgtcaggagtgcaaaaagacaattatgcctggcacccgaaagatggaatacaaaggaagctcctggcacgagacgtgcttcatttgccaccgctgtcagcagccaattggcactaagtctttcatccccaaagataaccaaaatttctgtgtcccatgttacgagaaacaacacgccatgcaatgcgtccagtgtaagaagcctatcacaaccggcggggtaacataccgagaacagccatggcacaaagaatgcttcgtgtgtacagcctgtagaaaacagctttctggccaacggttcacagctcgcgacgactttgcctactgtctcaattgcttttgcgacttatatgcgaaaaaatgcgccggctgcaccaatcctatcagcggactagggggcactaagtacatctcatttgaagaaagacagtggcataacgactgttttaactgcaagaaatgttccttaagcctggttgggcgcgggttcttgaccgaacgggatgacattctgtgtccagactgcggaaaggacatctag

SEQ ID NO: 117447 - DNA, 840 bp, Artificial Sequence
  Description of Artificial Sequence: Synthetic coding sequence
atgactgagaggttcgactgccaccactgcaacgaatcactgtttggaaaaaaatatattcttcgagaagagagcccttactgcgtcgtgtgcttcgagacgttgtttgccaacacctgcgaggaatgtggcaagccaattggctgcgactgcaaagacctgagctacaaagacagacactggcatgaggcatgttttcattgttcccaatgcagaaattccctagtggataaaccctttgctgccaaagaggatcaattattatgtacggactgctatagcaacgagtactcatcgaagtgccaggagtgtaagaaaactatcatgcccggaactcgcaaaatggaatataagggttcctcatggcacgaaacatgttttatatgtcacaggtgccagcaaccgattggtacaaagtcgtttattcctaaggacaatcaaaatttctgtgtaccttgctatgaaaagcagcacgctatgcagtgcgttcagtgcaagaaacctatcacaaccgggggcgtgacctatagagagcagccgtggcacaaagaatgtttcgtgtgcacggcctgccggaagcagctgtctggccaaaggtttactgctagggacgactttgcatactgtctcaactgcttttgtgatctgtacgccaaaaagtgcgccggctgcacaaacccaatcagcggattgggtggtactaaatatatcagcttcgaagaacgccaatggcataacgactgctttaactgcaaaaaatgctcactgagtctggtcggccggggcttcctcaccgagcgggatgatatactctgccctgattgcggaaaggatatctag

SEQ ID NO: 117448 - DNA, 60 bp, Artificial Sequence
  Description of Artificial Sequence: Synthetic coding sequence
atgaccgagaggtttgactgtcatcattgcaatgagtcattgttcggaaaaaagtattag

SEQ ID NO: 117449 - DNA, 435 bp, Artificial Sequence
  Description of Artificial Sequence: Synthetic coding sequence
atgacccggaggggtttctcaagggcgggtgcagcccagcggtctacaaggcctgctgccgagcctcagcctccggccgccagagccctgcagccgcgacctggggtccccgggcctctgagatgtcgtgagtacttacagccacccgctccccgtcgcgaagctgaaggtttgtctcatcaggggagtgaagtcggcgccgaaagcggcgcgcgcccaaaagaacgcggagccgagcccgagctgggcagactctggttacggaccgttagctcttggcgcttgggttggcactttgacttcggaaccgagtcccggttcgtcgcccaagccggcgttcagtggcatgatctatccagcttacaggcactgccgttaggctctagacatagtcccgcccctgcctcgcaggtggccggaaccaccggatgctag

SEQ ID NO: 117450 - DNA, 843 bp, Artificial Sequence
  Description of Artificial Sequence: Synthetic coding sequence
atgtcagaatcttttgattgcgcgaaatgcaacgaatcactttacggcagaaaatatatacaaaccgatagcggcccatactgtgtcccatgctatgataatacatttgcaaacacttgtgcggaatgtcagcagttgatcggccatgactctcgagaacttttttacgaagatcgccatttccacgaaggctgcttccggtgctgcaggtgccagcgttccctagcagatgagccttttacatgccaggactccgaactgttatgtaatgactgttactgtagtgctttttctagtcagtgctccgcctgcggagagacagtcatgcccggctccagaaagctcgaatacggagggcagacatggcatgagcactgtttcctgtgctccggctgtgaacagcctctgggatctcggtcattcgttccggacaagggggcccactactgtgtgccctgctacgagaataaatttgcacccaggtgtgcaagatgctctaagacccttacccaggggggcgtgacataccgcgatcagccctggcacagagagtgtctcgtgtgcaccggctgtcagaccccactggccggacagcagtttacgtccagagatgaggacccctactgcgttgcctgtttcggcgagctgtttgcgcctaagtgcagctcctgtaagcggcctattgtgggactcggaggcgggaagtatgtcagttttgaagatcgccattggcaccacaattgtttctcctgtgctagatgttcaacatcattagtggggcagggtttcgttccagacggcgatcaggttctgtgccagggatgcagtcaggcgggcccgtag

SEQ ID NO: 117451 - DNA, 855 bp, Artificial Sequence
  Description of Artificial Sequence: Synthetic coding sequence
atgacaacagctcacttttactgccagtattgtaccgcaagcctcttgggtaagaaatacgtgctcaaggacgactccccatattgcgttacctgctacgatcgggtgttttcaaactactgcgaggaatgcaaaaagccgattgaatccgactccaaggacctatgctataaggaccggcactggcacgaggggtgctttaaatgcaccaagtgtaatcattcactcgtagaaaagccttttgctgccaaggatgaacgcctactatgcacagaatgttattccaacgaatgctcgtctaagtgtttccactgtaaacggaccatcatgccaggaagccgcaaaatggagttcaagggaaattattggcacgaaacctgttttgtgtgtgagaactgtagacagcctataggcaccaaaccgctgatcagtaaagaaagtggaaattattgcgtcccatgctttgagaaagagtttgcccactattgcaacttttgcaaaaaagttatcaccagtggcggcattacgttttgcgaccagttgtggcataaggaatgcttcctatgtagtggatgtcgcaaggacttgtgcgaggaacagttcatgagccgggacgactatccattctgcgttgactgttataatcatttatacgctaacaagtgcgtcgcctgctctaagcctatttccggactcacaggcgccaagttcatttgttttcaggactctcagtggcatagtgagtgttttaactgtggcaagtgcagcgttagcctggttggaaagggctttcttacccagaacaaagagatattttgtcaaaagtgtggaagcggcatggataccgatatatag

SEQ ID NO: 117452 - DNA, 633 bp, Artificial Sequence
  Description of Artificial Sequence: Synthetic coding sequence
atgacgacggctcatttctactgccagtactgcactgcctccctcctggggaaaaagtacgtcctgaaagatgattccccgtattgcgttacctgctacgatcgggtgttttccaactactgcgaggaatgcaaaaagcctattgagagtgacagcaaggacctttgttataaagaccggcactggcacgagggttgcttcaagtgcaccaaatgcaaccactccctggtggagaagcctttcgccgcaaaggatgaacggctcctttgcacagagtgctattccaatgagtgcagtagcaagtgcttccactgcaagaggaccatcatgccaggcagtcgaaaaatggaatttaaaggcaattactggcacgagacttgctttgtatgcgagaactgcaggcagccaattgggaccaagcctctgatttctaaggagtcaggcaactactgtgttccttgttttgagaaggagtttgcgcactactgcaatttttgcaagaaggtgatcacctctgggggcattacattctgcgaccaactatggcataaggagtgcttcctgtgttccggctgtaggaaggatctgtgtgaggagcaatttatgagccgcgatgattaccccttctgctag

SEQ ID NO: 117453 - DNA, 855 bp, Artificial Sequence
  Description of Artificial Sequence: Synthetic coding sequence
atgaccactgctcacttctactgccagtattgtaccgcctctctgcttgggaagaaatatgtgctcaaagacgatagcccatactgtgtgacctgctatgaccgcgtattttctaattattgcgaggagtgtaaaaagcccatcgaaagcgactcaaaggatctgtgttacaaggataggcactggcatgagggctgctttaagtgcaccaagtgtaaccattcccttgttgagaagccctttgctgccaaggacgaaagacttctttgtactgaatgttatagtaatgaatgctcttccaaatgctttcactgcaaaaggaccataatgccagggtctaggaaaatggagttcaagggaaactactggcatgaaacttgctttgtgtgcgagaactgccggcaaccaattggaacgaaacctctgatttctaaagagtcagggaactactgcgtgccctgttttgaaaaggagtttgcacactattgtaacttttgtaaaaaggtcatcacctccggaggcataacattctgcgatcagctatggcacaaggagtgcttcctttgcagcgggtgccggaaggacctctgtgaagaacaattcatgtcacgggacgattatccattctgtgttgactgctataatcacctgtacgcaaacaagtgtgtcgcctgttcaaagcctattagcggcctgaccggcgccaagtttatttgtttccaggatagccagtggcactcagagtgttttaactgcggtaagtgctccgtcagtctagtcggcaaaggattcttgacccaaaacaaagaaattttctgtcagaaatgcggaagcggaatggataccgacatctag

SEQ ID NO: 117454 - DNA, 1314 bp, Artificial Sequence
  Description of Artificial Sequence: Synthetic coding sequence
atgggccgaagaatgcgcggtgccgctgcaaccgcgggcttatggcttctggcgctgggatcccttctggccctatggggtggtttgctgccacctcgaactgagctgccagcttccagacccccggaagatcggctccctaggcggccggctcgatcgggcggaccagcccctgcccctagatttccattaccaccacccctagcttgggatgcccgcggagggtctctcaaaacctttcgcgcgttgctgactctcgccgcgggcgccgatggaccccccaggcagtctagaagcgaaccccggtggcatgtgtccgcacggcagccccggcccgaggaaagtgccgctgtgcacgggggagtgttttggtctcgtggccttgaagagcaagttcccccaggatttagtgaagctcaggccgccgcctggttagaggcggcgagaggcgcgaggatggtggcattagaacgtgggggctgtggcaggagcagcaacaggttagcaaggttcgcggacggcaccagggcctgtgtgaggtatggaatcaacccagagcaaatacagggcgaagctctgtcctactacttagctcgcctcctcggtttgcagcgtcatgtgccaccactggcattggcgagggttgaggcccggggtgcccaatgggcgcaagttcaggaggagctgcgggccgcacattggacagagggatctgtcgtgtctctgacccggtggctgccaaacttaactgatgtcgtggtgcccgcaccttggcggtctgaggatggacgtctgagacccctacgggatgccggcggggagctggcgaatctctcgcaggccgagctggtagatttggtgcagtggactgacctcattctgttcgattatctgacagctaatttcgatcgactggtgtccaacttgttcagtctgcaatgggatcctagggtgatgcagcgtgctacatccaatctacatagaggacccggcggagcactggtgtttctagacaatgaggccggactcgttcacggatatcgtgtggcagggatgtgggataaatacaacgagcctctgcttcagagtgtgtgcgtgtttcgggagcgcaccgccaggcgcgttctggaattacatcgtggacaagacgccgcggctcggctgctgcgcctgtatcgccgccatgagccgagattccctgaactggccgctcttgccgacccacatgcacaactcctgcagaggagattagattttctggccaaacatatcctccattgtaaggcaaaatacgggcgcagaagtggtacttag

SEQ ID NO: 117455 - DNA, 312 bp, Artificial Sequence
  Description of Artificial Sequence: Synthetic coding sequence
atggaacgtcagcaacaacagcagcagcagctgcggaacctgcgggactttctgctagtgtacaatagaatgaccgaattatgcttccagcggtgcgtgccaagccttcatcacagagccctagatgcagaggaagaggcttgcctgcactcatgcgcaggcaagctgatccactccaatcataggctaatggctgcatacgtacagctcatgcctgcattagtgcagcgacgcattgccgactacgaagcggcaagcgccgtgcctggtgtggcagcagaacagcctggcgtatcgccatctgggtcgtag

SEQ ID NO: 117456 - DNA, 312 bp, Artificial Sequence
  Description of Artificial Sequence: Synthetic coding sequence
atggagcgacagcagcagcaacagcagcagttgaggaacctccgcgattttttgttggtgtataatcgtatgaccgagctctgcttccagaggtgtgtgccctctctgcaccaccgcgcattagatgctgaggaggaagcctgccttcattcatgcgcaggaaagttgatacattccaatcacagactgatggccgcttacgtgcaacttatgcccgcacttgtgcagaggcgaattgccgattatgaagccgcttctgctgtccctggagtggcggctgagcagcctggagtgtcaccttcaggcagttag

SEQ ID NO: 117457 - DNA, 312 bp, Artificial Sequence
  Description of Artificial Sequence: Synthetic coding sequence
atggagcgtcagcaacagcagcaacagcagctgcggaatctgagggatttcctgcttgtttacaataggatgactgaactttgcttccaacgctgcgtgcctagtctgcaccaccgcgccctggatgcggaggaagaagcttgtctgcattcatgcgcagggaagctgatacacagcaaccatagacttatggcagcttatgtgcaactgatgcccgcactcgtacagcggagaattgcagattacgaagccgcctcagctgtgcccggagtagctgccgagcagcccggggtgagcccctctggcagctag

SEQ ID NO: 117458 - DNA, 948 bp, Artificial Sequence
  Description of Artificial Sequence: Synthetic coding sequence
atgcacgggcacggagggtacgacagtgacttctcggatgatgagcgatgtggtgagtcctccaagcgaaaaaaacgcaccgtggaagacgatctgttgctgcagaaaccgtttcagaaagaaaagcacgggaaagttgcacataagcaggtcgccgcagaactccttgatcgtgaagaagcccgtaaccggcgattccatcttattgcaatggatgcatatcaacgacacacgaagttcgtgaacgattatattctttactacggcgggaaaaaagaggattttaagaggttgggcgagaatgataagactgacttggatgttattagggagaaccaccgtttcctgtggaacgaggaggatgaaatggatatgacttgggagaaacgtctagctaagaagtactacgacaagctcttcaaggagtattgcatagccgacctaagtaagtataaagaaaacaaatttgggtttcgttggcgagtggagaaggaagttatcagtgggaagggccagtttttctgtggcaacaagtactgcgataagaaggagggacttaaatcatgggaggtcaatttcggatatattgaacacggggagaagagaaatgccctggttaagctccggctgtgccaggagtgtagcattaagctcaacttccatcacagacggaaggaaatcaaatccaagaaacggaaagataagacgaagaaggattgcgaagagagctctcacaagaaatccagactaagcagcgcagaggaggctagcaagaaaaaggataaggggcactccagttccaagaaaagtgaggattcactgctccgcaacagcgacgaagaagaatccgcatccgagtcagagctttggaaagggcctctgcctgaaactgatgaaaagagccaggaggaggaattcgacgaatactttcaggacctcttcctgtag

SEQ ID NO: 117459 - DNA, 948 bp, Artificial Sequence
  Description of Artificial Sequence: Synthetic coding sequence
atgcacggccatggaggctatgacagtgactttagcgatgatgagcgctgtggggaatcctccaaacggaagaagaggactgtggaggacgacctccttttgcaaaaaccgttccaaaaagagaaacatggaaaggtcgctcacaagcaagtggctgctgagctgctggatagggaggaggccagaaataggcgtttccatctgatagcaatggatgcttatcagcggcataccaaattcgtcaatgactacattctgtattatggaggtaaaaaggaggacttcaagagactcggcgaaaacgataagactgacctcgatgtgattagagagaaccatcggttcctatggaacgaagaagatgaaatggatatgacatgggagaaacggcttgctaagaagtattacgataaactgtttaaggaatactgcatcgcagatcttagtaaatataaggagaacaaattcgggttccgctggcgggtcgagaaggaagtgatctctggcaaaggccagttcttctgtggaaacaaatactgtgataaaaaggaggggcttaaatcttgggaggtcaacttcggttacatcgaacacggggagaaaagaaacgctctcgtgaagctcaggctgtgccaggagtgcagcataaaactcaattttcaccacagacgaaaagagattaagagcaagaaacgtaaagacaagaccaagaaagactgcgaggaatcctcacacaaaaagtcacgactttccagcgctgaggaggctagtaagaaaaaagacaagggtcactcgtcaagtaaaaaatccgaagactctctccttcgccggatgctggaagagctgcagatgttcacgtgggagaaaagcgaacgcatggggggcaagcgtctcatcattataatcggggaggaactgtcagcaaacgttacgacattcaagatgtag

SEQ ID NO: 117460 - DNA, 942 bp, Artificial Sequence
  Description of Artificial Sequence: Synthetic coding sequence
atgcacggccatggaggttacgattctgacttcagtgatgatgaaagatgcggcgagtcttcaaagagaaagaaaagaacggtggaggacgacttgctccttcaaaagccatttcagaaagagaagcacggaaaggtcgcacacaagcaggtggcagcagagctgctggatcgggaggaagctaggaacagacggttccacctgattgcgatggatgcctatcagagacacaccaagtttgtgaacgactacattctgtactacggcggcaaaaaggaggactttaagagactgggggaaaatgacaagactgatttggacgttattcgcgagaatcacagattcttgtggaacgaggaggacgagatggatatgacttgggaaaaaaggctcgccaagaaatattacgacaagctctttaaagagtattgtatcgcggacctttctaagtacaaagagaacaaatttggtttccgctggagggttgagaaagaggttatcagcggaaagggccagttcttttgcgggaataagtattgtgataagaaagaaggactgaagagttgggaggttaacttcgggtacatagagcacggtgagaaaagaaacgcgcttgtgaagttgaggctctgtcaagagtgcagcatcaagctcaattttcaccatcggcgtaaggaaattaaaagcaaaaagaggaaggacaagacaaagaaggactgcgaggaatcaagtcacaagaaatcccgtctttcttccgccgaggaggctagcaaaaagaaagacaaaggccactcctcgtcaaaaaaatccgaggatagtctcttgaatggcgtgatgctcttccatcccggctggagtgccgtggctcgatcccaactaacagctgccccggcttctcaagtgcaaaccaataatcactattggcgcggcgtagtgtgctag

SEQ ID NO: 117461 - DNA, 879 bp, Artificial Sequence
  Description of Artificial Sequence: Synthetic coding sequence
atgcatggccacggaggctatgacagcgacttttccgatgacgagcgatgtggtgagagcagtaaaaggaaaaaaagaactgtcgaagatgacttactcctacaaaaacccttccagaaggagaaacacggtaaggttgcccacaagcaggtggctgccgaattactggatcgggaggaggcccggaacaggagatttcacttgatcgcgatggacgcctatcagcggcacaccaagttcgtcaacgactacatactctattatggcggaaaaaaagaagatttcaaacgactgggtgaaaacgacaagacagacctagacgtgatccgggagaaccatagattcctctggaatgaggaggacgaaatggacatgacatgggaaaaaaggctggccaaaaagtactatgacaaactgtttaaagagtattgcatagccgacctttccaagtataaggaaaataagtttggtttcagatggcgggttgagaaggaagtgatctctggaaagggccagttcttctgcgggaataagtactgtgacaaaaaagaagggctgaagagttgggaagtgaactttggctacatcgaacacggcgaaaagagaaatgccctggtaaaactgaggttgtgtcaggaatgtagcataaagttaaattttcaccaccgcaggaaggaaatcaaaagcaagaaacgcaaggataagaccaagaaggattgtgaagagagctcccacaaaaagagcagactctcatctgccgaagaggctagcaagaaaaaagacaaggggcactcgtcgtctaagaagtctgaagatagcctgttaaagacttactttgtcggcttactttcagagtccaacgaaaaaacctacatgtag

SEQ ID NO: 117462 - DNA, 831 bp, Artificial Sequence
  Description of Artificial Sequence: Synthetic coding sequence
atgcacggtcatggggggtatgactctgacttctctgatgacgaacggtgcggagaaagttctaagagaaagaaacgaacggtggaggacgacttgctgctgcaaaagcctttccaaaaggagaagcatgggaaagttgcccataagcaggttgccgctgagcttttggatcgggaggaggcccggaataggcggtttcatttgattgctatggacgcgtatcagcgccacacaaagttcgtgaacgactatattctgtactacggcggtaagaaggaggacttcaagcgcctgggcgagaacgataaaacggacctggatgtcatccgcgagaatcataggtttctttggaacgaagaagacgagatggacatgacatgggagaaaaggttagcaaaaaagtactatgataagcttttcaaagaatattgcattgcagacctgtccaagtataaagaaaacaagtttggatttagatggcgagtcgaaaaagaagtcatctctggcaaaggacaattcttttgcgggaataagtattgcgacaagaaagaaggtctaaaaagctgggaagtgaacttcggatacattgaacacggagaaaagaggaatgccctagtaaagctcaggctgtgtcaggaatgttccatcaagctcaacttccatcaccgacgaaaagagatcaaaagtaaaaaacggaaggacaagactaaaaaagattgtgaagagtcttcacataagaagtcaagactgagcagcgcagaggaagcctccaagaaaaaagataagggacatagcagcagcaaaaagtctgaggacagcctgttaaattag

SEQ ID NO: 117463 - DNA, 978 bp, Artificial Sequence
  Description of Artificial Sequence: Synthetic coding sequence
atgggaattttccctgggatcatattaatatttcttagggtgaaatttgcaactgcagcggtaatcgtgtcaggccatcagaaaagtaccacagtgagtcacgagatgtccgggctgaattggaagccattcgtgtatggcggcctcgctagtattgtggccgaattcgggacttttccagtggacctcacgaagaccaggctccaagtccagggtcaatccatcgacgcacgattcaaggagattaagtaccgcggaatgttccacgctctgttccggatctgcaaggaagaaggggtgctggccctctacagcggaatagccccagccttattgcgccaggcctcttatggaaccatcaaaattggcatttatcaatcactcaagcgactgtttgtcgagagattagaggatgaaacgctgctaatcaacatgatttgtggcgtggtctctggtgtgattagctctaccattgcgaatccgaccgatgtcctaaagatccgtatgcaggcccagggatccctctttcagggaagtatgattggctcattcatagatatctatcaacaggaaggcacacgtgggctgtggagaggcgttgtgccgaccgcacagagagcagccatcgtcgtgggggtggagcttccagtgtacgacatcacgaagaagcacctgatccttagcggaatgatgggggacactatccttacacattttgtgtcttcttttacatgcggattggcaggagcccttgcaagcaaccccgtagacgtcgtccgcaccaggatgatgaatcaaagggcaattgtgggccacgtggacctttacaaggggactgtggacgggatattaaagatgtggaaacacgagggtttcttcgccttatacaaaggcttttggccaaattggcttcgtttggggccctggaacatcattttcttcatcacttatgaacagctcaagcgcttgcagatctag

SEQ ID NO: 117464 - DNA, 894 bp, Artificial Sequence
  Description of Artificial Sequence: Synthetic coding sequence
atggaagaattggtggtggaagtgaggggatccaatggtgctttttacaaagcatttgtaaaggatgtccacgaggatagcattactgttgctttcgaaaacaactggcagccagataggcaaatcccctttcacgacgtccgttttcctccacccgttgggtataacaaagacatcaatgaatctgatgaggtagaggtatattctcgcgctaacgaaaaggaaccctgttgctggtggttggcaaaagtgagaatgatcaaaggcgaattttatgtcatcgagtatgccgcctgtgatgcgacctacaatgagatcgtcaccatcgaacgcttacgatccgtcaacccaaacaagcccgcaaccaaagacacctttcataaaattaagctagacgtgcctgaagacctgagacagatgtgcgccaaggaggcagcacacaaggattttaagaaggcagttggcgccttctccgtgacatacgaccccgagaactatcagctggtgattctgagtattaatgaggttacatccaagagggcacatatgctaattgacatgcacttccgcagcttacgcaccaaactgtccctcatcatgcgcaacgaggaggcctcaaagcagctggaaagctccagacaactggcatcaagattccacgagcaattcattgtcagagaggacctgatgggcttggctattggaacccacggcgcaaatatccagcaggctcgtaaagtgcctggtgtgacggcaattgacctggatgaagacacatgtacgttccatatctacggcgaggatcaagatgccgtgaaaaaggctcggagctttctggaatttgcggaagacgtcatccaggtgcctcgcaacctcgtggggctgaaaatctag

SEQ ID NO: 117465 - DNA, 1773 bp, Artificial Sequence
  Description of Artificial Sequence: Synthetic coding sequence
atggaggagctggtagtcgaggttaggggttctaatggagcattttacaaggcttttgtcaaggatgtgcatgaggattcaattacggtggccttcgagaacaattggcaacctgaccgtcagattcctttccatgatgtgaggttcccgccacccgtgggttacaacaaggatattaatgaatccgatgaagtggaagtatattcaagagcaaatgagaaagagccatgttgctggtggctggccaaggtgcggatgatcaagggcgagttttacgtgattgagtacgccgcctgtgacgccacctacaatgaaatcgttaccattgaacgccttcggagcgtgaatccaaacaagcctgcaacaaaggatacatttcacaagattaagcttgacgttcccgaggatctgcggcaaatgtgcgctaaggaggccgctcacaaggactttaaaaaagctgtcggtgcattcagtgtcacgtacgatcccgaaaattatcagctggtcatactgtctatcaacgaagtgaccagtaagagagcccatatgttgatcgacatgcactttagatctcttcggacaaagctatctcttatcatgcgaaacgaagaggctagcaagcagctggagtcatccaggcagctggcctctaggttccacgaacaattcattgtgagggaggacctcatgggcctcgcgatcggtacacatggagctaacatacagcaagcccgcaaagtgccaggcgtgaccgctattgatctggatgaagacacgtgcactttccatatctacggcgaggaccaggacgccgtaaaaaaagcccgaagtttcctggagtttgcagaagacgttattcaggtcccgaggaatctagtgggtaaagtgatcgggaaaaacgggaagctcatacaggagatcgtggacaaatccggcgtggttcgggtccgtatcgaggccgagaatgaaaaaaatgtacctcaggaggaggaaataatgccaccaaattcactcccttctaataatagtcgggtggggcccaacgcaccggaggagaaaaagcacctggacataaaggagaatagtacccacttctcgcagcccaattccactaaggtgcaaagggtgctggtggcctcatcagttgttgctggggagtcgcagaagcccgagctgaaagcgtggcaagggatggtgccttttgtgtttgtcgggacaaaagattcgatcgcaaatgctacagttctcctagactaccacctcaactacctgaaggaagtggaccagttgcggctcgagcgactgcagattgatgaacagctaagacagatcggagcttcctccaggccaccgccaaacaggactgataaagagaagagctacgtgaccgatgatggccaagggatggggcggggcagccggccgtataggaaccgcgggcacggacggaggggtcctggatatacttcagcgccaaccgaggaggagagagagtcattcctgagaaggggcgatggtcgcaggagaggtggtggcggccgaggacaggggggtcggggcagagggggcggcttcaagggaaatgatgatcacagccgaacagacaataggccacgaaatcctcgtgaggccaagggtaggaccaccgatggaagcttgcaaaatacctcttctgagggatctcgcctgaggactggcaaggatcgcaaccagaagaaggagaagccagactctgtagatggccagcagcccttggttaatggagttccttag

SEQ ID NO: 117466 - DNA, 1614 bp, Artificial Sequence
  Description of Artificial Sequence: Synthetic coding sequence
atggaggagttagtggtggaagtacggggctcaaacggagccttttacaaggcctttgtcaaagacgtacatgaggactctatcaccgtagcctttgaaaacaattggcaaccagatcggcagattcccttccatgatgtgcgcttcccaccccccgtgggctataacaaggatatcaacgagagcgatgaggtcgaagtgtactcgagagcgaacgaaaaagaaccctgttgttggtggctggccaaagttcgtatgattaaaggtgaattctacgtcatcgagtatgccgcctgtgacgctacttacaacgaaatcgtgacgatagagcgcttgaggtcggtcaaccctaataagccagcaactaaggatacctttcacaagattaaactcgacgtaccagaggatttaaggcagatgtgtgccaaggaggcggcacacaaggacttcaagaaagctgttggcgccttctcggtgacctatgatccggaaaattatcagcttgtgattctctcaattaacgaggtcacctcaaaaagagcccacatgctcattgatatgcatttcagaagcctgcgaaccaaactgtctctgattatgcgaaacgaggaggcatccaagcaacttgagtcgtccaggcagctggctagccgctttcatgagcaatttatagttcgagaagacctgatgggcctggccatcggcacccacggggctaacatccagcaggcccgcaaggttcctggggtgacagctattgatctcgacgaggacacctgcacttttcacatttacggcgaagatcaggacgcggtgaagaaggctcgttcttttctggagtttgccgaggatgtcattcaggtcccccgaaacctcgtgggcaaggttattgggaaaaatgggaaactgatacaggaaattgttgacaaatcaggggtggtgcgcgttagaattgaagccgagaatgagaaaaatgtgccccaggaggaggaaatcatgcccccgaacagtctgccatctaacaatagtcgcgtgggacctaatgctcccgaggagaagaagcacttggacattaaggagaactccactcatttttctcaacctaatagcaccaaggtacaaagggttctggttgcctcttctgtggtggccggggagtctcaaaagccagagctgaaggcatggcagggaatggtgcccttcgtcttcgtcggcaccaaagattccatagccaacgctaccgtcttattagactaccatctcaattacctgaaactgcagcagaggaagcgagggcgcgcttcctgcgctgaggagactgatggaggcgttgaaggcgaggaagaggacaaagaggaggaggacgttgaagaagcttccaaagagacaacgatcacaccagaacaaataatcgtccacgtcattcaagaaaggctcaaggaagagcagcagatggatcctttcagaagcgaactgacagctatcatgaaaggtgtctctactctgaaacactaccgcatccctccagtcaaggtggttggttgtgcacgcgtcaagatagtgacacggagaaagcgttcccaaacggcctggatggtcagtaaccattcctag

SEQ ID NO: 117467 - DNA, 1899 bp, Artificial Sequence
  Description of Artificial Sequence: Synthetic coding sequence
atggaagaattagtcgtcgaggtgaggggatctaacggcgccttttacaaagctttcgtgaaggacgttcatgaggactcaatcaccgtggcttttgaaaacaactggcagcccgatagacagatccccttccacgatgtgaggtttcctcctcctgttggctataataaggatatcaacgaatcagacgaagttgaagtctattcccgagcaaacgagaaagaaccctgttgctggtggttggctaaagtccggatgataaaaggagaattttatgtaatcgagtacgcagcttgcgacgcgacttacaatgagatagtcaccatcgaacgactccgatctgtgaatccgaacaaaccagcaacaaaagacacatttcacaaaatcaaactggacgtgccggaagaccttcggcaaatgtgtgccaaggaggcggcccacaaagatttcaagaaagcagtaggagctttctccgtgacatacgatcctgaaaattatcaactcgtaatcttgtccattaatgaagtgacttctaaaagagcccacatgcttatcgacatgcacttcagatcgttacgcacaaagctttccctcataatgcggaacgaagaggccagcaaacaattggagtcctcccggcagctggcgagcagatttcacgaacagtttatcgtgcgcgaggatctgatgggcctggccattgggactcatggtgcgaatattcagcaggctcgcaaagtaccaggcgtgactgcgattgacctggatgaggatacttgtacttttcatatctatggagaggatcaagacgcagtaaagaaggctcgctccttcctagaattcgccgaggacgtgatacaggtcccccgcaacctggtcggcaaagtgatcggtaagaatggcaaactgatccaagagatcgtggacaagagtggtgtagtgagggtccgcatcgaagctgagaacgaaaaaaatgtgccgcaagaagaggaaattatgccacctaactccttaccatctaacaattccagagtcggcccgaacgcaccagaggagaagaaacatttagacatcaaagagaattctacccatttctcccagcccaacagcacaaaggtgcagcgtgttctggttgcttcatcagtggtcgccggcgagagtcaaaaaccagagctgaaagcctggcagggaatggtgccattcgtattcgtggggaccaaagacagtatcgccaatgccacagtcctgcttgattaccatcttaattatctgaaagaagtcgaccagctcagattggaacggctacaaattgacgagcagctgaggcagatcggggccagcagtaggcccccgcctaatcgcaccgacaaagaaaagtcttacgtgactgatgacggccagggcatgggtcggggatcaaggccttacagaaatagggggcacggccgccgggggcccgggtacacctccggcacaaactccgaagcttcgaacgcatcggagaccgaaagtgaccacagggatgagctctcagattggagtttggcccctaccgaagaggagagggaaagtttcctgaggcgaggcgatggccggagacgagggggcggcggcaggggccagggcgggaggggccgcggcgggggctttaaggggaatgatgaccacagccggactgataataggcctcggaacccccgcgaagcaaaagggagaaccaccgacggatccctgcagattcgcgttgattgcaacaacgagcgcagtgtgcatacgaaaaccctgcaaaacactagcagcgaaggtagccggttacgaactggcaaagaccgcaatcaaaagaaggagaaacctgacagtgttgacggtcaacaaccgctcgtaaacggcgtgccttag

SEQ ID NO: 117468 - DNA, 1749 bp, Artificial Sequence
  Description of Artificial Sequence: Synthetic coding sequence
atggaggaactggttgtggaggtcaggggcagcaatggggctttttataaagcatttgtcaaggacgtccatgaagacagcataaccgtcgcattcgagaataattggcagcctgataggcagatccccttccatgacgtcaggtttcccccgcctgttggatacaacaaggacataaatgagtcagatgaggtagaggtatacagccgcgcaaacgagaaagagccttgttgctggtggctggccaaggtcaggatgatcaagggagagttctatgtgattgagtacgctgcttgtgacgcgacatacaacgaaattgtaaccattgagcgcctcaggagcgtgaaccctaacaaacccgcaaccaaggacacgttccataagattaagctcgacgtgccggaggacctaaggcaaatgtgcgctaaagaagccgcacataaagacttcaagaaggcggtaggcgcttttagcgtgacctatgaccctgagaactaccaacttgtgatcttatctatcaacgaagtgactagcaagcgcgctcacatgctaattgacatgcacttcaggagcttgagaaccaaactgtctctcattatgaggaacgaggaagcttccaagcaattggagagcagccgccagttggcctctcgattccacgagcagttcattgtccgtgaggatctaatgggcctcgcgattggaactcacggcgcgaatatacaacaggccagaaaagtgcctggggtgacggccatcgatctcgacgaggacacctgtacatttcacatttacggcgaagaccaggacgccgtcaagaaggcccgaagcttcctcgagttcgcagaggacgtgatccaagtgcctcgtaatctggtggggaaggtgatcggcaagaacggtaaactaatccaggaaatcgtggataagtctggcgtagtccgggtgcgaatcgaagctgaaaatgaaaaaaatgtcccccaggaggaggagataatgcctcccaactcacttccatctaataatagccgagtgggccctaatgcacccgaggaaaaaaagcatctggacatcaaggagaattccacgcatttctcccagcctaactctactaaggtgcagcgcgggatggtcccattcgtgtttgtgggcaccaaagatagtatcgcaaacgccactgtgctgttagattaccacctcaactacttgaaggaagtggaccagctgcgattagagagactgcagatcgatgaacagctgaggcagatcggcgcatcttcgcggccccccccaaacagaacagacaaggaaaagagttacgtgaccgacgacggccagggaatggggagaggaagccgtccctacagaaaccgcgggcacggaaggagaggccctggctatacctctgaaagcgatcatcgtgacgagctgtccgattggtctttggcgcccacagaggaggagagggagtcttttctgaggagaggcgatgggcggcgccgcggaggaggagggcggggacagggcgggcgtgggagaggcggcgggtttaagggaaatgacgatcatagtaggactgataatcggccgcggaacccgagggaggccaaggggagaaccacagatgggagtttacagaatacaagtagcgaaggctcccggttgagaacaggtaaggacagaaaccaaaaaaaggaaaaacccgatagtgttgacgggcaacagcctctagtgaatggagtgccttag

SEQ ID NO: 117469 - DNA, 1779 bp, Artificial Sequence
  Description of Artificial Sequence: Synthetic coding sequence
atggaagaactggtggtcgaagttagggggagcaatggagcgttctacaaggccttcgtcaaggatgtacacgaggactcaattactgttgcctttgagaacaattggcagccagacaggcagatcccctttcacgatgtaaggttccctcctcctgtgggttataacaaagatatcaacgaatctgacgaggtggaggtgtattctcgggcaaacgaaaaggagccttgctgctggtggttggctaaagtgcggatgatcaaaggggagttctatgtaattgaatacgctgcctgtgacgctacatataatgagattgtcactatcgaaagattgcgtagcgtgaaccccaataaacctgcaactaaagatacattccacaaaattaaattggatgtgccagaagacctgaggcagatgtgcgcaaaggaagccgcccacaaggattttaaaaaggctgtgggcgccttttccgtgacatatgacccagaaaattatcagctggtcatcctgagtatcaacgaggtcacaagtaaacgagctcacatgttaatagatatgcactttcgaagcctgcggactaagctttcgttaatcatgcgaaatgaagaagcctccaaacagctagagtcttctagacaacttgcaagtcggtttcatgagcagtttatcgtacgcgaggacttaatggggttggccattggcacccacggggctaacattcaacaggctcgaaaggttcctggtgtaacagcgattgacctggacgaggacacctgcacttttcatatctatggtgaggaccaggatgccgtgaaaaaggctcgaagttttctcgagttcgccgaagacgttatccaggtgccaagaaacctggtcgttatcggaaaaaacggaaagcttattcaagagattgtggacaagtccggcgtggtgcgcgtgaggatcgaggcagagaatgaaaagaacgtcccgcaagaagaggaaattatgccccctaactctctgcccagcaacaattcacgggttggcccaaatgccccagaggagaagaaacacttggacatcaaggagaactccacccatttttctcagcccaatagcaccaaggttcagcgcggcatggtcccttttgtcttcgttggaaccaaggacagcatagccaatgcgacagtgttgttggattatcatttaaattacttgaaggaagtggaccagcttaggttggaacgcctgcagatagatgagcagctgaggcaaataggagccagtagcaggcctccaccgaatagaacagacaaagagaaatcttatgtgaccgacgatggccaaggcatgggccgcggatcaaggccctaccgcaaccgaggccacggacgccggggcccaggctacacctctgggacaaattctgaagccagcaacgctagtgagaccgaaagcgatcaccgcgacgagctctctgattggtccctagcccctaccgaggaagaacgcgagtccttcctgcggcggggagacgggagaagacgcggcgggggcggccgaggacagggtggtaggggtaggggcggcggcttcaaaggcaatgacgaccactctcggactgacaaccgcccgagaaaccctagggaggctaaaggacgaacaacagacgggtccctgcagaacacctcaagcgagggaagtcgtctccggacaggtaaggacagaaaccagaaaaaggagaagcccgattcggtggacggccagcagcccttagtcaatggcgttccttag

SEQ ID NO: 117470 - DNA, 789 bp, Artificial Sequence
  Description of Artificial Sequence: Synthetic coding sequence
atgcctccaaacagtcttccgtccaataactccagggttggcccaaacgctcccgaagaaaaaaagcacctcgacatcaaggagaattctacccactttagtcagcccaatagcaccaaagtacaaagaggaatggttcccttcgtgttcgtggggaccaaggacagcattgctaacgcgacagtgttactcgactaccacctaaattatctgaaagaagtggatcaactccggctggaaagattacagatcgatgagcagttaagacagattggtgcgtcatcacgcccccccccaaacagaactgacaaagaaaagtcttacgtgaccgatgacggccagggtatgggccgggggtcccgcccctacagaaacaggggtcatggcaggcgaggtcccgggtacacttccggtacaaactctgaagctagtaacgcgtcagagacagaatccgatcatagagacgaattatccgactggtctttagccccaacagaggaagagcgtgaaagtttcctccgcagaggagatgggagacgccgggggggagggggtagaggacagggaggcagagggcgtggcggaggcttcaaggggaacgacgaccattcacgaaccgataatagaccacgaaatcccagagaagcaaagggcagaacaacagatggctctcttcagaacacaagcagcgagggatcgagactcaggacagggaaagatcgcaatcagaagaaggaaaaacccgactcagtcgacggccagcagcctctggtgaacggggtcccctag

SEQ ID NO: 117471 - DNA, 1611 bp, Artificial Sequence
  Description of Artificial Sequence: Synthetic coding sequence
atgatgaagggggagttctatgtcattgagtacgcagcgtgcgacgctacctataacgagatcgtcactttcgagcgtcttcgacccgtcaatcagaataagactgtcaaaaagaacacttttttcaagtgtactgtagacgtccccgaggatctacgggaggcctgcgccaatgaaaatgcccataaagatttcaagaaagccgtcggcgcatgccgaattttctaccaccccgagactacccagttaatgattttaagtgcaagcgaagcaaccgtgaaacgcgtcaatatcctgagcgacatgcatctgaggagcatccgaactaagctgatgctcatgtctcgaaacgaagaggctacaaaacatctcgagtgcacaaagcagctggccgcggcattccacgaggagttcgtggtccgagaggatcttatgggcttggctattggaacccacggtagcaatatccagcaggccagaaaggtgccaggcgtcaccgccatagaactggacgaggacacggggacatttaggatatatggagagagcgctgacgccgtcaaaaaggccaggggcttcctcgagtttgtggaggattttatccaggtcccccggaaccttgtcggaaaagtgatcggcaagaacggcaaggtgattcaagaaatcgttgacaagagcggtgtggtcagagtaagaatagagggtgacaatgagaataagctgcccagggaagacggcatggtgccattcgttttcgttggcaccaaggagtcaattggaaatgtgcaagtcctgctggaataccacatcgcgtatttgaaggaggtcgagcagctccgaatggagcgactacagatcgacgaacagctaaggcagattggctctcgctcgtacagtggccgaggacgtggtcgccgcggccccaactatacaagcggatatggcaccaattccgaactgtctaacccttctgagaccgagtcggagagaaaggatgagctaagcgactggagcttggccggggaagatgacagggactctagacaccagcgcgacagtcgcaggaggccaggtgggagaggccgtagtgtgtcaggcggacggggccgaggcggaccacgcggcggcaagtctagtatcagttccgtactcaaggatcccgattctaacccttacagtctgctagacaatacggagagcgaccagaccgcggacacagatgcttctgagagccatcattcaacgaatagaaggcgccggtctcggaggcggcggacagatgaggatgcagtgctgatggatggcatgacagaaagcgacacagcatcagtgaatgagaacggcctagtgacagtggccgactatatctctagggcggaatcccagtcacgccagcgaaacctgccaagggaaaccctggcaaagaataagaaggaaatggcgaaagacgtgattgaagagcatggaccaagcgaaaaagccataaatggtcctactagtgctagcggagatgacatctctaaacttcaacggactcctggagaggaaaaaattaatactcttaaagaagagaatactcaagaggccgctgtgttgaacggcgtgtcatag

SEQ ID NO: 117472 - DNA, 1866 bp, Artificial Sequence
  Description of Artificial Sequence: Synthetic coding sequence
atggcagaattgactgtggaagttcgggggtctaatggcgctttttataagggattcatcaaggacgtgcacgaggactccctcaccgtcgtgtttgagaataattggcagcccgagcgccaagtcccctttaacgaggtgcgcttgcccccaccccccgacattaagaaggagatatctgagggcgacgaagtggaagtctatagtcgggctaacgaccaggagccatgcggctggtggctggcaaaagtgcggatgatgaagggtgagttttatgtaatcgaatacgcagcctgtgatgctacgtataatgaaattgtgacattcgagaggctgaggcctgttaaccaaaataaaacagtcaagaagaacaccttcttcaaatgtaccgtggatgtgcctgaagaccttagggaggcatgcgcaaacgaaaacgcccataaagattttaaaaaagcagtaggagcgtgccgcattttctaccatcccgagaccacgcaactcatgattttgtccgctagcgaggctacagtcaagagggtgaacatcctcagcgacatgcacctcagaagtattaggacaaagctaatgttaatgtcccgcaatgaagaagccacgaaacatctcgaatgcaccaagcagcttgctgcggctttccatgaggaatttgtagtacgggaagacctgatgggtctggcaattggtacccacggatccaatatacagcaagcccgcaaagtgcccggggtaacagcaatagagctggatgaagacaccgggactttccgaatctacggtgaatctgcagacgccgttaagaaagccaggggttttctggagttcgtcgaggactttatacaggtacctcggaatctggtggggaaggtgattggaaagaatgggaaagtgatccaggagatcgtcgataagagtggtgttgtgagggtacgcatcgaaggggacaatgaaaataagctccccagggaggacggcatggtacctttcgtgtttgtaggaactaaggagagtattggcaatgtccaggtgctgctcgagtatcatatcgcttacctgaaggaagttgaacaactcaggatggagaggctccagatcgacgaacaattaaggcaaataggatcccgtagttacagcggcagaggccgcgggcgacgaggacccaattacacctcaggatatggaactaactctgaattatcaaacccatccgagacagagagcgagcggaaagatgaactgagtgattggagtttggccggcgaggacgatcgtgatagcaggcaccaaagagatagcagacgaaggcctggagggcgaggcagaagcgttagcgggggtcgtggacggggaggaccgaggggcggcaaatcctccattagctccgttctcaaggatcccgacagtaatccatactcgctgctcgacaacaccgaatcagatcagacagctgacaccgatgcttctgaatctcaccatagcaccaatcgaagacgcagaagccggagacgcagaacagacgaggatgccgtgctcatggatggcatgacagagagcgacaccgccagcgttaatgagaacgggctcgttaccgtggccgactatatttctcgggccgaaagccagtcccggcagcggaatctgccccgagagaccctagcaaagaacaagaaggaaatggcaaaggatgtgattgaggaacacggaccttccgagaaagcgatcaatggccctacatctgcctctggcgatgacatttcgaagcttcagagaacacctggtgaagagaaaattaacaccttaaaggaagagaacacacaggaggcagcagtacttaatggagtcagctag

SEQ ID NO: 117473 - DNA, 1620 bp, Artificial Sequence
  Description of Artificial Sequence: Synthetic coding sequence
atggccgagcttacggtcgaggtaagaggcagtaatggagcgttctataaagggttcatcaaggacgtgcatgaggactcacttactgtagtgttcgagaacaattggcagccagagcggcaggtcccatttaatgaggtccgactaccaccaccacccgatatcaagaaggagatctccgagggcgacgaagtagaagtctactccagagccaatgaccaggaaccatgtggctggtggttagcgaaagtgcgcatgatgaagggcgagttctatgtgatagaatacgctgcctgtgacgccacctataatgagatcgtgaccttcgagcgccttagaccggtgaatcagaacaagaccgtcaagaaaaacacgttttttaagtgcactgtggacgttcccgaggacctccgagaggcttgtgccaacgagaacgcacacaaggacttcaagaaagccgtcggagcctgtagaatcttctatcatccggaaacaacacagctcatgatactgtcagccagtgaagcgactgttaagagggtgaacatcttatcagatatgcaccttaggtcaatccgcaccaagctgatgttaatgtcgaggaacgaggaagccactaaacacctagagtgcacaaagcaactggccgccgcattccacgaggaattcgtggtaagggaggatctgatgggacttgccattggtacacacggatcaaacatccagcaggctaggaaggtccctggggtgacggccatcgagctcgacgaagacaccggtacctttcggatctatggtgagtctgccgacgctgtcaaaaaggctcgagggttcctcgagtttgtagaggacttcatccaggtgccgcggaaccttgtcggcaaagtgattggaaagaatgggaaggtgatccaggagattgtggacaagagcggcgtcgtgagagtgagaatcgagggggataacgagaataagcttcccagggaggacggcatggtaccgttcgttttcgtgggcactaaggagtcaattggcaatgttcaagtgctgcttgagtatcatatcgcataccttaaagaagtcgagcagctgaggatggaaaggctccaaatagacgaacagctgcgccagatcggcagcaggagctactcgggccgtggcagaggaaggcggggcccgaattacacttccggctatggtactaactccgaattaagcaatccgtccgagaccgaaagcgaaaggaaggacgagctgtccgactggtccctggccggtgaggatgacagggactccagacatcagagggatagccgaagaaggccgggcggtcggggtcgcagtgttagtggaggacgcggccggggcggtccaagagggggcaagtcatcgatctcttctgtgttgaaagaccccgactccaacccatactccctactggacaatacagaaagtgatcagactgctgatactgacgcctccgaaagccaccatagcacaaatcgtaggagaagatctcgacgccgccgcactgatgaagacgccgttctgatggatggcatgacagagtccgatactgcgagtgttaatgaaaacggtctggggaagcggtgcgactag

SEQ ID NO: 117474 - DNA, 1827 bp, Artificial Sequence
  Description of Artificial Sequence: Synthetic coding sequence
atggttaccgagggattcattaaagatgtccacgaggattcattaacggtagtgtttgaaaacaattggcaacccgaaaggcaggtgccatttaacgaagtacgcctgccaccacccccagacatcaaaaaggagattagtgagggcgacgaggttgaggtgtacagtcgagcgaatgatcaggagccttgtggctggtggctggctaaggtgagaatgatgaaaggcgagttttatgtgatcgaatatgctgcgtgcgatgccacttacaacgaaatcgtcacattcgaaaggttaaggccagttaaccaaaacaaaacagttaaaaagaatacatttttcaagtgcacagtggacgtccctgaagatctacgggaagcttgtgctaacgaaaacgcgcataaagacttcaagaaggccgtgggcgcttgccgcattttttaccaccctgaaacgacacaacttatgatcctgtctgctagtgaagcaaccgtgaagagggtgaacatcctatcagacatgcacctgcgctcaatccggactaagctgatgcttatgtctcgcaacgaggaagcaaccaaacatctcgagtgcaccaaacagctggccgctgcgttccacgaggaattcgtggtgagggaagatcttatgggactcgctattggtacccacggatccaacatccagcaggcacgaaaagttcctggggtcacggctatcgagctggatgaggatacaggcacgtttcggatttatggcgagagcgctgacgcggtcaagaaggcccgtggcttcttggagtttgtcgaggattttattcaggtcccacgcaatctggtcggtaaggtgattggtaaaaatgggaaggtgatccaggaaatcgtcgataaatctggtgtggttcgcgtgaggatcgagggagacaatgagaacaaactgcctagggaagatgggatggtacccttcgtattcgtagggactaaggagtctattggcaacgttcaggtgctcttggaataccacatcgcctaccttaaggaggtcgaacaactgcgtatggagcgcctgcagattgatgaacaactacgtcagatcggatctaggagctactccggacggggaaggggcagaagaggccccaattatacttcgggctacggtactaactctgagctcagtaacccctccgaaactgaaagtgaacgtaaggatgagctgagcgactggagtttggctggcgaggatgatagggattcgagacatcaacgagactcgcgtagacggcccgggggccggggccggtccgtttccggagggagggggcggggaggcccacggggaggcaaatcgtcgatctcatctgtgctgaaagaccccgactctaacccatactccttgctcgacaacaccgagtctgatcagaccgcggacactgatgccagcgaaagtcatcactctacgaatcgccgtaggaggagcagaagaagaaggacagatgaagacgcagtcctaatggatggcatgaccgagagtgatactgctagcgtaaacgagaacgggctagtgactgtggctgactatatatcaagagccgagagccagagtagacagaggaacctccctcgcgaaacgctcgccaaaaacaagaaggagatggctaaagatgtgattgaagaacacggacctagcgagaaggctatcaatgggccaacctccgcctcgggtgatgacataagcaaacttcagcgtacccccggggaggaaaaaataaacactttaaaagaagaaaatacacaggaggccgcagttcttaatggggtgtcctag

SEQ ID NO: 117475 - DNA, 2022 bp, Artificial Sequence
  Description of Artificial Sequence: Synthetic coding sequence
atggggggcttggcctccggaggcgacgtagagcctggccttcccgtggaggtgaggggcagcaacggagccttttacaagggttttgtgaaggatgtccacgaggacagcgtcactatttttttcgagaataattggcagagcgagcggcaaataccttttggagacgtgaggctgccaccccccgctgactacaacaaggaaatcaccgagggtgacgaggtcgaggtctactctcgggccaatgaacaagaaccctgtggatggtggctcgcacgggtgcggatgatgaagggcgacttctacgtgatcgagtatgcagcttgcgacgccacctataacgagattgtgacactcgaacggctgcgccctgtgaatcctaacccattagccaccaagggatctttcttcaaggtgacaatggctgtcccagaagacttgagagaggcttgcagcaatgaaaatgtgcacaaagagtttaaaaaagcgttgggcgccaattgcatttttctcaacatcaccaattccgagctctttattttaagcaccaccgaggcaccagtcaagagggcctccctgctgggtgacatgcactttcgcagtctgaggaccaagctgctcctaatgagtaggaacgaagaggcaaccaagcacctggagacttcgaagcaactggcagctgcatttcaagaagaatttacggttcgcgaggacttaatgggcctggctattggaacccatggagccaatattcagcaggccaggaaggtgccaggagtgacggctatcgagctcggcgaggaaacatgcacatttaggatttacggggagacacccgaagcatgtcgccaggccagaagttatctggagttctctgaagactctgtccaggtgccaagaaacctggtaggcaaagtgattggcaaaaacgggaaagttattcaagagatcgtggataagtctggcgtcgtcagagtgagggtggagggagataacgacaagaagaatccccgagaagaaggcatggtgcccttcattttcgtcggtaccagagaaaacatcagcaacgcacaagccttactcgaataccatctaagctacttacaggaagtggagcagttacgcttagagcggctgcaaattgacgagcagctcaggcagatcgggctcggctttcggccacccggatccgggcgcggcagtggtggctccgacaaagccgggtattccaccgatgagagtagcagctctagcctgcacgccactcgcacctacgggggctcttatggtggccgggggcggggacgccgtacgggcggccccgcttacggtccatccagtgacgtgtctaccgcatctgagactgaaagtgaaaagagggaagagcctaatcgggcaggtcctggcgatagagaccccccaaccaggggtgaggagagtcggcgccgccccacgggaggcaggggacgcgggcctccccccgcccctaggccaacctcccggtataattcaagctctatttcaagtgtgctaaaggacccagattccaatccatatagcttattagatacctcagagcccgagcctccagttgatagcgagcccggagaaccaccacccgcctcagcacggcgccggcggtctagaaggagacgtaccgacgaagatcggactgttatggatggcgggttggaatccgacggccccaatatgactgagaatgggctcgaggacgaatcccggccccagcggcgcaaccgatctagacgcaggcgcaatcgaggaaacaggacagatgggtcaattagtggagatcgacagccagttacagtggctgattacattagtcgcgcagagagccagtcccgacagcggcccccactggagcggacaaagccttctgaggattcactttccggccagaagggcgacagcgtttctaagcttcctaaaggacctagcgagaacggagaactgtccgctccgcttgaacttggaagtatggtgaacggagtctcttag

SEQ ID NO: 117476 - DNA, 6540 bp, Artificial Sequence
  Description of Artificial Sequence: Synthetic coding sequence
atgaattctttgtcatggggggccgcgaacgccgtcctgctgttgctactgctcgcctgggcttcccctaccttcatcagcattaatcgcggcgtgagggtgatgaagggccactccgctttcctatccggagacgacctgaagtttgcgattccgaaggaaaaggatgcgtgcaaagtagaggtggtaatgaatgaacctatcacccagcgagtgggcaagctcacaccacaggtttttgactgtcacttcctgcccaacgaggtgaagtatgtccataacggttgtccaatattggatgaagatacagtgaaactgcggctgtaccgcttcactgagagagacacgttcatcgagaccttcatcctttgggtttatctactagaacccgactgtaacataatccatatgagtaataacgtcctggaggtgcccgagtttaacgggcttagtcaggccatcgataagaacctgctgcgtttcgactacgacagaatggcgtctctggaatgcactgtgtctctggacacagctaggacccgcttgcccgcccacggccagatggttcttggggagcccagacctgaggagccccgtggtgatcagcctcatagtttttttccagagtctcagttaagggccaaactgaagtgcccgggaggcagctgcacacccggccttaaaaagatcggatccctcaaggtgtcatgtgaggagttcctcctcatgggactgagatatcagcacctggatccaccctcacctaatatagattacatctccattcagctggacctaaccgacacaagatccaaaatagtgtacaaatcagagtcggcttggctgcctgtctacattcgggcaggcattcctaaccagatacccaaggcagccttcatggccgttttcatcctggaggtcgatcagttcatcctaacgagtttaacgacgtccgtcttggattgcgaggaggatgaaacgccaaaacccctgctggttttcaatataactaaggctccactgcaggggtacgtaacgcatctgctggatcacacccggccaatttcaagctttacctggaaggacctttctgacatgcaaattgcttaccagcctcccaacagtagccacagcgagcggaggcatgatgaggtggagttggaggtctatgacttcttctttgaacgctccgcccccatgaccgtgcacatctccatacgcaccgcagataccaacgccccgcgggtgagttggaatacgggactgagcctgctggagggtcagtctcgagccatcacctgggagcagtttcaggttgtcgataacgatgatattggtgccgtacgacttgtcacagtcggtggcctgcagcatggatggctgactctgagaggcggaaagggttttttatttaccgtggccgatctccaggcaggcgtcgttcgttatcaccacgatgattccgacagcaccaaggactttgtggtttttcgcatttttgatggtcaccattccatcaggcacaagttccctataaatgttcttcctaaagacgactcaccacccttcctgattaccaatgtcgtgatcgaactcgaggaagggcagactatccttattcaaggcagcatgctgagggcctcggatgtggacgcaagtgatgattacatcttcttcaatattaccaagcctccccaggcaggtgaaattatgaagaaacccggccccggtctcatcggctatcctgtccacggattcttacaaagggatctgttcaatgggataatatactaccggcatttcgggggggagattttcgaagattcttttcagtttgtgctgtgggattctcacgagccccccaaccttagcgtgccgcaggtcgccaccatccacatcaccccggtggacgatcagcttccaaaggaggcccctggcgtgtcaagacacttggtggtgaaagagacagaggtggcctacataactaagaagcaattgcatttcatcgactctgagagttatgatagggagctcgtctacacaattactacaccacccttcttctcattcagccatagacatctggatgccggcaaactgttcatggttgatagcattcccaaggttgtaaagaaccctacagccctagaactacgtagctttacacagcacgctgtgaactacatgaaggtggcatatatgccccccatgcaggacatcggaccccattgcagagatgtgcagtttacttttagcgtgagtaaccagcatggagggacgctgcatggcatttgctttaacatcacaatcttacccgtggataatcaagttccagaggcattcaccaatccgctcaaggtgactgaaggaggtcagtccattatttccacagaacatatcctgataagcgacgcagacaccaaactggacaacattgacctcagcctgcgggagcttccccttcacggcagggtggagctcaatggctttccgctcaactcagggggcaccttttcctggggggacctacatacgttgaaagttcgctaccagcacgacggtactgaagtcctgcaggatgatctcttgctcgaagtcaccgacggaaccaattccgccgaattcgttctccacgtcgaggtcttccccgtcaatgacgagccccctgtcctcaaagcagatttaatgccggtcatgaattgcagcgaaggcggagaagtcgtgattacctcagaatatatttttgcaacagacgttgattccgataatctgaagttgatgtttgtaatcgccagggagcctcagcacggggtggtgcggcgcgcaggcgttactgtagatcaatttagccagagagacgttatctcagaggcagtgacctacaagcacacaggcggcgaaattggacttatgccatgctttgatacaatcacactggtggtaagtgacggcgaggctggcccgtttgtgaacgggtgttgttacaacggccccaacccatcagtcccgttgcacgcaagcttccccgtgtacgacttgaacatcactgtctatcctgtggataatcagcccccatcgatcgcaattggaccagtttttgtcgtcgatgagggttgctcgacagccctgactgtgaaccacttatctgcaacagatcccgacacagcagccgatgacttggaatttgtgctggtgtctcctccgcaatttggttatcttgaaaacattctgccgagtgtcggattcgagaagtctaacattgggattagcattgacagcttccagtggaaggatatgaacgccttccacatcaactacgtccagtctcgccacctaagaattgagccaaccgccgatcagttcacggtatacgtgactgacggcaaacaccatagtctcgaaatacctttcagtatcataatcaacccaacaaatgacgaggcccccgactttgttgtgcaaaacattaccgtgtgtgaagggcaaatgaaggagctcgactcttcaattatctccgcagttgacctggacatccctcaggatgctctcctcttctctatcactcaaaaaccccggcatggactcctgattgatcggggcttctccaaagatttcagcgagaataagcagcccgcaaacccccatcaaaagcacgccccagtccattcattttccatggagctacttaagacaggcatgaggctgacatacatgcacgacgacagtgagtctctcgcagatgactttaccatacaattgtcagatggaaaacataagatcttgaaaaccatttcagtggaagtaattcccgtgaacgatgagaagccaatgctcagcaaaaaggcagaaattgcaatgaatatgggcgagacgaggatcatcagctcagctattttatctgctattgatgaggatagtccacgggagaagatatattatgtgttcgaaagactcccccaaaacgggcagttgcagctgaagatcggcagggattgggtaccactctccccgggcatgaagtgcacacaggaggaggtggaccttaatctcctgcgctatacccacacaggggcaatggactcacagaatcaggattccttcaccttttacttgtgggacggcaataatcgaagccctgccctagattgtcagatcactattaaggacatggaaaagggtgacattgttatcttaacgaagcctctcgtcgtatccaagggggataggggctttttaactacaactacacttctcgccgtcgacgggacggataagccggaggagctgctgtatgtgattacctcgccacctcgctatgggcaaattgaatacgtgcattatccgggagtccccatcaccaatttctcacaaatggacgtcgtgggccaaaccgtttgctacgtgcataagagcaaggttacggtgagctcagaccgctttcggtttattatctccaatgggctgcgaacggagcatggagtatttgaaatcaccctcgagacggttgaccgagcgctccccgtcgtcaccaggaataaaggtttgcgcctggctcagggcgcagttggtctgctgtctccagacctgctgcagttaacagaccctgacactcccgcagaaaacctcaccttcttgctggtgcagctgcctcagcacgggcagctctatctgtggggaactggactcttgcagcacaacttcacccagcaagatgtggactcaaagaatgtcgcataccgacattccggaggggactcacaaaccgattgcttcacctttatggcaaccgatggtacaaaccagggattcatcgtcaacgggagagtgtgggaagagccggtactctttaccatccaagtggaccagctggataagacggcccctcgaataacactccttcatagtccgagtcaggtcggcctcctgaagaacggatgttacggcatctacatcacctctcgtgtgctgaaggctagcgatcctgatacagaggatgaccagattatctttaagatactacaaggaccaaaacacggacacctggagaataccaccaccggagaatttattcatgagaaattctcgcagaaggacctgaactcaaagaccatcctgtatataataaatcctagtctcgaggtgaactcagatactgtcgagtttcagattatggatccgacgggcaattccgctacaccgcagatcctcgagctcaaatggtcacacatcgagtggtcacagaccgaatatgaagtatgtgaaaatgtcgggctgttgccattggagataatcagacgcggctactccatggacagcgcattcgtcgggattaaggtcaatcaggtaagtgccgcagtcggtaaagactttacagtgattcccagtaagttgatacagttcgatccaggaatgagcactaagatgtggaatattgcaattacatatgatggcctcgaggaagatgatgaagtctttgaggtaatcctgaactcacctgtgaatgccgtccttggcacaaagaccaaggctgccgttaagattctcgacagcaagggagggcagtgtcacccctcttactccagcaatcagtccaaacattctacttgggagaagggaatatggcatctgcttcccccggggtcatcttcttcgaccacaagtggttcctttcacctcgagaggcgtcccctgcctagtagtatgcagctcgcggtgataaggggtgatacactgcgtggcttcgacagcacagacctttcccagagaaaacttcggacacgcggcaatgggaagaccgtcaggccgtcatccgtgtacagaaatgggaccgacataatttacaattaccacggcatcgtaagcctgaagttagaagacgacagtttccccacacataagcgtaaggcaaaagttagcattatatcacagccacaaaaaactatcaaagttgcggagctaccccaggcagacaaggtcgaatctacaactgactcacacttccccagacaggaccagctcccgagcttcccaaagaactgcactttagagctgaaaggcctgttccactttgaagagggcatacagaagctctatcagtgtaacggcatcgcctggaaggcctggtcaccccagaccaaagacgtagaggacaagagctgccccgccgggtggcaccagcattctggctattgccacatactaattaccgagcagaaagggacctggaacgcagccgctcaagcttgcagagagcagtatttgggcaatttggtgactgtgtttagccggcagcacatgcggtggctctgggatattggcgggaggaagagcttttggattggcctcaatgatcaggtgcacgcagggcattgggaatggattggcggcgagccagtagccttcaccaacgggcgccgggggcccagtcagagaagcaagctcggcaagtcatgcgtcctggtccagcgccaagggaaatggcagactaaggattgtcgacgagctaaaccccacaactatgtgtgttcccgtaagttgtag

SEQ ID NO: 117477 - DNA, 6543 bp, Artificial Sequence
  Description of Artificial Sequence: Synthetic coding sequence
atgaactccctgagctggggcgctgccaacgcagtgctattgcttctcttgctggcctgggccagcccgacattcatttctatcaatcggggagtgagggtgatgaaagggcatagtgccttccttagcggcgacgacttgaagttcgcaattcccaaggagaaagatgcctgcaaagttgaagtggtaatgaacgaacccatcactcagcgggttgggaaactgactccacaggtattcgactgtcacttcctccctaatgaagtcaagtatgtccacaacggttgtccaattctggacgaagacacagttaagctccggctttacaggtttaccgaaagagatacatttattgagacatttatactgtgggtgtaccttctcgaacctgattgtaacataatccacatgtctaataacgtactcgaggtgccagagttcaatgggttgtctcaggccatcgacaaaaatctcctgcggtttgattatgatcggatggcgtcgttagagtgcacagtgagccttgacactgcacggactcgcttaccagctcatggccaaatggtgcttggggagcctaggcctgaggaaccgcgtggagaccagccccactccttctttcccgagagtcagcttcgggcaaaactcaagtgtcctggcggatcctgcacacccggcttaaaaaagatcggatctctcaaggtttcctgcgaagagttcctcttgatgggtctgcgctaccagcatctagacccgccaagccccaatatcgactacatttcaatccaattagatctgacagatacccgcagtaagattgtgtacaagaaatctgaatctgcctggctgcctgtgtatatcagagcaggaattcccaaccagatccccaaggctgcatttatggcagtgtttatcctggaagtagaccaatttatcttaacatccctgaccacgtcggtccttgactgtgaggaagacgagacccctaaaccactgctggttttcaatataacaaaagcccccttgcagggctatgtcacccaccttcttgatcacacgagaccaattagtagctttacttggaaagacctaagcgatatgcagatcgcctaccagccacccaattctagtcatagcgaacggaggcatgatgaagtagaattagaggtgtatgatttttttttcgagcgctcagcccctatgacagtccatatatctatacgaaccgctgatacaaacgcgccgagagtgtcatggaacacgggattgtctctgctggaggggcagtctcgggccattacgtgggagcagttccaagtcgtagataacgacgacatcggcgctgttcgtctcgtgactgtcggtggccttcaacatggctggctcactctcagaggtggaaagggattcctgttcaccgttgctgacctgcaggcaggggtggtccggtaccatcatgacgatagtgattctactaaagacttcgtggtcttccgcatctttgacggccatcattccatacgtcacaaatttcccattaacgtgctgcccaaggacgactctccacccttcctgatcaccaacgtcgtgattgaattggaggagggacagacaattttgatccaggggtccatgctgagggcgagtgatgtcgacgcttcagacgactacattttctttaacattaccaagccaccacaggctggagaaatcatgaagaagcctgggcctggcctgatcgggtatccagttcatgggtttctgcagcgcgacttgttcaacggcataatatactaccggcacttcggaggagaaatcttcgaggacagctttcagtttgtattgtgggatagccatgaaccacccaacctctccgtaccgcaagtggctacaatccatattacaccagttgacgaccagcttcccaaggaggctccaggtgtctctagacatctggtggttaaggaaaccgaagttgcatatataactaagaaacagctgcactttattgactccgagtcttatgatcgtgaattagtctatacaataacaaccccgccatttttcagtttctctcataggcacctggacgccggcaagctgtttatggtggatagcattcccaaggttgtgaagaaccctaccgccctggagcttcgttcatttacccaacatgcagtgaactatatgaaagttgcctatatgccccccatgcaggatattggacctcactgccgggatgtgcagttcacattcagcgtgagcaatcagcatggcggaaccctacatggcatctgcttcaacattacgatcttgccagtcgacaatcaagtgcctgaagcttttacaaatccactcaaagtgacagagggggggcagagcatcatttcaaccgagcacattctgattagtgacgccgacactaaacttgacaatattgatttgtctctccgcgaattacccctgcacggtagagtggagctgaacggtttcccgcttaattccggcgggacctttagctggggggatttacacactcttaaagtccgctatcagcacgacgggacagaggtacttcaggacgacctgctgctggaagtgacagacggcactaatagcgcggagttcgttctccatgttgaagtcttcccagtcaacgacgaacccccggttttgaaggcagatctgatgcctgtgatgaactgcagcgaaggcggggaggtggtgataacatcagagtacatttttgccaccgacgtcgatagtgacaacctaaaattgatgtttgttattgccagagaaccccagcatggcgtcgtgagacgggctggggtgactgtggaccaattttcacaacgtgatgtaatctcagaggccgtgacctacaaacacaccgggggggaaattgggctcatgccatgctttgacactatcaccctcgtagtatctgacggagaggcgggcccattcgtgaatggctgctgctacaacgggccaaatccatctgtgccattacacgcctctttccccgtgtatgacctgaacattactgtttacccagtggataatcaacctccaagtatcgctattggacccgtttttgtagttgacgaaggttgtagcaccgctctcaccgtcaaccaccttagcgcgacagacccagacacagctgcagatgatctcgaatttgtgctcgtgtctcctcctcagtttggatatttagagaacatcctcccgtctgtgggattcgagaaatcgaacattggaatttccatcgatagcttccagtggaaagacatgaacgcgtttcacataaattatgttcagtccagacaccttcggattgaacccacagccgaccagtttaccgtctacgtgacagatggcaagcatcattcgctcgagatcccgttctcaattatcatcaacccaacaaacgacgaggcgccagacttcgtcgtgcagaacatcacagtttgtgaggggcagatgaaagagttagattcaagtattatttccgccgtggatctggatatccctcaggatgcactgctcttctctatcactcagaaacctcggcatgggttgctcattgatcggggtttcagcaaggacttttcagagaacaaacaacccgccaaccctcatcagaaacatgcccctgtgcatagtttctcgatggaactgctgaaaacagggatgcgtctaacttatatgcatgacgactccgagtccctggccgatgactttactatccagctctctgatggtaaacacaaaattcttaagacaatatccgtcgaagtgataccagtgaacgacgagaaacccatgctttctaagaaagctgagatcgccatgaacatgggtgaaaccagaattatatctagcgcaattctgtccgcaatcgacgaagattcaccaagagaaaagatttactatgtgtttgagagattacctcagaacggccagctccagctgaagataggcagagactgggtgcctctcagtccgggcatgaagtgtacacaggaagaggtggatctgaatctgttgagatatacacataccggagccatggactcccagaaccaggactcttttaccttctacttatgggacggcaacaatcgctctcccgccttggattgccagattaccatcaaagacatggaaaaaggcgacatcgtaattctcacaaaacccctcgtcgtgtctaagggagatcgcggattcctgactacgaccacactgctcgctgtggacggtactgacaaaccagaagaactactatatgtgataacttcaccaccacggtacggtcaaatcgagtatgtgcattaccccggggttcctatcacaaacttcagtcagatggacgtggtgggccagaccgtgtgctatgtccacaagagtaaagtaacagtcagctcagatcgatttagatttattattagtaacggactgcgaaccgagcatggcgtgttcgagattacactcgagacggtggacagagctctaccagttgtcacccgcaacaaaggcttaagactagcgcagggggcagtgggattgctgtctcccgatcttctgcagctgaccgacccagacactcccgcagagaatctaacctttcttctcgtgcaactcccacagcacggccaactgtacctttggggaactggactgctgcagcataactttactcaacaggatgttgatagtaaaaacgtcgcctaccgccacagtggaggagacagccagacagattgcttcacctttatggctaccgacggcacgaatcagggcttcatcgttaacggtcgggtctgggaggagcccgtcctctttaccattcaagttgaccagctcgataagactgctcctaggattactctacttcacagcccttcgcaggtcggactactcaaaaatggttgctatggtatctatattaccagccgtgtacttaaagcctccgaccccgatacagaagatgaccagatcatctttaagatcctgcagggccccaagcacggccacttggagaatacgacaacaggggaatttattcacgaaaagttttcccagaaagatctcaactcaaagaccatcctgtacattattaacccatctctggaggtgaattcggacactgtggagttccagatcatggatccaaccggcaactccgccaccccacagatacttgagttgaagtggagtcacattgaatggtcccagaccgagtacgaggtttgtgagaatgtggggcttctgccactggagatcatccggcggggctactcaatggacagcgcctttgtcggtataaaagtaaaccaagtgtcagccgcagtgggtaaggacttcacagtgattccaagcaaactgattcagtttgaccctgggatgagcacgaagatgtggaacatagccatcacttatgatggactggaagaggatgatgaagtcttcgaggtcatcctgaatagtcccgttaacgctgtgttgggcactaaaacgaaggccgcggtgaagatcttagactccaagggggggcagtgccatcccagctattctagtaatcaatctaaacactcaacatgggagaaggggatttggcatctcctcccgcctggcagttctagctcgacgacttcggggtcttttcatctcgaaaggcgtcctctccccagtagtatgcagcttgccgtaatccggggtgacacactccgaggttttgattctacagatctgtcccagagaaaactgagaactaggggtaatgggaaaaccgtccgtccttcttccgtgtatagaaacggcactgatatcatctataactatcatggaattgtgagcttgaaactcgaggatgattcttttcccacccacaaacgaaaagccaaagtctcaattatatcccaacctcaaaaaaccattaaggtggctgagctgccccaggccgataaggtggaaagcactaccgattcccactttcccaggcaagaccagcttccgtccttccctaagaattgcactctggagttgaagggcctgttccatttcgaagagggcattcaaaaattgtatcagtgtaatggcattgcttggaaagcctggtccccgcagactaaagacgtcgaggataagtcctgccctgcgggctggcaccagcactcggggtactgccacattctgattaccgaacagaagggaacgtggaatgctgccgcacaagcttgccgggaacaatatctggggaatctggtcaccgtgttttccagacagcatatgcgctggttatgggatattggaggccgaaagagtttttggatcgggctgaacgaccaagtgcacgccggccactgggagtggatcggaggcgagccagtggcctttacaaacgggcgcaggggaccgagtcagcgatctaaactgggcaaaagttgcgtcctcgtccaacgccaggggaaatggcaaaccaaggattgtcgaagagccaagccccacaattatgtgtgttccaggaagctctag

SEQ ID NO: 117478 - DNA, 648 bp, Artificial Sequence
  Description of Artificial Sequence: Synthetic coding sequence
atgctcgatgagtccttggctgttcggcgcagtaaaaaatgcaaagagatgatcatgcattgggagaagaaggaggatatcgatattgtgaataccgtggatcagctggataagacagcaccaaggatcacgctcttgcacagcccatcacaggtgggcctgctcaagaacggctgttacggcatttatatcactagtcgtgtgctgaaagcctctgatccagacacagaggatgatcagattatattcaagatcctacaaggaccaaagcatgggcaccttgagaacaccactacaggagagtttattcacgaaaagttttctcagaaggatctaaacagcaaaacaattctgtacattattaatcccagcctggaagttaattcagatactgtcgaatttcagattatggatccaaccgggaatagcgccaccccgcagatcctggaactgaagtggtcccacatagaatggagtcagacagaatatgaggtgtgtgagaatgtcggtctcctcccccttgagataattcgccggggatattcaatggatagtgcctttgtcggaatcaaggtaaaccaggtgtcagcagccgtgggcaaagatttcactgttatcccgagtaaactaatccagttcgatccgtag

SEQ ID NO: 117479 - DNA, 2148 bp, Artificial Sequence
  Description of Artificial Sequence: Synthetic coding sequence
atggtgacccaggagtctatgctgaaggccgccttacctctgttcaccaggttcatcatatccaatggcttgaggaccgagcatggcgttttcgagataacacttgagaccgtggatcgagcactgcctgtggtgaccagaaacaaggggctacgcctggcacagggcgctgtcggcctgttgagcccagacctcctgcaattaaccgatccggacactccagccgagaatctgaccttcctgctggtacagctcccacagcatgggcagctgtacctgtgggggactgggctccttcaacacaattttacacagcaagacgtcgactcaaagaatgttgcctaccggcattccggcggcgattcccagactgattgcttcacttttatggcgaccgacggtaccaaccaaggatttatagtcaatggccgagtgtgggaggagcccgtactgtttacaatccaggtcgaccagctcgataaaaccgctcctcgtataacactgctccacagcccttcccaagtcggtttacttaaaaacgggtgttacgggatttatattacaagccgtgttcttaaagcctcagaccccgacactgaggatgatcagattattttcaaaatactgcaggggccaaagcacggccatcttgaaaacaccaccaccggagaattcatccatgagaagtttagccagaaagatcttaattccaagacaatcctgtatattattaacccaagtctggaggttaattccgacaccgtggaattccaaatcatggaccctactggaaattccgctacgccccagattctggagcttaagtggagccacattgaatggtcccagacggaatatgaagtctgtgaaaacgtggggcttctgccattagaaatcattcggaggggttattctatggactcagccttcgtgggtataaaggtcaatcaagtcagtgctgccgtgggcaaagatttcactgttattcccagcaagttgatacaattcgaccccggcatgagtaccaagatgtggaatattgctatcacgtacgatggactagaagaagacgacgaggtatttgaggttatcctgaatagtcccgtgaatgctgtgttaggtaccaagactaaagccgctgtgaaaatattggattcaaagggtggacaatgccacccgtcgtactcctcgaaccaaagcaaacactctacctgggagaaaggcatttggcacctactcccaccgggcagttcatcatcaacaacctcaggaagcttccaccttgaaagacggcccctccctagcagtatgcagctggcagtgattagaggtgacacactacggggatttgactctacagatttgagccagaggaagttgaggacccgcggaaacggtaagacggtgagaccctctagcgtctaccggaacggcaccgacataatctacaattaccatgggatcgtttccctcaagctcgaggatgatagttttcctacgcacaaaagaaaagctaaggtgtccatcatatcacagcctcaaaaaacaattaaggttgccgaactgcctcaggctgacaaagtggagagcactacagatagccattttccacggcaggaccagctgccctcgtttcctaaaaactgtacacttgagctcaagggtctcttccacttcgaagaaggcatacagaaactttatcagtgtaacggcatcgcttggaaggcttggtccccgcagacaaaagatgtggaagacaaaagctgtcctgccgggtggcaccagcacagtggctactgccacatactgatcactgagcagaaaggaacttggaatgcagctgcccaagcttgccgggaacaatatcttggcaatctcgtcaccgttttctctcggcaacatatgaggtggctgtgggatatcggtggaagaaagtcattctggatagggctcaatgatcaggtccacgccggacattgggaatggattggaggagagcccgttgctttcaccaatggccgacggggcccttcacagcgcagcaagttggggaagtcgtgtgtgcttgtgcagagacagggaaagtggcagactaaagattgtcgccgcgctaaacctcacaattacgtctgttctcgcaagctgtag

SEQ ID NO: 117480 - DNA, 6540 bp, Artificial Sequence
  Description of Artificial Sequence: Synthetic coding sequence
atgaactctctgtcatggggagctgctaacgcagtgctgttgttacttttgttggcatgggcaagtcccactttcataagcattaatcgaggagtgcgcgtgatgaaaggccacagtgcttttctttcgggggacgacctcaaattcgcgatccctaaggaaaaggacgcttgtaaagtagaagtggtgatgaatgaacccattacccagcgagtggggaagcttacccctcaggtgttcgactgccacttcctccctaatgaagtgaagtacgtacataatggatgtccgatcctggacgaggacacagttaaactacggctctatcggttcaccgaacgagatacattcatcgagacttttattttatgggtgtaccttctcgaacctgattgcaatataatccacatgtcgaataacgtgctcgaggttcctgagtttaacgggttgtcccaggcgatagacaagaacttactgcgcttcgactatgataggatggccagccttgagtgtacagtgtccctagatacggcccgcactcgactgccagctcacgggcagatggttctgggcgaacctcggcccgaggaacctcgcggagaccagcctcatagcttctttcccgaatcacagctgcgagccaagctgaaatgcccaggcggcagctgcacgcctggactcaaaaagatcggctccctgaaagttagttgcgaggagttcctccttatgggcctgcggtaccaacacttggaccctccctcacctaacattgactatataagtatccagttggacctaaccgacacacggtctaagattgtgtataagagcgaaagcgcatggctaccagtctatattagggccggcattccaaaccagatccccaaggccgccttcatggccgttttcatcctggaagttgatcagtttatcctcacaagcttaaccacctcggtgctcgactgtgaggaagatgaaaccccaaagcccctgctggtgtttaatataaccaaagcgcccctgcagggctacgtgacccacctgctcgatcatacccggcccatcagctcatttacatggaaggatctcagcgacatgcagatagcctatcagccccctaactccagtcatagcgagagaagacatgatgaggtggagcttgaagtatacgacttctttttcgagcgctccgccccaatgactgtgcatatttccattcggactgccgacaccaacgccccacgagtatcatggaatacggggctgtcactgttggaaggtcaatcgcgcgccatcacttgggagcagttccaggttgtcgacaatgatgacatcggagccgtccgcctcgttaccgtcggcggactgcaacacggttggctcacattgaggggcggaaagggctttttgtttacagtggcagacttacaggctggcgttgtaagatatcatcacgatgatagtgactcaacaaaggactttgtagtgttcaggatcttcgacggtcaccatagcatacgccataagttccccatcaatgtgctccctaaggatgacagtccacctttcctcatcactaacgtagtaattgagctagaggagggccaaacaattctgatccagggaagtatgctccgcgccagcgatgtggacgcatccgacgattacatatttttcaatataacaaagcccccccaggctggtgagatcatgaaaaaaccggggcccggactgatagggtatcctgttcacggatttctgcagagagacctcttcaatggcatcatctattaccgtcactttgggggggaaatctttgaagattcatttcaatttgtgttgtgggactcacacgagccacctaatctctcagtccctcaggtggctaccatacacatcacccctgtcgatgaccagctgccaaaggaggcacccggcgtcagccggcatctcgtcgtcaaagaaactgaagtcgcttacattaccaagaagcagttgcactttattgactccgagagttacgatagggaactcgtgtacaccatcaccactccaccattcttctccttctcccaccgacacctggacgcagggaaactgttcatggtggacagtatccctaaggtggtcaagaatcccacggccctggaacttcgttccttcacccagcacgcggtgaactacatgaaagtggcctacatgccacccatgcaagacatcggcccacactgccgcgacgtgcaattcactttctctgtgtcgaaccagcatggaggaactctgcatggcatctgtttcaatatcactatcctcccggtggacaatcaggtgcccgaagcctttaccaatcctttgaaggtgaccgagggcggccagtctatcatctccaccgagcacatactgatcagcgatgctgatactaaactcgataacatagatctttcattacgcgagctacccctgcatggacgtgtggagttgaatggcttcccattaaattcaggtgggacctttagttggggcgacttgcacacactgaaggttcgataccagcacgacgggacagaagtgctccaggatgatttgctgctagaggtaaccgacggtaccaattcagccgagtttgttttgcacgtcgaagtgttcccagtcaatgatgagcctcctgtgctcaaggcagatctgatgcctgtcatgaattgtagcgagggcggcgaggtcgtgattacctccgagtacattttcgccaccgatgtggactcggacaatctcaagctcatgttcgtgatagcacgcgagccacagcatggtgttgtgcggagggcgggtgtcaccgtggatcagttctctcagcgtgatgtgatttccgaagcagtcacgtacaagcatactgggggcgagattggcttaatgccctgctttgatacgatcactctggttgtgagtgacggcgaagctggaccgtttgtgaacggctgctgctacaacggcccgaatccgtccgtcccactgcatgcttcattccctgtttatgatttgaacattactgtttatcccgtcgataaccagccccccagtattgcaataggccccgtgttcgttgtggatgaaggctgctctacggctctcaccgtgaaccatttgagcgctacagaccccgacaccgccgcagatgacctggagtttgtgctggtcagcccccctcagttcggttacctcgagaacattcttccaagcgtagggttcgaaaaatctaatattggaatttccatagacagctttcagtggaaagacatgaacgctttccatattaattacgttcagtccaggcacctgaggatagaaccaacagccgatcagtttactgtctacgtaacagacgggaagcaccactctctggaaatacctttcagcatcatcattaatcccaccaacgatgaagctcctgactttgttgttcagaacattactgtgtgcgagggccagatgaaggagcttgattcttcaatcatcagtgctgttgatcttgacattccacaagatgccctactcttctcaattacgcaaaaacctagacatggcctcctcattgatcgaggcttctctaaggatttcagcgaaaacaaacagcctgctaatccacatcagaaacacgcaccggtacattctttctcaatggaactactcaagaccggcatgagactgacatacatgcacgatgactcggagagcctggcggatgattttactattcagctgagcgatggtaagcataagattctgaagacgatttcagtcgaggtgattcctgtgaatgacgagaagccgatgctttctaaaaaagccgaaattgctatgaatatgggggagactcgaatcatcagcagcgcgattctttctgctatcgacgaggattctcctagagagaagatctactacgtgtttgaacggctgccgcagaatggacagttacagctgaaaattggcagagactgggttcctctgtccccaggcatgaaatgcacccaagaggaggtggacctcaacctactcaggtatactcacaccggcgccatggactcacaaaaccaagactctttcaccttttacttgtgggatggtaacaatcgctctccagccctggattgccagattacaatcaaggacatggagaaaggggacatcgtgatactgactaagccattggtagtgagtaaaggcgacaggggcttcttaacaaccaccaccttgctcgctgtagatggtaccgataagccagaggagctgctctacgtgattactagcccccctcggtacgggcagattgagtacgtccactacccaggagtacccatcaccaatttctcgcagatggacgtggtagggcagactgtctgttacgttcataagagcaaggtgaccgttagtagtgacagatttcgttttatcattagtaacggattgagaaccgagcacggggtttttgagattactctggaaacagtcgaccgcgcgcttcctgtggtcacccgcaacaaaggcctgagacttgcccagggagctgtgggcctgctgtcccccgacttgctgcagttaactgatcctgacactcctgctgaaaacctcacatttctgctggtacagctgccccagcatggtcagctgtatctctgggggaccggcctcctgcagcacaactttacacagcaagatgttgactccaaaaacgtagcctaccgccatagcgggggggatagccagacggactgcttcacgtttatggccacagacgggacaaaccagggatttattgtcaatggtagggtgtgggaggaaccagttctctttacaatccaagttgatcaactggacaaaacagcgcccagaattactcttctacattctccatcccaggtgggcctgctgaagaatggctgttacgggatctacatcacctcacgtgtgttaaaggcgtctgatcccgacaccgaagatgaccagattatctttaagattctccagggccccaagcatggccacctggagaatacaacaactggcgaatttattcacgagaaattttctcagaaagaccttaacagtaagactatactgtatatcatcaatccaagcctcgaggtcaattctgacactgtcgaattccagatcatggacccgacaggaaacagcgcaacacctcagatcctggagctcaaatggagtcacatagagtggtctcagactgagtacgaagtttgcgaaaacgtggggctcctcccactggagatcatcagaagaggctacagcatggattctgcattcgtgggcattaaagttaaccaggtatcagctgccgtgggaaaagactttaccgtcatcccatccaagctgatccagttcgatcccgggatgtcaacaaaaatgtggaatatagccattacgtatgacggcctcgaagaagacgacgaggtgtttgaggtcatactgaactcgcccgtgaacgctgtgctgggaaccaagacgaaggctgcagtaaagattctggattcaaagggcggacagtgccatcccagctattccagtaatcagtctaaacacagcacctgggaaaaagggatttggcatctgttacctcccgggtcttcttctagcaccacatccgggtccttccatctggaacgcagacccctcccctccagcatgcaacttgccgtcatccgcggggacacactccgtggatttgattctaccgatttaagccaaagaaagttgcgaaccagggggaatgggaagactgtgagaccaagctcggtttaccgcaatggaaccgatattatatataactatcatggcatcgttagcctgaagttagaggatgacagctttccaacgcacaagcgcaaagcaaaagtgagcatcataagccaacctcagaagaccatcaaggtggcagagctcccccaagctgataaagtggaaagcacaaccgacagccacttcccccggcaggatcagttgccctccttcccaaaaaactgcaccctggagctcaaagggttatttcacttcgaggaaggtatccaaaaactttatcagtgcaatggcatagcctggaaggcttggtctccccagaccaaagacgtcgaagataagtcgtgcccggctggttggcaccaacattcaggttactgccacatcctgatcacggaacagaaaggaacttggaatgcggccgctcaggcctgccgggaacagtacttggggaatttggtaaccgtcttttcccggcagcatatgaggtggctgtgggacatcggcggtcgcaaatccttctggataggactgaatgatcaggtgcacgccggccactgggaatggattggcggggagcccgtggcattcactaatggccgacgcggtcccagccaaagatcaaagttgggaaagtcttgcgtgctcgtccaaagacaagggaagtggcagacaaaagactgcagacgtgcgaagcctcacaactatgtctgcagtcggaagctgtag

SEQ ID NO: 117481 - DNA, 9510 bp, Artificial Sequence
  Description of Artificial Sequence: Synthetic coding sequence
atgcattcagccggcaccccaggcctgagcagccgcaggactggcaactccacctctttccagccgggtccaccccccccacccaggcttctgttacttctattgctactgcttagcctggtatcccgggtgccagctcagcccgcggcttttggcagggccctcctgagccctggcttggctggtgccgccggggtcccagcggaagaggctatagtgctggctaaccggggactgcgcgttccattcggcagggaagtgtggctagacccgctgcatgacttggtactgcaggtccagcccggcgatcgttgcgcagtttcggtgttagacaatgacgctcttgcccagagaccagggaggctgagtccgaaacggttcccctgtgattttgggcccggggaggttcggtacagtcatttaggcgcccgcagcccgtctcgcgacagagttcgcctgcagctccgctacgacgcccccggaggggccgtggtcctgccactagttctggaagtagaagtggtgtttactcagctggaggtagtgacgcggaatctgccattggtcgtggaagagttgttaggtacctcgaatgctctggacgctagatctcttgagttcgcatttcagcccgagaccgaggagtgcagagtgggaatcctttctggcctaggtgccctgccgcggtatggtgaactgcttcattacccacaagtgcccggcggcgcccgagagggcggcgcccccgaaactctcttaatggactgtaaggcgtttcaggagcttggtgtgcggtaccgacacactgcagcctcccgttctcctaaccgagactggattcctatggtggtcgagctgagaagcagaggagcacccgtggggtcccctgcactgaagcgggagcatttccaagtccttgtgaggatccgaggcggggccgaaaacacagcacccaaaccttcgttcgtcgcaatgatgatgatggaagtggatcagtttgtcctgaccgctctgaccccggatatgctggccgctgaggacgccgagagtcccagcgatctgctgattttcaatctcacgtctccattccagccaggccagggttaccttgtttctacagacgatcgctccctgcccctttctagttttacacagcgagacctccgtctgttgaagattgcctatcagccgcctagtgaggactccgaccaggaacgcctgtttgagctggagctagaggtcgtggatctggaaggcgctgcctctgaccctttcgcctttatggttgttgttaagccaatgaatacaatggcacctgtcgtcacccggaacaccgggctgattttatacgagggccagtctagaccattgactgggcccgcgggatccggaccccaaaatctggtcattagcgatgaggatgatcttgaggcagtgagactggaggtggtagctgggcttaggcacggccacctggtgatcctaggcgccagttccggatcatctgccccaaaaagctttacagtagcagaactggccgcaggccaggtggtctaccaacatgacgacagagacggcagtctcagcgacaacctggtcctgagaatggttgatggcggaggtaggcaccaggtgcagtttcttttccctattacattggtgcccgtggacgatcaaccgcctgtgctgaatgcaaacaccggcctgacgctggcagaaggcgagactgtacctattctgccactgtccctcagtgcaacagacatggacagcgacgactccctactacttttcgttttagaatcccctttcctgactactggccatcttctgcttcgccaaactcaccccccccatgagaaacaggaacttttgcgtggactgtggcgcaaggagggggccttctacgagaggactgtaacagaatggcaacagcaagatatcaccgaaggcaggttgttttaccggcattctggtccccattctcctggtcccgtgaccgaccagttcactttcagagtacaggacaatcacgatcccccaaatcaatccggcctccagcggttcgtaatccggatacatccggttgatcgcctgcctcccgaactcggcagcggttgtcctttgaggatggtggtacaagaaagtcagctcactcctctgaggaagaagtggctgaggtacacggacttggatacagacgacagggagctgcgttacactgtcacgcaatcgccaacggatacagacgagaaccatttacctgctccattggggacactggtgttaacagataatccttctgttgtggtgactcacttcacacaggcccagattaaccatcataaaatcgcatacaggccacctggacaggaattgggcgtggcaaccagggtagcccagtttcagtttcaggtggaggatcgtgccggcaatgtcgcaccgggcacgtttacactgtaccttcaccccgtcgataaccaaccccccgaaattttaaataccggcttcacaatccaagagaagggccaccatatcctttcagagaccgaactgcacgttaacgatgtagacacagacgtcgcccacatttcctttaccctaacacaggcgcctaaacatggccacatgagggtatcaggccagatcctccacgtaggtggactctttcatctggaagatatcaagcagggccgtgtatcgtacgcccacaacggggataaatctctcacagatagttgcagtttggaggtgtccgatcggcatcatgtggttcctatcaccctgcgagtgaatgttcgccctgtggacgacgaagtgccaatcctgtcgcacccgactggtacactcgagagctacctggacgtcttggagaacggggccacagagattactgcgaacgtgataaaaggtactaacgaggaaacggatgatctgatgcttacattcctcctggaggatccacctctttacggcgagatcctcgtcaacggcatccccgctgagcaattcactcagcgggatatactggagggcagtgtggtttacacccatacaagcggcgagattggattattacctaaagcagattcgtttaatctctctttgtccgacatgtcgcaggagtggaggataggcgggaacaccattcagggcgttactatttgggtaactattctgccagtggatagccaggcacccgagatttttgttggcgaacagcttattgtgatggagggcgataaaagcgttatcacctctgtccacatttctgctgaggatgtggatagcctgaatgacgatatcctgtgcaccatcgtgatccagcctacgtctggctacgtcgagaacatatcaccagcacctggttcagagaagagccgtgcgggtatagccatcagcgcttttaaccttaaggacctgcggcagggacatatcaattatgttcaaagtgtgcataaaggagtcgagcccgttgaggaccgcttcgtatttcgatgtagcgatggcattaatttcagtgaacgacagttctttcctatagtgatcatcccaaccaacgacgaacagccagagatgttcatgagggagttcatggtgatggagggcatgtctctcgtcatcgacactcctattttgaatgctgcagacgctgacgttcccttggacgacctcacttttaccattacacagttccctacccatggacacataatgaaccagctcattaacggcaccgtattggtagagagcttcaccctggatcagatcatagagagtagctccattatttacgaacacgacgactcagagactcaagaggacagttttgtaatcaagctgaccgacggaaaacatagcgtcgaaaagaccgtgctgatcatcgtgatcccagtcgatgatgaaaccccacgcatgactattaacaatgggctggagattgaaatcggcgacactaagataattaacaataagattctaatggctaccgacctcgactcagaggacaagtcactggtctatataatcaggtatggtcccgggcacggactgctgcagcgccgaaagcccacaggtgcctttgagaacatcacactcggcatgaacttcacgcaggatgaagtggaccgcaacctcatccagtatgtgcatcttggtcaggaagggatccgagacttgatcaagttcgacgtcaccgacggcatcaatcccctcatcgacagatacttttacgtgagcattggatctattgacatcgtattcccggacgtcatttcaaagggggttagcctaaaggagggcggtaaagtcactttgactactgatcttctgtctacgagcgatctgaactctcctgatgagaatcttgtctttaccatcacccgagctccaatgcgcggccacctcgaatgcacagatcaacctggggtctccatcacctccttcacacagcttcagctagccggcaataaaatatactatattcacacggcggatgacgaggttaagatggatagcttcgagttccaagtcaccgatggccgcaatccagtatttagaacattcagaatctcaataagcgatgtggataataaaaaacctgtggttacgattcataaattggtagtatctgagtcagagaacaaactgattacgccattcgagttgaccgtggaggatagggataccccagataagctactgaaatttactataacccaggtgccgatacacggccatctgctgtttaataacacgcgccctgtgatggtcttcaccaaacaagatctgaatgaaaacctgatttcatacaagcacgatgggaccgaaagttccgaagattctttctcatttactgttacagatggaacccatacagacttttacgtgttccctgacaccgtcttcgagaccagacgcccgcaggtgatgaagatccaagttctcgccgtagataacagcgtccctcaaatagccgtgaacaagggcgcctctactctgcggaccctggccaccgggcatctgggattcatgatcacaagtaagattctaaaggtcgaggatagggatagtctgcacatttcgctgcgatttatcgtcacagaagcaccccagcatggatatctgctcaatcttgataaaggaaatcattccatcacacagttcactcaggctgacattgacgatatgaaaatttgctatgtactgcgcgaaggcgctaatgcgacgtccgacatgttctattttgcagttgaagatggcggcggtaacaaactcacctatcagaactttaggctgaattgggcctggatatccttcgaaaaggagtattatctggtgaacgaggattccaagttcctcgacgtggtgttaaaacgacgcgggtacttgggggagacttcatttatatccatcggcactcgagaccgcaccgctgaaaaagacaaagactttaaggggaaggcccagaagcaagtgcagttcaatcccgggcagacgcgcgctacatggcgtgttaggatcctctcagatggagagcatgagcagagcgagactttccaggttgtgttatccgagccagtgctggctgccctagagttcccaactgtggcaacagtcgaaatcgtcgacccgggcgacgagccaactgtattcataccacagagcaaatatagtgttgaggaagacgtcggtgaattgtttatcccgatccggcgctccggtgacgtgtctcaggagctgatggtagtgtgttacacccagcaaggtacggctacgggtactgtgcccacctcagtgcttagttattcagactatatttcacgacctgaagatcatacttccgttgtacgcttcgacaaggatgagcgagagaaattgtgcagaatagtgatcatcgacgactcgctctatgaggaagaggaaacctttcacgtactgctttctatgccaatgggaggacgcattggatccgaatttccgggtgcccaggtaaccatagtgccggacaaggacgatgaacctattttctatttcggggatgttgagtacagcgtggacgagagtgctggttatgtcgaggttcaggtgtggaggaccggaaccgatctctcaaaaagctctagcgttaccgtgcggagccggaagacagaccctcctagcgccgatgcgggcacagattacgtaggtatctcaaggaacctcgacttcgcacccggtgtcaacatgcagcccgtgagagtagtgatattggatgatctgggtcaacccgcacttgaaggaattgaaaaatttgaattggtgctaaggatgcctatgaacgccgcactgggtgaacccagcaaagccacagtcagtatcaatgattccgtcagcgacctgccaaaaatgcagtttaaggaacgaatttacacaggctcagagagcgacggtcagatcgtgactatgatccatagaaccggcgacgtgcaatacagatctagcgtacgctgctataccaggcaagggtccgcccaggtgatgatggatttcgaggagaggcccaatacggacacatctatcatcacgtttttaccaggcgagactgaaaagccttgtatcttggaactaatggacgatgtgctgtatgaagaagttgaggagctccgcttggtacttggaactccgcagagtaattcaccatttggcgcggcagtgggtgaacagaacgagacattaatacggatacgagatgacgccgataaaactgtgatcaaattcggggaaacaaaattctcagtaacagaacccaaggagccgggcgaatcagttgtgattcggattcccgtaattcgccagggagacacatcgaaggtgtccatcgtgagggtacatacaaaggacggttctgccacgtccggtgaagattatcacccagtttccgaggaaatcgaatttaaagaaggtgagacccaacatgtcgtggaaatcgaggtgaccttcgatggcgtgagggaaatgcgagaggctttcaccgtgcacctaaagcccgatgagaatatgatcgcagaaatgcagctcaccaaagccatcgtttacatcgaggagatgagttccatggcggatgtcacctttcctagcgtccctcagatcgtgagcctcttaatgtatgatgatacttctaaggccaaagagtccgcggagccaatgtctggctacccagtgatctgcatcacagcgtgtaatccaaagtacagtgactatgacaagactggctccatctgcgccagtgagaatatcaacgacacactgaccaggtatcgctggctcatctcagcgcccgcaggtcctgacggggtcacctctcctatgcgcgaagttgacttcgacaccttttttacctcttcaaagatggtgacgctggatagcatttactttcagcctggatctcgggtccaatgtgccgcccgcgcggtgaacacaaacggtgacgaggggttagaattgatgagtcctatcgtaactatctcacgtgaagagggcctgtgccaacctcgagtacccggcgtagtcggggcagagcctttttccgctaagctgaggtatacaggccccgaggacgctgattacacaaacctgatcaaactcaccgttaccatgccccacatcgacggcatgctgcctgtaatctccacgcgcgagctctcaaatttcgagctcacactttcgcctgacggcacccgcgtcggaaatcataagtgttctaatcttttggactacaccgaagtgaaaacccactacggtttcctgaccgacgcaaccaagaatcctgagatcatcggcgaaacatacccctatcagtattccctatccattcgtggaagcacaacactgaggttctatcgcaatctgaatcttgaggcttgtctctgggagttcgtctcttactacgatatgtcagaacttctggcagactgtggaggcactataggcaccgacggtcaagtcctgaacctcgtacagtcttacgtgactttacgggttcccctatacgtatcttacgtctttcattcgccagtgggagtcggcggatggcagcacttcgatttaaagtccgaactgagactgacctttgtttacgacaccgctatcctgtggaacgatgggattgggagtccccccgaggctgagctccagggctcactctacccaacatccatgcggattggcgatgaagggcgcttagccgttcattttaaaacggaagcacaattccatggcttgttcgtcctcagtcacccagcgtctttcacaagctccgtcattatgagcgccgaccacccgggtttgacattcagcctaagactgatccgaagcgagcccacttataaccagcccgttcagcagtggagctttgtgtccgactttgcagttagggactactccggaacgtataccgtcaagctggtgccttgcacagctccatctcatcaagaatataggctcccagtgacttgtaatcctcgcgaacccgtgaccttcgatctggacattcgcttccagcaagtttccgatcccgtggccgccgagtttagcttgaacacgcaaatgtacctgctctctaaaaagagcctgtggttgagcgatggaagcatggggtttggccaagaatctgacgtagcgtttgcagaaggagacattatatacggacgggttatggtcgacccggtgcagaaccttggcgactctttctactgcagcattgaaaaggtctttctatgtaccggcgccgacggctatgtccccaagtacagcccgatgaacgccgagtatgggtgcttggctgacagtccgtctctgctgtacagattcaaaatcgtggacaaagcgcagcctgagactcaggccactagctttgggaacgtgctctttaacgctaaactagctgtggacgatccggaggcgattctgctggtcaaccagcccggttctgatgggttcaaagtcgactccacccctctgttccaagtggccctaggccgggaatggtatatacatacgatctacacagtacggtctaaagataatgcaaatagaggaatcgggaaaaggagtgtcgagtaccacagcctcgtttcacaaggcaagccacagtccacaactaagagcagaaaaaaacgggagattaggtccacgccgtcattggcctgggaaatcggcgcggagaatagcagaggaaccaatatccaacacatcgctctcgaccggacaaagcggcagatcccgcacggcagagcccccccagatggaatcctaccttgggagttgaacagcccgtctagcgcagtttctctagtcacagttgttggtgggaccactgtaggcctgctgaccatctgcctcactgtgattgccgtgctgatgtgtagaggcaaagagtcctttcgcggcaaggacgctccgaaagggtcttcctcctcagaaccgatggtgccccctcaatctcaccacaatgacagcagcgaggtttag

SEQ ID NO: 117482 - DNA, 12039 bp, Artificial Sequence
  Description of Artificial Sequence: Synthetic coding sequence
atgggggtcctaaaggtatggctggggctggccctggctttggcggagtttgccgtactgcctcatcacagcgaaggcgcttgcgtctatcaggacagtttattggctgacgctactatctggaaacccgattcatgtcagagttgcagatgccacggggacatcgtcatatgcaagccagccgtgtgccgcaatcctcaatgcgccttcgaaaaaggtgaagtgttgcaaattgccgccaaccagtgctgtccagagtgcgttctgagaactccagggtcgtgccaccacgagaagaaaatacatgaacatggaactgaatgggcatccagtccttgttcagtctgctcgtgcaaccacggggaagttaggtgtacccctcaaccatgtcctcctctgtcttgcgggcatcaggagctcgcctttattcccgagggcagttgttgcccagtgtgcgtcggattagggaagccttgcagttatgaaggccacgtgttccaagatggggaggattggcggctatcacgctgtgctaagtgcttgtgcagaaatggggtggcccaatgctttaccgcacagtgtcaaccactgttctgcaaccaagatgaaaccgtcgtgcgcgtgcccggaaagtgctgcccccagtgttccgcacgcagttgcagcgccgcgggtcaggtgtacgagcatggcgagcagtggagcgaaaatgcttgtacaacttgcatctgtgaccggggggaagtacgctgccacaagcaggcatgtcttcccttgaggtgcggcaagggtcagagtcgtgctagacggcatggccagtgctgcgaggagtgtgttagcccagcgggtagctgcagctatgacggcgtggttcgctaccaggacgaaatgtggaagggttctgcttgtgaattttgcatgtgtgaccacggtcaggtaacttgccaaactggtgagtgtgctaaagtggagtgcgctcgcgatgaggaactgatccatttagacgggaagtgttgtcccgaatgtatctccagaaacgggtactgcgtgtacgaggagacaggcgagtttatgtcttccaacgctagtgaagtcaagcggatacctgaaggcgaaaaatgggaggacggaccttgcaaggtgtgtgagtgccgtggtgctcaggttacatgttacgagccctcatgccccccctgtccagtgggaacacttgcacttgaggttaagggccaatgctgtcctgactgcaccagcgtgcactgtcaccccgactgtttgacctgttcccagtctcctgaccattgtgatctgtgccaagacccaaccaagctattgcaaaatggttggtgcgtgcactcctgtgggctcgggttttaccaggccggttcattgtgcctcgcctgccaaccccagtgcagtacttgtacgtccgggcttgagtgttcgagttgtcagcccccactgctgatgcgccatggccagtgcgtccccacttgcggcgacggcttttatcaggatcggcacagctgcgcggtgtgtcatgagagttgtgccgggtgctggggcccaacagagaaacactgcttagcctgccgggatcccttgcacgttctgcgggacggcgggtgcgagagtagctgtggaaagggtttctacaaccgccagggtacttgcagtgcttgtgatcagagctgcgatagctgcggccccagctctcccagatgcttaacttgtacagagaagacagtcttacatgacggaaagtgtatgagcgaatgtcctggcggctattacgcagatgccacgggccgatgcaaggtctgccataattcctgcgcctcttgttccggtcccacaccctcccattgtacggcctgctctcctcccaaggcactgcggcaggggcattgcctgcccaggtgtggggaggggttctactcagaccatggggtctgcaaagcctgccactccagttgtctggcctgcatggggcccgctcctagtcattgtaccgggtgtaaaaagcccgaggaggggttgcaggtcgagcaactcagcgatgtcggaatcccttcaggcgaatgcctcgcccagtgtcgcgcacacttctatctggagtcaacaggaatttgtgaagcatgccaccaaagctgtttccgttgcgccggaaaatccccccataattgcaccgactgcggcccgagccacgtccttcttgacgggcagtgtctaagtcagtgtccagatggctactttcatcaggagggaagttgtaccgaatgccaccctacgtgtagacaatgccatggaccactggagtccgactgtattagttgttatccccacattagcctcaccaacggcaattgcaggacgagttgtagagaagagcaattcttgaacctggttggctattgtgccgactgccaccacttgtgccaacattgtgcggccgatctgcataataccggatcgatctgcctgagatgccaaaacgctcactacctcctcctaggagatcattgcgtacccgactgcccttcaggttactacgctgagcgcggcgcctgtaaaaagtgtcacagctcatgtcggacctgtcagggacgtggccctttttcttgtagctcctgtgatactaatctggttctcagccacacggggacttgctcgactacgtgtttccctggtcactatctggatgacaaccacgtttgtcaaccctgtaacactcactgcggctcatgcgatagccaggcctcttgcacgtcctgccgggacccaaacaaagtactgctctttggcgaatgccagtacgaatcatgcgccccccagtattacctcgatttctctacaaacacctgcaaggaatgtgattggtcgtgcagcgcttgttctggcccactgaagacggactgtctgcagtgcatggacggatatgtgcttcaggatggcgcttgtgtggagcaatgtctgagctccttttatcaggactccgggttatgcaagaactgtgacagctattgcctccagtgccaggggccacatgagtgcacacgctgtaagggtccattccttctactagaggcacaatgcgtgcaagaatgcggcaagggctatttcgctgatcacgccaagcacaagtgtacggcttgtccccagggatgtttgcagtgcagccacagggatagatgtcacctttgcgaccacggcttcttcctgaagtccggcttatgtgtctacaattgtgttccaggcttctcggtgcacacgagtaacgagacctgctctggaaaaatacatactccctcactccacgttaacggctccctgattctcccgattggttccataaagccattggatttctccctgctgaacgttcaggatcaggagggcagggttgaggacctgctgttccatgtcgtttctaccccaactaatggccagctcgtgttgtctagaaacggaaaggaggtccagttggataaagcaggtaggttcagctggaaagacgtgaacgagaagaaagtgcggtttgtgcactcaaaagaaaaattacggaaggggtatctgttcttgaagatctctgaccagcaatttttcagcgaaccccaacttatcaatatccaggcatttagtactcaggcaccttacgttcttaggaacgaagtgctgcatatttctcggggggaaagagcaactattaccactcaaatgctagacatccgggatgacgataatcctcaggatgtggtgatagagatcatcgatcccccactgcatggtcaattgctccagacattgcaatctccggcaacccctatctatcagttccagctagatgaactcagtcggggtttactacactatgctcatgacggttcagactccaccagcgacgttgccgtcctgcaggccaacgacggacactcctttcataatattctgttccaggtgaaaacggttccccagaacgacagaggcctccagcttgtcgccaactctatggtctgggtgccagaaggcggaatgctccagatcacaaacaggattctgcaggccgaggcgccaggcgcatcagccgaagaaatcatttataaaataacccaggactacccccaattcggggaagtggtgttactcgtcaacatgccagccgacagccctgcggatgaaggccagcatttaccagacggacgcacagccactcccacctccacgttcacgcagcaggacatcaacgaggggattgtctggtacaggcactccggagctcccgcccaaagcgatagctttagatttgaagtctcatctgcaagcaacgcacagactaggctggaatcccatatgttcaacatagcaatcctgccccaaacgcctgaggctccaaaagtgtctctggaggcatccctacacatgaccgctcgtgaagacggcctgactgtgatccagcctcactctctctcttttattaattcggaaaaaccctctggcaagattgtgtataacatcactttgcccctccaccccaatcaggggatcattgaacacagggaccacccccacagccccatacgatactttacccaggaagacataaatcagggaaaggtgatgtacagacctccaccagctgctccccatctccaggaactgatggccttctcattcgctggccttccagagtccgtcaaatttcatttcactgtatccgacggtgaacacacttctcccgagatggtactgaccatccatcttctgccgagcgaccagcagctgcctgtatttcaagtgaccgctccccgcttggccgtgagccccgggggatctacctcggtgggactgcaggtcgttgtccgggacgcagagaccgcacccaaggagcttttcttcgaattgagacgccctcctcagcacggtgttctgctgaagcacaccgcagagttcaggcgcccgatggctacgggtgacacatttacctatgaagacgtggaaaaaaacgccctgcagtacatccatgacggatcctccacacgggaggactccatggagatctccgtgaccgacggactaacagtcaccatgcttgaagtccgagttgaggtgtcgctaagcgaggatagggggcccaggctggccgcaggctccagtctcagcatcacagttgcaagcaaatccacagctatcatcaccagatcccatctcgcctacgtcgacgacagcagccctgatcctgagatctggattcagctgaattacctgccatcttacggcaccttgttgcggatttcagggtctgaagtcgaggaactatccgaggtgtctaatttcacgatggaggatatcaacaacaaaaagatccgctattccgctgtcttcgagactgatggtcatctcgttacagactcattttactttagcgtgtcagacatggaccataaccacctggacaatcagatcttcactatcatgattactcctgctgaaaaccctcctccagtgatcgctttcgccgatttgattacagtcgacgaaggtggaagagcaccgctgtcctttcatcactttttcgcaaccgacgatgatgacaatctacagagagatgccatcataaaactctccgccctccccaaatacggctgcatcgagaacacaggaaccggcgaccgttttggtcccgaaaccgcctcggatctggaagcttctttcccaatacaagacgtgcttgagaattatatctactactttcaatcagtccatgaatccatcgagcctacccacgatatctttagtttctacgtctcagacggcacatctagatccgaaatccactcaattaacattacaatcgagagaaagaacgacgaaccacctagaatgacacttcagccactccgcgtacagctgtctagcggagtggttatttccaattcaagtctatctttacaagatctggacacacccgacaacgagttgatctttgtgctgaccaagaagccggatcatggccacgttctgtggcggcagaccgcatccgaacccttagagaacggaagagtgctagtgcagggttccacgttcacctaccaggacatactggctggcctggtgggctacgtgccctccgtgccaggaatggtagtcgacgagttccagtttagcctgacagatggtttgcacgtggacactgggcggatgaaaatttacaccgagttgcccgccagtgatactcctcacctggctattaaccagggtttacagctgtccgccggcagcgtggcccggatcactgagcaacacctcaaggtgacagacattgattctgacgaccaccaggtgatgtacatcatgaaagaagatcccggcgctggacgcctccaaatgatgaagcatgggaacctggaacagatcagcatcaaggggcccatcaggagcttcacacaagctgatatatcacaaggacacgtggagtacagccatggaaccggtgagcccggaggttcttttgccttcaaattcgacgtcgtcgatggagagggcaaccgactcatcgacaagtctttctcaatcagcatactagaggacaaatccccacccgtaattaccacaaacaaaggactagtcctagacgaaaattccgtcaagaaaatcaccactctgcagttgagtgccactgatcaagacagcgggcccaccgagctcatctatcgtatcactcgacaaccacagttagggcatctggaacatgccgctagcccaggaatccagattagctcgtttacacaggctgatctgacgtcgaggaatgtccagtacgtgcactcctccgaggctgaaaagcactctgatgccttctcgtttacactgagcgatggggtttctgaggtgacccaaaccttccatattacactgcatccagttgatgactccctccccgttgtccagaatcttggaatgcgggtacaagaggggatgcgaaaaaccatcacagaatttgagctaaaggcagttgacgcggacacagaggccgagtcagtcacctttactatcgtgcagcccccacgccacggaaccattgagagaacctctaacggtcagcactttcatcttacttccacattcacaatgaaagatatctatcagaaccgggtgtcctactcgcacgatggctctaatagtctcaaggaccgatttactttcaccgtgtcggacggtaccaatccgttctttatcatcgaggagggcggaaaggagatcatgaccgccgcccctcagccctttcgggtggacatactgccggtggatgatgggacaccacggatcgttaccaacctgggactccagtggctcgagtacatggatggcaaagctactaaccttatcaccaaaaaggagctcctcaccatggatcctgataccgaggacgcgcagctggtatacgagataactacagggcccaaacacggattcgtagagaataaacttcagcctggacgtgccgctgcaacttttactcaggaggacgtgaatctggggctgattcggtatgtgctccataaggagaagatccgcgaaatgatggactcatttcagtttttggtgaaagatagcaaacctaacgtggtgtctgataacgtctttcacatccaatggtcactgattagtttcaagtacacaagttataatgtttctgaaaaggctgggagtgtatctgttactgtgcagagaaccggcaatctgaatcagtacgctattgtcttgtgtagaacagaacagggaacagcatccagcagcagtcgtgtcagcagccaaccgggtcagcaagactacgtggagtacgccggacaagtccagtttgatgagcgggaggacaccaaaagctgtacaatcgtgatcaacgacgacgatgttttcgaaaatgtggagagtttcacggttgagttgagtatgcctgcgtatgccttgctgggagagttcacgcaggcgaaagtgatcatcaacgacaccgaggatgaacctacactcgaatttgacaagaaaatctactgggtgaacgagagtgcgggattcctgttcgcacctatcgagcgcaaaggtgatgcttccagcatagtatccgctatttgctacacagtccctaagtcagccatgggctctagcctctacgctctggagtctggaagcgacttcaaaagtaggggaatgagtgcagccagtcgggtgattttcgggcctggagtaacgatgagcacatgcgacgttatgcttatcgacgactcggaatatgaggaggaagaggaattcgagattgccctagctgacgctagcgacaacgcgagaattggaagagtggcgaccgcaaaggtgcttatcagcggccccaacgacgcctctaccgtgagcctgggcaacacagcgtttacagtgtccgaggacgccggcacggtgaagattcctgtgatacgccacggcaccgatcttagcaccttcgcttccgtctggtgcgccacaagacccagtgaccccgccagcgctacccctggagttgattacgtgccttctagccggaaggtagagtttggaccgggcgtgattgagcagtactgtactttaaccatattagacgatacccagtatccggtcatcgagggccttgagacgtttgtcgtttttctatcctcggcccaaggagccgagcttactaagccgttccaggcagtgattgccatcaacgatacattccaggacgtgcccagcatgcaattcgccaaagacctcctgctagtaaaagagaaggaaggggtgctgcatgtgcctattacccgatccggcgatttaagttacgagagtagcgtaagatgctacacccagtcccactcagcacaagtcatggaagatttcgaggagcggcaaaacgccgacagttcgcgaatcacttttcttaagggtgacaaggtaaaaaactgcacagtgtatattcatgacgatagcatgtttgagccagaagagcagttccgagtgtatctgggactccccctgggcaaccactggagcggggcacggattggtaaaaacaatatggcgacaataactattagcaacgatgaggatgctcctactattgaattcgaagaggctgcctatcaggtgagggaacctgctggtccagacgccatagcgatccttaatatcaaggtgattaggaggggagaccaaaaccggacatcgaaggttcggtgcagcacaagagatggatccgcacaaagcggcgtggactactacccaaagtcacgggtgctcaagttcagtcccggagtcgaccatatcttctttaaagtggagatcttgtctaacgaagaccgggagtggcatgagagcttttctctggtactgggacccgacgaccccgtggaggccgtcctaggagacgtgacgaccgccaccgtgactattctcgatcaggaggcggctggttctctcattctgcctgcccccccgatcgtggtgaccctggcagactatgaccacgtagaggaggtaacaaaggaaggcgtgaagaagtcccccagcccagggtatcccctggtgtgtgttacaccttgtgacccccacttcccaaggtatgccgtgatgaaggagcgctgctcggaagccggtatcaatcagacgagcgtccagttttcttgggaagtggccgcccccacagacggcaacggcgctagaagtcctttcgagacaatcaccgacaataccccgtttacatccgtgaatcatatggtgctcgatagtatctattttagtaggaggttccatgtgcggtgcgtagcaaaggcggtggacaaggtgggccacgtgggtacaccactccgcagcaacattgtaacaattgggactgattcagctatatgtcatacccctgtggttgccgggacatcaagaggtttccaggcccaatcatttatcgctaccctgaagtacctggatgtgaagcataaagagcatcccaaccgaattcatatctctgtccagattccacatcaggatggaatgttgcctctgataagcactatgccactccacaatctacacttcttattgagtgaaagtatttataggcaccagcatgtatgttctaatctcgtgacaacatacgatctgcgaggcattagcgaggcgggctttctcgatgatgtggtatatgatagtacagcccttggcccaggctatgataggccgttccagttcgacccctcagtcagggagcctaagaccatacagttgtacaagcacttgaatttgaaaagttgtgtgtggacatttgacgcatattacgacatgaccgagctgatcgatgtgtgtgggggaagtgtgactgctgatttccaggtgagagactctgcccagtcgttcttgacagtacatgtgcccctctacgtctcttacatttacgttacagcccctcgcggatgggcatccttagaacaccatacagagatggagttctctttcttctacgacaccgttttatggcgcactggtatccaaactgacagtgttctttctgccaggctacaaatcatccggatctatatcagggaggacggccgtctcgtgattgagttcaagacccatgccaaatttagggggcaattcgtgatggagcatcacaccctgcctgaggtgaagtcatttgtgctcacccctgaccatctgggaggaatcgaatttgatttgcagctactgtggagtgctcagacatttgactctccacaccaactgtggagggcaacgtctagctacaataggaaagattactcaggagaatacacaatctacctcataccttgcaccgtgcaacctactcagccatgggtcgatccaggggaaaaaccactcgcgtgtacagcgcatgctcctgagcgcttcttgattccaatcgctttccagcagacaaaccggcccgtacctgtcgtgtattccctgaatacggaattccagctgtgcaataacgagaaagtgttcttgatggacccaaatactagcgatatgagtttggcagagatggattacaaaggagccttttccaaaggccagattctgtacggaagagtgttgtggaatccggagcagaatcttaattctgcgtacaagttacaactcgagaaggtctacctatgcactggtaaagacggatatgtgccgttttttgatccaacgggcacgatttacaacgaggggccccaatatggctgtattcagcctaataagcacctcaaacacaggttcctgcttctagataggaatcagccagaagtcacggataaatacttccacgatgtgccattcgaagcccatttcgcatctgagctaccagattttcatgtggtaagtaacatgcccggcgtagatgggtttacattaaaggtggatgctctctacaaagtcgaggcgggccatcagtggtatctgcaggtgatatacataatcggccctgataccatttctggtcccagagtccaacggtctcttacagccccactgagacgtaaccgcagagatttggtagagccagatgggcagctgatattagatgattcccttatctatgacaacgagggggaccaggtcaagaatggtacaaacatgaagagcctgaatctcgagatgcaggaactcgccgtggcagcaagcctttctcagaccggggcctccattgggtccgctctggctgccatcatgctgttgctgttggtattccttgtggcctgttttattaacaggaagtgtcagaagcagagaaagaaaaaacccgccgaggacatcctggaagagtacccactgaacactaaagttgaggtccccaagcggcacccagatagggtggagaaaaacgtgaacagacattactgtaccgtgcggaacgttaatatattgtccgagccagaggcagcttacaccttcaagggtgctaaggttaaaaggctgaaccttgaagtgagggtccataacaaccttcaagatgggaccgaggtttag

SEQ ID NO: 117483 - DNA, 2214 bp, Artificial Sequence
  Description of Artificial Sequence: Synthetic coding sequence
atgggggtgctgaaagtgtggctggggcttgccctggccctggctgagtttgctgtcttgccccatcactcagagggtgcctgcgtgtaccaggatagcctgcttgcagacgccaccatctggaaacccgattcgtgccagagctgtcgctgccatggagatattgtgatctgcaagccggctgtttgtcgaaatccccagtgcgctttcgagaaaggcgaggttctgcagattgccgctaaccagtgctgccccgagtgcgtattgaggacacctgggtcctgtcaccacgagaaaaaaattcatgaacatggaacagaatgggcatcgagtccctgtagtgtgtgcagttgtaaccatggtgaagtgcgctgtacgccacagccatgtccacccctgtcttgtggacaccaggagctcgccttcatacccgagggttcttgttgccctgtctgtgtgggcctgggcaagccctgtagctacgagggacatgtgttccaagatggcgaggactggaggctgagtagatgtgcaaaatgcttatgtcgcaacggagttgcccagtgctttactgctcagtgccagccgctcttttgcaatcaggatgaaactgtcgtgcgggtgccaggaaagtgctgcccccagtgctctgctcgtagttgttcagccgcgggccaagtgtatgagcatggagagcagtggtcagagaatgcgtgtacaacctgtatttgcgaccgtggcgaagtacggtgccataagcaggcctgtctgccccttaggtgcgggaagggacagagtcgcgcccgccgacacgggcagtgttgtgaagaatgtgtttcaccggccggttcttgctcttacgatggggtggtgagatatcaagatgaaatgtggaaaggttccgcctgtgagttctgcatgtgtgaccacggccaggtgacgtgccagaccggagaatgtgccaaagtggaatgcgcaagagacgaagaactgattcatcttgacggtaaatgctgcccggaatgcatcagccggaacgggtattgtgtctacgaggagaccggagagttcatgtcctccaatgcgtcagaagtgaaacggatcccggagggcgagaaatgggaggacggaccttgcaaggtatgtgagtgtagaggcgcacaggttacgtgctatgagcctagctgcccaccttgcccagtcggaacattggctctggaggtgaagggccagtgctgcccagattgcacgagtgtacactgtcaccctgactgtctgacctgctctcagtctcccgatcactgcgacttgtgccaggatcccaccaaacttctccagaatggctggtgcgtgcactcctgcggactcggattctatcaagctgggagtctgtgcctcgcgtgccaaccccagtgcagtacctgcacatccggcctggagtgctccagctgtcagcccccactgctcatgcggcacgggcagtgcgtacccacatgcggggatggattctaccaggatcgccacagttgtgcagtttgccacgagtcatgcgcagggtgttggggcccaaccgagaagcactgcttggcgtgtcgagatccattgcatgtcctgcgggatggtggatgcgaaagctcttgcggtaagggcttctataacaggcagggaacctgttcggcctgtgaccagtcctgtgactcttgtgggccttctagtcctagatgtttaacatgtacggaaaagactgtgctccacgatgggaagtgcatgagcgaatgccccgggggttattacgcagatgccacggggagatgtaaagtgtgtcacaattcgtgtgcgagctgtagtggaccgactccatcacactgtaccgcctgctcaccgcccaaggctttaagacagggccactgcttgcccagatgcggggagggcttctactcggatcatggagtgtgcaaggcatgccactccagttgcctggcctgcatgggacctgctccatctcattgtaccggctgcaagaaaccggaagagggacttcaggtagagcaactcagtgatgttggcatacccagtggagaatgtctggcccagtgcagggctcatttctacctggaatccacgggtatctgcgagggtcagaacctggatttttgtcagaatctcgaggttattagcgccgtgtgtctcggtatttccagcactgagaactag

SEQ ID NO: 117484 - DNA, 954 bp, Artificial Sequence
  Description of Artificial Sequence: Synthetic coding sequence
atgggagtgttgaaagtctggctcggcctcgcgctggccctggctgagttcgccgtcctgccgcatcactctgagggggcctgcgtttatcaggattccttgctggcggacgctaccatctggaagccagactcctgccaatcttgcagatgccacggcgacatcgttatatgcaagcccgccgtatgccgaaatccccaatgcgccttcgaaaagggggaagtgttgcagatcgccgctaaccagtgttgtccggagtgtgtcctgcgaaccccagggtcctgccaccacgagaagaagatccacgaacatggaactgagtgggccagttctccttgtagcgtgtgttcttgcaaccatggagaggttcgctgcacaccgcagccttgccctcccctgagttgcggccatcaggaattggctttcatcccagaaggaagctgctgtccggtgtgcgtgggactaggcaaaccctgcagctacgaaggacacgtgttccaagatggagaagactggcggctatcaagatgcgccaaatgtctgtgtagaaacggcgtcgcccagtgttttactgcccagtgccagccgctgttctgtaaccaggacgaaactgtagtgagagtcccgggtaaatgctgtccacaatgctccgcaagatcgtgcagcgcagccggacaggtttatgaacacggggagcaatggagcgagaacgcatgcactacctgcatatgcgaccgcggcgaggtccgctgccacaagcaagcctgtctgccactccggtgcggcaaggggcagtcacgcgcccggaggcatggtcagtgttgtgaagaatgcgtatctcccgcattagcaagccagtccgtcggaattaccggtatgtcacatcacgcgcaatctctcctgggacctttcctgactcagatcaaaaaaccccacttctcctgtctggaatag

SEQ ID NO: 117485 - DNA, 6726 bp, Artificial Sequence
  Description of Artificial Sequence: Synthetic coding sequence
tagagtgaagtttccaattttactatggaggatatcaacaacaaaaagatcaggtatagcgctgtgtttgaaaccgacgggcatctggtgacagactcgttttattttagcgtgagcgacatggaccacaatcatcttgataatcagattttcactatcatgatcacgccagctgagaaccctcccccagtcatcgcctttgctgaccttataacagtcgatgagggtggcagagcccctctgtccttccatcatttttttgcaactgacgacgacgataacctgcaaagagatgcaatcataaagttgtccgcattgccgaagtacggctgtatagagaacacaggaaccggcgaccgctttggtcccgagacagcctctgatctcgaagcttcctttcccatccaggacgtcctggaaaactacatctactatttccagtccgtccatgagagcattgaaccaacacatgacattttctccttttatgtgagcgacggcacaagtagatccgaaatccatagtattaacatcactatcgagcgcaagaacgatgaaccccctagaatgactctccagcctttgagggtccagttgagtagtggggtggtgataagcaatagtagtctctccttgcaggatctggacacacctgataatgagctgatcttcgtactgaccaaaaaacctgaccatgggcatgtgttgtggaggcagactgcctccgaaccactcgaaaacggcagggtgctggtacagggttcaacgtttacctaccaagatatacttgctggcctcgttggatacgtgccctccgttcccggtatggtagtcgacgaattccaattctctcttacggacggactgcacgtcgacactgggcgcatgaagatctacaccgaactcccagcttccgatacaccccatttagcgataaatcagggtcttcagctttccgccggctctgtggctaggattactgagcagcacttgaaggtcactgatatcgattccgacgaccatcaggtgatgtatattatgaaggaagacccgggggccggtcgacttcagatgatgaagcatgggaacctggagcagatttccattaagggccctatcaggtcattcactcaagccgacatcagccagggccacgttgagtatagccatggaaccggtgagcctggtggctcgtttgccttcaaattcgacgtggtagacggggaggggaatcggttgatagacaagtcgttctccattagcattcttgaggataagtcaccacctgttataactacgaacaagggtctggttctggacgagaactccgtgaaaaagatcaccaccctccagctgtcggcaacggatcaggactcgggtcctacggagcttatatatcgtatcacccgacagcctcagctcggccatctcgaacatgcagcttcccctggaattcagatctcatcatttactcaggcggaccttacctccaggaatgttcagtatgtccatagcagtgaggctgagaaacactccgatgcgttcagtttcacacttagcgacggagtgtcggaggtaacccagacgttccacattacccttcacccggtggacgattctctacctgtggtccagaacctgggtatgagggttcaggaaggcatgcgcaagacgatcacagagtttgagcttaaagccgttgacgccgacacggaggccgaatcagtgactttcacaatagtgcaacctccgcgtcacggcaccattgaacgaacctcaaatggacagcactttcacttgacaagtacgttcacaatgaaggacatctaccaaaatagagtgtcttacagtcacgacggtagtaactcattaaaagatcgcttcaccttcactgtttctgatggtactaacccatttttcattatcgaggaagggggaaaagagatcatgaccgcggctccccagccgttccgtgtagacatactgcccgttgatgatggcactccgaggattgtgaccaatttggggctccagtggttagagtatatggatgggaaggcaaccaacttaatcaccaaaaaggagctgttaaccatggaccccgacaccgaggacgctcagctcgtttacgaaattaccacaggccctaagcatggattcgtcgaaaacaagctccagcccggccgtgctgcagcaacctttacacaggaggacgtcaacctggggcttatcagatatgtcctgcataaggaaaagatcagggaaatgatggatagcttccaatttctagttaaggatagtaaaccgaatgtagtgagtgataacgtattccacattcaatggtctctcatctcctttaagtatacctcctataacgtgagtgagaaggcaggatctgtttcggtgaccgtacagcgaacgggcaacctcaatcagtacgcaatcgtgttgtgccggacagagcagggaaccgcttctagttcttctcgcgtttcatcccagcctggccagcaggattacgtggagtacgctgggcaggtccagttcgacgagcgggaggatacaaagtcctgcacgattgtgattaacgacgacgacgttttcgagaacgtggagtcttttacagttgagctgtcaatgcctgcttacgctctcctgggcgaattcacccaggccaaagtgattatcaatgatactgaagacgagccaacattagaattcgacaagaagatttattgggtcaacgagtcagctggatttctgtttgcaccgattgaacgaaagggagacgcaagctctatcgtgagtgcaatttgttacacagttccaaaaagtgcaatgggctcctcactttatgccctggaatcaggaagtgattttaagagccggggaatgagcgccgcttcgagagttatatttggtccaggtgtgactatgtccacctgcgacgtaatgcttattgacgacagtgaatacgaagaagaggaagagttcgaaatcgccctggcagatgcaagtgacaatgcaagaattgggcgggtcgcgacagcaaaggtgttgatatctggcccaaatgacgcctccactgtgagtctaggcaataccgcgtttacagtgtctgaggacgcgggcactgttaagatcccagtgattagacatggcacagacttgagtacttttgcttctgtgtggtgtgcaacgcggccgagcgacccagctagcgctacacccggcgttgactacgtgccctcttcccgaaaagttgaattcggtcctggagttattgagcagtattgtactctgaccattctggatgacacccagtatcctgtgatagaaggactggagacgttcgtggtgtttcttagcagtgctcagggagccgaactgacgaagccatttcaggctgttattgccataaatgatacctttcaagacgtgccgtctatgcagttcgctaaagatctgttgctcgtaaaggaaaaggagggcgtattacacgtgccgattacaagatctggagatctctcctatgaatcctctgtgaggtgctacactcagagccactctgctcaggtgatggaggactttgaagaaagacagaatgcagatagtagtagaattacgtttctgaagggcgataaggtgaagaactgtaccgtgtacatacatgatgactcgatgtttgagccagaagagcaatttcgagtgtacctggggctgccgttaggaaatcactggtctggcgccagaattggtaagaataatatggcaaccataacgatctcgaatgacgaagacgccccgaccattgaattcgaggaggctgcgtaccaagtgagggaacccgccggaccagacgcaatcgcaatattgaacataaaggtgattcgccggggagaccaaaaccggactagtaaggtcagatgttcgacaagggacggaagcgcccaaagcggcgtggactactatccaaaatcccgtgtactcaaattttcaccgggcgttgatcacattttcttcaaggttgagatcttgtctaatgaggaccgagaatggcacgagagcttcagcctggttctgggacctgatgaccccgtggaggcagtgctgggggacgtcaccacagctaccgtcactattctggatcaggaggccgcagggtcactaatcctgcctgcgccaccgatcgtcgtgacactggctgactacgatcatgttgaggaggtgactaaggagggggttaaaaaatcgcccagccctgggtaccccctcgtgtgcgtgactccttgtgatccacactttccacgatacgcagtgatgaaggaaagatgctcagaagccgggattaatcagacctccgtgcaattctcctgggaggttgccgcacccactgatggcaacggcgcaagatctccattcgagactatcacagataatacccctttcacatccgtgaatcacatggttctagacagtatttatttctctcggagatttcacgtacggtgcgtggccaaggccgtggacaaggtcggacacgtgggcacccctctgcggagtaacattgtcaccattggtaccgacagcgccatctgccacactcctgttgtcgccggaacgtctaggggctttcaggcccaatcatttattgccacgctgaagtatctggacgtcaagcataaagagcaccccaacaggattcatatttcggtccaaattcctcaccaggatgggatgctacctttaatctctacaatgcccctccacaaccttcactttctcctcagcgaatctatatacaggcatcagcatgtgtgctccaatctcgtaactacctacgatcttcgagggatttctgaggccggatttctggacgacgtggtgtacgattccacagctctcggccctggctacgacaggccattccaattcgaccccagcgtgagggagccaaaaacaatccaactctataaacacctgaacttgaaatcgtgtgtgtggacctttgacgcctactacgacatgaccgagctcatcgatgtgtgtggcggctcggtcacagccgactttcaggtccgggattccgcccagagctttctcaccgtgcatgttcccttatatgtctcctatatctatgttaccgctccacgcggctgggcaagcctcgagcatcacaccgaaatggagttttctttcttttatgatacagttttgtggcgtacgggtatccagacagatagtgtcctatcagccaggcttcagatcatccgcatctatattcgagaggatggacgcctcgtaatcgaattcaagacacacgctaaattcagagggcagttcgttatggaacatcataccctgccagaagtgaagtcttttgttctaactcctgaccacttaggagggatcgagtttgatctgcagctgctgtggtcagcacagacgttcgatagcccacatcagctgtggagagctacctcctcttataatcggaaggactacagcggggagtataccatataccttatcccttgtacagtacaaccaacacagccctgggtggatccaggcgaaaaaccactcgcctgcacggctcatgcacctgaacgattcctgatcccaatcgcgtttcagcagacaaacaggccagtccctgttgtttattctctaaacacagagtttcagctgtgcaataacgaaaaggtgtttctcatggatccaaatacctccgatatgtcactggcagaaatggattacaagggagcattcagtaaaggacagatcctgtatggtagagtgttatggaatcctgagcagaatctcaacagcgcctacaagctgcagcttgagaaggtttacctctgtactggcaaagacggatatgtgccattcttcgatcctaccgggactatttacaatgaaggaccccagtacggatgtatccaacccaacaagcatctgaaacaccgctttctgctgctagatcggaatcagccggaggtgacagataagtacttccacgatgttcccttcgaggctcactttgccagcgagttgcctgactttcacgtagtttctaatatgcccggcgtggatggctttacacttaaggtggacgccctatacaaggtggaggccggccatcagtggtatctccaggtgatttacataatcggacccgataccatcagcggccctcgtgttcagcgttctttgaccgcaccattgcgaagaaataggcgcgaccttgtggaacccgacggccaactgatcctcgatgattcattgatctatgacaatgagggggatcaggtgaagaatggaacgaacatgaagtcgctaaacctggaaatgcaagagctggcagtggcagcctcccttagccagactggcgctagcataggatcagctctggccgcaatcatgttgcttctgctcgtttttctagtggcctgttttatcaatcggaagtgtcagaaacaaaggaaaaagaagccagccgaggatatcctggaggaataccccttgaataccaaggtcgaggtccctaagaggcacccggacagagtcgaaaagaacgtgaacagacactactgtacagttagaaacgtgaacatactcagcgaacctgaggcagcatacaccttcaaaggcgcgaaggtcaaacgtcttaatcttgaggtcagggtccacaacaatctacaggacggcaccgaagtgtag

SEQ ID NO: 117486 - DNA, 768 bp, Artificial Sequence
  Description of Artificial Sequence: Synthetic coding sequence
gagcggcaaggacagagtcgggcaaggcggcatggtcagtgctgcgaagaatgtgtcagtccagctggatcgtgctcctacgacggagtggtccggtatcaggacgagatgtggaaagggtctgcgtgcgaattttgtatgtgcgatcatggccaggtaacatgtcaaaccggagaatgcgctaaggtagagtgtgcacgtgatgaggagctgatccatctggatggcaagtgctgcccggagtgtattagtcgaaatggctactgtgtgtacgaggagactggcgagtttatgagctccaatgctagcgaagtgaaacgaatccctgagggcgaaaagtgggaggacggaccatgtaaagtctgcgagtgtaggggcgctcaggtgacctgctatgaaccaagctgcccgccctgtcctgtaggcacgttggcccttgaggtgaaagggcagtgctgccctgactgcacttccgttcactgtcatcccgattgtctcacctgtagtcagtctccggaccattgtgatctgtgccaagaccccaccaagcttttgcagaacggctggtgcgtgcactcttgtggactgggattctatcaggctggtagcctctgtttggacgacgggttcagcctgcccgcccccgttctgcatgtgtatcagtgggccggggtccttatcctaccggccagtcccgccgacgccgctcgcgccgtttgcgcctatctgtgggggagactcctcccaagaagtcccttcctttgctag

SEQ ID NO: 117487 - DNA, 840 bp, Artificial Sequence
  Description of Artificial Sequence: Synthetic coding sequence
atggtcctcacaatccacctactgcctagtgaccagcagttgcccgtctttcaggtgaccgcccctaggctggccgtttcacccgggggctctacaagtgttggcctgcaggtcgtggttcgtgacgctgagacagcacccaaagagctgttcttcgagctcagacggcccccacaacatggcgttctgctgaaacatacggctgagttccgtaggcctatggccaccggagataccttcacttacgaagatgtggagaaaaacgctctccagtatatccatgatgggagcagcactcgggaggattccatggaaattagtgtcacagacggtctcacggtgactatgctggaagtgagggtggaagtctctctgagcgaagaccgcgggcctaggctggcagccgggtcatctctgtcaatcacggtcgccagtaagtcaaccgccatcatcaccaggtctcacctggcgtatgtagatgatagctcacccgaccctgagatatggatccagctgaattacttgccgtcatacggcacgttactacggatatccggatccgaagtggaggagctgagcgaggtgtctaactttactatggaggatatcaacaacaagaagattcgttacagcgcagtgttcgaaactgacgggcacctcgtcacggactccttctatttttcagtaagcgacatggatcacaatcatcttgataaccagatttttaccatcatgataacccctgcagaaaacccgccccccgttattgcctttgctgacttaattacggtagatgagggcggcagggccccactgtctttccaccacttttgctactag

SEQ ID NO: 117488 - DNA, 5931 bp, Artificial Sequence
  Description of Artificial Sequence: Synthetic coding sequence
atgggcgtcctgaaggtgtggctgggtctggctctcgcgctcgccgagtttgccgtgctgccccatcacagtgagggcgcctgtgtttaccaggattctctcctggcagatgccactatttggaaacccgactcatgccagagctgtcggtgtcatggcgatattgtgatttgcaagccagcagtatgccgcaaccctcagtgcgcgttcgagaaaggcgaagtgttgcaaatagccgcaaatcaatgttgtcctgaatgcgtcctgagaacgccgggttcttgtcatcacgaaaagaaaatccacgaacacggaaccgagtgggcatcaagcccctgttcagtgtgctcatgcaatcacggcgaggtgcgctgcaccccacaaccatgtcctcccctaagctgcggccatcaagaactcgcattcataccagaagggtcgtgttgtccggtttgcgttgggctgggcaaaccttgctcctatgaaggccacgtgtttcaggacggggaagactggaggctttctcggtgcgccaaatgtctttgcagaaatggagttgcccagtgcttcaccgcccagtgtcaacctctgttctgcaaccaagacgagacggtagtgcgtgtgcccgggaagtgctgtccgcagtgttccgctcgtagctgcagcgcagcgggacaggtatacgagcatggcgaacagtggagtgaaaatgcttgtaccacctgtatttgtgataggggtgaagtgcgttgtcacaagcaagcatgtttgccattgcgctgtgggaagggacagtccagggctcgcaggcatgggcagtgctgcgaagagtgcgtgagccctgctggatcttgctcatacgacggggtggttagataccaggatgagatgtggaagggctccgcttgcgaattctgtatgtgcgatcacggacaagtgacatgtcagacaggagaatgtgccaaggtagaatgcgcaagagatgaggagctgattcacctcgacggtaaatgttgccctgaatgtatttcacggaatggttactgtgtctacgaggagacaggagagttcatgagttctaacgccagcgaggtgaagcgcatccctgagggagagaagtgggaagatggaccttgcaaggtgtgcgaatgtcggggggcacaggtaacctgctacgagccttcctgtcctccctgtcctgtggggacattggctttggaagttaaggggcagtgttgtccagactgtacctctgttcactgccaccctgattgccttacttgtagtcaaagtcctgaccactgtgatctgtgccaggaccccactaaactgttgcagaatggatggtgcgtgcatagctgtgggctgggcttttaccaggccggctccctgtgtctggcctgtcagccacagtgctcaacctgcacctcgggactcgaatgttcatcctgtcagccaccattgcttatgcgtcacggccagtgtgtgccaacttgcggcgatggcttttatcaggatcgtcactcatgcgccgtttgccacgaatcctgcgccggctgttggggcccaactgagaaacattgtcttgcatgccgggatcccctacatgtcctgcgagatgggggttgcgagtcctcctgtggaaaggggttctataacagacaggggacctgctcagcatgcgaccaatcatgcgatagttgtgggccatcatctcctaggtgtttgacctgcacggaaaaaaccgtgctgcatgatggcaagtgtatgtctgagtgtcccggtggatactacgctgacgctacaggacggtgcaaggtctgccacaatagctgcgcctcctgttcagggccaaccccttcccactgtaccgcatgttctcctcccaaagcactgagacaaggacactgtctgcctcgctgcggggaagggttctatagcgatcatggggtatgtaaggcttgccactctagctgcctggcttgcatggggcctgcccccagccactgtaccggctgtaagaagcctgaggagggactgcaggtggagcaattatccgatgttggtatcccctctggtgaatgcctggcccagtgtcgcgcgcacttttatctggagtccactggtatctgtgaagcctgccatcaatcctgcttccgatgcgccggcaagtcaccccataactgcacagactgcggtccgtctcatgtgctgcttgatggccagtgcctttcgcagtgtcccgacggctacttccatcaggaggggtcctgcaccgagtgtcacccaacctgcagacaatgccatggtcctttagagagcgactgcatttcatgttatcctcacatctcactgacaaacgggaattgtcgaacctcttgccgagaggaacagttcttgaatctggttgggtattgcgctgattgccaccatctttgccagcactgcgcagccgacctccataatacagggtcgatttgtttgaggtgtcagaatgcccactacttactgttgggtgaccactgtgtgcctgattgcccctcggggtactatgccgagaggggcgcatgtaagaagtgtcattctagttgtcgaacgtgccagggtcggggcccgttctcatgcagtagctgtgacactaacctggtgctttcacatacaggcacatgctccacaacttgcttccccggtcattatttggacgacaaccatgtgtgtcagccatgcaacacacactgcgggagctgcgattctcaggcttcttgtactagctgccgcgaccctaacaaggtgcttctgttcggtgagtgccagtatgaatcttgcgcaccccagtattatctcgacttcagcacaaacacttgcaaagagtgtgattggagctgctctgcctgtagcggcccgcttaaaactgactgtctgcaatgtatggatgggtatgtactacaggatggcgcctgcgtggaacagtgcctgagctccttctatcaggatagtgggctgtgcaaaaactgtgatagctactgtcttcagtgccagggcccacacgaatgtactcgttgtaagggcccattcttgttgctggaggctcaatgcgtccaggagtgcggcaaggggtatttcgccgatcatgcgaagcacaaatgcacagcctgcccccaggggtgcctgcaatgcagccaccgggacaggtgtcacttgtgtgatcacggattcttccttaagagcgggctctgcgtgtataattgcgtgccaggattttctgtccacacaagcaatgaaacctgctctgggaaaattcatactccttctttacatgtgaacggctcacttattttacccataggtagcatcaaaccacttgacttctcgctgctgaacgtgcaggaccaggaagggagggtggaagaccttttattccacgtcgtgtccactcccactaacggacagctcgttctttcccggaatggaaaggaggtacaactggataaggctgggaggttcagctggaaggacgtgaacgagaagaaggtgaggtttgtgcactccaaggagaaactgcgcaaagggtatctgttcctgaaaatttctgaccagcagttcttttctgagccacagctcatcaatattcaggccttctccactcaagctccatacgtgctgcgcaatgaggtattacatatctcgcgaggggaaagagccactataacaacccagatgcttgatattcgggatgatgacaacccccaagatgtggtcatcgaaataatagacccaccccttcacggccaactccttcaaacattgcagagtccagccacacctatttaccagttccagctagatgaactgtcacgtgggctgctgcattatgctcacgacggaagtgacagcacttccgacgtggccgttttgcaggcgaacgacggccactccttccacaacatcctctttcaggttaagaccgttccccagaacgacaggggcttacaattagtcgccaactccatggtttgggtaccggaaggaggaatgttacagattactaatcgaattctgcaagctgaggcacccggagcctctgccgaggagataatatacaagataacacaggattatccccagtttggagaagtcgtcttgttagtgaatatgccagcagatagtcctgcggacgagggtcagcatctccccgacggcaggactgccacgccgaccagtacatttacccagcaggatatcaatgaagggatcgtctggtacaggcactcgggtgcccccgcccagtctgatagctttcggttcgaggtcagctcagcctccaacgctcagaccaggttagaatcccacatgttcaatatagccattctgccgcaaacccccgaagcgccaaaggtcagcctggaggctagcctgcatatgaccgctagggaggacgggctgacggtcatccaaccgcatagtctttcgttcattaactccgaaaaaccctcgggtaaaattgtctacaacatcacgcttccgcttcatcctaatcagggaattatcgagcaccgggaccatcctcacagccctatcagatatttcacgcaggaggacatcaatcagggaaaggtgatgtataggccgccacccgccgcgccccatctgcaggaacttatggccttcagttttgcgggactgcctgagtcagtgaaatttcatttcacggtcagtgacggagagcatactagtccagaaatggtgctcaccattcacctgctgcccagcgaccagcagctcccagtgttccaagtgactgcaccccggttagcagtgagtcctgggggctccactagcgtgggtctgcaggtggtggttcgggatgccgaaacggctcccaaagagctgttcttcgagctacggagacccccacagcacggcgttcttcttaagcataccgccgagtttcgccgccccatggctacgggggatacttttacgtacgaggacgtcgagaagaacgctttgcagtatattcacgacggctccagtacaagggaggatagtatggagatttcggtgacagatggccttacggtgacaatgctcgaggttcgggttgaggtctctctctctgaggatcggggaccccgactggcagcaggaagctccctgtccatcaccgtggccagcaagagcactgcaatcattactcgcagccatctagcctatgtagatgattctagccccgaccctgagatctggattcagctcaattatctgccctcatacggcaccctcctaagaatctcaggcagcgaggtggaggagctgagcgaagtgtctaattttaccatggaggacattaacaacaaaaagatccgatatagcgccgttttcgagactgacggtcacttagttaccgatagcttttattttagcgtgtccgatatggaccacaatcacctggacaaccagattttcactatcatgatcacccccgccgaaaatccacccccggtgatcgcatttgcagatttgatcacagtcgacgagggaggccgagctcctctgagctttcaccatttcttcgcaactgatgatgatgataatctccaacgggacgccataatcaagttgagcgccctgccaaagtacgggtgcatagagaacacgggtacgggagataggttcggtcccgaaacagcgtccgacttggaggccagcttccccatccaggatgtgcttgagaactacatttactactttcaaagtgttcacgagagcatcgaacctactcatgacatctttagcttctacgtgtcagacgggaccagccgttcggagatccactctatcaacatcactatagaggtcaaaacactagaagtagggaaagtcgaacccttgacaactatcttccacacaattcgagagcttagcctgtag

SEQ ID NO: 117489 - DNA, 633 bp, Artificial Sequence
  Description of Artificial Sequence: Synthetic coding sequence
atgtggaccctgggtcgtcgcgctgtcgccgggctcttggcctccccctcccccgcgcaggcccagaccttgactagagtccctcgcccagcggagcttgcacccctgtgtgggcggcgtggcctgcggacggatatagacgccacctgtacacccaggcgtgccagttctaatcagaggggccttaaccagatttggaacgtgaagaagcagtcagtgtacttgatgaaccttagaaagagtggtacactcggacaccccggatcgttagacgagacaacatacgagaggttggctgaagaaactcttgactctcttgcagaattctttgaagacctggcagacaagccatacactttcgaagactatgatgtgtcttttggaagcggagtgctaactgtcaagctggggggcgacctgggaacctatgtaattaataaacagaccccgaacaaacaaatctggctgagcagtccgtcatccggacccaagcgatacgactggactgggaagaactgggtctacagccacgacggcgtgtccctgcatgagcttcttgccgccgagcttacgaaggcactaaagactaagcttgacctgtcatcgttagcatattctggtaaagacgcctag

SEQ ID NO: 117490 - DNA, 516 bp, Artificial Sequence
  Description of Artificial Sequence: Synthetic coding sequence
atgtggacactgggtagacgggctgtggcaggactgctggccagtcctagccccgcgcaggcccagacactcacacgcgtgccgagacctgcagaactcgcccctctgtgtggaagacggggtctgaggactgacatcgacgcgacctgtactccaaggagagcttccagcaatcagaggggtctcaatcagatctggaacgtgaagaagcagtccgtgtacttgatgaatctgaggaagagtggcacactgggacatcctggatctcttgacgagacaacctacgagcgacttgccgaggagacattagactcgcttgccgaatttttcgaggacctggcagataaaccctatacctttgaagactatgatgtctccttcgggagcggtgttctaacagttaagctcggcggtgatctcggaacatatgtgatcaataaacagacccctaacaagcaaatctggctttcttccccctctcgcctgacatggcttttgtggctgttccacccctag

SEQ ID NO: 117491 - DNA, 591 bp, Artificial Sequence
  Description of Artificial Sequence: Synthetic coding sequence
atgtggacccttgggagacgagcagttgctggcttgttagctagtccaagccctgcccaggcgcagacactgacacgtgttccgcgcccagcagaattagctcccctctgcggccgcagagggttgagaaccgatattgatgccacttgcaccccacgccgagcaagttctaatcagaggggactgaatcagatctggaatgtcaagaagcagtcggtttatctaatgaacctgagaaagagcggtacattaggccatcccggaagtctcgacgaaaccacctacgaaaggctcgcagaggaaacactcgacagtctggcggagtttttcgaggaccttgctgataaaccttatacctttgaggactacgatgtaagttttggctctggagtcctgaccgtcaagctcgggggggacctgggaacatacgttattaacaagcagacaccaaataagcagatttggctgagtagcccaagccggtacgtggttgatctttctgtaatgacaggtcttggcaaaactggatgtacgcccaccactgcttgcccatccatgtcctgttggccccaaagttctctgaagccctag

SEQ ID NO: 117492 - DNA, 702 bp, Artificial Sequence
  Description of Artificial Sequence: Synthetic coding sequence
atgccttgccggcgggaggaagaagaagaggctggtgaggaggctgagggcgaagaggaagaagacgactcttttcttctgctgcaacagtctgtcaccctagggagctcaggcgaagttgatcggctggtggctcaaataggcgaaactctccagcttgatgccgcacaggattcaccagcctccccctgtgccccacctggagttcccctcagggccccaggtccactggccgccgctgttccggcagacaaagcgcgacccccagcggtgcccttactgttgcccccggcctccgcggagacagtaggcccagccccaagcggcgcacttcgatgcgctctcggggatcgcggccgcgtgcggggccgggcagccccctactgtgttgcagaggtggctgccggccccagtgcgttgcccgggccttgtcggagaggctggctcagagacgcagtcacgagccgccggctccagcaaagaagatggactcaggccggagcgagggcgggcgacgacgacccacaccggttgctacagcagctggtcctttccggaaatctcatcaaggaggctgtgaggaggctgcagagagccgtggccgccgtggccgccacaggtcctgcttccgcgcccggacccggaggcggcaggtccgggcccgatcgcatagccctgcagccttcgggcagcctgctgtag

SEQ ID NO: 117493 - DNA, 1161 bp, Artificial Sequence
  Description of Artificial Sequence: Synthetic coding sequence
atggagggcggactggccggcgagagggcccgcgagtctcccgtggactgcagcgtgagtaagtgttctaaacttgttggagggggggagtctaaccccatgaattacaattcttatatggatgaaaaaaacggccctcctccgccaaatatgactaccaatgagcgcagagtgatagttcccgccgacccgacactgtggactcaggagcatgtcaggcagtggctggagtgggccataaaagaatactctcttatggaaatagacacatcatttttccaaaatatggacggaaaagaactgtgtaaaatgaacaaggaagattttttacgggcaaccactctttacaataccgaggttttactttcacacttgagctacctgcgcgaatcatctttgctggcttacaatactacctcccacacggaccagtcttctcgtctttcggtgaaagaggacccaagttacgactccgtgagacgaggagcctgggggaataacatgaatagcggcttgaataagtcacccccactggggggagctcagactattagtaagaataccgaacaacggccacagccagacccgtaccagatcctgggcccaacatcgtcccgactcgccaacccaggcagcggacagatccaactgtggcagttccttctagagctgcttagcgatagcgccaacgcaagctgtatcacctgggaagggacgaacggcgaatttaagatgacggacccagatgaggtggcgcgaaggtggggagagaggaagtcgaagcctaatatgaactacgataaactgagtcgagcactccggtattattacgataagaatattatgacaaaggtccacggaaaaagatacgcatacaagttcgattttcatggcattgcacaggcccttcagccacaccctacggagtcttccatgtacaagtaccctagtgacatctcctatatgccgtcataccacgctcaccagcagaaggtgaattttgtgcccccccatccgagctccatgcctgtgacttcatcctccttttttggtgctgccagtcagtactggacctcacctaccggcggaatctacccaaatcctaatgtccccaggcacccaaacacccacgttccttcacacctcggttcatattactag

SEQ ID NO: 117494 - DNA, 1260 bp, Artificial Sequence
  Description of Artificial Sequence: Synthetic coding sequence
atgacagcctccgggagtccagactacggacagcctcacaagataaatccgctgccgcctcaacaggagtggatcaaccagcccgtccgtgtgaacgtaaagcgcgagtatgaccatatgaatgggtcccgggagtcaccagtggattgcagcgtgtccaagtgcagtaaactcgtgggaggcggcgaaagcaaccccatgaattataacagctacatggacgagaagaacggtccacctcccccgaacatgaccacaaacgaacggcgcgtcattgttcctgcagacccaaccctgtggacacaagagcacgtgagacagtggttggagtgggccatcaaagagtactccctgatggaaatcgacacatccttcttccagaacatggacggcaaagaactgtgcaagatgaacaaagaggattttctgagggccacaacactgtacaatactgaagtgctgctgtcacatctaagttacctcagagaatccagccttttggcttacaatacaacttctcatacggaccagtccagccgtttaagtgtaaaggaagatccctcttacgacagcgttaggcgaggtgcctggggcaacaatatgaattcaggtttaaacaaatccccccccctgggaggggctcagacaatctcaaagaacaccgagcagcgaccccagcctgacccctatcaaattctagggcccacttcatcgcggctggcaaatccagggtctgggcaaatccaattatggcagttcctactggagctcctgtcggattctgcaaacgcttcttgcattacttgggagggaactaatggggaatttaagatgaccgaccccgatgaagtggccagacggtggggtgaaagaaagagcaaacccaatatgaactatgataaactgtcacgcgctctgcggtactactatgacaaaaatataatgacaaaagtgcatggtaaacgatacgcttataagtttgactttcacggtatcgcccaagccttgcagccccacccaactgaatctagtatgtacaagtacccctctgacatctcatacatgccatcctatcacgcacaccagcaaaaggttaactttgtaccgcctcacccctcaagcatgccagtgacctcttcctccttctttggcgcagccagccagtactggacctctccaaccgggggtatataccccaaccccaacgtccctcgtcatccaaacacacatgttccttcacacttaggatcctactactag

SEQ ID NO: 117495 - DNA, 1359 bp, Artificial Sequence
  Description of Artificial Sequence: Synthetic coding sequence
atggacgggacaatcaaagaggccctgtctgttgtgtctgatgatcaatcgctattcgacagtgcctatggcgcggccgcccacctgccaaaggccgacatgaccgctagcggttcacctgactatggccaaccccataaaatcaacccactccctccgcagcaagagtggataaatcagccagtccgcgtcaacgtaaaacgggaatacgatcacatgaatgggagcagggagagtcccgtcgattgctcagtgtccaaatgcagcaagcttgtcggggggggggagtctaacccgatgaactacaactcttatatggacgaaaaaaatggacctcctcctcctaatatgaccaccaacgagcggcgtgtgattgtgcccgcagatccaacactttggactcaggagcacgtccgtcagtggctagaatgggctattaaggagtactcactcatggagattgacacatcctttttccagaacatggacgggaaagagctgtgcaagatgaataaggaggacttcctccgcgctaccaccttgtacaacacggaggtgctcctgagccatctgtcctacctccgggagtccagtctgctggcctacaataccacctcccatacagaccaaagtagccgtctgtccgttaaagaagacccaagctacgatagcgttagaaggggggcgtggggcaacaacatgaatagcgggttaaacaaatcacccccgctcggtggcgcccagaccatttcaaaaaatactgagcagaggccgcagcccgacccctatcagatcctcggacccacatctagcaggttggccaatcccggttcaggtcagatccagctgtggcagttcctgctggaacttttgagtgattcggctaacgccagttgcattacatgggaagggactaatggggaattcaaaatgactgaccccgatgaagtggcacgccgatggggcgaacggaagtcaaaacctaatatgaattatgataagctgagccgagcactgaggtactactatgacaagaatatcatgactaaggtccacggcaaacggtacgcatacaaatttgatttccacgggatagcgcaagcattacagccacacccaacagaatctagcatgtacaagtatccaagcgatattagctatatgcccagttaccacgcccaccagcagaaggtcaattttgtgcccccccacccctcgtctatgcctgtgacaagctcctcctttttcggggctgccagccagtactggacctcacccaccggagggatctaccctaatccaaacgtgccacggcaccctaacacccatgtaccatcccatcttggtagctattactag

SEQ ID NO: 117496 - DNA, 780 bp, Artificial Sequence
  Description of Artificial Sequence: Synthetic coding sequence
atggatcctgggtctctcctggcgtacaacactacatcacataccgaccaaagctctaggctcagcgttaaggaggatccttcatatgactccgtgaggcgtggtgcgtggggcaataacatgaattccggattgaacaagtctccaccgctgggcggcgcccagacaataagcaagaacactgaacaacgtccacagcccgatccctaccaaattctgggcccaaccagcagtcgactcgcgaatcctggcagcggccagattcagctgtggcaattcctgctcgaattgttgtcagacagcgctaacgcaagttgtattacctgggaaggcaccaatggggagttcaagatgacagaccccgatgaggtggcacgtcggtggggtgagcggaagtctaagccaaatatgaactacgacaagcttagcagagccctgcgctattactacgataagaatatcatgactaaagtgcacggtaaacgatatgcctacaaattcgattttcatggcatcgcgcaggcacttcagccccatccaactgagtccagcatgtacaaatacccctcagatattagctatatgccaagctaccatgctcaccagcagaaggtaaattttgtccccccacatcctagctcaatgcccgtaacttccagctccttctttggcgccgctagtcagtattggacctcccccaccgggggcatctaccctaatcctaatgtgcctcgtcacccaaacacccacgtcccaagccatctcggctcctactactag

SEQ ID NO: 117497 - DNA, 1944 bp, Artificial Sequence
  Description of Artificial Sequence: Synthetic coding sequence
atggccgaggaagaggctccgaagaaaagccgtgccgcaggaggaggcgccagttgggagctctgtgcaggcgcactgagcgcccgactggcagaagaagggtccggagatgctgggggcaggagaagacccccagtggatcctcggcgtctcgcgcggcagctactactattgctttggctgctggaggctccactgctcttaggcgtgcgggctcaggcggcgggccaaggacccggccaaggcccaggccccggacagcagccaccaccacctcctcagcagcagcagtctggtcaacaatacaacggagagcggggcataagtgtgccagatcacggttattgtcaaccaatctccatacctctgtgcacagatattgcttataaccagactatcatgccaaacctcttaggccatacaaatcaggaagatgcaggcttggaggtgcaccagttttaccccctggttaaggtgcagtgttcagcggaactgaaattctttttgtgctctatgtacgcccccgtgtgcaccgtgctggaacaagctctgccgccgtgcagatctctatgtgagagggcaagacagggctgcgaagcgctcatgaacaaatttggctttcagtggcccgatactctgaaatgcgagaagttcccagtccatggagccggagagctttgcgtgggccagaatactagcgataaggggaccccgactcccagcctgttaccagagttttggaccagtaaccctcagcacggcggggggggacaccgggggggatttcccggaggcgccggcgcatcagaaagaggcaagttctcttgtcctagggcgcttaaggtgccttcttacctgaactatcacttcctaggcgagaaagactgcggcgctccttgcgaacccactaaagtttacggacttatgtatttcgggcctgaggagctgaggttcagccggacgtggatcgggatttggtctgtgctgtgctgcgcctctacactctttactgttctgacataccttgtggatatgcggcggttttcctaccccgagcgccccatcatcttcctctccggctgttacaccgcagtcgcagtcgcatatattgcaggattccttttggaggacagagtggtgtgcaacgacaagttcgcagaagatggcgctaggactgtcgcccaggggacgaagaaagagggctgcactattctgtttatgatgttgtacttcttcagtatggctagctctatttggtgggtcatcctgagtctgacgtggttcttggccgcagggatgaaatggggccatgaggctattgaagctaacagccagtacttccacctggccgcctgggctgtgcctgctattaagacaatcactattttggcccttggacaggtggacggtgatgtgctgtccggtgtctgtttcgtaggccttaataatgttgatgcactgaggggatttgtcctcgctcctttgttcgtctacctcttcattggaacctctttcttgctggccggattcgtgagtctgttccggatccggacaataatgaagcacgacggtaccaagaccgagaaactagaaaagctgatggtgaggatcggggtgttctccgtcctctacactgtccctgccaccattgtgatcgcgtgctacttctacgagcaggcatttcgggatcaatgggagcggtcctgggttgctcagtcatgcaagtcttacgctattccttgccctcacctgcaggctggcgggggtgcacccccccatcccccaatgtctccagactttacggtgtttatgatcaaatatctgatgaccttaattgtcggaatcacaagtggattctggatttggtccggaaagaccctcaacagttggcgtaagttctatactcggcttactaactccaagcaaggagaaacaacagtgtag

SEQ ID NO: 117498 - DNA, 1284 bp, Artificial Sequence
  Description of Artificial Sequence: Synthetic coding sequence
atggaggcgatggctgcctctacatctttacccgatcctggtgatttcgataggaatgtcccacggatctgcggagtgtgcggagacagagccacaggattccactttaatgctatgacatgcgagggctgtaagggatttttccgccggtctatgaagcgcaaggctctgttcacatgcccttttaacggagactgcaggataacgaaagataatcgcagacattgtcaggcttgcagactgaagagatgtgtcgacattggcatgatgaaggaatttatcctgaccgatgaagaagtgcagcgcaagagagagatgatcttaaaacgaaaagaggaggaagccctcaaggatagccttagacctaagctgagcgaagaacaacagcgcatcatagctattcttctggacgcccatcataaaacttacgaccccacatattccgacttctgccagtttagacctccagtacgggttaacgacggcggcggtagtcatccctcccgccccaatagccgccacaccccgagcttctcaggagactccagctcctcatgttcagaccattgcatcacctcaagcgatatgatggattcgagctcattctctaacctagacctaagcgaggaggattccgacgatccctccgtaacgttggaactctctcagctctccatgctcccgcatctcgccgaccttgtttcctactcgatccagaaagttatcggtttcgcaaaaatgatccctgggttcagagaccttacctcagaggaccagattgttctgctcaagtccagtgcgattgaggttatcatgctccgatccaacgagagtttcacgatggatgacatgagttggacgtgcggaaaccaggactacaagtaccgggtgtcggacgtgactaaggcggggcattcacttgagttaatcgagccattaatcaagttccaggtgggcctgaaaaagttgaacctgcacgaggaagagcacgtcttgctgatggccatttgcatcgtgtccccggataggcctggggtccaggacgccgctttgatcgaggcaatacaagatcgactgtccaacacgttgcagacatacattcgatgtaggcatcctcccccaggctcacatcttctatatgccaaaatgattcaaaaactcgcggatttgagatctctgaacgaggaacattccaagcaatataggtgtctctcattccagcccgagtgtagtatgaagctcactccgctcgtgcttgaggtcttcggaaatgagatttcctag

SEQ ID NO: 117499 - DNA, 1365 bp, Artificial Sequence
  Description of Artificial Sequence: Synthetic coding sequence
atgcctgctcaccgggaccccgacgtgcaggggcatagactacagcacgacagttacgcccagcccgacggaccaagggagccagctagaggcagccacccagtcgcgagggtacgtgctgccggaggagtgagactccctcgcccgccccccctgctgcccgtacttgcagttcgagcagatgtgcatagggctggcctgtaccctcatcccagattgcctggccacgttcgagccggacccgcgcaggttctgcccgactacggcgccgtgcagctgcaggtcgcccggctccctgggctgccggagaccccccaacaggaaaggcctcagttgcccgtacacggaggggcacagcagcgcctcgggcgagcacatcctggcctgggccctgtccccgccgctgtgccagcagctgctgctccccagcgagctggcgcgccagcagaggggcggggacctcgtgcgcgccgattacggcagcccggccaggtaccacccagaggggaagagagagtggtgcgcgctgccctgcacgcccgccgaggtagagttctggaaccgcgtggccaggctctgcgatcaggactcgctggccacttaggcggcgcagtgcttctgctgcagcggcttcacagggcccacctcccacacagacccgggcctcttcctctgccgcgcgccccccaccatctgcccctgcacgtgcttctccgactccttagaggcctcccgcatcctccactccggagaaggcgcgaacacagactccgcccaggtcaaaggcccgccctctgccaccccggaggaacaggcgaacatagactgcacgcaggtctgcccgggccactgcttctgaggcatggacaactagcagtggtgggtgggccacacgcccatttagtccctgggaggcgccaggaggtcggtcccagaggccacaggagccagcagcagctgctccctcccggctccctgggtcaccccgggggagaagaccaccccgaccccggacacgcccagggtggcggcggcagggctcaccgcgggttactccgcggacagcacggtcgtcagagagctcatcgcttgcgagcccacagtcccgggttactgcccggtcaccggcatgtgctccatccactgggtttgcgaggccctgttcctcacccggagggcgacgaggatggaaggcgggagcacggacaggccggggaagcgcacggggcatacagggcacttctgtgcgccgtgcacagggccgggcatctttgcgacaggctactcctccttcggaccccccaacatggacttctcgaggatcccggaggagcggcacaggtccaaaacgagcagccagattag

SEQ ID NO: 117500 - DNA, 1698 bp, Artificial Sequence
  Description of Artificial Sequence: Synthetic coding sequence
atgcggcccaggtcggcacttccgcgtctccttctgccattgctgctgctgcctgcagccgggcctgcacagttccacggagaaaagggtatcagtatacctgatcatgggttctgtcaacccatcagcatccccctgtgtaccgacattgcttataatcagacgattatgccaaatctgctgggtcatacgaatcaagaggacgccgggctagaagtacatcagttctaccccttggtgaaagttcaatgtagtccggagctgcgcttcttcctgtgttctatgtatgcgccagtctgcacagtgctggagcaagccattccaccgtgtcgcagtatttgcgaacgagcgcggcaaggatgtgaggccctcatgaataaatttgggtttcagtggcccgagcgcctaagatgcgagcactttccgaggcacggcgcagagcagatttgtgttggacagaatcactccgaggacggagcccctgccctgttaacgaccgcaccaccccccggattgcagcccggagccggaggcacacccggaggacccggcggtggcggcgcgccaccgcggtacgctacactggagcaccctttccactgcccacgcgttcttaaagtaccgtcctacttgtcctataagttcctcggcgaaagagactgcgccgccccatgcgagccagccaggcctgacgggagtatgtttttcagccaagaggaaactaggtttgcccggctgtggattcttacatggtccgtgttatgttgtgctagcacattttttactgtgacgacttatctcgttgatatgcagaggttccggtaccccgagcgccccatcatattcctctcaggctgttacaccatggtgtctgtcgcctatatagcgggcttcgtccttcaagagcgtgttgtttgcaacgagcgtttttccgaagacggatataggaccgtcgttcaggggacaaagaaggagggatgtaccatcctatttatgatgctttacttttttagtatggcatcttctatttggtgggttatcctgtcactgacatggtttctagcagccggcatgaagtgggggcacgaggccatcgaggcaaattcacaatattttcacctagccgcctgggccgtgcccgcagtgaaaactatcaccattctggctatgggacagattgatggcgatcttcttagcggcgtgtgttttgttggcctaaacagcctcgatcctttaagaggtttcgtcctggctcccctgtttgtctatctctttattggcacgtcattcctgttggctgggttcgtgtccttgttcagaatccgcaccatcatgaaacacgatggtaccaaaactgagaaattagaacgactgatggtccggattggtgtattttcagtactttacacagttcccgccacgattgtgatagcatgttatttctacgagcaggccttcagagaacactgggagagatcctgggtgagccagcattgcaaatccttggcaattccctgccccgctcattatacccccagaatgtctcctgatttcaccgtgtatatgattaagtacctcatgacactgattgtgggaataacctccgggttttggatctggtcaggtaagacactgcattcctggagaaaattttacacacgacttacgaatagcaggcatggcgaaaccacagtgtag

SEQ ID NO: 117501 - DNA, 1926 bp, Artificial Sequence
  Description of Artificial Sequence: Synthetic coding sequence
gcacggggggtctcgggctgtagtgtaaggccccgccaggcgagtggccaggcccacaggcctctgccacggcccgcaagtcccaccctaaggcctagggtaaaattcgcaaaaagaagaggacgaagacagcctcagaggggtggcggcggagaggaagcccagtccccaggctgggggagaggacgcggcggacggcaaggcgctggctggggggcagcggccagcatgcgccccaggtcagctctcccccgattgctccttccccttcttctcctgccggcagcaggccctgcccagttccacggggagaagggaatcagtatccccgaccatgggttttgccagccgatatccatacctctgtgtaccgatatagcctacaatcagactattatgcccaatctcctggggcacacaaaccaggaagatgctggcctggaagtacatcaattttacccactggtcaaagttcagtgctcccccgagctgagatttttcctctgctccatgtatgcgccggtgtgtactgtcctggagcaggctatcccaccctgtaggagtatctgcgagcgcgcacgtcaggggtgcgaagcacttatgaacaaattcggatttcagtggccagaacgtctccggtgcgagcatttccccaggcatggggccgagcagatatgtgtcgggcagaatcactccgaagatggcgctcccgccctgcttacgacagcccctcctccaggactgcaaccaggagcgggcggaacacctgggggcccaggcggtggaggtgctccgcctcgctacgctaccctggagcacccttttcactgccctagggtgctaaaggtgccctcttatctgtcctataagtttctgggcgagcgtgactgtgctgctccgtgcgagcctgcaaggcctgatgggtcaatgtttttctctcaagaggaaacccgtttcgctcgcctttggattctcacatggtcagtcctgtgttgcgcatcaacattctttactgtaaccacatacctcgtcgatatgcaacgctttaggtaccctgagcgacctatcatattcttatctggatgctatacaatggtgtccgtcgcctacattgctgggttcgtgctgcaagaaagagtggtctgcaatgaacgcttcagcgaggacggataccgaacagtcgtgcagggtacaaagaaagagggctgcaccattctgttcatgatgttgtattttttcagcatggctagttccatttggtgggtgattctgtctcttacctggtttctggctgctggtatgaaatgggggcacgaggcaatcgaagcaaattctcagtacttccacctggcggcatgggcagttcccgcagtcaaaacaattactatcctggcaatgggacagatcgatggggacctcctaagcggggtctgtttcgtcgggttgaattcccttgatcctctacgcggttttgtcctcgcccctctgtttgtgtatttgttcatcgggacctcttttcttcttgccgggttcgtcagcctgtttcgaatccggactattatgaagcatgacggcactaagactgaaaaattggagagactaatggtgagaatcggtgtgttttccgtgctctacacggtgccagctactattgtgatcgcctgttatttttacgaacaagcattcagggaacattgggaaagatcctgggtatcccagcattgcaaatcgctggccattccctgtcctgcccactatacacccagaatgagccccgatttcaccgtctacatgattaagtatctgatgaccctcatcgtaggaatcaccagcgggttttggatctggagtgggaagacacttcacagttggaggaagttttacacacgtttaacaaacagtcgccatggagagaccaccgtttag

SEQ ID NO: 117502 - DNA, 2001 bp, Artificial Sequence
  Description of Artificial Sequence: Synthetic coding sequence
atggccatgacctggattgtgttctctttgtggccattgactgtgtttatgggccacataggcgggcatagccttttttcatgtgagcctatcaccttgaggatgtgccaagaccttccttacaacaccactttcatgcctaatctgctgaaccattatgatcagcaaaccgcggccctggctatggagccattccatcccatggttaatctcgactgtagcagggacttccggccatttctttgtgctttgtacgcgcccatctgtatggagtacggcagggtgaccctgccttgtcggagactctgccagagggcatactctgagtgcagcaaactcatggagatgtttggagtaccttggcccgaagatatggagtgctcacggttccccgattgcgatgagccttaccctcgattggttgacttaaacctggctggagagccgactgagggagcccctgttgctgtgcaacgcgactacgggttctggtgtcctcgagagctcaagatcgaccccgacctaggctactcctttttgcacgtaagggattgcagcccaccgtgccctaatatgtatttccgacgcgaagagctcagttttgcacgctactttattggcttaataagcatcatttgcctgtctgccactttgttcaccttcctgacctttttgatagatgtcactcgatttagatatcccgagcggcccataatattctacgccgtatgttatatgatggtgtctctgatcttttttattgggttcctccttgaggatcgagtggcttgtaacgcaagcattcccgctcagtacaaagcgagtactgtaacacagggttcccacaacaaagcgtgcaccatgttattcatgattctttacttctttaccatggctggttctgtgtggtgggtgattcttacaattacttggttcctggccgcggtgcccaagtgggggtctgaggcaatagagaaaaaagctctgctgttccatgcctcagcctggggaatcccaggaacgctgacaattattctgcttgccatgaataaaattgagggcgacaatatctcaggtgtctgcttcgtgggtctgtacgatgtggacgcccttcggtatttcgtgctggccccgctctgcctttatgtggtcgttggtgtttcattgttactggcaggcatcatctctcttaatagagtgaggatcgagataccactagagaaggagaaccaagacaagctggtgaaattcatgattcgaatcggagtgttctcaatcctgtatttagtacccctcctggttgtcattgggtgttacttctacgaacaggcttatcgcggcatttgggaaaccacttggatacaggagaggtgtcgcgaataccacatcccttgtccttatcaggtgactcagatgtcaaggccagacctgattctcttcctgatgaagtacctgatggcattgatcgttggcattcctagcgtattctgggtcggttctaagaagacatgcttcgaatgggcaagcttcttccacggaaggcggaaaaaggaaattgtgaatgagtcacgccaagtgctgcaggagccggattttgcccaatccttactccgcgacccaaacacccccatcattaggaaatctcgagggacaagcacccaaggcacatctacacacgcttcttctacccaattagccatggtggacgatcaaagatctaaagctgggtcaatacattccaaggtgtcgagctatcatggcagtcttcacaggtcacgggatggccggtacaccccctgttcttacagagggatggaagaaaggctgccgcatgggagcatgagtcgccttaccgaccacagtcgccatagttctagtcaccgcctgaatgagcaatctaggcattcctccatcagagacttatcaaacaatcctatgacccacatcacacacggcacgagcatgaacagagtaattgaggaggatggcacgtcagcttag

SEQ ID NO: 117503 - DNA, 108 bp, Artificial Sequence
  Description of Artificial Sequence: Synthetic coding sequence
atggctatgacatggattgtttttagtctgtggccactgaccgtttttatggggcacatagggggacatagtctgttttcctgcgagccaattaccctccggatgtag

SEQ ID NO: 117504 - DNA, 2001 bp, Artificial Sequence
  Description of Artificial Sequence: Synthetic coding sequence
atggcaatgacatggatagtgttctccctatggcctctgacagtgttcatgggtcatattggtggccactctttattcagctgtgagcccatcacactgcgtatgtgtcaggacttaccctataataccactttcatgcctaatctgttgaaccactatgaccagcagaccgccgccctggctatggagccatttcaccctatggtaaatctcgactgctccagagacttccgcccatttttgtgcgccctgtacgctccaatttgtatggaatacggacgcgtaacactgccctgccgcagactctgccaaagagcttattccgagtgctctaagctcatggaaatgttcggcgttccttggccggaggatatggaatgtagccgcttccccgactgtgatgaaccctacccaagactggtcgacctcaacctggccggggagcccaccgagggggccccggtggccgttcaacgcgactacgggttttggtgtccccgggaattaaaaatcgatcccgacctaggatactcctttctccacgttcgcgattgcagccccccttgcccgaacatgtacttcaggcgggaggaattatcctttgcccggtacttcatcgggttaatttctatcatatgcttgagtgcaactcttttcacatttcttaccttcttaatcgatgtcacacgtttcaggtatcctgaaagaccaataatcttttatgccgtgtgttacatgatggtgagcctgatcttctttattgggtttctactggaagaccgagttgcgtgcaacgcttctataccagcacagtacaaagccagcacagtgacacaaggcagtcacaacaaagcgtgcaccatgttgttcatgatactgtacttcttcaccatggccgggtctgtctggtgggtgatccttaccatcacatggttcctggctgctgtgcccaaatgggggtctgaggctattgaaaagaaggccctgctgttccatgcctccgcgtggggaattccagggacacttactattattcttcttgcgatgaacaaaatcgagggggataacatttcaggcgtgtgcttcgtggggctctatgatgtagacgctctgagatactttgtccttgccccgttgtgcttgtacgtggtggtgggcgtgagcttacttctggctgggattatcagcctgaatcgcgtccggatcgaaattccattagaaaaggaaaaccaagataagctcgtcaagtttatgatcagaatcggtgtatttagtatactatacttggtccccttgctcgtggttattgggtgttatttttacgagcaggcctaccgggggatctgggagacaacgtggatccaggaacgttgtcgcgaataccacattccatgcccatatcaggtgactcaaatgagccgccccgatttaatcttgttcctgatgaaatatctcatggccctgatcgtgggaatcccttcagtgttctgggtaggaagcaagaaaacctgcttcgaatgggcctcgttctttcatggcaggcggaagaaggaaattgtgaacgaaagtaggcaagtgctgcaggagcccgacttcgcccagtctctcctgagggaccccaacacccctattattcggaagtctagagggacctcaactcaaggcacaagtactcacgccagctctacccagcttgcgatggtcgacgaccagcgcagtaaagcgggctctatacatagcaaggtgagtagctatcacgggtctttgcatcgcagccgggatggaagatacacaccgtgctcttataggggaatggaagagaggcttcctcacggaagtatgagccgacttactgatcattcaagacattcctcatctcaccggctcaatgagcagtcgcggcactcctcaattagggatctttccaacaaccctatgactcacatcacacatgggacatctatgaacagagtaatcgaggaggacggtacctccgcttag

SEQ ID NO: 117505 - DNA, 1614 bp, Artificial Sequence
  Description of Artificial Sequence: Synthetic coding sequence
atggcttggaggggcgctggcccctcggtgcctggggctccaggaggcgtcgggctcagtcttggtctactgctgcagctgctacttctgcttggtcccgcaagggggtttggcgacgaggaagagagaaggtgcgaccctatcagaatttctatgtgccagaatttaggatataacgttactaaaatgcctaacctggtgggacacgaactacaaacagatgccgaactgcagctaacaacttttactcccctgatccagtacggatgttcgagtcagttacagttcttcttgtgtagtgtgtacgtgccaatgtgtacggaaaagatcaatatccctatcggcccctgtgggggaatgtgcctgtctgtgaagcggagatgcgagccagtcctaaaggaatttggtttcgcctggcctgaatccctaaattgttcaaaatttccccctcagaatgaccataaccacatgtgtatggagggtccaggcgacgaggaagttcccctccctcataaaaccccaatccagccaggagaggaatgtcactctgtcggcactaattctgatcaatacatttgggtgaagcgttcattaaactgcgtcttgaagtgcggatacgatgctgggctgtacagcaggtctgcgaaggaattcactgacatctggatggctgtttgggctagcttgtgctttatctccaccgcctttactgtgcttaccttcctgatagatagctctaggttttcttatcctgagagaccaatcatcttcctctctatgtgttacaacatttattctattgcatatatcgtgagacttactgtaggacgcgagcgtatttcttgtgatttcgaggaagcggctgaaccagtgctcattcaggagggcctcaagaataccggctgtgccatcatttttctcctgatgtactttttcgggatggcgtcgtctatttggtgggtcattctgacccttacttggtttctcgccgccggactgaagtggggacatgaagccatcgagatgcactctagttactttcatattgctgcatgggccatccctgccgtgaagacgatcgtcattctgatcatgagattggttgacgccgacgagcttactggactgtgctatgtgggaaaccaaaatctcgacgctcttacaggcttcgtcgttgctcctttgtttacctatctggtcatcgggactctcttcatcgctgccggtcttgtggctttattcaagattcgatcgaatctacagaaagacgggaccaagactgacaaattagagaggttaatggtgaaaattggggtcttttccgtgctgtacaccgtgcccgctacatgcgtgatcgcctgttatttctacgaaatctccaattgggctctgtttcgctactcagccgatgattcgaacatggctgttgagatgctgaagatttttatgagtctccttgtggggattactagcggaatgtggatttggtctgctaagaccctgcacacatggcagaagtgcagcaataggctcgtgaacagcggcaaggtcaagcgcgagaaaagaggcaatggctgggtaaaacctggcaaaggttccgaaacagtggtatag

SEQ ID NO: 117506 - DNA, 2121 bp, Artificial Sequence
  Description of Artificial Sequence: Synthetic coding sequence
atggagatgtttacctttctgctgacgtgcatatttctacctctgctgagaggacactccctgtttacatgcgaaccgatcaccgtaccaagatgcatgaagatggcgtacaacatgacattttttcctaaccttatgggccactacgaccagtccatagccgctgtcgaaatggaacattttctcccattagctaacctggagtgcagtccgaatattgaaacattcctgtgtaaggcctttgtccctacctgcattgagcagatacatgtggtacctccatgtcggaaactatgtgagaaggtgtattctgactgcaaaaagctcatcgatacattcggcataaggtggccagaggagctggagtgcgaccgacttcagtactgcgatgagaccgtgcctgttaccttcgatcctcacacagaatttctcgggccgcagaagaagacagaacaagttcagcgagatatcggattctggtgtccccgccatctcaagacttccggcggtcaggggtataaatttctaggcatagaccagtgtgcacctccttgccctaatatgtattttaagagcgacgaactcgagttcgcgaagtcatttataggcactgtgtccatcttctgtttgtgtgcaactcttttcaccttcttgacattcctgatagacgtccgtcgcttccgctaccctgagcggcctataatctactacagtgtgtgttacagtatcgtttcactgatgtactttatagggtttttactcggcgatagcaccgcctgcaacaaggccgacgagaagttggagctcggagatacagtcgtattagggtcccaaaataaagcttgcaccgtcctattcatgctcttatattttttcacaatggccggcacagtgtggtgggttatattgaccatcacttggttcctggccgccggccggaagtggtcatgtgaggccattgaacagaaggccgtgtggttccatgctgttgcgtgggggactccgggcttcttgaccgtcatgctattagcaatgaacaaagttgaaggcgataacataagtggtgtgtgctttgtgggcctctacgaccttgatgctagtaggtacttcgtgcttctacccctgtgtctctgcgtgttcgtcggtctgagtcttcttctggccggaattatctctcttaatcatgtgcggcaggtaatccagcatgacggacggaaccaggagaaactcaagaagttcatgatcagaatcggagtgttcagcggcctgtaccttgtccctctggtaactttgttagggtgttacgtatatgaacaggtgaataggattacctgggagatcacttgggtgtccgaccattgtcgtcagtaccacatcccatgcccgtaccaggccaaggccaaggcacgccctgagctggccttgtttatgataaagtatttgatgacactgatcgtcggtatctcagcagtcttttgggttggctcgaagaaaacttgtacggagtgggctgggttctttaagcggaacagaaagcgcgaccctatatccgaaagcaggcgagtgctccaggagtcatgcgaattcttcctgaaacacaattccaaagtcaaacacaagaaaaaacactacaagccttcatcccacaaactgaaagtgatctcaaagtcaatgggcacatcaaccggcgcgactgctaatcacggaacgtctgctgtggcaattacttctcatgactacctgggccaggaaaccctgacggagattcagaccagccccgagactagtatgagagaagtcaaggctgatggcgctagtactccccgcttacgggaacaagattgtggtgagcctgcctctccagcggcaagcattagtagattgagcggggaacaggtagacgggaaagggcaggctggcagcgtcagcgagtctgctagatcagaaggacggatatctccaaagtcagatatcacagacaccggtctagcgcaatctaacaatctacaggtccccagcagcagcgagccaagtagtcttaagggctccacaagcctcctggtgcacccagtgtctggggtgaggaaagagcaaggtggcggttgtcatagtgatacatag

SEQ ID NO: 117507 - DNA, 2121 bp, Artificial Sequence
  Description of Artificial Sequence: Synthetic coding sequence
atggaaatgttcacattcttactcacctgtatcttcctcccacttctgcgtgggcactcgctgtttacctgcgagcccattacagtaccacgctgcatgaagatggcctacaacatgaccttcttccccaatctgatgggtcattatgaccagtcaattgctgccgtggagatggagcattttcttccccttgctaacctcgagtgttctcccaatatcgagaccttcttgtgcaaggcctttgtcccaacttgcatagaacagatccacgtcgtacccccatgccgaaaactgtgcgagaaggtctactcagactgcaagaagctgatcgatacctttggaattcgatggcccgaggaactggaatgtgatcgattgcaatattgcgacgaaacggttcccgtgacgttcgaccctcatactgagttcttagggccccagaagaagaccgaacaggtgcagcgggatatcggtttttggtgtccccgacatttaaaaaccagtggcgggcagggatacaagtttctcggcatagatcaatgtgcccctccctgtcctaacatgtacttcaaatcagatgagcttgagtttgccaagtcattcattggcacagtgagtatattctgtctttgcgcaacccttttcactttccttactttcctcatcgacgtccgcagatttcgctatcctgagcggcctattatctactatagcgtgtgctacagcattgtctcactcatgtacttcatagggtttctgctcggcgacagtacagcctgtaataaagctgatgagaaactcgagctcggagatacagttgtcctgggttcacagaataaggcttgcactgtcttgtttatgctcttatatttctttaccatggctggcaccgtgtggtgggtgatcctaacaattacttggtttctcgctgctggaagaaagtggtcatgtgaagccatcgagcagaaggcagtgtggttccacgcagtcgcatggggaacacccggttttctgacggtcatgctgctggctatgaataaggtcgagggcgacaacatctccggagtctgctttgtgggtctatatgatctcgatgcctctcggtacttcgttcttctgccgctctgcttgtgcgtgttcgtgggcctctctcttctgttagctgggatcatttccttaaaccatgtacgacaggtgatccagcacgacggtagaaaccaggagaaactcaagaagttcatgatccgcataggagtgttctccgggctgtaccttgtgcccttggtaaccttattggggtgttatgtctacgagcaggtaaatagaatcacttgggagatcacttgggtcagtgatcactgcagacagtatcatattccatgtccatatcaggccaaggccaaagctagacccgagttagccctttttatgattaaatatctgatgacccttatcgtgggaatatctgcagtgttctgggtggggtccaagaagacgtgtaccgagtgggccgggttcttcaaaaggaatcgaaagcgcgatcctatttcagagagtaggcgagtgctgcaggagtcgtgtgagttcttcctgaaacacaacagcaaggtgaagcataaaaagaaacactacaaaccttcttcccacaagttgaaagtcattagcaagtcgatgggcacctcaaccggcgccacagccaaccatgggacaagtgctgttgcaattacttcccatgattacctcggacaggagacgctgacggagattcaaaccagcccagagacctctatgagagaagtgaaggcagatggagctagtacaccccggcttagagagcaggactgtggggaaccagcatctcccgcggcatccatttcgagactcagcggcgaacaagttgatggaaagggacaagcgggttcagtgtcggagtctgctcgaagcgaggggcgcatttcccctaagagcgacatcactgacactggcctcgcacagtcaaacaatcttcaagtaccttcctcgtccgaaccttcctcactcaagggttcaacatcactgcttgtccaccccgtgtccggagtccgaaaagagcagggtgggggttgtcattctgatacatag

SEQ ID NO: 117508 - DNA, 2025 bp, Artificial Sequence
  Description of Artificial Sequence: Synthetic coding sequence
atgaaaatggcatacaacatgacatttttccccaatttaatgggccactacgatcaaagcatcgccgcagtagagatggaacattttctccctttggcaaacttggagtgttctcccaacattgagactttcctttgcaaggcctttgtgcctacatgcatagaacagattcatgtggtcccgccttgcaggaagctctgtgaaaaagtgtacagtgactgcaagaaactcattgacactttcggcatccggtggccggaggaactggagtgtgacaggcttcagtactgcgatgaaacagtgcctgtgaccttcgacccccatacggagtttctggggcctcagaagaagaccgagcaggtgcaacgcgacattggattctggtgccctagacacctgaaaacaagtggcggccagggctacaaatttcttggcatagatcaatgcgcccccccctgtcctaacatgtatttcaagagtgacgagctcgagtttgccaaatcttttattggcaccgtcagcattttctgcctgtgtgccactctattcaccttcctgacctttctgatagatgttaggaggtttcgataccctgagcggcccatcatatattacagcgtgtgctactccattgtttcactcatgtattttattgggttcttgctgggcgacagtactgcttgtaacaaagccgacgagaagttggagctcggggatactgtcgtattgggaagtcaaaataaggcgtgtacagtattgtttatgttgctgtactttttcacaatggcaggcaccgtctggtgggtgattctgactattacttggtttctggcagctgggaggaaatggtcctgcgaggccattgagcaaaaagccgtttggtttcacgcagtagcatggggcactccagggtttttgaccgtgatgcttctagccatgaacaaggtggaaggcgataacatctctggcgtgtgtttcgtgggtctttacgatctggatgcctcgaggtactttgtgcttctcccgctgtgcctctgcgtctttgtgggcttgagtctcctccttgcagggatcataagtctgaaccatgttaggcaagtcatccagcatgacggccgcaatcaggaaaaacttaaaaaattcatgatacggatcggcgtatttagtggtctgtacctcgtccctctggttaccctgttggggtgctatgtctacgagcaggtgaataggataacatgggaaataacatgggtctctgatcattgtcggcagtaccacataccttgcccctatcaagcaaaagccaaagccaggccagaacttgccctttttatgatcaagtacctgatgacactgatcgtgggtatctccgccgttttttgggttggaagcaagaagacttgtacagagtgggccggattcttcaaaagaaatcggaaacgcgatcctatctcggagtccagacgggtactccaagaatcctgtgaattttttttgaagcataattctaaagtcaagcacaagaagaagcactataagcctagttcccataagctgaaggttataagcaagtccatgggtacatctacaggtgccacggccaaccacgggacttccgccgtagctattaccagtcacgattatttgggacaggaaacactcacagagatccagacctcccctgagacatctatgagggaggtgaaggccgacggtgctagcacccctcgcctgcgcgaacaggactgcggagagcccgcttcacccgcagcctcaatctcccgactgtccggagaacaggtcgatggtaagggacaggccggatctgtctcagaatcagccagatcagagggccgcatctcccccaagagtgatataacagacactggcctggctcagtcaaacaacctgcaggttccttcctctagcgagccgtcctccctgaagggctccacttccttgctggtccaccccgttagtggcgtaaggaaggagcaaggcggaggatgccattctgatacatag

SEQ ID NO: 117509 - DNA, 1956 bp, Artificial Sequence
  Description of Artificial Sequence: Synthetic coding sequence
atgctggcccagcatttcctgcctctggccaaccttgaatgttcccccaatatagagacattcctatgtaaggcttttgtccccacatgtattgagcaaatacacgttgtgcccccgtgcagaaagctttgcgaaaaagtctatagtgactgcaaaaaactcatcgataccttcggcatccggtggcccgaggaattggagtgcgacagactgcagtactgcgatgaaaccgtgccagtgacattcgacccacatacggagttccttggaccacaaaaaaaaaccgaacaggtgcaacgggatatcggtttttggtgccctcgtcacctgaagacgtctggtggacagggatataagtttttgggcattgaccagtgtgcacccccgtgtccaaacatgtacttcaagagcgacgagcttgaattcgccaagagctttatcggtaccgtctcaattttttgcctgtgtgcaaccctgtttacttttttgacgtttctgatcgacgtccggcgatttaggtatccagaacgtcctataatatactacagcgtgtgctatagcattgtgtcacttatgtactttatcggattcctgttaggggattccaccgcttgcaacaaagccgacgagaaactggagctaggagacactgtggtcctcggctcgcaaaataaagcctgcaccgtcctgtttatgctcctctacttttttaccatggcaggaaccgtttggtgggtgatcctaactattacctggttcttggcagccgggcgaaagtggtcttgcgaagcaatcgaacaaaaagccgtctggttccacgctgttgcatggggaacccctggcttcctgacagtcatgttattagccatgaacaaagtggaaggcgacaacatctctggtgtctgcttcgtcggtctgtacgatcttgatgcctcccggtattttgtgctgctccctttatgcctgtgtgtcttcgtagggttgtcgcttctcctcgccggtatcatcagcctgaaccatgttcgccaggtgatccaacacgacggacggaaccaagaaaagctcaagaagttcatgattaggatcggcgtgttcagcggcctgtatttagtgcctctagtcaccctcttaggctgttacgtctacgagcaggtgaacaggatcacttgggaaattacttgggtctctgaccactgtagacaataccacatcccttgtccgtatcaggccaaggcaaaggccaggcccgagttagcactctttatgataaaatacctgatgaccctgatcgttggaatatccgcagtgttctgggtgggaagcaagaagacgtgcaccgaatgggccggttttttcaagcgaaaccgcaagagagacccaatctctgagtcacgtagagtgctgcaggagtcttgtgagtttttcctcaaacataatagtaaagtgaagcacaagaagaagcattacaaacctagttctcataaactcaaagtaatctccaagtcaatgggtactagtaccggtgcaactgctaatcacgggacaagcgctgttgcaatcacctcccatgactatctcggccaggagacacttaccgagatccagacgtcaccagagacgtccatgagggaggttaaggccgatggcgctagcactccaaggctcagggaacaggattgtggagaaccagcctctccagctgccagcatctcacggctaagtggcgaacaggtggacggcaaaggccaagccgggtctgtaagtgagtctgcccgctctgagggaagaatctcacccaagagcgacatcacagatactggactggcccagagcaacaatctacaggtgcctagctcatcagagccctccagcttaaaaggtagcacttccctgctggtccatcccgtctctggtgtgcggaaagaacagggaggggggtgtcatagcgacacttag

SEQ ID NO: 117510 - DNA, 1206 bp, Artificial Sequence
  Description of Artificial Sequence: Synthetic coding sequence
atgacaagagtattacccagatggaagtggtcgtgcgaagcaatcgagcagaaggccgtttggttccacgcagtcgcatgggggacccccggcttcctgacagtgatgctcctcgccatgaataaagtcgagggcgacaatatctctggggtctgctttgtaggtctgtatgatctggatgcttcaagatactttgtgcttcttcctctctgtctgtgcgtttttgtgggcctgtcactcctgctggccggaatcatctccctgaaccacgtccgccaagtgatccagcatgacggcaggaatcaagaaaagctgaagaaattcatgatccggattggggtgttttccgggctgtacctggtgccactcgtgacactcctcgggtgctacgtgtacgagcaggttaatcggatcacctgggaaatcacttgggttagcgaccactgccggcagtaccatataccttgtccctatcaggccaaagccaaggcccgccccgagttagcgttgttcatgattaaatatctgatgactttaattgtaggcatcagcgccgtcttctgggtgggaagtaagaagacatgtacagaatgggccggtttttttaagcgcaaccgtaagagggacccaatttccgagtcacgccgggtcttgcaggaatcctgtgagtttttcctcaaacataacagtaaagtgaagcataaaaaaaagcattacaagccatcctcccacaaactcaaggtaatctccaagagcatgggcacctctaccggcgcgacagccaaccatggaacatctgccgtagccatcacctcacacgactatctggggcaggaaactctcacggagatccagaccagccctgagacctctatgagggaggtcaaggcagatggtgcaagcactccaaggctccgcgaacaggactgcggagaaccagccagtccggcagctagtatctcacggctgtcaggcgaacaagtggacgggaagggccaggctggatccgtttcagagtccgctcgatccgagggacgcatctcacctaagtcggacataacagatactggtcttgcacagagcaacaacttgcaggtgcccagtagtagcgagccatcctctcttaaagggagcacgagcttactggtgcacccagtgtctggcgtccgtaaggagcagggcggaggctgccacagcgacacgtag

SEQ ID NO: 117511 - DNA, 2085 bp, Artificial Sequence
  Description of Artificial Sequence: Synthetic coding sequence
atggaatggggctaccttctggaagttaccagcctcttggccgcactggccttgctgcagaggtctagcggagcagccgccgctagcgccaaggaactcgcatgtcaagaaattactgtgccactgtgcaagggaattggatataattatacatacatgcccaaccagttcaaccacgatacacaggacgaggctggcctagaggttcaccaattctggcctttagtggaaattcagtgtagccccgaccttaagttcttcctgtgcagtatgtacacccctatctgtctggaagactataagaaaccactccctccatgccgctcagtttgcgagcgcgcgaaagccggatgtgcgcccttgatgcgccagtatgggtttgcctggcctgatcggatgcgttgtgatcgcctgcctgagcagggaaacccagacaccctgtgcatggattacaatcgtaccgatctgaccaccgcagctccctcccccccgcgacgtctgccccctcctccaccaggagagcagccgccttccgggtctggacatggccgcccccctggtgccagacctccccacaggggaggtggaaggggcggcggaggaggcgacgcagccgccccgcctgcgcgaggaggcggaggcggggggaaagctcgtcctccgggtggcggcgccgctccatgtgagcctgggtgtcagtgtcgagccccgatggtcagcgtgagctcagagcggcaccctctgtataatcgtgtgaaaactggtcagattgctaactgtgcgctgccatgtcataacccgttttttagccaggatgaacgagcttttacagtcttttggatcggcctctggagcgtgctctgttttgtttccacttttgccaccgtgtccacattcttaattgacatggaacggttcaagtacccagagcgccccatcattttccttagcgcttgttacctctttgtgagcgtgggctaccttgttcgtctggtagctggacacgagaaggttgcgtgcagcggcggtgcacccggggcaggcggtgccggtggcgctggcggggccgcggcgggtgcaggagcagcgggggcaggtgcagggggtcctggtgggcggggagaatacgaggagctgggggccgtagagcagcacgttcgctacgagacaaccggaccagccctctgtaccgttgtgttcctgttggtatacttcttcggtatggcttcatccatctggtgggtaatcctgagcttgacctggttccttgctgccggcatgaaatggggaaacgaagccatagcaggctattcacagtactttcatctagcggcatggttggtcccttcggtcaagtcgattgctgtgttggcactgagtagtgtagacggggatcctgttgccggaatctgttatgtgggaaatcagtccctcgataatctgcgcgggtttgtactggcccctttggttatttatctcttcattggcacgatgtttctcctagccggctttgtatcattgtttcgaatccgttccgtcatcaaacaacaggatggcccaactaagacacacaaattagagaagttaatgattcgattgggcctcttcacagtcctgtatactgtccccgccgccgtggttgttgcctgcttattttatgagcaacataatcggcccagatgggaggccacacacaactgcccttgcttgcgcgacctgcagcctgaccaggccaggcgcccggactatgctgtctttatgcttaaatactttatgtgcctggtggttggaattacaagcggggtgtgggtgtggtcaggcaagacgctagagtcatggcgctcactgtgtacccgctgctgttgggctagcaagggcgccgccgtgggcggaggagccggcgccaccgccgcgggtggggggggagggcccggcggcggaggcggaggcggtcccggaggaggaggcgggccaggaggaggaggcgggtcattatactccgacgtgtcgacagggctcacatggagaagcggaacagctagtagtgtcagctaccctaaacagatgccactatcacaggtgtag

SEQ ID NO: 117512 - DNA, 1776 bp, Artificial Sequence
  Description of Artificial Sequence: Synthetic coding sequence
atggccgtggcccccctgcgcggagcactgctcctgtggcagctgttggctgctggaggagcagccttggagatcggaaggtttgacccggagaggggaaggggcgctgccccttgccaggctgttgagattcctatgtgcagaggcatcggatataaccttacaaggatgcccaaccttctgggccatacctcccagggcgaggccgctgctgaattagccgaattcgcaccactggtgcaatatggctgccactcacatcttcgtttcttcttatgttccctgtatgccccaatgtgcacggaccaggttagtactcctatacctgcatgtaggcccatgtgtgagcaagcacgccttaggtgtgcccccatcatggagcaatttaactttggatggcctgacagcttagattgtgcaagactgcccacgcgcaacgatccgcacgccctttgtatggaagctccagaaaacgcaaccgccggcccggcagagcctcataaagggctgggtatgcttcccgtggcgccacggcctgctagacctcccggcgatcttggacccggcgccggaggctccgggacatgtgaaaatccagagaagtttcagtatgtggagaaatctcgatcgtgtgcacctagatgtggccctggcgtcgaggtattttggtctaggcgcgacaaagacttcgccttggtctggatggccgtctggagcgctctttgcttcttttccaccgcattcactgtgctgacatttctactggagccccatcgctttcaatatccggagcgtcccatcattttcctctcgatgtgctacaacgtttacagcctggcattcctgatccgggccgtggccggtgcacagagtgtcgcttgcgatcaggaggcaggagccctgtatgtgatccaggagggtttggagaacacagggtgtacactcgtcttcctgctgctgtattatttcggaatggcgtccagcctctggtgggttgttctgactttaacctggttcctggccgctgggaaaaagtgggggcacgaagcaatagaggcccacggctcttacttccacatggctgcctggggcctgcctgctctcaaaactattgtgatattaacgctgcgtaaggtggcaggagacgagctcacaggcctgtgttacgtggcttctactgacgctgccgccctgacagggttcgttcttgtgcccctgtccggttatcttgttctgggtagcagtttcctgcttaccggcttcgtagctttatttcacattcggaagatcatgaagaccggaggcacgaacaccgagaagcttgagaagctcatggtgaaaataggggtgtttagtatactctacactgtgcccgccacctgtgttatcgtgtgttatgtttacgaacgcctaaatatggacttctggagattacgagccacggaacagccttgtgccgccgctgctggacccggagggcgcagagattgttccctgccaggcggaagcgtgccaactgtagcagtgttcatgctgaagatatttatgagtctggtcgttggtatcacctccggtgtgtgggtgtggtcctccaagaccttccaaacttggcagagcctctgctaccggaagattgccgctggtcgcgccagggctaaagcatgtcgcgcgcctggtagttatggcaggggcacccattgccactacaaggcacctactgtggtcttgcacatgaccaaaactgacccctcactagagaacccaactcatctctag

SEQ ID NO: 117513 - DNA, 978 bp, Artificial Sequence
  Description of Artificial Sequence: Synthetic coding sequence
atggtttgtggcagtcccggcggtatgctgctactacgagccggcctgctggccttggccgcactgtgcttactcagggtcccgggggctcgggcggccgcctgtgagcccgtgcgcatcccgttatgtaagagcttaccatggaacatgacgaagatgccgaatcaccttcaccattccacgcaggccaatgccattttagcgattgagcagttcgaggggctccttgggacccactgctcacctgaccttctgttttttctttgcgcaatgtatgccccaatctgcacaatcgactttcaacacgagcccatcaaaccatgtaaatccgtgtgtgagagagccaggcagggatgcgaacccatattaatcaagtatcgacactcttggccggagaaccttgcctgcgaagaactgcccgtgtacgataggggagtgtgtattagcccagaggctatcgtgactgctgacggggccgattttccgatggacagctctaacggtaattgccggggcgccagctccgagagatgtaaatgcaagcccatcagggcgactcagaagacctatttccgaaacaactacaattatgtgatacgtgccaaagtcaaggagatcaagacaaagtgtcatgacgtgacagcagtggtcgaggtgaaggagatactaaagagctcccttgtaaatattccgcgggatacggttaacttgtacaccagttccgggtgtttgtgtcccccacttaacgttaacgaagaatacattatcatggggtatgaggatgaggaaagaagcaggctgttgctggtggaggggagcatcgcagaaaagtggaaggatagactaggtaaaaaggtaaaacgttgggatatgaaattacgtcatcttggtctttctaagtctgacagttcaaatagtgacagcacacagtcgcaaaaatccggcaggaatagcaacccacgtcaagcgcggaactag

SEQ ID NO: 117514 - DNA, 930 bp, Artificial Sequence
  Description of Artificial Sequence: Synthetic coding sequence
atggaggagctgctccggagagaattgggatgcagctctgtaagagcgaccggacatagcggcggagggtgcatctcgcaagggaggtcgtacgacaccgaccagggcagggtctttgtgaaagtgaaccccaaggcagaggcacggcggatgttcgagggcgagatggcaagcttaaccgcgatactgaaaacgaataccgttaaggtgcctaaacccatcaaggtgctggacgcgccagggggcggtagtgttctcgttatggagcacatggacatgagacacctgtcttcacatgcagccaagctgggagctcagttggccgacctgcacctggataacaaaaaactgggcgaaatgcggctaaaggaggccggaacagtgggtcgtggcggaggccaggaggaaagaccgtttgtggccaggttcggattcgatgtggtgacatgctgcggctacctgcctcaggtgaacgattggcaggaagattgggtggtgttctatgctagacagcgaatccagccccagatggatatggttgagaaggaatcgggggatcgagaggccttacagctgtggagcgctttgcagcttaagatccctgatttattcagagacctcgaaattattccggctctgttgcacggcgacctgtggggagggaacgtggccgaagattcctccggcccggtgatctttgaccctgccagtttctacggccattccgagtatgaacttgccatcgctggtatgtttggtggatttagcagcagcttctatagtgcgtaccacgggaaaattccaaaggcgccaggcttcgagaagaggttgcagctttaccagctatttcactatctgaatcactggaatcacttcggaagcggatacaggggttcgtctcttaacataatgagaaacctggtgaaatag

SEQ ID NO: 117515 - DNA, 780 bp, Artificial Sequence
  Description of Artificial Sequence: Synthetic coding sequence
atgtttgaaggggagatggcaagcctcaccgcaattctcaagaccaatacagtgaaagtgcccaagcctataaaggtcctcgatgccccaggaggggggtcagtactcgtcatggagcatatggatatgcgccacctgtccagccatgcagcaaagctcggcgcccagctggcagaccttcacttggataacaagaaactgggcgagatgcgcctgaaggaggccggcacagtgggtcgcggtggcggacaagaggaacgaccgtttgtggccaggtttggattcgatgttgtcacctgctgcggttatcttccacaggtgaacgattggcaggaggactgggtggtgttctacgcccgacagagaatccagccccagatggatatggtagaaaaggagtcaggggaccgggaggccctgcagctgtggagtgccctccagttaaaaatcccagaccttttcagagatctggaaatcattccggccttgctgcatggggatctgtgggggggcaatgtggccgaggattctagcggccccgtgattttcgaccccgcctctttttatggtcactcagaatatgaattggccatcgcagggatgttcggcgggttctctagttctttctatagcgcatatcacgggaaaatccccaaagcccctggcttcgagaaaagattacagctttatcagttgtttcactacctcaaccattggaatcattttggctccggatatagggggtctagcttgaacattatgcggaatctggtgaaatag

SEQ ID NO: 117516 - DNA, 1017 bp, Artificial Sequence
  Description of Artificial Sequence: Synthetic coding sequence
atggccgatcaagctcccttcgacaccgacgtcaatacactgaccagattcgtaatggaagagggaagaaaagcacgtggtacaggagagcttactcagctgctgaactccctgtgtaccgcggtgaaggccatttcctcagctgtaaggaaagctggcattgcccatctgtacggtatagctggctccacaaacgtaaccggtgatcaggtcaagaaactggacgtgttgtctaatgacttagttatgaacatgctgaaatcaagctttgccacatgtgttcttgtgtccgaagaggacaagcacgctatcattgtggaaccagagaagaggggcaagtatgttgtgtgtttcgacccactggacgggagctcaaacatcgactgcctcgtttctgtggggacaatatttgggatatacagaaagaaatcgaccgatgaaccatctgaaaaagatgcactccaacctggcagaaatctcgtcgccgcaggttacgccctgtatggctccgccacaatgttagtgctcgccatggactgtggtgtgaactgttttatgctggaccctgcaatcggcgaatttatccttgtggacaaagacgtgaagatcaaaaaaaaaggtaagatttacagcctgaatgagggttatgcaagagatttcgacccagctgtcaccgagtacatccagagaaagaagttccctcccgataattcagccccctacggtgccaggtacgtgggatcgatggtggccgatgttcatcggacactggtgtacggtggcatctttctttatcctgccaacaagaaatcccccaatggaaaactgcggctcctctacgagtgcaaccctatggcctacgtaatggaaaaggcgggggggatggcaacgacaggcaaggaggccgttttggacgtgattcccaccgacatccaccagagagcccccgtcattctgggctccccagacgatgttctcgagtttctgaaggtctacgagaaacattctgcgcaatag

SEQ ID NO: 117517 - DNA, 456 bp, Artificial Sequence
  Description of Artificial Sequence: Synthetic coding sequence
atgttaaagagcagtttcgccacttgtgtgctggtgtccgaagaggataaacacgccatcatagtggaacccgagaaaaggggcaaatacgtggtgtgcttcgaccccctcgacgggtcgagcaatatcgactgcctggtgagtgtggggacaatcttcgggatctaccgcaaaaaatccaccgatgagccatcagaaaaagacgctctgcagccaggacgtaacctggttgctgccggatacgctttgtatggctccgctaccatgctagtgttggcaatggactgcggcgtcaactgtttcatgctagacccagctatcggagagtttatccttgttgacaaggatgtgaaaatcaagaaaaagggaaaaatatactccctaaatgagggatacgcaagggactttgatcctgcggtcactgaatacatccagcggaagaaattcccaccttag

SEQ ID NO: 117518 - DNA, 1017 bp, Artificial Sequence
  Description of Artificial Sequence: Synthetic coding sequence
atggccgatcaggcaccatttgacactgacgtgaatacgctgacccgatttgtaatggaagagggccggaaggctcgcggtaccggtgaacttacacagctcctgaactctctgtgtaccgccgtgaaggcgatcagctccgctgtgagaaaagctggaatcgcacacctttacggaatcgctggaagcacaaacgtgactggagatcaggtcaaaaagctagatgtgctgtccaatgatttggttatgaatatgctgaagtcgtccttcgcaacctgcgttctggtttcagaggaagataaacacgccatcatcgttgagcccgagaaaagaggcaaatatgtggtctgttttgacccactggatggcagttcaaacatagactgtctggtctccgtgggtactatatttggaatttaccgtaaaaagtcaacagacgaacccagtgaaaaggatgccctgcagccgggcaggaatctagtggcagccggttatgcactgtacgggagtgccaccatgttggtcttggccatggactgcggcgttaactgtttcatgttggatcctgcaatcggcgaattcatccttgtggacaaggatgtgaaaattaaaaagaaaggtaagatttactcactgaatgagggctatgcccgggatttcgaccccgcagtaaccgaatacatccagcgtaagaaatttccgccagataacagtgccccatacggcgctcggtacgtcgggtcaatggtcgctgacgtccatcgaaccctggtgtatggcggcattttcctttatcccgcgaacaaaaaatccccaaacggaaaacttcggctactttatgaatgcaatcccatggcctatgttatggaaaaagctggcggaatggcaaccacgggcaaggaggcagtgcttgacgtcatacccaccgacatacatcaaagagccccagtaatcctcgggtcaccagatgacgtgctggaattcctaaaggtctatgaaaaacactctgcacagtag

SEQ ID NO: 117519 - DNA, 1020 bp, Artificial Sequence
  Description of Artificial Sequence: Synthetic coding sequence
atgacagaccgcagccccttcgaaactgatatgcttaccctgacccggtacgtgatggagaagggcaggcaggccaaaggcactggggaacttacacagctcctcaatagtatgttaacagccattaaggccatttctagtgccgttagaaaagccggcctcgctcatctgtatggcatcgccggctctgtgaatgtaacaggagatgaagttaagaagttagacgtcctgtctaattctctagtgatcaatatggtgcagtcctcatatagcacctgtgtgctggttagtgaagaaaacaaggatgctatcatcaccgctaaggagaagcgcggcaaatacgttgtttgcttcgatccgctcgacgggtcttctaatatcgattgtctggcatctattggtaccatcttcgccatctataggaagacaagtgaagatgagccatctgagaaagatgccttgcagtgtggtcgcaacatcgtagctgctgggtacgctctatatggatctgcaaccctggttgcactgtccaccggacagggcgtcgatctgttcatgcttgaccctgcactgggagagttcgtgttagtcgagaaggatgtgaagataaaaaagaagggtaagatctattcccttaatgagggctatgcaaagtatttcgacgccgcgaccactgagtacgttcaaaagaaaaagttccctgaagacggtagcgccccctacggcgcaaggtacgtggggtctatggtggctgatgttcaccgaacattagtgtacggcggcatatttttataccctgcaaatcaaaaaagccccaagggcaaactcaggctgctgtatgagtgcaatcctgtggcctatattatcgagcaggccggcggactcgctaccacagggacccaacctgtgttggatgtgaaacccgaggcgatacatcagagagtgccccttattctgggctccccagaggacgttcaggaatacctgacatgcgtgcagaagaaccaggctgggtcgtag

SEQ ID NO: 117520 - DNA, 837 bp, Artificial Sequence
  Description of Artificial Sequence: Synthetic coding sequence
atggggaaaggcaacgaggactctgacctccactgctctagtattcaatgcagcaccgaccagccaccctttcaacagattagctttaccgaaaaaggatctgatgagaagaaaccctttaaggagaagggtaagactgcctttagccactctagcgagaagcatattcagcgccagggctctgagcccaaccccaacaaagaaaactctgaagagacgaaactcaaagcaggcaactccactgcagggagtgaacccgagagctccagctatagagaaaactgtagaaagagaaaaatgtcttctaaggattcatgtcaggacacggcagggaactgtccggaaaaggaatgctccctgtctctaaacaagaagagccgctctagcacggccgttcataactcagaaatccaggaaacttgcgatgctcatcaccgtggccattctagggcctgcacaggccactccaagaggcaccgaagcagggctttaggcgtccagacaccatcaatccgcaaatctctggtaactagcgtgcgcgcaatgtctgaggccgtctatcaggacctagcacaggtctgggctcagcagatccattcccctctgacctgcgagcaactgaccctgcttacaagactgaggggacccctttgcgcccaggtccaaactttgtactctatggccactcaggctgcttatgtatttcccgctgagtcttggttggtccctgcaactctgcccggtcccggagaaagcgccctcgaccgcgaagcgcacccattccctggtcaagaaatcaccgaaaccgtgtccggcagcgatgaggctaaactgtag

SEQ ID NO: 117521 - DNA, 984 bp, Artificial Sequence
  Description of Artificial Sequence: Synthetic coding sequence
atgggcagaacaagtaaagacaagcgcgacgtgtattacaggctggccaaggaaaacggctggcgcgcgcgctccgcctttaaattactccagctcgacaaggaattccaactgtttcagggggtcacacgggctgtggatctgtgcgctgcccctggttcttggtcacaggtccttagtcagaagataggaggacaaggatccgggcacgtagtggccgtggacctccaggcaatggcgcccctcccgggggtggtgcagatccagggtgatataacgcaattgagtactgccaaggaaattatccaacactttaaaggatgtccagcggacttggtggtttgtgatggagcacctgatgttaccggtctgcacgatgtggatgagtacatgcaggcccagctcttacttgctgcgctgaacattgccactcacgtcctgaaaccaggcggatgctttgtggcaaagatatttcgcggacgagacgtgaccttgttatattcacaacttcaggtttttttcagcagcgtactgtgtgccaaacccagatctagcaggaactccagcatcgaagcctttgctgtatgtcaagggtatgacccccccgagggtttcatcccagacctttctaagcctctgttggatcactcctacgattttaatcagctagacggacccactaggatcatcgttccatttgtgacttgcggtgatcttagcagctacgactccgatcgctcttatccactcgacctggaaggaggaagcgagtataaatacacacctccaacgcagccccctattagccccccataccaggaagcttgcactctgaaacgcaagggacaactggcgaaggagatacggccacaagactgtcccatctcacgagtcgatacttttcctcaacctctggccgcccctcaatgccatacactcttggcccctgagatggaggacaatgagatgagctgttctccttag

SEQ ID NO: 117522 - DNA, 990 bp, Artificial Sequence
  Description of Artificial Sequence: Synthetic coding sequence
atgggcaggacgtcaaaggataagcgggatgtttactatcggttagccaaggagaacggctggcgtgcaagaagtgcgtttaagttgttgcagttggataaagagtttcagctgtttcagggcgtaacccgcgctgtcgatctgtgtgccgcgcctggcagctggtctcaagtcctctcacagaagatcggaggccaagggtcggggcatgtagtcgctgtggacctgcaggcaatggcacccctccccggagtggttcagattcagggagacattacccagctcagtaccgccaaggaaattatccaacacttcaagggctgcccagcggatcttgtcgtgtgtgacggcgcacccgatgtgactggcctgcacgacgttgatgagtatatgcaagcacagctgcttctggctgccctgaacatcgcgacgcacgtcttgaagccaggcggctgctttgtcgccaaaatttttcgtggaagggacgtgacgctcttgtattcccagctgcaagtattcttttccagcgtgctgtgcgcaaagcctcgtagtagcaggaattcgagtatcgaggcattcgcagtttgccagggctatgatcctcccgaaggttttatccccgatctctccaagcccctgctggaccattcctatgatcctgattttaatcaacttgacggcccgacacgcatcattgtgccattcgtcacatgtggtgacctgtcgtcttacgacagtgatagatcataccccctggatttagaagggggctctgaatacaaatatacccctcctacccagccaccgatttcccccccttaccaggaggcctgtactcttaagcgcaagggccagctggcaaaggagattcgcccgcaggattgccccataagcagggtggacaccttcccccagcctttagcggccccccaatgtcataccctgctggctcccgagatggaggacaacgagatgtcatgctcaccatag

SEQ ID NO: 117523 - DNA, 579 bp, Artificial Sequence
  Description of Artificial Sequence: Synthetic coding sequence
atggccttgaacatagcaacccacgtattgaaacccggcggctgtttcgtggccaagatatttaggggcagggacgtgacattgctgtactcacagctccaggtgttcttttctagcgtgctgtgtgctaagccgaggagtagcagaaacagtagtatcgaggcatttgcggtgtgtcagggttacgatcctccagaggggttcattcccgacttaagcaaaccgttactggaccactcctatgatcccgactttaatcaactggatggtccaaccagaatcattgtgccatttgtgacttgtggggacttatcttcttatgactccgacagatcctaccctctggacctcgaaggaggctccgaatataaatacaccccccccacgcagccacccatatcacctccctaccaagaggcttgcaccctgaagcggaaaggtcagttagccaaagagatccggccacaagattgtccgattagccgtgtggatacctttccacagcccctcgctgctccgcaatgtcacacactcctagcccctgagatggaagacaacgagatgtcctgttccccctag

SEQ ID NO: 117524 - DNA, 984 bp, Artificial Sequence
  Description of Artificial Sequence: Synthetic coding sequence
atggggagaacgtccaaagacaagcgtgacgtatactaccgccttgctaaagagaacgggtggagagccaggagtgcattcaaattactccagttggacaaggaatttcagctcttccaaggggtcacccgagctgtagatttatgtgccgctccgggctcatggagtcaggtccttagtcagaagatcggcggacagggctccggacacgttgtggccgtagatttgcaggctatggctcctcttcccggagtggtgcagatacaaggggatatcacgcagcttagcactgcaaaggagattattcaacactttaaaggctgcccagctgatctggtagtgtgtgacggcgcaccagatgtaacaggacttcacgacgtcgatgagtacatgcaggctcagttgctgttggccgctttaaatattgctacccacgtgcttaagcccggcggatgttttgtagctaagatttttcgggggcgtgacgtgacactcttgtattcacagttacaggtcttcttttcaagtgttctctgcgctaagccgcgttccagccggaattcatccattgaggcctttgctgtctgccaaggctacgatcctcccgagggcttcattccagacttgagcaaaccactgcttgaccattcatatgactttaaccagctcgatggccccactcgcatcatcgtgccctttgtgacttgtggggatctctcgagctatgacagcgatcgcagctaccccctggatcttgaagggggctctgagtacaaatacacccccccaacacagccccctatcagccccccataccaggaagcatgcacgctgaagcgtaagggacagctggccaaagaaatcaggccccaggactgtccaatctctagggtggataccttcccccaacccctggcggccccgcagtgccataccctacttgcccctgaaatggaagataatgaaatgtcctgcagtccatag

SEQ ID NO: 117525 - DNA, 741 bp, Artificial Sequence
  Description of Artificial Sequence: Synthetic coding sequence
atggcgggttacttgaaacttgtatgcgtgtccttccagaggcagggttttcacaccgtgggctcacgctgcaaaaaccgtactggcgcagagcacctgtggctcacacgccacctccgtgatccatttgttaaggcggctaaagtggaaagttataggtgcagatccgcttttaagctgctggaggtcaacgaacgacatcagattctgcgtcctggcctgcgagtgctggattgcggcgccgcacctggggcctggtcacaggtggccgttcaaaaggttaacgccgctggcacagaccctagctccccagtcggcttcgtgctgggagttgacctgctacacatttttccgttagagggggctacttttctgtgccctgctgacgtgaccgacccacgcaccagccaacgaatcttagaggtgctgcctggacgtcgagcagacgtgattttatccgatatggccccaaatgccaccggttttagggaccttgatcacgataggctgatttcactgtgtttgacgcttctctctgtcactcccgacatcctccagcctggagggacgtttttgtgtaagacatgggcagggagccagagcagaaggcttcagcgccgattaaccgaggaattccagaacgtacgcatcattaaaccggaagcctctcgaaaggaatcatccgaggtgtacttcttagccacacaataccatgggagaaagggtaccgtgaagcagtag

SEQ ID NO: 117526 - DNA, 438 bp, Artificial Sequence
  Description of Artificial Sequence: Synthetic coding sequence
atggccgggtatttaaagctggtttgtgttagctttcaaaggcaaggatttcacacagtaggttcaagatgcaaaaaccggacgggtgctgagcatctgtggctgacacgacatctgcgcgatccttttgttaaagccgccaaggttgaaagctaccgatgtcgaagtgcctttaaattgcttgaggttaatgagcgccatcagattttgcggccggggctacgagttcttgactgcggtgctgcccccggagcctggtcccaagtagccgtacagaaagtaaatgccgcaggcaccgatggcgtgagcctcctcccacggctgcagtgcaacggggtaatctccgcacactgtaacttgtgtctccctggctcctcagactcgcccgcgagcgcatcacagatcccagctctgctgctcgcatcttgtttggggtag

SEQ ID NO: 117527 - DNA, 768 bp, Artificial Sequence
  Description of Artificial Sequence: Synthetic coding sequence
atgccagagctatatgacctcgttaattcatacaagccggatctcatctggtctgatggtgaatgggagtgtcccgatacgtattggaattccaccaattttttgtcgtggttgtacaacgattcacccgttaaggatgaggtggtcgtgaatgatcgctggggccagaactgtagttgtcaccacggcggctattataattgtgaagataagtttaaaccccagtctctccccgatcacaagtgggaaatgtgtactagcattgacaagtttagctggggctacagaagagatatggccttgtcagatgttactgaggagtcagagatcattagcgagctggtgcaaactgtgtcattgggggggaattacctgttaaacatcggacctacgaaagatggactgatcgttcctatttttcaggaacgcctgctcgcagtggggaaatggctgagtatcaatggcgaagcaatatacgccagtaagccttggcgcgtgcagtgggaaaagaatacaacttcagtttggtacactagcaagggatctgcagtttatgctatctttctgcactggcctgagaatggcgtgctcaatctggagagcccaatcaccacgagcacaactaagatcaccatgctgggcatccagggcgacctgaagtggtccaccgaccccgacaaagggctcttcatatctttgccacagctcccccctagcgcggtgcccgccgagttcgcctggaccattaagctgaccggggtgaagtag

SEQ ID NO: 117528 - DNA, 1401 bp, Artificial Sequence
  Description of Artificial Sequence: Synthetic coding sequence
atgcgcgctcccggcatgcgttcccgacctgctggacccgccctccttctgttgctgttattcctcggtgcagccgagtctgttcgccgtgcacagcctccccgtcgctacactccagattggccgagcctggattctcgaccactcccagcatggttcgacgaggcaaagttcggggtttttatacactggggggtgttttctgtgcctgcctggggctccgaatggttctggtggcactggcagggagagggccgcccacagtaccagcgcttcatgcgggacaattatcctcctgggtttagctacgccgatttcggcccccagtttaccgcaagattctttcatccagaggaatgggccgatctattccaggcagctggggccaagtatgtggtgctgaccactaaacatcatgagggatttacaaactggccctctccggtcagctggaattggaactcaaaggatgtcgggccccaccgcgatcttgtgggagaattgggaactgcactccgaaagcggaatatccgctatggactgtaccactcattactggagtggttccaccccctttatttgttggataagaaaaatggatttaagacccagcattttgtgagtgctaaaaccatgcctgagctgtacgacctcgtgaacagttataagccagatcttatctggagtgacggtgagtgggaatgccctgacacttattggaactcaaccaattttctgtcctggctgtacaacgacagcccagttaaggatgaagttgttgttaatgatcggtggggccagaattgtagctgtcatcacggcggttactataactgcgaggacaagttcaaaccgcaatcactccccgaccacaagtgggaaatgtgcacatctattgataaatttagctggggctacaggcgagatatggccctatcagatgtgactgaggagtcggaaattattagtgagctagtgcaaaccgtaagtttgggtgggaactatctgttaaatattggtcctacaaaggatggtctgatcgttccgatttttcaggaacgtttattagcagttgggaaatggttatctatcaatggcgaggccatttacgcatcaaaaccttggcgggtacagtgggaaaagaacacaacttcagtgtggtatacctcaaagggctctgcagtgtatgcaatcttcttacattggcctgagaacggagttttgaatttagaaagccccatcaccacgtctaccacaaaaatcacaatgcttggaatacagggcgatctgaagtggtcgacagatccagacaaggggctctttatttcacttcctcaacttccaccctctgctgtccccgctgaattcgcttggaccattaaactcactggagtaaaatag

SEQ ID NO: 117529 - DNA, 1404 bp, Artificial Sequence
  Description of Artificial Sequence: Synthetic coding sequence
atgaggccccaggagctgcctaggttggccttccccctgttgctacttttgcttctgctactgccacctcccccatgcccagcccactcagctactcgctttgatcctacttgggaatctttggacgcacggcagttaccggcctggttcgatcaggctaaattcggaatcttcatccactggggcgttttttctgtaccgtctttcggaagcgagtggttttggtggtattggcagaaagagaaaatccctaagtatgtcgagttcatgaaagataattatccacccagcttcaagtacgaagacttcggacccttgttcaccgctaaatttttcaatgccaaccagtgggcagacatcttccaagctagtggggctaaatacatagttctaactagtaagcaccatgaaggttttacgttatgggggagcgagtacagctggaactggaacgccatcgatgaaggccccaagcgggacattgtgaaagaactggaagttgcaattagaaaccgcaccgatctccggttcgggctgtattattctctcttcgagtggttccacccgctgttccttgaagatgaatcaagttcgttccataagaggcagtttcccgtttcaaaaacacttcccgagctgtatgagctcgtgaataactaccagcccgaggtcttgtggtccgacggagatggaggcgccccggatcagtactggaactcgactgggtttctggcatggctgtacaacgaaagtccagtgcggggaaccgtcgtgaccaatgatagatggggcgcaggcagcatctgtaagcatggaggcttctacacttgctcagatcggtacaatccaggacaccttctacctcataaatgggagaattgcatgacgattgataagctttcttggggatatcggagggaagccggaatcagtgactatttaacaatcgaagagttggtgaaacagctggtagagaccgtgtcttgtggagggaatctcctaatgaacatcgggcccactctcgatggcacgatctctgtagttttcgaagagcgcctgaggcaaatggggagttggctgaaggtcaatggagaggccatttacgagacccacacctggaggtctcagaatgataccgtgactcccgatgtgtggtatacttctaagcctaaggagaaactggtgtacgccattttcctgaaatggcctacctctggacagctattcctgggccaccccaaagccatccttggggcgactgaggtcaagctgctgggtcatggccaacccctaaactggatcagtctcgagcagaacggcataatggtggaactgccacagctcaccattcaccagatgccatgtaagtggggctgggccctcgcgctgacaaatgtaatttag

SEQ ID NO: 117530 - DNA, 498 bp, Artificial Sequence
  Description of Artificial Sequence: Synthetic coding sequence
atgaggccacaagagctccctcgtctggcgttccccctgctcttgctattgttactcctgttacccccacccccatgtccagcccacagcgccacaagatttgaccctacatgggaaagccttgacgcaagacagctgccggcatggtttgatcaggctaaatttggcatcttcatccactggggagtgttcagtgtccctagttttggcagcgagtggttttggtggtactggcaaaaagaaaagatccccaaatacgtggaattcatgaaggacaactatccaccctcattcaaatacgaggactttggcccattgttcaccgcaaagtttttcaacgcaaatcaatgggccgacattttccaggccagtggcgctaaatacatagtgctgacctccaaacaccatgaggcaacatgcagagacagcttcatgtggagaaaatcattcgatgagtattgggcacataccagatggcatcacttctgctctttttag

SEQ ID NO: 117531 - DNA, 498 bp, Artificial Sequence
  Description of Artificial Sequence: Synthetic coding sequence
atgcgcccgcaagaactccctcggcttgctttccctttactgttgcttctgctcttattgctccccccccctccttgtcctgctcacagcgcaacacgcttcgatccgacctgggagtccctcgatgcccggcagctgcctgcttggttcgatcaggctaagtttggcatttttatccactggggcgtctttagcgtcccaagttttggtagcgaatggttctggtggtactggcaaaaagagaagatcccaaagtatgtggagttcatgaaggacaactacccgcctagtttcaagtacgaagattttgggcccctcttcaccgcaaaattcttcaacgccaaccagtgggctgacatattccaggcgtccggtgctaaatatatagtgctgacttcaaaacaccacgaggccacttgccgggattcttttatgtggcgcaaatcctttgatgaatactgggcacacacacgctggcatcacttttgcagtttctag

SEQ ID NO: 117532 - DNA, 330 bp, Artificial Sequence
  Description of Artificial Sequence: Synthetic coding sequence
cagttggtggagactgtctcctgtggtggaaatctattgatgaacatcggccccactcttgacggtactatttctgtagtgttcgaagagagactgcgccagatgggctcctggctgaaggtgaatggtgaagcgatttacgagacccatacatggaggtcacagaatgacacagtgacccccgacgtttggtacacctctaagcccaaggagaaacttgtgtacgctatctttctcaagtggcctacttcgggccagttattccttggccacccaaaagccatactcggggccactgaggtgagaggaaacttcaccctctttctgtag

SEQ ID NO: 117533 - DNA, 1098 bp, Artificial Sequence
  Description of Artificial Sequence: Synthetic coding sequence
atgtggcttcggagccaccgccagctttgccttgcatttctgctggtgtgcgtgctttcggtgatcttctttctgcatattcaccaggacagctttccacacgggctgggcctgtctatcctgtgtcctgacagacgcctggttactccaccggtggctatcttctgcttgccgggcacagcgatgggccctaacgcgagtagttcttgtcctcagcaccctgcttcactcagtggaacctggaccgtgtaccccaacggtcggtttgggaatcagatgggacaatatgccaccttgctggcactggcccagcttaatggaagaagagccttcatcttacccgccatgcatgctgccctggcccccgtctttagaattacactcccagttctagcccccgaggttgattccagaaccccctggcgggaacttcagttacacgactggatgagcgaggaatacgcagatctcagagatcctttcctcaagctcagtggttttccctgctcttggacctttttccatcatctgagggagcagatccgtagggaatttactctgcacgatcacctgcgtgaagaggcccagtctgtcctgggtcaacttaggcttggacggaccggagatcgcccaaggaccttcgtgggggtgcacgtgcggcggggggattatctgcaggtcatgccccagcgctggaagggagtggtgggagactcggcctacctcaggcaggcgatggactggttccgcgcacggcacgaagccccagtcttcgttgtcacatccaacggaatggagtggtgcaaggaaaatattgatacctcccagggagacgtgaccttcgccggcgacggccaagaggcaactccctggaaagattttgcacttcttactcagtgtaaccacacgatcatgacaataggcaccttcggtttttgggctgcatacctggccggaggcgacacagtctacctcgcaaattttactctgcccgactccgagttcctgaaaattttcaagcctgaggccgctttccttccggaatgggtgggaatcaatgccgaccttagcccgctgtggaccttggctaaaccctag

SEQ ID NO: 117534 - DNA, 1068 bp, Artificial Sequence
  Description of Artificial Sequence: Synthetic coding sequence
atgtggctgcggtcacaccgacagctctgcctggcctttctgctggtgtgcgtgctgtctgtgatcttcttccttcatatccaccaggactcattccctcacgggctgggtttgtcaatattgtgtcccgatcggaggctagttacacccccagttgctattttctgcttgcccgggactgcaatgggaccaaacgcttccagctcgtgccctcaacaccctgcgtcactcagcggaacctggaccgtctaccccaatggacggtttggcaatcagatgggacaatacgctacattactggctctggcccagctgaatggaagaagggcgttcatcctgcctgccatgcatgcagcactggctcctccagaggtggattcacgtaccccgtggagggagctccaactgcatgattggatgtccgaggaatacgctgacctgagggatccattcttgaaattgagtggttttccatgctcttggactttttttcatcacctgcgcgagcagatccgccgcgagtttactctgcacgatcatctccgtgaagaggcccaatcagtgctaggccagctgagactgggaaggaccggagaccggccgcgcaccttcgtgggcgtccacgtgaggaggggcgattatctgcaggtgatgccacagagatggaagggtgtggttggggatagtgcgtacctgagacaggcgatggactggtttcgagcccggcacgaagccccggtgttcgtcgttacctcaaatggtatggagtggtgcaaggaaaatattgataccagtcagggcgatgtgactttcgccggtgatggccaggaagctaccccttggaaagactttgccttacttacacagtgcaatcacaccattatgactataggaacattcggcttttgggcggcctacctagccggcggagacacagtgtatctggccaattttacactgccagactctgagtttctgaaaatcttcaagccggaagctgctttcctcccggagtgggtcggaataaatgccgacctctctcccctctggacgctagctaaaccgtag

SEQ ID NO: 117535 - DNA, 1032 bp, Artificial Sequence
  Description of Artificial Sequence: Synthetic coding sequence
atgttggtcgttcaaatgcccttctcttttccaatggcccacttcatcctgttcgtcttcaccgtgtccacaattttccatgtccagcagagattagccaaaatccaggcaatgtgggaactgccagttcagattcctgttctcgcttcaacttcgaaggcactgggcccgagtcagttaagggggatgtggacgataaatgcaattgggagactcggaaaccaaatgggggagtacgcaacactctacgcgctcgccaaaatgaacggaagaccagcgttcattccagctcagatgcatagcacattagcccctatttttcgcatcacgttaccagtgttgcactcagctaccgcatcaagaataccgtggcaaaactaccatctcaacgactggatggaagaggagtacaggcacattcctggcgagtatgtgagattcacagggtacccctgtagctggacattctatcaccaccttaggcaggagattttacaggagttcacactgcacgaccacgttcgagaagaggcgcaaaagtttctccggggactccaggtgaacggtagtaggcctggaaccttcgtgggtgtacacgtcagaaggggagactacgttcacgtgatgcccaaggtgtggaagggagtggtggccgatagaaggtatctgcaacaggccctggattggtttcgcgctaggtattcttccttaatattcgtggtgacttccaacggcatggcctggtgccgcgaaaatatcgacactagccatggcgacgtcgtgttcgccggtgatggcatcgaggggtcaccggccaaggattttgccctgctgacccagtgcaaccatacgataatgaccattgggacgttcggcatctgggcggcctatctcactgggggggacacgatctacctggccaattatacacttccagattcaccattcttaaaaatctttaaacctgaagccgcctttctgccggagtggaccggcattgccgccgatctttctccgctgcttaaacactag

SEQ ID NO: 117536 - DNA, 1032 bp, Artificial Sequence
  Description of Artificial Sequence: Synthetic coding sequence
atgctggttgtccagatgccattcagcttccccatggcccactttatcctgttcgtcttcaccgtcagtacaatattccatgtccagcagcggctggctaagatacaggccatgtgggagctgcccgtacagatccctgtgttagcatctacctccaaggccttgggcccatctcagcttcgcggcatgtggacaattaatgcaattggccgcctggggaatcagatgggagaatatgcaactctgtacgccctggccaaaatgaatgggagaccagccttcattcccgcccaaatgcactccactctcgccccaatcttccggattacattaccggtcctccattccgccacagcaagtcgaatcccatggcagaattaccacctgaacgactggatggaggaagagtataggcatatcccaggagagtacgtccgttttactggctatccgtgcagttggacattctaccatcacttgaggcaggagatcctgcaagagtttaccctgcacgaccacgtccgcgaggaagcacagaagttcctccggggattgcaggttaacggttctcggcccggcaccttcgtcggagttcatgtgaggaggggagactacgtgcacgtgatgcctaaagtgtggaaaggcgttgtcgctgaccggcggtatttacaacaggccctcgactggttcagggctcgatatagctcccttatttttgtggtcacatctaatggcatggcttggtgtcgagaaaacattgatacttcccacggtgatgtcgtgttcgctggggatggtattgaaggatcaccagccaaggatttcgccctcctaacccagtgtaatcataccattatgactatcggcacatttggtatctgggctgcctatctgactgggggcgacacgatctacctggccaattataccctgcctgattccccgttcctgaaaatttttaaacctgaggccgcttttttgcctgaatggacgggcattgcggctgacctgtcacctctccttaaacattag

SEQ ID NO: 117537 - DNA, 663 bp, Artificial Sequence
  Description of Artificial Sequence: Synthetic coding sequence
atgttggtggtgcagatgcccttctccttcccaatggctcacttcattctgttcgtgttcaccgtgtccaccatttttcacgtacaacagcgcctcgccaaaatccaggccatgtgggaactgcccgtgcagataccagtgttggcctcaacgagcaaggccttaggaccatcccagctgagagggatgtggactattaatgcaataggccggctggggaaccagatgggcgagtatgctacattgtatgccctcgctaagatgaacggtcgacccgcctttatacccgctcaaatgcactccacactggcgcccatattccggatcaccctgccggtgttgcactcagccacagcttcacgtataccatggcaaaactaccatctcaacgactggatggaggaggagtacagacacataccaggggaatacgtacgtttcacgggatatccatgttcctggaccttttaccatcacctaaggcaggaaatcctccaggagttcacgctgcatgatcacgtcagggaagaggcacagaagtttctgagagggctccaggtgaatgggtcaaggcccggaacattcgttggtgttcacgtcaggcgtggagattatgtccacgttatgcccaaagtgtggaagggggtagtggccgatcggtag

SEQ ID NO: 117538 - DNA, 1086 bp, Artificial Sequence
  Description of Artificial Sequence: Synthetic coding sequence
atggacccgctgggggccgcaaagcctcagtggccctggcggcgctgcctggccgcactactttttcaactcttggtcgcagtgtgcttttttagttacctgagagtttccagagatgatgccacgggatcgccacgggcaccatccggctcgtcccggcaggatacaactcccactagacccacattgctgattttgcttagaacctggccatttcacatccccgttgccctcagcagatgctcggagatggtcccaggcactgccgactgtcacattactgcagatcgaaaagtatatccccaggctgacatggttatcgtacatcactgggacatcatgagcaacccaaagagtagattgcccccaagtccccgtccacaggggcagcggtggatatggttcaacctggaacccccccctaactgccaacacctggaagccctcgatcgctatttcaacctgaccatgagttaccgctctgatagtgatatctttaccccttacggatggctggagccatggtccgggcagccagcgcaccctccactgaatctcagcgcgaaaactgagctcgtcgcctgggccgtgtccaattggaagcccgactcagctagagtgcgctattaccagtcactccaggcacatttgaaagtcgatgtgtacggtagatcgcacaaacccttgccgaagggcacaatgatggagaccctgagtagatataaattttatctggccttcgagaactcacttcaccctgattacatcactgaaaagttatggcgaaacgccctggaagcttgggccgtgccagtagtccttggacccagtcgatctaattatgagcgattcctgccccccgatgcctttatccacgttgacgattttcagagccctaaagatcttgctagatatcttcaagagttagacaaggatcatgctcgatatttgagctattttcgatggcgcgaaactcttaggcctcgctcattcagttgggctttggatttttgtaaagcttgctggaagctgcagcaggagtcaaggtaccagacagtgcgatctatagccgcatggttcacttag

SEQ ID NO: 117539 - DNA, 1086 bp, Artificial Sequence
  Description of Artificial Sequence: Synthetic coding sequence
atggatcccctcggcgcagccaagccacagtggccatggaggaggtgcctagcagccctgctcttccagcttctcgtggcggtgtgctttttttcctacctgagggtgtctcgggacgacgcgaccggctcccccagagccccttccggtagctcacgccaggatactacgccgaccaggccaaccctgctcatcctgctcagaacatggccttttcacatcccagtggccctgagccgatgctcggaaatggtccctggaaccgctgattgtcacatcactgcagataggaaagtgtacccacaggcagatatggttatcgtgcaccactgggatattatgagcaaccccaagtcccggttgcctccatccccaaggccccagggccagcgatggatctggtttaacctggagcctcccccaaactgtcagcatttggaagctctcgacaggtactttaacctgacgatgagctaccgctcagattccgacatcttcaccccatatggatggctggaaccctggagtgggcagcccgcgcacccacccctgaacctgagtgccaagactgaactcgtcgcctgggcggtgagcaactggaaaccagactctgcacgtgtgcggtattaccagagtctacaagcacatctgaaggttgatgtctacggaagatcacataagccactcccgaagggaaccatgatggagactctctctaggtacaaattctacctagcttttgagaattcgctgcaccccgactatatcacagagaagttatggaggaacgcactggaggcctgggcagtccctgtggtgctgggcccctctcgcagtaactacgagagattccttccacccgacgcttttatccatgtcgatgacttccaaagtccgaaggaccttgccagatatctgcaggaactagacaaagaccatgcaagatatctctcctacttcagatggagggaaaccctaagacctcggtccttttcatgggcattagatttttgtaaagcgtgttggaaactgcagcaggagtcccggtaccaaacagttcggtccatcgccgcctggtttacatag

SEQ ID NO: 117540 - DNA, 1086 bp, Artificial Sequence
  Description of Artificial Sequence: Synthetic coding sequence
atggatccattgggggctgccaaacctcagtggccttggcgtagatgcctcgctgccctgctgtttcaactacttgtcgcagtgtgcttttttagctacctaagagtgtctagagatgatgccaccggttctcccagagctccgtcagggtcgagtaggcaagacacaactcccacacgccctacgcttctaattctgcttcgaacctggccttttcatattccggttgctttgtctcgctgctctgaaatggttcccggcactgcggactgccatatcaccgccgaccgtaaggtatatccacaagcggacatggtcatcgtgcaccactgggatattatgagtaatcccaagagccgcctgccaccgagcccacgccctcaaggccagcggtggatctggtttaacctcgaaccacctccgaactgccagcacttggaagccctggaccggtattttaaccttacgatgtcttaccgcagcgacagtgacatcttcactccttacggttggctagagccctggtctgggcagccagcccacccaccactgaacctgagcgcaaaaaccgagctggtcgcgtgggctgtaagcaattggaaacccgatagtgcaagagtgcggtactatcagagcttgcaggcccatctcaaagttgacgtctatggcaggtcccacaaaccacttccaaaaggtaccatgatggagactctgtccaggtacaagttttatctggcctttgagaattccttacacccggactatattaccgagaaactgtggcggaacgcactcgaggcctgggcagtaccagttgtactgggcccttccagaagcaactatgaaaggtttctcccccccgatgcatttatccatgtggacgacttccagtcgcccaaagacctggctcgctatctgcaggagctcgataaagatcacgcgcgctacctgtcatactttcggtggagggagacacttcgcccgcgctcgttctcctgggcactagatttttgtaaggcctgttggaaattgcagcaggaatcccggtatcagacggtacggagtatcgcagcctggtttacgtag

SEQ ID NO: 117541 - DNA, 1086 bp, Artificial Sequence
  Description of Artificial Sequence: Synthetic coding sequence
atggaccctttgggcgccgccaagcctcagtggccctggcgacggtgtttggccgccctgctgtttcagctacttgttgccgtgtgcttcttttcttacttacgggtttcaagggatgatgctacgggttccccccgcgcgccatctggtagctcgcggcaagatacaactcccaccagacctacactgctaattctgcttcggacttggccatttcacattcctgtggccctttctaggtgctctgaaatggttcccggcacagcagattgccacatcacagcagacagaaaagtctacccccaggcggacatggtgattgtacaccattgggacatcatgtccaaccccaaatctcgattgccccctagtcctcgcccacaaggccagagatggatctggtttaatttggagccacctccaaattgtcaacacttagaggctcttgacagatacttcaacctgactatgtcatacagatcagactctgacattttcaccccttacgggtggttggagccttggtcaggccagcctgcccatcccccactgaatctcagcgcaaagacagaactcgtggcgtgggctgtcagcaactggaagcccgacagcgccagagttcgatattatcaatctctccaggcgcacctgaaggttgacgtctacggccgctcgcacaaaccgctcccaaagggcaccatgatggagacactgtcaagatacaagttttatcttgcctttgagaactccttacatcccgactacatcactgagaaactgtggcgcaacgcccttgaagcctgggcagttccggtggtcctgggtccatcccgcagcaactatgaaaggttcctccccccagacgcattcattcatgttgacgattttcagtcccccaaggatctggccagatacctccaagagctggataaggatcatgcgcgttacctgagctacttccggtggagggagaccctgcggccccggagtttcagctgggccctggatttttgcaaggcatgctggaagttgcaacaggagtccagataccagactgttaggagtattgcagcttggttcacctag

SEQ ID NO: 117542 - DNA, 1593 bp, Artificial Sequence
  Description of Artificial Sequence: Synthetic coding sequence
atgcggaggctgtggggggctgcgcggaaacccagcggggcaggctgggaaaaagagtgggccgaggccccgcaagaggctcccggggcctggagtggacggctcggcccaggacggtccggccgcaaagggcgggctgtccccggatgggcaagctggcctgctcatctggctctggctgccaggcctgcccgacatctgggcggagccggccagggtccaagacctcttcactccggcacggcaccatttcacagtcgcgcatctggtgaaagacagagacgcctcgaaccccagctgcagcatgaaagcagatgtcgctcatcaactcctgctgatgcctggcgcgcagaagcggccctccccgtccgagccatgggcgccccttgggggtcacctactgccgccgcaggagggagaagggggtggcgccggggtagaggtctgccttggacagtatgcgttctggccgccgctggcctgacctgcacggctctcatcacatatgcctgctggggacagctccctcctttgccctgggcctcaccaactccaagtagacccgtcggggttctcctgtggtgggaacctttcgggggcagggacagtgcaccccgccccccaccagactgtcgcctgaggttcaacatatccggctgtaggttgctgactgacagagcttcctacggagaggcacaggctgtcctgttccaccacagggacctggtgaagggccctccggattggcccccaccctgggggattcaagcccatacggccgaagaagtcgacctaagagtactggactacgaggaagccgcagccgcagccgaggccctggctacctcgagtccacgaccccccggacagcgttgggtttggatgaatttcgaatccccgtcccacagtccaggcctaagaagcttggccagtaacttgtttaattggaccttgagctatcgggccgactctgacgtgtttgttccctacggctacctgtatccccgctctcaccccggggaccctccttctgggctggcccccccattatcacgcaaacaagggcttgttgcttgggtggtcagtcactgggatgaaagacaggctagggtcagatactaccaccaacttagtcaacacgtgaccgtcgatgtcttcggcaggggcggtcctgggcagcctgtccccgaaatcggcctgctgcatacagtggcccgctacaagttttacttagcgttcgaaaactcgcagcacctggattatatcaccgaaaagctctggaggaatgcccttctcgcgggcgctgtccctgtagtgcttgggcccgatcgcgcaaattacgagcgtttcgtgccccggggagccttcatacacgtggatgactttccaagcgcaagtagtctggcttcctacctgctgtttttggataggaatccagccgtgtatagaaggtatttccactggaggcgctcatatgcagtgcacattacctcattctgggacgagccctggtgcagggtttgccaggccgtgcagagagcgggcgaccgccccaaaagcataaggaatttagcatcctggtttgagcggtag

SEQ ID NO: 117543 - DNA, 1125 bp, Artificial Sequence
  Description of Artificial Sequence: Synthetic coding sequence
atggaccccttgggacccgcaaagccacagtggctctggagacgttgcctggctggcctcttattccagctccttgtggccgtttgtttcttttcatacctgcgcgttagccgagatgatgctaccggctcaccccgacctggattgatggccgtggaacccgtgactggggcccctaacggcagccgctgtcaggattctatggctacacctgcgcacccaacactcctcatactgctctggacttggccttttaatacacccgtggcccttccccggtgctctgagatggtcccaggggctgcagattgtaatattaccgccgattcaagcgtgtacccacaggctgatgcggtgatcgtgcatcactgggacattatgtataacccaagcgcaaatctccccccacctacacggccgcagggacaacggtggatctggttctcaatggagtcacctagcaattgcagacatttagaggccttggacggatatttcaacctcactatgagctaccgatccgactcagatatatttaccccgtacggatggcttgagccatggtctggccagcccgcacatccaccgctcaacctttcagccaagacagagctcgtggcctgggctgtgagtaactggaagcctgacagtgccagagtgcggtattaccagagtcttcaggcccatttgaaagtcgatgtctatggccggagtcacaagcccttacccaaagggacaatgatggagacgctgtctcggtacaagttctacttggcgttcgaaaactcgttgcatccagactatatcaccgaaaagctatggcgaaatgccctggaggcgtgggccgtccccgttgtcctgggaccctctcgcagcaactatgaaaggtttttgcctcccgatgccttcattcacgtcgatgattttcagagtcccaaggatctggctcgctacctccaggaattagataaggaccatgcgaggtacctttcttacttccactggagggaaaccctgcgacctaggagcttcagctgggctctggctttttgtaaagcctgctggaaactgcagcaggagtctcgctaccagaccgtgcggagcatcgccgcctggttcacatag

SEQ ID NO: 117544 - DNA, 1125 bp, Artificial Sequence
  Description of Artificial Sequence: Synthetic coding sequence
atggacccactgggcccggccaaaccacagtggctttggcgacggtgcctcgcagggctcctgttccagctcctcgtagcggtttgtttcttctcatacttgcgagtgtcccgcgatgacgctacaggaagccctcgaccgggactgatggccgtagagcctgtcaccggcgcacccaatgggtctcgatgccaagatagcatggccactcctgcccatcccaccttactgattctcctttggacatggccgttcaatactccagtcgccctgccccgctgtagcgaaatggtccccggtgccgctgattgcaatattacggctgacagctctgtctaccctcaagcagacgcagttatcgtgcaccactgggacatcatgtataacccttcagctaacttaccaccacctacacggcctcagggccagagatggatctggttctccatggaatctccaagtaattgccggcatctcgaggccttggacggctattttaatctcaccatgtcctataggtccgattctgatatcttcacaccatatggatggttagagccgtggtctggccagcccgcccatcctccccttaatctctctgcaaagaccgagctggtggcctgggcagtatctaactggaaacccgactcggcccgagtgagatattaccagagtctccaagcccaccttaaggtggatgtatacggcagaagccacaagcccttgccgaaaggtactatgatggagacactctcacggtacaaattctacttggcgtttgaaaacagccttcatcctgattatattacagaaaaactgtggcggaatgctttggaggcttgggccgtgcccgtggtgctcggaccctctagatctaactacgagaggtttctcccgcccgatgccttcatccatgtggatgatttccagtcccctaaagatttagctagatacctccaagaactagacaaagaccacgccaggtatctgagttacttccactggcgggaaacgctgaggccccgtagcttctcttgggcactcgcattttgcaaggcatgctggaagctccagcaggagagcagataccagaccgtgcggagcatagccgcatggttcacctag

SEQ ID NO: 117545 - DNA, 1080 bp, Artificial Sequence
  Description of Artificial Sequence: Synthetic coding sequence
atggaccctctgggacctgcaaaacctcaatggagctggagatgctgcctgaccacgttgctctttcaactgctcatggccgtttgtttctttagctaccttcgtgtatcacaggacgatccgacagtctaccctaatggaagcagatttcccgacagcaccgggactccagcgcactctataccgctcatcttgctttggacatggccttttaacaaacccattgcactgccaagatgcagtgaaatggtgcccggcacagccgactgcaatataacagctgataggaaggtgtacccccaggcagatgcggttattgtgcatcacagggaggtcatgtacaacccatcagcgcaactgcccagaagcccccgccggcagggacagaggtggatctggttcagcatggaaagtcctagccattgttggcagttgaaagcaatggatggctattttaacctgacaatgagctatagaagtgacagcgacatttttacgccgtacggatggctagaaccatggtctgggcaacctgcccaccctccactgaatctgagcgcaaagacagagctggtggcttgggccgtatcaaattggggaccgaactccgcccgggtacgctattatcagagcctacaggctcacttaaaggtggacgtgtacggtagatcccacaaaccactgcctcaaggaacgatgatggaaacactttcaaggtataaattctatctcgccttcgagaatagcttgcaccctgactacatcaccgagaagctctggaggaatgccctggaggcctgggctgttcccgttgtccttggcccctctcggagtaactacgaacgctttctgccacccgatgccttcatacacgtggacgattttcagtccccaaaggacctggcgaggtacctacaggaactggataaggaccatgcacggtacttgtcctatttcaggtggcgcgagacactgcggccccggtcctttagctgggctctcgccttttgcaaagcttgctggaagcttcaggaggagtctcgctaccagaccagagggatagccgcatggttcacttag

SEQ ID NO: 117546 - DNA, 1080 bp, Artificial Sequence
  Description of Artificial Sequence: Synthetic coding sequence
atggatccattgggtccggctaagccccagtggagttggcgatgctgcctgaccaccctcctatttcagctgttgatggcggtgtgtttcttttcttatttgcgcgtgtcacaggacgatcccacggtgtatcccaacggtagccggttcccagactcaactgggacacccgctcattcaatccccctgattttgctttggacctggccattcaataagcctatcgccctccctcgctgtagcgagatggtccccggcacggccgattgtaacattactgctgacaggaaagtttaccctcaggctgacgcagtgattgtgcaccaccgcgaggtcatgtacaacccttccgctcagctcccacggagtccgaggaggcagggtcagcggtggatctggtttagcatggaaagtcccagccactgttggcagctgaaagccatggatggatacttcaacctgacaatgagctatagatccgatagcgatatcttcactccatatggctggctggagccctggagtgggcaaccagcccaccctccactgaatttgtccgctaagacggagctagtggcgtgggcggtttccaattggggtcccaacagtgcccgcgtgagatactaccagagcctgcaagcccacctgaaggtggatgtttacgggcgaagccacaaaccactgccccaggggacaatgatggagactctgagtagatacaagttctatctggcgttcgaaaatagcttacatccggattatataacagaaaaactgtggagaaacgccttggaggcctgggcggtacccgtggtgctgggaccaagccggtctaattatgagcggttccttccccctgatgcatttatccacgtggacgatttccagtcccctaaagacctcgccaggtatctgcaggagctcgataaagaccacgcccgctatctgtcgtactttagatggagagaaacactcaggccacggtccttttcttgggcactggctttctgtaaggcttgttggaagctgcaagaagagtcccgttaccagactcgaggcattgctgcttggttcacttag

SEQ ID NO: 117547 - DNA, 1098 bp, Artificial Sequence
  Description of Artificial Sequence: Synthetic coding sequence
atggacccactcggacccgcaaagcctcaatggagttggcgctgctgtctgaccaccctgctgtttcaactcctaatggctgtgtgcttcttctcctatctcagggtgagccaggatgaccccacagtgtatcccaacggttctaggtttcctgattcaacagggaccccagctcatagtatcccattaatactgttgtggacctggccttttaacaagccaatagcgctgcctcgctgtagcgagatggtaccaggcaccgcagattgtaatatcaccgctgatcgaaaggtgtaccctcaagcggacgccgtcatcgtgcaccatcgtgaagttatgtacaacccctcggcccaactgccaaggtcccctcgccggcagggacagcgctggatttggttcagtatggaaagccctagccactgctggcagctgaaggcaatggatggatacttcaatttaacgatgtcttaccgctccgattctgacatttttaccccctacggttggctcgaaccatggtccgggcagcctgcccacccaccacttaacctctccgctaagactgagctcgtcgcctgggcagtctctaattggggaccaaactccgcccgggtaaggtactatcagagcctgcaggctcacctcaaggtggacgtctacggtcgcagccataagccactcccccagggcacaatgatggagaccttgtcgaggtataaattctacctggctttcgagaactctctgcatccggattacataacagagaagctgtggcgcaacgccttggaggcttgggccgttccagtggtgttgggaccctccaggtccaattacgagaggtttcttccacctgatgccttcatccacgtcgatgactttcagagtcccaaggacctggctaggtacctccaggagctggacaaggatcatgctcgctatctaagctactttaggtggcgggagaccctacgaccccggagtttcagttgggctttggccttctgcaaagcttgctggaagctacaggaagaatccagatctggcggccttatctatttacgtacaagattaccagaggctagtcccgcatag

SEQ ID NO: 117548 - DNA, 1080 bp, Artificial Sequence
  Description of Artificial Sequence: Synthetic coding sequence
atggacccgctcggaccggcaaagccacaatggagctggagatgctgtctgacgactctattgttccagctactcatggccgtttgcttctttagctatctccgagtgtcccaggacgatcccacagtttatcctaacggcagtaggttccccgactccacgggtactcctgctcatagcatcccactgattctcctgtggacttggcctttcaacaaacctatcgctctccctaggtgcagtgagatggtgcccggcaccgccgactgtaacattactgccgatcgcaaagtttaccctcaggccgacgcggttattgtgcatcacagagaggtcatgtataatccatccgcacagctgcctcggtctccacgcagacaaggacaacggtggatctggttcagtatggaatccccgtctcactgctggcaattaaaggccatggatggctattttaatcttaccatgtcatatagatctgattccgatatattcacaccgtatggctggttggagccctggagcggacagccagcgcacccccctctgaacctgtcagctaagactgagcttgtggcatgggccgtctccaactggggccctaattcagctagagtgcggtactatcagtccctacaggcacacctgaaagtggatgtatacggaagatcccacaaaccattgccacagggcaccatgatggagaccctgagcagatacaagttctacctggcttttgagaactccttgcatcccgattatattaccgagaaactttggcgcaatgcgctggaagcatgggcagttccagtcgtgctggggccgtccagatcgaattacgaacggttcttgcctcccgacgccttcatccatgtagacgacttccaatccccgaaagatctggccagatacctgcaggaattggacaaagatcacgcccgatacctgtcttacttccgttggagggagacactccggccgagaagcttcagttgggcccttgccttctgcaaggcctgttggaagctgcaggaggagagtagataccagactcggggtattgcggcctggttcacttag

SEQ ID NO: 117549 - DNA, 1080 bp, Artificial Sequence
  Description of Artificial Sequence: Synthetic coding sequence
atggatccactcggccccgccaagcctcaatggtcgtggcgctgctgtctgaccaccttgttgtttcagctactcatggcggtgtgctttttctcttacctcagagtctcacaggatgatcccactgtgtacccaaacggttcaagattccctgactccacgggtacacctgcccattctataccgcttatccttctttggacctggccctttaataagccgattgcgctgcctcggtgcagcgagatggtgcctggcaccgcagactgcaacatcaccgccgataggaaggtatacccccaggcggatgctgtgatcgtacaccatcgcgaagtaatgtataatccctcggcccaactgccacgaagtcccaggcggcaaggacaacgttggatctggttctccatggaatctcctagccattgctggcaactcaaggcgatggatggttatttcaacctcacaatgtcataccggtcagattccgacatctttaccccttacggctggctcgagccgtggtcgggccaacctgcccacccacctttgaacctgtcggcaaaaacagagctagtcgcctgggcggtgtccaattggggacctaattcagccagggtaagatactaccagagcctgcaagcccacctgaaggtggacgtgtacgggcgcagtcacaagccgcttcctcaggggacaatgatggagacactgtctagatataagttctatttagcatttgagaactccctccaccctgactacattacagagaaactctggagaaatgctctggaagcatgggcagtgcctgttgtgttgggaccctctagaagcaactacgaacgctttctgccaccagacgcattcattcatgttgacgatttccagagccctaaagacttggcgcgttacctgcaagagcttgataaagaccatgctcggtatctgtcatatttcagatggagagaaaccctgcgcccacgatcattctcttgggcactggcgttctgtaaggcttgctggaagttacaggaggaaagccgttatcagacacgcgggatcgccgcgtggttcacatag

SEQ ID NO: 117550 - DNA, 93 bp, Artificial Sequence
  Description of Artificial Sequence: Synthetic coding sequence
atggacccactgggtccggcaaaacctcaatggtcttggaggtgctgtctgactaccttgctgttccaactgctaatggcagtgtgcttctag

SEQ ID NO: 117551 - DNA, 414 bp, Artificial Sequence
  Description of Artificial Sequence: Synthetic coding sequence
atggatcctctaggaccagcaaagccccagtggagttggcggtgctgtttgacaaccttgttattccagctgctgatggccgtgtgctttttctcatacttgagggtgtcgcaggatgacccgaccgtctaccctaatggctcccggttccctgactctaccggaactcctgcacattccattccacttatccttctgtggacttggccgtttaataagccaattgcgctgccacggtgttcagagatggttccaggtacggcagattgcaacataaccgcagaccggaaagtctatccccaggccgacgccgtgatcgtccatcacagggaagtcatgtacaatccttccgcccaactcccgcggagcccacgcagacagggacagaggtggatctggttttccatggagtag

SEQ ID NO: 117552 - DNA, 210 bp, Artificial Sequence
  Description of Artificial Sequence: Synthetic coding sequence
atggatccactgggccctgccaaaccgcagtggagctggagatgttgcctgactacgctactgttccagcttctcatggctgtctgtttttttagctacctccgcgtgagtcaggacgaccccaccgtataccccaacggtagtaggtttcctgattcgacaggaaccccagcccacagtatccctctgatcctgctctggacctggtag

SEQ ID NO: 117553 - DNA, 201 bp, Artificial Sequence
  Description of Artificial Sequence: Synthetic coding sequence
atggaccctctgggtcccgccaagcctcagtggagttggcgctgctgtttaactacgctccttttccagctcctcatggccgtgtgttttttctcttacttgcgggtctctcaagatgatcctacagtctacccaaacggttctagattccctgatagcaccggaaccccagcccactcgataccattgatcctcctctag

SEQ ID NO: 117554 - DNA, 138 bp, Artificial Sequence
  Description of Artificial Sequence: Synthetic coding sequence
atggatccactcggccctgcaaagccccagtggtcttggcggtgctgcctgacaaccttattgtttcagttactgatggcagtgtgcttcttctcctatttgagggtgtcccaggatgacccgaccgtgtacccatag

SEQ ID NO: 117555 - DNA, 1029 bp, Artificial Sequence
  Description of Artificial Sequence: Synthetic coding sequence
atgaataacgcaggacatgggccaacaagacgtttgcgagggctgggggttcttgccggcgtcgccctgttggccgctctctggctgctgtggctgctcgggtctgccccccggggaacacccgccccccagcctaccatcaccattctggtttggcactggccttttaccgatcaacccccagaattgccttctgatacctgcacccgctacggcattgccaggtgccatctgagcgctaatcggtcactgcttgcctccgccgacgctgttgtttttcaccaccgggagcttcagacaagacgtagccacctgcctcttgcgcagaggccacgaggccagccatgggtgtgggcctctatggagagcccatcccacacgcacggcttgagtcacctgcggggcatttttaactgggtcttatcttatcgccgcgattcagatatcttcgtgccatacggcagattagagcctcattgggggccatccccaccgctccctgccaagtccagagtggctgcctgggttgtgtccaacttccaggagagacagttacgcgcaagactataccgtcagctggcacctcacctgcgagtcgacgttttcggacgcgcgaacggccgacctctatgcgcaagctgcctcgtgcctactgtggcgcagtaccggttctatttaagttttgaaaatagtcaacacagggattacatcacagaaaagttctggaggaatgccttagtcgccggcacagttccagtggtcctcggacccccccgagcaacctatgaggcgtttgtgcccgcggatgcattcgttcacgtggacgactttggatccgctcgggaactggcagcattcctgacaggtatgaatgagagccggtatcagcgtttttttgcctggagagatagactgcgggtgcgactcttcactgattggagggagagattttgtgcaatttgtgaccggtacccgcatttgccccggtcacaggtgtacgaggatctcgaggggtggtttcaggcttag

SEQ ID NO: 117556 - DNA, 1728 bp, Artificial Sequence
  Description of Artificial Sequence: Synthetic coding sequence
atgcgaccctggactggatcctggcggtggataatgctgatcctctttgcctggggcacattgctgttctacattgggggccacctggtccgggacaacgatcaccccgatcattcttcaagagaactttctaaaatcttagccaagctggagagattgaaacagcagaatgaagatctgaggcgcatggcggaatctctgcgcattccagaagggcccatcgaccagggccccgccattgggagagttcgcgtgctggaagaacagttggtaaaggccaaagaacagatcgaaaactataagaaacaaaccaggaatgggcttggaaaggatcacgagattctgcggagaaggatagagaatggcgccaaagagctatggttcttcctccagagcgagctcaagaagctgaagaatctggagggcaatgagctgcagaggcacgctgatgagtttctgttggatctgggacaccatgaaagaagcatcatgactgacctgtattatctctcccagacagatggcgccggagactggagggagaaagaggccaaagacctaaccgagctagtgcaacggaggattacttacttgcagaatccaaaagattgttcaaaggcaaagaaactggtttgcaacattaacaaagggtgcggctatgggtgtcagctgcaccacgtggtgtactgtttcatgatcgcttacggcactcagagaacacttatcctggaatcacaaaactggaggtatgccaccggtggatgggagaccgtattccggcccgtatctgagacctgtacagatcgcagtggcatttcaaccggtcattggtccggcgaggtcaaggacaaaaacgttcaggtggtggaactccctatcgtggactcattgcatccccgccccccttacctcccattggccgtccctgaagacttggccgatagactggtccgagtgcacggagaccccgccgtgtggtgggtgtcgcagttcgttaagtatctcatacggcctcagccctggttagagaaggagattgaggaggcgaccaagaaactgggtttcaagcaccccgtgattggcgtgcatgttagacgaactgataaggtgggaacggaggcggcatttcatcctatcgaagagtatatggtgcacgtcgaagaacatttccagctgctggctagacgcatgcaggttgacaagaagagggtttacctggcaacagatgatccttctttactaaaagaggcaaagaccaagtatcccaactatgaattcatctctgacaactctattagttggtctgccggccttcacaatcgctacacagaaaatagcctcagaggagtcattctcgacatccacttcctctcacaggctgacttcttagtttgtacattcagcagccaggtgtgccgtgtggcatatgagatcatgcagactctgcacccagatgcctcagctaactttcactcactggacgacatctactattttggcgggcaaaacgcacataaccaaatcgctatctacgcacaccagccccgaaccgccgatgagattccaatggaaccgggtgacataattggggtggcaggaaaccactgggatggctactccaagggggtcaacagaaagcttgggcggacagggctgtacccatcatacaaggttagggagaagatcgagactgtcaaatatcctacttatcctgaggccgagaagtag

SEQ ID NO: 117557 - DNA, 1728 bp, Artificial Sequence
  Description of Artificial Sequence: Synthetic coding sequence
atgcggccctggacaggatcctggagatggatcatgctgattctttttgcctggggaaccctgctattttacataggaggccacttagtgagggacaatgatcaccctgatcattcgtcaagagaactgagcaagatcctcgcaaaactggagcggctgaagcagcagaacgaagatttgcgaagaatggctgaatccttaagaattcctgaaggcccaatagaccaaggccctgcaatagggcgagtgagagtcttggaggagcaactcgttaaagctaaggagcagattgaaaactacaagaagcaaactcgcaatgggctgggaaaagatcacgagatcctaaggcggagaatagagaatggtgcaaaggagttgtggtttttcctccagagcgagctcaaaaaactgaagaatttggaaggtaatgaactacagaggcacgccgacgagttcctcctggacctgggtcatcatgagcggtctatcatgactgatttatactatttaagtcagactgacggagcgggtgattggcgagaaaaagaggcaaaggatctgaccgagttagtgcagcggagaatcacctacctccagaacccaaaagactgttctaaagccaaaaagctggtttgtaacattaataaaggttgcggttatgggtgccagttgcaccacgtcgtctattgctttatgattgcttatggaacgcagcgcacacttattctcgagagtcagaattggaggtacgctactggagggtgggagaccgtctttaggcccgtatcggagacctgtacggaccgttcggggatttccaccggacactggtccggcgaagtgaaggacaagaacgtgcaggtggtcgagcttcctatcgttgattccctgcacccgcggcctccttaccttcccctggcggtccccgaagatctggccgacagattggtgcgggttcacggggaccctgccgtatggtgggtttctcagttcgtgaagtatctaattcgcccacagccctggcttgaaaaggaaatcgaagaggccaccaaaaaactggggttcaaacaccctgtgattggtgttcatgtgaggagaaccgataaagtgggtaccgaggcagccttccatccgatcgaagaatatatggtgcatgtcgaggagcatttccagctcttggcccgccggatgcaagtggacaagaaaagagtgtatctggccacggatgacccatccctcttaaaggaggccaagactaagtaccccaattatgaatttattagcgacaattctatttcctggtccgccggtctgcataatcgatatacagaaaactctctgcgcggggtcattctcgacattcatttcctctcccaggctgacttcctggtgtgtacttttagttctcaagtgtgtagagtcgcatacgaaataatgcaaaccttgcaccccgatgcttccgcaaattttcacagcctggatgatatctattattttgggggtcagaatgcgcacaatcagatcgcaatttacgctcaccagcctcgtaccgcggacgagatcccaatggaaccaggggacataatcggtgtagccggaaaccattgggacggctacagtaaaggcgtcaataggaagttggggcggacaggattataccccagctacaaggtccgggaaaaaattgagaccgtgaagtacccgacctacccagaggctgagaagtag

SEQ ID NO: 117558 - DNA, 1728 bp, Artificial Sequence
  Description of Artificial Sequence: Synthetic coding sequence
atgcgcccctggacaggcagctggcgctggatcatgctgattctgttcgcgtgggggactctgcttttctatatcgggggccacctagtcagggacaacgatcaccccgatcattcgtcacgcgagctcagcaaaatcctagccaagctcgaacggctgaagcagcaaaacgaggaccttagacgcatggccgagtctttgcgcatccctgagggaccaatcgatcaaggaccggctatcgggcgcgtaagagtgcttgaggagcaactggttaaggccaaggagcagatcgaaaattataagaagcagacgagaaacgggctaggtaaagatcatgaaatccttaggcgccgcattgagaacggtgctaaagagctttggttcttcctccagtccgagctaaaaaaactcaaaaacctcgaggggaatgaactccagcggcacgcagacgagttcctcttggacctaggacatcatgagcggtcgattatgacggacttgtactatcttagtcagactgatggagccggagattggcgggagaaagaggctaaagacctaaccgagcttgtgcaaaggaggattacctatctccaaaatcccaaggactgctccaaagctaagaaacttgtctgtaacataaataagggttgtggatacggctgtcagttgcaccacgtggtttattgttttatgatcgcatatggaacgcagagaactttgatattagagagccagaactggcggtatgctacaggtggatgggagacggtcttcaggcctgtgagcgagacctgtactgaccggagtggcatctcaacagggcactggtctggcgaggtgaaggataagaatgtgcaggtcgtggagctccccatcgtggactccttacatcctcgcccaccatatcttccgctcgccgtgcccgaggacttagctgatcgtttggttcgcgtgcacggcgacccagccgtttggtgggtgtcacagtttgtgaaatatttgattcgcccccaaccgtggcttgagaaggagatcgaagaagccacgaagaaactgggcttcaaacacccagttatcggggtccacgtccggcggacagacaaggtggggaccgaagcggcttttcacccgatcgaggagtatatggtgcacgtcgaagagcactttcagctgctggcccgtcgcatgcaggtggacaagaagcgcgtgtatttggccactgacgatccctccctgctcaaggaagctaaaacaaagtatccaaattacgagtttatttctgacaacagcatctcttggtccgcaggactgcacaatcggtacacggagaactccttgcgcggcgtcatccttgacatccacttcctttctcaggcagactttctagtgtgcactttcagctcccaggtgtgtagagttgcatacgagatcatgcagaccttacacccagatgcgagcgctaactttcactccctcgacgacatatattacttcggaggacagaatgctcacaaccaaattgccatatatgcacaccagccccgaactgcggatgaaataccaatggagcctggtgacataatcggggttgcagggaaccactgggatgggtattctaaaggggtgaacaggaagctgggccgcactggtctgtacccatcctacaaagtccgtgagaagattgagaccgtgaagtatcccacttaccctgaggcagagaaatag

SEQ ID NO: 117559 - DNA, 510 bp, Artificial Sequence
  Description of Artificial Sequence: Synthetic coding sequence
atgcatcggcagatttggcatctgcattggacactcgtgcgctacccgaactacgaatttatcagtgataactcaattagctggagcgctgggcttcataaccgatataccgagaacagtctgcggggagtgatactagatatacatttcctgtcccaggccgattttctcgtgtgcaccttttccagtcaggtatgcagagttgcttacgaaataatgcagacactacatcctgacgcaagtgccaattttcacagtctggacgatatatactactttggaggccaaaacgcccacaatcagatagctatatacgcccatcagcctagaacagccgatgaaatccctatggagcccggcgacataataggtgttgcagggaatcattgggatggctactccaagggggtgaaccggaaactgggcagaaccggactgtacccatcttacaaggtccgagagaaaattgagacagttaagtacccgacctaccctgaagccgagaaatag

SEQ ID NO: 117560 - DNA, 48 bp, Artificial Sequence
  Description of Artificial Sequence: Synthetic coding sequence
atgagaccttggactggctcttggcgatggatcatgctcatcctgtag

SEQ ID NO: 117561 - DNA, 135 bp, Artificial Sequence
  Description of Artificial Sequence: Synthetic coding sequence
atgagaccctggacagggtcatggagatggattatgctgatcctctttgcgtgggggaccctgctattttacataggcggccacctggtacgagacaatgaccatccagatcactcttctcgtgagcttagctag

SEQ ID NO: 117562 - DNA, 141 bp, Artificial Sequence
  Description of Artificial Sequence: Synthetic coding sequence
atgaggccctggacaggctcatggagatggattatgctgatcttatttgcctggggtactcttcttttctacattggcggccatctcgtgagggacaacgaccatcctgatcactcaagtcgcgagctgtctaagatttag

SEQ ID NO: 117563 - DNA, 126 bp, Artificial Sequence
  Description of Artificial Sequence: Synthetic coding sequence
atgagaccttggacggggagctggaggtggatcatgctaatcctgttcgcatgggggacgctactgttctatatcggtggccacctggttagagataacgaccaccccgatcactcctcaaggtag

SEQ ID NO: 117564 - DNA, 93 bp, Artificial Sequence
  Description of Artificial Sequence: Synthetic coding sequence
atgcggccctggaccggcagttggaggtggataatgctaatactgtttgcctggggcactctgctgttttacatcggtggccatctggtttag

SEQ ID NO: 117565 - DNA, 1239 bp, Artificial Sequence
  Description of Artificial Sequence: Synthetic coding sequence
atgacagacttatactaccttagccagactgatggtgccggtgactggagagagaaagaggctaaggatctaacagagctggtgcagcggcggatcacttatctacaaaatccaaaggattgttcgaaagctaaaaagcttgtgtgtaacatcaacaagggatgtggctacgggtgccaactgcaccatgtcgtgtactgtttcatgattgcttacggtacccagcggaccctgatcctcgagtcacagaactggagatacgccacaggaggctgggaaaccgtgtttcgaccagtgtctgagacatgcacagaccgctcaggtatatcaaccggacactggtcgggggaggtgaaggataagaatgttcaagtggtggagctcccaattgttgacagcctccatcctaggcccccgtatctgccgctcgctgtgcccgaagacctagcagataggctggttcgcgtgcatggcgaccctgcagtttggtgggtcagtcagtttgtgaagtacctgatccggccccagccctggttggaaaaggaaatagaagaggcgactaaaaagctggggttcaaacatccagtcattggggtgcacgtcaggaggacggacaaggttggcacggaagccgcttttcaccccatcgaagaatacatggtccatgtggaagaacatttccagcttcttgcgaggaggatgcaagtagacaagaagcgggtgtacctggccactgacgacccatctctgctcaaggaggctaaaacgaaataccctaactacgagtttatttccgataacagcatctcttggtcagcaggcttacataatcgctacactgagaattccctgcggggcgtcattcttgacatccatttccttagtcaggcagattttttggtgtgcacctttagcagccaggtctgtcgagtcgcttacgagatcatgcagaccttacatcctgacgcatcagccaattttcacagcctagacgatatctactacttcgggggccaaaatgcccacaatcagattgccatttacgcccaccagccgcggaccgccgacgaaattcccatggaacctggcgacattatcggagttgcagggaaccactgggatggatattcaaaaggggtcaatcgtaaactcggtaggacaggcctgtacccctcttacaaagtgagagaaaaaattgaaactgtgaagtatccgacctatccagaggccgagaagtag

SEQ ID NO: 117566 - DNA, 153 bp, Artificial Sequence
  Description of Artificial Sequence: Synthetic coding sequence
atgcgaccctggacaggctcgtggcggtggatcatgcttatcctgttcgcatggggtacccttcttttctacattggcggccatctggtgcgggataacgaccatcctgaccacagtagccgcgagctgtccaagatcctcgccaagctctag

SEQ ID NO: 117567 - DNA, 1080 bp, Artificial Sequence
  Description of Artificial Sequence: Synthetic coding sequence
atgacctctacttcaaagggcatcctgcgcccattcctgatcgtttgcatcatactgggatgtttcatggcttgtctgctgatttacataaaacctacaaactcatggatcttcagtccaatggaatccgcaagctcggtcctgaagatgaagaattttttttctaccaagacagattactttaatgagacgaccatcctggtatgggtgtggccatttggccaaactttcgatctgacgtcctgccaagccatgttcaatattcaagggtgtcacctgactacagatcggagcctctataataagtcccatgcagtcctgattcatcaccgggatatatcatgggacctgaccaatcttccacaacaagcaagacccccctttcagaaatggatatggatgaatcttgagtctcccactcatactccacagaagagcggaatcgaacacctctttaatctaaccctgacgtaccggcgcgacagtgacatccaggtcccttatggattcttaaccgtaagtaccaatcccttcgtctttgaggtgcctagtaaggagaagttggtctgctgggtggtgagcaattggaacccagagcacgctagggttaaatattacaacgagctgtcgaagagtattgaaattcatacatatggacaggcttttggagagtacgtgaatgacaagaacctgatccccaccatctctacatgtaaattttatctgtcctttgaaaattctattcataaggattacattaccgagaagttatataacgccttcttggccggctctgtgccagtagtgctcgggccttcgcgcgaaaactacgagaactacataccagccgatagtttcatccacgtggaggactataattctcccagcgagctggccaagtaccttaaggaagttgataagaataataagctctacttgtcatactttaactggagaaaggatttcacggtgaatctcccaaggttttgggagtcacacgcgtgtctcgcatgtgatcacgtgaagagacaccaggagtacaagtccgttgggaatctcgaaaagtggttttggaattag

SEQ ID NO: 117568 - DNA, 660 bp, Artificial Sequence
  Description of Artificial Sequence: Synthetic coding sequence
atgaaccgtctcttcggaaaagccaaacccaaagcccctcctccctcactgacagactgtattggaacagtggattcacgtgccgaaagtatagacaaaaaaatatctaggcttgatgcagaattggtcaaatataaagaccagattaagaaaatgcgggaaggcccagcaaaaaacatggtgaagcagaaggccctgagagtgctgaaacagaaaagaatgtatgaacaacaacgggacaaccttgctcaacaatctttcaacatggaacaagccaattataccatccaatcacttaaagataccaaaacaaccgtggatgccatgaaattaggcgtcaaagaaatgaaaaaagcatacaaacaggtgaaaatcgaccagattgaagatttgcaagatcaactggaggacatgatggaggacgcgaacgaaattcaggaagcactgtcccggagctacggaacacctgaactcgacgaagatgatctggaagccgagttggatgcattgggagacgaactgctggcggatgaagatagtagctacttggatgaagccgccagtgctcccgctatccctgaaggggtgcctactgacacaaagaacaaagatggtgtgctagtagatgagttcggattaccacagatacctgcctcttag

SEQ ID NO: 117569 - DNA, 1293 bp, Artificial Sequence
  Description of Artificial Sequence: Synthetic coding sequence
atgagtcgtatcaacaagaacgtggtcttagccttattaacccttacgagtagtgctttcctcttgtttcaactgtactactataaacactatttaagcactaaaaatggtgcgggattgagtaagtcaaagggctctcggattgggtttgacagtacccagtggcgcgccgtgaaaaaatttatcatgttaacctctaatcaaaacgtcccagtgtttctcatcgaccctctcatcttggaactgattaacaagaacttcgagcaagtcaagaatacatcacatggatcgacatcacagtgtaagttcttttgcgtgcctcgggatttcacagccttcgctctgcagtatcacctgtggaaaaacgaagagggttggttccggattgctgaaaacatggggttccagtgtctcaaaatcgagtcaaaggacccacgcctcgacggcatcgatagcctgtcagggaccgaaatacctttgcattacatctgcaagttagccacacacgccatacatctagtggttttccatgagcggagtggtaactacctttggcatgggcatcttcgcttaaaggagcacatagatcgtaaatttgtccccttcaggaaacttcaatttggtcgctatcctggcgcgtttgatcggccagagctgcagcaggtgacagtggatggtcttgaggtgctgattcccaaggaccccatgcatttcgttgaggaagtgccccactcacgtttcatcgaatgtcggtataaagaagccagagctttcttccagcagtacctggacgacaacactgtggaagccgtggcattccgcaagagcgccaaagaactcctgcagttggccgctaagaccctgaacaaactgggggtcccattttggttatcgtcaggcacttgcctcggatggtacagacagtgcaatattatcccttattctaaggacgtcgatctgggcattttcatccaggactataagtcggacataattttagcgttccaggacgctggcctccctcttaaacataaattcggtaaggttgaggacagcctcgagttgtcctttcaggggaaagacgatgttaagctggatgtttttttcttttacgaggagactgaccacatgtggaatggtgggacccaggcaaaaaccgggaagaaatttaagtacctgtttcctaagtttacactctgttggacagagttcgtggatatgaaggtgcacgtgccctgcgagacactcgagtatatagaagctaattacgggaagaaccagcagggggcatag

SEQ ID NO: 117570 - DNA, 708 bp, Artificial Sequence
  Description of Artificial Sequence: Synthetic coding sequence
atgatcctcgaggtgggcgagaataacgggttctttagcaagtccctgctgccaagatacgcgagcaaaaagctaaagtcttcactcccacatagcagggcagtgaagaagttcataatgttgaccagcaatcaaaatgtacctgtgtttcttatcgatccgttgattctggagcttattaataagaactttgagcaggtgaagaacacctcacatgggtccacaagccagtgcaagtttttttgcgtgcccagagactttacagcgtttgcactccaataccacttatggaagaacgaggaggggtggttccggatcgccgaaaatatgggcttccagtgccttaagatagagagcaaagatccacggctggacggaatcgatagcctgagtggaacagaaattcccctgcactacatctgcaagctggctacccacgctattcacctcgtagtctttcacgaacggagcggcaattacctctggcacggccacttgagattaaaagaacatatcgataggaaatttgtgcccttcagaaaattgcagttcggcagatatccaggcgcgtttgacaggcctgaactgcagcaagttaccgtcgacgggctggaggtcttaatccccaaggatcccatgcatttcgtcgaggaagtcccccactcgagatttatcgaatgccggtataaagaggcccgggctttctag

SEQ ID NO: 117571 - DNA, 552 bp, Artificial Sequence
  Description of Artificial Sequence: Synthetic coding sequence
atgagcagaataaataagaatgtcgtgttggctctgctaacgcttacctccagcgccttcctcttgttccaactttattattataagcactatctgtccacaaagaacggcgctggactgtcaaagagcaagggaagtcgaattgggttcgactcaacgcagtggcgagcggtgaaaaagtttatcatgcttacttccaatcaaaacgtgccggtgttcctgatcgatcctctgattttagagctgattaataagaactttgagcaggtgaagaacacatctcatggcagtacatcccaatgtaagttcttttgcgtgcctagagactttactgcctttgcactacagtatcatctgtggaaaaacgaagaaggctggttccgtattgccgagaacatgggcttccagtgcctaaaaatcgagtccaaggacccaaggcttgacgggatcgatagcctcagtggcactgaaattcctctacactatatttgcaaacttgctactcatgcgatacatttggtggtgtttcatgagaggtcaggcaattattag

SEQ ID NO: 117572 - DNA, 483 bp, Artificial Sequence
  Description of Artificial Sequence: Synthetic coding sequence
tagtggtaccggcaatgtaatattataccatactccaaggacgtggacctgggcatttttatccaggactacaagtctgatatcatcttggctttccaggatgccggccttccacttaagcataaattcggcaaagtcgaggactctctggaactctctttccagggtaaggatgacgtgaagctagacgtgttctttttctacgaggagacagaccacatgtggaatggcggcactcaggccaagactgggaaaaaattcaagtacctgtttcctaaatttactctgtgttggacagagtttgtcgatatgaaggtgcacgtgccatgcgagacactcgaatacattgaagccaactatggaaaggaagccgaaagttacatattgtctatgctctttcgcactactttctggagcctcgcagactttcccctgacgcctgaaaacaacagcagcctgaaaaatgggaacctcaatgtttag

SEQ ID NO: 117573 - DNA, 816 bp, Artificial Sequence
  Description of Artificial Sequence: Synthetic coding sequence
atgtcccggatcaataaaaacgtcgtattggcgctgctcacactcacaagtagtgcattcttactcttccagctctactactataaacattacttatccactaagaacggggccggcctctcaaaatccaagggctcccggattggttttgacagcacacagtggagagcggtaaaaaagttcattatgctgacaagtaaccagaacgtgccagtctttctaattgatcccctcatcctggaactgattaacaaaaattttgaacaggtgaagaacacaagtcacggctctacaagccagtgcaagtttttttgcgtccctagggacttcacggcctttgctctgcagtatcatttgtggaagaatgaggagggctggttccgcatcgccgagaatatgggatttcagtgtcttaagatcgaaagcaaggatccaagattggacggaattgattccctgtctggaaccgagattcctctccattatatctgcaagctggctacccacgctattcacctcgtggtgtttcatgagagaagtggaaactacctctggcacggtcatcttaggctgaaggagcacatcgatcggaaattcgtgccgtttaggaagcttcagttcggtcgctatccaggcgcatttgatagacccgaactacagcaggttacagttgatgggttggaggtgttgatcccaaaagaccccatgcatttcgttgaggaggttccacattccaggtttattgagtgccgctacaaagaggctcgagccttttttcagatccccgtgagcgaggtctacaccgtgttggactag

SEQ ID NO: 117574 - DNA, 1488 bp, Artificial Sequence
  Description of Artificial Sequence: Synthetic coding sequence
atgcgactgactaggtgtcaagccgcactagccgcagctattactctgaacttactcgttttgttctacgtgtcgtggctccagcaccaaccgcggaactctcgggctcgggggcctagacgcgctagcgccgcaggaccacgcgtgacggtgctggtgagggagttcgaggcttttgacaacgccgtgcccgagctggtagatagctttcttcagcaggatcctgctcagcctgtcgtagtcgccgccgacacactaccttatccgcccctggcactgccccgaattcctaatgtccgccttgctctcctccagcccgctttggataggcccgctgctgccagccgacccgagacttacgtagccaccgaatttgtcgcgctggtaccagacggggctcgagccgaggcacccgggctcctggagcgcatggtagaagctttgcgagccggttccgccaggctggttgcggcgccagttgccacagccaatcccgccagatgtctcgctttgaacgtgtctctgcgagagtggactgctaggtatggagctgcccctgcggcaccccgctgtgatgccctcgatggcgatgcagtcgtccttctccgggcacgggacctgttcaatctaagcgctccactggcacgccctgtcggaacttcactttttctgcaaactgctctgcgcggatgggcagtgcaactgttagaccttacatttgccgctgcacggcagcccccattagcgaccgctcacgcaaggtggaaagccgagcgcgagggaagggcaagaagggctgccctcctgagagctctgggaatccgcctcgtgtcatgggagggcgggcgcttggagtggtttggctgcaacaaggagacgacacggtgctttggtaccgtagtcggggatacccccgcctacctgtatgaagagagatggacacctccctgctgcctgcgagccttgcgggagacagcccgttatgttgtgggcgtcttagaagctgccggggtgcggtactggctggaagggggctccctcctgggagctgcacggcatggcgatattattccctgggattacgacgtggacctgggaatctacctggaggatgtcggcaactgtgaacagttgaggggggccgaggcgggatccgtggttgacgaacggggatttgtctgggagaaagcagtggaaggagacttcttccgcgtacaatattcagaatccaaccatctccacgtcgacctgtggcccttttacccccgcaatggcgtcatgaccaaggatacctggctggatcaccgccaagatgtggaatttcccgagcatttcttacagcccctggtgcctctgcccttcgcgggattcgtggctcaggctcctaataattaccgtaggttcctcgaactgaagtttggacccggcgttatagagaaccctcagtaccctaaccccgcactgctcagcctcacagggtccgggtag

SEQ ID NO: 117575 - DNA, 1488 bp, Artificial Sequence
  Description of Artificial Sequence: Synthetic coding sequence
atgagactgacacgctgccaggcagctctcgcagcagcaataactctcaacctgttggtcctcttttatgtgagctggttgcagcatcagcctagaaacagtagagccagggggcccaggcgtgcctctgccgccggaccccgtgtcaccgtcctggtgcgcgaattcgaggccttcgataatgccgttcccgagctagtggatagctttctccagcaggacccagcgcagcccgtggtggtggctgccgataccttaccgtatccccctctggccttgccgcgcatacccaacgttaggctcgcactgctgcagcctgccctggaccggcctgccgccgcctctaggcccgagacatacgtggccactgagtttgttgccctagtacctgatggtgcccgagctgaggcacccgggctccttgaaagaatggtcgaggcattacgcgccggcagcgctcggctggtcgcggcaccagtcgcaacagctaacccagctaggtgcctggctctgaacgtctcattacgcgagtggactgcacggtatggggcggctcccgcagcacctcggtgcgacgccttagatggagacgctgtcgtgctactccgagcacgggacttgtttaacctgagcgcccccttggccagaccggtaggcacaagtctcttcctccagactgccctgcgggggtgggccgttcagcttctggacctcactttcgccgccgcaagacaaccccctctagccactgcgcacgcgcgctggaaggccgaaagagagggacgggcgcgccgggccgctctcctccgggctctgggcattaggctggtctcctgggagggcggtcggctcgagtggtttgggtgcaacaaggaaaccaccagatgttttgggaccgtcgtgggtgatactccagcgtacctttatgaggagcgctggaccccgccctgctgccttcgggctctccgggagaccgcccggtacgtggtcggcgtgctggaagctgccggggtgaggtactggctggagggtggatctctgcttggcgctgcccgacacggcgacatcatcccttgggattatgacgtggacctggggatctatcttgaagacgtgggcaactgtgaacaactgcgaggcgccgaagcagggagcgtggtggatgaacgaggctttgtgtgggagaaggctgtagaaggggacttctttcgcgtccagtacagcgagtccaatcatcttcatgttgatctgtggcccttctatcccagaaacggtgtcatgaccaaagacacgtggctcgatcaccgtcaggacgttgagtttccagagcattttctacagcccttagttccattaccattcgcagggtttgtggcgcaggccccaaacaattaccggaggttcctagagctaaaatttggtccaggggttatagagaacccgcagtatcccaaccctgccctgctatctctgacaggcagcggctag

SEQ ID NO: 117576 - DNA, 2385 bp, Artificial Sequence
  Description of Artificial Sequence: Synthetic coding sequence
atggaattacggccttggttgttgtgggtggtggccgccactgggactctcgtcctcctcgccgctgacgcccagggccagaaggtgtttacaaacacctgggcggtgaggatccctgggggcccggcagtagctaactctgtcgcccgcaaacacggattcttaaatttgggacaaatcttcggagattattatcacttttggcatagaggtgtcacaaagcgcagcctgagtcctcaccgccctagacactcccggctgcagagagaacctcaggttcagtggctggagcagcaggtggctaagcgcaggacaaagagggacgtgtaccaggaaccaactgacccaaaattcccacaacagtggtatctgtcaggggttacgcaaagggatttaaacgtgaaggccgcatgggcccaaggatacactgggcacgggatcgtcgtgagcatcttggacgatggaatcgagaaaaatcatcccgatctggctggaaattacgatccgggggcctcgtttgacgtgaacgaccaagatccggaccctcagccgcgttacacacagatgaacgataaccgtcatggaacccggtgtgcaggcgaagttgctgcagtagcaaataacggggtctgtggggtcggagttgcctataacgcccggattggaggcgtcaggatgttggacggggaggtcactgacgccgtggaggctcggagccttgggttaaaccccaaccatatccacatctattccgcaagttgggggcctgaagacgatggtaaaaccgtggacgggcccgcccgactggccgaggaagcgttttttaggggggtgtcacagggccggggtgggttgggctccatttttgtctgggcttccggcaatggcgggagagagcatgactcctgtaactgtgacggatacaccaactctatctatactttgtcaataagtagcgcaactcagtttggcaatgtgccctggtatagcgaagcatgctccagtacgctagctacaacgtactcatcgggcaatcaaaatgaaaaacagattgtgactactgaccttagacagaagtgcactgaatcacataccgggacatcggcaagcgccccactcgcagctggcattatcgcattgaccctagaggcaaataagaacttgacgtggcgggacatgcagcaccttgtagttcagacatccaaaccggcacacctgaatgccaatgactgggcaacaaacggcgtaggccgaaaggtgtctcatagctacggttatggactgctggacgctggggccatggtagctctagcccagaattggacaaccgtggccccgcaacgaaaatgtattatcgatatcctgacagaacctaaggatattggaaagcgtctcgaagtgcggaaaacagtaaccgcttgcctgggagagccgaatcatataactagattagagcatgcccaggcaaggctaacgctcagctacaatcgtaggggggatctcgctattcaccttgtcagtcctatgggtaccagaagcacccttcttgctgcacgcccccatgactactcagctgacggcttcaacgactgggctttcatgaccacccattcttgggatgaggatccatccggggagtgggtcctcgaaattgaaaacacttccgaggccaataactacggtaccctgaccaaattcactctggtcctctatggcacagcccctgagggcctgccagtcccacccgagtcttcgggctgtaagaccttaacctcttcccaggcctgcgtggtatgtgaagaaggattcagcctccaccagaagagctgcgttcagcattgcccccctggatttgctccacaggttctggacactcactactccactgaaaatgatgtcgagacaatacgcgcgagcgtgtgtgccccgtgtcacgcatcctgtgcaacctgtcaggggcctgcccttaccgactgtctatcttgcccatcacacgctagcttggatccagtggaacagacctgttcacgccagtcccaatcaagcagggagtcccctcctcaacagcagccaccacggctaccacccgaagtggaggccggccagagactgagggccgggctactgccatcacacttgcccgaagtggtggcaggcttatcttgcgctttcatcgtgctggtcttcgtaacagtgttcctggtattgcaactgaggagtggattttctttccgtggagtgaaagtgtacacaatggatagaggactgattagctacaaaggtctgcctccagaagcatggcaggaggagtgtcccagtgattccgaagaagatgaaggccgaggagaacgcacagcattcatcaaggaccagtccgctctctag

SEQ ID NO: 117577 - DNA, 210 bp, Artificial Sequence
  Description of Artificial Sequence: Synthetic coding sequence
aaaccagctcacctgaatgcgaacgactgggctaccaatggagttggtagaaaggtctcgcactcttacggatatgggctgtggactcaggctccttggtggccgtggccgagaatcggcccccagtggccccccagtggaagcgcctcaagcaccagtagcccctcccctaagactagcgggaatgggtccagatgtggacgcccctag

SEQ ID NO: 117578 - DNA, 210 bp, Artificial Sequence
  Description of Artificial Sequence: Synthetic coding sequence
atggaactgagaccatggctactgtgggtggtggctgctacggggactctggttctactggccgccgatgcacagggccaaaaagtctttacaaatacctgggccgtacggatccccggaggaccagctgttgcaaatagcgtggcacgcaagcacgggttccttaatttgggacagatattcggcgactattatcatttttggcattag

SEQ ID NO: 117579 - DNA, 1581 bp, Artificial Sequence
  Description of Artificial Sequence: Synthetic coding sequence
atggcctcaaacgactacacacagcaggctacccaaagctacggggcataccccacccagcctggtcaaggatattcccaacagtcatctcagccctacggacagcagagctattcaggatacagccagtctaccgacacctccggatacggccagagttcttattcctcatacggacagtcacaaaacaccgggtacggtacccagtccacaccccagggttacggatctacaggggggtacggctcgtcccagtcgagccagagcagttacgggcagcagagttcctatccaggttatggacagcagccagcccccagttccacatcaggctcatacggatcttcatctcagagctcttcctacggtcaacctcagtcaggctcttactcccagcagccgtcctacggaggccagcagcagagctatgggcagcagcagtcatataaccctccccagggttacggacagcaaaatcagtataactcttctagcggtggagggggggggggaggcggtggaggcaattatggacaagatcagtcctcgatgagcagtggaggaggtagcggtggtgggtacggcaaccaggaccaatcagggggcggaggtagtggtgggtacggacaacaggataggggtggaagaggccgcggcgggtcggggggcggcggggggggcggagggggcggctataataggagcagcggcgggtacgaaccacggggacgcgggggtggacgaggaggccgcggtggaatgggaggaagtgacagaggaggcttcaataaatttggtggacctcgcgatcaaggaagccgacatgactcagaacaggataattctgataacaacactatcttcgtgcaggggctgggagagaacgtgactattgaatccgtggccgactacttcaagcagataggcataattaaaacaaataagaaaacaggtcagccgatgatcaatctgtataccgaccgagagaccggcaaactaaagggagaggccactgtctcttttgacgacccaccgtcagccaaagccgctattgattggttcgacggcaaagagttttcaggcaaccctatcaaagtcagttttgccacgcgacgggctgattttaatcgcggggggggcaatgggaggggaggtagaggccgcggagggccaatgggtcgaggcggatatggcggggggggtagtggtggcggtggccggggcggttttccttccggaggaggaggggggggcggccagcagagggccggtgattggaagtgcccgaatccaacctgcgagaacatgaatttctcctggcgcaatgaatgcaaccaatgcaaggctccaaaacccgatggccctggtggtggacccggtgggtcacatatgggcggcaattatggagacgatcgtagaggaggtagaggcggatatgatcgagggggttacagaggccgagggggagatcggggtggttttcgtggtggacgaggaggcggagacagaggggggttcggaccgggaaagatggactcccgcggcgaacacagacaggacaggcgggagcgcccttattag

SEQ ID NO: 117580 - DNA, 456 bp, Artificial Sequence
  Description of Artificial Sequence: Synthetic coding sequence
atgaacccggaggttgtcgaggtggccgtggaggctgaggtggcctgggcggaagtgacggtggtggcatctattaatttggtagccctcgggactaaagaccacgtaatgactcctaccaacaagaagactgggcagccaatgatcaatctgtatacagaccgcgagaccggaaaactgaagggcgaagcaaccgtgtcatttgacgacccacccagcgccaaggcagctatcgattggttcgacgggaaagagttctctgggaaccctattaaggtctcattcgctacacgccgcgccgactttaaccggggcggcggcaacggccggggtgggagggggcgggggggacccatggggagaggaggctatggcggaggtggatccggcggggggggtcgtggcggcttcccctccggtggagggggcggaggcggtcagcagcgcgccgggtag

SEQ ID NO: 117581 - DNA, 1290 bp, Artificial Sequence
  Description of Artificial Sequence: Synthetic coding sequence
atggcatcgaacgactatacccagcaagcaacacaatcctatggagcttatccaacccaacctggtcagggatattctcaacagtcaagtcagccttacggacagcaatcgtattccggatatagccagagcactgatacgagtgggtacggccaaagttcctactccagttacggccaaagtcagaatacagggtacggaacccaatcgacccctcagggctacggctcaacaggaggatacggatcatcccaatcgtcccagagctcgtacggccagcagagcagttatccaggatatggtcagcaaccagccccaagctctacctctggctcctacggatcttccagccagtcctcatcctacggacagccacagagcggctcttattctcaacagccctcctatggtgggcaacagcagagctatggacagcagcagtcctacaaccctcctcagggctacggacagcagaatcaatacaatagcagctcgggcggatacgaaccaagaggccgggggggaggccggggaggtcggggtggaatgggcgggtcagaccggggcggttttaacaaatttggcggtccaagagatcagggcagtcgtcatgacagcgaacaagacaactctgataacaacaccatcttcgtgcaaggtctgggcgagaatgtcaccattgagagcgttgccgactatttcaagcagatcgggattattaaaaccaataaaaagacaggacagcctatgatcaatctgtataccgacagggagaccggcaaactcaagggtgaggccacggtctcctttgatgaccccccaagtgcaaaggctgccattgactggtttgatggcaaagaattctctggaaatcctataaaagtgagcttcgcaacccgccgtgccgatttcaacagaggcgggggcaacggacgcgggggaaggggaagaggagggcccatggggaggggcgggtacgggggaggtggctccgggggaggagggcggggcgggtttccttcaggaggcgggggggggggtggtcagcaacgggcaggagattggaagtgtccaaatcccacctgtgaaaacatgaatttttcttggcgtaatgagtgtaatcaatgtaaggcccctaaaccagacggtcctggcggaggcccaggtggaagccacatgggaggcaattacggagacgaccgaagaggcggcgatcggggtgggttcgggcctggcaagatggatagcagaggtgaacaccgccaggacaggagagagcgcccctattag

SEQ ID NO: 117582 - DNA, 1257 bp, Artificial Sequence
  Description of Artificial Sequence: Synthetic coding sequence
atgggggaggagggtaccggcgggaccgtgcatctgctttgtctagccgcctcatccggagttccactcttttgcagatctagccgcgggggggcccccgcacgtcagcagctgccattttccgtcatcggcagcctgaacggggttcacatgttcggacagaatctcgaagttcaactgtccagcgcccgcaccgagaacacgacagtcgtttggaaatcattccacgatagcatcaccctcatagtgctgtcctccgaagtgggcatttccgagctgagactcgagagattgctgcagatggtgttcggcgccatggttcttctggtcggacttgaggaactgactaatattagaaacgtcgaaagactcaagaaggacctccgagccagctactgcctgatcgacagttttctgggggactctgaacttattggcgacctgactcagtgtgtggattgcgtaattcctcccgaaggttcactcctccaggaggccctgtcaggatttgccgaagccgcaggtaccacctttgtctccctcgttgtgtcaggcagggttgtcgcagctacagagggctggtggcgactgggaactcctgaagccgttcttctcccgtggctggtggggtccttgccgccccagaccgcccgcgactaccccgtataccttccacatggatcccccacagtgccacaccggctcctcacactcacgctgttgccttccctcgaactgtgtcttttgtgtggcccaagtccacctctaagtcagttatacccccagctgctagagcgctggtggcagcccctgttagatccattacgcgcctgcttacctctgggaccacgcgccctgccatcgggttttcccctgcataccgatatcctcgggcttcttctcctgcacttagagctgaaacgctgtttatttaccgtggagcccctgggggacaaagagcccagccctgaacagcgcagaagattactccggaatttttacacactggtgactagtacccactttccacccgaaccggggcccccagagaagacagaagatgaggtctatcaagcgcagctgcctcgggcttgctatctagtgttggggactgaagaaccaggcactggcgtgcgcttagttgccctgcagctgggcctgcggcgcctgctgctcctgcttagtccccagtcgccaacacacgggctcagaagcttggcaactcacaccctccacgccttgacacctctcttgtag

SEQ ID NO: 117583 - DNA, 711 bp, Artificial Sequence
  Description of Artificial Sequence: Synthetic coding sequence
atgggggaggagggcactggtggtacagttcacctgctctgtctggcggcttcatccggggtgccgctgttctgtaggagttcccggggcggcgcccccgcccgacagcagctgcccttttctgtgatcggctccctgaatggcgtgcatatgtttggccaaaacctcgaggtgcagctgagctctgcgagaactgaaaacacaaccgtggtgtggaaaagctttcacgattctattactttgattgtactgtcaagtgaagtcggaataagcgaactgcgcctggaacgcctcctacaaatggttttcggggccatggtgctcttggtcggtctcgaggagctgaccaatatccggaacgtagaacggctgaaaaaggacctgcgagccagctattgtctcatcgactcctttctgggtgacagtgagttgattggcgacttgactcaatgcgtggactgtgttattccaccagaaggttccctgttacaggtcctcgggatgctctggaagcttctccacctgttttgctggccctggctaagccctcacccactgtccagcgggccactcagccaacctccgccaattttgtctgcatcctcacccattccaacgtggtcccagaaaaatttgttctccttttttttttccttcctctccctgtctttcctctttagtttcctgtccctcttcctctttgaaacatag

SEQ ID NO: 117584 - DNA, 1164 bp, Artificial Sequence
  Description of Artificial Sequence: Synthetic coding sequence
atgggggaggagggaacgggcggcactgtccacttgttatgtctggcagcctccagtggagtacccctattttgcagatcctctcggggaggggccccagctcggcagcagctacccttctccgttattggctcacttaacggcgtacacatgtttggccagaacctggaggtgcagctctcctctgcaaggaccgaaaatactaccgtggtttggaagtcttttcatgattcaatcaccctgattgtccttagctccgaagtgggaatttctgaattgcggcttgagaggctgctgcagatggtgtttggcgccatggtcctgctcgtgggtttggaagaactcacaaacattcgtaacgtggagcggttaaagaaggacttgcgcgcctcttattgcctgatcgacagcttcctgggcgattctgagcttatcggtgacttaactcaatgtgtagattgcgttattccaccagaaggtagtctgttacaggaggcgctgtcaggatttgctgaggccgctggtactacattcgtttctttggtcgtgagcgggagagtggtggccgccaccgaagggtggtggaggctcggcacccctgaagccgtgctactgccctggttagtcgggtctctgcctccccagactgcgcgagactatcccgtatacttacctcatgggtcacccaccgtcccacaccgacttctgaccctcaccttactcccttcattggaactgtgcttgctttgcggaccttcccctcctctgagtcaactgtaccctcagctcctagagagatggtggcagccactcttggaccccttgagagcctgtctccctttaggcccccgggctttgccttcgggcttccctctacacacagacattctgggattacttctgcttcacttagagcttaagcggtgtctcttcacagtagagccactcggtgataaagagcctagtcccgagcagagacgccggctacttcgaaacttctacacactggtaacaagtacccacttccccccggaacctggcccaccggagaaaacagaggatgaggtatatcaagcacagctcccccgtgcatgttatctcgtgatgggggacggccacaggcacggggccgttagtgtgtcactctttatacgatctcagtag

SEQ ID NO: 117585 - DNA, 1149 bp, Artificial Sequence
  Description of Artificial Sequence: Synthetic coding sequence
atgggcgaagagggcaccggagggactgtgcatctcctatgtctggccgcctctagcggagtgccgttattctgtcgatcttctcgcggtggcgcccccgctaggcagcagcttcccttctcagtaatagggtcattaaatggggtacacatgtttggccaaaacttagaggtgcaacttagcagcgcaaggactgagaacactaccgtggtgctgctggtcggtctggaagagttgaccaacataaggaacgtggagaggctgaaaaaagacctacgagccagttactgtctcatagattcctttttaggagatagtgaactgatcggtgatctcacacagtgcgtggattgcgtgatccctccggagggaagcctgcttcaggaggcgctgagcggtttcgccgaagccgccggtacaacattcgtaagcttggttgtcagtggcagagtggtggctgccactgagggctggtggcgcctggggactccagaagccgtgcttcttccctggctggtggggtccttacctccccagacggctcgtgattacccagtgtacctgccccacggttctcctaccgtacctcatcgcttgcttacactgacactcctcccgtctttagagctttgcttattatgcgggccatcacctccactgtcccaattgtaccctcagctgctggaacgatggtggcagcctctgctcgatccactgcgtgcatgcttacccttgggcccacgcgccctccccagcggatttccactgcatacagacattctcggcctgttgctgcttcacttggagctcaagcgctgcctgtttacagtggagcccctgggcgacaaggagccgagcccagagcagagacgcaggctgttgagaaatttttatacattggtgacatccacccacttccctccagagcctgggccaccagagaagactgaggatgaagtttaccaggcccagctgccccgtgcatgctatctcgtcctgggcacggaggaaccaggaaccggggtgcgtctggtcgccctgcagctgggtctcaggaggctgttgttactgctgtcaccccagtctcccactcacggtttgagatctttagccactcacactttgcatgccttgaccccactgttatag

SEQ ID NO: 117586 - DNA, 279 bp, Artificial Sequence
  Description of Artificial Sequence: Synthetic coding sequence
atggccagcttgggacacattctggtgttttgtgtgggcctgctgactatggccaaggccgaatctcctaaagaacatgaccccttcacatacgattatcaatccctgcaaatcggaggattagtgattgccggaattctcttcatcctagggattctgatcgttctttcacggagatgtagatgcaaattcaaccagcagcagcgtactggggaacccgatgaggaggaggggacgttcagatcatctatcaggcgattgtcaacaaggcgaaggtag

SEQ ID NO: 117587 - DNA, 279 bp, Artificial Sequence
  Description of Artificial Sequence: Synthetic coding sequence
atggcaagtctgggccacatcttggtgttttgcgttggcttgctcaccatggcaaaggctgagtcccctaaggaacacgacccctttacctatgattaccagagccttcaaataggtgggcttgtgattgcagggatattgtttattctgggcattctgatcgtgttgtcacgccgatgccggtgtaaattcaatcagcagcaaagaacaggggaacccgatgaagaggagggtacctttcgcagttcaatccgcaggctttccacgagacgaaggtag

SEQ ID NO: 117588 - DNA, 195 bp, Artificial Sequence
  Description of Artificial Sequence: Synthetic coding sequence
atggacaggtggtatctggggggttcacctaagggggacgtggaccccttttattatgactatgagacggtaaggaatggcgggctcatttttgctggactggcttttattgttggtcttttaatcctgctctctagacgctttcgttgtggaggtaataaaaagcgacgccaaatcaacgaagacgagccttag

SEQ ID NO: 117589 - DNA, 201 bp, Artificial Sequence
  Description of Artificial Sequence: Synthetic coding sequence
atgacggggctgtctatggatggcggcgggtccccaaagggcgacgttgacccgttctattatgattatgagaccgttaggaacgggggactaatatttgccggcctggccttcatcgtgggcctgcttattctgctcagcaggaggtttcgttgtggcggtaacaaaaagaggaggcagattaatgaggacgagccttag

SEQ ID NO: 117590 - DNA, 195 bp, Artificial Sequence
  Description of Artificial Sequence: Synthetic coding sequence
atggacagatggtacctgggaggttctccaaagggtgatgtggatccattctattatgactacgaaaccgtcagaaatggagggctcatttttgcaggcctggcatttatcgtcggtctgctcattttgctgtctcgccggtttagatgtgggggcaacaaaaagcggcgtcaaatcaatgaggatgaaccgtag

SEQ ID NO: 117591 - DNA, 264 bp, Artificial Sequence
  Description of Artificial Sequence: Synthetic coding sequence
atgcaaaaagtcaccctgggattgttggtatttctggcgggatttccggtgttagatgccaatgacttggaagataaaaacagccctttttattacgattggcacagtctccaggtgggcggcctgatctgcgcgggggtcttgtgtgccatgggcataatcatcgtgatgtctgcgaagtgtaagtgcaaattcggtcagaagtcaggacaccacccgggtgaaacaccgccattaatcacccccggatcagcacagtcctag

SEQ ID NO: 117592 - DNA, 342 bp, Artificial Sequence
  Description of Artificial Sequence: Synthetic coding sequence
atgcagaaggtcaccttaggactcctcgtctttttggcgggcttccctgtcctggacgccaacgatctggaggacaagaacagccctttttactacgattggcactcactgcaggtgggcggactcatctgtgcgggagtgctatgcgccatgggtataattattgtcatgagcgagtggagatcctctggcgagcaagcagggagaggctggggctctccccccctcaccacccaactgagcccaactggcgccaagtgcaagtgcaaattcgggcagaaaagcgggcaccaccccggtgagacacccccattaatcacgccgggatccgcgcagtcttag

SEQ ID NO: 117593 - DNA, 291 bp, Artificial Sequence
  Description of Artificial Sequence: Synthetic coding sequence
atgcaaaaagtgactctcgggctgttggtcttcctggccgggtttccggtgctggacgcaaacgatctggaagacaaaaacagccccttttactatgattggcactctctgcaggtgggcggcttaatctgcgcaggagtcctgtgcgccatgggtataattattgtgatgtctgaatggagaagctcaggcgagcaggcggggcgtggatgggggtcccctcccctcactactcagctgtctcccaccggcgccaagtgcaaatgtaagttcggacaaaaaagtgggtag

SEQ ID NO: 117594 - DNA, 264 bp, Artificial Sequence
  Description of Artificial Sequence: Synthetic coding sequence
atgcaaaaggtgactcttggtctcctggtgtttctagcgggttttccggtcctggacgctaacgatctcgaagataagaatagccctttttattatgactggcacagcttgcaagtgggtggactgatttgcgccggggttctgtgtgcaatgggaataatcattgtgatgagtgccaagtgcaagtgcaagttcggacagaagtctgggcaccacccaggagaaacgccaccccttatcactcccggctccgctcagtcctag

SEQ ID NO: 117595 - DNA, 435 bp, Artificial Sequence
  Description of Artificial Sequence: Synthetic coding sequence
atgggccgcggatacagtggagcacttcaggctaggggtggcttggaggagccactcgagcgaggcctgaggggaccaagcttcactcaaagccctttgcacggggcagctgcggcatacctctcagctcagagggacgcttctctccccgtaccaggccagaggtctgacatgcagaaggtgacccttggactgctggtcttcctcgctggcttccccgtgctggatgccaatgacctagaggacaaaaacagcccattctactacgattggcattccctccaagtgggagggctcatctgcgctggcgttttatgcgctatggggatcatcatcgttatgtctgctaagtgcaagtgtaaatttggtcagaagagtgggcatcacccgggcgaaaccccacctttaataacacccggctccgctcagtcttag

SEQ ID NO: 117596 - DNA, 186 bp, Artificial Sequence
  Description of Artificial Sequence: Synthetic coding sequence
atgcaaaaggtgacactgggtcttctagttttcctggcaggtttcccagtcctcgacgctaatgatctggaggacaagaacagtcccttttactacggtgaatccccatgcccccttagcccgccacacaatcctacatattgcctggtaccccgcgtgcccattcaggggtggggattgacatag

SEQ ID NO: 117597 - DNA, 435 bp, Artificial Sequence
  Description of Artificial Sequence: Synthetic coding sequence
atggggcggggatatagtggcgccctccaagccagaggcggcctagaggaaccgttggagcggggactgcgcgggcctagcttcacccagagtccactgcatggggcagctgctgcctatcttagcgctcagagagacgcttcgctgcctgtgcctggacagagaagtgatatgcaaaaagtgacccttggccttctggtatttctggccggcttcccagttttagacgccaacgatctcgaagataaaaatagtcccttttattacgattggcactcgctgcaggtgggaggcttgatttgcgctggcgtactttgtgccatgggcataatcattgtgatgagtgcaaagtgtaagtgtaaatttggacaaaaaagtggacatcacccgggagagacacccccacttatcacccctggtagtgcccagagctag

SEQ ID NO: 117598 - DNA, 288 bp, Artificial Sequence
  Description of Artificial Sequence: Synthetic coding sequence
atggagcttgtgctggtctttctgtgttccctgctcgcacccatggttctcgcttccgctgcggaaaaagagaaagagatggacccattccactacgattaccaaacgctgagaatcggaggtctcgtctttgccgtggtgctgtttagcgttggcatcctattaatcctctcacggaggtgcaagtgcagcttcaatcagaagcctagggccccgggcgatgaagaggcccaagtggagaacctgattacggctaatgcaaccgagccacagaaagccgaaaactag

SEQ ID NO: 117599 - DNA, 288 bp, Artificial Sequence
  Description of Artificial Sequence: Synthetic coding sequence
atggagcttgtgctggtcttcctgtgctctttgttggccccgatggtgctggcgtccgcagctgagaaagaaaaggagatggacccgttccattacgattatcagaccctgcgcattggaggactcgttttcgcggtcgtcctcttcagcgtcggcattctgctgatcttatcacgtaggtgtaagtgtagcttcaatcagaagccccgcgcccctggagatgaagaggcacaagtcgagaacctgatcacggccaacgctactgagccgcaaaaggctgagaactag

SEQ ID NO: 117600 - DNA, 288 bp, Artificial Sequence
  Description of Artificial Sequence: Synthetic coding sequence
atggagctcgtgttggtgttcctctgtagcttactcgctcccatggtcctggcctcagcggcagagaaggagaaggagatggacccattccactacgactatcagacactgaggatagggggtctggtgttcgcggtggtgctcttttcagtgggcatcttgctcatcttgagccggagatgcaagtgttcttttaatcagaagccacgagcacctggggatgaggaggcccaggtagaaaatttgataaccgcaaacgctactgagccacagaaggccgaaaactag

SEQ ID NO: 117601 - DNA, 288 bp, Artificial Sequence
  Description of Artificial Sequence: Synthetic coding sequence
atggaactcgtgctggtgttcctgtgttccttgcttgcccctatggtcctggctagtgcggccgaaaaagagaaggaaatggacccattccattatgactaccagacattgagaatcggtggactggtgtttgccgtggttctctttagcgttgggatcctcctgatcctttcgaggagatgtaagtgctcctttaaccagaaaccacgagctcctggtgacgaggaggcgcaggttgagaatttgatcaccgccaatgcaacggaaccacagaaagccgaaaattag

SEQ ID NO: 117602 - DNA, 288 bp, Artificial Sequence
  Description of Artificial Sequence: Synthetic coding sequence
atggagctcgtcctcgtgtttctgtgctccctgctagctccaatggttctggcttcggctgctgagaaggagaaagagatggatccttttcactacgattaccagaccctgagaatcggcggactggttttcgctgtagtccttttctcagtgggaattctgctgattctgtccagaaggtgcaagtgcagctttaaccagaaaccgagagctcccggcgatgaggaagcccaggtcgaaaatctcattaccgccaatgcaaccgagccacagaaggcagagaactag

SEQ ID NO: 117603 - DNA, 288 bp, Artificial Sequence
  Description of Artificial Sequence: Synthetic coding sequence
atggagctggttctggtatttttgtgtagtctcttagcgcccatggtactcgcaagcgctgctgaaaaggagaaggagatggaccctttccattacgactaccagacactgaggatcggaggcttagtctttgctgtggttctattctcagtgggaattcttctgatcctcagccggcgttgcaaatgtagctttaatcagaaacccagggccccgggagacgaggaggctcaggtcgagaaccttatcacggcaaacgctacagagccccaaaaagcagagaattag

SEQ ID NO: 117604 - DNA, 243 bp, Artificial Sequence
  Description of Artificial Sequence: Synthetic coding sequence
atggccactccaacacagactccaaccaaggcccccgaagagccggatcccttttactacgattataacaccgttcagaccgtggggatgactctcgcaactatcctattcctgctaggaattctaattgtaataagtaagaaggtcaaatgtaggaaggccgactcacgatccgaatctcctacctgcaagtcctgtaagtcagagctgccctcaagcgccccggggggggggggcgtgtag

SEQ ID NO: 117605 - DNA, 402 bp, Artificial Sequence
  Description of Artificial Sequence: Synthetic coding sequence
atggtgagcgtgggattcggcgaccgggcaggcctgggctctagctgtagatgctcccagatcactccagatatggcttccgcagtggccactcggtatgtgctgggacactggccacgcgaccacatctgcggctgtggtagccaccaactcagctcttggcgggccgagcctgacggcggcgtgggcatgccccacactttgagcgagcccccgtccggcctaaccggtatttgggccggggctctggtgagtcccgagaagcaaatgaaagaaaatttgcgtagtaatgattctgaacctcggcttccaggatttgagtcatgcctgatccattctcttgcagtgtggccatgggctagcaatttcgccagtctcggtccatcagttaacaaagggtag

SEQ ID NO: 117606 - DNA, 882 bp, Artificial Sequence
  Description of Artificial Sequence: Synthetic coding sequence
atgtacttcctgaccccaattttggtggcgatcctgtgcatcctggtggtgtggatcttcaagaatgcagataggtcaatggaaaagaaaaaaggagaacctaggacccgcgccgaggcacggccttgggtggacgaggacctgaaagatagctctgatctccatcaggccgaggaagacgccgatgagtggcaggaatctgaggagaatgtagagcacatccctttctcccacaatcattatccggagaaagagatggttaaaagatctcaagagttctatgagctgcttaacaaacgcagaagtgtgcggttcataagcaatgaacaggtacccatggaagttattgacaacgtgattcggactgccggcacagcgccctcaggcgcacacaccgaaccttggaccttcgtggtagtcaaggatccagatgtgaagcacaagattagaaagattatcgaagaagaggaggagattaattacatgaagaggatggggcaccgttgggtaaccgatcttaagaaactccgaactaattggatcaaagagtatctggatacagcacctattctgatattgatttttaaacaggtgcatggatttgcagcgaacggtaaaaagaaagtccactattacaatgagatttctgtgtctatagcttgcggcattctactggcagccctccaagtgaacaatggcatcactatgcgccaccaaaccgccagacacaggcatttaatcgaaggtcccggacgatccagtgaagcctgtagtaaactgagctcacagggttgcccagagtgccggagcggcgactgccactatcattcctcccagctgtggccctccacggagggagctccagggcctccacggacgtag

SEQ ID NO: 117607 - DNA, 1458 bp, Artificial Sequence
  Description of Artificial Sequence: Synthetic coding sequence
atgggctgcgtgcagtgtaaagataaagaggccaccaagctaacggaggagcgtgacggaagcctgaaccagtcatctggatacaggtacggaaccgatcctacaccgcagcattaccctagtttcggcgtgaccagtatccccaactacaataattttcacgcagcgggaggtcaaggcctgaccgtttttggcggtgtgaactcctcttcccacacaggtactctgagaacgaggggtgggaccggggtcactttgttcgtggccctctatgattacgaggcacggaccgaggaatggtatttcggcaagctcgggaggaaagatgcggagcgacaactgctgtcgtttggaaacccacgtggcacattcctgattcgcgaatccgaaaccacaaagggggcatacagtctgagtattcgagattgggacgacatgaagggcgatcacgtgaagcattataagatccgcaaacttgacaacgggggctactacatcaccacaagagcacagttcgagaccttacagcagctggtccaacattacagtgaaaaagccgacgggctctgcttcaacctaactgtgatcgcgtcttcctgtacgccccagaccagcgggcttgccaaggatgcatgggaggtcgcccgacgcagcctgtgcctcgagaaaaaactcggacaaggctgctttgctgaggtgtggctcgggacttggaatggaaatacaaaagttgccatcaagacgctaaagcccggcactatgtcacctgagtcctttctagaggaggctcagatcatgaaaaagttaaaacacgacaaactggtccagctctacgctgttgtgtccgaggaacctatatatattgttacagagtatatgaacaaaggctcgctcttagattttttaaaggacggagaagggcgggcattaaaactccccaacctcgtcgacatggccgcccaggttgctgcaggtatggcttatattgagaggatgaattatattcatagggacctgcgttccgctaacatcctggtcggcaacggactcatttgcaagatcgccgactttggcctagccaggctcatcgaggacaacgaatatactgcgagacagggcgcaaagtttccaatcaaatggacagctcctgaagccgctctctacggacggttcacgattaaatcagatgtgtggtctttcgggattctcctgacagaactggtaacgaaaggcagagtgccttaccccggaatgaacaatcgggaggtcttggagcaggtcgagcggggctataggatgccttgtccccaagactgccccatatccctacatgagctgatgattcattgttggaagaaagacccagaagaaaggcccacattcgagtacctccagagcttcctggaggactactttaccgcgaccgaaccgcagtaccagcctggggaaaatttgtag

SEQ ID NO: 117608 - DNA, 1614 bp, Artificial Sequence
  Description of Artificial Sequence: Synthetic coding sequence
atggggtgcgtccagtgtaaagataaggaggccactaagctaaccgaggagagagatggtagtttaaatcaatctagcggataccgctatggaacagatccaacaccccaacactatcctagtttcggagtaacatcgattccgaactataataacttccacgccgcgggcggccagggactaaccgtgtttggaggtgtgaactcaagtagccataccggtactttacggacaaggggaggcactggggtgactttgtttgtagcactctacgattatgaagccaggacggaagacgacctctcgtttcataagggggagaaatttcagatcctcaattccagcgagggagactggtgggaagctagatctctcactaccggcgagacgggatatatccctagcaattacgtggcacctgtggatagcattcaggccgaggaatggtacttcggcaaactcggaagaaaggatgccgaacgccagctcctgagcttcggcaatccccgggggacgtttttgatccgtgagagtgagacaaccaaaggcgcctatagcctgtcaattagggactgggacgatatgaagggggatcacgtcaaacattacaagatcagaaagctcgacaatggaggctactatataacaaccagggctcagttcgagacactgcaacaactggtacagcactacagcgagagagcagcaggcctgtgttgccgcctggtggttccttgccataagggaatgccgagactgactgacctgagcgtcaaaactaaggatgtgtgggaaattcctcgtgagtccttacagctcatcaagaggctgggaaacgggcagtttggcgaggtttggatgggtacttggaatggaaacacaaaagtggccatcaaaactttaaaacctggcaccatgagccctgagtcgttccttgaggaggcccagataatgaaaaaactaaagcacgacaagctggttcagttatacgcagttgtatctgaagagccaatctatatcgtcacagaatatatgaacaagggaagcctgctggattttctgaaggatggagagggccgtgctctgaagttgcctaacctggttgacatggccgcccaggtggccgccgggatggcttatatagaacggatgaattatattcacagagacctacgctccgccaatatcctcgtggggaatggcctgatctgtaagattgctgatttcggcctcgctcgacttattgaagacaacgagtatacagctaggcagggtgcaaaattcccaatcaagtggaccgcccctgaagctgcgctgtatggccgcttcaccatcaagtccgacgtctggtctttcggcatactcctgactgagctggttacaaaggggcgggtgccgtatccagggatgaataatcgcgaggttctggagcaggtggagcgtggataccgtatgccatgtccccaggattgccccatctcactgcatgagctgatgattcactgctggaagaaggatccagaagagcggcccaccttcgaatacctgcagtcttttctggaggactactttacagctaccgaaccccagtaccagccaggcgagaacctgtag

SEQ ID NO: 117609 - DNA, 1449 bp, Artificial Sequence
  Description of Artificial Sequence: Synthetic coding sequence
atggggtgcgtgcaatgcaaggacaaagaggccacaaaactgacggaggagagggacgggtctttgaatcaatcttccgggtataggtacggaacagatcccacacctcagcattacccttccttcggtgtaacgtcaatacctaactacaataacttccacgccgctggcggccagggtctcaccgtgtttggcggtgttaattcctctagccacacgggaactctaaggaccagaggcggaacgggagtaacccttttcgtcgctctatatgattacgaagcgcgtacagaggatgacttatcctttcataagggcgaaaagttccaaattcttaacagctccgagggcgattggtgggaagcccgatcgctaactacgggcgagacaggctacataccatcgaattatgtggcgccagtcgatagcattcaggctgaggagtggtactttggtaagctaggtcgtaaggatgctgagcggcagctgctatccttcggcaatccaaggggcacttttctgataagagagtccgagacaacgaaaggagcttatagcctctcgattagggactgggatgatatgaagggcgatcacgtaaagcattataaaatccggaagctcgataatggaggatattatatcacaacgagggcccagtttgaaaccctgcagcagctggtacagcactattctggaacgtggaatggaaacacaaaggtcgccataaagaccctcaagccaggcacaatgagcccggagtcattcctggaggaggcacagatcatgaagaaactgaaacacgacaaattagtccagctttatgcagtagtgtcggaggagccgatttacatagtgacagagtatatgaacaaaggaagtctgctggatttcttgaaggatggcgaagggcgggctctgaaattacccaacctggtggatatggcagcacaagtggctgcagggatggcatacatcgaaaggatgaactatattcaccgggacctaagatctgctaacatcctcgtgggtaacggactcatatgcaaaatcgctgatttcggccttgcaagacttattgaggataacgagtacactgccaggcaaggcgctaagttcccaatcaaatggacagcacccgaggccgcactgtacggccggttcactataaagtctgacgtgtggtcatttgggatccttttaaccgaactggtgacaaaaggtagagtgccgtatcctggcatgaacaaccgagaagtgctcgaacaggtggagagaggctatcgcatgccctgtccccaagactgtccgataagtctgcacgagctcatgattcactgctggaaaaaagatccagaggagcggcctacgttcgagtatctgcaaagctttctcgaggattatttcacggctactgagccccagtatcagcccggggaaaatctctag

SEQ ID NO: 117610 - DNA, 1614 bp, Artificial Sequence
  Description of Artificial Sequence: Synthetic coding sequence
atggggtgcgttcaatgtaaagacaaggaagcaacaaaactaaccgaggagcgcgacggctccctgaatcaaagtagtgggtataggtacggcaccgacccgacaccgcaacattatccatctttcggggtgacgagtatccctaactacaataatttccacgccgctggcggccaaggtttgactgtgttcggtggtgttaacagctcgagtcacacggggaccctccgtacgaggggtggcaccggcgtcaccctgtttgtggccctgtacgattatgaggcccgaaccgaggatgatttaagcttccacaaaggggaaaagttccagatcctcaacagctcagagggcgactggtgggaagctaggtcactgaccaccggagagacgggctacatcccttccaattatgtggcccccgtggactctatccaagctgaggagtggtactttggtaaactggggagaaaagatgccgagcggcagcttctgagcttcggaaaccctagaggcactttcctaatccgggaaagcgagacaactaagggagcctactcgttgtctatacgggattgggatgacatgaagggagaccacgttaagcactacaagatacgaaagctagataacggcggttattacatcacaacaagggcgcagtttgagaccctacaacagctggtacagcactacagcgagagggcggccggattgtgctgtagattagtggttccatgccacaaaggaatgcctagactgaccgacctgtctgttaagactaaggacgtttgggagataccaagagagtccctgcagctcatcaaaagactggggaacggacagtttggagaagtctggatgggcacttggaacggaaacactaaagttgcaatcaaaacactgaaacctgggaccatgtcacctgaaagcttcctcgaagaagcccaaattatgaagaaacttaaacatgataagctagttcagctctatgcagtggtgtcggaagagcctatctatatcgtgaccgaatacatgaataaaggcagtctgctcgacttcctcaaagacggagaaggcagagcactgaagcttccaaaccttgtggatatggcggcgcaggtggccgctggtatggcatacattgaacggatgaattatatccaccgtgacctgagatccgccaacattctggtaggaaacggattgatctgtaagatcgcagacttcgggctcgcccggctcattgaggacaatgaatataccgcccggcaaggcgcgaaattcccgattaagtggaccgccccagaagcagcactttacggccgattcacaataaagagcgatgtgtggagtttcggaatcctcctgacggagctggtaaccaaagggcgcgtgccgtatccaggcatgaataaccgggaagtgcttgaacaggtggagagagggtaccggatgccttgccctcaggactgcccaatctcccttcacgaattaatgattcactgttggaagaaggacccagaggaacgcccaacgtttgagtatctgcagtccttcctcgaggattatttcacagccactgagccgcagtatcagccaggtgaaaatctgtag

SEQ ID NO: 117611 - DNA, 1605 bp, Artificial Sequence
  Description of Artificial Sequence: Synthetic coding sequence
atgggttgcgtgcaatgcaaggataaagaggctaccaagctgactgaggagcgggacggatccctaaaccagagctccggctatagatatggtacggacccaacccctcagcactatcccagcttcggagtgacctctattcctaattacaataactttcatgctgcaggggggcaaggtctcaccgtcttcggaggcgtgaattccagctcccatacagggactctgcggactcggggcggaacaggcgtcacactgtttgttgcactgtatgattatgaggcaagaacggaagacgacttgagctttcataagggtgagaaatttcaaatcctgaattcatctgaaggcgattggtgggaggctaggtccttgaccacgggtgaaactggatacattccctcaaactatgtggccccagtagattcaatacaggccgaggaatggtatttcggaaaactggggcggaaggacgcggaacgtcagcttctttctttcggaaacccacggggcacatttctgatccgggagtccgagactaccaagggtgcctattcattgtctattagagattgggacgacatgaaaggtgatcatgtgaagcactataagataaggaaactagacaacggcggctactatattacaacaagggcacagttcgaaaccctccaacagttggttcaacactattccgagaaggcagatggactgtgttttaacctgaccgtcatcgctagctcctgtacgccccagacaagcggccttgcaaaagatgcatgggaggtcgctagacgttctctgtgcctggaaaaaaagcttggtcagggctgcttcgcagaagtctggcttgggacttggaatggcaacacaaaggttgccataaagaccctcaagcccgggaccatgtccccagaatccttcctcgaagaggctcaaattatgaaaaagctgaagcacgacaaactagttcaactttatgctgtggtatctgaggagcctatttatatcgtgactgagtatatgaacaaagggagtctgttggattttctgaaggatggagagggtcgtgccttaaaattgccaaacctcgtggacatggccgcccaggtagctgcaggaatggcttacatcgaacggatgaattatatccaccgggatcttagatcagctaatatactcgtcggaaatggtttgatatgtaaaatcgctgactttggtctcgcccgtttaattgaggacaatgaatataccgccagacagggtgccaagtttcctatcaaatggacagcgcctgaggcagccctctatggcaggtttacaataaagtcggacgtgtggtcatttggaatccttctcaccgaacttgttaccaagggtcgcgtcccataccccgggatgaacaatcgtgaggtgctagagcaggtggagcgtggctaccggatgccgtgcccccaggactgtcctatcagtcttcacgagctgatgatccactgctggaagaaggatccggaggaaaggccgacattcgagtacctgcagtcctttctcgaagactactttaccgccaccgaaccccagtaccagcccggtgagaacttatag

SEQ ID NO: 117612 - DNA, 1605 bp, Artificial Sequence
  Description of Artificial Sequence: Synthetic coding sequence
atgggttgtgtacagtgtaaggacaaggaagccaccaagctcacagaagagcgcgatgggtcattgaatcagagttccggatacaggtacggaactgaccctacgccacagcactacccgtcatttggtgtcacgtccattccaaactacaataacttccatgccgccgggggccagggtctgaccgtttttggtggcgttaatagcagtagccatacgggcaccttacggacaagaggaggaactggagtcaccctttttgtagctctgtatgattatgaagcccgaacagaggacgatctttcttttcataagggcgagaagttccaaattctcaattcctctgagggcgactggtgggaggcacgaagcctgacgacgggcgaaactggctatattccatctaattacgtggcacccgtagactctattcaggctgaggaatggtactttggcaaactgggacgcaaggacgccgaaaggcagctgttatcctttgggaaccccagaggaacatttctcattcgcgagtcagaaaccaccaagggcgcttacagcctctccattcgagactgggatgatatgaagggtgatcatgtcaagcattataaaattcgcaagctcgacaacggtgggtactacataactacccgcgctcagttcgagactctccagcaactagttcagcactactccgagaaggccgacggcttatgcttcaatctgactgtgattgccagttcttgcactccgcaaacctctgggctggccaaggacgcctgggaggtggcaagaagaagcctttgcctggagaaaaagctcggtcagggatgttttgcagaagtatggctgggaacatggaatgggaacaccaaggtagctattaaaacacttaaaccggggacaatgagcccagagtcattcctggaggaagcccaaatcatgaagaagcttaaacatgataaactggtgcaactgtatgccgtagtgtctgaggaacccatttatattgtaacagagtacatgaacaaagggagtctcctagattttctgaaggatggcgaaggccgagcactcaaactgccaaatctagtggacatggccgctcaggtcgcagctgggatggcctacattgagagaatgaactacattcacagagacctccgaagtgccaatattctggtcggaaacgggctgatctgtaaaatcgccgattttggcctggcgcgcttgatcgaggacaatgagtatacagctagacagggcgctaagtttcccattaagtggaccgcacccgaagctgcactttatggccggtttaccataaagagcgatgtgtggagttttggcatcctcctgacggaactggtcacaaagggtagagtgccgtacccgggcatgaacaatcgcgaggtgcttgaacaggtggagcgtggttaccggatgccctgcccgcaggactgtcctatatccctacatgagctcatgatacactgttggaaaaaggacccagaagagcgcccgacctttgagtacctacagagctttctggaggactatttcacagccactgaaccacagtatcagcccggcgaaaacctgtag

SEQ ID NO: 117613 - DNA, 363 bp, Artificial Sequence
  Description of Artificial Sequence: Synthetic coding sequence
atgggttgcgttcagtgcaaagataaagaggcaacgaagctaactgaggagcgggacggcagtctgaatcagtcatccggctatcgctacggaactgatcctacccctcagcactatccctccttcggcgtgacctccataccaaattacaacaactttcatgccgcaggtggccaaggactgaccgtattcggcggagtgaactcctcctcccacacgggcacactgaggacccgtggggggaccggcgtcacgctatttgtcgcactgtatgactacgaggctagaacggaggacgacctgagtttccataaaggcgagaaattccaaattctgaactcctctgaaggcgactggtggtag

SEQ ID NO: 117614 - DNA, 699 bp, Artificial Sequence
  Description of Artificial Sequence: Synthetic coding sequence
atgggctgcgtacagtgtaaagataaggaggctacgaagcttaccgaggaacgcgatgggtcactaaatcagagttcaggatatagatacgggaccgatcctacaccccagcactacccttccttcggcgtgacatcaattccgaactacaacaactttcatgccgcgggaggccagggactaacagtgtttggcggcgtaaactcatctagccacaccggcacactgcgcaccaggggcggtacaggagtaacactgttcgttgcactctatgactatgaagcacgaaccgaggacgacctatcgttccacaagggcgagaaatttcagatcctgaattccagtgagggcgactggtgggaggcgagatcacttacaacaggcgagaccggttacattccttcaaattatgtggcgcccgttgacagcattcaagctgaggaatggtattttggcaagcttggacgcaaggatgcagagcgccagctgctgtcctttggaaacccaagaggtacatttctgattcgggagagcgaaaccacaaaaggggcctactccttgtcaatccgcgactgggatgacatgaaaggtgaccacgtgaaacattacaagattcgcaagcttgacaatgggggttactatatcaccacccgtgcacaattcgaaacactccagcagcttgtgcagcattacagctag

SEQ ID NO: 117615 - DNA, 321 bp, Artificial Sequence
  Description of Artificial Sequence: Synthetic coding sequence
atgggttgcgtgcagtgcaaagacaaagaggctaccaaactaacagaggaaagagatggcagtctcaatcaatcatcgggataccggtatggcaccgatcccacgccacaacactacccttcttttggcgttacaagcattcccaattacaacaattttcacgccgcaggaggccaaggccttacagtgtttggaggagtgaactcttcaagccacaccgggaccctgcgaaccagaggcggcacgggggtaacgttgtttgttgccttgtatgactacgaggcacgcacggaggatgacctgagctttcataaggggtag

SEQ ID NO: 117616 - DNA, 198 bp, Artificial Sequence
  Description of Artificial Sequence: Synthetic coding sequence
atgggatgcgtccagtgcaaagataaagaagcaaccaagcttaccgaggaaagggacggctctctgaatcagtctagcggctaccggtacggaacagatcccacaccccaacactatccttctttcggagttactagcatccctaactataataattttcacgctgcaggaggacaagggttaactgtatttgggtag

SEQ ID NO: 117617 - DNA, 528 bp, Artificial Sequence
  Description of Artificial Sequence: Synthetic coding sequence
atgggatgtgtgcagtgcaaggataaggaagccacaaagttaaccgaagaaagagatggtagcctgaaccagtcttcaggctacagatacggtactgatcctactccccagcattatccaagttttggagtgacctctatcccgaattacaacaatttccacgctgctgggggacagggcctgactgtgtttggcggcgtcaactcgagcagccatacaggcaccctgcgcactcgaggggggactggcgttacgctattcgttgccctttacgattacgaggcccgtaccgaggatgacctgagcttccacaaaggggaaaagttccagattctaaattcttctgagggtgactggtgggaggcccggagccttacaaccggcgagacaggttatatcccaagtaattacgtggcccccgtcgattcaattcaggctgaggagtggtactttgggaaacttgggcgaaaggacgcggaaaggcaacttctgtcctttggcaatcctaggggcacgtttctgatctag

SEQ ID NO: 117618 - DNA, 462 bp, Artificial Sequence
  Description of Artificial Sequence: Synthetic coding sequence
atgggctgtgtgcaatgtaaggataaagaggcaactaagctgacagaggaacgcgacggctcactcaatcagtcctcaggatataggtatggtacggatcctacgcctcagcattacccttcatttggggtgacaagcatccccaactacaataactttcacgcagctggaggacaggggctaaccgtcttcggtggtgtgaattcctcttcacatacaggcaccttgcgcacaagggggggaaccggtgtgacactgtttgttgcgttatacgactatgaggcgagaactgaggatgacctgagcttccataagggcgagaagttccagattcttaatagtagtgagggagattggtgggaggctaggagtctgacaactggcgaaactggatatataccgagcaactatgtggctccggtggactccatccaagctgaggagtggtactttggcaaatag

SEQ ID NO: 117619 - DNA, 357 bp, Artificial Sequence
  Description of Artificial Sequence: Synthetic coding sequence
atggggtgcgttcagtgtaaggataaggaagccacaaaactgaccgaggaacgagatggatctttgaaccagtcgtcaggatatcgatatgggaccgatcccactcctcagcactacccttcttttggggtgacatctattccaaattataataactttcatgctgcgggtggccaaggactgaccgtctttggcggggttaattcctcatcccacaccggtaccctgaggacaagggggggaactggtgtaacccttttcgtggccttatacgattacgaggcgcggacggaagacgacttgagcttccataagggagagaaatttcaaattcttaacagctccgagggagactag

SEQ ID NO: 117620 - DNA, 561 bp, Artificial Sequence
  Description of Artificial Sequence: Synthetic coding sequence
atgggatgcgttcagtgcaaagataaggaggccaccaagctgacagaggagagagacggcagcctgaatcagtcgtccggttatcgttatggcaccgacccaacgccccagcactatccgtcttttggagtaacctcaatccccaactataataattttcacgccgctggagggcagggtctgactgtattcgggggcgtgaactccagttcccatactggtaccttacgcacgaggggaggaactggtgtcacgctatttgtcgccttgtatgactatgaggcacgcactgaggacgacctgagttttcataagggggagaagttccagattttaaactctagtgagggggattggtgggaagctaggtcattaactacgggggaaacaggctatatcccgtccaactacgtcgcgcccgtggatagtatccaggcggaggaatggtactttggtaaacttggccggaaagacgcggaacgccagctcctcagctttggcaatcctcgcgggactttcctgatcagagaatctgaaacaacaaaaggcgcctactcatag

SEQ ID NO: 117621 - DNA, 312 bp, Artificial Sequence
  Description of Artificial Sequence: Synthetic coding sequence
atgggctgcgtgcagtgtaaggataaagaagcaaccaaactcacagaggaacgagatggatcactaaatcagtcgagtggatacagatacggaactgatcctacaccccagcactatccctctttcggcgtgacatcgatccctaattacaataattttcacgctgccggcggccaagggctgacggtgttcggcggcgtgaactccagttcacacacaggtaccctgcgcactagagggggcacaggcgtgacactgttcgtggctctgtatgactacgaagctaggactgaagacgatttatcattttag

SEQ ID NO: 117622 - DNA, 459 bp, Artificial Sequence
  Description of Artificial Sequence: Synthetic coding sequence
atggggtgcgtgcagtgtaaggacaaagaggcaactaagctgacggaagagcgagacggctctctcaaccaatcgtccggctaccggtacgggaccgatcccacaccgcagcactacccctcttttggcgtgacctcaatccccaattacaataactttcacgccgccggcggccagggtctcaccgtctttggaggagtgaattcttcctctcacacaggcacactgagaacacgggggggaactggcgtcactctgttcgtggccctgtacgattacgaagcgcggacggaagatgatttgagtttccataagggcgaaaaatttcagattctgaacagctctgaaggcgactggtgggaagctcgttcactcaccacaggagagactggttacataccatctaattacgtggccccagtggattctatacaggctgaagaatggtacttcggctag

SEQ ID NO: 117623 - DNA, 351 bp, Artificial Sequence
  Description of Artificial Sequence: Synthetic coding sequence
atgggctgtgtgcagtgtaaggacaaggaagccaccaagctgacagaagaaagggacgggtccctcaaccaatcaagtggataccgctacgggacggacccaactccccagcactatccttcgttcggcgtaacatcgattcctaactacaacaattttcatgcagctggaggccagggactgaccgttttcggcggggtcaatagtagttctcataccggcacgctacggactaggggaggcacaggcgtgacactctttgtcgccctgtatgattacgaggctcgaaccgaggacgacctgtccttccacaaaggcgaaaagttccagattctgaacagcagtgaatag

SEQ ID NO: 117624 - DNA, 423 bp, Artificial Sequence
  Description of Artificial Sequence: Synthetic coding sequence
atggggtgcgtgcaatgcaaggacaaggaggcgacgaagctgacagaggagagagatggatccctgaaccaatcctcgggctacaggtacgggaccgaccctaccccacaacactatccatcctttggtgtgacctctatccccaactacaataacttccacgcagccgggggccagggattgaccgtgttcggtggcgttaacagctccagccacactgggactctacgcacgcggggcgggaccggagtgaccttattcgtggccctgtacgactacgaagcacgcaccgaagatgacctcagcttccataagggcgagaagtttcagatcctaaacagcagtgagggagattggtgggaagcccgatccctgactaccggagagaccggttatattccatcaaattacgtagctccttag

SEQ ID NO: 117625 - DNA, 438 bp, Artificial Sequence
  Description of Artificial Sequence: Synthetic coding sequence
atgggctgcgtgcagtgcaaggacaaggaagccaccaaactaaccgaggagcgtgatggctcactgaaccagagtagcgggtaccgctatgggacagaccctaccccacaacattatcctagctttggcgtgacttcaatacctaactataacaactttcatgcagcaggaggtcagggccttaccgtgtttggaggagtgaacagcagttcccatacaggcacactcaggacccgagggggcaccggagtcacactgttcgtggcactgtatgattacgaggcccggaccgaagatgacttaagcttccacaaaggcgaaaagtttcagatcctgaattcttcggagggggattggtgggaagcgcggtcccttacaactggtgaaacaggctacattcccagtaattacgtggcccccgtcgacagcatccaatag

SEQ ID NO: 117626 - DNA, 1605 bp, Artificial Sequence
  Description of Artificial Sequence: Synthetic coding sequence
atgggctgcgtccagtgtaaggacaaggaggcaacaaaattaacggaagaacgcgacgggtcgctcaaccagagctcagggtatagatatggcacagaccctaccccacagcattatcctagtttcggagttacctccatcccaaattataacaactttcatgcagccggaggacaaggtctcactgtgttcggaggcgtgaattccagctctcacactggaacactgaggacacggggagggaccggggtaactctgttcgtggccctgtatgattacgaagccagaactgaagacgatctgtcattccacaaaggggaaaaattccaaatcttgaacagctcagagggcgactggtgggaagctcgttctctgacaaccggcgagactgggtacatcccctccaactacgttgcgcccgtggattcaatccaagcggaggagtggtacttcgggaagctaggtcgaaaggacgcggagcgacagctgctgagtttcggcaacccaagaggtactttcctgatccgcgaaagcgaaacaacaaagggagcctattcattgtccatccgcgattgggacgatatgaagggcgatcatgtgaaacattacaagatcagaaagctcgacaacgggggctattacattaccacccgggctcagtttgagacgctgcaacagctagttcagcactattcagagaaagccgacgggctatgtttcaacttgaccgtgatagcgagttcatgcactccccagactagtggcctcgctaaggatgcctgggaagtggcccgtcggtccctctgcttagaaaaaaagctcgggcaggggtgcttcgccgaggtgtggctgggcacatggaatggaaatacaaaggtggcaattaaaacactgaaacctggaactatgtcacctgaatcctttcttgaagaagcccagataatgaagaagttaaagcatgataaactggtccaattatatgccgtagtgtccgaggagcccatctacattgtgactgagtacatgaataaaggctcactgctggacttcctgaaagatggtgaggggcgcgccctgaagctgcccaatttggtcgatatggccgctcaggtggccgctggtatggcttacatcgagcggatgaactatattcaccgggatttgagatccgccaacatcctcgtgggtaacggtctgatttgtaagattgccgacttcgggctggcacggctgattgaagacaatgagtataccgccagacagggcgcaaaattcccgataaagtggacggcaccagaagctgcgttatatgggcggttcaccattaagtccgatgtatggtccttcgggatcctgctgaccgagcttgttacaaaggggcgcgttccctatccaggaatgaacaaccgggaagtgttagaacaggtcgaaaggggatatcgcatgccatgcccgcaggattgccctatatctctccatgagcttatgattcactgttggaagaaggaccccgaggaacggccaacctttgagtatctgcaaagcttcctcgaggattattttacagctaccgaacctcaataccagcccggcgaaaatttatag

SEQ ID NO: 117627 - DNA, 1458 bp, Artificial Sequence
  Description of Artificial Sequence: Synthetic coding sequence
atgggctgcgtccagtgcaaagataaagaagctactaagctaaccgaagaaagagacggatctctgaatcagtctagcggctatcggtacggcaccgatcctacgccccagcactacccatcattcggagtgaccagtattcctaactataacaattttcatgcagctggcggacaagggctaacagttttcggcggcgtgaactcttcaagccacacggggaccctcagaacgcggggtggaacaggggtgactctgttcgtcgcactgtatgactacgaggcccaggccgaggaatggtatttcggaaaactgggtcggaaggatgcagagaggcaactactgagcttcgggaacccacggggcaccttccttattcgtgaatcagagacaacaaagggcgcctacagcctttccattagagattgggacgacatgaagggcgatcacgtgaagcactacaaaattcgcaagctggacaacggaggttactacataacaactagagcccagtttgagaccctgcagcagctggttcagcactattccgagaaagcagacggattgtgctttaatctgactgtcatcgcttcttcgtgtacccctcagacaagcggcctggccaaagacgcctgggaggtggcgaggcgctctctgtgcctggagaaaaagctcggccagggatgcttcgccgaggtgtggctgggtacatggaacggaaatacgaaagtcgctatcaaaacactgaaaccaggcacaatgagtccagagtctttcctagaggaagcacagatcatgaagaaattaaagcatgacaagctcgtgcaactctatgctgtggtgagcgaagaaccaatttacatagttacggagtatatgaataaagggtcacttctagactttctgaaggacggcgaaggacgcgccttgaaactcccaaatctggtcgatatggccgctcaggtcgccgctgggatggcttatattgaaagaatgaattacattcacagggaccttcgatccgccaatatcttggtaggaaatggcttaatctgcaagatcgccgactttggcctagccaggctcatcgaagataatgaatatacagcccggcagggcgctaaattcccgatcaagtggaccgcccctgaggccgctctgtatggccggtttaccataaagagcgatgtgtggtccttcggaatcctgctgaccgagctggttactaaaggccgcgtgccctacccgggcatgaacaatcgtgaagtgctggagcaggtggagcgtggctaccggatgccctgcccgcaagattgtcccatttcattgcatgagctgatgattcactgctggaagaaagaccccgaggagcggccaaccttcgaatacctccagagctttctcgaagattacttcactgcgactgaaccccagtatcaacccggggaaaatttgtag

SEQ ID NO: 117628 - DNA, 4437 bp, Artificial Sequence
  Description of Artificial Sequence: Synthetic coding sequence
atggcctctaccaacgctgagtcccagctccaacgcatcatccgagacttgcaagatgctgtgacagagctgagtaaggaattccaggaagcgggtgagccaataaccgatgattctacctccctccacaagttttcttataagctcgaatatctgctccagtttgatcagaaagaaaaggcaaccctcctcggcaataaaaaggactactgggactacttctgcgcctgtctggccaaggtgaaaggagctaatgatggaattcggtttgtgaagagtatctctgagctacgaaccagtttaggaaaaggccgcgcctttatcaggtactcgctcgtacaccaaaggctggcagatacactgcaacagtgcttcatgaacaccaaagtcacttccgattggtattatgcccgaagcccctttctgcagcctaaactaagttccgacatcgttggacagctgtatgagctgacagaagtccagtttgatctcgccagcagaggtttcgatttagacgccgcgtggccgacgttcgctaggaggaccctgacgactggaagtagtgcttacctttggaaaccccccagccgatctagctctatgtcatccttggtatcctcttatctgcagacccaggagatggtctcaaatttcgacctgaattctccccttaataatgaggcattggaagggttcgacgagatgcgactcgagctggatcagcttgaggtccgtgaaaagcagctgcgagaaaggatgcagcaactggacagagagaatcaggagctccgagcagctgtaagccaacagggagaacagttgcagacagagagagaacgcgggcgtaccgcggccgaagataatgtcaggcttacatgcttggtagctgaactccaaaagcagtgggaagttacccaggccacccaaaacaccgtgaaagagttacagacttgcctgcaagggttggagctgggagccgctgagaaagaggaggattaccacacagccctacgtcgcctggaaagcatgcttcagcccctggcacaggagctcgaggcaaccagggacagtttggacaagaaaaatcagcacctggccagctttcccggctggctagctatggcccagcagaaagcagacaccgccagcgacacaaagggtagacaagaaccgattccctctgacgccgcccaagagatgcaggaattgggagagaaactccaggccctcgagcgggagagaacaaaagtggaagaggtgaaccgccaacaatcagcccagctcgaacagctggttaaggaactgcagctgaaggaagatgcacgtgcatcgctagagaggcttgtgaaggaaatggcccccctgcaagaagagttgtccggcaagggacaggaagccgatcagttgtggcgccgactccaggagctgctcgcccatacaagttcttgggaagaagaacttgccgagctgcgtagagagaagaaacaacagcaagaagaaaaagagctgctcgaacaggaggttagatcccttacacggcagttacagttcctcgagacccaattagcccaagtgagccagcacgtctctgacctcgaggagcaaaagaagcagttgattcaagataaagaccacctctcgcagcaggtcggaatgcttgaaagactggctgggcctcctggccccgaactccctgttgccggggagaaaaatgaggcgctggttccagtgaatagctctctccaggaggcatggggaaaacctgaagaggaacagaggggactgcaagaggcacaactggacgatactaaggtgcaagaaggaagccaagaagaagaactgcggcaagctaaccgagagctagagaaggagcttcaaaacgtcgtgggccgaaaccaacttttggagggcaaactccaagcccttcaggctgactatcaggctctgcagcaacgagaatcagccatccaaggcagccttgcatccctcgaagctgagcaggctagcatacgccatctaggtgaccaaatggaggctagcctgctggccgtccggaaggccaaggaggccatgaaagctcagatggcagagaaagaagctatcctgcagagcaaggaaggggagtgtcaacagcttcgggaggaagttgaacagtgtcagcagttagccgaggccagacaccgcgagctgagggctttggaatcgcaatgtcagcagcagactcagctcattgaagtgctgaccgctgaaaagggccagcagggggtggggccacccacagataatgaagccagggaactcgcagcacagctggccctaagtcaggcacaactcgaggtacaccaaggagaagtccagcgtctccaggcacaggtcgtggatctacaggcaaagatgcgggccgccctggatgatcaagacaaggtgcagagtcagctgtccatggccgaggccgtgcttcgcgaacataagaccctggtccagcagttgaaggagcaaaatgaagccctcaatagagcccacgtgcaggaactcttacagtgtagtgaaagggagggggcgctacaggaagagagggcagacgaagctcagcagagggaggaggagcttagggccttacaggaggaattatcccaggccaaatgctccagtgaagaggcccaactggaacatgcagaactgcaggagcagctccaccgcgctaacaccgacaccgccgagttgggcatacaggtgtgcgccctgaccgttgaaaaggaaagggtggaggaggccctggcctgcgcagtccaagagctgcaggatgccaaggaggccgccagtcgcgagagggagggactggagagacaggtggcaggactgcagcaggaaaaagaaagcttgcaggagaagctaaaagcagccaaagctgcagccggtagcctgcccggcctgcaggcccaactggcgcaggctgagcagagagcacaatcactccaggaagccgcacaccaggagttaaatacactcaaattccaactttcagctgaaatcatggattaccaatctcgcttgaagaacgccggagaagagtgcaaatccttgcgggggcagctcgaagagcagggaaggcaacttcaggccgccgaggaggctgtggaaaaactgaaggctactcaagcagatatgggtgagaagctctcctgcacctcaaatcatctcgccgaatgccaggcagccatgctcaggaaggataaggagggtgctgctttgcgcgaagacctggaaaggactcagaaagagttagaaaaggcgacgactaagatacaggagtattataacaagctgtgccaagaggtaacaaaccgtgagcgtaatgaccagaaaatgctggctgacttggatgatctgaaccgtacgaagaaatacctggaagaacgacttattgaactgctgagggacaaagacgccctatggcagaagtcggacgccctcgaattccagcagaagttatctgccgaggagcgctggctcggggatacagaggccaaccactgtttagattgcaagagagaattctcctggatggtgaggagacaccattgtcgtatctgcggccgaatattctgctactattgttgtaacaactatgtcctcagtaaacacggcgggaaaaaggaacgttgctgcagggcatgcttccagaagttatcagaagggccgggttcccccgactctagcgggtcgggaacaagtcaaggggaaccctcacctgcattgagccctgcttcgcctgggccgcaggccaccggaggtcaaggtgctaacactgattacagaccacctgatgatgctgtgtttgatataattacagatgaagaactgtgccagattcaggagtcaggcagtagtttaccagagacgccgactgaaaccgattctctcgatcccaatgccgctgagcaggacacgacatctacctcacttacgcctgaagatacggaggacatgcccgtgggtcaggactcagagatctgtctcctgaagagtggagaactgatgatcaaggtgccactcacagtcgatgagatcgcgtcctttggagagggatctcgagagctatttgtccgaagtagcacttactcactgattcctatcacagtggccgaggcagggctcacaatatcttgggtgttcagcagcgacccaaagtcaattagctttagcgttgtgttccaggaggcagaagatacgcccctggaccaatgtaaagtcctgattcccactactcgatgcaactcccataaagaaaatattcaggggcaattgaaggtcagaactcccggaatttacatgttgatcttcgataacacgtttagcaggtttgttagtaagaaggtattttaccacttaacagtggataggcctgtaatctatgacggctcagactttctgtag

SEQ ID NO: 117629 - DNA, 804 bp, Artificial Sequence
  Description of Artificial Sequence: Synthetic coding sequence
tgatctaagcacggcggcaagaaggaaagatgctgtagggcgtgtttccagaagctcagcgagggccccgggtcgccggacagcagcggcagcgggacatcacagggtgagcccagtccagcgctgagccccgccagccctgggcctcaggcaaccgggggccagggagcaaacacggattataggccacccgatgacgccgtgttcgacattataaccgacgaggaactgtgccaaatccaagagagcgggagctctctgcctgagacccctaccgagacagattctcttgaccctaatgcagctgagcaggatacaacatctactagtctgacaccagaggataccgaggacatgcctgtcggtcaggatagcgagatttgcctgctcaagtctggagagttgatgatcaaagtcccgctcactgtggacgagatagcgtcgtttggggagggatctcgggagctgttcgttcggtcttccacctatagcctgatccccatcaccgtggctgaagccggactgacgattagctgggtgttctcttctgatccaaagtcaatctccttcagtgtagtgttccaggaggcggaggacacccctctggatcagtgtaaggtgctgattcctaccactagatgcaactctcacaaggaaaacattcagggacagctcaaggtgcgcactcccgggatttacatgcttattttcgacaacactttcagccgtttcgtctcaaagaaagtcttttatcatttaaccgtcgaccgacctgtcatatatgacgggtcagattttctctag

SEQ ID NO: 117630 - DNA, 4497 bp, Artificial Sequence
  Description of Artificial Sequence: Synthetic coding sequence
atggcctcgactaatgccgaatcccagctgcaaaggatcatccgagacttgcaggacgccgtgaccgaactgtcaaaggagtttcaagaggcaggtgagcctattaccgatgactcgactagtctgcacaaattctcttacaaactggagtacttgcttcagtttgaccagaaagagaaggccactttgcttggaaacaaaaaagactattgggactatttctgtgcctgcttggccaaagtgaagggcgcgaacgacggtatacggttcgtcaagtcaattagcgaactacgaacctctctcggcaaggggcgtgcattcattagatacagcctggtgcaccagcgcctggcagacaccctgcaacagtgcttcatgaacaccaaggtgactagtgattggtactacgctcggagccccttccttcaacctaaactgtcttccgacattgtaggacaactttatgaactcactgaagtccagtttgacttagcatcgagaggattcgatcttgatgctgcttggccgacattcgcccgcaggaccctgacaaccggcagctctgcatacctgtggaagcctccatcccgctcatccagtatgagttcgttggtatcaagctacctgcagacacaggagatggtgtcgaactttgatctcaactcccctctcaataatgaggcactcgaaggattcgacgaaatgaggttggaacttgaccagctggaggtgcgggaaaaacagttgcgtgagagaatgcagcaactggacagggagaatcaggagctccgtgcagccgttagccagcaaggagaacagctccagaccgaaagggagcgtgggcgcaccgctgcagaagataatgtcagactgacttgtcttgtggctgagctgcagaaacaatgggaggtcactcaggccacacagaatacagtcaaggaactgcaaacatgtctacagggccttgaactgggcgccgccgagaaggaagaggattaccacaccgctcttcggagacttgaatcgatgctccaaccgctggcccaggaactggaagcaactcgagattccctggataaaaagaaccagcacttagctagctttccaggttggttggccatggcgcagcagaaggctgacacagcctctgacacaaagggtagacaggagcctataccctcagacgcagcccaagagatgcaggaactgggagagaagctccaggctctcgagcgcgaacgaactaaggttgaagaggtcaacagacagcaaagcgcccagttagagcaactggtcaaagagctgcaattaaaggaagatgcgagggctagtttagagaggctggtcaaagagatggcgccactgcaagaagaactgtccgggaagggccaggaagccgatcagctatggaggcgcctccaggagcttctggctcacaccagctcctgggaggaagagcttgccgagttaagaagagagaagaagcagcagcaagaggaaaaggagcttctggaacaggaggtacggtctttgacccgacagctgcagttcttggagactcagctggctcaggtttcacagcacgtaagcgatctcgaggagcaaaaaaagcaactaatccaggacaaagatcacctgtcccagcaggttggcatgctagagcgcctggcaggaccccctggccctgagctcccagtggcaggggagaagaatgaagctctggtaccagtaaactcctctctccaggaggcatggggcaagcccgaagaagagcagcggggcctgcaggaagctcagctcgacgacacaaaggtgcaggagggcagtcaggaagaggagttaagacaggccaatcgcgagctcgagaaggaactgcagaatgtcgtggggagaaaccagctcctggaaggcaagttgcaagcactgcaggcagactatcaggccctgcaacagcgagagtctgctattcaagggtccttagctagcctggaggccgagcaggcctcaattagacaccttggcgaccagatggaggcttctctcctagccgtgaggaaagccaaggaggctatgaaagcgcagatggccgagaaggaagctatcttacagtcaaaagaaggggaatgtcaacagctccgggaagaggtggaacaatgtcagcaactggcagaagcccggcaccgagagctccgggctttagaatctcagtgtcagcagcagacacagctgatagaggtcttgaccgcagagaaggggcagcaaggagtggggccgcccacagacaatgaagcccgtgagctggccgctcagctggctctctctcaggcgcaactggaagtgcatcagggagaagtgcaaagactacaggcgcaggtggtcgacttgcaggccaagatgcgcgcagctcttgacgaccaggataaggtccagagccaactctccatggcagaggcagtacttcgcgaacacaagacactggtacagcagctaaaggaacagaatgaggccctgaatcgggcccacgtgcaggagttgctgcagtgttctgagagagagggggctctgcaggaggaacgagccgacgaggctcagcagcgagaggaggagctgagggcattacaggaggagctctcccaggctaagtgttcctcagaagaagcccagcttgaacatgccgagcttcaggagcagctgcaccgagccaacaccgatactgctgagctgggtattcaagtgtgtgccctcaccgtggaaaaagagagagtcgaggaggctctggcttgtgcagttcaggagctgcaggacgcaaaggaagctgcttcaagagagagggaggggctggaaaggcaagttgcgggactgcagcaagaaaaggaatcccttcaggaaaagctcaaagccgctaaagcggccgctggatccttgcctgggctccaggcccagctcgcccaagcagagcaaagggcacagagtctgcaggaagctgcgcatcaagagctgaacaccctcaagtttcagctgtccgcagagattatggattaccaaagtcgcctgaaaaatgctggggaagagtgtaagtcattaaggggacagctggaagaacagggaaggcaacttcaggccgccgaagaggcagtggagaagctaaaagctacgcaggcggatatgggtgaaaaactcagttgtacctcgaatcacctcgccgaatgccaggcggccatgcttaggaaggacaaggagggcgcggctctgcgcgaggatctagaaaggactcagaaagagttagagaaagccacaactaaaatacaagagtactacaacaagctctgtcaagaggtgaccaatagagagaggaatgatcagaaaatgctggcggacttagatgacctgaaccgcaccaaaaagtacctggaggaacggcttattgagctgctccgagacaaagacgccctctggcagaagagcgatgctcttgagttccagcagaaacttagtgcagaggagcgctggttgggagacaccgaagccaaccattgcctggactgcaagcgggaattttcctggatggtgcgacgacatcattgccggatttgcggcaggatcttctgttactattgctgtaacaattacgtgctgtccaagcacggtggcaaaaaggaaagatgttgtcgggcttgtttccagaaactgtcagaaggacccgggtccccagatagcagtggctccggaacttcccagggagagccttctccagccctgtctcccgccagccccggaccacaggcaacaggcggccaaggtgctaatactgactacaggcctcccgatgacgccgtcttcgatatcattactgacgaggagttgtgtcagatccaggagtccggtagttccttacctgaaacccctaccgaaacggattctctggacccgaacgcagctgagcaagctagcgttggcgccagcaaaggactcggtaatctcctgtgcgaatcgtccgcctgccgcgacacaaccagtacatcgctcacaccagaagacactgaggacatgccggtcgggcaagactctgagatttgtttgcttaagagtggggagctgatgattaaagtgcctctcactgtcgacgagatcgcttccttcggagaaggcagtcgcgaactcttcgtccgtagttctacatattctcttataccaatcaccgtggctgaggcagggctcactatttcttgggtgttttcctctgatcctaagtccatatccttttctgtggtgtttcaggaggctgaggacaccccactggatcagtgtaaagtcctgatccccacaacgcggtgtaactctcataaggagaacatccagggccaattgaaagttcggaccccaggcatatacatgctgatcttcgataacaccttcagtagatttgttagcaagaaagtcttttatcacctaacagtggaccgccctgtgatttatgacggaagtgattttctttag

SEQ ID NO: 117631 - DNA, 2886 bp, Artificial Sequence
  Description of Artificial Sequence: Synthetic coding sequence
atgcacgggcatcgggctccaggaggagctgggccctccgagccagagcaccctgctaccaaccctccgggcgctgcaccccctgcgtgcgccgacagtgacccaggagcttctgagcctggcctactcgcccgccggggatccgggagcgcactgggtggccctctggacccacagttcgtgggccccagcgacacttctctcggtgccgcccctggtcatcgcgttctcccctgtggcccttcaccacagcatcacagggcattgcgtttttcctatcatctagagggttcccagcctcggcccggcctccatcaaggcaataggatacttgtgaaatcgctgagtctggatcctggtcagagtctggagcctcaccctgaaggccctcaacggctccgaagcgaccccgggccacctacagaaaccccgagccagaggccaagtcctctaaaacgggcacccggtccgaagccacaggtcccccctaagccatcataccttcaaatgcctagaatgcctcctcctctggagccaatcccccctccgccaagtaggcctctccccgctgaccctagggttgccaaagggctcgctcccagggcagaagcctctccctcatctgctgcggtctcgagcctaatcgaaaagtttgagcgcgaaccggtcattgtggcaagcgatcggcctgtgccaggtcctagccccggacctcccgaacctgtcatgctgcctcaacctacctcgcagccccctgtgccccagctgccggagggcgaagcctcaagatgtctgtttctcctggcccccggcccgcgtgacggcgagaaagttcccaacagggattcggggattgactcaattagttccccatctaactctgaggagacttgttttgtgtctgacgacggccctcctagccattccctatgtcccggtcctccagccctggctagtgtcccggtcgcactcgctgaccctcaccgacctggcagccaggaggtagattctgacttggaggaagaagacgacgaagaagaggaggaggaaaaagacagagaaattccagtgcctcttatggagaggcaggagtcggttgagctgacagtccagcagaaggtgtttcatatcgcaaacgaactgttacagactgagaaggcatatgtttccaggctgcaccttttggaccaggttttctgcgcccgtctcctggaagaggccagaaaccgttcctccttccctgctgatgttgtgcacggaatcttctcaaatatctgcagcatttactgcttccatcagcagttccttctgccagagctcgaaaagcgaatggaggagtgggacaggtaccctcgaatcggcgacattttgcagaagctggccccctttcttaagatgtatggggaatatgtaaagaactttgatagggctgttgaactcgtaaacacttggacagagcggagtacacagtttaaggtgatcattcatgaagtccagaaagaggaggcctgcgggaacctgacacttcagcaccatatgctggaaccggttcaaaggatcccccgatatgaactgctcctgaaagactatctgctgaagctgcctcatggttcgcccgattcaaaggacgcccagaaaagccttgagctgatcgcaacagcggccgagcatagcaatgctgctattcgcaaaatggagcggatgcacaagctgcttaaggtctatgagctgctgggtggcgaagaggacattgtttcaccaaccaaagaactaattaaggaaggtcatattctcaagctgtccgctaagaacggcacaacacaagatcgctacctgatcctgttcaatgaccgcctgctgtattgcgttccacgcctccgattgcttggacagaagttttcagtgcgtgcaagaattgatgttgacggcatggagctaaaggagagttccaatctgaatctgccccgaacattcctggtcagtggaaaacaaaggtcgctggagctgcaggcaagaactgaggaggaaaagaaggactgggttcaggcaattaatagtacgctcctgaagcatgagcaaaccttggagaccttcaaactgctgaactctacaaaccgcgaggacgaggacacgcctccaaatagccccaacgtcgatttgggaaaaagagccccaacaccaattcgggaaaaagaggttacaatgtgtatgaggtgccaggagccattcaacagcattacaaagcggcgccatcactgtaaggcctgtggacacgtcgtgtgtggcaagtgctcggaattcagagctcggttagtctatgacaacaatagaagtaatagggtatgcacagattgctacgtggcactgcacggcgtacccgggtccagccccgcctgctcccagcacacaccacaaagacggaggtcaatacttgagaaacaggcgagcgtcgccgctgagaactcggttatttgctcttttctacactacatggagaagggcggcaaggggtggcacaaagcctggtttgttgttcctgagaatgaacccctcgtcctgtacatttatggtgccccacaggacgtcaaggctcagaggtcattgccactcattggctttgaagtggggcccccagaggcaggtgagcggcccgataggagacacgtattcaaaataacgcaaagccacttgtcttggtacttttccccggaaaccgaggagctccagcgccggtggatggccgtgctgggccgggcaggtaggggcgacacgttctgtccaggccctaccctctctgaggatcgtgagatggaagaggcccccgtcgcagctctgggcgccactgccgaacctccagaatccccgcagaccagggataaaacttag

SEQ ID NO: 117632 - DNA, 1968 bp, Artificial Sequence
  Description of Artificial Sequence: Synthetic coding sequence
atgaagggcgccagcgaggaaaagctggcctctgtgagtaaccttgtgacagttttcgagaattcacggacaccagaggccgccccccggggacagagactcgaagacgtgcatcaccggcccgagtgcaggccacccgaatcacctggcccaagagagaagactaatgttggtgaagctgtgggctccgagcccaggactgtctcacggcgttacctcaattccctgaagaacaagctctcttcggaagcatggcgcaagtcgtgtcaacctgtaacactctcagggtcaggcacccaggaacccgagaagaagatcgttcaggagttgctggagaccgaacaggcctacgtagcccggcttcacttactggatcaggtctttttccaagaattgctgaagaccgcccgctctagcaaggcctttccagaagacgtagtacgcgtgattttttctaacatttcttcaatctatcagtttcattcacagtttttcctacccgagcttcagagacgtctggacgattggacggccaacccaaggatcggggacgttattcaaaaactggctccctttttgaaaatgtattccgagtacgtgaagaattttgagagggctgccgagctgcttgccacgtggaccgacaagtcaccccttttccaggaagtcttgacacgaatccagagttcagaggccagtgggagtctgactctccaacaccacatgctggaaccagtgcaaaggattccgcgttatgaacttcttctgaaggagtacattcagaagctgccagcacaagcccctgatcaagccgatgcacagaaagccctcgatatgattttttccgccgcccagcacagtaatgccgcaattaccgaaatggagcgcctacaggacttgtgggaggtttaccaacggctgggcctggaggatgatatcgtggatccatcaaacaccctgttgagagaaggccctgtgctgaagatcagttttagacgaaacgaccccatggaacgatacctgtttctgtttaacaatatgctgctttactgtgtcccgcgcgtgatccaggttggcgctcagtttcaagtgcgaacacgcatcgatgtcgccggcatgaaggtgcgggaattgatggacgctgagttcccacattcttttcttgtgtctggtaaacagcgcacacttgagctccaggcacggtcccaggaggagatgattagttggatgcaagcgttccaagcagccattgatcagatcgaaaagcgcaacgaaacgttcaaggctgcagcccagggtccggagggcgacattcaggaacaggagctgcagagcgaggagctggggcttcgggcgcctcagtgggtgcgcgataagatggtcacaatgtgcatgagatgccaggagccgttcaatgcccttactcggcggcgccaccactgccgcgcatgtggttacgtggtctgcgcgagatgcagcgactatcgggccgaactcaaatatgatgacaacagacccaaccgtgtgtgcttgcattgctatgcgtttctaacaggcaatgtgctgcctgaagccaaggaggacaaacgtcgcggcattctggagaaagggtcctctgccacaccagatcagagcctaatgtgttccttcctccagcttattggagacaagtgggggaaaagtggaccccggggctggtgcgttatccccagggatgatcctttggtcctgtacgtgtacgccgccccgcaggacatgagggctcacacgtccatccccttgctgggctatcaggtgactgtgggccctcaaggcgacccccgagtattccagcttcagcaatcaggacagctgtacaccttcaaggccgagactgaggaactaaaaggaagatgggtgaaggccatggaacgggcggcatcaggatggtcaccttcatggcctaacgacggcgacctgagtgactag

SEQ ID NO: 117633 - DNA, 852 bp, Artificial Sequence
  Description of Artificial Sequence: Synthetic coding sequence
atgaaagtaagagagctcatggatgcggagttcccacatagcttcttggtgtccggcaaacagcgaactcttgagctgcaagctcggtcccaggaggaaatgataagttggatgcaggctttccaagcggccatcgatcagatcgaaaagcggaatgagacgttcaaagcagccgcccaaggcccggaaggagatatacaagagcaggagttacagagcgaggaactagggttacgcgccccccagtgggttcgggacaaaatggtgactatgtgcatgcggtgtcaggagccattcaatgcccttactcggagacgccatcactgtagggcgtgcggttacgttgtgtgcgcccggtgttcggattaccgcgcagagctgaagtatgacgacaatcgacccaacagagtgtgcttacactgttatgctttcttaaccggcaatgtgctccctgaggcaaaggaggacaagcgccgcggtatccttgagaagggctcgtccgcaacacctgaccagagccttatgtgttctttcctccaattgatcggtgacaaatggggtaaatctgggccacgcggctggtgcgtgattccccgagatgatccactggtgttatatgtgtatgcggctccccaggatatgcgagcccatacatccatcccccttttggggtatcaggtaactgtgggcccgcagggagacccccgtgtctttcagctacagcagagtggccagctatatacatttaaagcagagacagaggaactcaaggggcggtgggtcaaggccatggagcgtgccgcctcaggttggtcgccttcctggccaaacgatggagaccttagcgattag

SEQ ID NO: 117634 - DNA, 2178 bp, Artificial Sequence
  Description of Artificial Sequence: Synthetic coding sequence
atggagtcaggccgcggctcgtcaacccccccaggacctatcgccgcactggggatgcctgatacaggacctggttctagcagcctggggaagttgcaggcactaccggtggggccacgagcacactgcggagaccctgtgtccctcgcagcggccggcgacgggtctcctgatattggacctactggcgagctgtctggcagcttgaagattccaaatcgggattctgggatcgattcaccctcttcttcagtggccggcgagaacttcccttgtgaggaaggtctggaggctggcccctcccccaccgttctcggcgctcatgccgagatggcactggattcacaggtgcccaaggtgaccccacaggaggaagccgattcagatgtgggcgaggagccggactccgaaaatacgccacaaaaagccgataaagatgcaggcctggcgcagcatagtggcccccagaagctccttcatattgcccaggagcttctgcatacggaagaaacttatgtgaagcgcttgcacctgcttgatcaggtcttctgtaccagactcaccgacgcgggcataccacccgaagtgattatgggaatcttttctaacattagctctatccaccggtttcatgggcagtttctcctccccgagctcaagactcgcattaccgaagagtgggacacaaacccaaggttaggagatattctccagaagttagctcccttcctgaagatgtacggagaatatgtcaaaaattttgacagggctgtgggactggtgagcacctggacacagagatctccactgttcaaggacgttgtgcacagtatacagaaacaggaggtgtgtggcaacttgactctgcagcatcacatgttggaacccgtgcagcgggtaccacgttatgagttgctgctgaaggattacttgaagaggctccctcaggacgcgccagatcggaaggatgcagagcgatccttggaactgattagtaccgctgccaatcactcaaatgccgctatcagaaaggtagagaaaatgcataaactgctcgaagtttacgagcagctcggaggagaagaggacatcgtgaaccccgctaacgagctgatcaaggaaggacagatacaaaaactgtcagccaagaacggcactcctcaagatagacacctgttcctgtttaactcaatgatcctatactgcgttcccaagctcagattaatgggccaaaaatttagtgtcagagagaagatggacattagcgggctgcaagttcaggacatcgtaaaacctaatactgcccacacctttatcataacaggtcgaaagagatcactagaacttcaaaccaggaccgaggaagagaaaaaggagtggatccagatcattcaggctactatcgaaaaacataaacagaatagcgagaccttcaaagctttcggaggcgctttttcccaggacgaagatccgtcactttccccagacatgccaataacttcaacaagcccggtggagccagtcgtcaccacagaagggagctccggtgccgccggacttgaaccaaggaagctgtcaagcaagacccgcagggataaagagaaacagtcttgcaagagttgcggggagaccttcaattctattacgaaacgccgacaccattgtaaattgtgcggagctgtgatttgtggaaagtgctctgaattcaaagctgagaatagtaggcagagtagggtctgcagagactgttttttaacccagcctgtggccccagaatccaccgagaagaccccgacagcggatcctcagccatcccttttgtgtggcccgctccgtttgagtgagagcggagagacatggtctgaggtatgggccgcaattcctatgtcagacccccaggtgttgcacctgcagggaggtagccaggacggccggctgccacggaccatcccattgccttcctgcaagcttagcgtgcctgatcctgaggaacgactggacagtgggcacgtatggaagttacagtgggctaagcagagctggtacctatcggcaagtagtgctgaacttcagcagcaatggctggaaaccctgtcgaccgccgctcacggcgataccgcacaggattcacccggagcattacagctgcaagtcccgatgggcgctgctgccccttag

SEQ ID NO: 117635 - DNA, 2178 bp, Artificial Sequence
  Description of Artificial Sequence: Synthetic coding sequence
atggaatcaggccgggggtcttcaacgcctcccggcccaattgccgcacttgggatgcctgacacaggaccaggatcctcatccttaggaaagcttcaggccttgccagtaggtccccgggcccattgtggcgaccccgtgtccctcgccgcagccggagacggcagtccagacattggaccaacgggggagctttctggatcactcaagatacccaatagggattcaggaatcgattccccaagttcttcggtggcaggcgaaaactttccttgcgaagaaggcctggaggcgggaccaagtccaacagttctcggtgcacatgccgagatggctctcgattcccaggtccctaaagtgactccccaggaggaggccgatagtgatgtgggtgaagaaccagactcagagaatactccccagaaggctgataaagatgccggtcttgcccaacactctggaccccagaagctgcttcacatagcccaggagttgttgcacacagaggagacctacgttaagcggctccacttactcgaccaggtcttttgtacaaggctgacggacgctgggataccgccagaagtgatcatgggaatcttctccaacatctcctctattcacaggttccatggccaatttttgttgcctgagttaaaaacgagaattactgaggaatgggacaccaacccgagactcggagatattctgcagaagctggccccgtttctgaaaatgtacggtgagtacgttaagaactttgaccgcgccgtgggtctggtgtccacctggacccagaggtcacctcttttcaaagatgtcgttcactcaattcagaaacaagaggtgtgcggcaacctgacccttcagcaccatatgctcgagccggtacagagagtgccgcggtatgaactgctgctaaaggattacctcaagagattgccacaggacgcaccggaccgtaaagatgccgaaaggagcctggaactgatttctacagctgctaaccactcaaacgctgcaattagaaaggtggagaagatgcataaactgctcgaagtctacgagcaactagggggggaagaagacattgtgaaccctgcgaatgagcttattaaggagggtcaaattcaaaagctgtcggcgaagaacggaacccctcaagaccggcaccttttcctgttcaatagcatgattctatactgcgtacccaagctgcggctgatgggccagaagttcagtgtccgagaaaaaatggatataagtggtctgcaagtgcaggacattgtgaagcctaacacggcccacacatttatcattaccggcaggaaacgctctctcgagctccagactcgtacagaggaggaaaagaaggaatggatccagataattcaggctaccattgagaagcacaaacagaactctgagactttcaaggcctttggcggcgccttctcacaagatgaggatcccagcctaagtccagatatgcccataacctccactagtcccgtggagcctgttgtcactactgaaggctcttcaggtgctgccggcctcgaaccccgcaagctatcaagcaagacccgcagagataaggagaagcagtcttgtaagtcttgtggtgaaacatttaactccataactaaacgcagacatcactgcaagctttgcggcgctgtgatttgcgggaaatgctcagagttcaaagccgagaactctagacagtctcgcgtgtgtagagactgctttcttacacaacctgtggctcctgagtcaaccgaaaaaacacccactgcagatcctcagccaagtttgctgtgcggtcccctccgacttagtgagtcgggtgaaacttggtccgaggtgtgggccgcaatccccatgagtgatccccaggttctacacttgcaggggggaagtcaggacggaagactgccccggaccattccattgccttcttgtaagctgagcgtgcctgaccccgaagaacgtctggactccggacatgtatggaaactgcagtgggccaaacagagttggtacctgtccgcttcaagtgcggaactgcagcagcaatggctagagacactttcaaccgcggctcatggagatactgctcaggattctcctggagccctacaacttcaagtgccgatgggtgcagccgccccgtag

SEQ ID NO: 117636 - DNA, 2175 bp, Artificial Sequence
  Description of Artificial Sequence: Synthetic coding sequence
atggaatcaggccgtggaagtagcactcctcccggacccattgccgcattagggatgcctgataccggacctgggtccagctcgctgggaaagctgcaggctttgcctgtaggacctcgagcgcactgcggagacccggtgtctctggctgccgccggggatggtagcccagatatcggtcccactggtgagctttctgggtctctcaagattcccaatcgggactccggtattgactcccctagctcatcagtagccggtgagaactttccctgtgaggagggcctagaggccggtccttcccctaccgtgctgggggcacatgctgagatggcactagacagccaagtccccaaagtcactccacaggaagaggctgactccgacgtcggcgaggaacctgactccgaaaacacgcctcagaaagccgataaagacgccggcctggctcagcacagcggcccacagaaactgctacatatagcacaggaactgctgcacactgaggagacttatgttaagcgcctccatcttctggatcaggttttctgtaccaggctgactgatgccggcattcctccggaagtgattatgggaatttttagcaacatctctagcatccatcggttccatgggcagtttttgctgccggagctgaagacacgcatcaccgaagagtgggatacaaatcccaggctgggggacatcctccagaagcttgccccatttttgaaaatgtacggtgagtacgtaaagaacttcgatcgggcggtggggctggtgagtacttggacacaaagatccccacttttcaaggatgtcgttcattctattcagaagcaggaggtttgtggaaatttaaccctccagcaccacatgttggagcctgtacagagagttccacggtatgagctgctgctcaaggactatctaaagaggctccctcaggacgcaccagaccgcaaagacgccgagaggtctctcgagttaataagcactgccgcaaatcactcaaatgccgccatccggaaagtcgagaaaatgcataagctgttagaggtctacgaacaactaggcggtgaggaagacatcgtgaatcctgcgaatgagcttataaaggaaggccagattcagaagctgtctgcaaagaatggaaccccacaggatagacatctgtttctttttaactcaatgattctttactgcgtgccaaagctgcggttgatgggacaaaagttcagcgtgcgggaaaaaatggatatctcgggtctccaggtccaggatattgttaaaccgaacaccgcgcatacatttatcattacagggcggaagcggtccctggagttgcaaacaagaaccgaagaagagaaaaaggaatggatacagatcatccaggcgacaatagagaaacacaagcagaacagcgagacatttaaagcatttggtggcgccttctcacaggacgaagatccaagtctgagtcccgacatgccgatcacatctacctctcccgtggagccggtggtgactacagaggggtctagtggagcggctggactggagcctaggaaattgtctagcaaaacaaggcgcgataaggagaagcagtcctgtaaaagttgtggagagacatttaattcaataactaagaggcggcaccactgcaaactgtgcggggctgttatttgtggaaaatgttcagaatttaaggcagaaaactcaaggcaaagccgtgtttgccgagactgttttctgacccaaccggttgcccccgaatctactgagacacctacagctgatccgcagcctagtctgctgtgtggtccgcttcgcctgtccgaaagcggggaaacctggagcgaagtctgggccgccattcccatgtctgatccccaagtgttacatctgcaaggaggctctcaagacggtcggctacctaggacgataccattaccttcttgcaaattgtctgtcccagacccggaggagcggctggacagcggccacgtgtggaaacttcagtgggccaaacagtcttggtacttgagcgcatcgagcgccgaacttcaacagcagtggctggaaacactgtccacagcagctcacggagacacagcacaggatagccccggcgcacttcagttgcaggtccctatgggagcagcggccccttag

SEQ ID NO: 117637 - DNA, 987 bp, Artificial Sequence
  Description of Artificial Sequence: Synthetic coding sequence
atgattctatattgtgtgcccaagctgcgcctgatgggtcagaaattttccgtgcgggagaaaatggacattagcggactgcaggtccaggacatcgtcaagcccaataccgcccataccttcattattactgggagaaagcggtctttagagttgcagacccgcaccgaggaggaaaaaaaggaatggattcaaattattcaggctacaattgagaagcataaacaaaattctgaaacattcaaagcctttgggggagcattctcccaggatgaggatccttccttgtccccagacatgccaatcacctcaacatctcctgtggaacccgttgtgacaactgagggatcatccggtgccgccgggctggaacctaggaaattgtccagcaaaaccaggcgagataaggaaaaacagagctgcaagtcttgcggggagacttttaacagtattaccaaacggagacaccactgcaagctatgcggggccgtgatctgtggaaaatgttcagagttcaaggcagagaactcaaggcagagccgcgtctgtcgagattgctttctgacccagcctgtcgcacccgagagcactgagaagactcctaccgccgaccctcaaccctctctgctttgcggaccattgagattatccgagtctggggaaacctggtcagaagtgtgggccgctatacccatgagcgacccacaggtgcttcaccttcagggaggttctcaggatggccggcttccacgaacaattcccttgccaagttgtaagctgagcgtccccgaccccgaggagagactcgattctgggcatgtctggaaacttcaatgggctaagcagagctggtatctgtctgcttcaagcgccgaactgcagcagcagtggctggaaacactttcgaccgccgctcacggagatacagcccaggactctcccggagctctacaactgcaggtgcctatgggcgccgccgctccctag

SEQ ID NO: 117638 - DNA, 1416 bp, Artificial Sequence
  Description of Artificial Sequence: Synthetic coding sequence
atggtcaataagatcttttctaatattagtagcattaacgcgttccacagcaagttcctgctgcctgaactggagaaacggatgcaagagtgggaaactacaccgcgcattggcgatatcttacaaaagctagctccattcctaaagatgtacggtgaatacgtcaaggggttcgataatgcaatggagctggtcaagaatatgacagagcgaatcccacaattcaagagcgtagtggaggagattcagaaacagaaaatttgtggctctctcacgctccagcaccatatgctggaaccagtgcaaaggatcccgcgttatgagatgttactgaaggactaccttcgaaaattacctccagactccctggattggaacgatgccaagaaaagcttagagataatatcaacagcagcgtctcactcaaactctgcaatcaggaaaatggagaacttaaagaaattgcttgaaatctatgagatgctgggtgaggaagaggacattgttaatccatcaaatgaactgatcaaggagggacagattctgaagctggccgctaggaatactagtgcccaggagagatacttatttctgttcaacaacatgctcctctattgcgtgcctaaattttcgttggttgggtctaagttcactgtgaggacaagagtgggaatagacgggatgaaaatcgttgagacgcaaaatgaagagtaccctcatactttccaggtgagtggcaaggagagaacacttgagcttcaggcctcatccgctcaggataaggaagagtggatcaaggcgctgcaggaaacgattgacgcattccaccagaggcacgagacatttagaaacgccatcgccaaggacaatgacatccatagcgaggtcagcactgcggagctcggcaagcgtgcaccacggtggattcgggataatgaggtaacaatgtgtatgaagtgtaaagaaccgtttaatgccctcacccgaaggaggcaccactgcagagcttgtggctacgtggtgtgttggaagtgttccgattataaagcacaattggagtatgacggtggaaagctctccaaagtgtgcaaagattgctatcagatcatttccgggttcactgattccgaggaaaagaaaaggaaggggatcctggagatcgaaagcgccgaagtttcaggaaactctgtggtctgtagtttcttgcaatacatggaaaagtctaagccctggcagaaggcctggtgcgtgatcccgaagcaggaccccctagtgctgtatatgtacggcgctcctcaggttagtaaacctcacctgagtgagggcactgatgccctcggtggcaagggtaagagggtcgactcagggctgaagatttgcaggactcgagtgcaggccgtgtcactgttccactag

SEQ ID NO: 117639 - DNA, 843 bp, Artificial Sequence
  Description of Artificial Sequence: Synthetic coding sequence
atggtcaataagatttttagtaatatttcgtcaattaatgcattccattccaagttccttttaccggagctcgaaaaaaggatgcaggaatgggagactacccccaggattggtgatattttgcagaagctagcaccttttctcaaaatgtatggcgaatatgtgaagggcttcgataatgctatggaactggtgaaaaacatgactgaacgcatccctcagttcaagagcgtagttgaggaaatacagaaacagaagatctgtggcagcctcaccctgcagcatcatatgctcgaaccagtccagagaatccctaggtacgaaatgctgttgaaggactatctgcgaaagctgccaccggattctctggactggaatgatgctaaaaagagtttggagatcatcagtaccgctgctagccacagcaatagtgctatccgaaaaatggagaacctgaagaagctgttagagatctatgagatgcttggggaggaagaggacatcgtgaacccaagcaatgaactgataaaagaaggccagattttgaaactagctgcacggaacacttccgcccaggagcgttatctctttctgttcaataatatgttgttgtattgcgttcccaagtttagtctggtcggatctaaatttaccgtccggaccagagtcggaattgacggaatgaagattgtggagactcagaatgaggagtatccacacaccttccaggtttcgggaaaggaacgcacgctggagctgcaggccagttcagcacaagacaaggaggaatggatcaagcgcagggggtttgccatgctgccacgtttaatatcaaacagttag

SEQ ID NO: 117640 - DNA, 567 bp, Artificial Sequence
  Description of Artificial Sequence: Synthetic coding sequence
atgttttcttgctttctctgcatcctgagcttttctagtctttcaaactactcagacttgaaaaaggaaagtgcagtgaacctaaacgcaccaagaacacctggaaggcacggtctgactacaacaccccaacaaaagctcttgagccaacacctcccccagagacaggggaacgataccgataaaacacagggggctcagacctgtgttgccaacggtgttatggccgcacagaatcagatggaatgtgaggaagaaaaagctgcaaccctgtcctctgacacctccatccaggcttctgagccactcctggacacacatatcgtgaacggcgagcgcgacgagactgccactgcccccgcttctcccactaccgatagttgcgacggcaacgcttccgacagtagttacagaacccctggcatcgggcctgttttgcccctggaagagaggggggcagaaaccgagacaaaggtccaagagagggagaacggagagtcacctctggagctggaacagctggaccagcaccacgaaatgaaggtcgagcacgaaacctcatcctag

SEQ ID NO: 117641 - DNA, 2301 bp, Artificial Sequence
  Description of Artificial Sequence: Synthetic coding sequence
atggaggagatcaaaccagcctccgcatcctgcgtatctaaggagaaaccaagcaaggtctccgacctgattagtcggtttgaaggcgggagctcactcagcaattattccgatctgaagaaagagagtgccgttaacctgaacgcacctcgaacccctggcaggcacggtctgactactacaccacagcagaagctgctgtcacagcacctgcctcagagacaggggaacgacaccgacaaaacgcagggagcccagacatgcgttgccaatggtgtcatggcagcccagaaccagatggagtgtgaagaggagaaagccgccactttgtcttccgatacttccatccaggccagtgaaccactgcttgacacgcacatcgtcaatggcgagcgcgatgagaccgccaccgccccggcctcaccaactacggactcgtgcgatgggaatgcatccgacagttcctacaggacccctggaataggacctgtgctgccgctggaagagcggggcgccgaaacagagacaaaggtacaggaaagggagaacggcgagagccccctggagctggaacagcttgatcagcaccacgagatgaaagaaacaaacgagcaaaagctgcacaagatcgctaatgaattgctccttaccgagcgggcatacgtcaacagacttgatttactggaccaggttttttattgcaagctcctcgaagaagccaaccgtggcagtttcccagccgagatggtgaataaaatcttctcaaacattagctctataaacgcttttcatagtaagttcttactgcctgagctggagaagcggatgcaagaatgggagacaacccccagaataggagatatcttacagaagcttgcccctttcctgaagatgtacggggaatacgtgaagggctttgacaacgccatggagttggtcaagaatatgactgagcggatcccacagtttaaaagtgttgtagaggagattcaaaaacaaaagatatgcggctccctcacgttgcagcaccacatgctggaaccagtccaacgcatcccccgatacgaaatgcttctcaaggattatctacgtaaattgcccccagattctcttgattggaacgacgctaagaagtccctagagatcatctcaactgccgcatcccactctaacagcgccatacgtaagatggagaacctcaaaaagctacttgagatttatgagatgttaggcgaggaagaggacattgtaaatccctccaacgaattgatcaaagagggacagatccttaaactcgccgcaagaaatacatctgcccaggagcgttatttgttcctgtttaacaatatgttgttgtattgtgtccctaagttctctctggtgggttctaagtttaccgtaagaacacgagtgggaatcgacggaatgaaaattgtcgagacccagaatgaggagtatccccataccttccaagtatcgggcaaggaacgtactctggagcttcaggccagcagcgctcaagacaaagaagagtggattaaggccctgcaggagactattgatgccttccatcaacggcatgaaacatttcggaacgccattgctaaggacaacgatatccattctgaggtctctactgctgagctgggtaaaagggcaccacgctggatccgcgacaacgaagtgactatgtgcatgaagtgtaaagagccattcaatgctctaacccgccggagacaccattgcagggcctgtggctatgttgtgtgctggaaatgtagcgactacaaggcacaacttgagtacgatggaggaaaactgtcaaaggtctgtaaagattgctaccagatcatcagtggcttcacagacagcgaggagaagaagaggaagggcattctggagatagaatcggcagaggtgtcagggaattctgtagtgtgttcatttttgcaatacatggaaaaatcaaaaccttggcaaaaggcatggtgcgtgatacccaagcaggaccctctggtgctctacatgtatggagcacctcaggatgtccgggcccaggcaacaatacctctcctcggctacgtggtggacgagatgcctcgcagtgccgatttacctcacagctttaaacttacccagagcaaatcagttcatagtttcgctgccgatagcgaggagctgaagcaaaagtggctgaaagtgatccttctcgcggttaccggggaaactccgggcgggcctaatgagcatcccgcgacactcgacgatcatcccgaacccaaaaagaagtccgaatgctag

SEQ ID NO: 117642 - DNA, 624 bp, Artificial Sequence
  Description of Artificial Sequence: Synthetic coding sequence
atggaggaaattaaacctgcatccgcctcctgcgtgagcaaagagaaaccttccaaagtctccgacttgatctcaaggtttgagggggggtcctcccttagcaactactccgatctgaagaaagagtcagccgtgaaccttaatgccccacgcacaccgggacgtcacggcctgacgactacacctcaacagaagctgctttctcagcatttgccacagcgtcaagggaacgacacagataagacccagggcgcccagacatgcgtcgctaatggtgtcatggccgcgcagaatcagatggagtgcgaagaagagaaggctgcgactctatcctccgacacttctatccaagcaagtgagccactcctggacacccacatagttaatggcgagcgggatgagactgctactgctccggcaagtccaactaccgatagctgcgatggcaacgccagcgacagttcctacaggacaccaggcatcggacctgtgttacccctggaggagcgcggggccgagacagaaaccaaggtgcaggagagggagaacggcgagtcacccctggaactggagcagctcgatcagcatcacgagatgaaagtcgaacatgaaactagttcttag

SEQ ID NO: 117643 - DNA, 2637 bp, Artificial Sequence
  Description of Artificial Sequence: Synthetic coding sequence
atgaattttaaacgggtgaaacccaacatttttctcctgaatcagtcacggcttatcatctctatctgcgaaataatgtccaccgatcagggatctagtacttgtcccaaaattgccttagtgcccccatgcagcacttcgagcactactaccttagtgggagagaatgtatccgaagaggaagcccaaggcatcaatggcaatcgacctgctaagcatagtgccgccagtcccaaaccccaggtcccgcctaaaccactccatctccaaaacagtccgtcgtctaatatccatcaaacccctcgacacaaggcattgccttcagcgaagccaaggatggaagagatcaaacccgcctccgccagctgcgtttccaaggagaaaccttctaaagtgagcgatctgattagcagatttgaaggcggcagctctttaagcaactacagtgatctcaagaaagaatctgccgtgaatctcaatgcaccacgaactccgggacggcacggtcttaccacgactccccagcagaaactcctaagtcaacatctgcctcagcgacagggaaacgacactgataaaacacagggagcccagacctgtgttgcaaacggagtaatggcagctcagaaccagatggagtgtgaagaggagaaagcagctactcttagctcagacacctccatacaagcctcagagcccctcctcgacacccacattgtgaacggggaacgcgacgagaccgccacggctcctgcctctccaaccaccgattcctgtgatgggaacgccagtgactctagctacagaaccccaggcattgggccagttctacccttggaggaacgcggtgctgagacagaaaccaaggtgcaggaaagagaaaacggagaatctcccctcgagctcgagcagctggaccaacaccacgagatgaaggaaacaaacgagcaaaaactgcataagattgcgaacgaattgctgcttacggaacgagcgtacgttaacagactggatctgcttgaccaagtcttttactgcaagctgttggaagaggccaaccgggggtcgttcccagccgagatggttaataagattttctctaacattagctctataaacgcttttcactcaaagttcctcctgccagagctcgagaaaaggatgcaagaatgggaaaccacccctaggattggggacattctgcagaaactggccccatttctgaagatgtacggggagtatgtgaaaggattcgataatgcaatggagttggtcaagaatatgacagagcgaattccccagttcaaatccgttgttgaagagattcaaaaacagaaaatctgcggttcactgacattgcagcaccacatgctggagcctgtgcagcggattcctcggtacgagatgctcctcaaagactacctgcgcaagctgcctcccgactccctcgactggaacgacgctaagaagtccctggaaattatatccaccgctgctagccacagtaatagcgcaattcggaaaatggagaacttgaagaagctgctcgagatttacgaaatgctcggagaggaggaggatatcgtaaacccatctaatgaactgattaaagaagggcagatcttgaaactggcggctagaaatactagtgcccaggaacgctatctgttcttgtttaacaatatgctgttatattgtgtgccgaaattctctctggtgggttcaaagttcacagttaggacacgcgtgggcatcgatggtatgaagatcgtcgaaacgcaaaacgaagagtatccccatacctttcaggtgagtggcaaggagaggactctggagctccaggcaagcagcgcccaggacaaggaggagtggataaaggcacttcaagaaaccattgatgcgttccatcagaggcacgagacattcaggaatgccattgccaaggataacgatattcatagtgaggtgtcaactgccgagctcggaaaaagagctcctcgttggataagagacaacgaagtgacaatgtgcatgaaatgcaaggagcctttcaacgctcttaccaggcgaagacatcattgccgcgcttgcggatacgtggtttgttggaagtgcagcgactataaagctcagcttgagtacgatgggggaaaactgtctaaagtttgcaaggactgttaccagataatctcaggcttcacagattcggaggagaagaagagaaaggggattctcgagatcgagagcgcggaagtctccggtaacagtgtggtatgcagttttctgcagtatatggagaagtcaaagccttggcagaaggcatggtgtgtgatcccaaaacaagaccccctcgtgctgtatatgtacggcgccccccaggacgtgcgcgctcaggccaccatcccacttcttggttatgtggtcgacgaaatgcctaggagtgccgacctcccccacagcttcaagctgacccaaagtaagagcgtgcactctttcgccgccgacagcgaggagctcaagcagaagtggcttaaggtgatactcctggcagtaaccggtgagacccctgggggtcctaacgagcatcccgctacactggatgatcaccccgaaccgaaaaagaaaagtgagtgttag

SEQ ID NO: 117644 - DNA, 2556 bp, Artificial Sequence
  Description of Artificial Sequence: Synthetic coding sequence
atgggagggtgtagcagcacgtgtcctaaaatagcccttgtccccccctgttccacttcaagtactactactctggttggggaaaacgtcagcgaagaggaggcgcaaggtatcaacgggaataggcctgctaagcacagcgcagcctcacccaagcctcaggtgccccccaaacctctccatctgcagaacagtcctagcagtaacatccatcaaacacctaggcacaaagctctgccgtccgctaagcccagaatggaagaaattaaaccggcgagcgcttcatgcgtgtcgaaggagaagccttctaaagtgtccgacctgattagcagatttgaagggggatcttctctgtcaaactacagtgacttgaaaaaagaatccgccgtgaatctaaacgccccacggacccccggccgccacggcctgaccacaaccccacagcagaagcttctgtctcagcacctaccacagagacagggaaacgatacggacaagacgcagggtgcacagacttgtgtggctaatggtgtcatggcagcgcagaaccagatggagtgtgaggaggagaaagcagcaaccctgtcaagcgatacatctatccaggcaagcgaacccctgctggatactcacatagtgaatggagaaagggatgaaaccgccactgcaccagcctcgccgaccacggacagctgcgatgggaatgcctctgacagcagctacaggacccccggtattgggcccgtgcttccattggaagaaaggggtgccgagacagagactaaggtgcaggaacgggagaatggcgaatcaccattggaactggaacaactggatcagcaccatgagatgaaggaaacaaatgaacagaagctgcataagatcgccaacgaattacttctcacggaacgggcgtacgttaaccgtcttgacttattggaccaggtcttttactgcaagttactcgaggaagcaaaccgggggtccttcccggccgaaatggttaacaagatattttcaaatatttccagcattaacgccttccactctaaatttctgctgccggagttggagaagagaatgcaggaatgggaaacaacacctcggattggcgacattttacagaagctggcaccctttcttaagatgtatggggagtatgtcaagggctttgataatgccatggagcttgtgaagaatatgacggagaggataccacaattcaagagcgtagtggaagaaattcagaagcagaagatctgcgggtcactgactctccagcatcacatgctggaacccgtgcagagaataccgcgatatgagatgctgctcaaagactacctgagaaaactgccccccgactcccttgattggaatgacgcaaaaaaatcactggaaatcattagcaccgcggcctcacactctaatagcgccattagaaagatggaaaatttgaaaaagctcttggagatctacgaaatgttgggtgaagaagaagacattgtgaatccctccaatgaattgattaaagagggacagatcctgaaactcgctgcgaggaatacaagtgctcaggaacgttatctgtttctgttcaacaatatgcttttgtactgcgtgccaaagttttccctggtggggtctaagttcactgtccgcacgcgtgtcggaatcgacggaatgaaaattgtggaaacccaaaatgaagaatacccgcacactttccaggtgtcagggaaagaacggactctcgaattacaggcctcatcagcccaggataaagaggagtggattaaggccctccaggaaactatcgatgcattccaccagagacatgagaccttccgaaatgcaattgccaaggacaatgatatccattccgaggtgagtactgcggaactcggcaaaagagcaccaaggtggatccgagacaacgaagttacaatgtgcatgaagtgtaaggaaccctttaacgccctgacccgtagaaggcaccactgcagggcatgtggatacgtcgtgtgttggaagtgctccgactacaaagcacaattagagtacgatgggggaaagctctccaaggtgtgcaaggattgctaccagataatatccgggttcaccgatagtgaagagaaaaagcgcaagggtatcctcgaaattgagagcgcagaggtgtctggaaactccgtggtgtgctcattcctgcagtatatggagaagtcaaagccttggcagaaagcatggtgtgtcatccctaagcaggacccgcttgtcctgtatatgtacggagctccccaggatgtgcgggcccaggcaactatccctctcttaggctacgtggtcgatgagatgcccaggagtgctgatcttccccactctttcaaactgacccagtcaaagagtgtgcactcattcgccgccgattccgaagaattgaagcaaaagtggttgaaagtgatcctgctggccgttacgggggagacgcctggaggccctaacgaacacccagcaaccctggatgaccatcctgaacccaaaaagaaatccgagtgttag

SEQ ID NO: 117645 - DNA, 2712 bp, Artificial Sequence
  Description of Artificial Sequence: Synthetic coding sequence
atgtcggacgagggcggcagcaattttcggagagtggcaattcggcgtaaaagcaacccctcctacctcccacccggcgttccacgaccgtggagccgccccgcctcacacctaggccgagtgggtaccgccgctttcaagggacaggttccttcgggggccactggctccagtacatgtcctaagatagctttggtgccaccttgttccacgtctagcaccactaccctggtgggggagaatgtaagcgaggaggaggctcagggaatcaacgggaatagaccagccaagcactcagcagcctctcctaagcctcaagtcccacccaaaccgttgcacttgcagaattcacccagcagcaacatccaccagacacccaggcacaaggctctgccctctgccaaaccaagaatggaagaaattaagcccgcctccgctagttgcgtgtccaaggagaagccatccaaagtcagcgacctgatctctaggtttgaaggagggtcatctctgtcgaattattctgacctcaaaaaagaaagcgctgttaacctgaatgctcctcgcactccaggtcggcacgggttaacaaccacccctcagcagaagcttctctcacagcatttgccgcaacgtcaggggaacgacacagataaaacccagggcgctcagacctgtgtggctaacggagtgatggccgcgcaaaatcagatggaatgcgaagaggagaaggcagctacactttccagcgatacctccattcaggcatctgagcctctgttggacacccatatcgtgaatggtgagcgcgacgagacagccaccgcccccgccagcccgactacggactcatgtgatggcaacgcaagtgattcaagctatcgcaccccaggcattggacctgtgctcccccttgaggagcgtggtgcagaaaccgaaaccaaagttcaggaaagggagaacggggaaagtccactagaactggagcaactggaccaacatcacgaaatgaaggaaaccaacgaacagaagctccataaaattgccaacgaattgctcctgaccgagcgtgcctacgtaaaccgtttagatctgctcgaccaggtcttttactgtaaactcttggaagaagccaataggggatcctttcccgccgagatggttaacaaaattttttccaatatctcctccattaatgcatttcatagtaaattcttattgcccgagctggagaagcggatgcaggagtgggaaaccacgccaaggatcggggacattctgcagaagctcgccccgtttcttaaaatgtacggcgaatacgtaaaaggctttgataacgccatggagctggtcaaaaacatgaccgaacggatcccccagtttaagtcagtggtcgaggagatccagaagcagaagatatgtgggtctctgactcttcagcaccacatgttggagccagtgcagcgcatccccaggtacgagatgctgcttaaggactaccttcggaaactccctcctgatagccttgactggaatgatgctaaaaagagtttagagattatcagcaccgccgcgagtcatagtaatagcgccattcgcaagatggaaaacctcaagaaacttctagagatatacgaaatgcttggggaggaggaagacatcgtgaatccatctaacgaattgattaaggaaggacagatactgaaactggcagcccgtaatacatctgcccaagaaaggtatttgtttctgtttaataacatgttactttattgcgtgccgaagttctccttggttgggtctaagttcactgtacgtacacgggtagggattgacggaatgaagatcgttgagacgcagaacgaagagtacccacacacctttcaagttagtggcaaggagagaacactggaattgcaggccagttcagcccaggataaagaggaatggattaaagccctgcaggagacgatagacgcatttcaccaacgtcacgagacctttagaaacgcgattgcgaaggacaacgacatacattccgaagtatcaaccgcagaattggggaaaagagctccaaggtggatccgagacaatgaggtcactatgtgtatgaagtgcaaagagccattcaatgccttaacccgccgcaggcatcattgtcgcgcttgtgggtatgtggtgtgttggaaatgctctgactacaaagcccagctcgagtatgatggtgggaaactgtctaaggtgtgtaaggattgttaccagattatcagcggtttcacggatagtgaagagaaaaaacgaaaaggcatcctggagatcgagagtgctgaggttagcggaaacagtgtggtctgcagttttctgcagtacatggagaaaagcaagccatggcaaaaggcctggtgtgtaatccccaaacaggatcctctcgtgttgtatatgtacggcgcacctcaagacgtccgggcccaagcaaccattccactgctcggttacgtggtcgacgagatgcctcgatcagccgatctgccgcactcattcaagctcacacagtctaaaagtgttcactcctttgccgctgactccgaggaactcaagcagaagtggctcaaagtgattcttttggccgtgactggggagacaccaggcggcccaaatgaacacccggcaacgctcgacgatcatccagaacctaaaaagaagtccgagtgttag

SEQ ID NO: 117646 - DNA, 420 bp, Artificial Sequence
  Description of Artificial Sequence: Synthetic coding sequence
atgagctggcgcggcaggtcaacatattattggcctaggcctcggaggtatgtccagcccccagaaatgataggccccatgcgccctgaacagttttcagacgaggtggagccggccactccggaagagggggagcccgcaacccagcgccaggatcctgctgccgcacaggagggggaagatgagggggcaagcgccggacagggccccaaacctgaggcggatagtcaagagcaagggcatccacagacaggatgcgaatgtgaggatggccctgacggtcaggagatggacccaccaaacccggaagaggtaaagaccccggaagaagagatgcgcagtcattacgtggctcagactggtattctttggctactcatgaacaactgttttttaaatctctcccctcgcaaaccttag

SEQ ID NO: 117647 - DNA, 351 bp, Artificial Sequence
  Description of Artificial Sequence: Synthetic coding sequence
atgtcttggagagggaggtctacctacaggagtagaccacgcctctatgtggagccaccggaaatgataggccctatgctgcctgagcagtttagcgatgaggtcgaacccgccacaccagaagaaggcgaacccgccactcagagacaggatcccgcggcagcccaagagggtgaggatgaaggagccagcgctggtcagggacctaaacctgaagcggacagccaggaacaagttcacccgaagaccggctgcgaatgtggggacggtcctgacggccaggagatgggtttgcccaatcccgaagaagtgaagcgtcctgaagaaggtgagaagcagtctcagtgctag

SEQ ID NO: 117648 - DNA, 354 bp, Artificial Sequence
  Description of Artificial Sequence: Synthetic coding sequence
atgagctggcggggaagaagcacatactattggccgaggcctcggcgttacgtacagccaccagaaatgattggaccgatgcgccccgaacagttttcggacgaagttgagcccgctactccagaggagggggagccagccacacagtgccaggacccagccgccgctcaggagggcgaagacgaaggggcaagcgccggccaagggccgaaacccgaagcgcattcacaggagcagggccacccccagaccggatgtgaatgtgaggatgggccagacggccaggaaatggatccacccaatccagaggaggttaagactcccgaagagggggagaagcagagccaatgctag

SEQ ID NO: 117649 - DNA, 354 bp, Artificial Sequence
  Description of Artificial Sequence: Synthetic coding sequence
atgtcctggagaggtcggagtacttactactggcccaggccacgacgctacgtacagcctcccgagatgatagggcccatgagacccgaacaattttctgacgaggtcgaaccagccactccagaagagggggaaccagcgactcagtgtcaagatccggcagccgcccaagaaggcgaagatgagggcgcaagcgccggccagggtcctaaacctgaagcacactctcaagaacagggtcatccccagactggctgtgaatgtgaggacggacccgatggccaagaaatggatccccccaaccctgaggaggtaaagacgccagaggaaggggaaaagcagtctcaatgttag

SEQ ID NO: 117650 - DNA, 354 bp, Artificial Sequence
  Description of Artificial Sequence: Synthetic coding sequence
atgtcttggcgtggtaggtcaacgtattattggcctcgcccgaggcggtacgttcaaccccccgagatgattggaccaatgagaccagaacagttttcggatgaagtagaaccagccaccccagaagagggcgagcccgcgactcaatgccaggaccctgcggctgcgcaagagggcgaagacgagggcgcatccgccggccagggtcctaaacctgaagcgcactcacaggagcaggggcaccctcagaccgggtgtgagtgcgaggacggacccgacggccaggaaatggatccgccgaatccagaggaggtgaaaacacctgaggaaggagagaagcagagccagtgttag

SEQ ID NO: 117651 - DNA, 354 bp, Artificial Sequence
  Description of Artificial Sequence: Synthetic coding sequence
atgagctggaggggccgctccacttactactggccgcggccccggcggtatgtgcagcctcccgagatgataggccccatgcgtccagagcagtttagcgacgaagtggaacccgccactcccgaagaaggggagcccgccacacagaggcaagatccagctgccgcccaggagggtgaagacgaaggcgccagcgcgggacagggtcctaaaccggaagctcatagtcaggagcagggtcacccacaaaccggttgcgaatgtgaggacggacccgatggacaggagatggacccccccaaccccgaagaagtaaagacacctgaagagggagagaagcagagccagtgctag

SEQ ID NO: 117652 - DNA, 354 bp, Artificial Sequence
  Description of Artificial Sequence: Synthetic coding sequence
atgtcatggagagggagaagcacatactattggcctcggcccaggaggtacgtgcaaccgcccgagatgatagggcccatgcgcccggagcaatttagtgatgaggtggagcctgccacaccggaagaaggcgaacccgccacacagcgacaggacccagccgcagcccaagagggcgaggacgagggcgcatccgccgggcaaggccccaagcctgaggcccactcccaagaacagggtcacccacagactggatgtgaatgcgaggacggacccgacggacaagagatggatccacctaacccagaggaggttaaaactcccgaagagggggaaaagcagagtcaatgttag

SEQ ID NO: 117653 - DNA, 354 bp, Artificial Sequence
  Description of Artificial Sequence: Synthetic coding sequence
atgagctggcggggacggagtacctattactggcctcgccccagaagatatgtgcagccccctgagatgatcggaccaatgcgtcctgagcagttttccgatgaagtggagccggccactccggaggaaggggagcccgctacccagtgtcaagatcccgctgccgctcagaagggtgaggacgaaggtgcaagcgcaggtcagggtcccaagccagaagcacactcacaggaacagggccacccccagaccggatgcgaatgtgaggatggccccgacgggcaggaaatggatccaccaaaccccgaagaggtaaaaaccccggaggaaggcgagaagcagtcacagtgctag

SEQ ID NO: 117654 - DNA, 354 bp, Artificial Sequence
  Description of Artificial Sequence: Synthetic coding sequence
atgagctggcgggggcggtctacttactactggccccgtccgagaccctacgtacagcccccagagatgatcggcccaatgagaccagagcagttctccgacgaggttgaaccagcgacccccgaagaaggagaacccgctacacagaggcaggatccagccgctgcccaagagggggaggacgaaggagccagcgctggacaggggcccaaaccagaagccgatagccaggaacagggccaccctcagacagggtgcgagtgtgaagatggccctgacggccaggagatggatccaccaaatccagaggaggttaaaactcctgaagaaggtaagaaacaaagtcagtgttag

SEQ ID NO: 117655 - DNA, 354 bp, Artificial Sequence
  Description of Artificial Sequence: Synthetic coding sequence
atgagttggcgcggccgctctacctattataggcctcgcccacgtcgttatgtggaacctcctgagatgatcggccccatgcggccagagcagttctccgatgaggtcgagccagccaccccagaggaaggcgaaccggctactcagtgccaggatcctgctgctgcacaggaaggggaagatgaaggagcctcggctggtcaggggccaaaacctgaagccgattcgcaggaacaggggcatccacaaactggttgtgaatgcgaggacggtcctgacggacaggaaatggacccacctaatcccgaggaagtcaaaactcctgaagaagggaagaagcaatctcagtgctag

SEQ ID NO: 117656 - DNA, 351 bp, Artificial Sequence
  Description of Artificial Sequence: Synthetic coding sequence
atgtcttggcgtggtaggtcaacctatcgtccaaggccacggaggtatgtggagccccctgagatgatcggacctatgagacccgagcaattttccgatgaggtagagcccgctactccagaggaaggtgagccagcaactcagcgtcaggaccccgcggctgcccaagaaggtcaggacgaaggagcttccgctgggcagggccccaaaccagaagcccactcacaggaacaggggcatccgcagactggctgcgagtgcgaggacggtcctgacggccaagaaatggatcctcccaaccccgaggaggtgaagactcccgaagaaggggagaagcagagtcagtgctag

SEQ ID NO: 117657 - DNA, 351 bp, Artificial Sequence
  Description of Artificial Sequence: Synthetic coding sequence
atgagttggcgaggacgcagcacttaccggccaagaccccggcgttatgtagagcctcccgaaatgattggacctatgcgcccggagcagttctccgatgaagtggaaccagcaacacccgaggagggagagcctgcgacccagcgccaggatcctgcagctgcccaggagggcgaagatgaaggtgcatccgccgggcagggtcccaagcccgaagcgcattcacaggagcaagggcacccgcagaccggttgcgagtgtgaggacgggccggacggccaggaaatggacccccctaatccagaagaagtcaaaaccccagaagagggagagaaacagtcccagtgttag

SEQ ID NO: 117658 - DNA, 351 bp, Artificial Sequence
  Description of Artificial Sequence: Synthetic coding sequence
atgagctggcggggcaggtccacttacaggccccgtcctagaagatacgttgagcccccagaaatgattgggccaatgaggcccgagcaattctcagatgaggtggaaccggctacacctgaagagggcgaaccagccacccagaggcaggaccccgccgccgcccaggaaggagaggatgagggcgcctccgccggacagggcccgaaacctgaggctcacagccaagaacaggggcacccccagactgggtgtgaatgcgaggatggccctgacggccaggagatggacccccccaaccccgaggaagtgaaaaccccggaagaaggcgaaaagcagtcccagtgttag

SEQ ID NO: 117659 - DNA, 351 bp, Artificial Sequence
  Description of Artificial Sequence: Synthetic coding sequence
atgagttggcgcggtcggtcaacttatagaccacggcccagacgctacgtggagcctcccgagatgatagggccaatgcgccctgaacagttttcagatgaggtggagccagccacaccggaagagggagaaccggcaacccaacgacaggaccctgctgcagctcaggagggtgaggacgaaggtgcctcggctggtcaaggacccaaacccgaagcggacagtcaggaacagggtcatccacaaaccggatgcgaatgtgaggacggtcctgatggacaggagatggatcccccaaaccctgaggaggtgaaaacccctgaggagggtgagaagcagtcacaatgttag

SEQ ID NO: 117660 - DNA, 351 bp, Artificial Sequence
  Description of Artificial Sequence: Synthetic coding sequence
atgagttggcggggaagatccacttatcgaccacggccacgaagatacgtggagccgccagaaatgattggccccatgcgccctgaacagttcagcgacgaagtggaaccagccacaccagaggagggggagcccgcaacacagcggcaggatccggcagccgcacaggagggggaagatgagggcgccagtgccgggcagggacccaagcccgaagctgattctcaggagcagggacatccacagactggatgcgaatgcgaagacgggcccgatggacaagaaatggaccccccgaaccctgaggaggtgaaaacgcccgaagaaggcaaaaaacagtcacaatgttag

SEQ ID NO: 117661 - DNA, 435 bp, Artificial Sequence
  Description of Artificial Sequence: Synthetic coding sequence
atgttcctggaggaaaaaatcccttccattagcgatcttaagcttgccatcagaagagctactctgaagagatctttcacccccgtgttcttgggttctgccctcaagaacaagggtgtacagcccctccttgatgctgtcctcgagtaccttccaaatccctccgaggttcagaattacgccatactgaataaggaggacgattccaaagagaaaacaaagattttgatgaactccagccgtgataattctcacccatttgtgggccttgcctttaagttggagttcctgagcagatctttttttaggctgactcggcagaaggaccacaggaggccgatacaacgtacaaccctctatctcatcgtgatgagcccgtatgacctgctagggtgtaacagctttctcgatttcccgtgttttagtagggactag

SEQ ID NO: 117662 - DNA, 2256 bp, Artificial Sequence
  Description of Artificial Sequence: Synthetic coding sequence
atgagactactgggcgccgcggccgtagctgcactgggtcgcgggagggctccggcgagcttaggttggcagaggaagcaagtgaactggaaagcctgtcgctggtccagcagcggggtgatccctaacgagaaaatccgaaacatcggcatttcagctcatattgatagcggcaagaccactttaactgagcgggtcttgtactatacgggcagaatcgcaaagatgcacgaagttaagggaaaggacggcgtcggcgccgtgatggactcaatggagttggagaggcagagaggaatcacaatccagtccgcagcgacatacacaatgtggaaagacgtgaatatcaatatcatcgatacccctgggcatgtagacttcactattgaagtcgagcgagctttacgggtattggacggcgccgtcctggtgttgtgtgccgtcggaggcgtgcagtgtcagacaatgacagtgaaccgccagatgaagaggtataatgtgcccttcctgacgttcataaataagctggacagaatgggttccaatcccgcacgggcactgcagcagatgcgctcaaaattaaatcataacgccgcttttatgcaaatcccaatgggactagaagggaattttaaagggattgtggacctgatcgaggaacgggcaatctactttgatggagacttcggccagatcgtccgctacggcgagatacccgcagagctgcgtgccgctgccacagaccatcgacaagagctgatagaatgcgtggcaaattctgacgagcagttgggcgaaatgtttctggaggaaaagatccctagcatctctgatctcaagctggctattcgtagggctacacttaaaaggtcgtttacacctgtgttcctcggttcggctctgaagaataaaggcgtccaaccactgttggatgccgtgctcgaatacttaccaaaccctagcgaggtacagaactatgccatactaaataaggaagatgatagtaaggagaagacaaaaatcctgatgaattcttccagggacaacagccatccctttgttggactggccttcaagctggaggtcggcagattcggccagctcacctatgttcgttcctaccagggggaactgaagaagggcgataccatctacaacacgcgcacacgcaaaaaggttcggttacaacgtctggccaggatgcacgctgatatgatggaggatgttgaagaggtgtacgcaggagatatctgcgcattgtttggcatcgactgcgcgagcggtgatacgtttacagataaggccaattcaggcctatcaatggagtccatacatgtgcccgatccagtgatttccatcgcaatgaagccgtccaataagaacgatcttgagaagttcagcaagggtattggccgctttaccagagaggacccaaccttcaaggtgtatttcgatactgagaataaggaaacggtcatttcaggtatgggcgagttgcacctcgagatctatgcacagcgcctcgagagagaatatggctgcccatgtatcactggaaaacccaaagtagcatttagagagacaatcaccgcacctgttcctttcgactttacacacaagaaacaatcggggggagccgggcagtacggtaaagtcattggagtgttggagcccctggatcctgaagattacactaaactggaattcagtgatgaaacgtttgggtcaaacattcctaaacagttcgtgcctgccgtggagaaaggatttctcgacgcctgcgagaaaggccctctgagcggacataagcttagcgggcttaggttcgttctgcaggacggagcccaccatatggtggactccaatgaaatttccttcattagagctggagagggggcccttaagcaggcactggcgaatgctaccctttgcattctagaacccatcatggctgtggaagtggtcgccccgaatgaattccaagggcaggtaatagcgggtattaataggaggcacggcgtaattactggtcaagatggcgtcgaagactacttcacactatacgccgacgtgcccctcaatgacatgttcgggtatagtaccgaactccggagctgcacagagggtaagggcgagtacactatggaatacagtcggtatcagccctgcctgcccagtacacaggaggatgttattaacaaatacctcgaggccacaggccaattgccggtcaagaaaggcaaagctaaaaactag

SEQ ID NO: 117663 - DNA, 459 bp, Artificial Sequence
  Description of Artificial Sequence: Synthetic coding sequence
atgagcctcgttatacccgagaaattccagcacatcctgagagtccttaataccaatatagatggcagacgcaagatcgctttcgcaatcaccgcaattaaaggggttggtaggcgctatgcccatgtggtccttcgtaaagccgatattgaccttactaagagggccggcgagctcaccgaggacgaggtggagcgggtcattaccataatgcagaaccctaggcagtacaaaattccagattggttcctgaatagacagaaggatgtgaaagatggtaaatactcacaggtgcttgccaatgggctggacaataaattaagggaggatttagaacgtctgaagaagattagggcacaccggggcttaaggcatttctggggcttacgggtcagaggccagcacaccaaaaccacagggagacgaggacgtaccgtgggcgtgagtaaaaagaaatag

SEQ ID NO: 117664 - DNA, 1071 bp, Artificial Sequence
  Description of Artificial Sequence: Synthetic coding sequence
atgagccggcctttgctgatcacctttactcctgcaaccgacccaagcgacctctggaaagacggccagcaacaacctcagcctgaaaagcccgagtccaccttagatggggccgcagcgcgtgctttctacgaggctctgattggagacgagtcaagtgcccccgatagccagagaagccaaaccgagcctgcgcgagaaaggaagcggaaaaagcgtcgaatcatgaaggcgcccgccgccgaggccgtggctgagggagccagcggccggcacgggcagggccgctcactggaagccgaggataaaatgacccatagaatcctccgcgctgcacaggaaggcgatctgcctgagttgagacgattacttgagcctcatgaggctggaggcgccggtggaaatatcaatgcacgggatgccttttggtggactccacttatgtgcgctgcccgcgccggtcagggagcagcagtcagttacctgctgggaaggggcgctgcatgggtaggggtgtgcgagctctctggccgggacgctgcccagctcgccgaggaagcaggatttcccgaggtagcgcggatggtgagagagagccatggcgagacacgatcccccgaaaaccgatcgcctacaccaagcctgcagtactgcgaaaattgtgacacccacttccaggatagcaaccacaggacatcaaccgcccacctactatcgctgtcccaagggccccagcccccgaacttaccactgggagtacccatctcaagtccgggtttcaagttgcttctgcgggggggatgggagcccgggatgggtctgggcccaaggggggagggaagagccaatcccattcctacagtcctgaagagagaccaggaagggctgggctatcggagcgcaccacagccccgtgttacccatttcccggcctgggatacccgggccgttgccggtagagagcggcccccccgcgtggccaccctttcctggagggaggaaaggcggagggaggaaaaggatcgggcctgggaacgcgatctacggacatacatgaaccttgaattctag

SEQ ID NO: 117665 - DNA, 1071 bp, Artificial Sequence
  Description of Artificial Sequence: Synthetic coding sequence
atgtctcgacccctgttgataaccttcacccccgccacagaccccagcgacctgtggaaggatggacaacagcagccacagccagaaaaacctgagtccacactggatggagcggccgctcgcgccttctatgaggcattgataggtgacgaatcaagcgccccggacagccagcgctcccagaccgagccagctcgcgaacggaaacggaaaaagcgaagaatcatgaaggcccctgctgctgaagcggttgcagagggagcctccgggcgccacggccagggacgcagcctggaggcagaggacaaaatgacccatcgaatcctccgcgccgcgcaggagggtgatctgccagagctccgacgcttactcgagccccacgaagctggaggtgccgggggcaacatcaatgccagggacgccttctggtggacccccctgatgtgcgcagccagagcaggccaaggggccgctgtctcttacctcctggggaggggggcggcttgggtgggtgtctgcgagctgtcaggccgagatgctgcacagttggcagaggaggccgggtttcccgaagtagcccgtatggtccgcgagtcccacggggagacacgaagtccagaaaacaggtcccctaccccttccctgcagtactgcgaaaactgcgacactcatttccaagattcaaaccatcgcacctccaccgctcatctgctgagtctgtcccaggggccccaaccacccaatctcccattaggagtgcccatctcttccccaggtttcaagctgttgcttcgtggaggctgggagcctggtatgggtctgggaccacgaggcgaaggacgagcaaaccctatcccgactgtgttaaaacgggatcaggagggtctgggctatagaagtgcccctcagccacgggtaactcactttcctgcctgggacacccgcgctgtggcgggtcgcgagcggcctcctagggtggcaacactgtcctggagagaggagaggaggcgggaagagaaagaccgggcttgggagagagacctgcggacctatatgaacctggaattctag

SEQ ID NO: 117666 - DNA, 1071 bp, Artificial Sequence
  Description of Artificial Sequence: Synthetic coding sequence
atgagccgccccttgctgatcacatttacacctgccaccgatccatctgacctctggaaggacggacagcagcagccccagcctgagaaacctgagtctacgctggatggggccgcagcacgggccttttacgaggccctgatcggcgatgaatcttccgcacctgatagccaacgatctcagaccgaacctgcccgcgaacgaaaacgcaagaaaagaagaataatgaaagcgccagccgctgaagccgtagcagaaggcgcttccggcaggcacggtcaggggagatcacttgaggcagaagataagatgactcacaggattctccgggctgcccaggaaggtgacctgcccgagctgcgccgcctcctggagccccatgaagctgggggagccggtggcaatattaacgcccgcgacgcgttttggtggactcccttaatgtgcgctgcccgggccggacaaggggccgctgtgtcctaccttctgggccggggggcagcttgggtaggcgtttgtgagttaagtggccgggatgccgcccaacttgctgaggaagctggtttcccggaagttgcccgaatggtgagggaatcccacggagagacccgctctcccgaaaatagatcacccactccttctctccagtattgtgaaaactgcgacacccatttccaggactcgaatcaccgcacgagtaccgctcatctgttatccttgagccaaggcccacaaccccccaaccttcccttaggcgttcctattagcagccctggttttaagttactcctgcgtggtggttgggaacccggtatgggcctggggccccggggtgaaggccgagctaaccctatcccaacagtactgaaaagggaccaggagggcttaggatatcggagtgccccacagccgcgcgtaacccattttcccgcctgggatacacgtgctgtcgcagggcgggaacgtccgccacgggtagcgactctgtcgtggcgggaggagcgcagaagggaagaaaaggatcgcgcctgggagcgggacctgaggacttatatgaatctcgagttttag

SEQ ID NO: 117667 - DNA, 1071 bp, Artificial Sequence
  Description of Artificial Sequence: Synthetic coding sequence
atgagccgacctttgcttattaccttcactcctgcgacagatccttctgacttatggaaagatgggcagcagcaaccccagcccgagaaacctgaatctacactcgacggtgccgctgctagagcattctatgaggccctgattggagacgagtccagcgctcctgatagtcagaggagtcagacggagcctgcaagagagaggaagcgaaaaaaaagacgaataatgaaggctcccgcggctgaggccgttgcggaaggcgcaagtgggcgccacgggcagggccggagcctcgaggcagaggataagatgacccatcggatcctgagggcggcgcaggagggagacctgccagagctccgtcgacttctggaaccccacgaggctggaggagccgggggaaacatcaacgccagagacgctttctggtggaccccactgatgtgtgcagcccgcgctgggcagggagctgctgtatcttatctgcttggccgtggggcggcatgggtgggagtatgcgagctcagcggaagagacgcagcacagcttgctgaggaagcggggtttccagaggtcgccagaatggttcgagagtcccatggagagaccaggagccccgagaaccgatcaccgacccctagtctgcaatattgtgagaactgcgatactcatttccaggacagcaaccacaggacatcaaccgcccacctgttatcattgtctcagggtccgcagccaccaaatttgccactcggcgtccccatatcttctcccgggtttaagctgctactgcgtggaggttgggaacccggcatgggcttggggcctcggggggaaggacgggccaacccgatccctaccgttctaaagagggaccaggagggtttagggtacagatcggcaccccagccgcgtgttacccacttccccgcctgggacactcgggccgtggcagggcgggagagacctcctcgcgtagctaccctttcttggagagaagagcgtcggagggaggaaaaggatcgggcttgggagagggacctgcggacatacatgaatttggagttctag

SEQ ID NO: 117668 - DNA, 1071 bp, Artificial Sequence
  Description of Artificial Sequence: Synthetic coding sequence
atgagtcgccctctgctgatcacattcacccctgccacggatccttctgatctttggaaggacggacaacagcagcctcagcctgagaagcctgagtcgactctagacggagcagcagctcgtgccttctatgaagcacttattggagacgaatcctcagcccctgattcacagagaagccagacggagcccgcgcgagaacgaaagcgtaagaagcgcagaattatgaaagcaccggccgccgaagcggtggcagaaggcgcatccgggaggcatggtcagggtcggtcactggaggcagaggacaaaatgacccaccggattctgcgagctgcccaagaaggagatttgcctgaattacgtaggcttttagaacctcacgaggccggtggcgctgggggcaatatcaatgctcgggatgcattttggtggactcctctgatgtgtgcagcccgggccggacagggcgcagccgtctcatacctccttgggcgaggcgccgcctgggtgggggtgtgtgagctgagcggcagagatgccgctcagctcgccgaggaagccggcttccctgaggtcgccaggatggttagggagtctcatggagaaaccagaagcccagaaaatcgcagcccgacaccaagccttcagtactgcgaaaattgtgacacacactttcaggatagcaatcatagaacttccaccgctcatttgctttcattgagccaagggcctcagcccccaaacttgcccctgggagtgcctatctcatcaccagggtttaaactcctcctcagaggtggctgggagccaggcatgggactcggcccacgaggtgaaggacgggctaacccaatccccacggtgttaaagcgagaccaggagggactcggctacagatccgccccgcagccccgggttacccactttcctgcttgggacacgcgagctgtagcgggcagagaaaggccaccaagggtcgcaactctatcttggcgggaggagcgacggagagaagagaaggatagagcgtgggagcgagacctgcggacgtacatgaacctcgagttttag

SEQ ID NO: 117669 - DNA, 1071 bp, Artificial Sequence
  Description of Artificial Sequence: Synthetic coding sequence
atgagtagacctttgctaatcacattcacgcctgccactgacccttctgatctgtggaaagacgggcagcagcagccgcagccagagaagccggaaagcacacttgatggggccgcagctcttgcgttctacgaggccctcattggggacgaaagttcggcccctgacagccagaggagtcagactgagcctgcccgtgaacgcaaaagaaaaaaaagaaggattatgaaggctccagcagccgaagcggtggctgaaggagctagtggaaggcatggccaggggaggtctctcgaggccgaagataagatgacgcatagaatcctccgcgcagcgcaggaaggagatctccctgagttacgcaggttgctagaacctcatgaggctggaggggcaggcgggaatattaacgctcgagacgccttctggtggactccattgatgtgcgccgcgcgcgccggtcagggcgcggcagtctcctacctgttagggcggggtgcggcttgggtcggagtatgcgaactgagcggccgtgacgccgcccagctggccgaagaagctggattcccggaagttgcccgaatggtgcgggagagccacggcgagacaaggtcccctgaaaatcgtagtccaaccccctccctgcagtactgcgaaaattgcgacactcacttccaagatagcaaccaccgcacaagcaccgcgcatctgctatctctctctcaggggccccagccacccaacctccccctgggcgtgcctatcagctcccccggtttcaagctgcttctccggggtggatgggagcccggtatgggcctgggaccccggggcgaagggcgggcgaaccccattcccaccgtgttaaaaagggaccaggagggactcggctacagatcagctccacagccacgggtaacccatttccctgcctgggacacgcgcgctgtggccgggcgggagcgaccaccgagagtcgccaccctctcctggcgagaggaacgcagacgagaagaaaaagaccgggcttgggagagggacttgagaacctacatgaacctggagttctag

SEQ ID NO: 117670 - DNA, 1071 bp, Artificial Sequence
  Description of Artificial Sequence: Synthetic coding sequence
atgtcaagacccttgctaattactttcacccctgcaaccgatccctcagatctatggaaagacggtcagcagcagccgcagcctgagaaacccgagagcacgttggatggtgccgctgccctggccttctacgaggctctaatcggtgatgagagctccgctcctgacagccagcgctctcaaactgagccggccagagagcgtaagaggaagaaaaggagaataatgaaggcccctgcagccgaagccgttgccgagggcgccagtggaagacacggccaagggagatccctggaagcagaagacaagatgactcatcgcatccttcgcgccgctcaagaaggggacttgccagagctccggcggttgctggaaccccacgaagccggaggggcgggcggtaacattaacgcccgagatgcattttggtggacaccactgatgtgtgcagcaagggccggccagggtgccgcagtcagctaccttttggggcggggagctgcctgggtgggggtgtgcgaactcagcgggcgggatgctgctcaattggctgaggaggctggcttcccggaggttgcgagaatggtccgtgaatcgcatggcgagacgagatccccagagaaccgcagccccacgcctagcctacagtattgtgaaaactgtgatacccactttcaggactctaatcaccgaactagtaccgcgcacctcctgtcactgtctcaggggccgcagcccccaaatctccccttgggcgttcctatcagttctcccggatttaagctacttctgcgcgggggatgggaacctggcatggggttgggcccacggggtgagggtcgggctaaccccattccaaccgtacttaagcgcgaccaggagggccttggctataggtccgcgccccagccacgggtgactcactttccagcttgggacaccagagccgtcgctggacgagagaggccccccagagtcgcaacactcagctggagggaagagcggcggagagaggagaaggaccgagcctgggagagggacctgcggacatacatgaatttggagttttag

SEQ ID NO: 117671 - DNA, 1071 bp, Artificial Sequence
  Description of Artificial Sequence: Synthetic coding sequence
atgagtagaccactccttattacattcacaccggccacagacccaagtgacctttggaaagacgggcagcagcagccgcagcctgagaaacctgaatccacattagacggcgcggcagcactagccttttacgaggcactgatcggtgatgagagctccgctccagacagccagaggagtcagaccgagccggccagagaaaggaaacggaaaaagcgtaggataatgaaagcccctgccgctgaagctgttgcggagggggcaagcggcaggcatggccagggccgctcactggaagctgaagacaagatgacccacaggatcttacgagcagcccaggaaggcgacctgccagaactgagacgactcctcgagccccacgaagccgggggggcaggcggcaacataaacgcacgcgacgccttctggtggacccccctaatgtgcgccgcccgggctggacagggggctgcggtatcctatctgctcggaaggggggccgcctgggtaggggtgtgtgagcttagcggcagggacgccgctcagctcgcagaggaagccggctttcccgaggtagcccgaatggttcgggagagccatggagaaaccagatctccagaaaaccggagtcccactccctccctccaatattgcgaaaactgtgatacccatttccaagattctaatcaccgcacctccaccgcccacttgttaagcctgagtcagggacctcagccccctaaccttcctctaggcgtgccaataagttccccaggattcaagctccttctcaggggcggctgggagccaggcatgggccttgggccccggggagaagggcgtgctaaccccattccgaccgtgctgaagcgggatcaggagggcttaggataccggagcgccccccaacctcgagtaacccactttcccgcctgggatacaagagcagttgcggggcgggagcgaccaccccgtgttgccacattatcctggcgagaagaaagaagacgagaagagaaggaccgagcatgggaaagagacctccgcacgtatatgaatctcgagttctag

SEQ ID NO: 117672 - DNA, 1071 bp, Artificial Sequence
  Description of Artificial Sequence: Synthetic coding sequence
atgtctcgccctctcttaataacgtttaccccagctacagacccatctgacctttggaaagatggccagcagcagccgcagccagagaagccagagtcaacactcgacggtgccgccgccttggcgttctacgaggccctgattggcgatgaatcctctgcccccgatagccaaaggtcacaaacagagccagctagggaaagaaagaggaagaagcgaagaattatgaaggcccccgccgctgaggccgtggcagaaggggccagcggacgccacggccaagggcgctccctggaggcagaagataagatgacccataggatcctgagagcggcccaggaaggagatctgcccgaattgcgcaggctcctcgaacctcatgaagccggtggagcagggggcaacataaatgccagagacgctttttggtggacccctctaatgtgtgccgcccgcgctggacagggcgctgccgtatcctatctgttaggacgtggcgccgcatgggtaggtgtttgtgaactcagcggtagggatgctgctcaactggctgaagaagcgggttttcctgaagtggcacgtatggtgagagaatcgcacggcgaaactcggtcgcccgagaaccgttctccaactccatccctgcaatattgcgaaaactgcgacacacatttccaagactctaaccataggacatccacagcccacctgttatccttgtcacaggggccccagcctcccaacttacccctcggagttccgatttcttcacccggctttaagttattgctacgcgggggatgggagccggggatgggtttggggcctagaggagagggccgggctaatcctatcccaactgtgcttaaaagggaccaagagggccttggatatcgctccgccccacagccgcgagtgacccacttccctgcatgggacacacgcgccgtcgccggtagggaaagaccaccacgagtggccaccctgagctggagagaagaaaggcgacgtgaagaaaaagatcgtgcgtgggagcgcgacctaaggacctatatgaacctggaattctag

SEQ ID NO: 117673 - DNA, 1071 bp, Artificial Sequence
  Description of Artificial Sequence: Synthetic coding sequence
atgagtcgcccactgctgataacctttacgcccgcaacagacccctcggacctgtggaaggacgggcagcaacagccacagcccgagaaacccgaatccacactggacggtgcagcagcgttggcattctatgaagcccttattggggatgaaagttcagcaccggattcacaaaggtcacagaccgaacctgcaagagaaaggaagcgcaaaaaacgaagaataatgaaagcaccggcagcggaggccgttgcggaaggtgcttccggacgacacggacaggggagatccttggaggccgaagataagatgactcaccggattctaagggccgcccaggaaggcgaccttccagagctcaggaggttgctcgaacctcacgaggcaggaggggctggggggaacatcaacgcgcgggacgcattttggtggacacctctgatgtgtgctgcacgtgcagggcaaggcgctgccgtgtcctatctgctcggcagaggtgctgcctgggtcggcgtgtgcgaattaagcggtcgagatgccgcacaattagctgaggaggcaggtttcccggaagttgccagaatggtcagagagagccatggcgagacgcggtcacctgagaaccgttctccaacaccgtcattacagtactgcgagaactgtgatacacactttcaagattccaaccaccgcacctccaccgcccatcttctgtccctgagtcaggggccgcaacctccaaatctcccactcggagtgccaatttccagccccggtttcaagctgttacttcgagggggatgggaacccgggatggggctgggcccgaggggtgaggggcgcgccaatccgattcccaccgttctgaagagggatcaagagggcttaggctatcgcagtgccccgcagcctcgggtgacacacttcccagcctgggacaccagagcagttgccggacgcgagcggcccccgagagtggcaactctctcctggagagaggagaggaggagggaggaaaaagacagagcctgggaacgggatctgcgcacttatatgaatctggagttttag

SEQ ID NO: 117674 - DNA, 498 bp, Artificial Sequence
  Description of Artificial Sequence: Synthetic coding sequence
atgagccgccctttgttgattacttttacaccggcgactgatccgagcgacctgtggaaagatgggcagcagcagccccagcccgaaaagcctgagtctacgctcgatggcgctgccgcgcgcgctttctacgaggccctgattggggacgagagtagcgcacccgacagccagcgttctcaaaccgagcctgcgcgcgaacgtaagcgcaagaagcggcggattatgaaggcccccgccgctgaggccgttgcagagggcgccagcgggcgacacggacaagggagatccctggaagcagaagacaagatgactcatagaattctccgtgccgcgcaagaaggagacctccctgaattaaggcgacttctcgaaccgcacgaagccgggggagctggcggtaatatcaacgccagagatgccttctggtggacccccctcatgtgtgctgcccgtgctggtcagggagctgcagtgagttaccttcttggaagatag

SEQ ID NO: 117675 - DNA, 459 bp, Artificial Sequence
  Description of Artificial Sequence: Synthetic coding sequence
atgtccagacctctgctcattacttttaccccggccactgacccgagcgacttgtggaaggatggtcagcaacagccacagcccgagaagcctgaatccaccttggacggagccgccgctctcgccttttacgaggctctgatcggggatgagagctcggcgccagacagtcagagaagccagacagagcctgcccgagaacggaagagaaagaaacgacgtatcatgaaagcccctgcagcagaagcagtcgccgagggggcgtctgggaggcacggacagggacgatctttagaggctgaggataagatgacgcaccgtatcttaagagccgctcaggagggggacctccccgaacttagacggctgctagaacctcatgaggctggaggggctggtggtaacatcaatgctcgggacgccttctggtggacccctctgatgtgtgccgcccgctag

SEQ ID NO: 117676 - DNA, 1071 bp, Artificial Sequence
  Description of Artificial Sequence: Synthetic coding sequence
atgagtcggcccctgcttataaccttcactccagctacagaccccagtgatctctggaaggatgggcagcaacaaccccaacctgagaagcctgagagcacccttgacggcgcggccgcattggctttctatgaagccctgattggcgatgaatcctcggctccggacagccagaggtctcagaccgaaccggcgagggagagaaagcgcaagaagaggagaataatgaaagccccagctgccgaggcggtagctgagggcgcaagcggacgccatggccaggggcgctctctcgaagccgaggataagatgacccacagaattttaagggccgctcaggaaggagatcttcccgagcttagacgcctgctggaaccgcacgaggctggtggcgcgggtgggaatataaatgcacgagacgccttttggtggacgcctctaatgtgcgccgcccgagctggacagggcgctgccgtctcatatctactgggccgcggcgccgcctgggtcggagtctgcgagctgtccgggagggacgccgcccagttagcagaagaagctggattcccggaagtcgcacggatggtcagagaatctcacggggagacaaggtcccctgagaatagaagccctacccccagcctccagtattgtgaaaattgtgatactcactttcaagattcgaaccaccgtacatccaccgcccacctgctcagcttatcacaggggccacagccaccaaacctcccccttggcgtccccatttcgtcgcctgggtttaaattgctgctgcgcggcggctgggaaccggggatgggattggggccccgcggtgaggggcgggccaacccaatcccgaccgtgcttaaacgcgatcaggaaggcctaggttacagatcggctccgcagcctcgagtgacccacttccccgcttgggatactcgcgccgtggcaggccgggaacggcccccccgagttgccacactctcatggcgggaggagcgacggcgcgaagagaaagaccgcgcatgggaaagggaccttcggacttacatgaatcttgaattttag

SEQ ID NO: 117677 - DNA, 459 bp, Artificial Sequence
  Description of Artificial Sequence: Synthetic coding sequence
atgtcccgcccactgctcatcacattcactcccgcaacagacccaagcgacctctggaaagatggccagcagcaaccacagccagagaagcctgagtctacactcgacggagctgccgctcgagccttctatgaagccctgatcggcgatgagagctccgcgcccgactctcagcgctcacagaccgaacctgcacgggaaagaaaacggaaaaaacggcggattatgaaagctcccgccgcagaggcagttgctgagggcgcttccggacgccacggccaaggtcgctctttagaagccgaggacaaaatgacccataggattctcagagccgcccaggagggagacttgcccgaactccgaagactcctcgagccgcatgaagctggcggtgcgggaggtaacattaatgcaagagacgccttttggtggacacccttaatgtgtgctgctagatag

SEQ ID NO: 117678 - DNA, 498 bp, Artificial Sequence
  Description of Artificial Sequence: Synthetic coding sequence
atgagccgccccctcctcatcacctttactcctgcaaccgacccaagtgacctgtggaaggatggccagcagcaaccccagccagagaagcccgagagtactctcgatggcgcagccgctttggccttttatgaggcattgatcggcgacgagtcatcagcacctgatagtcagcgatctcagaccgagccggcaagggaacgtaagagaaagaagaggcggattatgaaggcccctgctgccgaggccgtagcagaaggcgcaagcggccggcacggccagggacggagcttggaggccgaggacaaaatgactcaccgcatcttaagagcagcccaggagggtgacctgccagaattgcgccgattactcgagccacatgaagctgggggcgcaggcggaaacatcaacgccagagatgcattttggtggacgcctctgatgtgcgccgcgagggccggacagggcgccgctgtatcatacctcctaggtcgctag

SEQ ID NO: 117679 - DNA, 273 bp, Artificial Sequence
  Description of Artificial Sequence: Synthetic coding sequence
atgtccagaccactgctcattacattcacgcccgccacggaccccagcgacttatggaaagacggccagcagcagccccagcctgaaaaacctgaatctaccctggatggcgcagccgcactggcattttacgaggctttaataggggatgagtcatcagcccctgactcccagagatcacagactgaacccgcacgggagaggaagcggaaaaagcggagaatcatgaaagcccctgcggctgaagccgtggctgaaggcgccagcggttag

SEQ ID NO: 117680 - DNA, 1071 bp, Artificial Sequence
  Description of Artificial Sequence: Synthetic coding sequence
atgtcacggccgttactgattacattcacccctgctaccgatccatctgacttatggaaggacggacagcagcagcctcagcctgagaagcccgagtctacccttgatggggcggctgccagagctttctacgaggcactgatcggtgacgagtcttctgcacctgatagccagcgttcccagactgaaccagcgcgcgagcgcaagaggaaaaagaggagaattatgaaggccccggccgctgaagctgtggccgagggcgcatcaggcagacacgggcaggggagatccctagaagcggaggacaagatgacccaccgtatactgcgggctgcccaggaaggtgatctgcctgaattgcggcgtttgctcgagcctcacgaggctggcggtgcaggtggcaatatcaacgcgcgggatgccttctggtggacacccttaatgtgtgcggcccgggcggggcagggagctgctgtgtcatacctcttgggaagaggcgccgcttgggttggcgtttgcgaattgtccggccgagacgccgcccagctggctgaggaagccggctttcccgaagtggcacgtatggttcgcgaatcacacggagaaacccggtcccctgaaaataggtcgcctaccccaagtttgcagtattgtgagaactgcgacacacatttccaagattcgaaccacaggactagcacggcccatctgctctccctatcgcagggcccccagcctcctaacctccctttgggcgttccaatttcatcacccggctttaagctgttactgaggggtggctgggaacccggaatgggattagggccgaggggcgagggtcgagcaaatcccatcccgaccgttctgaaacgcgatcaggaaggccttggctacagaagcgctccccaacctcgggtcactcacttccccgcttgggatacgcgggcggttgccggcagagagagaccccctcgagtagccactctgagctggcgcgaggagcgtagaagagaagagaaggaccgtgcgtgggagagagatttgcgaacctacatgaacctggaattttag

SEQ ID NO: 117681 - DNA, 1071 bp, Artificial Sequence
  Description of Artificial Sequence: Synthetic coding sequence
atgagcagaccgctgcttatcacctttactcctgcaaccgacccctcagacctgtggaaggatggccagcaacagccacagccagagaagcccgagtctacactggacggtgctgctgcaagagccttctatgaggccctgattggtgacgagtcctctgcccccgattcccagcgaagtcaaactgagcccgccagagagcgtaaacgtaaaaagcgcagaatcatgaaagctcccgctgcggaagcagtggcggaaggtgcctccggccgacatgggcagggaagatcactggaagccgaagacaagatgactcatcggattctgagggccgctcaggagggtgatctgcccgaattgagaagactgctggaaccacatgaggctggcggtgcaggtgggaacatcaatgcacgggacgctttttggtggactcctctaatgtgtgctgccagggccgggcagggggcagcggtgtcctacctgctggggcgaggcgctgcctgggtgggggtctgcgagttgtccggccgcgatgccgcacaattggcagaagaggctggcttccccgaggtggctaggatggtccgcgagtctcacggagagacacgctctcctgaaaataggtccccgaccccttctctgcaatactgcgagaactgtgatacacacttccaggactccaaccacagaacaagcacagctcacctcctttccctctcgcagggcccacagccaccaaacttaccactcggagtgccgatatcatcccctggctttaagctgctcctcaggggtggatgggaacccggcatggggctgggccctcgtggcgagggccgcgccaatccgatccccaccgttcttaagagggatcaggaaggactggggtaccgctccgccccgcagccccgggttacccactttcccgcatgggacacacgggcagtcgccggaagagagcggccacccagagtcgctaccctgagctggagagaggagagaagaagggaggaaaaggacagagcatgggaaagagacctcagaacgtacatgaatctggagttctag

SEQ ID NO: 117682 - DNA, 324 bp, Artificial Sequence
  Description of Artificial Sequence: Synthetic coding sequence
atgtctcgtcccctgttgatcacattcactccagccacggatccatccgacctatggaaagatggccagcagcagccacagcctgaaaagccggagagtaccctggacggtgcagctgcccgggctttctacgaggcgctgatcggggacgaaagctctgcgcccgatagtcagaggtcgcagaccgagcctgctagggagcggaagcgtaagaagcgccgaatcatgaaggcccctgccgcagaagctgtggcagaaggagctagcggccgacatgggcaggggcgctccctggaggctgaggataagatgacccatagatag

SEQ ID NO: 117683 - DNA, 324 bp, Artificial Sequence
  Description of Artificial Sequence: Synthetic coding sequence
atgtcccggcctttgttgatcacttttacacctgcgaccgatccatccgacctatggaaggatggacagcagcagccccagcctgaaaaacccgaaagtaccctggatggagctgccgctctggccttttatgaggcactgatcggggacgagtctagtgcgcccgatagccagcgatcccaaaccgaaccagcacgggaaagaaaaagaaagaaaagacggattatgaaggccccagccgctgaagccgtggccgaaggagcctccggcaggcacggacaaggcaggagcttagaagctgaggacaaaatgacgcatcgttag

SEQ ID NO: 117684 - DNA, 1071 bp, Artificial Sequence
  Description of Artificial Sequence: Synthetic coding sequence
atgagcagacccttgctgataacgttcacgcctgcaactgacccctccgatctgtggaaagacgggcagcagcagcctcagccggagaagcctgaaagtactctggacggcgcagccgctcgagccttttatgaagctctaatcggggatgagtcgtctgcacctgactcccaacggagccagactgagccagccagagaacgcaagcgaaaaaagcggcggattatgaaggctcccgccgccgaggctgtggctgagggtgcctctgggagacatggtcaggggcgctccctggaggccgaagataagatgacgcatcggattcttagagccgctcaggagggtgatctgcctgaacttagaagactgctggaaccccatgaggccggcggtgccggaggaaatatcaacgcccgcgatgcattctggtggacccctctgatgtgtgccgcccgcgcaggccagggcgctgctgtgagttacctcctaggccgcggggcagcatgggttggtgtgtgcgaattgagcggacgggacgctgctcaactcgctgaagaggccggatttcccgaagtggcacgtatggtgagagagtcacacggtgagacacggagccctgagaacagaagccctactccttcacttcagtattgcgaaaactgcgacacccacttccaggactccaaccatcggaccagtactgcccatctcctgagtctcagccagggaccacagccacccaatcttccactaggggtgccaatctcctctcctggcttcaagctgcttctgcgtgggggttgggaaccagggatgggactggggcctcggggggagggccgcgccaaccctatcccaacagtgcttaaaagagaccaggaaggcctagggtaccgcagtgcaccacagccaagagtcactcactttcccgcttgggacacacgagccgtggcaggtcgagaacgccctccaagggtcgctaccctgtcttggcgcgaggaaaggagacgtgaggaaaaagaccgcgcctgggagcgcgatttacgcacatacatgaacctcgaattctag

SEQ ID NO: 117685 - DNA, 1071 bp, Artificial Sequence
  Description of Artificial Sequence: Synthetic coding sequence
atgtctaggcccctactgatcacatttaccccagccactgacccatccgatctgtggaaagatggccagcaacagccccagcctgaaaaacctgaaagcacactcgatggcgcagccgctcgtgccttctacgaggcccttattggcgatgaaagcagtgcccctgatagtcagcgatcccagactgaaccagccagagagcggaaaagaaaaaaacgccggatcatgaaggccccagccgctgaggctgtggctgagggcgctagcggcaggcatgggcagggcaggtccttagaagcggaggacaaaatgacacaccggatactaagggccgctcaggagggagacctgccagagttgcggcgtctgttagaaccacacgaggccggcggggcggggggcaatattaacgcccgcgatgccttttggtggactcctctgatgtgcgccgcccgtgctggacagggcgccgcagtgtcgtatttgctcggaaggggagcagcatgggtcggcgtttgtgaactctctggccgcgacgcagcccagttggcggaggaagctggcttcccagaagttgcccgcatggtgagagaatcacacggggagactcgaagccccgaaaataggagccccacaccctccctgcagtactgcgagaattgcgacacacacttccaggatagcaatcaccgcacatccacagcacatcttttgtcgttaagccagggcccacagccacccaacctccctctcggcgtgcctatctcatcaccgggattcaagttgctcctgaggaggggatgggagcctggaatggggctcggaccacgcggggagggaagagccaatcccattcctactgtgctaaaacgcgatcaggaaggattggggtaccgcagcgcaccacaacctagggtgactcacttccccgcctgggacactagggctgtggcgggcagggagagacccccacgggtagccaccctgagctggcgagaagaacgacgccgggaagagaaggaccgcgcctgggaacgtgacctaagaacatatatgaacttggagttctag

SEQ ID NO: 117686 - DNA, 1071 bp, Artificial Sequence
  Description of Artificial Sequence: Synthetic coding sequence
atgtcacgacctctcctcatcaccttcacacccgcgacagatcctagcgacctctggaaggacgggcagcagcagccacagcccgagaagcctgaatccaccctcgacggcgcagctgcccgtgccttttatgaggccctgatcggcgacgagtcatccgctccggattcacaaagatcccagactgaacccgctcgcgaaaggaagagaaagaagagacgaatcatgaaagcacctgcggcagaggcggttgctgagggggcatctggtcgtcatgggcaaggcagatctcttgaagctgaggataagatgacacacagaattcttcgggccgcccaggagggggacctgccggagctacgccggctccttgagccgcacgaagctgggggagcaggtgggaacatcaatgcgagagatgccttctggtggaccccactgatgtgcgcagccagagccggccagggcgccgcagtgtcttacttgctgggacggggcgccgcttgggtcggtgtttgcgagttatcaggccgagacgctgcccaactcgctgaagaggctggatttcctgaagttgcacgcatggtccgcgagagccatggggaaactaggagccctgagaaccgctctccaacacctagccttcagtactgtgaaaattgcgatacacattttcaagactccaatcaccgaacaagtacagcccacctgctttctttgagtcagggccctcaaccacccaatctacccctgggggtccctatttcatccccaggcttcaaacttttgttgcgccgcgggtgggagccaggtatgggactggggccacgaggagaaggacgggcgaatccgatccccaccgtccttaagcgcgaccaggaaggcctcgggtatagatccgccccacagcctcgcgtcactcattttcccgcttgggacacccgagctgtcgctggcagggagagaccgcccagggtggccaccttgtcttggagagaagagcggcggcgggaggaaaaggaccgcgcctgggagagggacctcaggacttacatgaacctggagttctag

SEQ ID NO: 117687 - DNA, 498 bp, Artificial Sequence
  Description of Artificial Sequence: Synthetic coding sequence
atgagtcgaccactcttgatcaccttcacccccgctactgatccaagcgatctttggaaagatgggcaacaacagccccagcccgagaaacccgagagcaccctggacggcgcagctgcccgggctttctatgaggccctgatcggtgacgaatcctctgcacctgattctcagcgatcccagactgagcctgctcgtgagcggaaacgcaagaaacgcagaatcatgaaggccccggctgcagaggccgtggcagagggagcgtcagggaggcacgggcagggaaggagcttggaagctgaagacaagatgacccaccgtattctgcgggccgcacaggaaggcgatctgcccgaactccgtcgactgcttgagccccacgaggccggcggagccggtggcaacataaatgctcgcgacgctttttggtggacaccactgatgtgtgccgcacgggctggtcagggcgcggctgtgtcatatctgctaggtcgttag

SEQ ID NO: 117688 - DNA, 1071 bp, Artificial Sequence
  Description of Artificial Sequence: Synthetic coding sequence
atgtcacgccccctcctgatcactttcacgcctgcgaccgaccctagtgatctttggaaagatgggcagcaacagcctcagcctgagaagcctgaatcaacgctagatggagctgcagcaagagcattctacgaagccctcattggagatgagtcatcagcccctgattcccagaggtcacaaactgagcccgccagggaacgcaagcggaagaaacgacgaatcatgaaagcgcctgccgccgaggccgtcgccgagggagcttctggacgtcacggccaaggacgaagcttggaggccgaagacaaaatgacccaccggattctgcgtgctgcccaagaaggtgatctccccgaattgcggagactcctcgagcctcatgaggccggcggagctggagggaatatcaacgcccgagatgctttctggtggactcccctgatgtgcgccgcccgtgccggacaaggtgcagctgtgtcctacctactggggcgaggtgccgcctgggtgggggtgtgcgagttgtcgggtagggatgccgcccaactagccgaagaagctggctttcctgaggtggcccggatggtcagagagtctcatggcgagacccgctcccccgagaacagaagccctacccccagcctccagtattgtgagaattgtgatacccattttcaggattcaaatcaccgcacttcaacagcacacttgctttctctttcccagggccctcaaccccctaatctgcccttaggtgtgcccataagctctccagggtttaagctccttctccgcggcggttgggaaccaggtatgggattgggacccaggggcgagggaagggccaaccccattcccaccgtgctaaagagggaccaggaaggattggggtatcgatccgccccccagccacgagtcacgcacttccctgcctgggacaccagggccgtagccgggagggagcgcccaccaagggtggcgaccctgagctggcgggaggagcggaggcgagaagagaaggaccgggcttgggaacgagacttgaggacctacatgaatctggagttctag

SEQ ID NO: 117689 - DNA, 597 bp, Artificial Sequence
  Description of Artificial Sequence: Synthetic coding sequence
atgtctagacctctcctgatcacattcacacccgcgaccgatcctagcgatctgtggaaagacgggcagcaacagccccaacccgagaaacccgaatccaccctcgacggagcggccgcgcgggccttctacgaggcactgatcggggacgaaagctcggcccctgactcccagcgcagtcagaccgaacctgcgcgtgaacgaaaaaggaaaaaacgccgaataatgaaagctccagctgcagaagctgtggcagagggagcctctgggcgccatggtcagggcaggtctctggaggccgaggacaagatgacacataggatcttaagagcagctcaagaaggcgatttgcccgaactcaggaggctccttgaaccccatgaggcaggcggcgctggcgggaacattaacgctcgggacgccttctggtggacgccacttatgtgcgcagcaagggcaggccagggcgccgccgtgtcttatctgctgggcaggggggcagcttgggttggtgtgtgtgagttgtctgggagagacgccgcacagctggcagaagaggcaggattcccagaggtagctaggatggtgcgcgaatag

SEQ ID NO: 117690 - DNA, 1071 bp, Artificial Sequence
  Description of Artificial Sequence: Synthetic coding sequence
atgagtcgacctttgctcatcacttttactcctgccacagacccgagcgacctgtggaaagatggccagcagcagccccagccagagaagcctgaatcaacgctggatggggcggctgccagagctttttacgaggcgctgatcggcgacgagagcagcgcccctgacagccagaggtctcagaccgaaccggcgcgggagcgcaagcgtaagaagcgtagaattatgaaggctccagcggcagaagcagtcgcagagggcgcgtccggccgccacggacagggccggtcgctcgaggccgaagacaaaatgacacaccgcattctcagggcagcccaggagggggatcttccggagcttagacgcctcttggaaccccatgaagccggcggtgctggaggcaatattaacgcacgggacgccttctggtggacccccctgatgtgcgctgccagggcaggccaaggagccgcagtatcatatctccttggccgaggcgccgcgtgggtgggcgtttgtgagctgagtgggcgagatgctgcccagttagcagaggaagctggtttccctgaagtggctagaatggttcgcgagagtcacggggaaactcgctcccccgaaaacagatccccaacaccaagtctgcagtattgtgagaattgcgacacgcattttcaagattctaaccaccgtactagcacagcccacctcttatcacttagccagggccctcagcctcctaatcttccattgggggtgccgattagcagtccaggcttcaagctgttgttacgccgcggatgggagccaggaatggggctcggtccccggggagagggacgagctaatcctatacccaccgtgctgaagcgggaccaggaagggctgggctaccgatctgcaccacaacctagagtcacccacttccctgcttgggacaccagggccgtggcggggcgcgaacgacctccaagagtggcgaccctctcctggcgggaggagagaaggcgagaggagaaagacagggcgtgggagcgcgacctccgtacatacatgaatctggaattctag

SEQ ID NO: 117691 - DNA, 498 bp, Artificial Sequence
  Description of Artificial Sequence: Synthetic coding sequence
atgtcacgtccactgctgatcacttttacccccgccactgacccaagtgacctctggaaagacgggcagcagcagccacagcccgagaaacctgagtccactctcgacggtgcagcggctctcgcattctatgaagctttaataggtgatgagtccagcgcccctgactcacaaagatcccagaccgaacccgctagggaaaggaagcgcaaaaagaggcgcatcatgaaggctccagccgcagaagcagtggctgagggcgcctcaggaagacacggtcaggggagatctctggaggccgaggataagatgactcatcggattctgcgggccgcacaagagggtgatctacccgaactccgccgactgcttgagccgcacgaggctggcggtgcgggggggaacatcaacgcacgcgacgctttctggtggacgccattgatgtgtgctgccagggcagggcagggggcggccgtatcctatttgttagggcgctag

SEQ ID NO: 117692 - DNA, 459 bp, Artificial Sequence
  Description of Artificial Sequence: Synthetic coding sequence
atgtcaagaccgctgcttatcactttcacacctgctaccgatccttccgatctgtggaaagacggacagcaacaacctcagcctgaaaaaccagaatcaactcttgatggagctgctgcacttgccttctatgaggccttaatcggcgacgagtcctccgccccggacagtcagagatcacagaccgagccggcccgcgagaggaaacgcaagaaaaggagaataatgaaagctccagcggcggaggcggtcgctgagggcgcatccggcaggcacggacaggggcgctctttggaggccgaggacaaaatgacgcataggatactgcgcgccgcacaagaaggagacctgcctgaactcaggcggctccttgagccacacgaggccgggggcgcggggggaaatatcaatgcaagagatgcgttctggtggacccccttaatgtgcgctgcacggtag

SEQ ID NO: 117693 - DNA, 459 bp, Artificial Sequence
  Description of Artificial Sequence: Synthetic coding sequence
atgtcgcgcccactcttaatcacgttcacaccagcaaccgaccccagcgatctgtggaaggatggccaacagcagccccagccggagaagcctgagtcaaccttagatggtgctgctgccttagccttctatgaggccctgatcggcgacgaaagctctgcacctgatagtcagcgtagtcaaacggagcctgcaagagaaagaaaaagaaagaagagaagaatcatgaaagcacccgctgctgaagccgtggccgaaggcgcctccgggagacatggccagggccggtctctggaagcagaagacaaaatgactcaccgcatcttgcgagccgcccaggaaggcgacctgccagaactacgtcggctcctcgagccccacgaagccggcggggcaggaggcaacattaatgcccgggacgccttctggtggacacccctgatgtgcgcagcaaggtag

SEQ ID NO: 117694 - DNA, 597 bp, Artificial Sequence
  Description of Artificial Sequence: Synthetic coding sequence
atgtccagaccgctgctcattaccttcactccagctactgatcctagtgacctgtggaaggatgggcagcaacagccacagccagaaaaacctgagtctacgctagacggtgccgccgctctagcattttatgaggccttgatcggcgacgagtcctccgcgcctgactcccagcgatcccaaactgaacccgctcgcgagaggaagaggaaaaaacgaaggataatgaaagcaccagccgccgaagccgtggcagaaggagcttctggccgacacggtcagggtagatcccttgaggctgaggataagatgacacaccgcattcttagggccgctcaggaaggcgatctcccagaactgcggcgcctgttagaaccacacgaagccggcggcgccggaggaaacataaatgcaagagatgctttctggtggacaccgcttatgtgcgccgcgcgagcgggacaaggtgcagcggtttcctatctgctcggaaggggggccgcttgggtcggcgtctgcgaactgagcgggcgtgacgctgcgcagctggcagaagaggctggttttcctgaggtggcccggatggttcgcgagtag

SEQ ID NO: 117695 - DNA, 597 bp, Artificial Sequence
  Description of Artificial Sequence: Synthetic coding sequence
atgtcaaggcccctcctcattacattcacacccgcaacagacccttcggacctctggaaggatgggcagcagcagcctcagcctgaaaaacctgagagtaccctggacggagccgctgccctggccttctacgaagcactcattggagacgagtccagcgctccagactcccagcggtctcagacagagccagcaagagaaagaaagcgcaagaagaggcggatcatgaaagcaccagcggccgaggctgtcgctgagggtgcaagcggccgccacggccagggacgatccctcgaagcggaagataagatgacccacagaatcctccgggctgcgcaggagggcgatttgcctgaattgagaaggctcctcgaacctcatgaggccggtggcgctggcgggaacattaatgcacgcgatgccttctggtggacccccctcatgtgtgccgcgcgtgcggggcagggagccgcagtgagctacctcctggggcggggagcagcctgggttggagtgtgtgagcttagtgggcgagatgctgctcaactggctgaggaggctgggtttccagaggtcgcgagaatggtgagagaatag

SEQ ID NO: 117696 - DNA, 1071 bp, Artificial Sequence
  Description of Artificial Sequence: Synthetic coding sequence
atgtcacgtcctcttctgatcaccttcaccccggcgacggacccctccgacctttggaaagatgggcagcagcagccccaacctgagaaacccgagtcaaccctggatggcgccgccgcaagagcgttttacgaagccctgattggcgacgagtcctcagctcccgattcacagcggtcccagacggagccagcgcgggagagaaaaaggaaaaaacgtcggatcatgaaggcccccgccgcagaggcggtcgccgagggagcctccggcaggcacgggcagggaagaagtctggaagctgaagacaagatgacacaccgcatcctgcgcgctgcacaggaaggggatcttcctgagctgcgcagactgctggaaccccacgaagctgggggggctgggggcaacatcaatgccagggatgctttctggtggacaccactcatgtgtgcggcccgagctggacaaggggcagccgtgtcgtacttgctgggacgcggagctgcctgggttggagtctgcgaactgagcggaagagatgccgctcagcttgccgaggaggccggattcccagaggtcgcgagaatggtgagagagtcccatggcgagacccgctcacccgaaaatagatcgccaactccctctcttcagtattgtgagaattgcgacacccatttccaggacagcaatcacagaactagtacagcccatctgctgtctttatcccaggggccgcagcctccaaacctgcccctgggcgttccaattagttcccctggttttaagttgctcctgaggcgggggtgggaaccaggcatgggcttgggaccgcggggggagggcagggcaaacccaatacccacagttctgaagcgagatcaagaggggttgggctaccggtccgctcctcagccccgagttactcacttccctgcctgggacacccgggcggttgctggaagggaacgaccaccgcgtgtggccacactctcatggcgggaagagcgacgacgtgaggagaaggacagggcctgggaacgggacttgaggacgtatatgaatctggagttttag

SEQ ID NO: 117697 - DNA, 1071 bp, Artificial Sequence
  Description of Artificial Sequence: Synthetic coding sequence
atgtctagaccactgctgataacgttcactccagcaacagatccatcggacctgtggaaggatggccagcagcagccccagccggagaaacccgaatccacccttgatggcgctgccgccctcgcgttctacgaggccctcataggcgatgaatcctccgctccggatagccagcgttctcagaccgaacccgcccgcgaacgcaaacgcaagaaacgtagaatcatgaaggcaccggccgccgaggctgtagcggagggggcgtctggtcggcacgggcagggtagaagcctggaggctgaggacaaaatgacgcatcgaatcctccgtgccgcccaggaaggtgacctgcccgagttgcgcaggttgctggagccccacgaagccggaggggccggcggtaacataaatgcgagagacgctttttggtggaccccactgatgtgcgccgctcgggccggccagggcgccgctgtaagctacttactgggaaggggggcagcatgggtaggcgtatgtgagctcagcggcagagacgccgctcaattggccgaggaggcgggctttccagaggtggcccgtatggtcagggagagccatggagagacgaggtctcctgagaatagatcgccaactccatcccttcagtattgcgagaactgcgacacccatttccaagactccaaccatagaacgagcactgcgcacttgttaagcttgtcccagggacctcagccccctaatctgcccctcggcgtacctataagctccccagggttcaagttactccttcggggcggctgggaacctggaatgggcctcggaccacgaggggagggccgggccaatcctatcccgacagtgcttaagagggaccaggaaggtctgggataccgctctgcccctcagcctcgagtcacccacttccccgcgtgggatacacgggctgtggcagggagagagcggccgccccgggtcgccaccctcagctggagagaggagcgccgtagagaggaaaaagatagagcatgggaacgggacttgaggacatatatgaacttagagttctag

SEQ ID NO: 117698 - DNA, 597 bp, Artificial Sequence
  Description of Artificial Sequence: Synthetic coding sequence
atgagtagacccctgctgataaccttcactcctgctacggacccctctgacctgtggaaggatggccagcagcagcctcaacctgaaaagcccgagagtaccctggatggagccgccgccctggctttttacgaggctctgattggtgacgagagttctgcccctgattcacagcgctctcaaactgaaccagcccgcgaaaggaagcgaaagaaacgcagaattatgaaagcccccgcagccgaggctgttgccgaaggcgcctcgggaaggcacggacaggggagatctctggaggcggaagataagatgacccaccgcatcctcagggccgctcaggaaggagacctgcccgaacttagacgtctgctcgagcctcatgaagccggaggggcaggaggcaacatcaatgcccgcgatgctttctggtggacacccctgatgtgcgccgctcgggcagggcagggggctgcagtcagttacctgctgggcagaggggcagcatgggttggggtgtgcgagctgtccgggcgagacgccgcccagcttgccgaggaggctggctttcccgaggtcgccagaatggtgcgcgagtag

SEQ ID NO: 117699 - DNA, 1071 bp, Artificial Sequence
  Description of Artificial Sequence: Synthetic coding sequence
atgagtcggcctttattgattactttcactcctgcaacagacccaagcgatctttggaaagatgggcagcagcaacctcagccagaaaaacctgaaagcacgcttgatggtgctgccgcactagcattttatgaggccctaataggcgatgagtcaagcgcacccgatagccagagaagccaaaccgagcccgcgcgggaacgtaagagaaaaaagaggcgcatcatgaaggcgcctgctgccgaggcagtcgccgagggcgcatccggaaggcatggacagggccgatcactcgaggccgaggacaaaatgacccatcgaatactgcgcgctgcacaggaaggtgacttacccgagctgcgacgacttcttgaaccccatgaggctgggggcgcgggtggaaacattaatgctcgcgacgctttctggtggacccccctcatgtgtgcagccagggccggccagggcgccgcggtgagctacctactggggagaggggccgcgtgggtgggcgtctgcgagctctcgggaagagacgctgctcagctggcggaggaggcaggattcccggaggtcgccagaatggtccgtgagtctcacggagagacacggtctccagagaacaggagtccaacgcctagcctgcagtactgtgagaattgtgacacccacttccaggatagtaaccatcgaaccagcactgcccatcttctttctctcagtcaaggcccccaacctcccaatctgccactcggcgtgcccatcagcagccctggctttaaacttctgctgagaggtggttgggagcctggaatgggtctgggccccaggggtgagggcagagccaacccaattcccacagtgctgaagagggaccaagaaggcctgggctatcggagcgcaccccagccgcgcgtgacgcacttccccgcttgggatacccgggctgtcgccggtcgcgagcgccctccacgggtggctactctttcctggagagaggaaagacgacgagaagagaaggatagagcctgggagcgagacctgcgcacttatatgaatctggagttttag

SEQ ID NO: 117700 - DNA, 597 bp, Artificial Sequence
  Description of Artificial Sequence: Synthetic coding sequence
atgagccggcccctccttatcacgttcacgcccgctaccgatccgagcgacctgtggaaggacgggcagcagcagccacagccagagaagccagagtcaacactcgatggcgccgccgctcgcgccttctacgaggccctcatcggagatgagagctccgccccagactcgcagagatctcagactgagcccgctcgtgaacgcaagcgtaaaaagcgcaggatcatgaaggcaccagccgccgaggccgtagccgagggggcatcggggcggcatggccaaggcagatccctggaggccgaagataaaatgacacatagaatcttacgtgccgcccaggagggagaccttcctgaacttcgtagactcctagagccccacgaggccggaggcgcgggaggcaacatcaacgcccgagatgcgttttggtggacacctttgatgtgtgcggcgcgggctggtcagggtgccgcggtgtcctatcttctcggcagaggtgccgcttgggtgggcgtctgcgaattgtcaggacgcgacgccgcacaactagctgaggaggccggcttcccagaagtggcgcgtatggtgcgagagtag

SEQ ID NO: 117701 - DNA, 1071 bp, Artificial Sequence
  Description of Artificial Sequence: Synthetic coding sequence
atgtcacgccctcttctaatcacattcactcctgccacagatcctagtgatctgtggaaagacggccagcaacagccccagcccgagaaacctgaatctactctggacggcgcagccgccagagccttttacgaggcgttgatcggtgacgagagcagcgctccagatagtcagaggagccaaactgagccagctcgtgaaagaaagcgaaagaagcgacgaattatgaaggccccagccgcagaagctgtggctgagggagcgtcagggcggcacggtcagggtcggtcactggaggccgaagataaaatgacccatcgcattttgagagccgctcaagagggtgacctgcccgagctacgtaggttattagagccccacgaggccgggggcgccggcggcaacattaatgcgcgtgacgcgttttggtggacgcctctcatgtgtgccgcccgtgccggacaaggtgcagctgtctcgtatctgcttggccgcggtgctgcttgggttggcgtgtgtgagctcagcggcagggatgctgcccagctcgctgaggaggccgggtttccagaggtggcccggatggtgagagaaagccatggggaaacccgcagccctgagaatcggtcaccgactcctagcttacagtactgcgagaactgcgacacacattttcaggatagtaaccaccgtacctctacagcacacctgctgtcgctttcccagggccctcagccacctaatctgcctctcggtgtgccaatttcaagtcctggcttcaagctcctgctaagaggaggctgggaacctgggatgggtttaggacctagaggagaaggacgagccaaccctatacctaccgtgctcaaacgggaccaggagggcctaggctaccgtagtgcccctcagcccagagttacccattttccggcctgggatacgcgcgccgtggccggaagggagagacccccaagggtagcaacactgagttggcgggaggaacgccgaagggaagaaaaagacagggcttgggaaagagatctgaggacttacatgaaccttgagttttag

SEQ ID NO: 117702 - DNA, 324 bp, Artificial Sequence
  Description of Artificial Sequence: Synthetic coding sequence
atgtccaggcccctgctcatcactttcaccccagccaccgatcccagcgacctgtggaaagatggccagcagcagccacaacctgaaaaacccgagtcaaccctagacggggcggcggctcgcgctttctatgaggcacttatcggggacgagagcagcgctcctgatagccagaggagccagacagagcctgctagggaaagaaaaaggaagaagaggagaatcatgaaagcacccgctgcagaggccgtggccgaaggcgcctccggcaggcatggtcaaggccgaagtctggaagctgaggataaaatgacccataggtag

SEQ ID NO: 117703 - DNA, 1071 bp, Artificial Sequence
  Description of Artificial Sequence: Synthetic coding sequence
atgtcaaggcctctgctgattactttcaccccagcaaccgacccgtccgacctgtggaaggacggccaacagcaaccacagcccgaaaagcccgagagtacactcgatggggccgctgcaagggccttctatgaggcgctcatcggagatgaaagctccgcccccgatagtcagcgttctcaaacggagcctgcacgagagagaaagaggaagaagaggaggattatgaaagcacctgctgctgaggccgtggccgagggagcaagtggaaggcatgggcagggacggagcttggaagccgaagacaagatgacacaccggatcctccgggccgcgcaagagggagatctgccagagcttaggcggctgctcgaaccccatgaggctggtggggccgggggcaacatcaacgctcgggatgcattttggtggacaccattaatgtgtgcagctcgagcaggccagggcgcagccgtatcctacttactcggtcgaggcgctgcatgggttggagtatgcgaactctctggccgggacgccgcacagctggcggaggaggcgggattcccagaggtcgctagaatggttcgggagagtcacggcgagaccaggtcacccgagaataggtcgcccactccctcactacagtactgtgaaaactgcgatacacactttcaggatagcaatcaccggacatcgaccgcacatctcctctccctgtcccagggtccacaaccgcctaatctccccttaggggtccctatctccagtcccgggtttaagttgctcctgaggcggggctgggagcccgggatgggactcggcccaagaggcgagggtagggcaaatccgatccctaccgtcttgaaacgggatcaggaggggctaggatacaggagcgctcctcagcccagagtcacacacttccccgcttgggacactcgcgccgtcgcaggtagggagaggccccctagagtggcaacattgtcctggcgggaagagaggcgccgggaggaaaaagatagggcatgggaacgagatctgagaacgtacatgaatctggaattctag

SEQ ID NO: 117704 - DNA, 324 bp, Artificial Sequence
  Description of Artificial Sequence: Synthetic coding sequence
atgagcaggcctctcctcattaccttcacccccgctaccgatccgagcgacctgtggaaggatggccagcagcagcctcagcctgagaaaccagaaagcaccttggacggagctgccgcccgcgcattttacgaggcgctgatcggtgatgagagcagtgcacctgattcacagcggtcccagactgagccagctcgagaacggaaacgcaagaagagacggatcatgaaggcgcctgccgccgaagccgtggctgagggtgcctcaggaaggcacggacagggaagaagcctcgaggccgaggacaaaatgactcataggtag

SEQ ID NO: 117705 - DNA, 459 bp, Artificial Sequence
  Description of Artificial Sequence: Synthetic coding sequence
atgtcacgcccattactgattaccttcacgcccgctaccgacccctcagatctgtggaaggacgggcaacagcaaccccagcctgaaaaaccagagtccacactcgacggagcagcggccagagccttttatgaagcccttataggcgacgagagtagtgcaccggactcacagagatctcagactgagccggcccgggaacggaaacgtaagaagcggcgcattatgaaagcgcccgccgctgaagctgtggctgaaggggcttctggccgccacgggcagggacggagtcttgaagccgaagacaaaatgacccacagaattctgcgggctgcccaggagggcgatttgccggagctccgtcggttgctggagccccatgaagctgggggcgcaggcggcaacatcaacgccagggacgccttctggtggacacctttgatgtgtgccgctcgctag

SEQ ID NO: 117706 - DNA, 1071 bp, Artificial Sequence
  Description of Artificial Sequence: Synthetic coding sequence
atgtcgagacctctcttgattacctttacgcccgcgacagatccatcggacctgtggaaggatggccagcaacaaccacagcctgagaagccagagtcgaccctggatggggctgctgcactagcattttacgaggcactcatcggcgatgagagctcagctccggactcacagaggagtcagacggagccagcccgcgaacggaaaaggaagaagagaaggattatgaaggcaccggctgccgaggcagtggccgagggtgcttcaggacgccatggacagggaaggtccctcgaggctgaggacaaaatgacccatcggattctacgggctgcccaggaaggagaccttcccgaacttaggcgcctcttggagccacacgaagctgggggggctgggggcaatatcaacgcacgggacgcattttggtggactccactgatgtgcgcagccagggcgggccagggagcagccgtcagctatctgttgggacgtggtgccgcatgggtcggggtgtgtgagttgtccggcagggacgctgctcagcttgctgaagaagctgggttcccggaagtggctaggatggtccgtgagagccacggcgaaaccagaagccctgagaaccgatctcctacccctagcttacagtactgcgaaaattgtgatacacactttcaggatagtaaccaccgaacatctacagcacatcttctgtctctttctcaggggccccagccccctaaccttcctctaggcgtgcccatctcgagccccggattcaaattgctcttaagaggcgggtgggaaccagggatggggctgggccctcggggggaaggtagggctaatcctatccctactgtcctgaagcgcgatcaggaggggctgggttatcgttcagccccccaaccaagggtgacccacttcccagcatgggacacaagggccgttgccggccgcgagcgcccaccaagggtggctaccctgagttggagagaggaacggagacgcgaagaaaaagatagagcttgggagagagaccttaggacatacatgaacttggaattctag

SEQ ID NO: 117707 - DNA, 1071 bp, Artificial Sequence
  Description of Artificial Sequence: Synthetic coding sequence
atgagccgtccattgttaattacctttacgcccgcgaccgatccttcagatctttggaaggacggacaacaacagccccagcctgaaaagccggaaagcaccctcgacggagctgcagctcttgctttctatgaggcgctgattggcgacgaatctagcgcacctgactcgcaacgcagtcagactgagccagcaagagaacgtaaacgcaagaagcgccgaatcatgaaggcccctgctgccgaggccgtagctgagggcgcatcaggccgacacggccaaggtcgcagcttggaagctgaggataagatgacccatcgcatcctgcgcgccgcccaggagggagatctccccgagctgcgtagactgctggagccccacgaggctgggggggcagggggaaatatcaacgcacgcgatgccttttggtggactcccttgatgtgcgctgcccgtgctggccagggcgctgcagtctcttacctgttaggacggggcgctgcatgggttggtgtctgcgaattgtccggccgggatgctgctcagcttgccgaggaagcagggttcccagaagtagcccggatggtgcgagagtcccatggcgagactaggtcacccgagaacagaagccctaccccttcgcttcagtactgtgagaactgcgatacacacttccaagactccaaccaccgtacctcaaccgcacatctgctgagtttgagccagggcccccagccccccaacctgcctctcggagttcctatttcgagtccgggttttaaactgctcctgagaggagggtgggagcctgggatggggctcggtcctagaggcgagggccgtgccaaccccattcccacagtcctgaagagagatcaggaaggcctcgggtataggagcgctcctcagccccgtgttacccacttccccgcatgggacacccgcgcagtggcggggcgcgaacggcccccccgggtagccactttaagctggcgtgaggagaggaggcgggaagagaaagacagggcatgggagcgagacctcagaacgtacatgaacctcgaattctag

SEQ ID NO: 117708 - DNA, 498 bp, Artificial Sequence
  Description of Artificial Sequence: Synthetic coding sequence
atgagccgtcccttgctgattaccttcacaccagccacagacccatccgacctttggaaggatggccagcagcagcctcagccagaaaagccagaaagtacccttgatggcgcggctgcacgcgccttttatgaggccctcattggagacgagtcaagtgccccagattctcagcgatcacagacggaaccggcaagggagcgcaagcgtaagaagaggcggatcatgaaagctcccgccgcggaggctgtagccgagggagccagtggtcgacacggccagggtcgaagcctcgaggcagaggacaaaatgacacatcgcatattaagagctgcgcaggaaggtgatttgcccgaactgagacgcctgcttgagcctcatgaggctgggggagctggaggaaacattaacgcccgggatgccttttggtggacaccactgatgtgcgccgctcgagccggacaaggggccgcagtatcctacctgctgggcagatag

SEQ ID NO: 117709 - DNA, 273 bp, Artificial Sequence
  Description of Artificial Sequence: Synthetic coding sequence
atgtcccggcctcttctcatcaccttcactcctgcaactgatcctagcgacctgtggaaggatgggcagcagcaaccccagcctgaaaagccagaatccaccttggatggcgccgccgcactagcattctatgaggccttaattggggatgagtcctctgcccccgactcacagcgctcacagactgagcctgctagagagcgcaaaaggaaaaaaaggagaatcatgaaggctcctgcagctgaggccgttgctgaaggagctagtggttag

SEQ ID NO: 117710 - DNA, 1071 bp, Artificial Sequence
  Description of Artificial Sequence: Synthetic coding sequence
atgagccgccctctgttgattacattcaccccggccaccgatccatcagatctctggaaggacggacaacaacagccacagcctgagaaacctgagtctactctcgatggagccgccgcgcgtgctttttacgaagccctgatcggtgatgagtcttccgccccagactctcaacgatcccagactgagccagctcgcgaacgaaaaaggaaaaaacgcaggatcatgaaggctcctgctgcagaggccgtcgccgagggggcctccggccgccacggccagggccgttctctggaagcagaggacaaaatgacccaccgcatactgcgcgccgcccaagaaggggacctcccagagctgcgccgtctgctggaaccccacgaggcaggaggcgccggaggcaacatcaatgccagggatgcattctggtggacccccctgatgtgtgccgcccgcgcaggccagggggcagcagtcagctacctgctgggcaggggcgccgcctgggtcggcgtctgtgagctctccggacgggatgcagctcagttggcggaagaggctggctttccggaggtggcccggatggtaagagagtctcatggggagacgaggagcccagaaaatcgatctccaacccctagcctacagtattgtgaaaactgcgatacacacttccaggactccaaccacaggacctctaccgctcatctcctgagtctttctcagggcccccagccgcctaacctaccactgggcgttccaatcagtagccctggcttcaaattgctgctcagaggcgggtgggagccgggaatgggactgggtcctcgcggcgaggggagagctaatcctattccaacagtactgaaacgagaccaggaaggtctcggctatcgcagcgcaccccagcccagggtgacgcacttccctgcctgggacaccagagcggtcgccggtagggagagaccaccccgcgtcgccacactcagctggagggaagagagacggcgcgaggagaaggacagggcatgggagagggatctgagaacttatatgaacctggagttttag

SEQ ID NO: 117711 - DNA, 273 bp, Artificial Sequence
  Description of Artificial Sequence: Synthetic coding sequence
atgtcacgaccacttctcatcaccttcacccctgctacggatccatctgatctgtggaaggacggccaacagcagccacagcccgaaaagcctgagtctaccctggacggagcagctgctcttgctttctacgaggcgttaattggcgacgagagcagcgcgccagactctcaaaggagccaaactgagcctgcccgggagaggaaacgcaaaaaaaggagaattatgaaagcaccagccgcggaagcagttgccgagggtgcttcggggtag

SEQ ID NO: 117712 - DNA, 1071 bp, Artificial Sequence
  Description of Artificial Sequence: Synthetic coding sequence
atgtcgcggccactgctcatcacatttacccccgcaaccgatcctagtgatttatggaaggacgggcagcagcagccgcagccagaaaaaccagagtccaccctggatggtgctgctgcccgtgcattttacgaggctttaataggggatgagtcatccgcacccgactcacagcgctcccagaccgagcctgcgagggagcgcaagcggaaaaagcggcgcattatgaaggcaccagcagccgaagccgttgcagagggtgcttcggggcggcatggacagggtagatcccttgaagcagaagataagatgacacatcgaatactgcgcgccgcccaggagggggacctgcccgagctgagacggctgctggagcctcatgaagctggtggcgccggaggaaatattaatgcgagggatgcattttggtggaccccccttatgtgtgccgctcgggctggtcagggagctgccgtgtcttatctgttaggacgcggcgctgcgtgggtgggcgtttgcgagctgagtggccgcgatgccgcgcaactggccgaagaagctggttttcccgaagtggccagaatggtgcgagaaagtcatggggagactcggagcccagagaaccgcagcccaacgcccagcttgcaatattgcgagaactgcgatacccatttccaggactccaatcatagaactagcacagcccatctgctgagtctcagccaggggcctcagccccctaaccttcctctcggggtgccgatttcttctcctggtttcaagctgctgctgagagggggatgggagcccgggatgggcttgggcccccgaggagaaggccgtgccaaccccatccctaccgtgctgaagcgagaccaggagggtctgggctacaggagcgcccctcagcctagggtcacacactttcctgcctgggacactcgggcggtggcgggacgcgagcgacctcctagagtcgctacccttagttggcgggaggagcgccgccgagaagagaaagatcgggcatgggaaagagacctgcgcacttacatgaacctggaattctag

SEQ ID NO: 117713 - DNA, 597 bp, Artificial Sequence
  Description of Artificial Sequence: Synthetic coding sequence
atgtctcgccctctcctgatcactttcactcctgccaccgacccatcggacctttggaaggatggccagcagcagccacagcctgagaaaccggaaagcacacttgatggcgctgctgcacgcgccttctatgaggcgctcattggcgacgagagttctgcacctgactctcaaaggtcccagaccgagccagcaagagagcgtaaacgaaaaaagaggcgcattatgaaggcccccgccgcagaagccgtcgccgagggcgcaagtggaagacatgggcagggcaggtccctggaggcggaggataagatgacccatcgcatcctgcgcgcggcccaggagggcgacctcccagaacttaggcgtctccttgaacctcacgaagccggtggggctggtgggaatattaatgctcgggatgctttttggtggactcccctgatgtgcgctgcccgagccggccaaggggccgcggtgtcctacctgctcggacgtggggccgcgtgggtgggcgtttgcgagttaagtgggagggatgctgctcagcttgcggaggaagccggatttcctgaagtcgccagaatggtgcgtgaatag

SEQ ID NO: 117714 - DNA, 324 bp, Artificial Sequence
  Description of Artificial Sequence: Synthetic coding sequence
atgtcgcggccactgctcattactttcacccccgctacagatccatccgatctgtggaaagacgggcagcagcaaccacagccggagaagcctgagtcaaccctcgacggcgccgccgcattggccttctacgaagcactgataggggacgaaagctctgccccggactcacaacggtcccagacagaacccgcacgcgaaaggaagagaaagaaaaggcggattatgaaggctcccgctgcggaggcggtggcagagggagcctcaggccgacacgggcaaggaaggagcttggaggccgaagacaagatgacgcaccgttag

SEQ ID NO: 117715 - DNA, 324 bp, Artificial Sequence
  Description of Artificial Sequence: Synthetic coding sequence
atgagccgtcctctgttgattacctttacacccgccacggatccctccgatttgtggaaggatggccagcagcagcctcaacctgaaaagcccgagagcactctcgatggagccgctgctctggcgttttatgaggccctgatcggcgatgagtctagcgccccggattctcagagatctcagacggagccagcacgagagcgtaagcgcaaaaaaaggcggatcatgaaggcccctgcagccgaggcggtggccgaaggcgctagcggaaggcacgggcagggtaggtcgctggaagctgaggataaaatgacacacaggtag

SEQ ID NO: 117716 - DNA, 273 bp, Artificial Sequence
  Description of Artificial Sequence: Synthetic coding sequence
atgtctcgccccctgcttataacgttcactcctgcaaccgacccgtccgacctctggaaagatggccagcagcagccacaacccgagaaacctgaaagcacgcttgacggggcagcagcccgggctttttacgaagccctgatcggcgacgaatctagcgcaccagactcccagaggagtcagacagagcctgctagagaaagaaaaaggaagaaacgcagaatcatgaaggcccctgccgctgaagccgttgcagaaggcgcttctgggtag

SEQ ID NO: 117717 - DNA, 273 bp, Artificial Sequence
  Description of Artificial Sequence: Synthetic coding sequence
atgtcacgaccactcttgatcacttttacaccggctactgatccttccgacttgtggaaagacggacagcagcagcctcaaccagaaaaacccgaatccacattagacggagcagccgcccgggccttctatgaggctctgatcggagatgagagctccgccccagactctcagcgtagccagaccgagccagctcgggagaggaaacgtaagaagcgcaggatcatgaaagcaccagccgctgaagcagtggctgagggcgcctcgggttag

SEQ ID NO: 117718 - DNA, 459 bp, Artificial Sequence
  Description of Artificial Sequence: Synthetic coding sequence
atgtcacggcccctcctaatcacattcacacccgcaaccgacccatccgacctgtggaaagacggacaacagcagccacagccggaaaaaccggagtccacactcgatggggctgctgcccgcgctttctatgaggccctgatcggggatgagagctccgcaccagattctcagaggtcgcagacagagccagcacgcgagaggaagaggaagaagagacgaatcatgaaggcccctgctgctgaagcagttgctgaaggcgcatccggccggcatggtcaaggaaggagcctggaggctgaggataaaatgacacaccgtatactgcgtgcagcacaggagggcgacctacccgagctacggaggctattagagccacatgaagccgggggagcaggtggaaacatcaacgcccgagatgctttctggtggaccccactcatgtgtgcggccagatag

SEQ ID NO: 117719 - DNA, 597 bp, Artificial Sequence
  Description of Artificial Sequence: Synthetic coding sequence
atgtcacggccgctactcattacttttactcccgcaaccgatccttcagatctctggaaggatggccagcagcagccccagcccgagaaacccgagtccacactcgatggggccgccgcccgggccttctacgaagctctcatcggagatgagagttctgctcccgattcccagaggagtcagacagagccggcacgcgaacgcaagaggaaaaagagaagaatcatgaaggctccagccgccgaggccgttgcggaaggcgcctcgggaaggcacggccaggggcgaagcctcgaggcggaagacaaaatgacccaccggattctccgcgctgcccaggaaggagatctgcctgaactacgtaggctgctagagccacatgaagccggcggtgcaggcgggaacattaatgcacgcgatgctttctggtggaccccactcatgtgcgccgctagagctggccagggggctgcagtgtcataccttctgggccggggggccgcctgggtgggggtctgtgaactgagcggcagggatgcagctcaattggccgaagaggccgggtttcctgaagtggcgaggatggtcagggagtag

SEQ ID NO: 117720 - DNA, 1071 bp, Artificial Sequence
  Description of Artificial Sequence: Synthetic coding sequence
atgtctaggcctctgctgattacctttaccccagcaaccgatccttccgacttgtggaaagatggccagcagcagccacaaccagagaaacccgagtccactttagacggagccgccgctctcgccttctatgaggctctgatcggagacgaatccagtgcacccgattcccagcgatcccagactgaaccggcacgcgagaggaaaaggaagaagaggaggataatgaaagcccccgctgccgaggccgtggccgagggagcttccggaagacacgggcagggccgcagcttggaagccgaggataaaatgactcatcggatcctgcgtgccgcacaggagggggacctccccgaactgcggcggttgctcgagccacatgaggccgggggcgcagggggaaacataaatgctagggatgcattctggtggactccactcatgtgcgctgcgagagccgggcagggagcagcggtgagctatctacttggaaggggcgcagcctgggtgggcgtctgcgaacttagcggacgagacgccgcccagctggccgaagaagccggctttcctgaagtggccaggatggtgagagaaagccatggagaaacacggagtcctgaaaacagatcccctactccatcattgcagtactgcgagaactgtgatacccactttcaggactcaaaccaccgcaccagcactgcacacctgttaagcttgtctcagggcccacagccccccaatctgcctcttggcgtgcctatatcctcaccggggttcaaactactgcttcggggcggttgggagcctggtatgggtttggggccccgcggcgagggacgggccaatcccatccccaccgtactcaaacgcgatcaggagggactggggtaccggtctgccccgcaaccccgggtgacacactttccagcttgggacacccgggccgtggccgggagggaaaggcctcctcgagttgctactttgagttggcgagaggaacggcgaagggaagaaaaagatagagcctgggagcgggatcttaggacttacatgaacttggagttctag

SEQ ID NO: 117721 - DNA, 1071 bp, Artificial Sequence
  Description of Artificial Sequence: Synthetic coding sequence
atgtcccgaccgctccttataaccttcacacctgcgaccgaccctagtgacctttggaaagacggacagcagcagccccagcctgagaagccggaaagtaccctggatggagcagccgcacgtgctttctacgaggctctcatcggagatgaaagttcagctccagattctcaaagatcacagacagagcccgccagagaacgtaaacgaaagaaacgcagaattatgaaggctcccgctgcggaggctgttgcggaaggcgcaagtggaaggcacgggcagggtcggagcttagaggctgaggataagatgactcaccgcatccttcgcgccgcccaggagggggatctccccgaactgagacggcttctggaaccacacgaggccggcggagctggtggtaatattaacgccagggacgccttttggtggaccccacttatgtgtgcagctcgtgccggacaaggggccgccgtgagctatttactggggaggggcgccgcctgggtcggagtttgcgagctctcaggccgggacgccgcacagttggctgaggaagccggatttcccgaagttgctagaatggtgcgcgaatcacacggcgaaacacggagccccgagaacagatcccctacaccctccctgcagtactgcgaaaattgtgacacccatttccaggattcaaaccaccggactagtaccgctcacttgctcagcctcagccagggccctcagcctcctaacttgccactcggagtccccataagtagtcccggatttaaacttctgcttagggggggctgggagccagggatgggcctgggcccccgaggggagggcagagctaatcccatccctaccgtcctcaaacgcgaccaggaaggattaggatatcgctccgcccctcagccaagagtcacccattttccggcatgggacacccgggctgtagccggtcgcgagcgtcctcctagagtggccaccctgtcctggagggaggagagacggagggaggagaaagatagggcctgggagagagatctgagaacatatatgaatctggagttttag

SEQ ID NO: 117722 - DNA, 1071 bp, Artificial Sequence
  Description of Artificial Sequence: Synthetic coding sequence
atgtctcggccactgctcatcaccttcactcctgcaaccgacccctcagatctgtggaaagatggacagcagcaacctcagcccgagaagcctgagtccacgctagatggggccgcagcccgcgcattttacgaagcgctgattggggacgagagttccgctcccgattcgcaacggagccagactgaacccgctcgcgaaagaaagagaaagaagcgccggatcatgaaggccccagccgctgaagctgtagccgagggtgcttccggacggcatggccagggccgcagccttgaagctgaggataagatgacccacagaatccttcgggctgcgcaggagggtgacctgcccgaactccgccgcttgttggagccacacgaggccggaggtgccggcggcaacatcaacgctcgggatgctttctggtggactccactcatgtgcgctgccagggccggacaaggcgcagctgtgtcttatttgctcggtcgcggcgcggcttgggtcggggtgtgtgaactctcagggcgggacgccgcccagctcgccgaggaggcaggctttcctgaagttgctcggatggttagggaaagccatggcgaaaccagatccccagaaaatagatcccctaccccctccctgcagtattgcgagaattgcgatacccatttccaagactctaatcatcggacttcaactgcccatcttctgtccttaagtcaggggccgcagcctccaaatctgcctttgggcgtcccgatctcctcaccaggttttaaactgctcttgagaggcgggtgggagccggggatgggcttaggcccccgaggcgaaggtagggccaaccctatcccgaccgtcctgaagcgcgatcaggagggactgggatatcggtccgcaccacagccgcgcgtgacccactttccagcatgggacacccgcgcagtggccggacgtgagcgtcctccgcgagtggccaccctgtcttggcgcgaagagcgtagaagggaagaaaaggacagggcctgggagagagacttgcgaacatacatgaatctggagttctag

SEQ ID NO: 117723 - DNA, 498 bp, Artificial Sequence
  Description of Artificial Sequence: Synthetic coding sequence
atgagtaggccgctgctcataaccttcacccccgctacagacccaagtgacctgtggaaggacggccagcagcagccacagcctgagaagccagagtcaaccctggatggcgcggctgctctggcattttatgaagccctgatcggcgatgagtctagtgctcccgactctcagaggtcacagacagaacctgccagagagaggaagcgaaagaaaagacgcattatgaaagctcctgccgcagaggcggttgccgaaggcgccagcggccgacatggacagggaaggtctttggaggctgaggacaagatgacccaccgaattctgagagcagcccaagaaggagacctgccagagctgagacgtctcctggagccccacgaagccggaggggcaggaggtaatatcaatgccagagatgctttttggtggactcccctgatgtgcgcggctcgggccgggcagggagccgccgtgagctatctgttgggcaggtag

SEQ ID NO: 117724 - DNA, 273 bp, Artificial Sequence
  Description of Artificial Sequence: Synthetic coding sequence
atgtcacggccgctgttgatcacctttacaccggcaactgatccgagcgacctgtggaaagacggtcaacagcagcctcagccggagaagccggaatccaccctcgatggggctgcagccagagccttttacgaagccctgataggggatgaatcgagcgctccagatagccagaggtcacagaccgagcctgcacgcgagcgaaagcgcaaaaagcggcgcatcatgaaagcacctgcggctgaggccgtggccgagggcgcttccggctag

SEQ ID NO: 117725 - DNA, 324 bp, Artificial Sequence
  Description of Artificial Sequence: Synthetic coding sequence
atgagccgccctctgctgatcacttttacgcctgctactgatcccagcgatctatggaaggacggacagcagcaaccccaacctgagaagcccgagagcacgctagacggcgccgccgcgcgagcattctacgaggctctgataggtgatgagagtagtgcgccagatagtcagagatcccagacagaaccagctcgtgaaaggaagcgaaaaaagagacgcatcatgaaggctcctgccgccgaggccgtcgcagagggggcaagcggcagacacggacaggggagatcacttgaagccgaggataaaatgacacatcggtag

SEQ ID NO: 117726 - DNA, 1071 bp, Artificial Sequence
  Description of Artificial Sequence: Synthetic coding sequence
atgagcagaccactactcataacatttacaccagccaccgatccgagtgacctgtggaaagacggacagcagcagcctcagcctgaaaaaccagagtctactctggacggcgctgccgccagggccttttacgaagcactgataggggacgagtcctccgccccagactcacagcggtctcaaactgagccagctcgggagagaaagcggaagaagaggcgtattatgaaggcgcctgcagccgaagcggtggccgagggtgcttctgggcggcatggacaagggcgctcgctggaggctgaggataagatgactcataggattcttagggctgcccaggaaggcgatctgccggagctgcgccgcttgctggaacctcatgaggcggggggcgcaggaggaaatatcaacgcccgggacgctttttggtggacccccctgatgtgtgcagcacgggctggccagggcgcagctgttagctaccttctcgggcgcggggcagcttgggtgggggtgtgcgagctgtctggacgtgacgctgctcagctggcggaagaggcggggttccctgaagtagcccgcatggtccgagaaagccacggtgaaacacgctcaccggaaaatagaagtccgaccccatctcttcagtattgcgaaaactgcgatacacactttcaagatagcaaccaccggacatccacggctcacctgctttctttatcccagggccctcaaccccccaatctgcctttgggcgttcccattagttcaccaggctttaaattattgctgagaggagggtgggagcctggaatggggctcgggccacgtggagaaggtagagctaatcctattccgacagtcctgaagcgcgatcaggagggcttgggctatagaagcgccccccagccacgggtgacccatttccccgcctgggatactagagccgtggctgggcgggaacgaccaccaagggtagcaaccctaagttggcgggaggaaaggagaagggaggagaaggaccgggcctgggagcgggatctgagaacctacatgaatctcgaattctag

SEQ ID NO: 117727 - DNA, 1071 bp, Artificial Sequence
  Description of Artificial Sequence: Synthetic coding sequence
atgtcgcgccctctgctcatcacttttacgcctgctaccgatccttccgatctgtggaaggacggtcagcagcaaccacagccagaaaaaccggaatcaactctcgatggagccgctgccttggccttctatgaggccctgataggtgacgagagctctgcacccgatagccaaagaagccagaccgagcctgcaagagaacggaagcgaaagaaacgccgtatcatgaaggcgccagccgctgaggctgtggccgaaggggcaagtggccgtcatggacaggggcgttctctggaggctgaagacaagatgacccaccgcatcttgagggctgctcaggagggggatctacccgagctgcgacggctcctggaaccccatgaggctggcggcgctggcgggaacatcaacgcacgcgacgcattctggtggacacctttgatgtgcgcagcaagggccgggcaaggcgcagccgtctcatatctcctcggccgcggagcagcctgggtgggggtctgtgaacttagcggtcgggatgctgcgcagttggcagaggaggcaggtttccctgaggtggctcgtatggtgcgcgagtcacacggtgagacccgctctccagaaaaccgctcccccacaccatcactccagtactgtgaaaactgtgatacgcactttcaggactccaaccaccggacttccacggctcatcttttatccctgagccagggcccccagcctcctaacctccccctcggcgttccaatctcctcacccggatttaaactgctgttgcggggcggatgggagcctggcatggggctcggccctcgcggggaaggccgggccaaccctattccgaccgtactgaaacgagatcaggaggggctgggttacagaagcgctccacagccacgtgtgactcatttccctgcttgggacacgcgagcggtggctggacgagaaagaccccctagagtggccactctgtcatggcgcgaagaacgcaggcgggaggaaaaggatcgcgcctgggaaagggatcttcggacatacatgaacctcgagttctag

SEQ ID NO: 117728 - DNA, 1071 bp, Artificial Sequence
  Description of Artificial Sequence: Synthetic coding sequence
atgagtcgcccactactcattacttttactccagccaccgacccctcagatctctggaaagacgggcagcagcaaccgcaacccgaaaagcctgagtcaacgttggatggtgcagccgcccttgctttttacgaagcactcattggggatgagtcctccgcccccgattcccagaggtcacaaacagagcctgctagggaaagaaagagaaagaaacgtcgaattatgaaggcacccgccgcggaagcagtcgctgagggggccagcggacgccacggacagggcagaagccttgaggctgaggataagatgacacaccggatcctccgcgctgcccaagagggagacctgccagagctgcgccgactgctcgagccacatgaggcaggaggagccggcgggaatattaacgcccgggacgccttttggtggacccctctgatgtgcgccgcacgagccggccagggcgccgccgtgtcttacctgctggggcgcggtgccgcctgggtgggggtgtgtgaactcagcggacgcgacgctgctcagctggccgaagaagcagggttcccggaggttgcacgaatggtccgtgaaagccacggagagactaggtcaccagagaatcgctcccctactccttcgctccagtactgtgaaaattgtgacactcactttcaggattccaaccatagaaccagtacagcccatttgctgtctctaagccagggcccccagcctccaaacctgccgctcggagttccaattagttcacctggttttaaactgttactacgggggggatgggagccgggcatgggacttgggcctagaggggagggcagggctaatccaatcccaacagtcttgaagagagaccaggaggggctggggtacagatcagcaccacaacccagagtgacacactttccagcgtgggacacgagggccgtggctggacgcgagcgcccaccacgcgttgccaccttaagctggagagaagagcgcagacgagaggaaaaagaccgagcctgggagagagacttgcgaacttacatgaatctcgaattttag

SEQ ID NO: 117729 - DNA, 273 bp, Artificial Sequence
  Description of Artificial Sequence: Synthetic coding sequence
atgagcagaccccttctgatcactttcacacctgccacagacccctcagatttgtggaaggacggccagcagcagcctcagccagaaaaaccagagtctactcttgatggtgcagccgccagagccttttatgaagctttgatcggcgatgagtcaagcgcaccagacagccagcgatcccagacagagccagcacgggagcggaagcggaagaaaaggcggatcatgaaagctcccgccgccgaagccgtggccgaaggcgcatcgggatag

SEQ ID NO: 117730 - DNA, 1071 bp, Artificial Sequence
  Description of Artificial Sequence: Synthetic coding sequence
atgtctcgacctttactgatcacctttacgcccgctaccgacccttccgacctatggaaagatggtcagcaacagcctcaacctgaaaaaccggaatccacactcgatggcgccgccgcgttagccttttatgaggccttaatcggagatgaatcttctgcacccgacagtcaaaggtcccaaactgagcctgcccgtgagcgaaaaaggaaaaagcggcggataatgaaagcacccgccgcagaggctgttgctgagggcgcatctggaagacatggccaaggtcggagtctcgaggcagaagacaagatgacacaccgcattctcagagctgctcaggaaggcgatctccccgagttaaggagactgctggagccccacgaggccggaggagcagggggcaatattaatgctagggacgccttctggtggacgcctctgatgtgtgctgcccgggcgggccaaggggccgccgtatcctatttgctaggtagaggggccgcctgggtgggcgtgtgtgagctgtccggcagagacgccgctcaattggcggaagaggcaggattccccgaagtggcccggatggtccgggaatcccacggggagacacgcagccccgaaaaccggagtccgacgcctagcctccagtactgcgagaactgtgatacccattttcaagacagtaatcatcggaccagtacagctcacttgttgtccctcagtcaaggacctcagccaccgaacttgccactgggggtgcccatttcttctcctggctttaagctgttactgcggggcggttgggaacccggcatgggactgggaccccgcggcgagggccgggccaacccgattccaacagtattgaaacgggaccaggaaggcctcgggtatcgatctgccccccagcccagagtgacccactttcccgcttgggatacccgggccgtagcagggagagaaagacctcccagagttgcaaccttatcctggcgcgaagaacgaagaagagaggagaaggatagagcctgggagagagaccttagaacctacatgaaccttgagttctag

SEQ ID NO: 117731 - DNA, 498 bp, Artificial Sequence
  Description of Artificial Sequence: Synthetic coding sequence
atgtcgagaccacttctgattacttttacaccagccacggatccgtccgatctgtggaaagatggtcaacaacaaccgcaacccgaaaagcctgagtccaccctggacggggcagccgcacgggccttctacgaggctctgatcggagacgaatctagtgcaccagattcccagcgcagccagaccgagccagctcgagaacggaagcgaaaaaagcgccggatcatgaaagccccagccgccgaggcagtggctgaaggagcatctggacgtcatggccaaggtcggtcattggaggctgaggacaaaatgacccacaggatattgcgtgcggctcaggaaggagacctgccagagctccgccgcttactggagcctcacgaggctggcggagctggtgggaatatcaatgccagagatgccttctggtggaccccactgatgtgcgcagcaagagccgggcagggagctgccgtgtcttacctcctcggccggtag

SEQ ID NO: 117732 - DNA, 459 bp, Artificial Sequence
  Description of Artificial Sequence: Synthetic coding sequence
atgtctcgccccctgctgatcactttcacgcccgcaactgaccctagtgacctgtggaaggacggccagcaacagcctcagcccgaaaagcctgaatctaccctggatggggcagcagctcgcgccttctatgaggctttaatcggagacgagtcgagtgcacccgacagtcagaggtctcagacagaacccgcccgtgagaggaagagaaagaagcggagaatcatgaaggcacccgctgcagaagccgtggcagagggtgcttccggaaggcatggacaagggaggtcattagaagcggaagacaagatgactcatcggatcctccgagccgctcaggaaggcgacctgcccgaactccgtaggctactcgagccacacgaggctggcggcgcgggcgggaatattaacgcgcgagatgccttttggtggactcctctgatgtgcgcagccagatag

SEQ ID NO: 117733 - DNA, 4509 bp, Artificial Sequence
  Description of Artificial Sequence: Synthetic coding sequence
atggctgaccgtttttcacggtttaacgaggacagagacttccaggggaaccattttgaccagtatgaggaggggcacctggaaatcgaacaagctagtttggataagccgattgaaagcgataacattgggcaccggctgctgcaaaaacatggatggaagcttggccagggactggggaagtctctgcagggcagaactgatccgatccctatcgtggtgaaatacgacgtgatgggcatgggcaggatggaaatggagcttgattacgctgaagatgcaacagaacgccggcgagttctggaggtggagaaggaggatacagaagagctcagacagaagtacaaggattacgtggacaaggagaaggccatcgcgaaagccctcgaggatctccgtgccaacttttactgcgaattgtgtgataaacagtatcagaagcaccaggaatttgataaccatattaactcttatgatcacgcacataagcagcgcctgaaggacctgaaacaaagagaatttgctagaaatgtgtcttcccggtcacgaaaggatgagaaaaaacaggaaaaagcactgagacgtctccatgagttggctgaacaacgaaagcaggccgaatgtgcccccggatccggccctatgttcaaacccacgactgtggctgtggatgaggaagggggcgaggacgacaaggatgaatcagctactaactctgggaccggcgcaaccgcgtcctgtgggctcgggagcgaattctccacggacaaggggggcccctttactgctgttcaaatcactaacaccactgggctggcacaggcccccggattagcctcgcaggggatctccttcgggatcaaaaacaacctcggtactcccctgcagaagcttggcgtttcgttcagcttcgccaaaaaggctccagtgaaattggagagtatcgctagcgtcttcaaagatcacgcagaggagggcactagtgaggacggaactaagcctgacgaaaaaagtagtgatcaggggctgcagaaggtcggggacagcgatggatcatccaatttggatggaaagaaggaggacgaggacccccaggatggtggctcgctcgccagtacactttcaaaactcaaacgcatgaaacgcgaagaaggcgccggagccaccgagcccgaatactaccactatattcctcccgctcactgtaaagtaaaaccaaacttcccgttcctgttatttatgagagcatctgagcagatggacggcgataacactacccatcccaagaatgcgcctgagagtaagaaagggagcagtcccaagcccaagtcttgcattaaggccgcagcatctcaaggagcggagaaaaccgtaagcgaagtctcagagcaacctaaagaaacgtccatgacagagccatccgaacccgggtctaaagcagaagccaagaaggcactgggtggggacgtgtctgatcagagcctcgagagccactctcaaaaggtctctgaaacgcagatgtgtgaatctaattcttctaaagaaacctccctcgctacgccagccggtaaggagtcgcaggagggccccaagcacccaacaggaccattcttccccgtcctctcaaaggacgagagtactgctctgcagtggccttcagaacttctcattttcaccaaggccgagccttctattagctattcctgtaaccctctgtattttgacttcaagctttcacggaacaaggatgcaaggaccaaggggactgaaaagcccaaggatatcggctctagtagtaaggatcacctccaggggctggatccgggagagcctaacaagagtaaggaggtgggcggagaaaaaatagtaagaagctccggcggaagaatggacgccccagcttctggaagtgcctgctctggccttaacaagcaggaaccagggggctctcatggatcagaaactgaagacactggacggagcctgccatctaaaaaggaacgatccggtaagtctcacaggcacaagaagaagaagaaacataaaaagtcgagcaagcataagcggaagcacaaggcggataccgaagagaaaagcagcaaggctgaaagcggcgagaagtctaaaaagcgcaagaagagaaagagaaaaaaaaacaaatctagcgcacctgctgactcagagaggggaccgaagccagagccaccaggatccgggagtccagcccccccccggcgacggcgccgcgcacaggatgactcacagcggcggtctctgcccgccgaagaaggatcctccggtaaaaaggatgaaggcgggggaggtagcagcagtcaagaccacggcggccggaaacataagggcgagctgcctccgagttcctgccagcgccgcgccggcactaagaggtcctcccgctctagtcacaggtcccagccatccagcggcgacgaagattcagacgacgccagctcccataggttgcaccagaagagcccttcccagtatagcgaggaggaggaggaagaagacagtggtagtgaacactccagatcaagaagccggagtggacggcgtcactcctcacatcgctctagtcgtaggagctactccagtagttcggacgcttctagcgatcagtcttgttactctcgacagcgcagctattccgatgattcatacagcgactacagcgaccggagccggaggcactcaaagcggagccatgactcagacgactcggattatgcctctagcaaacatcgaagtaaacgccataaatattccagttctgacgatgactattccctatcctgttcgcagtcacggtcaagatcacgctctcatacaagagaaagatctaggtctcgcggccgctccagatcctccagttgttctaggtctagaagcaaacgtagaagtagaagcaccactgctcattcttggcagaggtctcggtcttactctcgcgacaggtcccggtccacacgcagtcccagccagcggagcggctcacgcaaaaggtcctggggacacgagtctccggaagagcgtcacagcggtagacgggatttcatccgatcaaaaatctatcgatcccagagcccacactatttccggtccggccggggggaaggtccaggtaagaaagatgatgggaggggcgatgactccaaggccacaggccccccatcgcagaatagcaatatcggaacaggccgaggaagtgaaggcgactgctcacccgaggacaagaacagcgttacagcaaagctgctgctcgagaaaatccagagcaggaaggtagagagaaagccaagtgttagcgaggaggtgcaagcaactcctaataaagcaggtcccaaattgaaggatcctccgcagggctacttcggaccaaagctgccgccgagcctgggaaacaagcctgttctaccgctgatcgggaagctgccagctacgaggaagcctaataagaaatgtgaggagtctggactggagcgcggtgaggagcaagagcagagtgagacagaggagggaccccctggcagctcagacgcgctcttcggccatcaatttccatctgaggagactacaggacccctgctggatcctccaccagaagagtctaaatcaggagaagctacggcagaccacccggtcgcaccattgggtacgccggcccacagtgactgctacccaggggacccaactatctcccacaactacctccctgatccctctgatggcgacactctggagtccctcgattcatcttcacaacctggaccggtggaatctagtttgctcccaattgcaccagatcttgaacacttcccaagttatgccccaccatccggagatcctagcatcgagtctacagacggagcggaggacgcctcacttgccccgcttgagagccagccaatcactttcacgcccgaagagatggaaaaatactccaagctccagcaggctgcccagcagcatatacaacagcagcttctcgctaagcaggtcaaggcattccccgcttctgcagctctggcaccagccacaccagctttgcagcctatccacatacagcagccagctaccgcatccgctacctcaatcaccaccgtgcaacatgctatcctgcagcatcacgctgccgcggcagccgcggcaatcggaattcacccccacccccaccctcagcctttggcccaagtgcatcacattcctcagccacatctcaccccaatttcactctcccaccttacacattccatcatccccggacaccccgcaacattcctcgcctcacacccaattcacataatcccggcttctgctatacatccaggacctttcaccttccatccagtgccacacgcagcattgtacccaaccctcctcgccccacgcccggctgctgccgctgctaccgccctccacctgcacccccttctgcacccaatttttagtggccaggacttacaacacccacctagccacgggacctag

SEQ ID NO: 117734 - DNA, 4275 bp, Artificial Sequence
  Description of Artificial Sequence: Synthetic coding sequence
atgggaatgggccggatggagatggaactcgattacgcagaagatgcgaccgagcgtagacgcgtcctggaggttgaaaaggaagatactgaggaactgcgacaaaaatacaaagattatgtggataaggaaaaggcaattgcgaaagctttagaggatctgcgtgctaatttttactgcgaactttgtgacaagcagtaccagaagcatcaagagtttgataaccatataaactcttatgatcacgctcacaagcaacgcttaaaggatttgaagcagcgagagttcgcgcgcaacgtatcaagccgaagtcgtaaggatgagaaaaaacaggagaaggccctgagacgcttgcacgagcttgccgaacaaaggaagcaagccgaatgcgcccctgggtcagggccgatgttcaagccgaccaccgtggctgtcgatgaagaaggcggcgaagatgacaaggacgagtccgctaccaacagcggcaccggcgcgaccgctagctgcggcctcggttccgagttttcgacagacaaaggcggcccttttacagcagtgcagataacgaatacaactggactcgcccaggcgcccgggttggcctcccaggggatctccttcgggattaagaataatttaggaaccccgctccaaaaactcggagtatccttttcttttgcgaagaaagctcctgtcaagctggagagcatcgcctctgtcttcaaagatcatgctgaagagggaacgagcgaagacggtacgaaaccagatgaaaaatccagcgaccagggattgcagaaggttggagactccgacgggtcatctaacctggatggcaagaaagaggatgaggatccccaagacgggggctcactggccagcacgcttagtaagctcaagcgaatgaagagggaggagggggctggggcgacagagccggaatactaccattatattcctcccgcccactgcaaagtcaagccaaacttcccattcctactgtttatgagggcgtctgagcagatggatggcgataatacaacccatcccaaaaatgcccccgaatcaaaaaagggcagctcacctaagccaaaatcctgcatcaaggcagcagctagtcagggcgcagagaaaacagtttccgaagtgagcgaacagcccaaagaaacatccatgacagagccgtctgagccagggtccaaggcggaggctaagaaggcactggggggtgacgtctcagatcaatccctggaaagtcactcacaaaaagtgtcagagacacagatgtgcgagagcaactccagcaaggagacttccctggccaccccagccggcaaggagagccaggagggccccaaacacccgacgggcccattctttcccgtgctgagtaaggacgagtcaaccgctcttcaatggccctctgagctgcttatcttcaccaaagctgagcccagcatttcatactcatgtaatcccctctattttgatttcaaactcagtagaaacaaagacgctcggacgaagggcaccgagaagcctaaagacatcggatcatcatccaaagaccacctgcaggggctcgacccaggagagcccaacaagagcaaggaggtgggtggagagaagattgtcagatcgtctggaggccgaatggacgccccggcttcaggcagcgcatgttctgggttgaacaagcaagagccaggcgggagccacgggtccgaaacggaggacaccggtcgtagcctgcctagcaagaaggagaggtcaggtaaatctcacaggcataaaaagaagaagaagcataagaaaagcagtaaacataaaagaaagcacaaggccgataccgaggagaaatccagcaaagcggaaagcggagagaagtccaagaaaagaaagaagaggaaacggaagaagaacaagagttctgctccggccgatagcgaacgcggccctaagcccgagccgcccggatccgggtccccagccccacccaggagaaggaggagagcccaagatgattcacagaggcgttccctgccggcggaagaggggtcatctggcaagaaagatgagggcgggggcggtagcagcagccaagaccacgggggccgaaaacataagggcgaactcccaccctccagctgccagcgcagagctgggaccaaacgttcctccaggtcaagtcaccgctctcaaccaagctctggcgatgaagacagcgatgatgccagctcccatcgcttgcatcagaagtctccctcccagtattccgaggaagaagaagaagaggactctggcagtgagcacagcagaagtcggagcagatccggccgccggcactcatcccatagaagctcacgtaggtcctattcttcgagctccgacgcgtcgtcggaccagagttgttatagtcgccagagaagttactcagacgacagttactcagattacagcgaccggagccgtcgacattccaaacgctctcacgattcagacgatagtgattacgcctcctccaaacaccgcagcaagagacacaaatattcgtcatctgatgatgattattccttaagttgcagccagagtaggtctaggagcagatcacataccagagagcggagtcgtagtcgtggacggtcgagaagcagttcatgttccaggtcgaggtctaagcgccggtctagatctactactgcgcactcctggcaaagaagcaggagctattctcgtgaccggtcgagatccacacgttcaccctctcagaggtccgggtctaggaaacgttcatggggacacgagtcaccggaggagcggcactcaggccggagggatttcatccgctctaagatttaccgaagccagtcaccacactactttcggtcaggacggggcgagggaccaggcaagaaggacgacgggcggggagatgacagcaaggcaaccggacccccatctcagaacagtaacattggcactgggaggggttccgaaggggactgctcgccagaggacaaaaattccgtcaccgcgaagctgctgttggaaaagatccagtcccgaaaggtggaaaggaagccatctgtgagcgaggaagtgcaggccacgccaaataaagccggccccaaactgaaagatcccccacagggttactttgggcccaagctgcccccctcgctcggtaacaagccagtcctccctctgataggaaagttgcccgctactcgcaagccaaataaaaagtgtgaggagtccggcctagagcgcggggaggagcaggagcaatccgagactgaggaggggcctccgggttcctccgacgcattgtttggacatcagttcccctcggaggagaccacgggccccctgttggatcccccccctgaggaaagcaagagcggagaggccactgctgatcatcccgtggcccctctgggtacgccggctcattccgattgttaccccggtgaccctacaattagccataactatttaccagatccaagtgatggagacacactggaatctttagactcatcctctcagcctggcccggtggagtcctcactgttgccaattgcccccgacctggagcacttccccagttacgctccaccatccggggacccctcaattgaatccaccgatggggccgaggacgccagccttgccccacttgagagccagcccattacgtttactcccgaggaaatggaaaaatatagtaaattacagcaggctgctcagcaacatattcagcagcagcttctggccaagcaagtcaaagcattcccagctagtgcggcactggccccggccactcccgccctgcagcccattcacatccagcaacccgcaacagcctcagccacctccatcactacggtgcagcatgcgatacttcagcatcatgcggccgccgccgccgctgctattggtatccacccccacccccatccccagcccctggcgcaggtgcaccatattcctcaacctcacttgaccccaatttccttgtctcatttgactcactcaataatccccggccacccagccactttccttgccagtcacccgatccatatcatcccggcctctgcgattcaccccgggccatttacattccaccctgtcccccacgctgctttatatccaactcttttggccccccgacctgccgcggccgccgctacggccctgcacttacatccccttctgcatcccatcttctccggtcaggacctacaacacccccccagccatggcacatag

SEQ ID NO: 117735 - DNA, 132 bp, Artificial Sequence
  Description of Artificial Sequence: Synthetic coding sequence
atggccgatcgcttcagtaggtttaatgaggacagggactttcaagggaaccactttgatcagtacgaagagggccatcttgagattgaacaggccagtctggataagccaattgaaagcagttgcttttag

SEQ ID NO: 117736 - DNA, 4509 bp, Artificial Sequence
  Description of Artificial Sequence: Synthetic coding sequence
atggctgatcggttttccaggttcaacgaggatcgcgacttccagggcaaccattttgatcagtatgaggaaggccaccttgaaattgagcaagcctctctcgacaaaccaattgagtcagataacatcggacatcgacttttgcaaaaacacggttggaaattaggacaaggcctgggtaagagtcttcagggtcgaacggaccctatccccattgtagtgaaatatgatgttatggggatggggcggatggagatggagctggattacgctgaggacgccacggagcgtcggagagtgctagaagtggaaaaggaggacactgaggaactgaggcagaaatacaaagattacgtggataaagaaaaagcgatcgctaaggcattagaggacctgcgggcaaatttctactgcgaactatgtgacaaacagtaccagaagcatcaagagtttgataaccatattaattcttacgaccacgctcataaacagagactgaaagatctgaagcagagggagttcgcacgtaacgtttcatcaaggtcccgcaaagacgaaaagaagcaggagaaggcactacggcgcttacatgagttggccgagcagagaaaacaagctgaatgtgctcccggctcagggcctatgttcaagcccacaaccgtggccgttgatgaggaggggggagaggatgacaaagacgaaagcgccaccaactccggaacaggtgcaacagctagctgcggtctgggcagtgagttctcaacggacaaaggcggtccatttacagccgtgcaaataactaacactaccggcctagcccaggctccgggattagccagtcagggaatatccttcggaatcaagaataacctggggactcccctccaaaagctgggcgtgtctttttcatttgccaaaaaggccccggtgaagctggagtctatcgcttccgtgttcaaagatcacgccgaagaaggcaccagtgaagatgggaccaaacccgacgaaaagtcctccgatcaaggactgcagaaagtgggggacagcgacggaagttcaaacctcgacggcaagaaggaggatgaagaccctcaagacggtgggtccctcgctagtactctgtccaagcttaaaaggatgaagagagaagagggggctggcgccacggagccggaatattaccattatatccctcccgcacactgtaaagtgaagcccaatttcccttttctgctcttcatgcgggcctccgaacaaatggacggcgacaataccacgcaccccaagaatgcacccgaatcgaaaaaaggctcatccccaaaaccaaaatcctgcattaaggcagcagcctctcaaggagctgagaagacggtcagtgaagtgagcgaacaacccaaagagacctccatgacagagccaagcgaacctggttccaaagctgaggctaagaaggctttagggggggatgtgagcgaccagagcctggagagccactcacaaaaagtgagtgagacgcagatgtgcgaaagcaatagctccaaagaaacctctcttgccacccccgcaggaaaagagtcacaagaaggacctaagcatccaacggggcccttctttcctgttctgagtaaggatgaaagcactgccctgcagtggccctccgagcttctaatttttaccaaggcagaaccctccatttcctattcatgcaacccactgtacttcgatttcaaactctcacggaataaagacgctcgcactaagggaactgagaagccgaaagacataggttcttcaagtaaggaccacctgcagggactagatcctggcgaacctaacaagagtaaggaggtagggggagaaaagattgtgcgaagtagcggaggccgcatggatgcaccagcttctggcagcgcttgttccggactcaacaaacaggagccaggcggcagccacggtagtgaaactgaagacaccgggagaagcctgccctctaaaaaggaacgaagcggcaaatctcacaggcacaagaagaagaaaaaacacaaaaagtccagcaaacacaaaagaaaacacaaggctgacaccgaggaaaaaagttctaaagccgagagtggcgagaagtccaaaaagaggaaaaaaaggaagagaaagaaaaataaaagttcagctcccgcagattccgagagaggcccgaagccagaacctcctgggtctgggtctcccgccccaccccgcagaagaaggcgcgcacaagacgactcacagcgtcgttccctccccgcggaggaaggctcatcaggtaaaaaagatgaggggggtggcggaagcagtagccaggaccatggcggccgtaagcataagggtgagctcccaccctcctcttgccagaggcgtgccggcaccaagcgaagctccaggagtagccaccgttcccagcctagttccggcgatgaggacagcgatgatgcctcttcgcatcgcctccaccagaagagcccctcccagtattccgaagaggaggaagaagaagattctggatccgaacacagcagatctcggtctcgctctggcaggcgtcactcgtcacaccgatcatcacgtcggagctactctagtagttccgacgcgtcctccgaccagtcttgctatagccggcagcgatcgtacagcgacgattcttacagcgattatagtgaccgctctaggagacattcaaaaagatctcacgacagtgatgattctgattacgcctcctccaagcaccgctccaaacggcacaagtatagctcttcagatgatgactattcactcagttgctcacagagtaggtctagatcaagatcacatactcgagagcgtagcagaagtaggggccggtccaggtcatcctcatgctctagaagcaggagcaagcgcagatcccgctcaactactgcgcattcgtggcaaaggagtcggtcgtactcaagggatcgaagcaggtccactaggtcaccgtcccaacgatctggaagtcgaaaacgttcatggggccacgagtctccagaggagcgccattctgggcggagagactttatccggagtaagatatatcgcagccagtcaccacactacttccgctctggcaggggggagggaccaggtaaaaaagacgacggccgtggcgatgatagcaaggctactggacccccctcccaaaactccaacattggaaccgggcgagggtcagagggcgactgcagccccgaggacaaaaactccgtaactgccaaattgttactggagaaaatacagagtagaaaggtggaacggaagccatccgttagcgaggaagtccaggctaccccgaataaggcaggccctaaactcaaggacccgcctcaggggtatttcggccctaaactgcctcctagcctgggaaacaagccagtgcttcccctgattggcaaactcccagcaacacgtaaacccaacaagaaatgtgaggaatcagggcttgaacgaggggaagaacaggaacaatccgaaacagaggagggtcccccagggtccagcgacgccctgttcgggcatcaattcccaagtgaggaaaccaccggacccctattagacccacccccagaagaaagtaaatccggtgaagccaccgccgaccacccagtggctccccttggcacccctgcacatagcgactgttaccccggggatccgaccatttcccataattacctccctgacccctcggacggcgacaccctggagtctctcgattcttccagccaaccaggcccggtcgagtcatcactgctccctatcgcccccgacctggaacactttccatcttacgctcctcccagcggggatcccagtatcgaatccaccgatggcgctgaggatgcatctctggctcctctggaatcccagccgattacttttacccctgaagagatggagaaatatagcaagctgcagcaggccgctcagcagcacatccagcagcaactattggcgaaacaggtgaaggcttttccagcaagtgcagctctggcaccggctacgcccgcgttgcagccaattcacattcagcagccagctaccgcttctgctaccagtatcactacagtccagcatgctatcctgcaacaccatgcagctgcagctgccgcggccattggcattcaccctcacccacaccctcagcccttggcgcaggtacatcatataccgcaacctcacttgacaccaatcagtttaagccacctgacccacagtatcatcccagggcaccctgccaccttcctggcctctcaccccatccatatcatacccgcatccgccattcacccgggacccttcacctttcaccccgtgccgcatgccgccctctacccgaccctcctggcaccccgccctgccgccgctgcagccaccgccttgcatcttcaccccttgttgcatcctatattctcaggccaagacctgcagcacccgcccagtcacgggacgtag

SEQ ID NO: 117737 - DNA, 1476 bp, Artificial Sequence
  Description of Artificial Sequence: Synthetic coding sequence
atgccattacctgtgcaggtctttaacctgcaaggtgccgtggaacccatgcagatcgatgtggatccacaagaagaccctcagaatgcacccgatgtcaactatgtggtggagaacccctccctggacctggaacagtatgctgcaagttactctgggctgatgaggatcgagcggctgcagttcattgccgatcactgccctactctgagagtcgaagccctgaaaatggcgttatcatttgtgcagagaacatttaacgtggatatgtacgaagagatccatcgcaagctttctgaggcaacaagatcatccctaagagaattgcaaaacgccccagacgctatccctgagtcaggcgtcgagccacctgctctggatacagcgtgggtcgaggccactcgaaaaaaagccctcttgaaactggagaaattggatactgacctcaagaactataaaggcaattctataaaagagtctatccggagaggccacgatgaccttggcgaccattacttggattgtggcgatttgagtaatgctctcaagtgctactctcgcgccagggactattgtacatccgccaaacacgtgattaatatgtgcttgaatgttattaaagtgtcagtctacctccagaactggtcccacgttctgtcgtacgtctcgaaggctgagagcactcccgagattgctgagcagaggggtgaacgcgattctcaaacccaggccatcctgaccaaactgaagtgcgcggccggacttgccgaactggccgcacggaagtataagcaggccgccaagtgcctcctcttagccagctttgaccactgcgatttcccagaactgctctccccgagtaacgtcgccatctatggagggttgtgcgccctggctacctttgatagacaggaactacagagaaatgttatcagttccagttcatttaagcttttcctggaacttgagccccaggttcgcgacattattttcaaattctacgagagtaaatatgcctcatgtctgaaaatgctagacgaaatgaaggacaacctcctcctcgatatgtatctggccccccatgtgaggactctgtacactcagatacggaatagggccttgattcagtacttctccccttacgtaagtgcagacatgcacagaatggctgctgcctttaacactaccgtggctgctcttgaggatgaactgacccaactaatcctcgaaggcttaatatccgcccgagtcgacagccacagcaagatcttatacgccagggatgtcgatcagcgtagtaccacgttcgagaagagcttgctgatggggaaggaatttcagagaagagctaaagccatgatgttgagagctgccgtcctcaggaaccaaatccatgtcaaatccccgcccagagagggctcccagggcgagttaacccccgcaaacagtcagtcacgcatgtccaccaacatgtag

SEQ ID NO: 117738 - DNA, 1653 bp, Artificial Sequence
  Description of Artificial Sequence: Synthetic coding sequence
atgcccctgcccgtgcaggtgtttaatctacagcagccggcgtccagcgttagcggatccggcggagctgagtctcaggatcggatgcgggatagctctgcgcctagctcggcgagctcatcggtcacagatctgtactgcacaccacatagctcacggagcgacctcgttctgccaggcaccgccggagatttctcattatccgctagcctttccgcctgcacgctgctgtacgagggcgcagtcgagcctatgcagattgacgtagacccacaggaagaccctcagaacgcccccgatgccattcccgagagcggcgtagagccccccgcactggatactgcatgggtggaagccaccaggaagaaagccctgctcaaacttgaaaaattggacactgatcttaagaattacaagggcaacagtatcaaagagtcaatcagacgaggacacgacgatctcggcgatcattaccttgactgtggagacctgtctaacgctctcaagtgttactcacgtgctcgcgactactgcactagcgcgaaacatgtcattaacatgtgcctcaatgtcattaaggtgagcgtctatctgcagaactggtcccatgtacttagctacgtgagtaaggcagagtccacccctgaaatcgctgaacagcggggtgagagagatagccagacccaggctatcctgaccaagcttaaatgcgctgcaggcttggcggagcttgcggcgaggaaatacaaacaggctgccaagtgtctccttctggcaagcttcgaccactgtgactttcccgaactgctcagcccaagcaacgtggctatatacggcgggctgtgtgctctcgccacctttgatcggcaggaacttcagagaaacgtcatctcatcctcatcctttaaactgttcctcgaattggaacctcaggtcagagatatcatatttaaattttatgagagtaaatatgcctcctgccttaaaatgctagatgaaatgaaggataatctattgctcgacatgtatctcgccccccatgtacgcaccttgtacacgcaaatacggaacagggctctcatccaatacttcagcccctacgtcagcgccgatatgcaccggatggccgctgcattcaataccacggtggcggcacttgaagatgaacttacgcagcttattctggaaggactcatctctgcccgtgtggacagccactccaaaatcctgtatgcccgggatgttgatcagcgcagcacaacttttgaaaagtcacttttgatgggcaaggagttccagagacgcgctaaagccatgatgctgcgggcggcggtgctgcggaaccagatccacgttaaacccttgcccacgtcgacagacctggggccccccggaggttccgtgttgccagcagctcagctgagagggctggcaacgggttgtcacccggcctgcgtgccctccctggggcttaggcgacaggcagcagcctcctgtggtccttcttggaaggagcgccctgccggtctagatcccgtgggattttgcccacagggcgccgactgtgccgcgccacgcccttccggcaccataagtcagactccgccagtcccagcttcagtgagatgtagacaggtcggaggagtccattag

SEQ ID NO: 117739 - DNA, 1584 bp, Artificial Sequence
  Description of Artificial Sequence: Synthetic coding sequence
atgcgtgacagtagtgctcctagttcagcctccagctccgttaccgatctgtattgtacccctcattcctcaagaagcgacctggtgttgcctggaacagccggggatttctccttgagcgcaagcctgagcgcttgcactctgttgtacgagggtgccgtggaacccatgcagatcgacgttgacccccaggaagacccacagaatgcccccgacgtgaattacgtggtcgagaacccatctcttgatctcgagcaatacgctgcatcctacagtggactgatgaggattgaaaggttacagtttattgcggaccactgccccactctccgcgtggaggctctgaaaatggcactctctttcgttcaacgcacctttaacgtggatatgtatgaggagattcaccgaaagctctccgaggccactagagagctacagaacgcccctgatgccattcccgaatccggagtggagccccctgcccttgacacagcctgggtcgaggcaacaagaaagaaggcactgcttaaacttgagaagctggatacagatctgaaaaactacaagggcaactcaatcaaagagtcaattcgacgcggccacgacgatctgggcgaccactatctggactgcggtgacctttctaacgcgctgaaatgctacagccgggccagggactactgtacgagcgctaagcacgtcataaatatgtgcttgaatgtgattaaagtgtcggtgtacctgcaaaactggtctcatgtgctatcgtatgtgagtaaggcagagtccactcccgagatcgcagagcagcgcggggaaagggatagccagacccaggccattctcacaaaactgaaatgtgcagccggtttagcggagctcgcagctcgaaaatataagcaggcagctaagtgtctacttttggcttcctttgatcactgcgacttccccgagttgctgtctccaagcaatgttgccatttacggaggcctgtgtgccctagccacttttgacagacaggaactccagagaaatgtcatttccagttcatcattcaaactgtttcttgaactggagccgcaggtgcgggacattatcttcaagttttacgagagcaagtatgccagctgtctcaagatgcttgatgaaatgaaggataacctcttgctggatatgtatttagctccccatgtacggacgctgtatactcagattaggaatcgcgctttgattcagtactttagtccttatgtatcagccgacatgcatagaatggcagctgcgttcaacaccacagtggccgccttggaagacgaattgacccagctgattctggagggtctcatatccgcaagggtggacagccattcaaaaattttgtacgcccgggacgtcgatcagcgatctactacatttgaaaagagcctcctgatgggcaaagaattccagcgtcgagccaaagctatgatgctgcgagcagcggtgttaagaaaccagatccacgttaaaagcccccccagagagggtagtcagggagagctgacccctgccaacagccaatctaggatgtctaccaacatgtag

SEQ ID NO: 117740 - DNA, 855 bp, Artificial Sequence
  Description of Artificial Sequence: Synthetic coding sequence
ggccagccagaaataggaggctttctgccttcgtccctagctcccgttaccgctgcaatcctgatggcacgcagttctttacgtgagctgcagaatgccccagacgcgatccccgaatccggagttgaacctcccgccctggacaccgcatgggttgaggccacacggaagaaagccctgctgaagcttgaaaaacttgataccgatttgaagaactacaaaggtaactccattaaggaatctatccgaaggggtcatgatgacttgggggaccactacctggactgcggcgacctttctaatgccctcaaatgctactcacgtgccagggattactgcacgagtgccaaacacgtgatcaacatgtgcctcaacgtcataaaggtcagcgtataccttcagaattggagccatgtgctctcctacgtctccaaagccgaatcgaccccagaaatcgctgaggtgagagccacttctagtgagaccctgccccctggattcctgacgaccgccggccccagctgccccccgccgccgcacagcccacctgatctgaacctgccttcatctccactgagtctaggagctgggcatagggctttgggaaatgtcgagcatggccctcacgcttgtgggttcctcctgcagcaacggggagagagagactctcagacgcaagctatcctgaccaaactgaaatgtgccgccggagaaggtctcggccatgcccaactgacacccagatcccccgttgccaagagcagtcagcctcgcgccgtcggctggtccctgccacagcccggaaagacatcattagcggggcgtcgtatgctgtgggctcatgtccaggtgtag

SEQ ID NO: 117741 - DNA, 1584 bp, Artificial Sequence
  Description of Artificial Sequence: Synthetic coding sequence
atgagggattcctcggctcccagctcagcctcctctagtgtgactgatctttactgcactcctcattcgtcaagatctgacctagtgctgcctggaaccgctggcgatttctctctctcagcaagcctcagcgcgtgcaccctgctgtacgaaggtgctgtggagcctatgcaaatcgatgtagatcctcaagaagatccacagaatgctccagacgtgaattacgtggtggagaacccatcactcgacttagaacagtatgccgccagttacagcgggctgatgcgcatcgagcggcttcagtttattgccgaccactgcccaaccctccgagtagaagccctaaagatggctctgtcttttgtgcaacggacatttaatgtggacatgtacgaagagatccatcgtaaattgtccgaggccacgagggaacttcagaacgctccagacgctatcccagagtcaggagttgagccgcctgccctggatacagcctgggttgaggccaccagaaagaaagccttattaaaattagagaagctggacacggatctgaaaaattacaaaggcaacagcatcaaggaaagcattcgccggggccatgacgatctcggagaccattatctagactgtggcgacctgtccaacgcacttaaatgctatagccgtgcccgagactattgcacttcagcgaagcacgtaattaatatgtgcttgaacgtgattaaagtgtctgtctacctgcaaaattggtctcacgtgttgagctatgtctcgaaggctgagagcactcctgagattgctgaacagcggggggaacgcgattcgcagacacaggccatcctgaccaagcttaagtgtgccgcaggactcgccgagttggctgccagaaaatataaacaggcggcaaaatgtctgcttctggctagcttcgaccactgtgatttccctgagctgttgtccccaagcaacgttgcaatctatggagggctgtgtgccctagctacatttgataggcaggaactccaaagaaatgtcatctcctcctcgtccttcaagctttttctcgagctcgagcctcaggtaagggacatcatctttaagttctatgagagcaagtacgcctcatgcctgaaaatgttagatgagatgaaggacaaccttctgctggacatgtatttggccccccacgtcaggacattgtacacacagataaggaatcgagccctgatccagtatttttcaccctatgtgtccgcagacatgcatagaatggcagcagcctttaacactacggtggcagcgctggaggacgaactaacacaactcatcctcgagggattgatttccgccagagtcgatagccactcaaaaattctctatgctagagatgtggaccagagatctaccaccttcgaaaaatcgcttctcatgggaaaggaattccagaggcgggccaaggcgatgatgttacgcgcggctgtcctgagaaatcagatacatgtaaaatccccaccacgggaaggatcccagggagagcttacccccgccaacagccagtctcgcatgtcaactaacatgtag

SEQ ID NO: 117742 - DNA, 993 bp, Artificial Sequence
  Description of Artificial Sequence: Synthetic coding sequence
atgactcccaactcaacaggcgaagtcccgtcccccataccaaaaggggccctgggactgtcgcttgctttggcctccctgattatcacggctaatctccttcttgctctgggaattgcctgggatcgaagactacggtccccccccgcaggatgcttcttcctgagtttgctgctggctggcctcctgaccggcttggcccttcctacgttacccggtctttggaaccagtcacggagaggttactggtcttgtctactcgtgtacttagccccgaacttctccttcctctcactgttggcaaatcttctgctggtgcatggtgaaagatatatggccgttctacgtccactccagccccccgggagtatcagattggccttgctgctgacttgggcaggtcctctattgttcgcctctctccccgcacttggatggaaccattggacacccggcgcgaattgcagttctcaggcgatctttcctgctccttacctgtacctggaggtgtatggcctgctcttaccagccgtcggcgccgccgccttcctgtctgtgcgggttctggccacagcgcataggcagttgcaggatatatgtagactggagcgagccgtgtgtagagacgaaccgagcgcattggccagggcccttacctggcgacaggcccgcgctcaggcaggcgccatgctgctcttcggcctttgctggggaccgtatgtggcaacactgctgctttccgttttggcttacgaacagaggccaccactagggcccgggaccctcctgtccctgctttcgctgggaagcgcctccgccgccgcagtacccgttgccatgggactgggggatcagcgatatactgcaccctggcgggctgccgcacaaaggtgccttcaggggctctgggggagagccagtcgcgacagcccagggcccagcatcgcctatcatcctagctcgcagtcttccgtggacttggaccttaactag

SEQ ID NO: 117743 - DNA, 993 bp, Artificial Sequence
  Description of Artificial Sequence: Synthetic coding sequence
atgaccccgaattccacgggggaggtgccatctccaatcccaaagggcgccctggggctcagcttggccttggcgagcttgatcataactgctaacctcctgcttgcattgggcattgcttgggaccggaggctgagaagccctcctgccgggtgcttctttctatccctgctcctggctggcctactcacaggtcttgccctgcccaccttacctggcctgtggaaccaatccaggaggggttactggagctgccttctcgtgtatttagctcctaacttctcttttctgtcattgctcgcaaaccttctcctagtgcacggggaaaggtacatggcagtcctacggcctctccagcctccaggctccatacgacttgccctcctgctcacctgggctggccctctcttgtttgcttcccttcccgctttaggatggaatcactggacacctggtgccaattgctcgagccaggcaatatttcccgctccgtacctgtacctggaagtgtacggtctgttactccctgctgtgggcgctgcagcctttcttagtgtgagggtgctagcgaccgctcatcgacagcttcaggacatctgccgccttgaaagagcagtttgtcgggatgagccctctgctctcgcccgcgcccttacgtggcgacaggctagagctcaagccggggcgatgctgctgtttggattatgctgggggccctatgtggccactcttctgctcagcgtcttggcttacgagcagcggcctccactcggcccaggaactttacttagccttctctcactaggcagtgcgtccgctgctgcagtgccagtggcaatgggccttggggaccagcggtataccgcaccatggagggccgctgctcagcgctgcctccaagggctttggggtcgggcaagtagagactcccctggaccctcaatcgcttatcaccctagctctcaatcttctgtggatctggatttgaactag

SEQ ID NO: 117744 - DNA, 993 bp, Artificial Sequence
  Description of Artificial Sequence: Synthetic coding sequence
atgactcccaactccaccggcgaggtgcccagtcctatccctaaaggcgccctgggcttatctctcgccctagcttccctcattatcacagctaacttactgctggcactagggatagcctgggacaggcggctaagatcccctccagcaggttgtttcttcctgtcactgctgcttgcaggactgctgactgggttagctttgcctacgctgccaggactttggaatcagtcgagacgcggctattggtcatgcctgttggtatacttggccccaaatttctctttcctgtccctgttggcaaatctattgctggttcatggtgagcggtacatggctgtgctccgccccttacagccaccaggctctatcagactggccctcttactcacatgggctggacccctgctgtttgcctcacttcccgctctgggctggaaccattggaccccgggagcgaactgttcaagccaggctatcttcccagctccatacctctaccttgaggtctatggtctcctcttgccggccgtcggagctgcagcattcctgtctgtgagggttctcgcaacagctcaccgccagctgcaagacatttgtcgcctcgagagagccgtgtgccgggacgagcccagtgccctggctcgagctctgacctggaggcaagcaagagcgcaggcaggcgcaatgctgttgttcggcctgtgctggggcccctatgtcgcgacccttctccttagcgtactggcatacgagcagaggcctcccctgggtccgggcaccctcctgtccctgttaagcttgggctcagcatcagccgccgccgttccagtcgccatgggccttggagatcagagatatactgcaccctggcgcgcagctgcacaaagatgtctccaaggtctgtggggcagggcttcgcgagactcccctggcccgtctatcgcctaccaccctagttcacagtcttctgtggatttggatctaaactag

SEQ ID NO: 117745 - DNA, 993 bp, Artificial Sequence
  Description of Artificial Sequence: Synthetic coding sequence
atgacgcctaacagcaccggagaggttccaagtcctatcccaaaaggggctctagggctctcactggccctggcgtccttgatcatcacagccaacctgttgctggccctcggtatagcttgggatcggcgccttagaagcccccctgcaggatgcttttttctgtccctgctcttggccggtcttctcaccggattagctttaccaacattacccggactttggaatcaatctcggcgcggttactggtcatgtctactagtctaccttgcccccaatttttccttcctgagcctcctagccaatctactgctagtgcatggtgagcgatacatggcggtcctgcgccccctacaaccgccaggatcaattcgactggccttattgctgacgtgggcagggccgctgctctttgctagtctgcccgctctcggatggaaccactggaccccgggggccaattgctcaagtcaggccatattcccagccccctacctttacctggaggtgtacgggctgctcctgcccgctgtaggcgccgcggcgtttctgtccgttagagttctcgctaccgcccaccgccagctgcaggatatctgtcgactcgagagggccgtctgtagagacgagcctagcgcccttgcaagagctcttacttggcgccaggcacgcgcacaggctggagccatgctcctgttcggactctgttggggcccttatgttgctactctccttctgtcggtgctggcttatgagcaacgaccacctctgggccctgggactttgctctccttgctttctctgggatccgccagcgcagcagcggtgcccgtggctatgggcttgggcgaccagcgatacactgcgccttggcgagcggctgcccaaagatgcctccagggactctggggtagggcgagcagagatagtcctgggccttctatcgcatatcatccaagttcacagtcttcggtggaccttgacctgaactag

SEQ ID NO: 117746 - DNA, 1128 bp, Artificial Sequence
  Description of Artificial Sequence: Synthetic coding sequence
atggacgtgacttctcaagctcggggagtcggcctggagatgtaccctgggacagcccaacccgccgcccccaataccacctcaccagaactaaacttatcccatcccttactcgggaccgccctggcgaatgggactggggagctctccgaacaccaacagtacgtgatcggactctttctcagttgtctttatacaattttcctcttccccatcgggttcgtgggcaacatcctgattctggtcgtgaacatctcattcagagagaaaatgaccattccagatttgtattttataaaccttgccgtcgcagatttgatactggtggccgacagtctcatcgaagtgttcaatctgcacgagaggtattatgatatcgcggtgctgtgcacattcatgagtttatttctgcaagtgaacatgtatagcagtgtttttttccttacctggatgtcttttgacaggtacattgccctggcaagagccatgaggtgctccctgttccgaactaaacaccatgctcgactctcttgcggcctgatatggatggcctcagtcagtgcgaccctggtgccttttacagccgtccatctgcagcacactgacgaggcttgcttttgttttgccgatgtcagagaggtgcagtggctagaagtcactttgggttttattgttccatttgctatcattggactctgttattccctgatcgtccgcgtgcttgtgagagcacatcgccatcgtggcctgagaccacgccgccagaaggctctcagaatgatactggccgtcgtgttggtctttttcgtctgctggctgccggaaaatgtatttatctctgtgcatttattgcaaaggacccagcctggtgccgcaccatgtaaacagtccttcagacacgcgcacccgttgactgggcacatagtgaatctggctgctttcagtaacagttgcctcaatccactgatttactcttttcttggagaaaccttccgggataaacttcgcctatacatcgagcagaagacgaatttaccagccctaaatcggttttgccatgcagcattgaaggccgtcattcccgattcaactgagcaatctgatgtgcgcttctctagtgctgtgtag

SEQ ID NO: 117747 - DNA, 531 bp, Artificial Sequence
  Description of Artificial Sequence: Synthetic coding sequence
atgtccttaaactgcgggcaaatgtggctcctggccccccggggcctggccagagtgacgcttgcatggtcaccatggggatgtctcggcaatctgacaacggggcatttggccctcttgacacaaaattgttacaacccaaaggctctcgcgccacaaggccccaaggcctcaggcgaccagcctgtaacccagttgctaccagcaaacccagcctgccggtgtacctgcctccccctgcaagaaacgttcctctctgttctgcaccttcctgggtggcaacagtggcggtgtgcggcttcaccggggcccagaggagctgcagctctagggcccgagcagcaagaggggccatctgttgaacgcccaccctccgcacctggctggttttctcattgcctgctaacatccacttggcagcttcacagctgcggtcttgggccctgcgagcttccttgtggactagtgggatgtcaggacaatgaaatcttacagcatttgtggttgacaaatctgttcctccaaaagtag

SEQ ID NO: 117748 - DNA, 1128 bp, Artificial Sequence
  Description of Artificial Sequence: Synthetic coding sequence
atggatgttacatcccaggccaggggagtgggcctggaaatgtatccaggtacagcccagcctgcagcccctaatactacatctcccgagctgaatctctcacacccactcctcggaactgctttagcaaacggcactggggaattgtctgaacaccagcagtacgttatcgggttgtttctgtcctgtctgtataccatttttctgttccccatcgggtttgttgggaatatcctgatcctggtagtgaacatctcatttagagaaaagatgactatcccagacctgtattttatcaatttggccgtcgctgaccttattctcgttgccgactcacttatcgaggtatttaatctgcatgaaagatattatgacatcgccgtgctttgcacctttatgagcctgtttctgcaggtcaacatgtactcctcggttttctttttaacatggatgagcttcgatagatatattgccctcgcacgcgccatgcgatgctcactgttcaggacgaagcaccacgcccggctgtcttgtggcctaatctggatggccagtgttagcgccaccctggtaccatttacggctgtacacttgcaacacacagatgaagcttgcttttgcttcgctgatgtgcgagaggtacagtggcttgaggtcactctgggtttcattgtgccgtttgccatcatcgggctgtgttatagccttatagtccgagtgttggtcagagcccaccgacatcggggtcttcgaccccgcagacagaaggcactgaggatgattctggccgtggttcttgtcttcttcgtctgttggttgcccgaaaacgtatttatctccgtacatttgctgcagaggacccagcccggggctgccccttgcaagcagtctttccgccacgctcacccactgacggggcacatcgtcaatttggctgcattttccaacagctgtctgaaccccctgatttactcctttctgggagaaacctttagagacaaattgcggctgtacatagaacagaagaccaacctccccgcacttaatcggttctgccacgctgcacttaaggcggtaatcccggatagcaccgagcagagtgacgtcaggttctcatccgctgtctag

SEQ ID NO: 117749 - DNA, 1128 bp, Artificial Sequence
  Description of Artificial Sequence: Synthetic coding sequence
atggatgtgacaagccaggccaggggtgtcggccttgaaatgtacccgggcacagcacaacccgccgcccctaataccacctctcctgagttaaatctgagccaccctttgctggggacagcactcgcgaacggtaccggggagctatctgagcaccagcagtatgtgattgggctttttctgtcttgtctgtatactatctttctgtttcctatcggcttcgtgggcaacatcctgatcttggtggtgaatatttctttccgggaaaagatgacaatccccgatttatattttataaatctggctgttgctgacctgattctggtcgcagattcactcatagaggtgtttaacctccacgagcgctattacgacatagctgtcctgtgcacgttcatgagcctattcctgcaggtgaacatgtatagtagtgtgttctttttgacctggatgtctttcgaccggtacattgccctcgcacgcgccatgaggtgctcgctcttcagaacgaagcatcatgctaggttgagctgcggtttaatttggatggcgagcgtgtcagctaccttagttccattcacagccgtgcacctgcagcataccgacgaagcctgcttttgtttcgcagacgtgcgggaagtccagtggctggaagtgacgctgggctttatcgtgccttttgcaattatcggcttgtgctattcactgatcgttcgcgtcctggtgagagctcacagacatcggggactacgaccacggcggcaaaaggccctgcgtatgattctagctgtcgtgcttgtattctttgtgtgctggctgccagaaaacgtgtttatttctgttcacctgctgcagcgcacacagcccggagccgcaccctgcaaacagagctttaggcacgcccatccacttactgggcacattgtgaacctggctgcattttccaatagctgcctgaatccgttgatatacagctttttaggtgaaaccttcagggacaaactccgactgtatattgaacaaaaaaccaatttgcctgctctgaatcggttctgtcatgccgcactcaaggccgtgattcctgactcaactgaacagagtgatgtacgcttctcttcggctgtatag

SEQ ID NO: 117750 - DNA, 1128 bp, Artificial Sequence
  Description of Artificial Sequence: Synthetic coding sequence
atggacgtaacatcacaggccaggggggtcggcctggagatgtatcctggaactgcccagccggcggcccctaatacaacatccccggagctgaatctctctcaccccttgttgggcacagcgctggccaacggcacaggtgagctgagcgaacaccagcagtatgtcattgggctgttcctgagttgcttatacacaatcttcttattccccattggatttgtgggaaacatcttgattttggtcgtgaatatatctttcagggagaagatgactatcccagacctgtacttcatcaacctggcagttgctgacctaattctcgtagcagacagcctcatagaagtgtttaacctccatgagcgctattacgatattgcggtgctctgcactttcatgagcctctttttacaagtgaacatgtactcctccgtatttttcttgacttggatgagcttcgatagatatattgccctcgcaagggcgatgagatgtagcctgttccggaccaaacatcatgcaaggctgagctgtgggctaatctggatggcctcagtctctgctactctcgttccttttactgctgttcacttgcaacacacagatgaagcctgtttttgttttgccgatgtgcgggaggtgcaatggttggaggttaccttagggtttatcgtgccgtttgccataatcgggctctgctattctctgattgtgagagtgcttgtgcgagcgcaccgccatcgagggctgaggcctaggcgacagaaggcgctgcgaatgattctcgccgttgttctggttttctttgtatgttggctgccagagaatgtattcatttctgtccatctccttcaaagaactcagccaggtgctgccccatgcaaacaatcgtttagacacgcacatcccttgacaggacacatcgtaaatctggccgccttttcaaactcttgcctaaaccccctgatctacagctttctgggagagacctttagagacaaactcaggctgtatattgagcagaaaacaaatctgccagccctgaatagattctgccacgctgccctgaaggctgtgatcccggattcaactgaacagtctgatgtcaggtttagctcagcagtgtag

SEQ ID NO: 117751 - DNA, 222 bp, Artificial Sequence
  Description of Artificial Sequence: Synthetic coding sequence
atggacgtgacttcccaggcacggggggtggggttagagatgtaccctggaaccgcccagcccgcggcacccaacaccacctctccagaactcaatctctcacatccgttactggggacagctctggccaacggtacaggagagctctcagaacaccaacagtatgtcattggcctgttcctttcctgcctttatactatcttcctgttcccaattgggtag

SEQ ID NO: 117752 - DNA, 1227 bp, Artificial Sequence
  Description of Artificial Sequence: Synthetic coding sequence
atggacgtgaccagtcaagctcggggagtgggcctcgaaatgtatccgggaaccgcccagcccgccgccccaaataccacctctcccgagctgaacctgtcccaccctctcttagggactgcacttgccaatggcactggggagctgagtgagcaccagcagtatgtgattggcctcttcctgagctgtctctataccatcttccttttcccaataggtttcgtcggcaacatcctgattctggtcgttaacatatcttttagagaaaagatgaccatcccagacctgtatttcatcaacttggccgtcgcagatctcatcctggtggccgatagcctaatcgaggtcttcaatctgcacgaacgctactatgacatagctgttctctgtaccttcatgtccctgttcttacaggtgaacatgtattctagcgtcttcttcctcacttggatgtcattcgacagatacatcgcactggcacgggccatgaggtgctccctgtttcgaactaaacaccacgcccgtttgtcttgcggactaatctggatggccagtgtatcagctaccctggtaccctttacagcagtacacttgcagcacactgacgaagcttgcttttgtttcgctgacgtcagagaagttcaatggcttgaagtcacacttggtttcatcgtcccattcgccattatcgggctgtgctacagcctgatcgtcagggtcttggtacgggctcaccggcatcgcggtctcagaccacgacgacagaaagccttgagaatgatactggcggtcgtgctagttttctttgtttgctggctgcccgaaaacgtgtttatctccgttcatcttttacagagaacccaaccaggcgcagctccatgtaagcaatcttttcgtcatgctcaccctttgacacatggccacgtgatgtcgttgaactgtggtcagatgtggctcctggctcccaggggactggcacgcgtgaccctcgcctggagcccatggggatgtcttggtaacctgactaccggacacctagcactactcacccaaaattgttacaaccctaaagcactggctccacagggccccaaagccagcggcgaccagccagtcacacaattgcttccagccaacccagcgtgtaggtgtacgtgtctgcccttgcaggagacattcctgactccttccacgcggaaggcaacacggcgaggacattgtgggtag

SEQ ID NO: 117753 - DNA, 1068 bp, Artificial Sequence
  Description of Artificial Sequence: Synthetic coding sequence
atggaagacttggaggagacgttgtttgaggaatttgaaaactatagttacgatctggattactacagtttggagagcgatctggaggaaaaagtacaattgggggtcgtgcattgggtctcgctggtcctgtattgtctggcattcgttctgggcatcccaggaaacgcaattgtcatatggtttactgggtttaagtggaaaaaaaccgtgacaacactgtggttcctaaatctggcaatcgccgattttatcttcctgttatttctacctctgtacatttcatatgtagccatgaatttccactggcccttcggcatctggctatgcaaggcaaactctttcactgcccagcttaatatgttcgcatcggtgtttttcttgaccgtgatttcactagatcactatatccacttaatccacccagtccttagccatcgccatagaacccttaagaactccctgatcgtaatcatcttcatttggctgctggcctctcttattggcggtccagccctctacttcagggacaccgtggaattcaataatcataccctgtgttacaacaattttcaaaagcacgatcccgatctgaccctgatacgccatcacgtccttacatgggtgaagttcataatcggatatctttttccattgttgacaatgtccatctgctacctgtgcctgatatttaaggtgaagaaaagatctatcttgatctctagcagacatttttggactatcctggtcgtggtggtcgcattcgtcgtgtgctggaccccatatcacctgttcagcatctgggagctgacaattcaccacaactcttactcccaccacgtgatgcaggctgggatcccactgagcacgggacttgcttttctgaactcttgtcttaacccgatactttacgtgttaatttccaagaagttccaggctagattccgctcctctgtcgcggaaatcctcaaatacactctttgggaggtgagctgctcggggacagtgtctgagcaattgcggaatagtgagacaaagaatctgtgtcttttagagaccgcgcagtag

SEQ ID NO: 117754 - DNA, 225 bp, Artificial Sequence
  Description of Artificial Sequence: Synthetic coding sequence
atggaggatttggaggaaactctcttcgaagagttcgagaactactcttatgacctggactactactcattagagtctgatctcgaagagaaggtacagctgggcgtcgtccactgggttagtttagtcttgtattgtctggctttcgtgctgggaatcccagggaacgccattgtgatctggtttacaggatttaagtggaagaaaacagtaacaacactgtag

SEQ ID NO: 117755 - DNA, 1068 bp, Artificial Sequence
  Description of Artificial Sequence: Synthetic coding sequence
atggaagacctggaggagaccctcttcgaggagtttgaaaactactcctatgatttagactattattcgttggagtctgacctggaggaaaaggttcagttgggcgtggtccactgggtgagcctggtgctctattgcctcgcatttgttctcggtattcctggtaatgcaattgtcatatggttcaccgggtttaaatggaaaaaaaccgtgactacattatggtttctgaacctcgccattgccgatttcatcttcttgctgtttctccccctgtacattagctacgtcgctatgaacttccactggccctttgggatttggctctgcaaggccaactcttttaccgcccagctaaatatgttcgccagcgtcttctttctgactgtgatcagtttggatcactacatccatctcatccatcctgtcctgtcccacagacatcgcacattgaaaaatagtctgatcgttatcattttcatctggctcctcgcctctctgatcggcggcccggctctgtacttcagggatacagtggaattcaacaaccacaccctctgctataacaatttccagaagcatgacccagacctgacccttatccggcaccacgtgctgacttgggtcaagtttatcatagggtatttgtttcccctcctgacaatgagtatctgttacctgtgtctcattttcaaggttaagaaaaggagtattctgatttctagtcggcacttttggacaattttggtggttgtggtggcgtttgttgtgtgttggactccttaccacttgttttccatctgggaattaaccattcatcacaactcctactctcatcacgttatgcaggccggaatccccttgagcacgggtctcgcttttctcaactcatgcctcaacccaatcctctatgtcctgatctcaaaaaaattccaggcacgttttcggagctcagtggccgagatactgaaatacacgctgtgggaagtgagttgctccggcaccgtcagcgagcagctcagaaatagcgaaacaaagaatttgtgcctactcgagacagcccagtag

SEQ ID NO: 117756 - DNA, 249 bp, Artificial Sequence
  Description of Artificial Sequence: Synthetic coding sequence
atggaagatctggaagagacgctgttcgaggaattcgagaattattcctatgatctcgattattacagtcttgaatccgacttagaggaaaaggtccagctaggcgtcgtgcattgggtgagtctcgttctctactgccttgcttttgtgctagggattcctggcaatgctattgttatttggtttacagggttcaagtggaagaagacagtcactacattgtggtttctaaatcttgctatcgcatag

SEQ ID NO: 117757 - DNA, 684 bp, Artificial Sequence
  Description of Artificial Sequence: Synthetic coding sequence
atggaggacctggaagagactttatttgaagagttcgagaattattcgtacgaccttgattactacagtttagaatccgaccttgaggaaaaggttcagctgggggtggtgcactgggtgagtctagtcctgtattgcctcgccttcgtcctgggaatccctggaaatgcgattgtgatctggtttactggtttcaagtggaaaaagacagtcactactctgtggtttcttaatttggccattgccgactttattttccttctgtttctgcctctgtacatctcctacgtggctatgaacttccactggcctttcggtatttggctatgcaaggcaaatagttttactgcccagctcaacatgtttgcctcagtgttctttctgacagtgatctcactcgaccactacattcacctgatccaccccgtactcagccaccgtcaccggacattgaagaattctctgattgtaatcatcttcatctggcttttggctagtctcataggagggcccgcactgtattttcgagataccgtagagttcaataaccatacgctctgttataataattttcaaaagcatgacccagatttaactcttattcggcatcacgtcctgacgtgggttaaattcataatcggataccttttcccattgctgaccatgagcatctgctacctgtag

SEQ ID NO: 117758 - DNA, 414 bp, Artificial Sequence
  Description of Artificial Sequence: Synthetic coding sequence
atggaggatcttgaagagacccttttcgaagaattcgagaattactcctacgatctcgactactacagcctagaaagtgatctggaggagaaggtacaactcggggtagttcactgggtgagcctggtgctctactgtctagccttcgtccttggcattcccgggaacgcaatcgttatctggttcacagggtttaagtggaagaagaccgtgacgactctctggttcctgaatttggcaatagctgacttcatcttccttctgttcctgcctctctatatttcgtacgtggccatgaacttccactggcctttcggaatctggttgtgtaaagctaattcatttaccgcccaactgaacatgttcgctagcgtgttcttcttgactgtcatctcacttgaccattacatctag

SEQ ID NO: 117759 - DNA, 537 bp, Artificial Sequence
  Description of Artificial Sequence: Synthetic coding sequence
atggaggatctagaagaaacgcttttcgaagaattcgagaattactcttacgatctggactactactctttagagtccgacctggaagaaaaggtacagctgggggtggtgcactgggtgagcctggtgctgtattgcttggcttttgtgctaggcatcccaggcaacgccatcgtgatctggtttaccggctttaaatggaaaaagacagtgacaaccctgtggttcctcaacctggccatcgcggattttatttttctgctgtttctccccctatatatcagctacgtggccatgaacttccactggccattcgggatttggctttgtaaagcaaacagctttactgctcagctcaatatgttcgcgagtgtcttctttttaactgtgattagccttgatcactacattcatctaattcatcccgttttgagtcatcggcaccgcaccctcaagaactctttgattgtaataatctttatctggctgctggcaagccttatcggcggtcctgcattgtacttccgggatacctag

SEQ ID NO: 117760 - DNA, 60 bp, Artificial Sequence
  Description of Artificial Sequence: Synthetic coding sequence
atggaagatttggaggaaaccttattcgaagagtttgaaaactatagctatgatttgtag

SEQ ID NO: 117761 - DNA, 1527 bp, Artificial Sequence
  Description of Artificial Sequence: Synthetic coding sequence
atgacctctacctgcaccaacagcacaagagagtccaacagtagccatacatgtatgcctctctcaaagatgccaatcagcctggcccacggtattatacggagtacagttttggtaatatttttggctgcctcctttgtggggaatattgtcctggcgcttgtcttgcagcgaaagccccagctgttgcaggttactaatcgcttcatttttaatctgcttgttaccgaccttctgcagatcagccttgtggccccttgggtggtcgccactagcgttcccctgttctggccactcaatagccacttctgtacagctcttgttagcctcacgcatctcttcgcattcgccagcgtgaatacaattgtcgtggtgagcgtcgatcgctatttatcaataattcaccctctgtcctacccaagtaaaatgacccagcgccggggctacctcctcctgtatggaacctggattgtggcaatcttgcagtccacccccccgctgtatggctggggtcaggcagcatttgacgaacggaatgccctgtgctctatgatttggggggcctctccctcttatactatcctcagcgtcgtgtcttttattgttataccattaatagtaatgattgcatgttacagtgtcgtgttttgcgctgcccggcggcaacacgccctgttatacaatgttaagaggcattctttggaggtcagagtaaaagactgcgtggagaacgaagatgaggagggagccgagaagaaggaagagttccaggatgagtccgaattccgcaggcagcatgagggtgaggtgaaggccaaggagggccgcatggaggcaaaagatgggtctttgaaggcgaaagaggggagtaccggtacttcagagagttctgtcgaggcccgcggttctgaggaagtgcgggaaagcagcaccgtagccagtgacggctctatggaagggaaggaaggctcgaccaaggtggaggaaaacagcatgaaagccgacaagggcaggacggaggtgaatcagtgttctatcgatctgggcgaagacgacatggaattcggggaagacgacatcaatttctctgaagacgatgtggaggccgtgaatatcccagagtctttgccaccttcccggcgtaatagtaatagcaacccccccctgcctcgctgctaccaatgcaaggcagctaaggtaatcttcattatcatcttctcttacgtgctaagcctaggaccttattgctttttagctgtattggcggtgtgggtggatgtggaaacgcaagtgccccagtgggtgattaccattattatttggcttttctttctgcagtgctgcattcatccatatgtctatggatacatgcacaagactatcaagaaagagatacaggatatgctcaagaaatttttttgtaaggaaaagcctccgaaggaagacagccatccagacctacctgggaccgagggcggaacagaaggaaaaattgtgcccagctatgactctgccacttttccgtag

SEQ ID NO: 117762 - DNA, 2088 bp, Artificial Sequence
  Description of Artificial Sequence: Synthetic coding sequence
atgaagatgaaaagtcaggccaccatgatctgctgtcttgtgtttttcctctcgactgagtgctcccactacaggtctaagatccaccttaaggccggcgacaaactgcagtcaccggagggcaagccaaagactggacgaatccaggaaaaatgcgaaggcccctgtatttcttccagcaactgttctcagccctgtgccaaggactttcacggagaaatcggctttacgtgtaaccagaaaaaatggcagaaatcagcagagacatgcactagcttaagtgttgaaaagctgtttaaggattcaacaggtgcaagcaggctttccgttgcagctccttctatcccattgcacatactggacttcagggcgccagagaccattgaatcagtggcgcagggcatcagaaaaaactgcccgtttgattacgcttgcatcactgacatggtgaaaagcagtgagactacttcaggcaatatcgcgtttattgtggagctattgaaaaacattagtaccgatctgtccgataatgtcactcgggagaaaatgaaatcctactccgaagtggccaaccatatcctggacaccgcagcgatttccaattgggcctttataccaaataaaaacgcctcttccgacctgctgcagagcgttaacctgtttgctcgtcagctccatatccataacaacagtgagaacatcgtaaacgagctgtttattcagacaaagggtttccacattaatcataacacttctgagaaatccctaaacttctccatgtctatgaataacacaacagaggacatactgggaatggtccagattcctcgccaagagctgcgaaagctgtggcctaacgccagtcaggcaataagcatcgcgtttcctacactcggtgccatcctgagagaagctcatcttcagaacgtctctctgcccagacaggtaaacgggctggttttgagcgttgtgcttccggaacgcctgcaagagatcatcttgacattcgagaagattaataaaacgcgaaacgcccgagcccagtgcgttggatggcacagcaagaaacgcagatgggatgagaaggcctgccagatgatgcttgatataagaaatgaggtcaagtgtcgatgtaactatacttccgtggtgatgagcttctctatactcatgagctctaagagtatgactgacaaagttctggactatattacctgtattggcctgtcagtctccatcctctctctcgtgctctgtctcatcatagaggccaccgtctggagtcgggtggtggtgaccgaaattagctatatgcgtcatgtttgtatcgtcaacattgcagtgtcactcttgaccgccaacgtatggttcatcattggctcacatttcaacattaaggcccaggattataacatgtgcgtcgctgtaacatttttctcacactttttttatctttcactttttttttggatgttgttcaaagccttgcttatcatatatggcattttggtgattttcagacgtatgatgaaatccagaatgatggtgatcggattcgcgatagggtatggatgtccattgattattgcggtgaccactgtggccatcactgagcctgagaaggggtatatgcgccccgaggcctgttggctcaactgggacaacacaaaggcactgttggcttttgcaattccagcattcgttattgtggccgtgaacttgatagtggtgcttgtagttgctgttaacacccagcggccatctatcggctccagtaaatcccaggacgtggtcattattatgcgcatatctaagaatgttgcaatactgacgccattgctggggttgacttgggggtttggcatcgctacactgatcgaaggcacctctttgactttccacatcatcttcgctctcttgaacgcatttcaaggattttttatcctgctcttcggcaccattatggatcacaagatcagggatgctcttcgtatgaggatgtctagccttaaaggaaaatccagggccgccgaaaatgcgagtctgggccccacaaacggcagcaagctgatgaacagacaaggctag

SEQ ID NO: 117763 - DNA, 2088 bp, Artificial Sequence
  Description of Artificial Sequence: Synthetic coding sequence
atgaaaatgaaatcacaggccactatgatctgttgccttgtttttttcctctctacggagtgcagtcattacagatccaagatccacctcaaggctggagacaaattacaatccccggagggcaagcctaaaacaggccggatccaggaaaaatgtgagggtccctgcatttcttcttccaattgctcgcagccctgcgctaaggattttcacggggaaatcggtttcacatgcaaccagaagaagtggcagaaatccgccgaaacatgcacatctctttcggttgaaaagctgtttaaagacagcaccggagcctctcgtctctctgtggccgcaccttccatccccctccacatcctggacttccgcgccccagagactatcgagtctgtcgctcagggcattcgcaagaactgcccttttgactacgcttgtatcactgacatggtcaagtcttccgaaaccacatcaggaaatatcgccttcatagtggaactgcttaagaacatcagcacagacctttcagacaatgttaccagggagaaaatgaaatcatacagcgaggtggccaaccatattctagataccgccgccatctctaactgggctttcatcccaaacaaaaacgcctcttcggatttgctgcagagtgtcaacttatttgcccgtcagttgcacatccataacaatagcgagaacatcgtgaatgagctctttatccagacaaaaggcttccatattaatcataacacatctgaaaagtcactaaatttctctatgtcaatgaataatacaacggaggacattttagggatggtccagatcccccggcaagagctgcgcaagctgtggccgaacgcctctcaggctattagcatagctttcccaaccctcggggccattctccgagaggctcacctgcaaaatgtctccctgccccggcaggtcaacggtttagtgctctcagtggttctgcctgaacgactgcaggagattatcctgacctttgaaaagatcaacaaaactcgaaacgctcgggcccagtgcgtagggtggcactcaaagaaacgtcgttgggacgaaaaggcatgccagatgatgctcgacattcgcaacgaagttaagtgtcgctgtaactacacaagcgtggttatgtccttctctatcctgatgtcttccaagtcaatgaccgacaaggtcctggattacatcacctgcatcggcttgagtgtttctattctctctctcgttttgtgcctgatcattgaggcgactgtttggagtcgagtggtggtgaccgaaatttcctatatgcgacacgtctgcatagttaacatcgccgtgtcactcctaacggcaaacgtctggtttattatcggctcacactttaacatcaaagcccaggactacaacatgtgtgttgccgttacttttttttcccactttttctaccttagcctctttttctggatgctgtttaaggccttactcatcatttatgggatcttggtcatttttcgcaggatgatgaagagccgcatgatggtgatcgggttcgcaatagggtacggctgccccctaattatcgccgttacgacagtggcgattacagagccggaaaagggatacatgcgaccagaggcgtgctggttgaattgggacaacaccaaagctttactcgccttcgctatccctgcatttgtcattgtggcggtaaatctcattgtagtgctcgtggtggctgtgaacacacagcgcccttccataggatcctctaaatctcaggacgtagtcattatcatgcggattagtaagaacgttgccattctaactccactacttgggcttacctggggattcggcattgcgactttgatcgaaggcacctcactgaccttccatatcatttttgctctcctgaatgccttccagggcttttttatcctactgttcggcactattatggaccataaaattagggacgcactgagaatgcgcatgtcatcccttaaaggaaaatcaagagccgcagagaacgcttcactcgggcccaccaacggtagcaaactgatgaatcgacaagggtag

SEQ ID NO: 117764 - DNA, 2259 bp, Artificial Sequence
  Description of Artificial Sequence: Synthetic coding sequence
atgtacaccggaccatgcaaggtgctgcacctgagttccgggctgctgcccaattccggccgcttcggtattgtgctttcagacgaatatcaggtcgtcacctcactttggtgtcagctatacacaactcacgctccccagcaagctagtggtatgcttctactgaattacctggttattccatcgaaggcacaggttaacaagccaggctatattcccaatctcggcgagtgcagtcattatcggagcaagattcatctgaaagccggagataaactacaatcacctgaaggaaagcccaaaaccggaaggattcaggagaaatgcgaagggccatgcatatcttctagcaactgcagtcagccctgcgccaaggacttccacggtgaaataggatttacatgcaatcagaagaaatggcaaaagagcgcggagacctgcacttcattgagcgtggagaaactgttcaaggactcgacaggggcttccagactgtcggttgcagccccttccatccccctgcacatacttgactttagggccccagaaaccatcgagtctgtggcccaaggaatcagaaaaaattgcccctttgactatgcttgcatcacagacatggtgaaaagtagtgaaaccaccagtggaaatatcgccttcattgtcgagctactaaagaacattagcacagatctgtcggacaatgtgacgcgggagaaaatgaagtcatattccgaagttgctaaccatatccttgacacagcagctatcagcaactgggcatttattcccaacaagaatgcgtcttctgatcttcttcagagcgtcaatctgttcgcccgccaactgcatattcacaacaattccgaaaacatcgtgaatgaactgtttattcagacaaagggtttccatatcaatcataacactagcgagaaatcgctgaatttttctatgtccatgaacaacacaaccgaagatattctgggcatggtgcagattccgagacaagagctgaggaagctttggcctaatgccagccaagccataagtatcgcatttccgactctgggcgcaatcttgcgtgaagctcacctgcagaatgtctcactcccgaggcaagttaatgggctggtgcttagcgtagtgctacctgagcggctgcaggagattattctgacattcgaaaaaatcaataagactagaaatgctagagcccaatgtgtgggctggcacagcaagaagcggcgatgggatgagaaagcatgccagatgatgctcgatatccggaatgaggttaaatgtagatgcaattacacctcagtggtcatgagcttctctatcttaatgtcctccaagtccatgaccgataaagtgctagattacattacctgtattgggctcagtgtgtctattctgagcctcgtactgtgcctgattattgaggctactgtttggtcaagggtagtcgttacagagatttcctatatgcggcatgtatgcatcgtgaatatcgctgtctctctgctgactgccaacgtgtggttcatcatcgggtcacactttaacataaaagcgcaggactacaacatgtgtgtcgcggtaacctttttctcacatttcttctacctcagtctctttttctggatgttgtttaaggctctactaataatctatggcattctcgttatctttcgacggatgatgaagtctaggatgatggtgatcggattcgcgatcggttatggttgccctctcattatcgccgtcaccacagtggccataacagaacccgaaaaggggtatatgaggcctgaggcgtgctggctgaattgggacaatactaaagcattgctggcattcgcgattcctgcatttgtcatagttgcagtcaatctcatcgtcgtgcttgtagtagctgtcaatacccagaggccctcaataggaagttcaaagtcccaagacgttgtgatcattatgcgtatcagcaagaacgtggccatacttacaccactactgggactgacctgggggtttgggattgccacccttattgaggggactagcctcaccttccacattatttttgcacttctgaatgccttccaaggcttctttatccttttgttcgggaccatcatggatcataaaatccgcgatgcactccgaatgagaatgtcctctctgaagggaaagagtcgcgcagccgagaacgcaagcctggggcccactaatggaagcaaactgatgaatcggcagggttag

SEQ ID NO: 117765 - DNA, 1005 bp, Artificial Sequence
  Description of Artificial Sequence: Synthetic coding sequence
atgaacgaggatctgaaggtcaatctctccggactgcccagagactatttggacgctgccgccgcagagaacatatccgctgccgtcagttcccgagtgcccgccgtcgagcccgagccagaactcgtggtgaacccttgggatattgttctgtgcactagtggcactctgatttcttgtgagaacgctattgtcgtcctgatcatctttcacaatccttcgctacgcgcacctatgtttctgctgatcggtagcctggcgcttgccgaccttctggcagggatcggtttgatcactaatttcgtattcgcctatctgttacaatcagaggccacaaagctggtgaccatcgggctcatagtcgcaagtttcagtgcgtctgtatgtagcctgctggcaataacagtggatcggtatctcagcctttattatgcactcacctaccactccgagcgaactgtgaccttcacttacgtgatgctggttatgctgtggggcacttcaatatgtttagggctgttgccagttatgggttggaattgcctcagagatgagtcaacctgttccgtggtgcggcccctaacgaaaaacaatgcagctatactgtccgtatcattcctgtttatgttcgccctgatgctgcagctgtacatccagatctgcaaaatagtaatgcgccatgcacaccagattgcactccagcaccatttcctggctacctcccactatgtcactactcgcaaaggcgtaagtactctcgctattattctaggtacgtttgctgcatgttggatgccctttactctgtactccctcatcgctgactatacatatcctagtatttacacatacgctacacttctgcccgcgacttataatagcatcatcaacccagtgatctacgccttcagaaatcaggagattcagaaagcactgtgtctgatctgctgtggttgcatcccctcctcacttgcccagcgcgcccggtcgccctcggatgtctag

SEQ ID NO: 117766 - DNA, 1005 bp, Artificial Sequence
  Description of Artificial Sequence: Synthetic coding sequence
atgaacgaagatcttaaagtcaacctttccggtttgccacgtgattacctggatgccgcagctgctgaaaatataagtgccgctgtttcctcaagagtacctgccgtcgagcccgagccagaactggttgtaaatccctgggacattgtgctgtgcacatccggtacactaatcagttgcgagaacgctatcgtggtcctgatcattttccataatcccagccttcgggccccaatgtttcttcttatcggtagtctcgctctcgccgatctgttggcagggatcggccttattaccaacttcgtgtttgcatatttactccagtctgaggccacaaaactagtgacgattggactgatcgtggctagtttctccgccagcgtgtgttctctcttggcaattaccgtcgatcgctatctgtcgctatattacgctttgacctaccactcagaacgtacagtaacgttcacatacgtgatgctagttatgctgtggggaacctctatctgcctgggacttttgccggtgatgggctggaattgcttgagagacgaatctacgtgttccgtcgttaggcctctgaccaagaacaacgctgcgattctcagcgtatccttcttgtttatgtttgcactcatgctgcaactgtatatccagatttgcaagattgtaatgcggcatgcccaccagatcgctctccaacatcactttctcgccacctcccactacgtaacaaccagaaagggggtgtccaccctggctattattctcggtacattcgcagcttgctggatgccgtttactctctactctttgatcgccgactacacatacccttccatatacacatacgccaccctcctccctgctacatacaactcaataatcaatccagtgatttatgctttcaggaaccaggagatccagaaggccctatgtcttatctgctgtggatgcatcccgtcttctttggcccaacgagcccgcagcccctcagatgtctag

SEQ ID NO: 117767 - DNA, 3840 bp, Artificial Sequence
  Description of Artificial Sequence: Synthetic coding sequence
atgaggggccatggcaaccacagccgactaaagtcacggtgtgcatcactcggaaatgtgcaccatcaccaggcgcagatggcccacggggcccactgtcggggaggcaggacacctcaatccccagatagcagaggcccaaccgctggcggtcatacaagggggcgatggacctacaggcccattgaagcgctgatcaacgtttcatttcctggcgccaaaggaggacgcacagcggagggggagcctagctgggcctgggtttttagaagcggctacctgcagagacaagccttgcctggactccccgtgagcacgcgggttgctgcatgctggtggcagcaccatccagggcgcgacagcggattccttggccctggttttattgatctgctacgagaagagccctctggtagagcggatggtaaagccgccgctcaaaagactggcaggctctatctcttcccaacctttctggggaacaagctccccgaggctgcagacagttttggggaaatcgccagtggcaattctgtgatcttcacaagtgtcctgcagagcagccacccacccgggaccccaccaccaagcgcccgtaaacccagccccggcgccgctatgctagtctgcgaggagaccctcgagttaggagcccagggatgttggggaagtacttctcctaggggccaggcggttagtctggttggcggcccaacagcaggagggtctaggctagggggcgctgggtgcacaatgggcctcctcatggcgctgcaggccaggagaccacgggacgggacatgggctgatcctagacggtgtagcagagccgtggaaggctccggtctaaccagagccgctctggtgagtcccgggccaagtggtgtcgaagaagacacaaggcgcgagggatgtgtgctcgtcgggagttggcggtcaagtacccatcgatcccgtgtgcttattatcaatactccgtctggtagaacgccatggtcacagggatctctgggttctactggacgctataaccaaacccgggctcccggttcacagcaacagggtctgtgctctgacgctgcgctacatgaggattttgtaccagaaccaacccccgcattttttcagtaccccccacaagccttctccaaaaccaaggtgagggacctgggcaggggaggattgtacgcctttagcaaagaggagaaggtttctgaagcccagagagtggaggcctacgagacccatgggcttggcttatccacgggtagacagaatcctgtcccatcaccttgcaaaccagggtgcgtctgccagggactggctttggacgccgaggcatggccacggcaccctgggcgccggccatgcgcagccaaagaagcctgtttaggtcccccaggatgctcaggcgaactgtccctgcccgaggaggagggcattgcacctggcgcggccaccgccgctccagcttgggtgcctcacggacgtgtgtccagattcctcactgtgaaactgtttacttacgttacgatgtatcaatgcaagcaggagcgcatccttagactgtgtatctcaggtgaatcggggaggtatgtccgccgctccagattcagaaacttcgccgccctgatggtaagtaccggggtcccaggagtgctgcagctgggtgccagacccttaaggggggggggccatccttacggcgactctcaggccggaaaagtcgtggagtggcgcgcaggcgatagagcatcaggtctgagcgccggcgagagacgcttcctttctcagtcagaactccagacctggccccgcactccccattgtgtcggaaagaaggtgcctcagccagttggcgcggctgacttggcccccgacacatccttgtgcagaaaggaaggaagctctgctagcaggtcttgtcggcccgggcctggtcacctaaccagaagagaagaagacagttttaggcaactggcctttccacgcttcgaagaggtgaccttcccacccttgaccgctgccgagcgagccccctcagtgcacggcgggcacagtctcgcctcacaaggcttggtgcttgcaggccggacccgctcagttgcgtccgggggaaaacaggaactgtccggccccctggctgcctgcattcctactcaagacctcaaaacagtgttgtccctcccacgatatccaggggaatttttacaccccgttgtgtatgcttgcacagccgttatgctgctgtgtttgctcgcatcctttgttacgtacatagtacaccagtccgcgatacggatctcacggaaaggccggcatactttgctgaacttctgctttcacgccgctctgacgttcaccgtgttcgccggcgggataaacaggacaaagtaccccatcctatgccaagcagttggaattgtcctccattatagcaccctttctactatgttgtggattggagtaacagcacgcaacatctacaaacaagtgacaaagaaagccccactgtgtctggatactgaccagcctccatatccccgtcagcctctccttaggttttatttggtcagcgggggagtcccctttataatctgtggagtaactgcggcaaccaacattcgcaactacgggactgaagatgaggacaccgcgtgctggatggcttgggagcccagtctcggggccttctatggacctgccgctatcatcacacttgtcacttgtgtctacttcctcggtacctatgttcagctgcgcaggcaccctgggcgtagatacgaactgagaacacagccagaagagcaacgaagactcgcaactcctgaaggcggtagggggatccggccagggacgccgccagcgcacgatgctccgggcgcaagtgtcctccagaatgagcatagttttcaggctcagcttagagctgcggccttcacgctcttcctctttaccgccacctgggctttcggtgcacttgccgtctctcagggtcactttctggatatggtgtttagttgcctgtacggagctttttgtgttacacttggccttttcgtcctgattcaccactgtgccaagagggaagatgtatggcagtgctggtgggcctgctgtccgccccgtaaagatgctcatcctgcactcgatgccaacggcgcagctctaggccgtgcggcgtgtctgcactcccctggacttggccagccaaggggattcgcccatcctcctggtccttgtaaaatgacgaatctacaagccgcgcagggtcatgcgagctgtctaagccccgcaacaccctgttgtgccaagatgcattgcgaacctctaaccgcagacgaagcccacgtccatctgcaggaagaaggggctttcgggcatgatccccacctgcacgggtgtcttcagggccgaaccaagcccccttatttttcacggcaccccgccgaagagcccgaatatgcctatcatatcccatcctccttagacggatcaccacgttcctccaggacagacagcccacctagcagcttggatgggcccgctggcactcatactctcgcttgctgtacgcaaggtgacccgtttcccatggtgacccagcctgaaggcagtgatggctcccccgcattatattcatgccctacccagccaggccgagaggctgcccttgggcctgggcatctggaaatgctgagacggactcagagcctgcctttcggtggtccttctcagaacgggcttcctaaaggaaagctgttggagggtctgccattcgggacggatggcactggaaatattcgcaccgggccatggaagaacgagactaccgtgtag

SEQ ID NO: 117768 - DNA, 1395 bp, Artificial Sequence
  Description of Artificial Sequence: Synthetic coding sequence
atgttgtggattggagttaccgcgaggaacatatacaaacaggtgacgaagaaagcacccctttgtcttgataccgaccagcccccatacccaagacagcccctgctgagtcgtttttacctggtaagcgggggcgtgcctttcattatttgtggggtgaccgccgcgactaacattcggaattatggcaccgaagacgaggatacagcgtactgttggatggcttgggaacctagtctgggagccttctatggccccgccgcaataatcactctggtgacttgtgtctactttcttggcacctacgttcagctcagacggcaccccggacggagatatgagttgcgcacccagccggaagagcaacggcgattggctactccagaaggtggcagaggcattcgcccgggcacaccaccagcgcacgacgctcctggggcatcggtcctgcagaatgaacactcctttcaggcccagctgagagctgccgcctttactctgttcctcttcactgcaacatgggctttcggtgcattggcagtctcccaggggcatttcttagatatggtcttctcatgtctgtatggggccttttgcgttactctgggactgttcgttctgatacatcattgcgccaagcgtgaagacgtttggcagtgttggtgggcttgctgccctccacgaaaggacgcgcaccccgctctcgacgccaacggagcagctctgggccgggctgcctgcctgcactctccagggctgggtcaaccgcgcggctttgctcaccccccagggccctgcaagatgacaaacttacaagctgcccagggacatgcgtcatgcctgagtcccgcaacgccctgctgcgccaaaatgcactgcgaacctttgactgctgacgaagcccatgtccacctgcaggaagagggcgctttcgggcacgatccccacctccacgggtgcctgcaagggcgcaccaaaccaccttatttcagccgtcaccccgccgaagaaccggagtatgcttaccacatcccttcaagcctggacggctcgcctaggtcctcacggactgattcaccaccgagtagcctggatggacccgccgggacgcacacacttgcctgctgcacacagggggatccatttcctatggtaacccaacctgaggggtcagatggcagccctgctttgtattcttgtcccactcagcctggccgggaggctgccctcgggcccggacacctcgagatgctgagaagaactcagtccctgcccttcgggggccccagccagaatggcctgccaaaggggaaattacttgaaggcctgccatttgggactgacggtaccggaaacatcaggacgggaccttggaaaaatgaaactactgtttag

SEQ ID NO: 117769 - DNA, 1683 bp, Artificial Sequence
  Description of Artificial Sequence: Synthetic coding sequence
atggatctgaaaactgttttgtccctccccagatacccgggtgagttcctgcacccagtggtatacgcctgtacagccgtaatgctgctgtgtctgctagcatcattcgtgacttatatagtacatcagtctgcaatccgcatcagcagaaaggggagacacaccctgctaaatttttgttttcacgcagcgctcacatttactgtgttcgctggagggattaaccgcacaaagtacccaattctctgtcaggccgttggcatagttctgcactattccaccctgagcaccatgctgtggattggtgtcacagccaggaatatctataagcaagtgacaaagaaagctccactatgtcttgatactgatcagcccccatacccaaggcagcccctgttgcgcttctatctggtgtccggcggagttccattcattatctgcggtgtgactgccgctactaatatccggaactacggaacggaagatgaggataccgcatattgttggatggcctgggagccttctctaggagcattttatggccccgcagccatcattaccctggttacttgcgtttatttcctgggaacgtatgtacagctccggaggcatcccggccgccgctacgagctgagaactcaacccgaggagcaaaggcgattggcaactcccgaaggcggccgtggaattaggcccggcacccctcccgcccatgacgcccctggtgcctcagtattacagaatgaacactctttccaagctcagcttcgtgcagccgccttcactctgtttctgttcaccgcgacctgggcgtttggagcgctcgccgtgtcacagggacattttttggacatggtgtttagctgcctgtatggagctttctgtgtgacactgggcctgttcgtcctcatacatcactgtgccaagcgggaagatgtctggcagtgctggtgggcctgttgccctccaaggaaagacgctcaccctgctctggatgcaaatggggcagcactgggcagagccgcctgcctccactcccccggcctgggtcagcctcgaggattcgcccacccccccggaccttgtaagatgacaaatctacaggccgcacaggggcatgcctcttgcctgtcgcccgcaactccttgctgcgccaagatgcattgcgagccactgacagccgacgaggcccatgtgcacctgcaggaagaaggcgctttcgggcacgacccccacctgcatggatgcttgcaagggcgaactaagccgccctacttttccaggcacccagcggaagaacctgagtacgcctatcacataccaagttctctagatggcagtcctagaagctcaaggaccgatagtccgcccagctccttggacggcccagctggcacacacacattggcctgctgcactcagggggatcctttccctatggttacacagccagaaggtagtgatgggtcccctgccctgtacagttgccctacgcaacccggccgagaagcagcattgggccctggccacctggaaatgctgcggagaacacaatcactgcctttcggcggaccgtcccagaatggtttacccaaaggtaaactgctggagggcctacccttcggaaccgatggaactgggaacattagaactggcccctggaaaaacgagacaactgtgtag

SEQ ID NO: 117770 - DNA, 2562 bp, Artificial Sequence
  Description of Artificial Sequence: Synthetic coding sequence
atgagaggacacggaaatcattcaagattgaagtcccgatgtgcgagcctgggtaacgtgcatcatcatcaggctcagatggcccacggagctcattgccgcgggggacggacaccgcagagtccggacagccggggccctaccgccggaggccatacccgcggtagatggacgtaccggcccattgaagcattgatcaatgtgtcttttcctggggccaagggaggccgcaccgcagagggagaacccagttgggcatgggtctttcgatcgggttacctgcaaaggcaggccctccccggtctaccagtgtctaccagagtggccgcttgctggtggcaacaccacccagggagggatagtgggttcctgggacccggctttattgatctgctaagggaggaaccttctggaagagcggatggcaaggccgccgcacaaaaaacggggcgcctctatctatttccaacctttttgggcaataagttgcccgaagctgccgattctttcggggaaatcgccagtgggaacagtgtgatttttacctctgtgttacagagcagccatccccccggtactcccccacccagcgcacgtaaacctagcccaggagccgccatgttagtctgcgaggagacgcttgagctgggagcccaggggtgctgggggtccactagtccacggggccaagctgtgtctcttgtcggaggtccaacagcaggggggagccggttgggcggtgccggctgtacaatgggcctccttatggccctgcaggctagaaggccccgggacggaacttgggccgacccgaggcggtgctcaagggccgttgaagggagcgggctgactagggccgctttagtatcacctggaccctctggtgttgaggaggacacacggcgtgaaggatgtgtgctggtgggttcctggaggtcaagcacccatagatctcgcgtgctcatcatcaatactcctagcggacgaaccccctggagtcagggaagcctcggaagtacaggccggtacaaccagacaagggccccggggagtcagcagcagggactctgtagtgacgctgccttgcatgaggattttgtgccagaacccacacctgctttctttcagtacccaccccaggccttctccaagacaaaagtacgggatcttggacggggaggtctctacgccttttccaaagaagagaaggtaagcgaagcacagcgagtcgaagcctacgaaacgcacggactcggactcagcaccggccgacagaacccagtcccaagcccatgtaaacctgggtgcgtctgccagggcttagctctggacgccgaggcctggccacgccacccagggagacgtccctgtgccgccaaggaggcctgccttggaccacccggttgcagcggcgaactctcactgcctgaggaggagggcatcgcaccaggagccgcgaccgctgccccagcctgggtccctcacgggcgcgttagtcggtttctgacggtgaagctcttcacctatgttacgatgtatcagtgtaaacaggagcgtattctgcggctttgcatcagcggcgagtctggcagatacgttagacgttctcgctttcgtaattttgccgctttaatggtcagtaccggggtccctggggtgctgcaattgggagccaggcccctcagagggggtggacacccctatggtgacagtcaggccgggaaggtggttgaatggcgggcgggagacagagcttccggcctgtcagccggcgagagacgattcttgtctcaatccgaactccagacatggcccagaactccacactgcgtcgggaagaaggtcccccagcctgtcggcgccgcagatctagctcctgacacctctctttgccgaaaggagggaagcagcgcctcaaggtcatgcaggccgggacctggacaccttacacgaagagaggaggactcttttcggcaactggcattccccagatttgaagaggtcacgtttcctcccctgactgccgcagagcgcgccccttcagtgcacggcggtcatagcctggctagccagggcctggtcctcgccggtcggactcgtagcgtcgcctcggggggtaagcaggagctgtctgggcctctcgccgcctgcattcctactcaggatcttaaaacagtactgagcttaccccgctatcctggtgagttcctgcaccccgtggtatacgcctgcaccgccgtcatgctcctatgcctgctggctagctttgtcacatatatcgtacatcaaagcgccatccggatcagccggaaaggtcgccacaccttactcaacttttgctttcatgctgctgagcatcccggtgtcaccccactgagaaccagtcctcctctgccttggtggacgccaattcaggtgggaatcgtacttcattactccacactgagcacgatgctctggatcggcgtcactgcaaggaacatctataaacaagttaccaagaaggcccctttgtgtttggacaccgaccagcctccttatcccaggcagcccctgctatag

SEQ ID NO: 117771 - DNA, 3366 bp, Artificial Sequence
  Description of Artificial Sequence: Synthetic coding sequence
atgggggccggcgggcggcgaatgcgtggtgccccagctcgcctgcttttgcccttactgccatggctcttactcctgcttgcgcccgaggcccgtggagcccccgggtgcccactgagtattaggtcatgcaagtgcagcggggagcgtcctaagggccttagcggcggagtgcctggaccagctaggaggagagtggtgtgctcaggtggtgacctacctgaacctcctgagccggggctgctgccaaacgggacagtgaccctgctcctgtctaataataaaattacaggcctgagaaacggaagttttctcgggctgtctctacttgagaagctcgacttgcggaacaacattatctcgacagtgcagccaggcgcctttctcgggctgggcgagctaaaaaggctcgacctctccaacaacagaatcggttgtcttactagcgaaacattccagggtttgccacggttactgagactgaatatctcaggaaacattttcagttccctacagccaggcgtgttcgacgagctcccagctttgaaagtagtggatctcggcactgagttcttgacatgtgattgccaccttcggtggctgcttccatgggcccaaaacagaagtttacaactgagtgagcacacactgtgtgcttacccaagtgcactgcatgcacaagctttgggtagtttacaggaggctcaactctgctgcgaaggtgcacttgagctgcacacccaccacctaatcccctctttgcgacaagtggtcttccagggcgaccgcctgcctttccagtgcagtgcctcttatttggggaacgatacgagaattcgttggtaccacaacagggcacctgtggagggcgacgaacaggcaggcatcctgcttgcagaaagtttgatacacgactgcaccttcattacaagtgagcttaccctgtcgcacataggggtctgggctagcggcgagtgggaatgtactgtatccatggcccaaggtaacgccagcaagaaggttgaaattgtggtcctggagacgagcgcctcctattgtccagcagaaagagtagctaacaatagaggcgattttcgctggcctcgcacgctggccgggataacagcttaccaaagctgcctgcagtacccatttacaagtgtcccactaggcggaggcgcgcctgggacgagggcttctcgacgctgcgatcgcgccggtagatgggagcccggggattacagccactgtctttatactaacgatataacccgggtgctgtacactttcgtgttgatgcccatcaatgcttccaatgctctgacactggcccaccaattgagagtatacaccgccgaagctgcgagtttttctgacatgatggatgttgtgtacgtggctcaaatgatccaaaagttcctgggctacgtcgatcagatcaaggaactggtggaggtgatggtggatatggcaagcaatttgatgctcgtggatgaacacttgctgtggctggcccagcgagaggacaaggcttgctctaggatagtcggtgctctagaaagaatcggcggcgcggctttgtccccccatgcacagcacataagtgtggaactgtcagcctttccccgtgaagtggggggagcaggtgctggcctgcatcctgttgtttatccatgcactgcacttctgctcttatgtcttttcgcaacaattattacatacatcttaaaccactcatccatacgcgtgtcacggaagggctggcatatgctgctgaacctttgctttcacatagctatgacatcagccgtctttgcgggaggcattaccttgaccaactaccagatggtctgtcaagccgtgggtatcactctccactattcttccctgagtacccttctgtggatgggggtgaaggccagagtgctccacaaggagcttacctggagagcccccccaccccaagagggggacccagccctgccaactccctccccaatgctgagattctacctgatagctggagggattcccctaattatttgcgggatcactgctgccgtgaacatccataactatagggatcatagtccctactgctggttagtttggcgccctagccttggggctttctacattcctgtggcgctcatcctgctcattacatggatttatttcctgtgtgccggactcaggctgcgcggccccctggctcagaatccgaaggccggcaattctcgcgcaagtctcgaggcaggggaggagctgagggggtctacccgattgcgaggctcagggcctttgttgtccgacagcggaagcctgctcgctacaggatcggcccgagtgggaactccaggcccacctgaggacggcgattccctttactctccaggagtgcagctaggtgcccttgtcacaacccattttctgtacttggcgatgtgggcctgtggcgccctggcggtgagtcagagatggctgccccgcgtcgtgtgcagctgtctttacggagtggccgcatcagccctcggtttgttcgtgttcactcatcactgtgcccgccgcagagacgttcgggctagctggcgggcatgttgccccccagcctctccagcagcaccgcacgctccacctagagctttaccagctgctgcagaggatggctccccagtgttcggtgagggccctcctagccttaagagcagcccaagcggatcaagcggtcatccgctggctcttgggccctgcaaactcaccaatctgcagctcgcgcagtcccaggtatgcgaggctggggctgccgccggaggggagggcgagcctgaacctgccggaacacgtggaaatctggcacacagacatcctaacaatgtgcatcacggccgccgggctcataaatcacgcgccaagggccaccgtgccggggaggcctgtgggaaaaaccgtctgaaggcgcttcgagggggagctgccggagccctggagttactaagcagtgagtcaggctctcttcacaatagccctaccgattcttatctaggcagctctcggaactctcctggcgccggactacagctggagggcgagcccatgctgaccccctcagaaggttctgatacctctgctgcccccctgagtgaggcaggccgggctggtcagcggcgtagcgcctcaagagatagcctcaagggggggggggcgttagagaaggagtcccatcgccgaagttatccccttaatgcagcatctctcaatggcgccccaaagggggggaaatacgacgatgtgaccctcatgggcgcggaagtggcgtccggagggtgtatgaaaaccggactttggaaatccgagaccaccgtgtag

SEQ ID NO: 117772 - DNA, 4017 bp, Artificial Sequence
  Description of Artificial Sequence: Synthetic coding sequence
atgggtgctgggggtcgtagaatgcggggcgcacccgccaggcttcttctgccgctcctgccttggttgcttctcctcctggcacccgaagcaaggggggcgccaggttgtcccctgtccatccgatcttgtaagtgcagcggcgaaaggccaaagggcctcagcgggggagtgcctggaccagcccgaaggcgcgttgtttgcagtggcggggacctaccagaaccaccagaacccgggctcctacctaatggcactgttacactcctcctttcaaataataaaatcactggtctccgaaatggctccttcctcggactctccttactcgaaaagctggacttacgcaataatataatcagcactgttcaaccaggtgcctttttgggattaggggaattgaagcgcttggacctgtctaacaaccgcatcggatgcctcacctcagagaccttccaaggccttcctcgtctgttgaggctcaatatcagcggaaatatcttttcatcgctgcagcccggggtgtttgatgagctgccagctcttaaggtggtagacctcgggaccgaattcctaacttgcgattgccacctaaggtggctgctcccttgggcacaaaatcgctccctgcagctcagtgaacacaccctgtgtgcttatccttctgccctgcacgcccaggccttgggaagtctccaggaggcacagctgtgctgtgagggcgccttggaactgcacacacatcacctcatacccagcttgaggcaggtggtgttccagggcgaccgcctgcctttccagtgctcagcatcctatttaggaaacgataccagaatacgctggtatcataatcgtgcccctgtcgagggggacgaacaagcaggaattcttctggccgaaagtctcatccacgattgcactttcataacctcagaactgactctgtctcacatcggcgtgtgggctagtggcgaatgggaatgcactgtcagtatggcacagggcaacgcgagcaaaaaggtcgagattgttgttctggagacttcagcttcatactgtcccgccgagagagtggcaaacaatcggggggattttcgctggccacggacacttgccgggatcaccgcttatcagagctgccttcagtatccatttacttctgttcctctgggcgggggagcacctggcactagggcttcacgcaggtgcgaccgggcaggacgttgggaaccaggtgactatagccactgcctatatacaaatgacataacaagggttctttatacctttgtactgatgcctatcaatgcttctaacgcgctgactctggcccaccagttgcgagtgtatacagccgaggctgctagcttcagcgacatgatggatgtggtgtacgtagcacagatgatccagaaatttctgggctatgttgatcagatcaaagaattggttgaagttatggtggatatggcctcgaacctgatgctggtggacgaacacttactgtggctcgctcagcgggaagataaggcatgctccaggatagttggggctctagaacggattggcggggccgccctctcacctcatgcacaacacatctccgtgaatgctcggaacgtagccctagaagcctatctgataaaacctcattcctatgtaggccttacgtgcacagctttccagcggcgtgagggaggcgtcccagggactcgccccgggtctccaggacaaaacccccccccggagcctgaaccccctgccgatcaacagctgcgtttccggtgcactacagggcgccctaatgtttccctttcaagttttcacatcaagaactcagtcgcgttagccagcattcagctgcccccctccctattcagctctttgcccgcggcactggcgccacccgttcctcccgattgtaccctccaactcctggtattcagaaatggtcggctctttcatagtcattccaacacttcccggcccggcgctgccggccccggtaaacggcgcggggtggcaacacccgttattttcgcaggcacctcaggctgtggcgtcggcaatctgactgagccagtggccgtaagtctcagacactgggcggagggagcagagccagtggccgcgtggtggtcacaggaaggcccaggagaggccggcggatggacctctgagggctgccaactgagatcgagtcagcctaacgtgagtgccctacactgtcagcacctggggaatgttgctgtcctgatggaactctctgcattccctcgtgaagttggtggcgcaggtgccgggcttcatccggtggtgtacccctgtaccgctttactgctactctgtctttttgcaaccatcattacctatattcttaaccatagttccatccgagtctcacgtaagggttggcacatgctgttgaacttgtgctttcacattgcaatgactagtgcagtgttcgccggcgggatcacgctgaccaattaccagatggtttgccaggccgtgggcataactctacactacagttcccttagcaccctgctgtggatgggagtgaaagccagggtgcttcataaggagctcacttggcgcgcgccccccccacaggagggggaccccgcattgccgactcctagccctatgctccgtttctatctcatcgcgggcggtattcctttgataatttgcggtatcactgctgccgttaacatccacaactatagagaccacagtccctactgttggctggtctggcgccctagcctgggcgcgttttacattcctgtcgccctgatcttgcttattacctggatttactttctctgtgctggcctgagacttcgcggtcccttagctcagaaccccaaggctggcaactctagagcatctttagaagctggagaagaactgaggggatccacccggctgaggggtagcggacccctgctgagcgacagtggaagcttgttggctacaggctctgcacgggtcggcacacccggacccccggaggatggcgattctctttacagtcccggtgtccagcttggagctctggtcactacccatttcctgtatttagccatgtgggcttgcggggcccttgcagtttcccagagatggctccctagggtcgtttgttcctgtctatatggcgtggcggcatccgcattgggcctttttgtgttcacccaccattgtgcacggcgccgggatgtcagagcttcttggcgcgcctgctgccctccggccagtcccgctgctccacacgccccccctcgagccctcccggcagccgcagaagatggttcacctgtatttggagaaggccctcccagtctgaaaagtagcccatcagggtccagtgggcacccattggcgttggggccctgcaaattgaccaatttgcagctcgcgcagagccaggtatgcgaagctggcgcagccgctgggggagagggcgaacctgagcccgctgggacccgggggaatctcgctcatcggcatccaaataacgttcatcacggaaggagagcacataagtctcgcgcaaagggtcaccgggcgggggaagcttgcggcaagaatagactgaaggccctaagaggcggagccgccggcgccttggagcttctctcctcagagagtggaagcctccacaatagccccaccgattcctacctcgggagtagcaggaatagtcctggcgccggtctgcaactggagggcgagcctatgctcactccttcagaggggtctgatacctcagctgcacctctcagcgaagcgggtcgtgctgggcagcggaggtccgcctccagggatagtctaaagggcggtggggccctggaaaaggagagccacaggaggtcttaccctctaaacgccgcttccttgaacggcgccccaaagggcgggaagtacgacgatgtgaccctgatgggtgcagaggttgctagtggcggatgtatgaagacaggcctgtggaagtctgagacaaccgtatag

SEQ ID NO: 117773 - DNA, 3771 bp, Artificial Sequence
  Description of Artificial Sequence: Synthetic coding sequence
atgcggggtgcccctgcgcgtttactgttaccccttcttccctggctgttactgttgctcgcgcccgaggcccggggcgcccctggttgccccctgagcatccgtagttgcaaatgttctggcgaaaggcccaaaggcctgtcaggcggagtgcccggccccgcccgacgacgtgtcgtgtgtagtggcggggacctccccgagccgcccgaacccggcctcctgcctaacggaaccgtaaccctgttgctgtctaacaataaaatcaccggacttcgcaacggtagctttcttggcctatcgctgctggagaaattggaccttaggaataatataatctccacggtgcagccaggggccttcttggggctcggtgaattaaagagattggacctgtctaacaaccgtattggatgcttaacatccgagacctttcagggcctgcccagactgctcagactaaatatctccggtaacatcttttcttccctccagcccggcgtttttgatgaactgccagctcttaaggtggtagacctgggcaccgagtttctgacgtgcgactgccatctcagatggctgcttccatgggctcagaatagaagcttgcagctctctgagcacacgctctgcgcgtacccttccgccttacacgcgcaggctttgggctctttgcaggaagctcagctgtgttgcgaaggagcccttgagttgcacacacaccatttaatcccctcactgaggcaggtggtctttcaaggggacagacttccatttcagtgtagcgcgtcatacctgggtaatgatacaaggattagatggtatcacaaccgcgcacccgttgagggggatgagcaagcaggtatcctacttgcagagtctctaatacatgactgtactttcattacttcagaactgacactttctcatatcggcgtctgggccagtggcgagtgggaatgtacggtgtccatggctcagggcaatgcaagcaagaaagtggaaatagtggtcctggagacaagtgcttcttactgtcccgctgaacgcgttgcaaacaacagaggagattttcggtggcccagaacactggctggaatcaccgcctatcagtcatgcctgcagtacccatttacctccgtacccctagggggcggggccccgggtaccagggcctcacgccggtgtgatagagcagggcggtgggagcccggcgattactcacattgtttgtacactaacgatattacgagagtcctgtataccttcgtgcttatgcctatcaatgcatctaatgccctcaccttggcacaccagttgcgagtctatacagccgaggcagcttccttttccgacatgatggatgtggtgtacgtcgcccaaatgatccagaagttcttggggtatgtcgatcaaattaaggagttggtcgaggtgatggtagatatggcttccaacctgatgctggtagacgagcatctgctgtggcttgcacagagggaggacaaggcgtgctctcgcatcgtgggagccctggaacgaattggcggggctgcactaagcccacacgcccaacatatcagcgtgaacgctagaaacgtcgccctggaggcttacctgattaaacctcatagctatgttggactcacgtgcacggcctttcagagacgtgagggcggggttcccggaactaggccaggcagcccgggtcagaacccccccccagagccagagcccccggcagatcagcaactgcgattccgctgcaccaccgggaggccaaacgtttccttgtcaagttttcatattaagaattcggtagcactggcaagcatccagctgcctccctccctatttagttccttgcctgccgctttagcccccccagtccccccagactgtactctgcagctcctcgtattcaggaacggccgcctgttccactcacatagcaacacttcaagaccaggggcggccggcccgggcaaaaggcggggagtcgcaacgccagtcattttcgccggtacctccggatgcggcgtcgggaatctaactgaaccagttgccgtatcgctgcgtcactgggccgaaggcgcagagcctgttgcggcctggtggtctcaggaaggccctggcgaagctggcgggtggacatcggagggatgccagttgcgtagctcacaaccaaacgttagcgcgctgcattgtcagcacctgggtaatgtggcggtgctcatggaactaagtgctttccctcgcgaggtcggaggggcgggtgcaggcctccatcctgtggtgtacccttgcacagccctcctgctcctgtgcctctttgccactattataacttacattctcaaccattccagtatcagggtgtccagaaaggggtggcacatgttattgaatctgtgtttccacatcgccatgacctctgcggtctttgccggcgggattactttgacaaattaccagatggtgtgtcaggcggtgggaattacactccattactcaagcttgtctacattgctgtggatgggagtaaaagccagagtcttgcacaaggaactgacgtggcgcgctccccctccacaggaaggcgacccagcgttacccactccctcaccgatgttacgcttctatctgatcgccggcggcatccccttgatcatttgcggaattaccgccgcagtgaacatacacaactatcgagaccactctccttactgctggctggtttggcggccaagtctgggcgctttttacatcccagtagcgctgatccttctgataacctggatctactttctgtgtgccgggctgaggctgaggggcccgctggcacagaatccaaaagccggcaattcacgggcaagcttggaggccggggaggagctgaggggttcaacacgtctgagggggagtgggccactgctttccgactctggctcgctgttagccaccggtagtgctagggtaggaacgccagggcctcctgaggatggggacagcctatatagtcctggagtgcagcgtggtgcgggcgaccacgctctccccgtgctcggccatgtgggcctgcgcgggagcggtagcgtccctgccctggcggccccaggaggagtacagctcttggtgcggggtggtagtctgcgccccgggcccctccgattgcactcccctctgtgtcaggccgagggacgagagagcctggtggcacgcttactgcctccatgtctctcacggggaccaccatgccccgcccccggccccgcgcgtcgtagacgaggaagattccctggcgtgaggggcgggcctccactgccccaggtgctgccaaagagacagcaacgcccttcagctggcagtggtcccttacaggcacaccagcctgcagccggtccagagtctggtgtccgcggaggcggagggggcaggagagggcggcgtgcgggggcaggcggccatcctggaaagcctcgcccaccccctccccaacagcgggctcctcgggcttcaggagcacaggagcccggtcagggaacaccacgaggtggaggtttgcgccaggagcctgcccaagggcccgcccgaggacgtgggggaggagctggcgccgcagtgcagcgcgagcgccaatccgcccaacagccacacagacagttgccaggacagcagcctcagcaacctggccgccgccctgcagctggacgtagagcccacgcccatgcggttagggggcagcgccaccagagacgagctgcattttag

SEQ ID NO: 117774 - DNA, 3966 bp, Artificial Sequence
  Description of Artificial Sequence: Synthetic coding sequence
atggagcctcccggtcgtagacggggacgcgcccaaccccccctcctgctgcctctgtctctgctggctctgcttgccctgttggggggaggagggggaggcggcgctgcagcccttccagctggctgtaagcatgacggcagacccaggggcgccggcagagcagctggcgcagctgagggaaaagtggtctgcagcagcctggagcttgctcaggtcctccctcctgacacactccctaatcgtacggtcaccctgatactgagtaacaacaagatctccgagctcaaaaacggatcattctcaggcctttcactcctcgagaggctggacctgcgcaataatctcatctcgtcaatcgatccgggtgccttttggggcctgtcttcactgaagcgactggatttgacaaacaataggatcggctgtctgaatgccgatatttttcgcggccttactaatctcgtcagactgaatctctccggaaatctcttttcctcgcttagtcaggggaccttcgactacctggcgtctctaagatcattggaattccagaccgagtatttgctgtgtgactgcaatattctctggatgcaccgctgggtcaaagaaaaaaacattaccgtgcgcgacacacgctgtgtgtatccaaagagcctccaggcacagccggtgaccggcgttaagcaagaactgctcacgtgcgatccaccgttggagctaccatctttctacatgactccgagtcaccgacaggtcgtctttgaaggcgattcactccccttccagtgcatggcatcatatatcgatcaggacatgcaggttctgtggtaccaggacgggcgcatcgtcgagaccgacgaatctcaaggcatattcgtcgagaaaaacatgatccacaattgttcactcattgcttctgccctgactatatcaaacatacaggctggcagcaccggcaactggggctgccacgtccagaccaaaagggggaacaatacgaggactgttgacatcgtggtgcttgagtcctcagcacagtactgccccccagagcgggtggttaacaacaagggcgacttcagatggccgaggactctggcggggattacagcatacctgcagtgcaccagaaacacacatggatcaggaatttatccaggcaaccctcaggacgaacgaaaggcctggcgaaggtgcgatcgtggcggtttctgggcagatgatgactatagcaggtgccagtatgccaacgacgtcacacgagttctctacatgttcaatcagatgcccctgaacctgaccaacgccgttgccactgctcgtcagctgctggcctacacggtggaggccgcaaacttcagtgataaaatggacgtcatctttgtggctgaaatgatcgagaagtttggcaggttcaccaaagaggaaaaaagcaaagagctcggcgacgtgatggttgatatagctagtaatattatgctcgcagatgagcgcgtgctgtggctcgcccagagggaagccaaggcttgcagccggatcgtgcagtgtttacagcgcattgccacatacaggctggctggcggagcccacgtgtactctacgtattctcccaacattgcgctggaagcatacgtcatcaagagcactggcttcaccgggatgacctgtaccgtgttccagaaagtcgctgcgtcagacagaaccggcttgtctgactatgggagaagggacccagagggcaatctggataagcagttgagctttaaatgcaatgtatccaacaccttctcgagcctagctcttaaaaataccattgttgaggccagcatccagttgcccccaagcctgttttctcccaaacagaaacgggaattaaggcccaccgacgacagtttgtacaaactgcagctcatcgcatttcgcaacggcaagctgttccctgcaacgggaaactctaccaacctcgcagacgacggcaagaggagaaccgttgttacccctgttattttaacgaaaatcgacggcgtgaacgtggatacccatcacatccccgtgaacgtgacattaagacgtattgcccatggtgctgatgctgttgccgcaagatgggacttcgatctgctgaatgggcaagggggatggaaaagcgatgggtgccacatcctgtactcagatgagaatatcaccacaattcagtgctatagcctgtcaaattacgccgtgctgatggacctgacaggatcggagctctatacgcaggccgctagtcttctgcacccggtggtttataccacggccatcattttgctgttgtgtcttctcgccgtcatcgtgagttatatctaccaccattctctgatcagaatatctctgaagagctggcatatgctggtgaatctttgtttccacatcttcctgacttgcgtggtgttcgttggcggcatcacacagacccggaatgcttcaatctgccaggcagtgggtattatattgcattactccaccttagcaaccgtgctgtgggtgggcgtgacggcacggaacatttataagcaggtcacaaaaaaagcgaagaggtgtcaagacccggacgaacctccgccccccccaagacccatgttgaggttctaccttattggtggaggaatacctatcatagtctgcggaatcaccgcagccgccaatattaaaaactatggatcccgccctaatgcaccatattgttggatggcatgggagccatctctcggcgcattttatggaccggcctcctttatcacgttcgttaactgcatgtatttcctgtctatattcatccaactgaaacgacatccagaacgtaagtatgagctcaaagaaccaacagaggaacagcaaaggctggccgctaatgaaaacggtgagatcaaccaccaggactccatgagtctttctctcatctccacatccgcgctagagaatgagcacacattccattcacagctcttgggggcctcattgacattgctcctgtacgtcgccctttggatgttcggcgctctcgcggtttccctctactacccactcgatctcgtcttctcattcgtgtttggtgcaacgagtcttagtttttctgctttcttcgttgttcatcactgtgtcaatcgcgaagacgtgagactcgcgtggattatgacctgctgtcccggtaggtccagttacagcgtgcaggtcaacgtgcagcccccgaattccaatgggactaatggtgaggccccaaaatgtccgaacagctccgccgagagttcctgcaccaacaagtccgcatcaagctttaagaacagctcccagggatgcaaactcactaacttgcaggcagccgccgcccagtgtcatgccaattctctaccactgaatagcaccccccagctggacaatagtctgactgagcactccatggataacgatatcaaaatgcacgtcgcccctctggaagtgcagtttagaaccaacgtgcatagcagccgccatcacaagaataggagtaaaggccacagggcttccagacttaccgtgctgcgggagtacgcttacgacgtcccgactagcgtcgaagggtccgtgcagaatggactccctaaatctcgcctaggaaataacgagggccactctagaagccgaagggcctacctcgcctacagagagaggcagtacaatccccctcaacaggatagttctgacgcatgctcaaccctgcccaagtcatcaaggaactttgagaagcccgttagtactacatctaagaaagacgctctgaggaaaccagccgttgtggagctcgaaaaccaacagaaaagttacggcctgaaccttgcaattcagaacgggccaatcaaatccaacggtcaggagggtcctctgctcggcacggacagtaccgggaacgtgcgcaccggcctttggaaacatgaaaccacagtgtag

SEQ ID NO: 117775 - DNA, 1851 bp, Artificial Sequence
  Description of Artificial Sequence: Synthetic coding sequence
atggaacctcccggccgaaggaggggccgcgcccagccacccctgttattgcccctgtctctactcgctctacttgcactcttgggaggtgggggagggggaggggctgcagccctgcctgccgggtgcaagcacgatgggagacctagaggcgccggcagagctgcgggcgcagccgaagggaaagtggtgtgtagctccttggaactcgctcaggtgttaccccccgacactctccccaaccgcacagtgaccctcatcttgtcaaacaataaaatctcagagctgaaaaacgggtcattctctggcctgagtctgttggagagactcgacctccggaataacctgatcagctcaattgaccccggagctttctgggggctgagttcactcaagaggttggatctgaccaataataggattgggtgccttaatgccgacatattccgtggacttaccaatctggtgcgtctcaatctgtcaggcaatctattttccagcctgtcacagggaaccttcgactatctggcttcactgaggtcactggaattccagactgaatatctgctgtgcgattgtaatattctctggatgcatagatgggttaaggaaaagaatattaccgttcgcgacactcgatgcgtttatcccaaatctctacaggcacagcccgttacaggagttaaacaggaactcctgacgtgtgatccacctctggaactcccctccttttacatgacgccttcccacagacaggtcgtgtttgagggtgactcgctgcctttccaatgtatggccagctacattgaccaagatatgcaggtgctgtggtatcaggacgggcgtatcgtcgaaaccgatgaatcccaggggatctttgtagaaaaaaatatgatacacaattgttcactgattgcaagtgccctcaccatctccaacatacaggccggatccacgggaaactggggctgccatgtccagacaaagcgaggaaacaatacaaggacggtagacatcgtagtcctcgagagctctgcccaatattgcccacccgagcgcgtggtcaacaataaaggagactttaggtggccacgaacactcgccgggatcactgcctatctacagtgtacccggaacacgcacggcagcggcatttacccaggcaacccacaggacgagcgcaaggcctggcggcgctgcgaccggggcggattctgggcagacgacgactactcacgctgccagtatgctaacgatgtcacaagggttctctatatgtttaaccagatgccacttaatctgaccaatgccgtggctacagctaggcagctgctggcctacacagttgaggctgccaactttagcgacaaaatggacgtgatcttcgtggccgagatgatcgagaagttcggtagattcaccaaggaggagaagtctaaggagcttggtgacgtcatggttgatatcgcctctaatatcatgctggcggacgagcgcgtgctctggctggcccagagagaggctaaggcctgcagcagaatagttcagtgcttgcaaaggatcgcaacttatcggctcgccggtggtgcccacgtgtactcaacatatagcccgaacattgcacttgaggcttatgtgatcaagtcaactggcttcaccggcatgacatgcactgtcttccagaaagtggccgctagtgatcggaccgggctctccgattatggacggagagatcccgagggaaacctggataagcagcttagtttcaagtgcaatgtgtcaaacacttttagctcactggcactgaaagtgtgctatatactgcagtcctttaagaccatatatagctag

SEQ ID NO: 117776 - DNA, 1146 bp, Artificial Sequence
  Description of Artificial Sequence: Synthetic coding sequence
atgccactcaagagaaataactcaaaatacccccccctggagcttccatccttctatatgacgccgtcccacaggcaggtagtgttcgagggggattctctgccttttcagtgcatggcaagctacattgatcaggacatgcaggtgctttggtaccaggacgggcgcatcgtggagacggacgaaagtcaaggtatattcgtggagaagaatatgatccacaactgttcactcatcgcaagcgccctgaccattagcaacatacaagccggcagcacaggtaattggggctgccatgttcaaaccaagcgcggtaacaacacgcgcaccgtcgatatagtagtccttgaatcctcagctcagtattgcccccccgaacgggtggtgaataacaagggggatttcagatggcctagaacgctagcaggcattacggcctacctccagtgtacgagaaatactcacgggagcggcatctaccccgggaacccacaggacgagagaaaggcatggagaagatgcgatcgaggcgggttctgggctgatgacgactatagccgttgtcaatacgcaaacgacgtgacaagggttctgtacatgttcaaccaaatgcctctaaacctaaccaacgctgtggcaaccgcaagacagctgctggcttacacggtcgaggctgccaacttctctgataaaatggatgttatttttgtggccgagatgatcgaaaaattcggccggttcaccaaggaggagaagagcaaggaacttggggacgtcatggtggacatcgccagcaatataatgttggccgatgagagagtgctctggctcgcccaaagggaagcaaaagcttgttcgcgaatagtacagtgtttacaacgaattgccacataccgcctggccggtggagcccacgtttatagcacatacagtccaaacatcgctctggaggcctatgtgatcaagagtacaggcttcacaggcatgacctgcaccgttttccaaaaggttgctgcttccgataggaccggtctctccgattatgggagacgggatcccgagggcaacctggacaagcagctgtcttttaagtgtaatgtgtccaatactttcagttctctggctctcaagggaaaattccgttag

SEQ ID NO: 117777 - DNA, 2724 bp, Artificial Sequence
  Description of Artificial Sequence: Synthetic coding sequence
atgccaactgcagctgcccctataattagtagcgtccagaagctcgtcctgtatgagacaagggctagatatttcctcgtcgggagtaataatgctgagactaagtatagagttctcaagattgacaggacagaacccaaggacctggtaattatcgatgaccggcacgtgtacacacaacaagaggtgcgggagctactgggccgtctggatctgggcaaccgaaccaaaatgggtcagaaagggtcctctgggctgtttcgcgctgtctccgcgttcggcgtcgtgggcttcgtccgcttcttagagggttattacattgttctcatcacaaagcgtcggaaaatggccgacattggtgggcatgccatctacaaggtggaggacactaatatgatctacatcccaaatgattctgtgagggtgacccacccagacgaggcccggtacttgaggattttccaaaatgtcgatctttctagcaacttttatttttcctattcatacgacctatcgcatagtctgcaatataaccttactgtcttaaggatgcctctggaaatgctaaagagcgagatgacccagaaccgccaggaaagtttcgacattttcgaagatgaaggcctgatcacacagggggggagcggggtatttgggatctgtagtgagccctacatgaagtatgtctggaatggcgagcttctggatatcatcaagagcactgtgcaccgtgactggctgctgtacataatccacgggttctgcggacagagtaagctcctcatttatgggcgccctgtgtatgtcaccttgatcgcccggcgatcaagcaagtttgcagggacacgcttcctgaagcggggtgctaattgcgaaggggatgtcgccaatgaagtcgaaaccgagcagatcctctgcgacgcaagcgtcatgtcattcacagccggctcctattcctcttatgtccaggtgcgcggctctgtgcccctctactggtcacaagatattagtacaatgatgcctaaacccccgataaccttagaccaggccgacccattcgcccacgtggcagctctccacttcgatcagatgtttcaacgctttggctctccaatcattatactgaacctggtgaaggagcgagagaagagaaaacatgaacggattttgtctgaagaactcgtggccgctgtgacctacctcaatcagttcctgcctcctgaacatacaatagtgtacataccatgggacatggctaaatatacaaagagcaaactctgcaacgtgctggacaggttgaatgtcattgccgaatccgttgtgaaaaagaccggattctttgtgaaccgccctgattcatactgttctatacttcgccctgatgagaagtggaacgaactgggaggatgcgtgattccaacaggtcggctgcagaccggtatactgcgcactaattgcgtggactgtctggatcgcactaacacagcccaatttatggtgggaaagtgcgctttggcgtaccagctgtacagtctggggctcatcgacaaacccaacctgcagtttgataccgacgccgtacggttgttcgaggaattgtacgaggaccatggagacacactgtctctgcaatacggtggctcacaactcgttcatagagtgaagacatacagaaagatcgcgccttggactcagcattctaaggacatcatgcaaaccctgagtagatactatagcaacgccttttctgacgcagaccgtcaggatagcatcaacttgtttctcggggtgtttcaccccaccgagggtaaaccacacctgtgggagctgcccaccgacttttatttgcatcacaaaaataccatgaggctcctgcccacccgccggtcgtatacatactggtggaccccagaagttattaagcatctccctctgccatatgacgaggttatctgtgcagtcaatctcaaaaaacttatcgtgaagaagttccacaagtacgaggaggaaatcgacattcacaatgagttcttccgcccctacgaattgtcgtcttttgatgataccttctgtcttgcgatgacctcatccgcccgagattttatgcccaagaccgtgggtatcgatccctccccatttaccgtccgcaagcctgacgaaaccggcaagagcgttttaggcaacaaatcgaatcgcgaggaagccgtgcttcagcggaaaaccgccgctagtgccccccctcccccctccgaggaggcggtgagctcctcctccgaagacgattccggcactgaccgggaggaagagggctccgtgagtcagaggtctacaccggtgaagatgaccgacgccggagattcagcaaaggtaacggaaaacgtggtgcagcccatgaaagaactgtatggtattaacctctctgacggcttgagtgaggaggacttttcaatctacagtcgtttcgtacagctcgggcaatcacaacacaagcaggacaagaatagtcagcagccatgttcccgttgttccgacggagtgatcaagctgacaccaattagcgcctttagtcaggataatatctatgaagtgcagcctccccgagttgaccggaagtcgactgagatttttcaggcccacattcaggcgagccaggggataatgcaaccactggggaaggaggactccagtatgtaccgggagtacatcaggaaccggtacctgtag

SEQ ID NO: 117778 - DNA, 3582 bp, Artificial Sequence
  Description of Artificial Sequence: Synthetic coding sequence
atgatgttccgtagtgatagaatgtggtcctgtcattggaaatggaaacccagccccctgctttttctgttcgcactctacatcatgtgtgtgccacactccgtttggggatgtgcaaactgccgagttgttctcagcaatccatccggtacattcacatcaccgtgttatccaaacgactatcccaatagccaggcttgtatgtggacccttcgggctcccaccgggtatataatacagatcaccttcaacgacttcgatatcgaggaagcaccgaactgtatctatgatagcctgagcctagataacggggaaagtcagacaaaattctgtggggctacagctaagggtttgagtttcaatagttcagcaaatgagatgcatgttagcttcagctctgactttagtatccagaaaaaaggatttaacgccagttacatcagggttgctgtcagtctgaggaaccaaaaagtcatcctgccgcagacatcagacgcttaccaagtaagcgtagccaaatccatttctatacccgagctctctgcgtttactctgtgtttcgaggccacaaaggtaggccacgaggactcagattggactgccttttcatatagcaacgcaagcttcacacaactgctgtcatttggcaaggcgaaaagtggctatttcctctccatttcagacagtaagtgtctattaaacaacgccttacctgtaaaagaaaaagaggacattttcgcagagtcctttgagcagctgtgcctggtctggaacaattcgctagggtcaataggagtaaactttaaacggaactatgagactgtcccgtgtgattccacaataagcaaagttatcccgggcaacgggaagctcttgcttgggtccaatcagaacgagatcgtatcactgaagggagacatctacaacttcagactgtggaacttcacaatgaatgctaagattttgtccaacttgagttgcaacgttaaaggcaacgtggtggattggcagaacgacttctggaatatccccaatttggccttgaaggccgagtctaacctgagttgtggcagttacctgatacctcttcctgccgccgaattagccagctgcgccgacttgggcaccctgtgtcaggatgggatcatctaccggatctccgtggtcatacaaaacattctgaggcaccctgaagtcaaagtccagagcaaggtggccgaatggctgaatagtacatttcaaaattggaactatacagtgtacgttgtgaatatttcgttccacttgagcgctggggaggataagattaaggtcaaaagatccctcgaggatgagccacgcctggttctgtgggccctcctggtttataatgctaccaacaataccaatctggaaggtaagatcatccagcaaaagctgttaaaaaataacgagagtctggatgaaggtctgcggctccatacagtaaatgttcggcagctgggtcactgcctcgctatggaggagccaaagggttattactggccgagtatacagccatcagagtacgttttgccttgtcccgataagccaggcttttcagcatccagaatatgcttctacaacgcgacaaaccctctggtgacttattggggccccgtagatatctctaattgtctcaaagaagccaatgaggtggccaaccaaattctcaatctgacagcggacggccaaaaccttaccagcgctaacataaccaacatcgtcgagcaggtgaaacggattgtgaacaaggaggagaatatcgatattacactgggaagcacgttgatgaacatattctcaaatatcttaagcagctctgacagcgatttgctggagtcgagctcagaggcccttaaaaccattgacgaactcgcattcaagatcgacctgaattcgacctcccatgtgaacataaccactagaaatctggccttgtccgtcagtagcctgctccctggcacaaacgccatctcaaatttctctattgggttaccatcaaacaatgagtcatatttccaaatggatttcgagtctggacaagtcgaccccctcgcctctgtaatcctgccccccaatcttcttgagaatttgtcgccagaggattccgtactagtgaggcgggctcagttcactttctttaataaaaccggattatttcaggacgtaggccctcaacgcaaaactctcgtcagctacgtgatggcatgctccataggaaatataaccattcagaaccttaaggacccagtgcagattaagattaaacatacaagaacccaagaagttcatcaccctatttgtgctttttgggatctaaacaaaaacaaatcctttggcggctggaacacttctgggtgcgtggctcacagagactcagacgcctccgagaccgtgtgtctttgtaatcatttcacccactttggcgtgcttatggacctccctcggtccgcatctcaactagatgcccgaaacaccaaagtgttgacgtttatcagctacatcgggtgcggaatctccgctatcttttccgccgcaacattgctcacatacgtagcttttgagaaacttcgccgcgactaccccagcaaaatcctgatgaatctcagcacggcactactgttcttgaacctccttttccttctggacggctggataacatccttcaacgttgatggcctgtgcatcgccgtcgccgttctgctgcacttttttttattggccactttcacctggatgggcctcgaagctattcatatgtacatcgcattggtcaaagtattcaatacctacattcgcaggtatatcctcaaattttgcatcatcggctggggattgcctgcgttagttgtgtctgtggtgctcgcctcaaggaataataacgaggtatacggtaaagagtcttatggtaaagagaaaggtgacgagttctgttggatccaggatcccgtgattttctacgttacatgtgctggctactttggggtgatgttcttcttaaacatcgctatgtttattgtcgtcatggttcagatctgcggacggaacggtaagcgatcaaatcgtacattgagagaggaggtgttgaggaatttgcggagcgtggtctctctgactttcctacttggcatgacatggggttttgccttcttcgcctgggggcccctaaatatcccattcatgtatctgttttcaatctttaacagcttacaggggctgtttatctttatcttccactgtgccatgaaggaaaatgtgcagaagcaatggagacagcatttatgttgtggaaggtttaggctggcggacaattctgactggagcaaaaccgccaccaacatcatcaaaaaatcttcagataatttgggtaagtcattgtcatcatcaagcattggatcaaatagcacatacctgacgtctaaaagtaaaagctcctcaacgacgtattttaaacgaaacagccacaccgacaatgtttcctacgaacatagctttaacaagagtggtagcctacggcaatgtttccacgggcaggttttggtgaaaacaggaccctgctag

SEQ ID NO: 117779 - DNA, 3669 bp, Artificial Sequence
  Description of Artificial Sequence: Synthetic coding sequence
atgatgttcaggtctgatagaatgtggagttgtcattggaaatggaaaccatctccactccttttcttatttgcgctctatatcatgtgcgtccctcattccgtgtgggggtgcgccaactgtcgagtcgtgctctccaatccaagtgggacatttacatcgccttgctatcccaacgactaccctaatagtcaggcctgtatgtggaccttgcgcgcccccactggttacatcatccaaattaccttcaacgactttgatatcgaagaagcccctaactgtatttatgatagtctgagcctggacaacggcgaatcccagactaagttttgtggagccacagcgaaaggactgtctttcaactccagcgccaacgaaatgcatgtgagtttctctagtgactttagtattcaaaaaaagggcttcaatgcatcctatatccgcgtggccgtgagcctgcgaaatcaaaaggttatcctgccccaaacatctgatgcctaccaggtgagcgttgcaaaatctatatctatacctgagctgtcagcatttacgctgtgttttgaggccaccaaggtcggacatgaggattccgattggacagctttcagttactctaatgcctcatttacccagctgttaagttttggaaaggccaagtccggctatttcctgtctatcagtgacagcaagtgtcttctgaataacgcactgccagttaaggagaaagaggacatctttgctgagtcattcgagcagctgtgcttggtctggaataactccctaggatccattggcgttaactttaaaaggaactacgaaacggttccttgtgatagcactatcagcaaagtgatccctggtaatggcaaactgctcctcggcagtaatcagaacgagattgtgagcctgaagggcgacatctacaacttcagattatggaacttcacaatgaacgctaagatcttgtctaacctatcctgtaacgtgaaagggaacgtggtggattggcagaacgacttctggaatatacctaacctggctctgaaagctgaatcaaacctctcttgcggttcttatttgattccactccctgccgccgagcttgcctcctgtgcagatctggggaccctgtgccaggacggcataatatatagaatatccgtcgtgatccaaaacatactccgccaccctgaagtgaaagttcagagcaaggtggcggaatggctgaatagcacatttcagaattggaactacactgtctacgtggtgaatataagcttccatctatccgctggggaggacaaaattaaggtcaaacgctctctggaagatgaaccacggctggttctgtgggctctgctggtatacaatgctactaataatacaaatctggaaggcaagatcattcagcagaagcttctgaaaaacaacgagtcgcttgatgagggactcaggctccatacagtaaacgtccggcagttgggccactgccttgccatggaggagcctaagggatattactggccatctattcagccctcggagtatgtcctcccttgtcccgataaacccggtttcagcgcatcacggatctgcttctacaatgcaactaatcctttggtcacatactggggtcctgtggatatttccaactgtcttaaggaggccaacgaggtggcgaatcagatcttgaacctgaccgctgacgggcagaatctgacgtctgccaacataacaaatatcgttgagcaagtaaagcggatcgtcaacaaagaggagaacatcgacataacgctgggcagcaccctgatgaacatctttagcaacattctgagcagttccgacagcgatctgctcgaatcttcaagtgaggctctgaagaccattgacgaactggcttttaagattgacctgaactccacgtctcatgttaacataactactcggaatctagccctgagcgtgagtagcctcctgccagggacaaatgccatcagtaacttctcaatcggactgccttccaataatgagagctacttccagatggattttgaaagtggtcaagtcgacccacttgcctccgttattttacctccaaatctcctggaaaacttgtccccggaagacagcgtgctggtgcgacgcgctcagtttacattctttaacaagaccggattgtttcaggatgttggacctcagagaaagactctggtgagttatgtgatggcttgtagtatcgggaatataaccattcagaacctcaaggacccagtccagataaaaattaagcacacccgaactcaagaggtccaccaccctatctgcgccttttgggatctcaacaaaaacaagagttttggcggttggaacacttccgggtgcgtcgcgcatagggatagtgacgcatcagaaacagtgtgcctatgcaatcactttacccactttggcgtgctaatggacctgcctcgtagtgcatcccaactggacgctagaaatacgaaggtgctcacatttatctcatatataggctgcgggatcagcgccatcttttccgcagccaccctgctgacttatgtggcctttgagaagctgaggagggattatccaagtaagattctgatgaacctgtccacggccctgttgttcctgaatctgctgttcctcttggacgggtggattacatcctttaacgttgatggcctgtgcattgcagtcgccgttctgctccacttcttcctgcttgctacatttacttggatggggttggaggccatacacatgtacattgccctggtaaaagtcttcaacacatatatccgtcgttacattctcaagttctgcataattgggtggggactgcctgcactagttgtttctgttgttttggcttcacggaataataacgaggtgtatgggaaggagtcttacggcaaagagaagggcgacgaattctgttggatacaggatcccgtgattttttatgtgacttgtgccggctatttcggggtaatgttctttctcaacatcgccatgtttatcgtggtgatggtgcagatttgtggccgaaacggcaaacgtagcaaccgaaccttgagggaagaggtgttgcgcaacctgcgcagtgtggtttctttaaccttcctcttaggcatgacctggggcttcgcattttttgcctgggggcctctgaacatcccattcatgtatcttttttctatcttcaactcattgcaaggactgttcattttcattttccattgcgctatgaaagaaaacgtccagaagcaatggcgccaacatttgtgctgtgggcgatttaggctcgcagataactctgactggtctaaaaccgctacaaacattatcaaaaaatccagcgacaacctggggaaaagcttatcctcaagcagcattggttccaacagtacatatttgacatccaagtcgaaatcctcttccacgacgtacttcaaaaggaacagtcatacagattcagcctccatggataagtcactgtctaagctggcacacgctgatggtgatcagacttcgataattcccgtccaccaggtgatcgataaagtcaagggatattgtaacgcgcatagcgacaacttttataagaatatcataatgtcagatacattcagtcatagtaccaagttctag

SEQ ID NO: 117780 - DNA, 3753 bp, Artificial Sequence
  Description of Artificial Sequence: Synthetic coding sequence
atgatgttcagaagtgatcgaatgtggagttgtcactggaagtggaagccatcgcctttgctatttcttttcgccctatatattatgtgtgtgcctcactcagtgtggggatgtgccaattgccgggttgtcctgtccaatcccagtggcacatttaccagtccatgttaccccaacgactatcccaactctcaggcctgcatgtggaccctccgcgcgcccaccggctacattatccagatcacgttcaatgacttcgatatcgaggaggccccaaattgcatttatgattccctgtccctggacaatggcgagtctcaaaccaagttctgtggcgcaaccgccaaagggctgagctttaactcatctgctaatgagatgcatgtgtctttcagtagcgatttctccatccagaagaagggattcaatgcctcatatatccgcgtcgcagtgtcactgcgcaatcagaaggtgatcctgcctcaaacaagcgatgcttaccaggtatcagtggcaaaaagcatctcaatcccggaattgtccgcgttcactctctgtttcgaggctactaaggtgggccacgaggatagtgactggactgcattctcctactctaacgcctctttcacccagctgttgtccttcggcaaagccaagtccgggtactttctgagcatctcggacagtaagtgtttactaaataacgccttgcccgtgaaagagaaggaagacatatttgccgagtcttttgagcagctgtgcctggtatggaataacagtttaggtagtataggcgtgaatttcaagaggaactacgaaactgtgccttgcgatagtactatttcaaaggttatccccggaaatgggaagttgctcctgggaagcaaccagaacgaaattgtgtcactcaaaggagatatttataatttccggctctggaactttactatgaatgcgaagattttatcgaatcttagttgtaacgtgaaagggaatgtggtggactggcagaatgatttctggaacatcccgaacctggcactgaaggcagaatccaatctatcctgcggttcctatctcatcccactaccagccgctgagctggcaagctgtgctgacctgggaaccctatgtcaggccacagtgaattctccatcaaccaccccaccgacagttaccaccaatatgccagtcaccaatcgaatcgataagcagcggaatgatggcatcatctacaggatatcagtggttattcagaatatcctgcgacacccagaggtaaaggtccaatcaaaggtggcggagtggttgaattcgacttttcagaactggaattacaccgtgtacgttgtcaacatctcattccatttatccgcaggggaggataagataaaagtgaaaagatctctggaagatgaaccacgcttggtcctctgggcactgctcgtatataacgccacgaacaacactaatctagagggcaaaattattcagcaaaaactgctgaaaaacaacgaaagcctggacgaggggttaagactgcacaccgttaacgttcggcagctaggccattgcttggctatggaagaacccaagggctattattggccttcaatccaaccctcagagtacgttctgccatgtccagacaagcctggtttttccgctagtagaatttgtttctataacgcaacaaaccctctcgttacatattggggccccgttgatatcagtaactgtctaaaggaagccaacgaggtcgcaaatcagatcctgaatctaaccgctgatgggcagaacctcacgtccgctaacattaccaacattgtagaacaggtcaagcggattgttaacaaagaagaaaacatcgacattacgcttggatccacactgatgaacattttctctaatatcttgagttctagcgacagcgatctgctcgagagctctagcgaggcacttaagaccatcgacgagctcgccttcaagattgacctgaactctactagccacgtcaacattacaacaagaaacttggcactgagtgtaagctctctcctgcctggcaccaacgctatctccaatttctctatcggactgccctccaacaatgagtcatacttccagatggatttcgagtccgggcaagtagaccccctcgccagtgttatcctcccacccaatctcctggaaaaccttagcccagaggacagcgtcctggtgcgcagagcccaattcaccttttttaataaaactggcctgttccaggacgttggcccacagcgaaagacgctcgtctcttacgtgatggcgtgtagcattgggaacatcacgatccagaacctgaaggacccagtgcagattaaaatcaagcacacacggacacaggaggttcaccatccgatctgcgcgttctgggacttgaataaaaataagagcttcggaggctggaacacgagcggatgcgtcgcacaccgcgactccgacgcctctgaaactgtgtgtctttgtaatcatttcacacacttcggcgttctaatggacctgcctcgaagcgcctcccagctggatgcaagaaacaccaaggtgcttaccttcatttcttatatcgggtgcggcatctcagcaattttcagtgcagctactctgctgacttatgtggcctttgaaaagctgcggcgcgattaccccagtaagatcctaatgaacctgtctactgcgctgttatttctcaacttgttgtttcttctggatgggtggataacaagcttcaatgtagacggcctttgtattgcagtagctgtgctgctccatttcttcctcctagcaactttcacttggatggggctggaggcgatccacatgtatatcgcgcttgtaaaggtttttaacacatacatcaggaggtatatcttgaagttttgcattataggctggggcttgccggctctcgtcgttagtgtcgtgctagcaagtagaaataataacgaagtgtacgggaaagaatcatacggcaaagagaaaggcgatgagttctgctggatccaggatcctgtaatcttctacgtgacttgtgcaggatacttcggtgtgatgtttttcttgaacatcgcaatgtttatcgtggtcatggtccaaatatgtgggcggaacggcaaacggtccaatcgcacgctccgggaggaagtcctgaggaacctgcggagtgtcgtgagcctgaccttcttactcggaatgacatggggcttcgccttctttgcctggggaccacttaacataccattcatgtatctgttcagcatcttcaactcgttgcaaggcctgttcatctttattttccactgcgctatgaaagaaaatgttcagaagcaatggaggcaacacttgtgctgcggaagattcagactagccgataattccgattggtccaaaacagccacaaacatcattaagaaatcgtctgacaatttaggtaagagcttgtcttccagctccatcggcagtaactcaacctacctgacaagcaagtcaaagtctagtagtaccacatactttaaacgaaattctcataccgactcagcctccatggataaatcactatccaaactggctcatgccgatggtgaccaaacaagtattattcctgtccatcaagtgatagataaggtgaagggttattgcaacgcgcattccgacaacttctataaaaatataatcatgagcgatactttttcccattcgacgaagttttag

SEQ ID NO: 117781 - DNA, 2394 bp, Artificial Sequence
  Description of Artificial Sequence: Synthetic coding sequence
atggcatcctgtcgggcttggaacttgcgggtacttgtagctgtcgtatgtggactgcttactggaattattcttggtcttggcatctggaggatagtcatcagaatccagaggggtaaatctacttcttcatcctcaactcctaccgaattttgcaggaacggaggcacctgggagaatgggcgctgcatctgcacagaagagtggaaaggactccgatgcactatcgctaatttctgcgaaaattctacctacatgggttttacattcgctcgaattcccgtcggccggtacggccctagtcttcaaacatgcgggaaagatacccctaatgccggaaatcctatggcagtgcgtttgtgctccttgagcttatatggggagattgagttgcagaaggtcacgatcggcaattgcaatgaaaacctagaaactcttgagaagcaggtcaaggatgtaacagctccactgaataacataagctctgaggttcagatcctgactagcgacgctaacaagttgaccgccgagaacattacatctgccacgcgggtggtgggccaaatcttcaacacgtctaggaacgccagccctgaagctaagaaggtagcaatagtaacagtttcgcagctcctcgacgccagcgaagatgcttttcagagggtggccgccaccgccaatgacgacgccctgacaacgttaatcgaacagatggagacttatagcctgtccctgggaaaccagtcagtggttgaaccgaatattgccatccaatccgcaaatttttcctcagaaaacgctgtcggcccatctaacgttagattttccgtccagaagggcgccagctcctcattggtgtcatcatcgacgttcattcacactaacgttgatggactgaatcctgacgcccagacagagctgcaggtgctccttaacatgaccaaaaactacaccaaaacatgtggattcgtcgtgtaccagaacgataagctgtttcagtcaaaaactttcaccgccaagagtgacttctcccagaaaattattagcagcaaaaccgacgaaaacgagcaggatcagtcagcaagcgtggacatggtgttcagtccaaagtataaccagaaggagttccagctctactcctatgcctgcgtttattggaacctgagtgcaaaagattgggacacatacggctgtcagaaagacaaggggacagacggtttcctgcgctgtaggtgcaatcatacaaccaattttgcagtcctcatgaccttcaagaaagactaccaataccccaagagtttagacatcctcagcaatgtcggctgtgcgctctccgtgacgggtctggcgttgacggtgatattccagattgttacacgcaaagtgaggaaaacaagcgtaacctgggtcctggttaatctgtgcatctctatgctcatctttaatttactgttcgtatttgggattgagaactccaacaagaaccttcagacctcggacggtgacattaataatatcgacttcgacaacaacgacattccacgcaccgatactattaatattcccaaccccatgtgcactgctatagcagctttgctgcactatttcctcctggttacttttacttggaatgcactgtctgccgcccaactgtactatctgttgatccgaacaatgaagcccctcccacgccacttcatactcttcattagtcttattgggtggggtgttcctgccatcgtggtggcgatcaccgtgggggtaatctattctcagaatggcaataatccccagtgggagctggactaccgccaagaaaagatctgctggcttgcaatcccggaacctaatggagtcatcaaaagccctcttctctggtcctttattgtgcctgttacgattattttgatttctaacgtggtgatgttcatcacaatttcaatcaaagtgctgtggaagaataatcagaacctgactagcacaaagaaggtctctagtatgaagaagatcgtttcgacactgtccgtggcagtggtctttggcatcacttggatattagcctacctgatgttagtgaacgatgatagcatacgcattgttttctcatacattttctgtctgttcaacactacccagggcctccagatcttcatcctgtacactgttaggactaaagtgtttcagagcgaagctagcaaggtgttgatgctgctgtcttctattggacggagaaaatctctacccagtgtcaccagaccccgattgagggtgaagatgtacaactttttaagaagtttaccaactttacatgagagatttaggcttctcgaaacgagcccgtcgacagaagagattaccttatcagagagcgacaatgctaaggaatctatttag

SEQ ID NO: 117782 - DNA, 1509 bp, Artificial Sequence
  Description of Artificial Sequence: Synthetic coding sequence
atgccggtgaaaatgctcttcaaggagctgctgctgctcctgatgatgatgcccctgcaacattacactaagacctgtgggttcgttgtctatcagaacgataagctcttccagtccaagacttttaccgccaagtccgacttctcacagaagatcatttcttctaagactgacgagaatgaacaggatcagtcagctagcgtggatatggtgttttcccctaagtacaaccaaaaggaatttcaactctatagttatgcctgtgtatactggaacctgtctgccaaggactgggacacatatgggtgtcaaaaagacaaaggaaccgatggcttcctgagatgccgttgtaatcatacaacaaatttcgcagttctcatgacatttaaaaaggattaccagtatcccaagagtctcgatattctttcaaatgtagggtgcgcactgtccgtgacaggcctcgcgctgacagtaattttccaaattgtgacacggaaggtgcggaagacttcggttacctgggttttggtcaatctctgcatctctatgctgatattcaacctgctgtttgttttcgggatcgaaaattctaacaaaaatctccagacaagcgacggagacatcaacaacatagactttgacaacaatgacatcccacggactgacacaatcaacatcccaaacccaatgtgcacagcaatcgctgccctcttgcattactttctcctggtgaccttcacgtggaacgctctgtccgcagcacagctgtattatttgctcatacgaacgatgaagcctctgccgcgccacttcatattgtttattagccttatcggttggggcgtgcctgcaatcgtcgtcgccatcacagtgggggttatctactctcaaaatggtaacaacccccagtgggagcttgactaccgtcaggagaaaatctgttggctggctatccccgaacccaatggagtaattaagtctccactcttgtggtcattcatagtgcctgttacaatcatattgatctctaacgtagtcatgtttattacaatcagcattaaggtgctgtggaaaaacaatcagaacctgacctcaactaaaaaagtgagctcaatgaagaaaatcgtcagcaccctgtctgtggcggtggtgttcggaattacctggattctggcgtacctcatgctcgtgaacgatgactccatccggattgtgttcagctacatcttttgcttatttaatacaacacagggtctccaaattttcatcctgtacaccgtgcgcaccaaggtctttcagtcagaggcttcgaaagtcctgatgctgcttagctccatcggacggagaaagtctctcccctctgtcactagaccgcgcctccgtgtcaaaatgtacaatttcctgaggtccctgcctactctacacgagcgattcagactgttggagaccagcccaagtaccgaggagatcaccctgagcgagtcagataacgccaaggagagtatttag

SEQ ID NO: 117783 - DNA, 1143 bp, Artificial Sequence
  Description of Artificial Sequence: Synthetic coding sequence
atgtgtcccatgcttctcaaaaacggctacaatgggaatgcaacgcctgtcacgactaccgccccatgggcctccttaggccttagtgccaaaacttgcaataatgtctccttcgaggagtcccgcattgtcctggttgtcgtctactccgccgtgtgcacgctgggagtgcccgcaaattgcctgacagcttggttagctctgctacaggtccttcaaggtaacgtgctggctgtgtaccttctgtgcctcgcactgtgcgaactcctctacaccggaacgctccctctgtgggtgatatatataaggaatcagcataggtggacccttggtttactggcctgcaaggtgacagcatacatttttttttgcaacatttatgtgtctatacttttcctttgttgcataagctgtgataggttcgtcgcggtggtatacgccctcgaatcgcgcggaagacgtagacggcgaaccgccatcctgatctctgcatgtattttcattcttgtgggaatcgtgcattaccctgtgttccagaccgaagataaggaaacatgttttgacatgttgcagatggattcgcggatcgctggctactactatgcccggttcaccgtggggtttgccattcctttgagtatcatcgcgttcactaaccatagaatcttccgatctattaaacagagcatgggtctgtcagctgcccagaaagcaaaagtaaagcattctgctatcgctgtagtagtgattttcctggtttgttttgctccttatcatttagtactgttggtcaaagctgcagcgttctcctactaccgaggcgacaggaacgctatgtgcggcctggaggagagattgtacacagccagcgtggtgttcctgtgcttgagcactgttaacggcgtggctgatccaatcatctatgttctcgcaaccgatcactcacggcaggaggttagccgaattcacaagggctggaaggaatggagcatgaaaaccgacgtcacaagattaacccatagccgggacacagaggaactgcagtccccagtcgccctcgccgaccattatactttttcccggcccgtccatcccccaggctccccctgcccagccaagagactgatcgaggagtcatgctag

SEQ ID NO: 117784 - DNA, 1116 bp, Artificial Sequence
  Description of Artificial Sequence: Synthetic coding sequence
atgccaggtaacgccactccggtaacaaccaccgcaccatgggcaagcctgggcttgtctgccaaaacgtgtaacaatgtgtccttcgaagagtccagaatagtgcttgtggtcgtctactcagcagtctgtaccctcggcgtcccagcaaattgccttaccgcatggctcgcccttctgcaggtgttgcagggcaacgtgttggcagtctatctgttatgcttagccctgtgtgaactcttatacacgggaaccctgccactttgggtcatatacatcagaaatcaacacaggtggacattgggtctcctggcttgtaaggtgacagcttacatctttttttgtaacatctatgtatccattttgttcctttgttgcatttcttgtgatcgcttcgtcgccgtggtttacgctctcgagtcccgtggcaggcgacggcgacgcaccgctatcctgatctctgcttgcatcttcatcctggtcggcatcgtccattatcctgtatttcagacggaagacaaagagacatgctttgacatgctgcagatggactctcggattgctggatattactatgctaggtttacggttgggtttgccatccccctcagcatcatagcttttaccaaccaccggatctttagatccatcaagcagtctatgggtctttcggccgctcagaaagccaaggtgaaacactccgccatcgctgtggtggtcatctttctggtctgtttcgctccataccacctggtgcttctcgtgaaggcggcagcgttttcttactatcggggtgatcgaaatgccatgtgtggtctggaagagagactttacactgcatctgttgtgtttctctgtctatccactgttaacggtgtggcggacccaataatttacgtgttagctactgaccattctagacaggaggtgagtcggatccacaagggctggaaggagtggtccatgaagactgacgtcacaagattaacccactcacgtgacacggaggagctgcagtcccccgtagctctggcggaccactatacattctctagacccgtgcaccctccaggctcgccttgtccggcaaagcgcctaattgaggaaagctgttag

SEQ ID NO: 117785 - DNA, 1143 bp, Artificial Sequence
  Description of Artificial Sequence: Synthetic coding sequence
atgtgcccaatgcttttaaagaacggatataacggcaacgccacacctgtgacaaccactgcaccctgggccagccttggcctgtctgctaaaacgtgtaataatgtttctttcgaggagagcagaatcgtactggttgtcgtgtactcagccgtgtgtaccctgggggttccagcaaactgccttacagcgtggctcgcactgttgcaggtgctccagggaaatgttctcgcagtgtatctgctctgtttggctctgtgcgagctcctctacacagggacccttcccctgtgggtcatatacatccggaatcagcaccgttggacattaggtctcctggcttgtaaagtgaccgcctacatcttcttctgcaacatttatgtgagcattctttttctgtgctgcatctcttgtgaccggttcgtagccgtggtttacgccctggagagtcggggacgtaggcggagacgaacagccatcctgattagtgcgtgtattttcattcttgttggcatagtgcactatcctgtcttccaaactgaagataaagagacctgcttcgatatgctgcagatggattcacgtattgccggctattattatgcacgattcactgtgggcttcgccattcccctgtctattatcgcatttactaaccacagaatttttaggtctataaagcagtctatggggctctccgctgctcagaaggctaaggtgaaacactccgctatcgcagtggtagtcatcttcctggtgtgtttcgctccttatcacttggtgctccttgtgaaagcagctgccttttcttattataggggggatagaaatgccatgtgcggcttggaggaacgcctgtatacagctagcgtcgtttttttatgtctcagcacagtcaatggggtggccgatcccatcatttatgtcttggctacagaccacagtaggcaggaagtgtcccgtatacacaaggggtggaaggagtggagcatgaagacggatgtcacacggctcacacacagccgggacacagaggagctccagagccctgtcgcccttgccgatcactatacttttagtagacccgtgcatccccccggctctccatgtcccgcaaaaagactcatagaggagtcgtgttag

SEQ ID NO: 117786 - DNA, 33 bp, Artificial Sequence
  Description of Artificial Sequence: Synthetic coding sequence
atgtgtccaatgttactgaagaatggttactag

SEQ ID NO: 117787 - DNA, 2625 bp, Artificial Sequence
  Description of Artificial Sequence: Synthetic coding sequence
atggaaaagctgctgcgactttgttgttggtatagctggctgctactcttctattataactttcaggtgagaggggtgtatagcagaagccaggatcacccaggatttcaagtgctcgcttcagcttcccactattggcctctggagaatgtggacggaatccatgaattacaagacaccacaggagacatcgtggaaggtaaggtcaacaaaggcatctatctaaaggaggaaaagggcgtcacattactgtactatggccgctacaactctagctgcatttccaaaccagagcagtgcggacctgagggagtgactttctcttttttctggaagacccagggagagcagagcaggcccatcccatctgcttatggaggacaagtgatctccaatgggtttaaggtctgtagcagcgggggccgaggaagcgtagagctatacactcgcgacaatagcatgacgtgggaggctagcttcagcccacctggtccctattggactcatgtcctattcacttggaagagcaaagagggattgaaggtctacgtcaatggtacgttatctaccagtgatccaagcgggaaagtatcaagggactatggcgaaagtaacgtcaacctcgtaatcggaagtgagcaggaccaggccaagtgctacgagaatggagcattcgacgagttcatcatctgggaaagggccctgacgcccgatgaaatcgctatgtatttcactgctgcaataggtaagcacgcactgttgagttctacccttccctcactatttatgacctcaaccgcaagccctgtaatgccgaccgacgcctaccatccaataattaccaatctgaccgaggagaggaagaccttccagtctccaggagtcatcctgtcttatctacagaatgtcagcctcagtctcccttcaaagagcctgtccgaacaaacagcccttaatttaaccaagaccttcctgaaagctgtaggcgaaatcctgctgctccccggatggatcgccctcagcgaggactccgccgtggtgttgtccctgattgacaccatcgacacagtgatgggccacgtgtcatccaatctacatggcagtacaccccaggttacagtggaagggtcaagtgccatggcagagttctctgtggctaagattctgcctaaaaccgttaactcttcacactacagattccccgcacacggacagtcttttatccaaatcccgcacgaggccttccatcggcacgcctggagtaccgttgtgggactgctctatcattccatgcactattacctgaataacatctggcccgcccatacaaaaatagcggaggctatgcaccaccaagactgtcttcttttcgctacaagtcaccttatttccttagaggtttctccaccgccaacactgtcacaaaacctgtccgggtcacctctgattacagtgcatctcaagcaccggctgactcggaaacaacatagcgaagctacaaattccagtaacagggtgtttgtgtattgtgctttcctagatttctcctctggagaaggcgtctggagcaatcacggctgtgctctgaccaggggtaacctgacatacagcgtctgccgatgcacccatctgaccaatttcgccatcttgatgcaggtggtgcccctagagttggcccgtggccaccaggtcgctttaagcagtatttcatacgtggggtgcagtttaagtgtgttgtgtctagtagccacactcgtgacctttgctgtgctgtcgtccgtctctaccataaggaatcagaggtatcatattcatgccaatctgtcatttgcagtgctcgtggcgcaggtgctgctgctgatctccttccgcctggaacccggtaccacaccgtgccaggtgatggccgtactgctacactatttttttctctcagcctttgcttggatgttggtagagggcttgcacctgtacagtatggtcatcaaggtgttcggaagcgaagattctaagcatcggtactattatggcatgggttgggggttcccactccttatttgtatcattagcctaagtttcgccatggattcatatgggacatccaataactgttggctctcactcgcttctggagccatttgggctttcgtggcaccagccctgtttgtgattgtcgtgaatattggtattctgatagccgttactcgtgtgatatcccaaatatcagcagacaattacaaaattcatggagacccatcggctttcaaactgaccgcaaaagcggtcgcggtcctgttgcctattcttggtactagttgggtatttggggtgctggccgtgaacggttgtgccgtcgtgtttcagtatatgttcgcaacactaaactcactccaagggctgttcattttcctgtttcactgcttactgaattccgaggtgagggctgccttcaaacacaaaacaaaagtttggtctctcacctccagcagtgctcgaacctccaatgctaagccctttcatagtgacttgatgaacgggaccaggcccggcatggcctctacaaaactgagtccttgggacaaatcctcccattcagcccatagagtggacctgtccgcagtgtag

SEQ ID NO: 117788 - DNA, 687 bp, Artificial Sequence
  Description of Artificial Sequence: Synthetic coding sequence
tagcatggtgtaagcgccagagatgtgctggagtcaagaacacgaaagcaacattctgaagccaccaacagcagcaacagggtgtttgtgtactgcgcgtttctggacttctcaagcggagaaggtgtgtggagtaatcacggctgcgccctgactcgcggaaatctcacctattcggtgtgtcgctgtactcaccttacaaacttcgctattcttatgcaggtggtgcctttggaggtgaatataggcatcctgatcgctgtaacacgagtcataagccaaattagcgctgacaactacaagatccatggggacccctctgctttcaagctgactgcaaaggccgtggccgtccttctcccgatcctgggtacttcatgggtttttggcgtcctggccgttaatggctgcgccgtggtgttccagtatatgtttgccacactgaattcgctgcagggtttattcattttcctgttccactgtctgctgaattccgaggtccgggccgcgttcaaacataaaacaaaagtgtggagtcttactagctcctctgcgaggacctcaaatgctaagccttttcatagcgatctcatgaatggcacacggccagggatggccagtaccaagctgtccccgtgggataaatcttctcactcagctcacagagtggatttgtccgccgtatag

SEQ ID NO: 117789 - DNA, 2721 bp, Artificial Sequence
  Description of Artificial Sequence: Synthetic coding sequence
atggaaaagctgttgagactgtgctgctggtacagctggctgctgctgttctattataatttccaggtccggggcgtatactcaaggtctcaagatcaccccggatttcaggttctggcttctgcaagccattattggcccctcgaaaatgttgatggcattcacgaactacaggacaccaccggggcatccaggacacacaagctgactgtgctgccaagccgcaatgctactttcgtgtactcgaacgacagcgcctattccaatttatccgctaccgtggatattgtggagggcaaagtcaataaaggaatttacttaaaagaagagaagggggtcacattactgtactatgggagatacaatagcagttgtatcagcaagccagaacagtgcggccccgagggcgtgacattcagctttttttggaaaacccagggagagcagagcagacccattccaagcgcatatggtggccaagttatctctaacggatttaaagtctgtagctccggaggtcgtggctccgtggaactgtatacacgggacaactccatgacctgggaggccagctttagtccacccggcccctattggacgcatgtgctttttacatggaaatcaaaagaaggcctaaaggtgtatgtgaacggaacactgtccacaagcgatccgtcgggcaaagtctcccgcgattatggcgagtcaaacgtgaacctagtgatcgggtctgaacaggaccaggccaaatgctatgagaacggagctttcgatgaatttataatttgggagagagcattgactccagacgaaatcgctatgtattttacagccgcaattggcaagcacgcactgctttcttccaccctgccatctctttttatgacgtccacggcctcaccagtcatgccaacagatgcttaccatcctattatcacgaacctcacagaggaacggaagacgtttcagtcccccggggtgattctgagttatttgcagaacgtgagcctcagccttcctagtaagtcactttccgagcagaccgcacttaacctgacaaagacatttctgaaggctgtgggcgaaatcctgcttctgcccgggtggattgcactgtccgaagactccgctgtggtcctgtcccttatcgatactatcgacaccgttatgggtcacgtctcgagcaatctccacgggagcactccacaggttacagtggaaggcagtagtgctatggccgaattttcagtggcgaagatcttgccgaaaacagtgaattcctcccattatcgattccctgctcacggacagagcttcatccagattccccacgaggcttttcacaggcacgcttggtccacggttgtgggcttgctgtaccacagtatgcattattatttaaacaacatctggccggcacacaccaagatcgccgaggctatgcatcatcaggactgcctcctattcgcgacatcccatttgatctccctcgaagtctcaccgccccccaccctgtctcagaacctgtctgggtctccccttataacggtgcacctcaaacacagactgactagaaaacaacacagcgaagcaaccaatagctctaacagagtgttcgtttactgtgctttcctggatttcagctctggcgaaggcgtgtggagcaaccacggctgcgccctaacacgcggcaatcttacctattcagtgtgccggtgtacgcacctgacaaacttcgctatactcatgcaagtcgtccctctggaacttgctaggggccaccaggtagcactgtctagcatctcctatgtgggctgtagtctgtcagtgctgtgcctcgtcgccacactcgtgacattcgccgtgctgagcagtgtgagtaccattcggaaccaaagatatcacatacatgccaacctcagtttcgccgtgctcgttgcgcaggtgctcctgctcatctcatttcgactggagccaggcaccacgccctgtcaggtgatggctgtgttgctccactattttttcctctcagcatttgcttggatgcttgtagaggggttgcatctttattccatggtgatcaaagtgtttggaagtgaggactctaagcacagatactactatggtatgggttgggggttccccttgctgatctgtattatctcactgtctttcgccatggatagctacggcacctcaaacaattgctggctgtcactggcttccggcgccatctgggccttcgttgctcccgcccttttcgtaatagtggttaatatcgggattcttatcgccgtgacacgcgtgatatcgcaaatctctgctgacaattataaaattcacggagatcccagtgcgttcaagctgacggccaaagccgtggctgtgttgcttcccattttaggtacatcatgggttttcggcgtgttagccgttaatggctgcgccgtggtgtttcagtatatgtttgctactctgaactccctgcagggactgtttattttcctgttccactgcctactgaatagcgaagtgcgcgccgcttttaaacataaaacaaaggtttggagcctgactagttcttcagcccgcaccagtaacgcaaagccgtttcactctgatctgatgaatggtactcggcccggtatggccagtaccaaactgtccccatgggacaagagcagccactcagcccacagagttgatctcagtgccgtctag

SEQ ID NO: 117790 - DNA, 1275 bp, Artificial Sequence
  Description of Artificial Sequence: Synthetic coding sequence
atgacacaggctggtaggcgaggtcccggaactccagagcccaggccccgaacacagcccatggcatctcctcgcctgggcacattctgctgtccaacccgagacgccgccacccaactggttctgtcgtttcagccccgtgcgtttcacgccctctgcctcggttctggaggactacggcttgctctcggacttctgcaacttctgcctggtagacgccctgccgggcccgggagccctgctacaagtcccccagcgtctgtccgcatcctccgcgccgccgccgcatgcgatctgctcggatgcctgggcatggtaattcgaagcactgtgtggttagggtttcctaattttgttgacagtgtctctgatatgaaccacacagagatctggcccgcagccttctgcgtgggcagcgccatgtggatacagctcctgtacagcgcctgtttctggtggctgttttgttatgccgttgatgcctacctggtaatcagaaggagtgcagggctgtctacaatcttgctttaccacattatggcctggggattagccacactcctgtgcgtggaaggggctgccatgctgtattaccctagcgtgtcaaggtgtgagcgggggttggatcacgccattcctcactacgtcacaatgtatctgcccctcttgctcgttttggtggctaatcccatcctattccagaaaacagtgactgcggtggcaagcctactcaaaggacgacagggaatttacacagagaatgaacggcggatgggagcagtgatcaagatacgcttcttcaaaatcatgttagtgctcattatctgttggcttagcaacatcattaacgaatctctgctgttctatttagagatgcagacagacataaacggaggatcactgaaacccgtgcggacagccgccaagaccacctggttcatcatgggtatactgaacccagctcagggttttttgctatccctcgctttttatggctggacaggttgctctttggggtttcaatctccgcgaaaagaaatccagtgggagagcctaaccaccagcgccgctgagggcgctcacccatctcctctcatgcctcacgaaaatccggcaagcggaaaggtgagccaggttggtgggcagacaagtgatgaagcgctcagtatgctgagcgaggggtcagacgcgagcacaatagagattcacacagcgtccgaatcctgtaataaaaatgaaggagacccggcactcccgacacacggggacctgtag

SEQ ID NO: 117791 - DNA, 516 bp, Artificial Sequence
  Description of Artificial Sequence: Synthetic coding sequence
atggtaatccggtcaaccgtgtggctgggcttccctaactttgtcgactccgtcagtgacatgaaccacacagagatttggcccgcggcattttgtgtgggaagtgccatgtggattcagctgctttacagtgcatgtttctggtggttattttgttatgcagtggatgcgtacctcgttatacggcggagcgcggggttgtccaccatcttgctgtaccacataatggcctgggggttggccaccctcctttgtgtagaaggtgccgctatgctgtattatcctagtgtgtcacgatgcgagcgggggttagatcacgccatcccgcactacgttactatgtacttgcccctgttgcttgtgcttgtggccaacccaattttgttccagaagactgtgacagctgtggccagccttctgaagggtagacagggtatctatacagaaaatgagaggagaatgggcgccgtgatcaagatccggttcttcaagatcatgctggttctcatcatctag

SEQ ID NO: 117792 - DNA, 864 bp, Artificial Sequence
  Description of Artificial Sequence: Synthetic coding sequence
tgaacggccggacccgtgacagggagcgcttcaaggggcccagcaagaggtcctaaaggaatggtgattcggtctaccgtgtggttaggattccctaactttgttgactcagtaagcgatatgaatcacactgagatttggccagccgccttttgcgtgggaagtgccatgtggatacagctgctgtacagcgcttgcttctggtggctcttctgctatgcggttgatgcctatttggtcatcaggcgaagcgctggcttatcaaccattctgctgtatcacataatggcatgggggctcgccaccttgctctgtgtggagggagccgctatgctgtactacccttcggtgagtcgatgcgagcgaggattggatcatgcgattccccactatgtcacaatgtatctgccgctcctcctagtgctcgtggccaatcccatcctgttccagaagacggtgacggcagttgcatctctactgaagggtcgtcagggcatctacaccgaaaatgagaggaggatgggcgccgtcatcaagattaggttcttcaagattatgttggtactcattatctgttggctgtcgaacatcattaatgagtccctgctgttctatctggagatgcaaactgatattaatggcggcagcctcaaaccggtgcggacggccgcaaagactacgtggttcataatgggtatcttaaacccggctcaagggttcctcttatccctcgctttctacggatggacggggtgcagtctgggcttccagagccctagaaaggagattcagtgggagtctcttactacatctgcagcggaaggggcgcacccatccccccttatgccgcatgagaacccatag

SEQ ID NO: 117793 - DNA, 1215 bp, Artificial Sequence
  Description of Artificial Sequence: Synthetic coding sequence
atggcgtccccacgtctgggaaccttctgctgtccaactcgtgacgctgcaactcagcttgtcttaagcttccaaccgagggcgttccacgccctctgcctcggttctggggggttgagactggccctagggcttctgcagctcctcccggggcgtcgccctgcaggccctggatctcccgctaccagccctccagcgagcgtgcggattctgagggccgctgcagcatgcgacctgctcggatgcctggggatggtaattcgctccacagtgtggttgggtttccctaacttcgttgactcagtcagtgatatgaatcataccgaaatctggccagcggcgttctgtgtggggtccgccatgtggatccagctgctctattccgcctgcttctggtggttgttttgttacgccgtggacgcgtatctggtaattcggaggagtgccgggctgtctaccatccttctatatcacatcatggcctgggggctggccaccttgttgtgtgtggaaggcgcagcaatgttgtactacccatcagtttctaggtgcgaacgaggcctggaccatgcgatccctcactacgttacaatgtacctgccactcctgttggtgctggtggcaaacccaatactatttcagaagactgtgacagccgtcgcttctcttctcaaagggcgccaaggcatttataccgagaacgaacgccggatgggagcagtgataaaaattagattcttcaagattatgctagtcctgatcatctgctggctctcaaatatcattaacgagtcacttctgttctacctggaaatgcaaaccgacataaacggcggatcgcttaaacctgtaagaactgcggcaaaaaccacatggttcatcatgggcattttgaatccagcacaggggtttctgctgtcactggctttttacggctggaccggatgttctctaggattccagtcaccgaggaaggagatacagtgggagtcactgactacatctgctgccgagggcgcccatccaagcccgctgatgccccatgaaaatccagccagtggaaaagtctctcaggtcggcggccagacatccgatgaagctctcagcatgttgagtgaaggaagcgatgcaagcactatcgagatccataccgcatccgagtcttgtaacaaaaatgagggagaccctgccctaccaactcatggggatctgtag

SEQ ID NO: 117794 - DNA, 1083 bp, Artificial Sequence
  Description of Artificial Sequence: Synthetic coding sequence
atggacccagaggagacatccgtgtatctcgactattattatgcgacgtcacctaatagcgacatccgagagactcactcgcatgtcccatatacttctgtgttcctgcccgtgttttacacagcagtatttttaactggagttctggggaacctggtgcttatgggggccctgcactttaagccaggatcgagacgactaattgacattttcataatcaatcttgcagcatccgattttatatttctcgtgactctgcccctctgggtcgacaaagaagcttccctcggactgtggcgcacaggttcctttctgtgcaaaggatcttcctacatgatctctgtcaacatgcactgttccgtcctcctgctaacgtgtatgtctgtcgataggtatctcgccatcgtttggcccgtggtgtcacgaaagtttcggagaacagactgcgcctacgtagtgtgcgccagcatttggtttatttcctgcctcctgggtctgcccacactgctctctcgagagctgacattgatcgatgataagccctattgcgcagaaaagaaagccaccccaattaagctcatatggtctctggtagcgctgatattcaccttctttgtccccttgttatcaattgtgacatgttattgttgcattgcgcggaagctgtgcgcccactaccagcagtcaggaaaacataacaaaaagctaaaaaaatcgatcaagattatctttatcgtggtggccgcttttttggtgtcttggctccctttcaatacctttaagtttcttgccattgtttccggcctccgccaagaacactacttgccgagtgcaatcctgcagctagggatggaggtgagtggtccactggcttttgccaattcatgcgtgaatccgttcatctattacatctttgatagctatatccgccgcgcgattgtgcactgcctttgtccatgtctaaaaaactacgacttcggatccagtaccgaaacctccgactcccatctcaccaaagctctgagcactttcatacatgcagaagatttcgcccggaggcgcaagcgatccgtttcgctgtag

SEQ ID NO: 117795 - DNA, 1830 bp, Artificial Sequence
  Description of Artificial Sequence: Synthetic coding sequence
atgtctgacgagcgacgattacctggctcagcggtcggctggcttgtctgtggcggcttaagcctcctggccaacgcttggggaatacttagtgtgggtgccaagcagaagaaatggaagccactggaattcttattatgtactttggccgctacacatatgcttaacgtggccgtacccattgccacatattccgtagttcagctccgacgtcagagacctgactttgaatggaacgaaggactgtgcaaagtgtttgtgtcaacattttacaccttgacattagccacctgtttctccgtcacgtctctgagctaccataggatgtggatggtctgctggccagttaactatcgactcagcaatgccaagaagcaagccgtgcacaccgtaatggggatttggatggtgagtttcattctgagcgcactgcctgccgtcggctggcacgatacatccgaaaggttttacactcacggctgcaggtttatagtcgccgaaattggcttggggttcggggtttgtttcctcttattggtgggcgggtccgtggcaatgggagttatctgcactgcaatcgcattgttccaaactcttgcagtgcaggtaggccgacaggcggatcgtcgggcctttacagtccctacgattgtcgttgaagatgctcaagggaagaggagaagctccattgatggctctgagccagctaaaacctcgcttcagactacgggccttgtaacaacaatagttttcatctatgactgtcttatgggtttccccgtgctggtggtttccttctcatccttaagagcggacgctagtgctccttggatggccctctgtgtgctttggtgctcagtggcccaagcacttctcttacctgtgtttttgtgggcctgcgaccgctatcgtgcagatctgaaagcagtacgggaaaaatgcatggcactcatggcaaacgatgaggaatcagatgatgaaaccagcctcgagggagggatctcccccgacttagtgctcgagcggtcactggactacggctacggcggcgacttcgtggccctggacagaatggctaaatacgaaatcagcgcacttgaaggcggactgccccaactgtatcccctgcggccattgcaggaggataaaatgcaatatctacaggtgccgccaacacgtagattttctcatgatgacgcagatgtgtgggccgcagtgccccttcccgccttcttaccccgctggggctccggagaagatctcgccgctcttgcccacttggtgctccccgccggtccagagcgccgcagagccagcctactagctttcgctgaggatgcaccaccctcgagagcacgtcggcgatcggctgaatccctgttatctctgaggccctctgctcttgactccggaccaagaggagctcgggactccccacccggtagtcctcgtcgacggccgggcccaggcccaagaagtgccagcgcttcactcctgcccgatgcattcgcccttaccgcgtttgagtgtgagccacaggccctgaggcgacccccgggccctttccctgcagcccctgctgccccagacggagccgacccaggcgaagcccccacaccaccaagcagcgcccagaggagcccaggtcccagacccagcgctcactcacacgccggatcgctgcggccaggcctcagcgcctcttggggggagccaggggggcttagagctgccgggggtgggggaagtacttccagttttctttcctccccctcagagtcttctggctacgctacacttcacagcgactcactgggaagcgcatcttag

SEQ ID NO: 117796 - DNA, 2445 bp, Artificial Sequence
  Description of Artificial Sequence: Synthetic coding sequence
atggagcccgaaatcaactgtagcgagttgtgtgactctttccctgggcaagaactcgatcgcaggccccttcatgacctctgcaaaactactattacgtcatctcatcattctagcaagaccattagctcgttgtctcccgtgcttctaggaatagtctggacgttcctgtcctgtggcttgctgctgattctgttcttccttgctttcacgattcactgcagaaagaaccgaattgtgaagatgtccagccccaatttgaacatagtgacactcttgggctcctgtctgacctacagcagcgcatacctgtttggaatccaagacgtgctcgtagggtcttccatggagaccttaatccaaaccagactgagcatgttgtgcatcggcacttctctggttttcgggccaatcctcggaaaatcctggcggctctacaaagtgttcacgcagcgggtgcccgataagcgagtcattattaaagacttgcagttgctgggtctggttgccgcgcttctcatggccgatgtgatactcctgatgacatgggtgctgactgacccaatccagtgcttgcagatactgtcagtctccatgacagtgaccggtaaggatgtttcatgcaccagtacgtctacccatttctgcgcatctcggtactctgatgtgtggatcgcacttatctggggctgcaaagggcttttattactttacggggcatacctggctgggctgacgggccatgtcagctcccctcccgtgaatcaatctctgaccattatggtgggcgtgaatcttctggttttagccgccggactcctgtttgtcgttaccaggtacctccactcatggccaaacctggtgttcggcctgacatccgggggcatatttgtgtgcacaaccactatcaattgcttcatctttattcctcagctgaaacagtggaaagcctttgaggaagaaaatcaaacaatccgccggatggccaaatacttcagtacgcctaacaagtctttccatacccagtatggcgaagaggagaactgtcatcccaggggggaaaagtcctctatggagagattgctgaccgagaagaacgccgtgattgaaagcctgcaggagcaggtgaacaacgccaaagaaaaaatagtcagactgatgtcagccgaatgtacctatgacctgccagaaggcgcagcacctcctgcttcatcgcctaacaaggatgtccaggccgtggcttccgttcacaccctggccgccgcccagggtccctctggccatctgtcagattttcagaacgacccaggcatggcagcgagggactctcagtgtacgagtggacctagcagctatgctcagagtctggagggtcccggcaaggatagctccttcagcccaggtaaggaagaaaagatctcagacagtaaagatttctcagaccacctggactcgggttgctcccagaagccctggacggagcagtctcttggaccagaacgcggcgaccaagtgcccatgaacccctcccagtctttactcccagagcggggcggctctgacccacagcgccagagacacttggaaaactccgaagagccgccagagagaaggtcccgcgtatcttccgtgatccgggaaaagctgcaagaggtcctgcaagacttgggcttgggccccgaggcatctctcagcaccgcgccctcttgccaccagcaaacctggaaaaatagcgccgccttcagtccgcaaaaaatgccactttccaaggagctggggttcagcccttacatggtccgtcggcgaagggcggctcagcgcgcacggagccactttcctggatccgcaccttcatccgtgggtcaccgcgctaatcggacagtgccaggggcgcactcccgcttgcacgtacagaatggagattcaccctccctggcccctcagacgactgacagtcgggtgcgccgcccttcttcacgaaagccttccctgccttccgaccctcaggaccggccggggaccctcgagggcagcaaacagtcgcagacagagccggagggagcacggggctccaaagccgcttttctgaggcagccgtctggatccgggcgcgctccttccccagcagcaccttgcttaagtaaggccagtcctgaccttcccgagcagtggcagctttggcccccagtgccttcaggctgcgcctctctatcgtcccagcattcctattttgatacagaaagctccagtagcgacgaattcttttgtcgctgtcatcggccctattgtgagatatgctttcagagctcatctgacagctccgactctggcacctccgataccgaccctgagccaaccggggggctcgcaagttgggagaaactttgggcccgatctaagcctattgtgaattttaaggacgatctaaaacccactctggtgtag

SEQ ID NO: 117797 - DNA, 2445 bp, Artificial Sequence
  Description of Artificial Sequence: Synthetic coding sequence
atggaacccgaaatcaactgttccgagctgtgcgattccttccccggacaggagcttgatcgccgaccactacacgatctgtgtaagaccacaattaccagcagccaccacagctccaagacgatctcctccctgtcccccgtactgctggggatcgtgtggacttttctaagttgcgggttactcctaatccttttttttctcgcctttacaatccactgtcgtaagaaccggatagtgaaaatgagcagcccaaacctgaatatcgtcacactcttaggcagctgcctgacgtattcatcagcctacctgtttggaatccaggacgtacttgtggggtcatccatggaaacgttgatacagacacgtctcagtatgctctgcatcggaacttcgctggtctttggtccaattcttggaaagtcctggcgcttgtataaagtgttcacacaacgggtgccagataaacgggtcatcattaaagacctccagttactgggtctagtggctgcactccttatggcggatgttatcctgctgatgacttgggtccttaccgaccctattcagtgtctgcaaatcctgagcgtttctatgacggtgacggggaaggacgtgtcatgcactagcacgagtacacacttctgcgcctcgcgatatagcgacgtgtggattgctctgatttggggctgcaagggcctgctattgctgtacggggcttatctcgctggcttgactggccacgttagttcaccacccgtcaaccagagtctgaccatcatggtgggagtgaacttactagtgcttgccgctggccttctctttgttgtaacccggtatctgcattcttggcctaacctggtcttcggcttaacaagcgggggcatctttgtgtgcactaccactatcaactgtttcattttcattcctcagctgaaacaatggaaggcctttgaagaggaaaaccaaacaatccgccggatggcaaaatattttagcacgcctaataaatcctttcacactcaatatggagaagaggagaattgtcatccaaggggcgagaagtcgtctatggagagactgttgacagagaagaatgcggtgattgaaagccttcaggagcaggtcaataacgcaaaggagaaaattgtgcgacttatgtctgccgagtgtacctacgacttgccggagggcgctgcaccgcccgctagtagtccgaataaagatgtacaggcagtagctagcgtgcatacacttgcagccgcccaagggcccagcgggcatctgagtgacttccaaaacgatcctgggatggccgcgcgagacagccaatgcacaagcggaccctcatcatacgctcaaagcctagaaggacccggaaaagactcctcattcagcccagggaaagaggagaagatctcagattctaaggacttttcagatcacttggattctgggtgttcacaaaagccttggactgaacagtcactgggaccagagaggggtgatcaggtacctatgaatccctcccagagcctcttaccagagcgggggggaagcgacccccaacgccagagacacctcgaaaattcggaagaacccccagaaagacgctctcgagtctcttcggtaatcagggagaagctgcaggaggttctgcaggatttgggattggggccggaggctagcctttctaccgctcctagctgccaccagcagacctggaagaattctgctgcattttctccccagaagatgcccctgtccaaagagctgggattctcgccttacatggtcagaaggaggagagcggcgcaacgagctcggagtcattttccagggtcagcccccagcagtgtcggacacagggccaaccggactgtaccgggcgcccatagtcgactccacgtgcagaatggtgatagtcctagtttagctccccaaaccacagactctcgtgtgagaagacccagctcgcggaagccctcactgcctagcgacccacaggatcggccgggtacactggaagggtcaaagcagagccagaccgagccagaaggagcaaggggatcaaaagccgccttcttgaggcagccctcaggctctggtagagctccttccccagccgcgccttgtctcagtaaggctagccctgacctcccggaacagtggcaactttggccccccgtgccatctggctgcgcttcgctctctagtcagcactcctattttgatacggagtcctctagcagcgatgagttcttttgccgctgccatcgtccctattgcgagatctgtttccagtcctccagtgacagtagcgacagcggcacgtccgacaccgaccccgaacccacagggggccttgccagttgggaaaagctttgggctcgcagtaagccaattgtgaatttcaaggacgacttaaagcccactctcgtgtag

SEQ ID NO: 117798 - DNA, 2433 bp, Artificial Sequence
  Description of Artificial Sequence: Synthetic coding sequence
atggagcccgagatcaactgcagtgaactctgcgattcatttcctggccaggagctcgataggagaccactgcacgatctctgtaagacaactatcacttcgtcccaccattccagcaaaacaatctctagccttagcccggtactcctcggcatcgtgtggacatttctttcctgtgggttactgctgatcctgttctttctggcgtttacaattcactgccggaaaaataggattgtaaagatgagtagccccaatctgaacatagtaacattacttggcagttgcctgacttattcatctgcctacctgttcggaattcaggacgtgctcgttggtagcagtatggaaacattgatccagacgagattatctatgctgtgcataggcacatcgcttgtatttggccccattttgggtaaatcttggcgactctacaaagtgttcacccagcgagtgccggacaagagggtgattattaaggaccttcagctgcttggcctggtagccgcccttctaatggctgacgtaatcctcttaatgacttgggtgctcactgacccaatccagtgccttcagatactgagtgtaactggtaaagacgttagctgcacatcgactagtacacatttctgtgcgtccagatattcagatgtgtggatcgccctgatttggggatgcaaaggcttgctactcttatacggagcataccttgctggcctgactggtcatgtgtccagtccccctgtgaatcagagtctgactatcatggtgggagtgaatcttctcgtccttgcagccgggctgctgtttgtggtgaccagatacctccactcgtggcccaatctcgtatttgggctgacaagcgggggtatcttcgtatgcaccactacaattaactgcttcatattcattcctcagctgaaacagtggaaggcttttgaagaagagaatcaaaccattcgccggatggctaagtatttctccaccccaaacaagtccttccatacgcaatatggggaggaggaaaactgccatccccgaggcgaaaaatcttccatggaaaggctgctgacggaaaagaatgccgtgatagaaagcctccaggagcaggttaataacgcaaaagagaagattgtacggctaatgtccgccgagtgcacgtacgacctgccagaaggcgccgctccccccgcctccagtcctaataaagacgttcaagccgtcgcctcggtgcatacactcgctgctgctcaaggaccatcaggacatttatctgatttccagaacgaccccggcatggcagcccgagacagtcagtgtacctctggtcccagctcttacgcccaatccttagaaggacctggtaaagatagctcattcagccctggaaaggaagagaagatctctgattccaaggacttctccgaccatctggattcaggatgtagccaaaagccctggactgaacagagtctcggtccagagagaggagatcaagtgcccatgaatccttctcagagtttattgcccgagagagggggtagcgaccctcaacgacagcgtcatctcgaaaacagtgaagaacctcctgagagacgatccagagtctcgagtgtgattcgggagaagcttcaagaagtgctgcaggacctcggtctcgggcctgaagcctctctatcaacggccccaagttgtcaccagcagacttggaaaaactcggccgcattttcaccccagaaaatgcccttgagtaaagaattgggattctcgccctatatggtcagacggagacgcgcggcccagcgagctcgctcccacttccccgggagcgcaccctccagcgtggggcacagggctaaccgtactgtccccggagcccactcacgcttgcacgtgcaaaatggggacagtcccagtctggcgccccagactacagactctcgggttaggcgcccttctagtaggaaacccagcctgccgtcagatcctcaagatcgccctggcactctggaaggatctaagcagtcccagactgaaccagagggggccagaggctcaaaagccgcttttctcaggcagccttcgggcagcggccgcgccccttcaccggcggcaccttgtctttccaaagcttcacctgatttaccagaacaatggcaactatggccccccgtaccttccgggtgcgctagtctgtccagtcagcacagttactttgacacggagtcaagctcttctgacgagttcttctgccgttgtcacaggccttattgtgaaatctgttttcaatcttcgtccgactcatccgattcaggtacaagcgatactgatccagaacccactggcggcttggcctcttgggagaagttgtgggcaagatcaaaaccaatcgtcaactttaaagacgacctgaagcctacgctagtgtag

SEQ ID NO: 117799 - DNA, 1590 bp, Artificial Sequence
  Description of Artificial Sequence: Synthetic coding sequence
atgagcctgaattctagtctctcgtgtcgaaaagaacttagcaatttaacagaggaagaaggaggggagggaggtgtgatcattacccaatttattgccattatagtgattacaatatttgtgtgcttgggaaatctagtcattgttgtgacactgtataagaaaagttacctgctgaccctttcgaataaattcgtgttttcactgactctctcaaactttctcttgagtgtgctcgtgctcccttttgttgtgacatcctctatcaggcgagaatggattttcggtgtcgtctggtgcaatttcagcgccctgctgtatctgctcatcagttcagcctcaatgcttaccttgggtgtgatcgcaattgataggtattacgccgtgttgtatccaatggtctaccctatgaaaataacaggcaaccgggctgtcatggcactcgtgtatatttggctgcattcactgattggctgtctgcccccactattcggctggtccagtgtagagttcgacgaatttaaatggatgtgtgtcgccgcgtggcatagggagccaggttacaccgccttctggcaaatttggtgcgcgctgtttccatttcttgtcatgctcgtctgctacggtttcattttccgagtcgcacgcgtgaaagctcgcaaagtgcactgtgggactgttgtcatcgtggaagaagacgcccagcgcaccggcagaaagaactcctccacctctacctcaagtagtggctctaggcgcaatgcttttcagggagtggtgtattctgcgaaccaatgcaaagcgctgattaccatcctggtagtccttggggcatttatggtaacctggggcccatacatggttgtgattgcctcggaggcactgtgggggaagtcatctgttagtccgagcctggagacctgggctacctggctctccttcgcttctgcagtctgtcatcctctcatatacggattatggaacaagacggtccggaaggaactgctcggaatgtgttttggagaccggtattatcgcgaaccgtttgtgcaacgccaacgaacttctcgtctgttctcaatcagtaaccggatcaccgatctgggactaagtccgcacctgacagccctgatggcgggcggccagcctctcgggcacagcagtagcacaggggataccggcttttcatgcagccaggacagtggaactgacatgatgctgttggaggattatacctccgatgataatccgccatctcattgtacctgccctcccaagcgtcgctccagtgtaacttttgaggacgaggtcgagcaaatcaaggaggctgccaagaactcgatactacacgttaaggctgaagtgcacaagtcgctggattcttacgccgcatctctggctaaagcgattgaggcggaagccaagatcaacctattcggtgaggaggctcttcctggagtgttagtcactgctcgcactgtccccgggggcggatttggcggacgccgggggtcccgaacactcgtctcccaaagacttcagctgcagagcatagaagagggcgatgtgctggctgcagaacagaggtag

SEQ ID NO: 117800 - DNA, 1590 bp, Artificial Sequence
  Description of Artificial Sequence: Synthetic coding sequence
atgagtctcaactcctccctgagctgcaggaaggagctatctaatttgactgaggaagagggcggcgaaggtggcgtgataatcacacaatttatcgccatcatcgtaatcaccatctttgtctgtcttggcaatcttgtgatcgtagtcacactttacaagaaatcctatctgcttactttgtctaacaagtttgtgttcagcctgacactcagcaacttcttgttaagtgtgctggtgcttccgtttgtcgtgacctcatcaattaggcgtgagtggatcttcggagttgtttggtgtaattttagcgccctgctttacctgttaatttcatctgcaagcatgctgactctgggtgtgattgccatcgatagatattacgcagtgctgtaccctatggtttatcccatgaaaattaccggaaacagggcggttatggccctggtttacatctggttgcacagtctcatcggctgcttgcctcctcttttcggatggagctcggtcgagtttgacgaattcaagtggatgtgtgttgctgcgtggcatagagaaccaggatacacagccttctggcagatctggtgcgccctcttccccttcctggtgatgctagtatgctatggctttatatttcgcgtggcacgggtcaaagccagaaaggtgcattgcggtactgtcgtgatcgttgaagaggatgctcaaaggaccgggcggaagaatagctcaaccagtacttcctctagtggatcccgcaggaatgccttccagggtgtggtgtactctgctaaccagtgtaaagcactgattaccattctggtggtcctcggcgccttcatggtgacttggggcccttatatggtcgttattgcgagtgaagcgctatggggcaaatcctccgtctctccatctctggagacttgggcaacatggcttagcttcgcgtcagcggtctgccatcccctcatctatgggctgtggaataagactgtgagaaaggaactattgggcatgtgtttcggggaccggtattatcgggagccgttcgttcagaggcagagaacttctagactgttcagcatcagtaacaggataaccgatcttggactctctccccatctgacagcactcatggctggtggccagccactggggcacagcagtagtactggagacacagggttctcttgctcccaggatagcgggactgatatgatgctgcttgaggactacacatccgacgataaccccccttcacattgcacctgcccaccaaagaggcgcagttctgtcaccttcgaagatgaagtcgaacagatcaaggaagccgcgaagaatagcatcctgcatgtgaaagcggaggttcataaaagcctcgactcttacgcagcttctctcgctaaagccatagaagctgaggcaaaaatcaatctgttcggtgaagaagcactgcctggcgtgctggtgacggctagaactgtgcctggagggggttttggcggccggaggggttctaggacattagtgtcacagcgtctgcagctgcagtctatcgaagaaggagacgtcctggcggctgagcagcggtag

SEQ ID NO: 117801 - DNA, 1590 bp, Artificial Sequence
  Description of Artificial Sequence: Synthetic coding sequence
atgtctctaaactcgtcattgagctgtaggaaggaactgagtaatctgactgaggaggagggcggtgaagggggggtcatcatcacacaattcatcgcaatcatagtcatcactatctttgtctgtctcggaaacttggtgatcgtggttaccctgtataagaagtcttatctactcaccttgagcaacaagtttgtgttctcgcttacactcagcaacttcttgttgtctgttctcgtcctgccgtttgtggtcacctcctccatccgtagagagtggatctttggtgttgtgtggtgtaacttttccgctctcctttacctgcttatctccagcgcttcaatgctgaccctgggcgtcatcgcaattgacaggtattatgccgtcctgtaccccatggtgtatcctatgaagattacaggaaacagggccgtgatggccctggtctatatttggctgcattctcttatcggctgtctaccacccctgttcggatggtcaagtgtagagttcgacgaatttaaatggatgtgcgttgcagcctggcacagggaaccaggttacaccgctttttggcagatctggtgtgctctgtttccatttctggtaatgctggtatgctacggatttattttccgggtcgcccgcgtaaaggccagaaaagtgcactgcgggacggtggttattgtggaggaagacgcccagcgtactgggcgaaagaatagttccaccagcacttcttcctctggcagtcgccgaaatgcgttccaaggagtcgtgtacagcgccaaccagtgcaaagcactgattacgatccttgtagtgctgggagcattcatggtcacttggggtccatacatggtggtcatcgcctccgaggctttgtgggggaagagttccgtgagcccctctttagaaacctgggccacctggttatccttcgccagtgcagtgtgccacccattgatatacgggttatggaacaagactgtcaggaaagagctgctcggcatgtgttttggcgacagatattatcgggagccgttcgtgcagcgacagaggacaagtcgccttttcagcatctctaacagaatcaccgacttgggtctgtcaccccatctcactgccctcatggctggcggacaaccactgggccactcctcgtctactggagatactgggttctcctgtagccaggattctggcaccgacatgatgttattggaggactacacatctgacgataatccgccttcgcattgtacatgcccccccaagcgaagaagctcagtaacatttgaagacgaagtggaacaaattaaagaggcagctaaaaacagcatcctgcacgtcaaggctgaagtgcacaagtcactggatagttacgctgcctctctggccaaagccatcgaggcggaggctaagattaacctgtttggagaggaggctctgccaggagtgctggtgactgccaggacagtacccggcggagggttcggaggcaggcgcgggtccaggacattagtgtcccagagactgcagctgcaatccatagaagagggagatgtgctggccgccgagcagagatag

SEQ ID NO: 117802 - DNA, 1590 bp, Artificial Sequence
  Description of Artificial Sequence: Synthetic coding sequence
atgtcactcaattcatccctgagctgcaggaaggaactttccaatttaaccgaagaggaggggggtgaaggaggcgttattattacacaattcatcgcaataattgtgattaccattttcgtctgtttaggaaatctagttatagtcgtgacgttatacaaaaaaagctacctccttactctgtcaaacaagttcgtttttagcctcactctgagtaattttctgttatctgttctcgtactcccctttgtggtcacaagcagcattaggagggaatggatctttggtgtggtgtggtgcaacttcagcgcactgctgtaccttttaatcagctcagcgtcaatgctgacactgggtgtgatcgctattgacagatattatgccgtcttatatcctatggtctatccgatgaagatcactggaaatcgggctgtcatggccctagtctatatatggctgcactcactgatcggatgtttacctccactgttcggctggtcatccgtcgaattcgatgagtttaaatggatgtgcgtcgctgcctggcacagggagcctggctacacagccttttggcaaatctggtgtgccctgtttcctttcctggtgatgctggtgtgctacggtttcatttttagagtcgccagggtgaaagcgcggaaagtccactgcggcaccgtggtgatcgttgaggaagatgcccaacgcaccggccgaaaaaattcctcaacaagtacaagttcaagcggctcccgtaggaacgcttttcagggggtggtctacagtgctaatcagtgtaaggcactcattaccatccttgtcgtgctgggagccttcatggttacttggggcccctacatggtcgtgatcgcgtccgaggctctctggggcaagtccagcgtatcaccttccctagagacatgggccacttggctcagcttcgcctccgctgtatgtcatcctcttatttatggcctctggaataaaactgtgaggaaagagctgctggggatgtgtttcggagatcgctactaccgggaaccatttgtccagcgccagagaactagccgtctgttttccatctccaaccggattactgacctgggtttatccccccatctgaccgcgctgatggctggggggcaaccactgggacactcaagcagtacaggggatactggcttctcatgttctcaagattccggtaccgacatgatgctgctggaggactacacctccgacgacaaccctccttcacactgtacatgcccacccaagaggaggtcctccgtgaccttcgaggacgaagttgaacagatcaaggaagccgctaaaaactccatccttcacgtgaaggccgaggtacacaaaagccttgactcgtacgcagctagcttggcgaaggccattgaggccgaggccaagattaatctctttggcgaagaagcgctgccgggtgtgcttgtgaccgcgcgaactgttcccggggggggcttcggaggcaggcgtggaagccgaaccttagtgtcacagcgcttacagctgcaatccatagaagagggcgatgttctggctgcagagcagcgctag

SEQ ID NO: 117803 - DNA, 1650 bp, Artificial Sequence
  Description of Artificial Sequence: Synthetic coding sequence
atgtctgccaggggggtggttcagcacgccttgcctactcccagaagaggtgccctgacaatgagcttaaatagttctctgagctgtcggaaggaattaagcaatttgaccgaagaggagggcggagaagggggtgtgatcataacccagtttatcgctatcatcgtaattacgatattcgtttgtctagggaacctcgtgatcgtggtaacactgtataaaaaaagctacttactaaccctctcgaacaagttcgtgttctccctaaccttgagcaatttccttctgtctgtcctggttctaccttttgtggtcacatcatctatacgacgggaatggatctttggtgtcgtttggtgtaatttctcggccctcctgtatctactgatctcctccgccagtatgctcacactgggcgtaattgccatcgaccggtactatgccgtgctgtacccgatggtttatcctatgaaaattaccggcaatcgcgcagttatggccctcgtgtacatttggttgcattccctcatcggttgtctgcctccgctcttcggttggtctagcgtggaattcgatgaatttaagtggatgtgtgtggccgcatggcatcgggagccaggatatactgcattctggcagatttggtgtgcgttatttccttttctggtaatgttagtatgttacgggttcattttccgtgttgctagagtgaaggctcgtaaagtacactgtggtaccgtggtgatcgtcgaggaagacgcccagcgaactgggcggaagaattcttctactagtacctccagctccggtagccgccggaatgcattccaaggtgtggtgtacagcgctaaccaatgtaaagctctgatcacaatattggtagttttgggggcattcatggtgacctggggtccatatatggtcgttattgcatcggaggctctttggggtaaaagctcagtgtccccctctttagaaacatgggccacttggctgtcttttgcatctgctgtgtgtcaccctttgatttacggcttgtggaataagaccgttcggaaggagctcctcgggatgtgcttcggtgaccgctattatagggagccctttgttcaacgccagcgcacatcacggcttttctctatctcaaacaggattaccgatctgggcctgtccccacacttaaccgctcttatggccggagggcagcctctgggccactccagtagcacaggagatactggatttagctgttctcaagatagcggcactgatatgatgttactagaggactataccagcgacgacaaccctcccagtcattgtacatgtcctcctaagaggcggtcaagtgttactttcgaagatgaagtagagcaaattaaagaggctgcaaagaatagcatcctgcatgtgaaggccgaggtgcacaagtccctggattcttacgctgccagcctagcaaaagctatcgaggctgaggccaagatcaatctattcggtgaggaggcccttcccggagtgctcgtgactgcccgcaccgtcccgggggggggctttgggggcagaagaggctctagaaccttagtgtctcagaggcttcagctacagtccattgaagagggagacgtacttgccgctgagcagcgatag

SEQ ID NO: 117804 - DNA, 1356 bp, Artificial Sequence
  Description of Artificial Sequence: Synthetic coding sequence
atgggtgggcgacggtgcgtgcccggcactctgccaatgcgtgcagcacctcccggggcaaagaggctgcacgtccctttaagagctaaaggcgtgggaaggtcaggtcatgccccacggctggagagcgtccgaacatcatactacgccgtgctttatccaatggtttaccccatgaagatcacagggaacagggccgtgatggccctggtgtatatctggctgcatagccttatagggtgtctgcctcccctgtttggctggagtagcgtcgagttcgatgagttcaagtggatgtgcgtcgccgcttggcacagggagcctggttacacagccttctggcagatttggtgtgcactgttcccatttctcgtcatgcttgtttgctatggctttatctttcgagtggcgcgcgtgaaggctcgcaaagtacactgcggaactgtggtgattgtggaggaggatgcgcagaggacaggtcggaagaattcttcaacttctacttccagttcagggagtcggcgcaacgccttccagggggttgtgtactccgccaatcagtgcaaagccttaatcactatcctggttgttctcggtgcatttatggtgacctggggcccttacatggtagtgatagcgagtgaggccttatgggggaaatctagtgtatccccatcccttgaaacatgggcgacgtggctgagcttcgcctcggcagtgtgtcatcctcttatatatggcttgtggaataagacggttcgcaaggagctgcttgggatgtgcttcggcgatagatactatcgggagccctttgtgcagaggcagcgcacaagccgtctattttctatctcaaatagaattaccgatttaggcttatctccccacctgaccgccctaatggcaggaggacaacctctggggcactcctcaagcaccggagatacaggattctcttgtagtcaagactctggcacagacatgatgctcctggaagactatacctctgacgacaaccccccttctcactgtacttgccctcccaagcgccggtcaagcgtaacatttgaagacgaggttgagcaaatcaaggaggccgctaaaaacagcattctgcatgtgaaggccgaggttcacaagagtctggatagctacgctgcctctcttgctaaggccatagaggctgaggcgaagattaatcttttcggtgaggaggccctgcccggagtgcttgtgactgctcgcactgtccctggtgggggtttcggtgggagacgaggatcacggacattagtatctcagcggcttcagctgcagtcaatcgaggaaggagacgtcctggccgccgaacagcgatag

SEQ ID NO: 117805 - DNA, 1248 bp, Artificial Sequence
  Description of Artificial Sequence: Synthetic coding sequence
atgctggtgcctgttggttggatgaatgaatcttactatgccgtgttgtatcctatggtgtaccctatgaagattactggaaatcgcgccgtgatggcccttgtctacatctggctgcactcgctcattggctgcctgcctccactctttggctggtcttcagtcgagtttgatgaatttaagtggatgtgcgtggccgcttggcaccgagagccagggtacacagccttttggcaaatttggtgcgccttgttcccctttttggttatgctggtttgctacggtttcatcttcagggttgcaagggtaaaggctcggaaagtgcactgtggaactgtggtgatagtcgaggaggatgctcagaggaccggcaggaagaacagtagcaccagcacttcatcctccgggagtcggaggaatgccttccagggagtggtgtattcggccaatcaatgtaaggctctgatcaccatcctggtcgtacttggagctttcatggtcacatgggggccatatatggtggtcatcgcttcggaagcactgtggggcaagtcttccgtgtccccgtctctcgaaacctgggccacatggctctctttcgcatctgccgtgtgccatccccttatctacggcctttggaacaaaacagtaagaaaggaactgctgggaatgtgttttggggatcggtattacagggagccattcgtgcagaggcagcgaaccagtaggttatttagcattagcaatcgtattactgatttgggcctttcaccccacctcacagccttgatggcaggcgggcagcccctgggacactcgagttctaccggcgatacaggtttcagttgcagccaggattccggtaccgacatgatgcttttagaagattatacaagtgatgataaccctccatcccactgtacttgtccacccaagagaagatcttccgtgacctttgaggatgaggtcgaacaaattaaagaggcagctaagaacagcattctgcacgtgaaggccgaagtccataagagtctcgactcttacgcagctagcctcgctaaagccatcgaggcagaagccaagattaaccttttcggcgaagaagcgctgcccggcgtgttggtgaccgcacgcactgtgccaggcggaggtttcggtggaagacgcgggagccgaaccctagtgtctcagagactccaactacaaagtattgaggagggcgacgtgctcgctgctgaacagcggtag

SEQ ID NO: 117806 - DNA, 1104 bp, Artificial Sequence
  Description of Artificial Sequence: Synthetic coding sequence
atgtctaaacgctcttggtgggcagggagccggaaacctcctcgcgagatgctgaagctgagtgggagcgacagctctcagagtatgaatggactcgaagttgctcccccaggtcttatcacaaacttctctctggcgaccgccgaacaatgtggacaggagacccccctcgaaaacatgttattcgcaagcttttatctgcttgatttcatcctggctctggtcgggaatacactggccttatggctgtttatccgggaccacaaaagcgggacacccgcaaacgtatttctaatgcatctagctgttgctgatctctcttgtgtactagtgcttcccacacgtctagtctatcactttagcgggaaccactggccctttggagagatcgcttgtcggctgacaggcttcctgttctacctcaacatgtacgcaagtatctacttcctgacgtgcattagcgctgatagattcttagcgatagtccatccagtgaagtctttaaaactgcggagacctttatatgcccatctggcatgtgcgtttctgtgggtggtggtggcagtcgccatggcacccctcttagtaagtcctcaaaccgtccagaccaaccacactgtggtatgtcttcaactgtatcgggagaaggcctcccaccacgccctggtgagcctggccgtagcatttactttcccatttatcaccactgtcacctgctatctgcttataatccgtagcttgagacagggactcagggtggagaaacgattaaaaaccaaagccgtcagaatgatcgctattgttcttgctatatttctggtgtgtttcgtgccctaccacgtcaataggtccgtgtatgtactgcactatagaagccatggcgcctcatgtgccacacagcgcatcttggccttggccaacagaattacttcctgcttgacatccctcaatggcgccttggatccaatcatgtacttttttgttgccgagaagtttcgtcacgctctctgtaacttgctatgcggcaagaggcttaaaggccctccaccgtctttcgagggaaagactaatgaatcgtccctctcagccaagtctgaactgtag

SEQ ID NO: 117807 - DNA, 312 bp, Artificial Sequence
  Description of Artificial Sequence: Synthetic coding sequence
atgaatgggctggaggtagccccccccggtcttattaccaacttctccctcgccacagcagaacagtgtggacaggaaacccctctggagaatatgctctttgcctctttttacctgcccctgccacgacagccaaggatgtgcaccgtgacaggtctgacggccggctctaccgctcggtccaaacaacacctggaggtggtgtttgccgtgttacctgcgtttaagctccagaggggtagacgggaacgaacgagcaagccgcctatcattcctatgagctcgcccgggccatgttgggtaaggacatag

SEQ ID NO: 117808 - DNA, 1104 bp, Artificial Sequence
  Description of Artificial Sequence: Synthetic coding sequence
atgagtaagcggtcctggtgggcggggtcaagaaagccccccagagaaatgctgaagctcagcggttcggactcttcccagagcatgaacggtctggaggtagccccaccaggcctgatcacaaatttctccttggccaccgccgagcaatgcggacaggaaacccccctcgagaatatgcttttcgcaagcttctatctgctggacttcattctggccttagttggcaacaccctagcactatggctctttatcagggaccacaaatccgggactcccgccaatgtctttttaatgcatctggccgtggctgacctgtcctgtgtgctcgttctgcctacccgcctcgtgtaccacttttctgggaaccattggccgttcggagagatagcctgtcgcctcactggctttctcttttacctcaacatgtacgcttccatctacttcttaacctgtataagcgccgacagattccttgccatcgtccatcctgtgaagagcttaaaattacgaaggcccttgtacgcgcatttggcttgcgccttcttgtgggtcgtagttgccgtcgcgatggctcccttgctggtttccccgcagactgtgcagactaaccatacagtggtctgtcttcaactgtatagagaaaaagcctcccaccatgccctcgtatccctggctgtggcctttacattcccgtttatcaccacagtgacctgctacctcctgattatccgtagtctcaggcagggacttcgggtcgaaaagcgtctcaaaactaaggcggtcagaatgatcgcaatcgtgctggcaattttcttggtgtgcttcgtcccctaccatgtgaaccggtccgtttacgttcttcactacagatcacacggggcctcctgcgcaacgcagagaatactcgccttggctaaccgtatcacctcttgtcttactagtctgaatggagcactcgatcccataatgtattttttcgtggcggaaaaatttaggcacgccctctgtaatctgctttgcggtaagagattaaaaggcccacctccatcatttgaaggcaaaaccaatgagtccagcctgagcgctaaaagtgaactttag

SEQ ID NO: 117809 - DNA, 411 bp, Artificial Sequence
  Description of Artificial Sequence: Synthetic coding sequence
atgtcaaaacggagctggtgggctggctccagaaagccaccccgagaaatgttgaaactttccggatcagacagttcgcagtcaatgaatggcctggaggtggccccgcctggtctgatcacaaacttctcattggccactgccgagcagtgtgggcaagagacccctctggaaaacatgctgtttgcgtctttctacttactggattttatcctggcactcgtgggcaacacgctggcactgtggctgtttattcgggaccacaaatctgggaccccagcaaacgtgttcctgatgcacctggcagtggccgaccttagctgtgtcctggtcctcccaacccgtcttgtgtatcatttctcagggaatcattggcccttcggcgagatcgcttgtaggttgaccgggtag

SEQ ID NO: 117810 - DNA, 1104 bp, Artificial Sequence
  Description of Artificial Sequence: Synthetic coding sequence
atgagtaaaaggtcatggtgggccggctcacggaaaccgccccgggagatgctgaagttatcggggtctgactcttcccagagtatgaacggactggaggttgctccaccagggcttatcactaacttctctttggccacagccgagcaatgtgggcaggaaacccctctcgaaaacatgttatttgctagcttttacctcctcgatttcatcctggccctggtcgggaacactcttgcgctctggttgtttatcagagatcacaagagcgggactcccgcaaacgtgtttctgatgcacctggcagtcgccgacttgagttgtgtcctggtccttcctacacggctggtctatcatttcagtgggaatcactggccattcggcgaaatcgcatgtagacttacaggtttcctgttttaccttaatatgtatgctagtatttattttctgacctgcatttcagccgaccggttccttgcgatcgtgcatcctgtgaagtccttaaaactccgtagacctctgtacgctcacttagcttgtgcttttctgtgggttgtggttgcggtggccatggcccctctcttggtgtctcctcagacagtacagaccaatcatacagtcgtttgcctccagctctacagggagaaggctagccatcatgcactggtgtctctcgctgtggcgtttacctttccttttataactactgtgacatgctaccttcttattatcaggtcattgaggcagggactcagggtagagaagaggctgaaaacaaaggccgttaggatgattgccattgttctcgccatttttctggtctgctttgttccttatcatgtaaacaggagcgtgtatgtactgcactatcgctcccacggggcatcctgcgctacacaaaggatcctggcattagccaatcgaattacctcttgcctgaccagtctgaacggagcactcgatccaatcatgtactttttcgtcgcagaaaaatttaggcacgcactgtgcaatcttctgtgtgggaagcgcctgaagggaccccctccctcgttcgaggggaagacaaacgaaagcagcctttctgccaaatcagagctgtag

SEQ ID NO: 117811 - DNA, 1338 bp, Artificial Sequence
  Description of Artificial Sequence: Synthetic coding sequence
atggcggcccctaccccagcacgacctgtgctgacacacttattggtggcgctgttcggaatgggtagctgggccgcagtcaacgggatctgggtggagttgcccgtggtcgttaaagaactgcctgaaggatggtcactgccatcttacgtaagcgtcttagtggctctgggcaatttagggttacttgtggtgacactttggcggagactggcgccgggcaaagatgaacaggtccctataagggtggtgcaggttctgggcatggtggggacggctttactggctagcctctggcaccatgtggcccctgttgctggacagctgcattccgttgcctttctggctcttgccttcgttctcgctcttgcatgctgcgccagcaacgtgactttcttgccattcctgtcacacctgcctcctcgctttcttcgtagtttctttttgggccagggcctgagtgcactgctcccatgcgtgctggcactggtgcagggcgtgggacggctggaatgcccacctgcccctatcaacggcactcctggtcctccactggattttctggaacggtttccagcaagcacttttttttgggctcttactgccctccttgtggcaagcgctgcggccttccaaggactgcttcttctgctgccccctccaccaagcgtgccgacaggagagctgggctccggcctgcaggtcggggcccccggtgccgaagaggaggtggaggagtcctcaccccttcaggagccaccgtctcaagccgccggcacaacgcccggcccggatccaaaggcttatcagctgttgtcagcccgttcggcctgcttgttgggactgctcgcagccacaaacgctctcacaaacggcgttctgccagcagtccagtctttctcctgtctaccttatggaaggttggcctaccacctggcagtggtcctgggctccgcagccaatccgctggcatgctttctggccatgggagttttgtgccgctccctggctggactcggagggctctcgctcttgggggtgttctgtggcggctacctgatggctctagcagtgctgagtccgtgcccacctttggtcggtacgtctgcaggcgtggtgctggtcgtactgtcctgggtgctctgcctgggagtattctcatatgttaaggtggctgcctcatctctgctgcatggcggaggcagacctgccctcctggctgcaggtgtcgcaatccaagttggatccctccttggggctgtggctatgtttccgcctacctctatctaccatgtgtttcactcacgcaaggattgcgcagacccatgcgactcctag

SEQ ID NO: 117812 - DNA, 1338 bp, Artificial Sequence
  Description of Artificial Sequence: Synthetic coding sequence
atggcggcccccactccggcccggccagtcttaacacatctgctggttgcactctttggaatgggctcatgggcagccgtgaatgggatttgggtcgaactgcctgtcgtcgttaaagaactaccagaaggttggtctctgccttcttacgtctctgttctggtagcgttgggaaatctggggttgctggtcgtgactttatggcgacggctggcaccaggcaaggatgagcaagttcctattcgtgtcgtgcaggtgttagggatggtgggcacagctctgctggccagtctgtggcatcatgtcgcacctgtcgctgggcagctgcacagtgtagcctttttggctctcgcctttgttctggcccttgcatgttgcgcctccaatgttacctttttgcctttcctatcacaccttccccccaggtttcttcggtctttcttccttggacaggggttgtctgcactgctcccctgcgtgctggccctagtccaaggcgtgggccgcctcgagtgtcccccagctcctatcaatggtaccccaggcccacccttagattttctcgagagatttcccgctagtacgtttttctgggcactgacagccctgcttgtggcttcagctgctgctttccaggggctcctgctcttattgcctcccccaccgagtgtgccgacaggtgaacttggatccgggttgcaggttggagccccaggggcagaagaggaagttgaggagtcatcaccactacaagagccgccaagtcaggcagcagggaccactccaggccccgatccaaaggcctaccagctgctaagtgcgagatctgcgtgtcttcttgggctcttagccgctacgaacgctctgacgaacggggtactgcccgcagtgcagtccttctcatgcttgccatatggacgtctagcataccatctcgccgtggtgttaggcagcgccgctaatcctcttgcgtgtttcctggcaatgggagtgctctgccgaagccttgccgggctaggcggtctgtcccttctaggagtcttctgtggcgggtacttgatggcactcgccgttcttagtccttgcccccccctggtcggtacaagtgctggcgttgtcttagtcgtgctctcatgggtcctttgccttggtgtcttctcttatgtcaaagtggctgcctcgtctctgctgcatggtggaggacggcccgccctgttggccgctggcgtcgccattcaagtcggcagtctcctgggcgcagttgccatgtttccgccaacgtcaatttaccacgtattccattctaggaaggactgcgccgacccctgcgactcatag

SEQ ID NO: 117813 - DNA, 1338 bp, Artificial Sequence
  Description of Artificial Sequence: Synthetic coding sequence
atggcagcccctacacctgcaagaccagtacttacacacctgctcgtggctctgtttggtatgggctcctgggccgctgtaaatggtatttgggttgaactgccagtggtggtgaaggagttacccgaaggttggtccctcccatcatatgtcagcgtcctggttgcactgggcaacctcggtctcctcgtcgtcactctctggcgccgcctagcacctggaaaagacgaacaggtgcccatcagggtagtacaggtgctgggtatggtgggaacggctctcctggccagcctgtggcatcacgtggcacctgtagccggccagttgcattcggttgcttttctagccctagcatttgtcttggcactggcgtgctgcgccagtaacgtcacgtttctacccttcctctctcacctgccaccccgatttctgcggtcattttttctcggacagggtctatccgctcttctgccctgtgtgctcgcccttgtgcagggagttggccggcttgaatgccctccggcaccgataaacggtactccgggcccaccactggattttcttgaacgtttccccgcttctactttcttttgggcattaaccgccctgttggtcgcgagcgcagcggcctttcagggactattgctgctgctgcctcctccgccttcagttcccacaggcgagttagggagcggactccaggtgggggcccctggagcagaggaggaagtggaggaaagctccccccttcaggagccaccctcccaggcagctggaaccacccctggccctgatcctaaggcataccagttgctaagtgccaggtcagcctgcctgctgggcctcttagccgcgacgaacgctttgacaaatggggttctgcctgccgtacagtctttcagctgcttaccttatggcaggctggcctaccacttagctgtagtgttgggcagcgccgccaatcctctggcatgcttcctggccatgggggtgctatgtcgcagcctggcgggcctcggcgggcttagtttgttaggcgttttctgtggcggttacctgatggccttagccgtcctgtccccttgtccccctctggtcggaacgtctgctggcgttgtgctggttgtcctgtcctgggtgctctgcctgggtgtgttcagctatgtaaaagtagctgccagctccctgctccacggcggaggcagacctgcactgctggctgctggcgttgctatccaggtgggttcactgctaggagctgtggcaatgttcccccccacttccatctatcatgtgttccacagccgcaaggattgtgcagatccttgcgacagttag

SEQ ID NO: 117814 - DNA, 1338 bp, Artificial Sequence
  Description of Artificial Sequence: Synthetic coding sequence
atggccgctcctactccagctcggccagtgctcacccatttgttagtggccctgtttggaatggggagctgggctgcagtgaacggtatttgggtcgagctccccgttgtcgttaaggagcttcctgaggggtggtccctcccttcttacgtgagtgtgctggtcgccctaggcaacttgggccttctcgtggtcacactctggagaaggctcgcccctgggaaggacgagcaggtgcctatccgcgtggtgcaagttttgggcatggtggggacagctctgctggcttctttgtggcaccacgtggcccctgtagctggccagctgcactctgtggccttcctagcgctcgcttttgtgctggctttagcctgctgcgcttcaaatgtaacatttctgcctttcctctcccatctgccgcctaggttcctgcgctctttttttctgggccagggactgtccgccctgttaccctgtgttttggcactggtgcagggtgtggggcggctggaatgtccccccgctccgatcaacggtaccccaggcccacctttggactttttggagagattcccggctagcactttcttttgggcactgactgccctcttggttgccagtgcagccgcattccagggtctactgctgttactccctccacctccaagcgttcccacaggggagttagggagtggattacaagttggagcgcccggggctgaggaagaagttgaggaatcaagccccctgcaagagcctccatctcaagcagctggtacaacgccaggccccgaccctaaagcataccagctcctgagcgccagatctgcttgtctcttgggcctcctcgctgccacaaacgcactgacaaatggagtcctgccagccgtacagtccttctcctgtctcccatacggaagattggcctaccacctggcagtagttctggggtctgccgctaatcctttagcctgcttccttgctatgggggtgctatgcaggtcactggcaggcctgggtggcctgtccctgctaggagtattctgtggcggatatttaatggccctggccgtgctcagtccatgcccccctctggtcggcacatctgctggagtagtgctcgtcgtcttgtcttgggtcctctgcctgggggtcttttcctatgttaaagttgccgcctcctccctattacacggaggtggacgccccgcccttttggccgccggcgttgctatacaggtagggagcctcctcggggccgtcgccatgttccctcccacttccatctatcacgtgttccactcccggaaagactgtgccgacccctgcgatagctag

SEQ ID NO: 117815 - DNA, 1338 bp, Artificial Sequence
  Description of Artificial Sequence: Synthetic coding sequence
atggccgcccccaccccggcacgaccagtgctgacacatttactcgtcgcattattcggcatgggcagctgggcagccgtgaacgggatatgggttgaactacctgtagttgtaaaggagctgcccgagggctggtcacttccttcctatgtgtctgtcttggtggctctaggaaatctagggctgctggtagtaacactgtggagaaggctggctccaggcaaggatgagcaagttcccatcagagttgttcaggttctggggatggtgggcaccgcgctcctcgcctccctgtggcaccatgtggcgcctgtggctgggcagcttcacagcgttgcgtttctcgcactggccttcgttttggccctcgcatgctgcgcatccaacgtgacattcttaccttttcttagtcatctcccaccacgctttctgcgcagcttctttctaggccagggtctgagtgcgttgctgccctgtgttctggccctagtacagggcgtcggccggctggagtgtcctcctgctcccataaatggcacacccggcccgccattggactttctcgaacgatttcccgctagtacctttttctgggcactgacggccctgttggttgctagtgccgctgccttccaaggcctgctgctgctactgccccctccaccaagcgtaccgaccggcgaactaggcagtggactgcaagtcggggcacctggagccgaagaagaggttgaagagtccagcccactgcaggaaccgccaagccaagcagctggcacaacacccggtcctgaccccaaggcctaccagctcctatcagctcgctccgcttgcttgctcggtctgttggcggcgactaatgccctgacaaacggggtgttgcctgccgttcaatcattcagctgtttaccatatggacggcttgcctaccacctggcggttgtgctgggtagcgcagcgaaccctctcgcctgttttctggctatgggcgtcttgtgtagatcactggcaggattgggagggctctccctgctgggcgtgttttgtgggggctatttgatggccctggccgttctcagtccctgtcctccactcgtgggaacatctgcaggagtggtgctggttgttttgtcttgggtgttgtgccttggcgtattctcatacgtgaaggtcgctgcatcttctctgttacacggaggcggccgccccgccctgctcgcagctggagtcgctatccaagtgggctccctactcggcgccgtggctatgttccccccaacatctatttaccatgtctttcacagcaggaaagactgcgccgatccgtgtgatagctag

SEQ ID NO: 117816 - DNA, 1074 bp, Artificial Sequence
  Description of Artificial Sequence: Synthetic coding sequence
atggtgggcaccgccctgcttgcatcgctgtggcaccatgtggcacccgttgccgggcaactacattcggtcgcatttcttgctctggcttttgttcttgccctcgcgtgctgtgccagtaatgtgaccttcttaccatttctgtcgcatctacccccacgttttcttcggagcttttttctgggccagggcctgtcagccttacttccatgcgtgcttgctcttgttcagggcgtgggccggctggaatgcccgcccgcgcctattaatggaacacccggacccccgctagattttttagagcgctttcctgctagcaccttcttctgggctctgacagccctgctggtcgcatcggccgccgcctttcaggggctgctgctgctgcttcctccgccaccttcagttccaaccggggaactggggtcaggactgcaggtaggggcccccggagccgaagaagaggtcgaggagtctagccccctccaagagcccccgagtcaggccgcaggcacgactccaggccctgatcctaaagcataccagctcctgagcgctcggtccgcctgcttactggggctcctcgccgcgacaaacgccctgaccaatggggtactccctgctgttcagtcgttcagttgtctcccctatgggcggcttgcttaccatctagccgtggtgctgggaagtgcagcgaatcctctggcctgttttctggcaatgggagtgctctgccggtcattggccgggctgggtggcctgtctctcttaggggttttctgcggcgggtatctaatggcccttgccgtgttaagtccatgtcctccactggtgggaacttccgctggggtcgttctcgtggtcctgagctgggttttgtgcctcggagtgttctcatacgtaaaggttgccgctagcagcctgctccacgggggaggccggccggccctgctggctgccggagtcgcaatccaggtcggctctttactgggagcggtggccatgtttccaccaacgtcaatctatcatgtgttccattcaagaaaagattgtgccgatccatgtgattcctag

SEQ ID NO: 117817 - DNA, 1347 bp, Artificial Sequence
  Description of Artificial Sequence: Synthetic coding sequence
atggctgcacccaccctaggccggctagtactgacccatctgctcgttgcgttgttcgggatgggcagctgggccgctgttaacggcatatgggtagagctgcctgtagttgttaaggatctgcctgaaggctggagccttccttcctacctaagtgtagtggtggcactgggcaacttgggactgctagtagtgacgctgtggcgacagcttgccccaggaaaaggcgaacaggttcccattcaggtcgtgcaagttctgtctgttgttggaaccgctttattggctcccctgtggcaccacgtcgcacccgttgcaggccaactgcattcggtcgcttttctaaccctggctctggtgttagctatggcctgctgcaccagcaacgtcaccttcctgcccttcctatctcacctccctcccccttttctgagaagcttcttcctggggcaaggcctcagtgcactcctaccctgcgtcctcgccttggtacagggtgttggccgactggaatgcccaccggcccccaccaacggtacctcaggaccgccactggattttcccgagagatttcccgcttctacatttttttgggccctcaccgctctgttggtgacttcagccgcagccttccggggattgctgctcctcctgcccagtcttccgtcagtcacaactggcggttctgggcctgagttacagctcgggagtccaggtgcggaagaggaagaaaaagaagaagaagaagcactcccactacaggagcccccttcacaagccgccgggacaattccaggacccgacccagaggcccaccaattatttagcgctcatggggcattcctgcttgggctgatggctttcaccagcgccgtgaccaacggggtgttgccttccgtgcaaagcttctcctgcttgccctatggaaggctcgcttaccacctcgctgtggtattaggtagtgcagcaaaccccctggcatgcttccttgctatgggagtcctgtgcagatctttagccgggctcgtggggctaagcctcctgggaatgctcttcggggcatatctaatggccctggcgatcttgagcccctgcccccccctagtcggcacgacagctggcgtggtactggttgtcctgagctgggtgctgtgcctttgtgtcttctcttacgtcaaagtggccgctagttcccttttgcatggaggaggaaggccggccctgctggcagctggagttgccattcaggtgggatcccttcttggtgctggagccatgtttcccccaactagcatataccatgtgtttcagtctcggaaagactgtgtagacccatgtggaccctag

SEQ ID NO: 117818 - DNA, 1347 bp, Artificial Sequence
  Description of Artificial Sequence: Synthetic coding sequence
atggccgcaccaacactcggtcgcctggtgctgactcacctgctggtggccctctttggcatgggatcatgggcagccgtgaacggaatttgggtcgagttgccggtggtggtcaaagatcttcctgagggttggtcactgccttcttatctctctgttgttgttgctctcggaaacctaggattgcttgtggtgacattgtggcgtcaactggctcccggaaagggggaacaggtgcccattcaggttgtgcaagttctcagcgtcgtgggtaccgctctgctggctcctctctggcaccacgtagcccctgtggcaggccagttgcacagtgtggcttttctgaccctcgccttagtgctggccatggcttgctgcacttcaaacgtgaccttccttccgtttctctcccacctgcccccaccctttcttaggtccttctttctaggtcagggtttgtcagcgctcttgccatgcgtgttagccctagtccagggtgtcggccgcctggaatgcccacctgcccctacgaatggcacctctggcccaccactcgatttcccagagcgcttcccagcatctacatttttttgggctcttactgcactactcgtcacttcggctgcggctttccgcggtttgctgctgctgctgccctccctgccgagcgtgacaacaggtgggtccgggcccgagctccagctcgggtcacctggcgccgaagaggaggagaaagaagaagaagaggcactgccactgcaggaacccccaagccaggctgcagggacaattccaggtccagacccagaggcacatcagttgttttccgcccatggcgcatttctccttggactcatggcctttacatctgctgtgaccaatggagtgcttcctagtgtccagtcttttagctgtctgccttatgggcggctggcctatcatttggcagtcgtgctcggttcagcagccaaccccctggcttgtttcttggcaatgggcgttctgtgccgttctttggcgggcttggtagggctgtcacttctgggtatgttattcggcgcatatctcatggcactggctatcctgtctccctgtccacctctggtaggcactaccgccggagttgtgctagttgtactttcatgggttttgtgcttatgcgtattcagctacgtcaaggtagccgcatcaagtctcttgcacgggggaggcagacctgcactcctggcagcgggcgtagccattcaggtggggagcctgcttggagccggagcgatgtttccgcctacgtccatttatcacgtgtttcagagtcgtaaagattgtgtggacccctgcggcccgtag

SEQ ID NO: 117819 - DNA, 1053 bp, Artificial Sequence
  Description of Artificial Sequence: Synthetic coding sequence
atggccgcgcccacgttggggcggctagtgctgacccatcttctggtggcactgtttggcatgggatcttgggccgcagtgaacggaatttgggtggagttaccggtcgttgtaaaggacctacccgaaggctggtctctgccgtcctacctgagcgtggtcgtggccttagggaatctcggacttctggtcgtgaccctttggagacaactggcaccaggcaagggcgagcaagtgccgatccaagtggttcaggtattaagcgtcgtgggtacggctctactggccccactgtggcaccatgttgcaccggtggctggccaactgcactccgtcgcattcctcacccttgccctggtactggccatggcctgctgcactagtaatgtcacattcctaccctttcttagtcacttgccaccgccattcctaagatccttttttctcggacagggactctccgccctgttaccttgcgtgctagctttagtgcagggcgtgggccgccttgaatgtccacctgcccctaccaatggtactagtggcccgccactcgacttcccagaacggttccctgcaagcacgtttttctgggccctcacagccctgttggtgacctcagcggctgccttcagaggcttgttgctcctcctgccatctttgccgtcagtcacaacgggaggatccggcccagaactgcagctcggtagtcccggtgcggaagaggaggaaaaggaggaggaggaggccctgcccctgcaggaacctccttcgcaggctgcaggaaccattccaggtcctgaccctgaggcccaccagctctttagcgctcatggagcattcttgcttggcctcatggccttcacgtcagcagtgactaatggagttcttccctctgtgcagtccttctcgtgtttaccatacggtcggttggcataccatctggcggtggtccttggatccgcagccaaccccttggcttgcttcctggcgatgggggttctgtgccgctgctgtcggggctgctgtgtgtgtgtttgttcccatatgtag

SEQ ID NO: 117820 - DNA, 1413 bp, Artificial Sequence
  Description of Artificial Sequence: Synthetic coding sequence
atgcctgctccactgctgttgatcagcaggactctgggaaacttcatggtcctctggagtacatgcagaaccacggtttttaaaagtgtgacaaatcggtttattaagaatcttgcctgttctgggatttgcgcctctcttgtgtgtgtgccgtttgacatcattctgtccacatctccccattgctgctggtggatctacacaatgcttttctgtaaagtggttaagtttctgcataaggttttttgcagtgtaaccattttgagcttcccggctattgcccttgaccgatattattctgttctgtaccccttggaacgcaaaataagtgatgcaaaatccagggagctggtcatgtacatctgggctcacgccgtggtggcttccgtccctgtattcgccgttactaatgttgctgacatctacgccacatcaacttgtactgaagtctggtcgaatagtctgggacatctggtgtatgttttggtttacaacattacgacagttatcgtgcccgtagtcgtggttttcctgtttctgattctcattcgaagggcgctcagcgcctcgcagaagaagaaagtaatcatagccgcactgagaaccccacagaacactatcagcatcccctatgcctcccaacgcgaagctgaactgcatgccacactgctgagcatggtgatggtcttcatcctctgttccgtcccttacgctacactggtggtttaccagacggtgctgaacgtccccgatacaagtgtcttccttctgctcactgctgtgtggctgcccaaagtctctctactcgcaaacccggtactgttcttaacagtaaacaaatccgtccgcaaatgcctgatcgggactctcgtgcagctccaccacagatatagcagaaggaacgtagtgagtacggggagtggcatggccgaagcgagtctagagcctagcattcgctctggatcccagctcctggaaatgtttcatatcggtcagcagcagatcttcaagcctaccgaggatgaagaggagtctgaggctaaatacatcgggtcagccgactttcaggccaaggagattttctccacttgcctagaaggcgagcaaggtcctcaattcgccccctcggcacctccactgtctactgtggatagtgtgagtcaagtggcaccagccgcccccgtggaacccgagacattcccggacaagtattcactgcagttcggatttggaccatttgagctgccaccgcagtggcttagcgaaactaggaacagtaagaagagactcctcccaccacttggcaatacaccggaggaactgatacagaccaaggtgcccaaggtgggaagagtggagcgtaaaatgtcacggaataataaagtgtctatctttcctaaggtggactcttag

SEQ ID NO: 117821 - DNA, 1548 bp, Artificial Sequence
  Description of Artificial Sequence: Synthetic coding sequence
atgggccacaacggttcttggatcagccctaatgcatctgaaccccataatgccagcggtgccgaggccgcaggcgtaaaccgtagcgccctgggtgaatttggagaggcacagttatatcgccagttcacaaccaccgtacaggttgtgatctttatcggatcccttctgggcaactttatggtgctctggtcaacctgtaggaccactgtattcaagagcgtgactaatagattcataaaaaatctggcctgtagcggcatttgtgcatctctggtgtgtgttcccttcgatattattctcagcacctctccacactgctgttggtggatttataccatgttattttgtaaagtagtcaagttcctccacaaggtgttttgtagcgtgaccatcctgagctttcccgcgatcgccctggaccgatattatagtgtgctgtatccacttgagaggaagatctcagatgccaagtcccgcgaattagtgatgtacatatgggctcacgccgttgtggccagtgttcccgtgttcgccgttacaaacgtggccgacatttatgctactagcacatgcactgaagtctggtctaactctctggggcatcttgtgtacgtgctggtgtacaacataacaactgtaatcgtaccagtcgttgtggtcttcctgttcctcatactaatcaggcgggccctttccgcttcccaaaagaaaaaggtgattatcgccgccctacgcacaccacagaacacaataagtatcccttacgcctcacagcgtgaggctgaactccacgccacactgcttagcatggttatggtcttcatcctctgcagcgtgccatacgccaccctggtcgtatatcagacagtccttaatgttccggatacatctgtttttctgctactgaccgctgtgtggctgcctaaggtgtctctgcttgcaaacccagtactctttctcactgtcaacaagagcgtccgcaaatgcctgattgggactctcgtacaacttcaccataggtactcacggcgcaatgtcgtgagtaccggcagtggcatggccgaggctagcctggaaccttctataaggtccggcagtcaactgctggagatgttccacataggccagcagcagattttcaagccgacagaagacgaggaagaatccgaagccaagtacattgggtcggccgatttccaagctaaagagatattttcaacatgcttggagggcgaacaggggccccagtttgccccctctgcccctccgttgtcaaccgtggactccgtctcacaagtggctccagcggcgccagtcgaacccgagacctttcctgacaagtattcactgcaatttggattcggccccttcgagctccccccgcagtggttgtccgagacccgtaactccaagaagaggttactacctcccttaggtaacacaccagaggagctgatccagactaaggtgcccaaagtaggacgggttgaacgcaaaatgtcccgaaataataaagtcagcatcttcccaaaggttgactcttag

SEQ ID NO: 117822 - DNA, 1548 bp, Artificial Sequence
  Description of Artificial Sequence: Synthetic coding sequence
atgggtcataatggtagctggattagccctaacgctagcgagccccacaacgcgtcaggagctgaggccgccggcgtaaaccggagcgccctgggtgaatttggggaagcacagctttataggcaatttaccactactgtgcaggtggtgatcttcatcggaagcctcttaggtaattttatggtcctgtggagcacctgccgtaccactgttttcaagtcagttactaatcgattcattaagaacttggcttgtagtggtatctgcgcctccctggtatgcgtgcctttcgacatcatcctatccacaagcccgcattgctgttggtggatctataccatgttattttgcaaggtggtaaagtttctgcataaagtgttttgttctgtcaccatcctttctttccccgcgattgctctggacagatattacagcgtactctatccattggaaaggaaaatttcagacgcaaagagcagagagttggtaatgtacatttgggcacatgctgtggtggcctctgtcccggtctttgcggtgactaacgtagcagacatatacgccacctctacttgcaccgaagtgtggtcaaattctttaggccacctggtctatgttctggtgtataacatcactacagtgatcgttccagtcgtggtcgtcttcctgtttctgatcttgattagaagagccctaagtgcctcacagaaaaagaaggtaatcatcgctgctctgcggacgccccagaatacgatctctattccctacgcttcccagcgagaggctgagctacatgccaccctgctctcgatggtgatggtctttatactctgcagtgttccatacgccactctggtcgtgtatcagactgtgctgaatgtgccagacaccagcgtcttcctgcttctgactgctgtctggctgcccaaggtctctctgctcgccaatccagtactgtttcttacggtgaataagagtgtcagaaagtgccttatcggaaccttagtccaactgcaccataggtacagcagaagaaacgtggtgtcgacagggtccggcatggcagaggcttctctggagccatcaattcggtcaggaagccagctactcgagatgtttcatattgggcaacagcaaattttcaaacccacagaagacgaagaggagagtgaagctaaatacatcggcagtgctgacttccaggctaaagagatatttagcacttgtcttgagggagaacagggcccccagtttgctccaagcgctccgcctctgtccaccgtggatagcgtgagccaggtcgctccagctgccccagtcgaacctgaaacctttcccgacaaatactctctacaatttggtttcggacccttcgaactgccgccccaatggttgtcagagactcgaaactcaaagaaaagattgctgcccccattagggaatacccctgaggagttgatccagaccaaggttcctaaggtcggacgggttgagcgcaaaatgtcacgtaacaataaggtgtccatctttccgaaggtggactcttag

SEQ ID NO: 117823 - DNA, 996 bp, Artificial Sequence
  Description of Artificial Sequence: Synthetic coding sequence
atgattactctgaacaaccaagaccagccagtgcctttcaactcttcacatccagatgagtataagatcgctgcgttggtgttttatagttgtatattcatcataggtctgtttgtgaacatcaccgccctgtgggttttttcctgtacaaccaagaagaggactacggtcacaatctacatgatgaatgttgcgctagttgacttgatcttcataatgaccctgccttttcgcatgttttattacgcaaaggatgaatggccattcggggagtacttctgccagattcttggtgccctcaccgtgttctacccgtctatcgccctgtggttgctcgccttcatttctgcggataggtacatggcaatcgtgcagcctaaatacgctaaggagctcaaaaacacttgtaaggccgttttagcgtgcgtgggagtgtggattatgactcttactaccacgacccctctgctgttgctatacaaagacccagataaagacagcaccccagccacctgcctgaagatctctgatattatctatttaaaggccgtcaacgtgcttaacctcacacgtctgacctttttttttctcatcccattatttatcatgatcgggtgttacctggttatcattcacaacctgctccatggccggactagtaaacttaagcccaaagtcaaagagaaaagcattcgtattataatcacattacttgtacaggtactcgtgtgttttatgccctttcatatttgtttcgcattcctgatgcttggaacaggggagaatagttacaatccatggggagcgtttactaccttcttgatgaacctcagtacttgcttggatgttatcctctattatattgtttcgaagcaatttcaggcgcgagtgatcagcgtcatgctgtacagaaactacctgagatctatgaggcgcaagtcctttcgaagtggctcactccgcagcctgagcaacatcaacagtgaaatgctctag

SEQ ID NO: 117824 - DNA, 996 bp, Artificial Sequence
  Description of Artificial Sequence: Synthetic coding sequence
atgattactctcaataatcaggatcagccagtgccgtttaattcaagccaccccgatgaatacaaaatcgcagccctggtgttttactcatgtatctttatcatcggactgttcgtaaacatcacggccctgtgggtgttttcttgtaccaccaaaaagagaacgactgtcacaatttatatgatgaacgtcgcactggtggatctgatcttcatcatgactctgccctttcggatgttctactatgccaaagatgaatggccattcggcgaatatttctgtcaaatcctcggcgcccttactgtgttttatccatcaatcgcactgtggttgttggcatttataagcgccgacaggtatatggcgatcgttcaacccaaatacgccaaggaactgaaaaacacttgtaaggccgtattagcctgcgtgggcgtgtggattatgactttgaccaccaccacacctctactgctgctttacaaggacccagacaaggatagtacccccgccacatgcctgaaaatctcagacatcatttacctcaaggctgtaaacgtcctgaacctgactcgcctgaccttcttctttctgatacccctcttcatcatgatagggtgctacttggtaattatacataatctgttgcacggccggacgagtaagttaaaacccaaggttaaagagaagtccatcagaatcataatcaccctcctggtgcaagtcctcgtctgttttatgcctttccatatttgttttgcatttctgatgcttggaacaggggaaaattcatataacccttggggcgccttcacaacttttctaatgaatctcagtacctgccttgacgtaattctgtactatattgtgagcaaacaatttcaggcacgggttatctcagttatgctgtacaggaattatctcaggtccatgcggcggaagtctttccgatcagggtccctcaggagcctgagcaatatcaattctgagatgctctag

SEQ ID NO: 117825 - DNA, 996 bp, Artificial Sequence
  Description of Artificial Sequence: Synthetic coding sequence
atgattacattgaacaaccaggaccaacccgtgcctttcaactcctcacatcctgatgagtataagattgccgccctcgttttctacagttgtatcttcatcattggcctgttcgtcaatatcacagcactgtgggtattctcatgcacaactaagaagcgcacaaccgtaaccatctatatgatgaacgtggctctcgtggacctgatcttcattatgacactaccgtttagaatgttttactatgcaaaagatgagtggcctttcggcgagtatttctgccagattctcggcgcattgaccgtgttttacccatcgatcgctttatggctcctcgcctttatcagcgcagaccggtatatggcgatagttcaacctaaatatgccaaagaactgaagaatacatgtaaggcggtactggcttgcgtgggagtctggattatgactctgacaacgactacgcctttgttgttgctatataaagaccctgataaggactcaacaccagctacctgcctgaagattagcgacattatatatcttaaagcagtgaacgtcctcaacctcacacggctaactttctttttcctgataccactattcataatgatcggatgctatctggtcatcattcacaatctcctgcacggtaggacatcaaaactgaagcctaaggttaaggaaaagagcatccgtattatcattacactgcttgtccaggttctcgtgtgcttcatgccattccatatatgtttcgcatttctgatgctggggaccggagagaacagttataacccatggggcgcttttactacctttctaatgaatctctctacatgtcttgatgtgatcctctactatattgtgagcaagcaattccaggcccgggtgatttctgtcatgctgtatcggaattacctccgctccatgaggagaaagtcattcagatctggcagcctccggtctctgagtaacataaactccgagatgctgtag

SEQ ID NO: 117826 - DNA, 297 bp, Artificial Sequence
  Description of Artificial Sequence: Synthetic coding sequence
atgatcactctgaataaccaggaccagcctgttccctttaactcaagtcacccggatgaatacaagattgccgcactggtcttttacagctgtattttcattatcgggctttttgtcaatatcacagctctttgggtattttcttgcactaccaagaagcgcacaaccgtcaccatttacatgatgaacgtcgcactggtggatctgatttttatcatgaccctgcctttccgaatgttttactatgctaaagatgaatggccctttggcgagtacttctgccagatcctgggctag

SEQ ID NO: 117827 - DNA, 1086 bp, Artificial Sequence
  Description of Artificial Sequence: Synthetic coding sequence
atggacattcagatggcaaacaactttaccccgcccagtgccactccgcaggggaatgactgcgatttgtatgcgcaccattctaccgcccggattgtcatgccccttcattattcactcgtattcattatagggcttgttggcaacctgttagccctcgtggtcatcgtgcagaaccggaagaaaatcaacagtacgactctgtactccaccaacctcgtaattagtgatatcctgttcacaaccgccctgcccactcgtattgcttattacgccatgggcttcgattggcgcataggcgacgccttatgccggatcaccgcccttgtcttttatatcaacacctacgcgggggttaactttatgacatgtctctcaattgacaggtttattgctgtggttcaccccctgcgatataataagatcaagcggattgagcatgcgaagggcgtctgcatcttcgtctggatcctcgtctttgcccagacgctgcccctgttgatcaatcccatgagcaaacaggaagccgagcggattacgtgcatggaatacccaaattttgaggagaccaaaagccttccgtggatactcctcggcgcctgtttcatcggctacgtgctaccgctgatcataattctgatttgttacagtcagatctgctgcaagcttttcaggacagctaaacaaaaccctttgacagagaagtccggtgtgaacaagaaagctctgaacaccataatcttaattatcgtggttttcgtgctgtgctttacgccctaccatgtggcaatcattcaacatatgatcaagaaacttagattcagcaacttcttggaatgtagtcagcggcacagcttccaaatttcacttcacttcacagtttgtttgatgaacttcaactgttgcatggatccttttatttacttctttgcttgtaaaggttataagaggaaggtgatgcgaatgctcaaacgacaggtgtcagtttctatcagctccgctgttaaatcggccccggaggagaacagtcgcgaaatgactgagacgcaaatgatgatccattcaaagtcatctaacgggaagtag

SEQ ID NO: 117828 - DNA, 1248 bp, Artificial Sequence
  Description of Artificial Sequence: Synthetic coding sequence
atggttttcgctcacaggatggataattcaaaacctcaccttatcatcccgacccttcttgtccccctacaaaatcgctcctgcacagagactgcgacacccttgccttcccagtacttgatggagctgagcgaagaacactcctggatgagtaaccagaccgatctgcactacgtcctaaaaccaggagaagtcgccacagcttcaatcttcttcggtatcctgtggcttttttccatattcggaaattctctagtctgtttggtgatccaccgatcccggaggactcagagcaccacaaattacttcgttgtaagtatggcctgcgccgacctgctgattagtgtggcatcgactcccttcgtgctgttgcaatttacgacaggtaggtggacacttgggtcagcaacgtgtaaggtggtaagatacttccagtacctgactcccggtgtccagatctacgtcctcctgtccatatgcatcgatcggttctatacaatcgtttacccgctgagcttcaaggtgtctagggaaaaggcgaaaaagatgattgctgcttcctgggtatttgacgcaggctttgtgacacccgtgctgttcttttacggcagcaactgggattcccattgcaactactttcttccctcgtcatgggagggcactgcatatactgtgattcacttcctggtcgggtttgtgatcccatcagtgttgattatactgttctatcaaaaagtaatcaagtatatttggcggattgggactgatgggaggactgtgcgacgtactatgaatatcgtgcctagaaccaaagtgaaaactattaaaatgttcctgattctcaacctgctcttcttactgagttggcttccctttcacgtggcccagctctggcacccgcatgagcaagactacaaaaagtcatccctggtgttcacggccatcacatggatctccttctcatcctctgcaagtaagcccaccctttattccatctacaacgccaatttccggaggggcatgaaggaaactttttgcatgtcctcaatgaagtgctatagatccaatgcatacaccatcactacatcttccagaatggcaaagaagaattacgtcgggatcagcgaaatcccaagcatggccaaaacgatcactaaggattctatttacgatagctttgatagggaagcaaaggagaaaaagctggcctggcctatcaattccaacccccctaatacgtttgtctag

SEQ ID NO: 117829 - DNA, 1248 bp, Artificial Sequence
  Description of Artificial Sequence: Synthetic coding sequence
atggtgtttgctcacagaatggataactcaaaaccccatctgatcattccaaccctcctagtgcctctacagaataggagctgtacagaaacagccacacccttacccagtcagtacctgatggagctatcagaggaacactcctggatgtctaaccagacagacctccattacgtgctcaagccaggtgaagttgccaccgcctctatcttttttggcattctgtggctattcagcatcttcggaaacagtttggtctgcctggtcatccaccgatcgcgacggacacagtccacaaccaactacttcgtcgtgtccatggcttgtgcagatctattaatcagcgtcgccagcacgccctttgtgctgctccaattcaccacaggaaggtggacactcggctctgccacttgtaaagtggttcgatactttcaatatctaacacccggggtgcaaatctacgtcctgttaagcatctgcatcgatcggttttataccatcgtttatccactgagttttaaagtgagcagggagaaagctaagaaaatgattgcagcttcatgggtatttgatgcaggctttgtcactcctgttctctttttctacgggtcaaactgggattctcactgcaattactttctgcccagtagctgggagggcactgcttatactgtcattcattttctggtaggattcgtgataccctctgtactgattatcctcttttatcagaaagtgattaaatacatctggcggattggcactgacggacggaccgtacgcaggacaatgaatattgttccacgcactaaggttaagactattaaaatgttcctgatcctgaacttgctgttcctgctgagctggctgcctttccacgtcgctcagctttggcaccctcatgaacaggattacaaaaaatcctccctggtattcaccgcaattacctggatcagcttctcttcctccgctagcaagcccaccctgtattccatatacaatgcaaatttccggcgcggaatgaaggagacattctgcatgtctagcatgaaatgttatagatcaaatgcctacactatcacgacgtcgtcaaggatggccaagaaaaattacgtgggtattagtgagattccttccatggctaaaactatcactaaggacagcatttatgatagctttgaccgggaggccaaagagaagaagctcgcgtggccgattaattctaatccgccgaatacctttgtgtag

SEQ ID NO: 117830 - DNA, 180 bp, Artificial Sequence
  Description of Artificial Sequence: Synthetic coding sequence
atggtttttgcgcatcgcatggacaattctaagccacaccttataattcccacgctgcttgtgccactccagaaccggtcctgcaccgagactgccactccgctaccctcccagtatctaatggagctatctgaggaacacagctggatgagcaatcaaactgatcttcattacgtctag

SEQ ID NO: 117831 - DNA, 1077 bp, Artificial Sequence
  Description of Artificial Sequence: Synthetic coding sequence
atgccatctgtgtctcctgcagggccctccgctggcgccgttcccaatgctactgcagtcacaactgtacggacgaatgcttccggactcgaggtcccgctattccatcttttcgccaggctggatgaagaattgcatgggacgtttcccggcctgtggctagcgctaatggccgtacacggggctatcttcttggctggcctagtcctcaatggcctggccctgtacgtcttctgttgtagaactagggcaaagacgcccagtgtgatttatacgataaacctggtcgtaactgacctgctggtgggcctttctttgcccacacgcttcgcagtatattacggcgccagggggtgcctgcgttgcgccttccctcatgtcctcgggtacttcctgaacatgcactgcagcatcctttttctgacctgcatatgcgtggatagatacctagccatcgtgcgcccggaggggtccaggcgttgcaggcaaccagcctgcgcccgggcagtatgcgctttcgtttggcttgcagccggtgccgtcactctctccgtcttgggtgtcaccggctctcgaccttgctgcagagtttttgccctgaccgttctagaattccttctgccgcttttggtcatctccgtgtttacgggccgaatcatgtgcgccctgtcccgccctgggctactacatcaaggcagacagcgcagggtccgggccatgcagttgctgctaacggtcctgattattttccttgtgtgttttacccctttccatgctcgccaagtggcagtggcgctgtggccggacatgcctcaccacacttcactcgtagtctaccacgtggccgtgaccctgagtagcctgaattcttgcatggacccaattgtgtattgcttcgtcacgagtggctttcaggctacagtgagggggctgtttggccaacatggggagcgtgagccctcgagcggggacgtggtctccatgcatagatcaagcaaagggtccggcaggcatcatatcctcagcgcaggaccgcatgctctgacccaggctcttgctaatggccccgaggcatag

SEQ ID NO: 117832 - DNA, 1050 bp, Artificial Sequence
  Description of Artificial Sequence: Synthetic coding sequence
atgaactccactctagatggcaaccagagttcacacccattctgtctactggcttttgggtaccttgaaactgttaatttctgcctgttagaggttctgataatcgtcttcctcacagtgctcatcatttccggaaatatcattgtgatcttcgtgttccactgtgcacctctgttgaaccatcatacgacgagctacttcatccagacaatggcctacgcagacttattcgtgggagtgagttgcgtggtgccttcgctaagcctcctgcaccaccccttgcccgttgaagagtcccttacttgccagatttttggatttgttgtcagcgtgttgaagagtgtgagtatggcctcactggcctgtatatccattgaccgctatatcgccatcactaagccactgacctataatactttggtcactccttggagattgaggttatgtattttcttgatttggctgtattccacactggttttcttaccctcgttctttcactggggaaagcccgggtaccacggggatgtgttccagtggtgtgcagaaagctggcacactgactcatatttcacactgttcatcgtgatgatgctctacgctccagctgctctgattgtgtgtttcacctacttcaatatcttccggatctgtcaacagcacactaaggatatttctgaaaggcaggccaggtttagctcacaaagtggggaaaccggagaagtccaggcttgccctgataagcgctatgctatggttcttttccgaatcacctctgtgttctatatcctgtggctaccgtacataatatatttcctgcttgagtcttccaccggccattcgaatcggttcgcctcctttttgacaacgtggctcgcaatctccaattcattctgtaactgtgttatctattctttgtccaactccgtattccaaagaggcctgaaaagactctcaggcgcaatgtgcacatcatgcgctagccagactaccgccaacgatccctatactgtaaggagcaagggccctctgaatggctgccacatttag

SEQ ID NO: 117833 - DNA, 753 bp, Artificial Sequence
  Description of Artificial Sequence: Synthetic coding sequence
atgaactctactctagatggaaatcagagcagccatcctttctgtctgctggcgttcgggtatctcgagacagtgaacttctgccttctggaggtgctgattatcgtgtttctgacagtcttgattatcagcggcaacattatcgtgatattcgtgtttcactgtgctcccctgcttaaccaccataccaccagttatttcatacagacgatggcttatgcagacttgttcgtgggcgtatcatgcgtagtgcctagcctgtctttgttgcatcaccctctgcccgtcgaagaaagtctcacatgccagatttttgggttcgtggtgagcgtattgaaatccgtgagtatggccagcctcgcctgcatctccatagatcggtacatcgctatcaccaaacctctcacgtacaatacactcgtgacaccttggcggttgaggctgtgcatttttctgatatggttgtatagcaccctcgtttttcttcccagtttttttcactggggtaagcctggttatcacggagacgtgtttcagtggtgtgcggaaagctggcacacagattcttacttcactctgttcatcgtaatgatgttgtatgctccagccgccctcattgtgtgcttcacgtattttaacatcttcaggatctgtcagcaacacacaaaagacatcagtgaacggcaagctcgattctcttcgcagtccggcgagactggggaagttcaggcatgcccagttagcaatcactag

SEQ ID NO: 117834 - DNA, 1302 bp, Artificial Sequence
  Description of Artificial Sequence: Synthetic coding sequence
atgtgcttcagcccaatcctcgagataaatatgcagagcgagtcaaatataacggttcgcgatgacatcgatgacattaatacaaatatgtaccagcccctctcatacccactgagcttccaggtttcgcttactggttttcttatgctggagatcgttttgggacttggttcaaatctaaccgtcttggtgttgtactgtatgaagagtaaccttatcaactcagtgtcaaatatcatcacgatgaacctccacgtgctcgatgtcattatctgcgtaggatgtattccactgaccatcgtgatcttactcctgtcactggagtccaacaccgcactgatttgttgcttccatgaagcctgtgtttccttcgcctctgtgtctactgcaatcaatgtgtttgctatcacgcttgatcgctacgacatttccgtgaaacccgctaacaggatattgacgatgggacgggccgtgatgttgatgatctcaatctggattttttcctttttcagctttctgattccatttatcgaagtaaacttcttcagcctgcagtcagggaacacctgggagaacaagacactgctgtgtgtgagtacgaatgagtattataccgaacttggcatgtattaccatcttctagtacagatcccgatcttctttttcaccgttgttgtgatgctgattacctacacgaaaattctgcaggcactgaatatccgcattggtactaggttcagcaccggacagaagaagaaagcccgaaaaaagaagacaatctctctaaccacacagcatgaagccacggacatgagccagagttctgggggtcgcaacgtcgtctttggtgttaggacatccgtttccgttatcatcgccttgagacgggcagtcaaacgtcaccgcgagcggagggagagacagaaacgggtgttcaggatgtcacttctcatcatttccacatttctactgtgctggacccccattagcgtgctaaacacaacaattctgtgcctcggcccctccgacctgttggtaaagcttcgcctgtgctttcttgtcatggcctatggcacaaccatattccacccccttctgtatgcatttactaggcagaagttccaaaaagtgctcaagtctaagatgaagaagcgcgtggtttccatcgtggaggccgatccactgcccaacaatgcagtgatacataattcatggattgaccccaagcgtaacaaaaagattacgttcgaggactcggagattcgtgaaaagtgcttagtaccacaggtggtgacagactag

SEQ ID NO: 117835 - DNA, 1086 bp, Artificial Sequence
  Description of Artificial Sequence: Synthetic coding sequence
atggctcctactgagccttggtcgccctcccccgggtcagccccctgggactacagcggcctggatggactggaggaactggagctgtgtccagctggtgaccttccttacggctacgtatacattcccgctctttacctggccgcttttgccgtgggccttctgggaaacgccttcgtggtttggttgctggctggtaggcgaggccctcggcggttggtcgacactttcgttctccatctagcggccgctgatttgggatttgtcctgacgctgcccctttgggctgctgcagcagccctcggtggtagatggcctttcggggatggcctctgcaagctgagctcctttgcccttgctggaactagatgtgctggggctctgttattagccggcatgtcagtcgataggtacctcgccgtagtgaagctgctagaggccagacccctgaggactccaaggtgcgctcttgcgtcttgctgtggtgtctgggcggtcgctcttctcgcgggtttgcccagcctcgtttaccgtggtttacagcctctgcccggggggcaggattcgcagtgtggagaagagccctcccatgccttccagggactcagcttgctgctgctgctgttaacgttcgttcttccgctggtggtcaccctcttttgttattgccgcatctcccggcgactcagaagaccccctcacgtgggccgggctcggcgcaacagtctgcgtatcatcttcgccatagagtccacattcgtcggctcgtggttacccttttctgccctgagggccgtgtttcatctggcacgtctgggtgccttgcccctaccctgcccactcttactggccctgcgctggggccttacaattgcgacttgcctggcattcgttaactcctgtgcaaatccactgatttaccttttactggaccgctctttccgggcccgggcactggatggggcctgcgggcggaccgggcgcttagctaggagaatctcgagtgctagtagcttgagccgtgacgactcttctgtattcagatgcagagcacaagccgcaaacacagcttccgccagctggtag

SEQ ID NO: 117836 - DNA, 1014 bp, Artificial Sequence
  Description of Artificial Sequence: Synthetic coding sequence
atgaattcttgggacgccggcttggccggacttttggtggggactatgggcgttagcttgttgtctaatgcccttgtactcttatgccttctacacagtgccgatattcgaagacaggcccctgctctgtttacattaaatctcacttgcgggaacctgctctgcacagtagtaaacatgccactcaccctcgccggggttgtcgcgcaacggcagcccgcgggggataggctgtgccgtctggccgccttccttgacactttcctggctgccaatagcatgctgagtatggctgctctaagcatcgatcgatgggtggcggtcgtattccccctctcttatagggccaagatgcgactcagggacgctgcactgatggtggcctacacctggttgcatgcactgacgtttcctgctgctgccctggcgttgtcctggctcggatttcatcagctttatgcatcttgcacgctatgttccagaaggcctgatgagcggcttaggtttgccgtgttcaccggcgcgtttcacgcactctctttcttgctctcattcgtagtcctgtgttgtacctacctgaaagttctgaaagtcgcacgcttccactgtaagaggattgacgtgataactatgcagaccttggtgcttctggtcgacctgcacccctcagtgcgagaaaggtgtttggaggagcaaaagaggaggcggcagcgggctaccaagaaaatatcaactttcataggcacattcctcgtctgcttcgccccttatgtaataactagactggtggagctcttctcaacagtccccataggttcgcactggggagtgcttagcaagtgcctcgcatactctaaagctgcctccgacccctttgtgtacagcctccttagacatcagtaccggaagtcttgcaaagagattctgaatcgccttctgcatcgccgcagcatccatagctctggtctgactggggactcccactctcaaaatatcctgcccgtcagcgagtag

SEQ ID NO: 117837 - DNA, 1128 bp, Artificial Sequence
  Description of Artificial Sequence: Synthetic coding sequence
atggcgaatgcgtctgagcctggcggaagtggcggaggtgaggctgctgcactgggtctgaagcttgcgaccctctctctcctcctgtgcgtttcactggcaggaaatgtcctctttgccctgctgattgtgagagaacgtagtctccaccgggccccctactatctgttactggacctgtgcctggctgatgggcttagggccctggcatgtcttccagccgtcatgctggcagcaaggcgggcggccgctgcagccggggctccgcctggggccctgggttgtaaacttctggccttcttagccgctttattttgttttcacgcagccttcttgctgttgggtgtgggcgtgaccagatatttggcaattgcacaccacagattttacgcagaaagactggctggatggccttgcgccgcaatgctcgtctgcgctgcgtgggcactcgctttggctgccgcttttcccccggtgcttgacggtggcggagatgatgaggacgctccttgtgcgctggaacagaggccagatggggcgcccggcgccctgggttttctgctgctcctggccgtagttgttggggctacccaccttgtctatctccgcttactgttctttatccatgatcggcgtaagatgaggccagcccggctggtcccagccgtgtctcatgattggacattccacggccccggggccactggccaagctgctgccaattggacagcagggttcggaagagggcccactcctccagctctcgttggcatccgacccgcgggccctggccgcggagcaaggcgcctactcgtgttggaagagtttaagaccgaaaagcgactttgcaaaatgttttacgcagtgacactcctgtttttgttgctctggggcccctatgtggttgctagttacctgagggtcttggttcgtcccggtgcagttccccaggcctacctgacagcatccgtgtggcttacattcgcccaagcaggaatcaaccccgtcgtgtgttttctgttcaatcgcgagctgcgagattgttttcgcgcccagttcccttgctgccaatctccaagaaccacacaggcgactcatccgtgcgatctgaaaggcatagggctgtag

SEQ ID NO: 117838 - DNA, 993 bp, Artificial Sequence
  Description of Artificial Sequence: Synthetic coding sequence
atgatgtggggcgctggctcaccactggcttggctgtctgctggttcaggtaatgtgaatgtgagcagtgtcggacccgcggagggaccaactggacctgcggcgcctttgccctcgccgaaggcatgggacgttgtcttgtgtatttctggcactctggtctcctgcgagaacgctctggtcgtggcaattatcgtgggcacgccagccttcagagcaccgatgttcctgcttgtcggatcattggccgtggcagatctgctggccggcctggggttggtgcttcatttcgcagcagtcttttgcataggttctgccgaaatgtcactggtgctcgtaggcgtgctcgcaatggcttttaccgcgagtataggaagtcttctggctattacagttgaccggtacctgagcctgtacaacgcattgacttactacagcgaaacaaccgtcactagaacatatgtcatgttggcccttgtgtggggcggggcccttggactcggactcctgcctgtcctcgcatggaattgcctggatggcctgaccacttgtggcgtggtttaccccctgagtaagaatcatctggttgttttagctatagctttttttatggtgttcggcatcatgctccagctgtatgcacagatttgtcggatagtatgccgacacgcccaacagatcgccctgcaacgccacctacttccagcctcccactatgtcgcaacccggaaggggattgccaccttagccgtggtgctgggcgctttcgccgcatgctggctgcccttcacagtgtattgcctgcttggggacgctcatagccctcccctgtatacctacttaacactgctccccgccacttacaattccatgattaatcctattatttacgccttccgcaatcaggatgtccagaaggttctttgggctgtgtgctgctgttgcagctctagcaagatccccttccgctccagatcaccatcggatgtgtag

SEQ ID NO: 117839 - DNA, 960 bp, Artificial Sequence
  Description of Artificial Sequence: Synthetic coding sequence
atgccttttccaaactgctctgccccctccactgtcgtcgccaccgctgtgggggttctcctcgggctagaatgtggcttgggcttgctgggcaacgccgtcgccctgtggactttcctgttcagggtgcgggtttggaaaccgtacgcagtatatttgttgaacctcgcgctcgcggacttgctgctcgctgcctgtttgcctttcctggccgctttttatttgtctctccaggcttggcatctaggcagagtgggatgctgggccctgcatttcttattggatctgagccgctccgtcggaatggccttcttggcagcagtggcactcgacagatatttaagggtcgtccaccccagactgaaagtgaatttgttatctccacaggctgccctgggcgtgagtgggctcgtgtggttgctcatggttgcgctcacgtgcccaggcttattgataagtgaagctgctcagaattcaaccaggtgccattctttctactcccgtgccgacggcagtttttccataatttggcaggaggccctgagttgtctgcaattcgtccttccgtttggcctgattgttttctgtaacgctggcatcatcagagctctgcagaaacgtctccgggagcccgagaagcagcccaagctgcagcgggcccaggccttggtaacccttgtagtggtgctcttcgctctgtgtttcctgccttgtttcctggcccgtgtgctcatgcatatttttcaaaatctgggttcctgcagggctttatgcgccgtggcccacacctcggacgtcacaggttccctgacatacctgcattccgtgcttaaccccgtcgtatactgtttttcttcaccaacctttagatcctcatacagaagggtgttccacacactgcgtggcaaaggtcaagccgccgagccgcccgatttcaaccctcgcgacagctatagctag

SEQ ID NO: 117840 - DNA, 1071 bp, Artificial Sequence
  Description of Artificial Sequence: Synthetic coding sequence
atgaacggagtgtccgagggaacaagaggctgttccgaccgacagccaggtgtgcttactagagaccggagttgcagccgtaagatgaactccagcgggtgtctgagtgaggaggtgggaagtctgcgcccacttactgttgtgatccttagcgcctcgatagttgtgggcgtgctggggaatggattagtcctctggatgacggtattcaggatggctaggaccgtgtcgacagtctgcttcttccaccttgctttggccgacttcatgctcagcctgtccttaccaatcgcaatgtactacatagttagccggcagtggctgctgggtgagtgggcctgcaagttatatatcacctttgtctttctcagctacttcgcatcaaactgcctactcgtgttcatttctgtggataggtgcatatcagtgctgtatcccgtttgggcgttaaatcaccgcaccgtgcagagagcatcctggctagcatttggcgtttggctactggccgcagctctttgttctgctcacctcaagttccggaccacacgaaagtggaatggatgtacccactgctacctggctttcaattccgacaatgagactgcccagatctggatcgaaggggttgttgaggggcacatcatcggtactataggacatttcttgctggggttcttaggacccctcgccatcatcggcacatgtgcccacctgatccgggctaaactgctacgggagggatgggtccacgccaacagaccaaagcgcctgctgctggtactcgtgtctgcattcttcattttctggtccccatttaatgtggtgctgctcgttcacctgtggcgaagagttatgctgaaagaaatctaccaccctcgcatgctgttgatcctgcaggcttcatttgcgctgggctgcgtgaatagtagtttgaatccattcctgtacgtgttcgtgggacgcgactttcaggaaaaattcttccagtcacttacgagcgccctggcacgtgcatttggcgaggaagagttcctgagctcttgtccccgcggcaacgcccccagagaatag

SEQ ID NO: 117841 - DNA, 1146 bp, Artificial Sequence
  Description of Artificial Sequence: Synthetic coding sequence
atgagatcgcacaccatcaccatgaccacaacaagcgttagctcatggccctattcatcccaccgcatgaggtttattactaatcacagcgaccagcccccacaaaacttctcagccactccaaacgtgacgacgtgtcctatggatgagaaactcctctcgactgtgctgacgacatcgtacagcgtcatctttattgtagggctagtgggcaacatcatcgccctgtacgtctttctcgggatccacagaaaacgcaattcaatacaaatctatctgctgaatgtagccatcgccgatcttctgttgatattttgtctgccctttcgaatcatgtatcacatcaaccagaacaaatggactcttggagtcatactctgtaaggtcgtcgggaccttattttacatgaatatgtacatctcaattattctgctgggttttattagcctcgataggtacattaagataaatcgctctatccagcaaagaaaagccataacaaccaagcagtccatttacgtgtgctgtatcgtgtggatgctggccctgggcggcttcttgaccatgatcatcctcacgctgaagaaaggagggcacaactctacgatgtgctttcactatcgcgataagcacaacgcaaaaggagaagccatttttaatttcatactggtcgtcatgttctggctcatttttctcctgatcatcctatcatatattaagattgggaaaaacctgctcagaatctctaaacgtaggagcaagtttcctaattcggggaaatacgctacaacagctcgcaattccttcatcgtcttaatcattttcacaatatgtttcgtcccttaccatgcattcaggttcatatatatctcgtctcagctgaatgtgtcctcttgctactggaaagaaatagttcacaagaccaatgaaattatgctggtcctctctagcttcaatagctgtctcgatcctgtgatgtatttcctaatgtcctcaaacattaggaagattatgtgccagctgttgtttagacgcttccagggcgaaccttctcgttcagagtctacctcggaattcaagccaggctactctctccatgacaccagcgtcgccgtaaagatccaaagttcgtccaaatccacttag

SEQ ID NO: 117842 - DNA, 1146 bp, Artificial Sequence
  Description of Artificial Sequence: Synthetic coding sequence
atgagaagccacaccatcacaatgactaccacctccgtgagctcatggccctacagcagtcatagaatgaggtttattactaatcactctgaccagcctccccaaaacttctccgccacccctaatgtaaccacatgcccgatggatgaaaaacttctgtctaccgtattaacaacatcttattccgtcatcttcatcgtcggcctcgtcgggaacatcatcgcactgtatgtatttcttggtattcatagaaaacgcaattccatccagatatacctgctcaacgttgctatcgctgatctcttgctcattttttgtctcccctttagaattatgtaccatatcaaccaaaataaatggacactcggagtaattctgtgcaaggttgtgggaaccttgttctacatgaacatgtatatctccatcattctcctgggcttcatatccttggaccgctacatcaaaattaaccgaagtatacagcagcgaaaggcaatcaccactaaacagtcaatctacgtgtgctgtatcgtatggatgttagccctgggaggatttctgactatgataatcttgaccctgaagaaagggggccataattcgaccatgtgcttccattacagggacaaacataacgcaaaaggagaggcaatatttaactttattcttgttgttatgttttggctcatattcctcctaattatccttagctacataaagatcggcaagaatctgctccggatcagcaagcgtcgctcgaagttccctaactcggggaaatatgccaccaccgcaaggaactcatttattgttttgattattttcaccatctgcttcgtaccttaccacgcgttcaggtttatttacatttccagtcagctcaacgtgagctcttgctactggaaggaaatagtgcacaaaacaaacgaaatcatgcttgtcttatctagctttaactcttgcctggatcccgtcatgtatttcttaatgtcgtcgaacatccgtaagatcatgtgtcagcttcttttccgtcgcttccagggcgagcccagtcgatctgagagcacttccgagtttaagcctgggtacagcctgcatgatacctctgtcgcggtcaaaattcagtcatcatcaaaatctacctag

SEQ ID NO: 117843 - DNA, 1005 bp, Artificial Sequence
  Description of Artificial Sequence: Synthetic coding sequence
atggatgagaaattgctgtccacagttctcacaactagctacagcgtgatattcatcgttggccttgtgggaaacatcatcgccttatatgtgttcctgggcatacatcggaagcgcaactccattcagatttacctgttgaacgttgctatcgcggatttactgcttattttttgcctccctttccgcattatgtaccacatcaatcaaaacaaatggacgttgggggtcatcctgtgtaaagtggtaggaactctattctatatgaatatgtacatctctattattctcttgggctttatttcacttgaccgctacatcaagattaaccgttctatccagcagcgcaaggcaatcactacaaagcagtccatctacgtatgttgtatcgtttggatgctggctctcggtggtttcctcacgatgattatactcactcttaagaaaggcggacataatagtacaatgtgtttccattacagagacaaacataacgcaaaaggagaggcaatctttaacttcattttggtcgtcatgttctggcttatatttctcctgatcatcctgagctacatcaagatcggcaaaaacctccttcgcattagcaagcggcgcagtaagtttcccaactcaggcaaatatgccaccaccgcccgtaactcctttattgtgctaattatttttactatttgtttcgtgccttaccatgcgtttagatttatctacatcagctcccaactcaacgtgtcctcttgctattggaaggagatcgtccataagactaatgaaatcatgttagtgctatcttctttcaatagctgccttgatccggtaatgtatttcctgatgtctagcaacatccgtaagatcatgtgccaacttttgtttcgccgatttcagggcgagccatcacggagcgagagtacaagcgagttcaagccggggtatagcctccatgacacatccgtggctgtgaaaattcagtcatctagcaaaagtacttag

SEQ ID NO: 117844 - DNA, 930 bp, Artificial Sequence
  Description of Artificial Sequence: Synthetic coding sequence
atgaatggtacttataacacctgtggttcaagtgatctgacctggccaccggccataaagctggggttttatgcctacctgggggtgttactggtgctcggcttgctgctcaattcactggcactgtgggtgttttgttgcagaatgcagcagtggacagagacacgcatctacatgacgaatctggccgtggcggacctctgcctactgtgcacactgccattcgttctgcacagtttgagagacacttctgatacaccgctgtgccaactgtcacaaggcatttacttgactaatagatatatgtccatctcactggtgactgccatcgctgtggatcggtacgtggccgtccggcatcctttgagagcgcgtggcttgcgcagtccccgccaagccgctgcagtgtgcgctgtgctttgggtactcgtgattggatcacttgttgctcgctggctcctggggattcaggaaggcgggttctgcttcagatcaactcgccataacttcaactcgatggcttttccactcctgggcttctacctgccactggccgtagtggtattctgttccctcaaggtggttactgcgctggcgcagaggccgcccactgatgtcgggcaggccgaggccaccaggaaagccgccaggatggtctgggcgaacctgctcgtctttgttgtgtgttttttacccttgcatgtggggttaaccgtgcggctcgccgtgggttggaacgcatgcgctttactagagaccattagacgagcactctacattacctccaagctgagtgacgccaactgttgtctggacgccatctgttactattatatggcaaaggaattccaggaggcctccgccctcgccgttgcgccatctgcaaaggcgcataagtcgcaggacagcttatgcgtgactcttgcatag

SEQ ID NO: 117845 - DNA, 930 bp, Artificial Sequence
  Description of Artificial Sequence: Synthetic coding sequence
atgaatgggacttataatacatgtggaagcagcgacctcacctggccccctgcaattaagctggggttttacgcgtatctgggtgtgctgctggtgctgggtttactgctaaattccctagcattgtgggttttctgctgtaggatgcaacagtggaccgagacccgtatttatatgaccaacctggctgtcgcggacctgtgtttgctatgtacgttaccgttcgtgctccatagcctcagagacacatctgacacgcccctgtgtcagctctcccaggggatatacctaaccaatcggtacatgagtatctctctcgtaacagccatcgccgtagaccggtacgttgcagtcaggcatccactccgagctagggggctgaggtccccccgccaggcagctgctgtttgtgcagtgctctgggtactggtgatcgggtctttggtcgctcgatggctgctggggattcaggaaggaggcttctgttttaggtccacaagacataacttcaattcaatggcctttcccttgttaggcttttatctccctctggccgtggtggtcttctgttcactgaaggtagtgacggcattagcacaaaggccacctaccgacgtgggccaagccgaggccactaggaaggccgcacggatggtgtgggcaaacctgttggtattcgtggtctgctttttaccactgcacgttgggttaacggttcgattagctgtgggatggaatgcatgcgccctccttgagaccatcagacgagccttatacattactagcaaattatctgacgccaactgttgtctagacgctatctgctactactatatggccaaggagtttcaggaagcgtccgctctggcagtggctccttctgctaaggctcataaatctcaagacagcctttgcgtgacgctggcttag

SEQ ID NO: 117846 - DNA, 930 bp, Artificial Sequence
  Description of Artificial Sequence: Synthetic coding sequence
atgaacggcacctacaatacttgtggcagtagcgatctcacttggccacccgcaatcaaactcggcttttatgcttaccttggagtccttctagtgctcggactcctgttgaactcattggcactctgggtcttttgctgccggatgcagcagtggacggagaccaggatatatatgacgaatcttgccgtcgcagatctatgtctgctgtgcacccttcctttcgttctccacagtctccgcgacacaagcgacacacccctgtgtcagctatctcaggggatttacctaaccaataggtatatgagcataagcttagtgaccgcgattgcggtggaccggtatgtggctgttcgacatcccctacgggctcgcggtttgcgttcccctcgccaggctgccgcggtgtgtgcagtactgtgggtcctcgtcatcggcagccttgtcgccaggtggctcctcggcattcaggagggaggcttttgtttcagaagcacccggcacaacttcaacagtatggccttccccctcctgggcttctaccttccgctcgcagtggttgtgttttgctccctgaaggtggttaccgccctcgcgcaaaggcccccaacggacgtcggccaggcggaagccacgcggaaagccgcaaggatggtgtgggccaacttactagtgtttgtggtgtgctttttacccttgcatgtcggacttaccgtaagacttgccgttggctggaacgcgtgcgccctgctggagacaattagacgagcgttatacattacttcaaagctaagtgatgccaattgttgcctcgatgccatctgctattattatatggctaaggaatttcaagaggccagtgcgcttgccgtggcaccgtcagccaaggcccataaatctcaggactccttgtgcgtgacactggcttag

SEQ ID NO: 117847 - DNA, 930 bp, Artificial Sequence
  Description of Artificial Sequence: Synthetic coding sequence
atgaacggtacctacaacacgtgcggttcaagcgacctcacatggcccccggccataaagctgggattttatgcatacttgggcgtacttctcgtgctaggccttctcctgaatagtctggcactgtgggtcttctgctgccgcatgcaacaatggactgagacacgtatctatatgacaaacctggcggtcgccgatttgtgccttctatgcacactacccttcgttcttcactccctgcgagacacctccgatacaccgctatgtcagctctctcagggtatctacttaaccaatcgctacatgtcaatctcattagtcaccgctattgcagtggataggtatgtagcagtgcgccacccgctgcgcgcccgtggactgagatcccctcgccaagccgcggcggtatgcgccgtcctgtgggtgctggtgattgggtcgctggttgcccggtggttacttggtatacaggaaggtggtttttgttttcgtagcactcgacacaatttcaacagcatggctttccctctgctcggcttctatttaccactcgcggtcgtggttttttgttcattgaaggtcgtgacagccttggctcaacgcccgccaaccgacgtggggcaggccgaggccacacggaaggctgccaggatggtctgggcaaatctgctggtattcgtcgtgtgcttcctgcctttgcacgttgggctgaccgtacggctcgccgtcggctggaacgcatgcgctcttttagagactatccgccgggccctttatatcacaagcaagctgagcgatgcaaactgttgtctcgacgctatctgctattactatatggcaaaggaattccaggaggcctcagctctggcggtggccccatccgcaaaggcgcacaaatctcaagactctctatgtgttacattggcctag

SEQ ID NO: 117848 - DNA, 1023 bp, Artificial Sequence
  Description of Artificial Sequence: Synthetic coding sequence
atgctttcaggctcacgagccgtgcctacaccccatcgagggtccgaagagttgcttaaatacatgttacattctccatgcgtgagtttgaccatgaatggaacttacaacacttgcggatcctcagacctcacctggccccctgccatcaagcttgggttttacgcttatctgggagttttgctagtacttggattgcttctgaactcactcgctttatgggtgttctgttgtaggatgcagcaatggaccgagacgcgtatttacatgactaacttagccgtggctgacctatgcctgctttgtacattgccatttgtgctgcacagcctgagagatacctcagatacccctctttgccagctgtctcagggtatatatctcaccaacagatacatgagtatatccctggttactgccatcgcagtggacagatacgtggctgtaagacatccactccgcgccagaggcctgagatcaccgcgacaggcagctgctgtgtgcgctgtcctttgggttctggttatcggatctctcgtggcgcgctggctgctgggcatccaagagggcggtttctgtttccgatcaactagacacaactttaactccatggcattccccctgttaggtttttacctacccctggcagtggtggtattttgtagccttaaagtggtaaccgcactggcacaacggcctccgaccgacgtgggccaagccgaagccacccgaaaggccgcccggatggtatgggccaacttgctcgtcttcgtggtctgcttcctccctctgcatgtgggcctgacagttcggctggccgtgggatggaatgcctgtgccctgttggagaccatacgtcgggctttatacatcacgtccaagctgtctgatgccaactgctgcctcgacgcgatttgctactactacatggctaaagagttccaagaggccagcgcattagctgtggccccttccgctaaggcacataagtctcaggattcactgtgtgtgactcttgcctag

SEQ ID NO: 117849 - DNA, 1842 bp, Artificial Sequence
  Description of Artificial Sequence: Synthetic coding sequence
atgcgcgctcctggagcgcttctggcacgcatgagccgtctcctccttctactgctactgaaggtgtccgcttcttcagctctcggagtagcaccggcatccaggaatgagacttgtttgggagagagctgcgcccccactgtgattcaaaggaggggcagagacgcttgggggcccgggaactctgctcgagatgtcctgcgcgcccgcgcacccagagaggaacagggcgctgccttcctggcgggcccatcgtgggacctcccagcagcgcctggacgagaccccgccgcagggaggggcgccgaggcctccgccgctggccctccaggaccgcctactcggccgcccggcccatggcgttggaaaggcgcacgaggacaggagccttctgagaccctggggagaggaaaccctactgcactgcagctgtttctacaaatcagtgaggaagaggagaaggggccccggggagcaggaatcagtggacggagtcaagagcagtcagtgaaaactgtgcccggagcaagcgatttgttttactggcccagaagggctggcaagctgcagggctctcaccacaagccattgagcaaaaccgccaacggcctggccggccacgaaggttggacaattgccttgccaggacgggccctcgcccagaatggatccctcggagaaggaatccatgaacctgggggtcccaggcgcgggaactcaaccaacaggagggtaagactcaaaaaccccttctatcccctgacccaagagagttatggcgcctacgctgtcatgtgcttgtccgtggtaatctttggcacaggaattatcggcaatctcgccgtgatgtgcattgtgtgtcacaactactatatgagatctatttccaactccctgttggcaaatctcgcattctgggactttctaatcatctttttttgcctgccccttgtgattttccatgagctgacaaagaagtggttgcttgaggactttagttgtaaaatcgttccctacatcgaagtggcttctctgggtgtgaccacttttacattgtgcgccctctgcatagaccgctttagagcggcaactaacgtccagatgtattacgagatgattgaaaattgctcatccaccacggccaaacttgctgtgatctgggtgggggctctgctgttagccttgcctgaggtggttctccgccagctttccaaggaagatcttggctttagtggccgggcaccagccgaaaggtgcataataaaaatttcgccggatctcccagacacgatttatgtgttggcgctgacctacgattctgcacggctatggtggtatttcgggtgctacttctgcctccccaccctgttcaccatcacgtgctctctggtgactgcaaggaagatccgaaaagcagaaaaagcatgtacgcgtggcaacaagcgtcaaatccagctcgagtcccagatgaattgtacagtcgtcgccttaaccatactttacggcttctgtatcatccccgaaaacatctgtaacattgtgaccgcttacatggcgaccggcgtgtctcagcagaccatggacctactaaacataattagtcaattcctcctgtttttcaaaagttgcgtcacgccggtgctgctgttctgcttatgcaaaccgttcagcagagctttcatggagtgctgctgttgttgttgtgaagagtgcattcagaagtccagcaccgtaacttctgacgataatgataatgagtatacgacggagttggaattgtctccttttagcactatccgtagggagatgtcaactttcgcttctgtggggactcattgttag

SEQ ID NO: 117850 - DNA, 1362 bp, Artificial Sequence
  Description of Artificial Sequence: Synthetic coding sequence
atggcgtctccatctctcccgggatccgactgcagccagatcattgaccactctcatgtgcctgagttcgaggttgccacctggattaaaataacgcttattttggtctatctcattatctttgtgatgggattacttggcaactccgccacgattagggtcactcaggtactgcagaagaagggttatctgcagaaggaggtgactgaccacatggtgtcgctagcctgtagcgacattctggtgtttctcatcggcatgcctatggagttctactccattatctggaaccccttaactacatcttcgtacactctcagttgcaagctgcacacctttctttttgaggcctgcagctatgcgacattactgcatgttctcacattgtcattcgagcgatacatagccatctgtcaccccttcaggtataaggctgtgtcgggcccttgccaagtgaaactgctcattgggtttgtgtgggtgacatccgcactggtggctctccccttgttgttcgctatgggaaccgaatacccactcgtgaacgtgcccagtcatcggggtctgacctgtaatcgctcatcgaccaggcatcacgagcagcctgaaaccagcaatatgtccatctgcacaaacctttcttccaggtggaccgtattccagagcagtattttcggcgcgttcgtggtgtacctcgttgtactgctgtcagtggcctttatgtgctggaacatgatgcaggtattaatgaagtctcagaaggggagcctggcaggaggtactagacctccacagttacgcaagtctgagagcgaggagagtcgaacagctcgaaggcaaaccatcatcttcctaagactcatcgtggtgaccctggctgtttgttggatgccgaatcaaatccggcgaattatggccgctgctaagcctaagcacgattggacgaggtcgtatttccgggcctacatgatcctcctgcctttttctgagaccttcttttacctaagcagcgtgatcaatcccctgctgtacacggtttctagccagcagttcagaagggtgttcgtgcaggtcctgtgttgtcgactgagcttacagcatgctaaccacgagaaaaggctgcgcgttcatgctcactcaactacggatagcgctaggttcgtgcagcggccactactctttgcgagtcgaagacagtcaagtgcccggaggacagaaaaaatttttctgagcacatttcagagtgaggccgaaccccagtctaagagtcagagcctttccttagagagtttagagcctaattccggtgcaaagcccgcgaacagcgctgcggaaaacggatttcaagagcacgaagtctag

SEQ ID NO: 117851 - DNA, 1089 bp, Artificial Sequence
  Description of Artificial Sequence: Synthetic coding sequence
atgggcaaccatacatgggaaggctgccatgtggactcccgcgtggaccaccttttcccaccaagtctgtatatctttgtcatcggcgtcgggctgcccactaactgcctggccctttgggctgcttatcgacaagtccagcagagaaacgaactgggggtttatctgatgaatctgagtatcgccgatttattatatatttgcaccctccccctgtgggtcgactacttcctccaccatgacaactggatccacggtcctgggtcctgtaaattgttcgggtttatcttctatacaaacatttatatctctatcgcatttctatgttgtatttcggtggaccgctacctagctgtggctcatcccctccggttcgctaggctgaggagagtgaaaacggccgtcgccgtgtcttccgtggtgtgggcgactgagttgggcgccaattccgcgcccctctttcatgacgagctatttagagacaggtacaaccatactttttgctttgagaaattcccgatggagggttgggtggcttggatgaacttgtaccgcgtgttcgtggggtttttgtttccttgggctctgatgctgctcagctaccggggaatccttagagctgtcaggggatcggtgagtaccgagcgacaggaaaaggccaaaattaaaagattggcgctgagcctcatcgcgatagtcttagtgtgttttgctccatatcacgtgttattactgtctcgatccgctatctatctaggccgtccctgggactgtggattcgaggaacgagtgttttctgcatatcatagctctctggccttcacatctttgaactgtgtggctgatcctattttgtattgtctggtgaatgaaggcgcccgtagcgacgtcgctaaggctcttcacaacctgcttcgtttcctggcctctgataagccccaggaaatggccaatgcaagtctcaccctggagacgccactcaccagtaagaggaactcaaccgctaaagccatgaccggatcttgggcagcaacccccccatctcagggcgatcaggtacagttgaaaatgctccctccagcccaatag

SEQ ID NO: 117852 - DNA, 1041 bp, Artificial Sequence
  Description of Artificial Sequence: Synthetic coding sequence
atggacacaggaccagaccagagctatttcagtgggaatcattggttcgtgttttccgtgtaccttttgacatttctggtcgggctacccctgaacctcctggccctggtcgtttttgtgggcaagctgcgctgtaggcctgtggctgtagacgtcctgttactgaatcttactgcttccgacctcctcctcctcttgtttttgccgtttcgcatggtggaggctgccaacgggatgcattggcccctgccgtttattttgtgccccctgtccggtttcatctttttcaccaccatatatctcacagcactctttctcgcagcagtgtccattgaaaggtttttatccgttgctcatcccctgtggtataagacccgaccccggctcgggcaggccggactggtttcagtggcatgctggctgctggcctccgctcattgttctgtggtgtacgtaattgagtttagtggggacatttctcattcccaagggactaacggcacatgctacctcgaattctggaaagaccaactggctatcctcctaccagtcagactcgagatggcagtggtgctctttgtagtgccgctgattatcacatcctactgctactcgcgactggtttggattctgggtcgcggcgggagccacagacgccagagaagggtcgctggccttgtggccgctacgctcctaaacttcttggtgtgcttcgggccttataacgtgagccatgtggtgggttatatctgcggcgaatcccctgtctggcgtatctacgttacactgctgtccaccctgaatagttgcgttgatccttttgtgtactactttagttcttctgggttccaggcggactttcatgaacttctgaggagactctgtggcctctgggggcagtggcagcaggaaagctcaatggaactcaaggaacagaaggggggtgaggagcaacgtgcagacagacccgcggaaaggaagacatctgaacacagtcagggatgcggaaccggcggccaggtagcctgcgccgaaaattag

SEQ ID NO: 117853 - DNA, 1119 bp, Artificial Sequence
  Description of Artificial Sequence: Synthetic coding sequence
atggcctgcaacagcactagtctggaagcttatacctatctgctgttgaatacttccaatgcctctgatagcggcagcacacagctgccagcacccttgcgcatcagtctagccatcgtgatgctattgatgactgtggtcggcttccttgggaacaccgtcgtctgcattatcgtgtaccagagacccgcaatgagatctgccataaatctcctgctagccactcttgctttcagtgatatcatgctctccctatgttgtatgcctttcacggccgtcacattaatcacggttcgctggcacttcggagaccacttctgccggctatccgctaccctgtactggttcttcgttttagaaggcgtcgccatccttttgatcatatcagtcgatagattcctcatcatcgtgcagagacaggataagctcaaccctcggagggccaaagtcattatagccgtttcatgggtgctgtctttttgtatagccggaccttctctaacaggttggacactcgttgaagtgcccgcccgagccccacagtgcgttctggggtacacagaactgcccgctgatagggcctacgtggtgactctagttgtagcggttttttttgccccctttggtgtgatgctttgcgcttacatgtgtatattgaatacagtgcggaaaaacgcagtgcgggtgcataaccagtctgactccctagacctccgacagctgacgagagccgggctgagaagacttcagagacagcagcaggtcagcgtcgacctatctttcaaaactaaggcctttaccactattttgattctttttgtgggcttttccctgtgttggctcccccattctgtatactcattactgagcgttttttcacagcgcttctactgcggctcatctttctacgcgacatcaacatgcgtgctgtggctctcttacctgaagtctgtgtttaatcctattgtatactgttggagaatcaagaaattcagggaagcgtgcatcgagctgcttcctcagacattccagatcctgcccaaggttcctgaaaggatcagaagacgcattcaaccctccacagtgtatgtctgtaacgagaatcagtctgctgtgtag

SEQ ID NO: 117854 - DNA, 837 bp, Artificial Sequence
  Description of Artificial Sequence: Synthetic coding sequence
atgtccgcacccggatccccggatcaagcatatgacttcctgctgaaattcctgctggtcggggacagggacgtgggcaaaagcgagatcttagaatctctgcaggatggcacagccgagtctccttattcccacctcggtggcatagactataaaacaactacaatactactcgatgggcagagggtgaaactgaagctgtgggatacctccgggcagggccgcttttgtacaatctttaggtcctactctcggggtgcacagggggttattctcgtatacgatatcgccaacagatggtcattcgagggaatggatagatggataaaaaaaatagaagagcacgctccaggagtgcctaagatcctagttggcaaccgactgcacctcgcctttaagcggcaggtgcctcgagaacaagcccaagcatacgctgagcgcctgggtgtgacattcttcgaggtcagcccactgtgcaacttcaatatcatcgagtcatttactgaattggcccgcattgtgctcctgcgacaccgtctaaactggctgggtcggccctctaaggtcctgtcattgcaggacctatgttgccgcactatcgtctcttgtacccctgtgcatcttgtcgacaagctgcctcttcctatcgcactgaggagccacctcaagagcttttccatggccaagggacttaatgctaggatgatgcgcggactgtcctacagcttaaccacttcaagcacgcacaaaaggagctccctttgcaaggtgaaaatcgtgtgtccgccacagtcacctcctaagaattgcaccaggaacagttgcaagatctcgtag

SEQ ID NO: 117855 - DNA, 585 bp, Artificial Sequence
  Description of Artificial Sequence: Synthetic coding sequence
atggttattctcgccgtgaccaaaaataaaaagctccgaaattctgggaacatcttcgtggtttccctgtccgtggctgatatgctggtggctatatatccgtatcccttgatgctgcacgcaatgagcattgggggctgggacctttctcaactgcagtgccagatggtcggctttatcacaggtctgtctgtggtaggttctatattcaatatcgtggctatcgccatcaaccggtactgctatatatgccactcacttcagtacgagaggatcttctcagtgcgcaatacatgcatttacctggtgatcacttggatcatgaccgtgctggcagttctgccaaatatgtatatcggcacgattgagtatgatcctaggacgtatacttgtatcttcaattacctgaacaaccccgtatttaccgtaaccattgtctgtatccatttcgtgctgcccctgcttatagtgggcttttgctatgtgcgaatctggacaaaagtcctagcagccagagatcctgccggccagaaccccgataaccagctagctgaaccaacctccactgctgcctcgaccctgtag

SEQ ID NO: 117856 - DNA, 1086 bp, Artificial Sequence
  Description of Artificial Sequence: Synthetic coding sequence
atgaacgagtccaggtggaccgagtggcggatcctcaatatgtcgtcgggaattgttaacgtctcagaaagacacagttgcccactgggcttcggccactatagcgtggttgatgtctgcatattcgaaaccgtcgtgatcgtattattaacatttctgattatagccggaaatcttacagtcattttcgtgttccactgtgctccgctgctccaccactatacaacaagttactttatccagactatggcttatgccgacttgttcgtaggcgtgtcttgcctcgttcccacactcagccttcttcactatagtaccggagtgcatgagtctctcacttgccaggtgttcggctacattatctctgtgctgaagtccgtgagcatggcttgcctcgcgtgtattagcgtggaccggtatcttgcaatcactaagccgttaagctacaatcaactggttaccccttgtaggctgaggatctgtatcatacttatatggatctacagctgtctgatcttcctccctagcttctttggctggggaaaacctgggtaccacggagatatctttgagtggtgtgctacttcatggctaacttcagcttattttactggcttcatcgtgtgcctcctgtatgctccagcagcattcgttgtctgctttacatatttccacatttttaaaatctgccgccaacacacaaaagagattaacgacaggagggctagattcccatctcacgaggtggatagtagccgcgagactggccatagcccagatagaaggtacgccatggtgttattccggatcaccagcgtattttacatgctatggctgccctatatcatatacttcttactagagtcatctcgcgttctcgacaaccctacattgagcttcctgactacctggctagctatctccaactccttttgcaattgtgttatctatagcctgtcaaattcagttttcaggctggggttgcgacgtctgtctgagaccatgtgcacttcatgtatgtgtgtcaaggaccaggaagcacaagaacctaaacctaggaagcgagcaaactcttgtagcatctag

SEQ ID NO: 117857 - DNA, 960 bp, Artificial Sequence
  Description of Artificial Sequence: Synthetic coding sequence
atgagtcagcagaacacgagcggcgactgcctgttcgacggggtcaacgagttaatgaagacactgcaatttgctgtgcatataccaacatttgtgctgggtctgttgctgaatttactcgccatccacggattcagcactttcctgaagaacagatggccggactatgcggccacttcaatttacatgatcaacctggctgtgtttgacttactcctggtactctcactcccctttaagatggttctctcccaggtacagagtccatttccatcgttgtgtacactggtggaatgtctgtacttcgtctccatgtacggtagcgtgttcactatttgcttcatatccatggacaggttcctggcgatccgatacccattattagtctcacatttgcgctcacctcgaaagatctttggcatttgctgtaccatctgggtcctcgtgtggacaggctccatccctatttattcctttcatgggaaggtggagaaatatatgtgctttcacaacatgtctgatgacacatggagtgcaaaggtatttttccctctggaggtgttcggattcctgcttccaatggggataatgggcttctgctgttcaaggtccatccatatcctgctcggaaggcgcgaccacacacaagattgggtgcaacaaaaagcctgcatctactcaatcgccgccagcctggctgtcttcgtggtgagttttctccccgtgcatctgggatttttcctgcagtttctggtgagaaattcctttatcgtggagtgcagggcgaaacagagcattagcttctttttgcagctgtccatgtgcttttctaatgtgaattgctgcttggatgttttctgctactattttgttatcaaagagtttaggatgaacattcgggctcaccgccccagccgagtacagctggttctgcaggacaccacaattagtagaggctag

SEQ ID NO: 117858 - DNA, 960 bp, Artificial Sequence
  Description of Artificial Sequence: Synthetic coding sequence
atgtcacagcagaatacatccggtgattgtttgttcgatggggtcaatgagctgatgaagacccttcagtttgcagtgcacataccaacgtttgtgttgggcctgctcttgaatctactggccatccacggtttttccaccttcctgaagaatcgctggccagattatgcagcaaccagcatctatatgatcaacctagctgtattcgatttactgctggtactgagtctaccttttaagatggttctttcacaggtccagtctcccttccctagcctctgcactctcgtcgagtgcctgtatttcgtgtctatgtacgggtccgtttttaccatttgtttcatctccatggatagattccttgcgatcagataccctctgctagtatcacatctgcgttcacctcggaagatattcggtatttgctgcactatttgggtcctggtgtggacaggcagcatccccatctatagcttccacggcaaggttgaaaagtatatgtgcttccacaacatgagtgacgacacatggagcgccaaggtgttcttccccctcgaagtattcggctttctgctgcctatgggtattatgggcttttgttgtagccgctctatccacatcttgcttggccgtcgggaccatacccaggactgggtccagcagaaagcttgcatttattcaatcgcagcaagtcttgccgtgtttgttgtgagctttcttccggtgcacctcggcttttttctccaattcctggtgcggaactcatttatcgtggagtgtcgcgcaaagcagtccataagtttttttttacaattatccatgtgcttcagcaatgtcaactgctgcttggacgtcttctgctattacttcgtaatcaaggagttccgtatgaacatccgcgcccaccgccccagccgcgtacagttagtccttcaggataccacaatctctcgaggctag

SEQ ID NO: 117859 - DNA, 729 bp, Artificial Sequence
  Description of Artificial Sequence: Synthetic coding sequence
atgtcccagcagaatacatcaggggactgccttttcgatggcgtcaacgaattaatgaagactctgcagtttgccgtacatatccccacctttgtgttgggccttctcctcaatttgcttgctatccacggtttttcaactttccttaaaaatcgatggcccgactatgcagctaccagcatctatatgatcaacctcgccgtttttgaccttcttctcgtgttgtctctacctttcaagatggtgttatctcaagtgcagagcccctttccatcactgtgcacgctggtggagtgtttgtactttgtgtctatgtacggcagcgtgtttacaatctgctttatctctatggacagattcctggctatcagatatcccctcctcgtctctcatctgaggagccctcgtaagattttcggtatctgctgtaccatctgggtcctggtgtggactgggagcatcccaatctacagctttcacggcaaagtcgaaaaatacatgtgctttcacaatatgagtgatgacacgtggagtgccaaggtctttttcccgctggaggtgtttggatttctattacccatgggaatcatgggtttctgttgcagtaggtccattcatattctcctcggccgccgggaccatacgcaggactgggtgcagcagaaagcctgcatctacagcattgctgcctcattggctgtcttcgtcgtgtcttttttgcctgtgtag

SEQ ID NO: 117860 - DNA, 960 bp, Artificial Sequence
  Description of Artificial Sequence: Synthetic coding sequence
atgtctcagcagaataccagcggagattgcctgttcgacggcgtgaacgaactgatgaagactctgcagtttgccgtccatatcccaacttttgtcctcggccttctactcaatctgttggcaatccacggcttctctaccttcctgaagaaccgctggcccgactatgccgctacctccatatatatgattaatttagccgtgttcgatttactcctagtcctgagcttgccgttcaagatggtactgagtcaggtgcaaagccctttcccttctctatgcactttagtggaatgtctgtacttcgtcagtatgtacggttctgttttcacaatttgtttcatctccatggatagattcctggcaatacgataccccctgctggtctcacacctgaggtctcctcgtaaaatcttcggcatctgttgcaccatctgggtgctagtctggactggatcaatccccatctactcatttcacggaaaagtcgagaagtacatgtgcttccacaatatgagcgacgacacatggtccgccaaagtcttcttccccttggaggtgtttgggtttctgctgccgatggggatcatgggcttctgttgttccaggagtatccacattctactgggacggcgcgatcatacacaggactgggtgcagcaaaaagcatgcatctactcaatagctgcctcactggctgtcttcgtggtctcttttctgccagtgcatctggggttttttttgcagttcctggtgaggaacagtttcatagtcgagtgtagagccaagcaatccatttcctttttcctccagctgagtatgtgcttctccaacgttaattgttgcctcgacgtgttttgttattactttgtgatcaaggaattccggatgaacataagagcacaccgcccatctagagtgcagcttgtgctgcaggacacaactatttcccgagggtag

SEQ ID NO: 117861 - DNA, 1572 bp, Artificial Sequence
  Description of Artificial Sequence: Synthetic coding sequence
atgacccctcaaagcctgctgcagactacgttgtttcttctctccttactgttcttagtgcaaggcgctcatgggcgaggccatagagaagactttcggttctgctcccagcagctgcagtctcttgaaagtaagctcacaagtgtgaggtttatgggcgacatggtttcctttgaggaagatcggattaacgcaaccgtgtggaaactccagcccacggcgggactccaagaccttcacatacactctagacaggaggaagagcaatctgaaatcatggagtacagcgtcctgctgccgaggaccctgttccaaagaaccaagggacgttccggcgaagctgagaaacgcctgctgcttgtcgatttctcaagccaggccctgttccaggacaaaaatagctcacaggtcctgggcgaaaaagtgcttggcatcgttgttcaaaacacaaaggtagccaatctgaccgagcccgtcgtgctaactttccagcaccagcttcagcctaagaatgtcaccttgcaatgcgtgttctgggtggaggacccaacactgagcagcccaggacactggtctagcgcagggtgcgaaacagtgcgacgggagacccagacttcatgtttctgtaaccaccttacctacttcgccgttcttatggtaagttctgtggaggtggacgcagtgcacaagcattatttgagccttctgagctatgtcgggtgcgtggtcagtgccctagcatgcctcgtgactatcgctgcgtacctctgctctagagtgccacttccttgtagaagaaagcctagggattatacaatcaaggtacatatgaaccttcttctggccgtgtttctgctagacacttcctttctactgtcagaacctgtcgcattgaccggcagtgaagcaggttgccgtgccagcgccatctttttgcacttcagccttcttacatgtcttagctggatgggcctggaagggtacaatctttataggctagtcgtagaagtctttggcacatatgtgccagggtatctgttgaagctctccgctatgggctggggatttcctatttttttggtgacactggtggccctcgttgatgtggacaactacggccctattatccttgctgtacacagaacccccgaaggggtgatctaccctagcatgtgctggatccgtgacagtctggtgtcctacattaccaatctcggcttattttccctggtgttcctgtttaacatggctatgctggcaaccatggttgtgcaaattctccgtctacgcccgcacacccaaaagtggtcgcatgttctaaccttactcggattgagcttggtgttggggttaccatgggctttaatcttcttctcctttgcaagcgggaccttccagttagtcgtcctctatctgttctccattatcacctcattccaggggtttttaattttcatttggtattggtccatgaggctgcaggccaggggcggaccttccccattgaagagcaattcggactcagcccggctgcccatcagcagcggcagcacctcgagcagccgcatctag

SEQ ID NO: 117862 - DNA, 2082 bp, Artificial Sequence
  Description of Artificial Sequence: Synthetic coding sequence
atgaccccccagtctctgcttcagacaacgctgttcctactctccttactgttccttgtccagggtgcccacggccggggccatcgggaagacttcaggttttgctcccagcgcaaccagactcacagatcctccctgcactacaaacccactccagatctgcgcatatccattgagaactccgaggaggccctgaccgtccacgctccattcccagctgctcacccagctagtcgttcattccccgatccaaggggcctgtaccacttctgtttatattggaacaggcacgccggtcggctgcacctgctgtatggtaaacgggacttcctactttccgataaggcatcctcattgctgtgcttccagcaccaagaagagagcctggctcagggccctccgcttcttgccaccagtgtaacatcctggtggagtcctcagaacatttctcttccctccgcggctagttttactttcagttttcactctcctccccatactgccgcacacaatgcctccgtggacatgtgtgagcttaaacgcgacttgcagcttctgtcccagttcttgaagcacccacagaaggcctcacgacggccatcagcagcccctgccagtcaacaactgcagtccttagagtccaagctgaccagcgtccgtttcatgggcgacatggtatctttcgaagaggaccgcatcaacgccaccgtgtggaaactgcagcccactgcaggactgcaagatttgcatattcattctcgccaggaagaagaacagtctgagattatggagtattctgtattgttgccccggacactgtttcagcggacaaaaggtagatctggcgaggctgaaaaaaggttgcttcttgttgactttagcagtcaggcgttgttccaggataaaaatagttcccaagtgttgggggagaaagtccttggcattgtagtccaaaatacaaaggtggctaacttgactgaaccagttgtgttgacatttcagcatcagctgcaacctaagaatgtcaccttgcagtgtgttttttgggtggaagaccctacactttcctccccaggtcactggtcatctgctgggtgtgagacagtgcggcgtgagacccagacttcctgtttttgcaatcacctgacctattttgccgtgcttatggtctccagtgtggaagtagatgcggtgcacaagcactatctttctctcctgtcttatgtgggctgtgtcgtcagtgcgctggcctgcctcgtcacaatcgcagcctatttatgcagccgggtacccctgccttgcagacgcaaacccagagattatactataaaggtgcacatgaacctcttgctggccgtgttcctgcttgacaccagtttcctcctgtcagagccggtggcactgacaggcagtgaggctggatgtcgtgcttccgccatcttcctccatttctctttattgacctgcctgagttggatgggcctcgaaggctataacctgtatcgcctggtggtggaggtgtttggcacatatgtgccgggatatctcctgaagttgagcgcaatgggctggggcttccccatcttcctggtaacccttgttgctctggttgacgtggataattatggacctataattctggcagtgcataggacgccagagggcgtgatatacccaagcatgtgctggattcgggacagcctggtcagttacataacgaatctgggactgttcagcttagttttcttgttcaatatggcaatgctagccactatggtggtgcagatacttagattacggccccatactcaaaagtggtcacacgtgctcaccctattgggactgagcctagtactgggcctgccttgggccctgatcttcttcagtttcgctagcggtaccttccagctggtcgtgctgtatctgttttccatcatcacatccttccagggctttctgatttttatttggtactggagcatgagacttcaagcgaggggcggcccctcacccctcaagagtaattcagattccgcacgtctccccatcagtagtggaagcacctccagcagcagaatttag

SEQ ID NO: 117863 - DNA, 2082 bp, Artificial Sequence
  Description of Artificial Sequence: Synthetic coding sequence
atgactcctcagtctctgttgcagactaccctcttccttctcagcctgctttttctggtgcagggagcacacgggcggggccacagagaggactttcgtttctgtagtcaaagaaaccaaactcacaggagtagcctgcactataagcccacccccgatctgcgtatatccatcgaaaattctgaggaggccctcacggtgcacgcaccgtttcccgcagctcaccccgcatcacgtagctttcccgatccccgggggctctaccacttttgtctttactggaataggcatgcggggaggctccaccttttatatgggaagagagactttttgttgagcgacaaggccagctcacttctgtgcttccagcaccaagaggaaagtctggcgcagggcccccctctgcttgcaaccagtgtaacctcatggtggagtccgcaaaacattagtttacccagtgctgcttctttcaccttttctttccacagtccccctcatacagccgcccataatgctagcgtagacatgtgtgagctgaagagagacctccagctgttaagtcagtttttaaaacacccccaaaaagccagtcgacggccatccgcagcccctgcgagccagcagctccagtctcttgaaagtaaattgacatctgtaagattcatgggagatatggtttcctttgaagaggatcggatcaacgcaacagtatggaaactgcagcctactgctgggctccaggatctacatatacatagtcgacaggaggaggagcaaagtgaaattatggaatactctgtcctcctgcctcgcaccctgtttcagcggacaaaggggaggtctggggaggcggagaaacgcctgcttttagtcgacttttcaagccaggccttgttccaagataagaactcttcacaagttctgggcgaaaaggtcctgggaattgtggtgcagaacacaaaggtcgctaatctcaccgagccagtggtgctcaccttccagcaccagctgcagcccaagaatgtgaccctgcagtgcgtattttgggtggaagatcccaccctgagcagtcctggtcattggagcagtgccggatgcgagacagtcagacgggagactcaaaccagctgtttctgcaatcacctgacttacttcgctgtacttatggtctctagcgtggaggtagacgcggtccacaagcattacttgtccctgttaagctacgtgggttgcgttgtgtctgccctggcctgtctagtgacaatagccgcatacttgtgtagcagagtccccctcccctgccggcggaagcccagggactacaccataaaggtccatatgaatctgttgctggccgtgtttctgctggatacatcgttcctcctctccgagccggtggcactaaccgggtcggaagcagggtgtagagcttctgcgatatttctccactttagcctgctcacatgcctgagttggatgggtctggaggggtacaacctatatagacttgtagtggaagtattcgggacatacgtgcctgggtaccttctcaagttgtcggcaatgggctggggcttccccattttccttgtgacactggtggccctcgtggatgtagataactacggcccaatcatacttgcggttcacagaaccccagaaggagtaatctatccttcaatgtgttggatccgcgattctctagtgtcttacatcacgaaccttggactgttttccctggtatttctgtttaatatggcaatgttagccactatggtggtgcagatactgaggctccggccacacacacagaaatggtcacatgtcctcactctactgggtctcagcctggtgctggggctcccttgggccttgattttttttagttttgcctccgggaccttccagctcgtggtgctctatcttttctcaattattaccagcttccagggcttcctgatcttcatttggtattggtccatgaggctccaagcacgcggcgggcctagcccacttaagtcaaactccgactccgccagattacccattagctctggttcaaccagttcttcacgcatttag

SEQ ID NO: 117864 - DNA, 2064 bp, Artificial Sequence
  Description of Artificial Sequence: Synthetic coding sequence
atgactccacaatccctgttacagacaaccctcttccttctctcattgttgtttctggttcagggggcccatggaagaggacaccgcgaagatttccgattttgcagccagagaaaccagacccaccggagcagtcttcactataaaccaacaccggacttgaggatttctatcgagaattcagaagaagcccttaccgttcatgcccctttcccagcggcccacccagcgagccggagcttcccagatccacgtggactgtatcatttttgcttgtattggaatcggcacgccgggaggctgcacttgctatatggaaagagagacttccttttatcagacaaagcatcctccctgttatgtttccagcatcaggaagagagcctcgcccagggaccaccccttctggccaccagcgtgacctcctggtggagccctcagaacatctcactgccgagcgccgctagctttaccttttcatttcacagcccaccacacactgcagcccataacgcatcagtggacatgtgcgagcttaaacgagatctgcagttactgagtcagttcttgaagcatccacaaaaggcctccagacgcccgtccgccgctccagcaagccagcagctccagtctctcgagagtaagctaacgtccgttaggttcatgggggatatggtgagctttgaggaggaccgaatcaacgcaacggtctggaagctgcagcctacagctggtctgcaggaccttcatattcactctcgacaggaagaagagcaaagcgaaataatggagtactccgtgctcctgcccagaactctgtttcagcgcaccaagggcaggtccggagaagccgagaaaagactcttgctagtagacttttcgtcccaagccttgttccaggacaagaatagtagccaagttctgggggagaaagttcttggcattgtcgtgcaaaatacgaaggtggcaaatttaacagaaccagttgttctaacatttcagcaccaactgcaacctaaaaacgttactctacagtgtgtgttctgggtggaggatcccacactaagctcacccggtcactggtcaagcgccggctgcgaaacggtccggcgcgagactcagacaagttgtttctgcaatcatctgacctacttcgcggttcttatggtgagttcagtcgaggtggacgccgttcataagcattatcttagcctgctgagttacgtggggtgcgttgtgtccgccctcgcatgccttgtcactatagctgcatacctctgctcacgaagaaagccgcgagattataccatcaaagtccatatgaatcttttgctggcagtcttcctgctcgatacctctttcctgctctcagaaccagtcgccctgacaggcagcgaggcaggctgtcgggcctctgccattttcttgcactttagcttgctcacctgcctgtcctggatgggcttagagggttataacctttaccggctggtggttgaggtgtttggaacatacgtaccaggctacctcctgaagctttccgccatggggtggggtttccccattttccttgtgaccttagtggccctcgtcgacgtcgacaactatggccctatcatcctggccgtccatcgtactccagagggtgttatctatccaagtatgtgttggatccgggacagcctggtctcctacatcaccaacctgggattgttcagcctggtttttcttttcaatatggccatgctggccactatggtcgtgcaaattctcaggttgaggccccacacacaaaagtggtctcatgtgctgacacttttaggtctgagcctcgtgctcggactaccctgggctttgattttcttttcattcgcatctggaacctttcagctggtagtgctctacctgttttctataattacctccttccagggttttctgatctttatctggtactggagcatgaggctgcaggccaggggagggccctcgcccctcaagtcaaactcagactccgctcggctgcccatttcctccggcagcacatcctcctcgcgcatatag

SEQ ID NO: 117865 - DNA, 2082 bp, Artificial Sequence
  Description of Artificial Sequence: Synthetic coding sequence
atgacaccccagtccctgctgcaaaccacactctttttactctcgctgctgttccttgtacaaggtgcccacggccggggacatagagaagactttcgattctgttctcagcggaatcagacccatcggagctctctgcattacaaacccaccccagatctccgcatatccattgaaaattctgaagaagctctgacggtgcacgctcccttccctgcagcccatccagctagcagatcttttcctgatccccgaggactttatcacttctgtctgtactggaacaggcacgctgggaggttgcatctgctatatggtaagagagatttcctcttgtccgataaagcatcctcgctactgtgtttccagcatcaggaagaaagcctggctcagggaccaccactcctggcgactagcgtgacttcctggtggagcccccagaacatttcactgcctagtgccgcatcatttaccttttcttttcactcaccgcctcacaccgccgcccacaatgcctccgtagatatgtgtgaattgaagagagatctgcaactcctcagccagttcctgaaacacccccagaaagctagtagacgcccctccgcagcacctgcatcacagcagctgcagtccttagagtccaaactcacttctgtgcggtttatgggagacatggtttcattcgaagaggacagaattaacgccactgtctggaagctgcagccaacggcaggcctccaggatctacacatacactctaggcaggaagaggaacagagcgaaatcatggaatactcagtgctactgcccaggactcttttccagaggaccaaggggcgtagcggagaggccgaaaaaagactgttactagtggatttcagttcgcaggctctgttccaagataagaacagctctcaagtgctaggtgaaaaagtcctgggcatcgtagttcagaatacaaaggtagcgaacctaaccgagcctgtcgtgctcacctttcagcaccagcttcagcccaagaacgttactttgcagtgtgtgttctgggttgaagatccaacgttaagttcccctgggcactggtctagtgctgggtgcgaaaccgttcgaagggaaacccagacaagttgcttttgtaaccacctcacgtactttgccgtactgatggtgtctagtgtggaagttgacgctgtccataagcactacttgtcgctgttgagctatgtgggctgcgtggtgagcgccctggcttgtctcgtaactatcgccgcatatctatgttcgagagtgcccctgccgtgtagaagaaaaccacgcgattataccatcaaggtgcacatgaacctgcttttggcagtctttcttctcgatacatccttcctgctgtctgaaccagtcgccctgaccggctctgaagctggttgccgtgcgagcgccattttcttgcacttttcgctgctgacatgtctgtcctggatgggactggagggatacaacttatataggttggtggtggaggtttttggtacctatgttcctggctacctgttaaaattaagcgctatggggtggggcttcccgatttttctggtgaccctcgttgctctagttgacgtggataattacgggccgataattcttgccgtgcacagaacacccgaaggggttatctatccatcgatgtgttggattagagacagcctcgtgtcttacattaccaacctggggctgtttagtcttgtgtttctctttaacatggccatgctcgctacaatggtggtacaaattctcagattgcgcccacacacacagaaatggtcccacgtcctgaccctccttggtctgtcgctagtactggggcttccttgggcactgatctttttctcctttgcatccgggacctttcagctggtggtcctgtacctcttctcaatcatcacaagtttccaagggttcttgatatttatctggtactggtctatgcgcctccaggcgagaggcgggccctctcccctgaagtcaaatagcgactctgctcggctgccgatcagcagcggctccaccagtagttctagaatttag

SEQ ID NO: 117866 - DNA, 2064 bp, Artificial Sequence
  Description of Artificial Sequence: Synthetic coding sequence
atgacccctcagagcctgcttcagaccacactgtttctgctgagcctgctttttctcgttcagggcgcgcacggccgcggtcatagagaagactttaggttctgcagtcagaggaaccagactcacagatcctccctccactataagccaactcccgacctaagaatctctattgagaatagcgaggaggctcttaccgtccatgcccccttccccgcagcacatcccgcctcgcgttcctttcctgaccctagagggctgtaccatttttgcctgtattggaacaggcatgccggcaggctgcacctcctttacggcaagcgcgactttttgttgagtgataaggctagttctctcctgtgtttccagcatcaggaagagtccctcgctcagggccccccactgctcgcaactagcgtcacaagctggtggagtcctcagaacatttccctgcctagtgcagcttcatttacattttcgttccacagtccacctcatactgccgctcacaatgctagcgtggatatgtgcgagttaaagagggatctgcagcttttatctcagtttttgaagcatccccagaaagcctcacggcggcccagcgcagcaccagcctctcaacagctgcagtccttggagtccaaactgaccagcgtgcgttttatgggcgacatggtctccttcgaagaagacaggatcaacgcgaccgtctggaagctccaaccaactgccggccttcaggacctgcatattcattcccgtcaggaggaagaacagtcagagattatggaatactccgttctgctcccaagaactctgttccaacgcaccaagggtcggagtggggaagctgagaagcgcctgctgctggttgatttctcttcccaggcactctttcaggacaaaaacagctctcaagttctcggcgagaaggtcttggggatagtcgtacaaaatactaaagtcgccaatctcacggagcccgttgtactcacattccaacatcagctccagcctaagaacgtcacgctgcagtgcgtgttttgggtcgaggatccaaccctttctagccccggccattggtcctcagctggttgtgagaccgtccgaagagagacccaaaccagttgcttctgtaaccacctgacttattttgccgtgctaatggtatcttccgtggaagtggacgccgtccataaacactatctgagcctgcttagttacgtggggtgtgtcgtttcagctcttgcttgtcttgtgacaatcgccgcctacctctgttctaggcgaaagccgcgagactacacaattaaggtgcacatgaatctgcttctcgccgtgtttctgttagatactagttttcttctgtcagaacccgtagctctgaccgggagcgaggcgggctgccgtgcctccgccattttcctccattttagcctgttaacctgtctgtcctggatgggattagagggctacaacctgtatcgactggtcgtagaggtatttggcacctatgtccctggatacctgcttaaactatcagccatgggctgggggttccctatcttcctcgtcactctggtggcactcgtggacgtcgacaactacggcccaatcatcttggccgttcatcgcacccctgagggtgtgatttatccctccatgtgctggataagggatagcctagtgtcatacattacaaatcttggcctttttagcctcgtattcctgttcaatatggccatgcttgccaccatggtggtacagatcttacgactgcgcccgcacacccagaaatggtcacacgtgctgactctcctgggtttgtccctcgtcctcggtcttccatgggccctcatttttttctccttcgcctctggcactttccagctagtcgtactttacctgttttcaattatcacatcttttcaaggattcctgattttcatctggtattggagcatgcgtcttcaggctagaggaggacccagtccgctgaagtctaattcagactcagctaggctccctatctccagtggtagcacatccagctcccgtatatag

SEQ ID NO: 117867 - DNA, 2064 bp, Artificial Sequence
  Description of Artificial Sequence: Synthetic coding sequence
atgaccccgcaatctctgctccagacgaccctgtttcttctgtcactactttttctggtgcagggtgctcatggacgcggtcatcgcgaagacttccgtttctgcagccagcgcaatcagacccaccgttcctctctacattataagcccacccccgatctgagaattagtatcgagaattctgaggaagcactcacagtccatgctcctttcccggccgcccatcccgctagcaggtcattccctgatccacggggtctctaccacttctgcctgtactggaatcggcatgccggtcgccttcacctgctatacggcaagcgggacttccttctgagtgataaggcaagctctctcctatgtttccagcaccaggaggagtcgctcgcccaaggaccaccccttctggccacatccgtcactagctggtggtcacctcagaacatctcattgccatctgcggccagtttcacatttagctttcattcccctccccacactgctgcacacaatgcttcagtggatatgtgcgaattgaaaagagacctccaactcctctctcaattcttaaagcatccccagaaagcctcccgccggccctcagccgctcccgcttcacagcaacttcagtcgctggagagcaaactcacttctgtgcgttttatgggggatatggtgagtttcgaagaggatcgcataaacgcaacagtgtggaaattgcagcccaccgccggcttgcaagatttgcatattcactccaggcaggaggaggaacaatctgagattatggagtacagcgtgctccttcctcgcacccttttccaacgtacgaaaggccgatcaggggaggcagagaaaaggttgcttcttgtggacttctccagccaggcgctgttccaggacaaaaatagctcacaggtgctcggtgaaaaagtgctgggaattgtggtccaaaatactaaggtggctaacctgacggaacccgtggtgctgacatttcaacatcagttgcagcctaaaaacgttacactgcaatgtgtcttttgggtggaggacccaaccctgtcctcccctggtcattggtcctccgcgggctgtgagactgtgagaagagagacacagacgtcttgcttttgtaaccacctgacctattttgccgttctcatggtgagctccgtggaggtggacgctgtgcacaagcattacctgtcattgttgagttatgtaggttgcgtggtgagtgccctcgcctgtctggtgacaattgcagcttacctatgttcccgccggaaaccgagagactacaccatcaaggtccatatgaatctcttgctggccgtgttcttactcgacacctcctttctattgagcgagcccgtcgccctcacaggctcagaagccggttgccgagcctccgccatttttctacatttctcattacttacatgtctgagttggatgggccttgagggctacaatctgtacagactggtcgtggaagtgtttggtacttacgtcccaggatacctgctgaaactatcagccatgggttggggctttccaatcttcctcgttactctggtggccctcgtggacgtagacaactatggaccaatcattctggccgtgcatcgaacgccagagggagtcatataccccagcatgtgttggatacgggactcactggtgtcctacattaccaacttgggattgttttccctggtgttcttattcaatatggctatgctggctaccatggtagttcaaatcctgcggctgagaccccatacacagaaatggtcacacgtgctgacattacttggcctctcactggtgttaggcctcccttgggccttgatttttttcagtttcgcctcagggacatttcagctggtggtgttatacctcttctcaatcatcaccagcttccagggatttttgatatttatttggtattggagcatgaggttgcaggcaaggggcggcccctcccctttgaagagtaattcggactcagctcgcttacctatctcctccggcagtacatcttcctcccgtatatag

SEQ ID NO: 117868 - DNA, 1539 bp, Artificial Sequence
  Description of Artificial Sequence: Synthetic coding sequence
atgtgtgagttaaagagggacttacagctgctgtcgcagttcttgaagcacccccagaaggctagcagaagaccatcggcagcccccgctagccagcagctgcaatcattggaaagcaagttaacttctgtcaggtttatgggagacatggtgagttttgaagaggatcgcattaatgccaccgtatggaagctgcagcctaccgccggactccaggatttgcacattcacagcaggcaggaggaggaacagagcgaaatcatggagtacagtgttttgttgcctaggactctcttccaacgcaccaaaggaagatccggcgaggccgaaaagagacttctactggttgacttttctagccaggccctgtttcaggacaaaaactcttctcaagtgctgggggaaaaagtgctggggatcgtcgtgcagaacacgaaagtggccaacctgaccgaacccgtggtgctgactttccagcaccagctgcagccaaaaaatgtcactttacagtgcgtgttttgggtggaggaccctacactctcctcaccaggccactggtcctctgcgggatgcgagacagtgagaagggaaacacagacatcttgcttttgtaatcatttaacatacttcgctgtgttgatggtctcatctgtggaggtcgatgctgtgcacaaacactacctctccttgttgtcgtatgttggctgcgtggtttctgccctggcctgcttggtgacaattgccgcgtatttgtgctcacggcggaaacctcgggattatacgatcaaagtgcacatgaatctactgctcgcggtatttttgttagacaccagttttctgctctcagagccagtggcgcttacaggctccgaggccgggtgtagagcttcagccattttcctgcatttctccctgctcacttgcctttcctggatggggctcgagggctacaacctgtatcgcctggtggtggaagtgttcggtacttacgtgcctggttacctgctaaagctgtccgctatgggctgggggttccctatttttctcgtgacactcgttgccctggtggacgtagataattacgggccaatcatactggctgtccatcgaactcctgagggcgtcatttacccaagcatgtgctggatcagagattctcttgtctcctatattactaatctggggctctttagcttggttttcctcttcaacatggccatgcttgccacaatggttgtacagatcttacggctgcgcccacacacacagaaatggtctcatgtgcttaccttacttggactgtccctggtcctgggcctaccatgggcactaatttttttttccttcgctagcggaacattccagctcgtggtactctatctctttagcattataacgtcattccagggcttcctcattttcatttggtactggagcatgagactccaggcgagaggtggcccctcgcctctgaagagcaacagcgacagtgctcgcctgcccatcagctctggttcgacctcttcctcacgcatctag

SEQ ID NO: 117869 - DNA, 2064 bp, Artificial Sequence
  Description of Artificial Sequence: Synthetic coding sequence
atgactccccagtctctgttacagacgacactgttcctgctgtccctcctgttcctcgttcagggagcccatggtcggggccatcgggaggatttccgcttttgtagccaaaggaaccaaactcataggagttctttacactacaagcccacacccgatctcagaattagcatcgaaaattccgaagaagcactcaccgtccacgccccattcccggcagctcatcctgcttcacgctcgttcccggatcctcggggcctgtaccacttttgcctgtattggaacaggcacgcagggagattgcacctgctgtatggaaagcgcgacttcctgctgagtgataaggctagttcccttctgtgcttccaacaccaagaggagtccttggcacagggaccaccactgctagcaacctccgtgacctcgtggtggtcaccccagaatatcagcctcccttcagccgcatctttcacatttagtttccattccccaccccacaccgccgcccacaatgctagcgtagacatgtgtgaattgaaacgagatttacagctgctctcccagttcctgaaacacccacaaaaggcatctagaagaccctccgctgccccagcatcccagcagctgcagagcctcgaaagcaaactgactagtgtgcgcttcatgggagatatggtctccttcgaagaggaccggatcaatgctacagtgtggaagttgcagccaacagcaggcctgcaggacctccatatacactcacgacaggaagaggaacaatctgagatcatggaatactctgtactgctacctaggaccctgttccagaggacaaagggccggtctggcgaagccgagaagagactcttattggtcgacttttcctcgcaggcactctttcaggacaaaaactcaagccaagtcctcggtgaaaaggtgctgggcatcgtcgttcaaaacacaaaggtagccaatctcaccgaaccagtggtcctcacatttcagcaccagctgcagcctaaaaacgtcactttgcagtgcgttttctgggtggaagacccaaccctcagctcccctggccattggtctagtgccggatgcgagacagtgcggcgagagactcagacatcctgcttttgtaaccacctgacctacttcgctgttctgatggtctcctcagtcgaggtggacgctgtacataaacattatctcagtctcctgagttatgtgggttgtgtcgtgagcgcattagcctgcttggtgaccatagccgcttacttgtgcagccggcggaaaccccgcgactacactattaaggtacacatgaaccttctgcttgccgtttttctgctcgataccagctttctcctaagcgagcctgtcgcgcttacagggagcgaggctggctgcagagcaagcgcaatttttttacacttttctctgctcacatgtctttcttggatggggctcgaggggtacaatctttacagactggtggtggaagtttttggcacatatgtccctgggtatctccttaagctcagcgcgatgggatgggggtttccgatttttctcgttacactcgtcgccctggttgacgttgataactatgggccgataatcctggcagtccaccgcacccccgagggcgtgatttacccaagcatgtgttggatcagggacagtctggtgtcctatataaccaacctgggcttgttttccttagtttttctattcaatatggcaatgctggctaccatggtcgtgcagatcctcagactaaggccccatacacagaaatggtcccatgtgctcaccctcttgggactgagtctggtgctcggtcttccatgggctctgattttcttctcctttgcctctggcacattccagttggttgtgttataccttttcagtattattacgtcgtttcagggctttttgatattcatatggtactggagcatgagattgcaggctcgaggaggcccctctccattgaagagcaatagcgattctgcccgcctccctatctccagtggctcgaccagttctagtcgcatatag

SEQ ID NO: 117870 - DNA, 2064 bp, Artificial Sequence
  Description of Artificial Sequence: Synthetic coding sequence
atgacgccacagagccttcttcaaactacattgtttctgctgtcactcctgttcttagtgcagggagcccacggccgggggcacagggaggacttcagattttgttcacaaagaaaccaaacccaccgatcgtcattacattacaagcccaccccagatctgaggattagcattgagaacagcgaagaggcactgaccgtgcacgccccgtttcctgctgcacatccggcctcgcgatcattcccagatcctcgagggctttatcacttctgtctgtactggaatcgccatgccggtagactccacttattatatggcaaacgggacttcctgcttagcgataaagcgtcttctctcctttgcttccaacatcaagaggagtctttagcacagggcccaccactgctcgcgacgtctgtcacttcttggtggtctccacagaacatctccctcccaagcgcagcaagcttcacgttcagctttcactctccacctcatactgcggctcacaatgcatctgtcgacatgtgcgaactcaaaagagacttacagcttctcagccagttcctcaaacatccacagaaggcaagccgccggccatccgccgcacctgcatcacagcaactccagtctttggaatccaagctgacatccgtgagattcatgggagatatggtatccttcgaagaggacagaatcaacgcaacggtgtggaagctccaacctactgcaggtctgcaggaccttcatatccactccaggcaggaggaagaacagtccgagataatggagtattccgtgctcctgcccagaactctctttcaaagaaccaaaggccgctccggggaagctgagaaacgcctgcttctggttgacttttccagtcaggctctgtttcaggataagaacagttcccaagtactcggagagaaagtgctgggaatagttgtccagaacacaaaagtggcaaatcttacagaacccgtggttctgacgtttcaacaccaactccagccaaagaacgtgacactccagtgcgtcttctgggttgaggaccctaccctgtcttcccctggtcattggagctctgctggctgcgagaccgttcgcagagagacccagacttcatgtttctgcaatcacctgacctactttgccgtactgatggtgagcagcgtcgaggtggacgccgtacacaagcattatctgagcctactgagctacgttgggtgtgtggtctcagcactagcctgcctggtgaccatcgccgcgtatctttgcagccggaggaagccaagggattacacaatcaaggtccatatgaacctgctcctggctgtattcctgctggacacctcatttctgctgagtgaacccgttgcactcacaggcagtgaagcagggtgtcgcgcttcggccatttttctgcattttagcctcctaacctgtttgagttggatgggcctggaaggctacaacctgtacagactcgtggtggaggtcttcggcacatacgtccccgggtatctcctcaagttatctgccatgggatggggatttcctatctttctcgttacactggtcgccctggtggacgtcgataactacgggcctattattctcgcggtgcatagaacgcccgaaggagtcatataccccagcatgtgctggatccgggatagcctggtctcttacataacaaatctgggccttttttccctcgtattcctttttaacatggctatgctggctaccatggtggtgcagattttgcgcctgaggcctcacacacagaaatggtctcacgtcctcacgctgctcggcctcagcctggtgttgggtctaccctgggccctgatattcttttctttcgcgtctggtactttccagctggttgtcctctatctgttctctataattacatcctttcagggctttctgatttttatctggtattggagcatgcggctccaggcgaggggggggccctcccctcttaaatccaacagcgactcagcacgcctgcccatctcctccgggtctacttctagcagccgaatatag

SEQ ID NO: 117871 - DNA, 1089 bp, Artificial Sequence
  Description of Artificial Sequence: Synthetic coding sequence
atgaatgccagcgccgcatcgcttaatgattcccaggtggtggtcgtcgctgcagagggggcagcagccgcagcaactgcggcaggaggtccagacacaggagagtggggtccaccagctgctgcggcactcggagctggtggaggagccaacggcagcctggaactcagcagccagctttccgccgggcctcccggtctcctgctgcctgcggtcaatccctgggacgttctgctgtgcgtctctgggaccgttatcgctggggagaatgcattggttgtggcgcttatcgcgtctactcctgccctccgaaccccgatgttcgtactggttggatccctggctaccgccgatcttctggctgggtgcggacttatcttgcatttcgtttttcagtatttagtgccatctgagacagtgtctctcctgaccgtgggatttttggtggcttcattcgcagcttctgtcagttccctgctggctatcaccgtggataggtacttgtccctgtacaacgcactcacatattattcccggaggactctcctcggcgtgcacctgctgctggcagctacatggacagtcagcctgggcctgggcttactgcccgtcttgggatggaactgcctggcagagcgggccgcatgctccgtagtacgtcccctagccaggtcccatgtggccttattgagtgcggctttttttatggtcttcgggatcatgttgcacttgtatgtccgcatttgccaggtggtgtggcgacacgcccatcagatcgcattgcagcagcactgcctggcgccccctcatctggccgccacaaggaaaggcgttggaacactcgccgtggtcttgggcacatttggcgcttcatggctgccgtttgctatttactgcgtggtcggcagtcacgaggaccctgctgtttatacctatgcaaccctgctgccagctacttacaatagcatgattaatcccattatctatgcgttccgaaaccaggaaattcagcgcgctctctggctcctgctatgcggctgctttcagagtaaagtgccctttaggagccgcagtccgtctgaggtctag

SEQ ID NO: 117872 - DNA, 1134 bp, Artificial Sequence
  Description of Artificial Sequence: Synthetic coding sequence
atgaccctcctcgcgtggtgcacccggggagccaatcctgccgccatgaatgcgagtgccgctagcctcaacgactcacaagtggtggtcgtggcggccgagggagctgcggcagctgctacagcggcagggggcccggacactggggagtggggacctccggctgcggctgcattaggcgccggcggcggtgcgaatggaagcctggagcttagctcacagttgtctgccggaccccccgggctgttgctccctgcagttaatccttgggacgtgctgctgtgcgtgtctggaacggtgattgccggtgagaatgcgctcgtcgtggctctaatcgcgtcaacccccgcactgaggaccccgatgtttgtgcttgttgggagtctggcaactgctgacttactggctggatgcggcctgattctccatttcgtgtttcagtatcttgtccccagtgagactgtctccttacttacggttggatttcttgtggcgagcttcgcagcatccgtgagcagcttacttgccattacagtggaccgctacctgagtctctacaatgccttgacatattactctaggaggaccttgctcggcgtgcatctcctgttggcagctacttggaccgttagtctgggactgggcctacttcccgtcctcggatggaactgccttgctgaaagagcagcctgttctgtggtgcgtcctttagctagaagtcacgtagccctgctgtctgccgctttcttcatggtctttggcattatgcttcacttatacgtcaggatctgtcaagtcgtctggaggcacgcacatcagattgccctccagcagcactgccttgcaccccctcatttagcagcgaccagaaaaggggtcggcaccctggctgtcgtattgggaactttcggtgccagttggcttccattcgccatatattgcgtcgtgggttctcacgaggaccccgctgtgtatacttacgctactctgttgcccgcaacgtacaacagcatgatcaatccaatcatctatgcttttagaaatcaggaaattcagcgtgccctctggctcctgttgtgtggttgctttcagtcgaaggtccccttccggtcaaggagtccgtctgaggtgtag

SEQ ID NO: 117873 - DNA, 1023 bp, Artificial Sequence
  Description of Artificial Sequence: Synthetic coding sequence
atgaacgcttcagcagcctcgttaaacgactcccaggtagtcgtagtcgctgcagagggggctgctgctgctgctacagctgctggtggaccagacacaggagagtggggcccaccagcggctgcggccctaggggccggaggcggagccaatgggagcttggagctttccagccagctgagcgccggtccccccggactgcttctgccggccgtgaatccttgggacgtgttgttgtgcgttagcggtaccgtgattgccggcgaaaacgccctcgtggtcgctctgatcgctagcactcctgcacttcgcacgccaatgtttgtactcgttggcagtttagctactgcagatctgttagctggatgcggcttgatattgcactttgtcttccaatatctcgtgcccagtgagactgtctcattgctgaccgtggggtttcttgtagcatccttcgccgccagtgtgtcatctctgctggctattaccgtagatagatacctttcactttacaacgcgctcacatactactccaggcgcactttgctcggtgtgcaccttcttctcgctgctacttggactgttagcctcggcctgggactgctccctgtgctcggttggaactgcctggcggagcgggccgcatgcagtgtggtgcgtccactcgctcgatctcacgtggccctgctttccgcagcctttttcatggtgttcgggatcatgcttcacttgtatgtaaggatttgtcaggtggtttggcgccatgctcaccagatcgccctgcagcagcactgtttagctccaccccatcttgccgcgacgaggaagggggtcggaaccctggccgtggttttgggaacctttggtgcgagttggctgccgtttgctacctacaattcgatgataaatcccatcatctacgctttcagaaaccaagaaatccaacgcgccctatggctgcttctgtgcgggtgctttcagtccaaggtgcccttcagatcccggagcccctccgaagtgtag

SEQ ID NO: 117874 - DNA, 1740 bp, Artificial Sequence
  Description of Artificial Sequence: Synthetic coding sequence
aacccacggctcacagtgctcgagcgggttgaaggctatggagaacaggaatggcagaaaggcgatggcaagggacgtggagaagggcattccgagtctggtgtgctgtccggctccggcagctgcacgtcgcatgtgtcttgcttccttgccgtaacgaaggccgatcctgccgccacctctgggcagaaaggcgatgagcttctaattctccagctgcctgggttggccctctgcacccaaaccaatttacctaaacggcttcaatgggaggtaccacccaccaaacctgggtctctcggcttaggcagtccgagtcaggggaggtggacacggatgggggatggaccacaagaggtgccctgggtgccctcgtttggaccaatggagtcaagtcccattcctcagtctagcggcaacagctccaccctcgggcgcgtcccacagacgcccggcccctctacggcctccggcgtccctgaagtagggctccgcgacgtcgcctccgagtcagttgccctgttctttatgctgcttctagatctgactgccgttgccggaaatgcggctgtcatggccgttatagcaaaaactcccgccctgcggaagttcgtgtttgtatttcacttgtgcctcgtggacttactggcggccctcacgttgatgcccctggcaatgctaagctcctcagccctgttcgatcacgcgctgtttggagaggttgcctgtcgtctttacttgttcctgtcagtttgcttcgttagcttagccatactgtctgtgagcgccatcaacgtggaaaggtactattatgtggtgcacccgatgagatatgaagtacggatgaccctggggctcgtggcatctgtattggtgggtgtgtgggttaaagcgcttgcaatggcgagtgttcctgtgctagggcgggttagctgggaggagggtgctccttccgtaccaccgggatgttccttgcagtggtcacatagcgcctattgtcaactctttgtggtggtgtttgccgtactgtactttctgctgcctctgctgctaattcttgttgtctattgttccatgtttagagtcgccagagtcgctgctatgcagcatggtccccttcctacttggatggaaacgcccagacagcgatcagaatccctgagtagcagaagcactatggttaccagctcaggggccccgcaaaccacacctcatcgtacatttggaggcggaaaagctgctgtggtccttctggcagttggaggtcagtttctgctgtgttggcttccgtacttcagcttccacctttacgttgccctgtccgcccagcctattagcacaggacaggtggagagtgtggtgacttggattggatatttctgttttacttccaaccccttcttctacggatgcctgaaccgacagatcagaggggaactttcaaagcaatttgtttgcttcttcaagcctgcccctgaggaagagctcagattaccttccagggagggaagtatcgaagaaaattttctccaatttcttcagggtacaggatgccccagcgaatcctgggtgtcccgtccactgccctctcccaagcaggagccaccggcagtagatttcaggattcccggccaaatcgccgaggaaacctccgagttcttagagcaacagctgacttccgatatcatcatgtcagacagctacctccgcccagcagcaagtcctcgactcgaatcatag

SEQ ID NO: 117875 - DNA, 1356 bp, Artificial Sequence
  Description of Artificial Sequence: Synthetic coding sequence
atggagagctctccgataccccaatctagcggcaacagttctaccctgggaagggtgccacagaccccaggaccttcaaccgctagtggcgtgcccgaggtggggctgagagacgtagcgtctgagagtgtggccctgtttttcatgctgcttctggatttgacagcagtggcaggaaacgccgcggtaatggctgtcattgcaaagacccctgccttacgaaaatttgtgttcgtgttccatctctgcctggttgatttgctcgccgcattgacactcatgcccctcgctatgctctctagctctgcactttttgatcatgctctcttcggggaggtagcctgtaggctgtacttgttcctgtccgtttgcttcgtgtccctggctatcttgagcgtgtctgcaatcaatgtagaacggtactactacgtggtgcatccaatgagatacgaggttcgcatgacattaggtttagttgctagtgtcttggtcggagtttgggtcaaggctctggctatggcttccgtgccggtgctggggagggtgagttgggaagagggtgctccctccgtaccccctggatgttccctgcagtggagccactctgcctactgccagctgtttgtggtggtcttcgctgtcctgtactttttgctgcccctcctgctgattctagtggtctactgtagcatgttcagagtggccagagtcgcagctatgcaacatggacccctacccacatggatggaaaccccgagacagaggtcagagagcctctccagccgcagcactatggtaacctccagcggagccccgcagactacgccccatcgcacttttgggggggggaaagctgccgtggtgctgctggccgtggggggtcagttcctcctctgttggctgccctatttttcctttcatctgtatgtcgctttatcagcccaacctatctccaccgggcaggtggagagtgtggtaacttggatcgggtacttttgctttacctctaatccgttcttctacggatgtcttaaccgccagataaggggcgagctatcaaaacagtttgtttgtttttttaagccagcaccggaggaggagcttcggttgccctcccgcgaagggtcaattgaggagaattttttgcagtttctccagggaaccggatgcccctccgaaagctgggtctcaagaccccttccttccccgaagcaagagccccccgcggtcgacttcaggattcccgggcagatagccgaagaaacaagtgagtttcttgagcaacaactcacaagcgacattattatgtctgacagttatcttagacccgcggctagccctcgattggaatcttag

SEQ ID NO: 117876 - DNA, 1356 bp, Artificial Sequence
  Description of Artificial Sequence: Synthetic coding sequence
atggagtcgagccccatcccacagtcttctgggaattcttcaacgcttggacgggtgccccagactccagggccttccactgcgagcggggtcccagaggtcggcctcagggacgttgcaagcgaatctgttgccctgtttttcatgctcctgttagacctgaccgctgtggctggaaatgctgctgttatggccgtgatcgccaaaactcccgccctgcgtaaatttgtgttcgtatttcatctgtgtcttgtggatctattagccgccctcactttaatgcctttggcaatgctgtcttcttctgctctgttcgaccatgcgctgttcggggaagtggcatgccgactgtatctgtttctgtccgtgtgtttcgtctctctggctattttgagcgtcagtgctatcaacgttgaacggtactattatgtggtgcaccccatgaggtatgaggtgagaatgaccttgggacttgtggctagtgtactagtgggcgtttgggtgaaggcactagccatggctagcgtccccgtgcttggcagagtctcttgggaggagggcgccccttcggtgcctccaggctgctcgcttcaatggtctcactcggcctactgtcagctcttcgttgtagtgtttgccgtgttatacttcctgctccctttactgttaatcttagtggtctattgtagtatgttccgtgtagcgagggtggccgccatgcagcatgggcctctgccaacctggatggaaactccccgccagcgaagcgaaagcctgtcgagtagatctaccatggtgacatctagtggggccccacaaaccacaccccaccgaaccttcggaggtggaaaagctgccgtggttctcctcgcggttggcggccagtttctgttatgctggctgccatatttctcttttcacctgtacgtcgccctatctgcacagcctatcagcaccggccaggtcgagtctgtggttacctggatcggttatttctgttttacttctaacccctttttctatggatgtctgaaccggcaaatccggggtgagctatctaagcagtttgtttgcttttttaaacccgcaccagaagaagagctgaggcttccttcacgcgagggcagcattgaagagaacttccttcaattcttgcaagggacaggctgcccctcggagagctgggtaagtcggccactcccttcacctaaacaggagccccctgcggtggatttcaggattccgggtcagatagcagaggagacctccgaattcctggagcaacagctgacaagtgacattataatgagtgatagctatctgcgtcctgccgcctcgcccagactggagtcctag

SEQ ID NO: 117877 - DNA, 1356 bp, Artificial Sequence
  Description of Artificial Sequence: Synthetic coding sequence
atggagagttcacctattccgcagtctagtggcaactccagtacactgggaagagtgccccagacccctgggcccagtacggctagcggtgtgccagaagttggcctgcgtgacgtggcatccgaaagcgtggccctgttctttatgcttctgctggacctgactgccgtggcggggaatgcagccgttatggcagttattgcaaaaacccccgctctgcggaaatttgtttttgtctttcacctgtgcttggtggacttactagcagcactcactctgatgcccttggctatgctgtcctctagtgctctctttgatcacgcgttgtttggggaggttgcatgtaggctgtacctgtttctctccgtttgcttcgtttcgttggctatcctgtcagtgtcagcgattaacgttgagcggtattactacgtggtgcatcctatgcggtacgaagtcagaatgacgctcgggctggtcgcctccgttctcgttggcgtatgggtgaaggctctagcaatggcctccgtcccagtccttggtcgagtcagctgggaagagggagctccctccgttccgccagggtgctctctgcaatggtctcattcggcatattgccagctcttcgtggtagtgtttgcagtgctgtactttttgctgccactgctactaattttggtggtttattgctcaatgtttcgggtagctcgtgtggctgcaatgcagcatggcccactgcccacttggatggagactcccagacagcggtctgagagtcttagctctcggtccaccatggtgaccagctccggcgcacctcagaccaccccccataggacctttggcggcggtaaagcagctgtggtgctactcgcagtcggagggcagtttctgctgtgttggctgccatatttcagtttccatttgtacgtagccttatcagcccagccaatctctaccggccaagtggagagcgtggtgacttggataggttacttttgctttaccagcaatcccttcttctacgggtgtctcaatcggcagattcgcggagagctctcaaagcagtttgtctgtttttttaagcctgctccggaggaggaacttaggctgccttcacgcgagggctcaattgaggagaactttttacagttcctgcagggaacaggctgtcctagcgagagctgggtctcgaggcctttgccatccccgaagcaggaacctcctgccgttgattttaggattcccggacagattgccgaagagaccagcgaattcctcgaacagcagctgacttcggatataattatgtcagattcataccttcggcctgctgcctctcctagattggagagctag

SEQ ID NO: 117878 - DNA, 1107 bp, Artificial Sequence
  Description of Artificial Sequence: Synthetic coding sequence
atggccaacagcactgggttgaatgccagcgaggtggctggatcactggggctaatcttagcggccgtggtggaagtcggagcactcctgggaaatggagcactgcttgtggtagtgttgcgcactcctgggttgcgtgatgctctgtatctagcccatctttgtgtggtggatctgctggctgctgctagcatcatgcccctagggctgctcgccgccccccccccaggcctgggacgggtacgcctaggtcctgcgccttgcagagctgcacgcttcttaagcgcagcactgctgcccgcttgtaccttaggtgtggctgccctgggccttgcaaggtatcggttgatagtgcatcctctcagacctggatccaggcccccccctgtgctcgtgctgacagccgtatgggctgctgcaggactgctgggcgctttgagtctgttgggcaccccgcccgctccaccaccggcacctgctcgctgctcggttcttgccggaggcctcgggcctttccggccgctctgggcactcttggcgtttgccctgccagctcttctgctcttgggagcctacgggggtattttcgtcgtggcacggcgcgcagccctgagacctcctagacccgcccgcgggtctcgtctccactcagacagcctcgattcacggctttctatcttacccccactacggccacggctgccaggcggcaaggccgcccttgccccagccctagccgtgggccagtttgcagcatgctggctgccatatggttgtgcctgcctggctccggcggcccgcgctgccgaagcagaggccgcagtcacctgggttgcctatagcgcattcgccgcacacccctttctgtacggtctcctgcaaagacctgtgaggctcgccttgggcaggctgagccggcgtgccctgcccggccccgtgagagcatgcactccccaggcctggcatccacgggctctgctgcaatgccttcagagaccacctgaaggacctgcagtcggcccttccgaagctccagaacagacccccgagctagctggaggtcgtagtcccgcctaccaggggccaccagagagctcactgagttag

SEQ ID NO: 117879 - DNA, 1434 bp, Artificial Sequence
  Description of Artificial Sequence: Synthetic coding sequence
atggcaaatatgcaaggactggtggagcgccttgaaagggctgtgtcccgcctggagtcgctgagtgcggaatcccaccggccacccgggaactgtggagaagtaaacggggtcattgctggagtggcccctagcgtcgaagcattcgataagctgatggattccatggttgcagagttcctgaaaaacagtcggatccttgccggcgacgttgagacgcatgccgagatggttcacagcgccttccaagcacaacgggcgttcctgctgatggctagccagtatcaacaaccacacgaaaatgacgtggcagcgttgctcaagcctatttcagagaaaatccaggaaatccaaaccttcagagaaaggaaccgcggctctaatatgtttaaccaccttagcgccgtctctgaaagcattcctgcactgggttggatcgccgtgtctcccaaaccgggaccttacgtgaaagagatgaatgacgcggccacattctatacgaaccgggttcttaaggactataaacactcagacctgcgccatgtcgactgggtgaagagctatctgaacatctggagtgaactgcaggcatacattaaggagcaccacaccacggggctgacctggtctaaaacagggcccgtggcgtcgaccgtttctgccttttccgtcctgtctagcggcccaggtttgcctccaccaccccctcctctgccccctcctgggccccctcctctgtttgagaacgagggcaaaaaggaggagtcctcccccagtcggagcgcactgttcgctcagctaaaccaaggggaagctatcacaaagggcctgaggcatgtgacagatgaccaaaaaacatacaaaaacccctctctcagggcccaaggtggccagacccaatctcccactaagtcacatacacccagccctaccagcccgaaatcgtatcccagccagaagcacgctcctgtactggagctcgagggaaaaaagtggcgcgtggagtaccaggaggataggaacgatctggtgataagtgaaaccgaactaaagcaggtggcctacatctttaaatgcgaaaagagcaccattcagattaagggtaaggtcaacagcatcatcatagacaactgcaaaaaattaggcttggtgttcgacaacgtggtcgggattgtggaggtcatcaactctcaggacatacagatccaggtgatgggccgtgtcccaacgatctccattaataagaccgaaggctgtcacatatatctctctgaagatgctctggattgcgagatagtgtccgcaaaaagctctgaaatgaatatcctgatcccacaggatggggactaccgtgaatttcctatccccgaacaattcaaaacagcatgggatggctccaagcttatcacggagcctgctgagattatggcctag

SEQ ID NO: 117880 - DNA, 1260 bp, Artificial Sequence
  Description of Artificial Sequence: Synthetic coding sequence
atggtgttctccgctgtgcttacagccttccatactgggactagtaatacaacctttgttgtctatgagaacacttatatgaatattacattgcccccccccttccaacatccagacctgtcgcctttactgagatatagtttcgagacgatggcgcctaccggattgtcctctctgaccgtgaatagtaccgccgtgcccaccactccggcagcatttaagagtttgaacctgcccctgcaaattacactgtccgcgatcatgattttcatcttattcgtaagttttctggggaacctagtcgtctgcctcatggtatatcagaaggctgccatgcgctcagccataaatatcttactcgcgtctctcgcctttgccgacatgctgttggccgtcttgaatatgcccttcgcgctggtgactatcttgacaacacgatggatattcggaaaattcttctgccgggtgtccgctatgttcttctggctcttcgtgatagagggggttgccatcttattgattatctcgatagatcgctttttaatcatcgtccaacggcaggacaagctgaatccctacagagcaaaggttctgatagctgtaagctgggctactagtttttgcgtggctttcccccttgctgtgggaaaccctgacctgcagatccccagccgtgccccccagtgtgtgttcggttatacaacaaacccgggatatcaggcatacgttattctgataagcctgattagtttctttatcccattcttggtcattctgtactcatttatgggtatcctcaataccctgcgccacaatgctcttagaatccacagctatccagagggcatttgcctgagtcaggcctctaaactgggcctcatgtcgctccagcgaccctttcagatgtccattgacatggggttcaaaacacgagcttttacaacaattctgatccttttcgccgtctttattgtttgttgggctccgtttacaacctacagcctcgtggcgactttttccaagcacttttattatcaacataatttctttgaaatttcaacttggcttctgtggctctgttatttaaaaagtgccctcaatccattgatttactattggcggattaagaaattccatgatgcttgcctggacatgatgccgaaatctttcaagtttctgccacaacttccaggccacacaaaacgccggatacgtcccagcgccgtgtacgtgtgtggcgaacacagaacagtggtctag

SEQ ID NO: 117881 - DNA, 1260 bp, Artificial Sequence
  Description of Artificial Sequence: Synthetic coding sequence
atggtcttttccgcggtcttaacggctttccatactggcactagcaataccacttttgtggtttatgaaaatacgtatatgaacattacgttaccaccgccctttcagcacccagatctgtccccgctcctgaggtatagttttgagacaatggcgccaaccggactgtccagccttaccgttaattccaccgcggtccctaccacccccgccgcctttaagtctctgaacctgcccctacagatcactctttcagccattatgatcttcatcttatttgtttcttttttgggaaatttggtcgtttgcctgatggtgtaccaaaaggccgctatgcgatcagcgattaacattctactggcaagccttgcatttgccgatatgttactcgccgttttgaacatgccctttgcactggtcactattctgactacgagatggattttcgggaagtttttctgcagagttagcgccatgtttttttggctgttcgtcattgaaggggtcgccatcctgcttatcatatctattgacagattcctaatcatagtgcagaggcaggataaacttaatccttatagagccaaagtgctgattgcggttagttgggctaccagtttttgtgttgcttttcccctcgccgttggcaacccagatcttcagatccctagccgcgcaccacagtgcgtatttgggtacactaccaatcccgggtatcaggcttacgtgattcttatttcacttatctccttttttatcccgttcctcgtgatcctctattcattcatggggatactgaataccctgcggcataatgccctgcggatccattcttatcctgagggtatatgcctttctcaggcatcgaaacttgggttaatgagtctgcagcggccttttcaaatgtccattgacatgggtttcaaaactcgtgccttcacaactatcttgatactgttcgcagtcttcattgtttgttgggccccattcaccacctacagcttggtcgctacgtttagcaagcacttctactaccaacataatttctttgaaatcagcacatggctcctctggttatgttatttaaagtccgcgctgaaccccctgatctactattggagaattaagaagtttcacgacgcatgcttggatatgatgcctaaaagttttaagtttcttcctcagctccctggccacaccaaacgtcgcattaggcccagtgcagtgtacgtatgcggtgagcatcgtactgtagtgtag

SEQ ID NO: 117882 - DNA, 1332 bp, Artificial Sequence
  Description of Artificial Sequence: Synthetic coding sequence
tattgttgcagcgtgctaaagtgcctaaaaaacagttgcatcagtgcttgcatttttcacccaacggagactatggtgtttagcgcagttcttactgccttccacactggtacaagcaatacaacctttgttgtgtacgaaaacacctacatgaacatcacccttccaccaccttttcagcatcccgacctctcgcctctcctgcggtacagctttgaaacgatggcccccacagggttatcctctcttactgttaacagcaccgcagtcccaaccacgcccgctgcatttaagagccttaatctccccctgcaaatcaccctcagcgccatcatgattttcattctgtttgtctcgttcttagggaatttagtcgtatgtttgatggtatatcagaaagcagccatgcgtagtgcaatcaacatcctcctggccagcctggcctttgccgatatgttgttagctgtgttgaacatgcctttcgctctggtaactatcctgacaacccgctggattttcggaaaattcttctgtcgcgtttccgcaatgtttttctggttattcgtgattgaaggagtggctatactcctaatcatcagtatagacagatttctgattattgtgcaaaggcaggacaaactgaatccttacagggcaaaagttctaatcgccgtctcatgggctaccagtttttgcgtcgccttcccactggcggttggcaaccccgacctgcagatacctagccgggctccccagtgcgtgtttggctataccacaaatcccgggtaccaagcatacgtgattctcatttccttaatcagtttctttatacctttcctggtgattctgtattcgtttatgggcatcttaaataccctcaggcacaacgccctgcggattcacagttatccagaggggatttgcctgtcacaggcctccaaattaggacttatgtctctacagcggcctttccaaatgtccatcgatatggggtttaagacccgagcatttactacaatactcattctttttgcagtgtttatcgtgtgttgggcaccttttactacttacagccttgtcgctaccttcagcaaacacttctattaccagcataacttcttcgagattagtacatggctgctgtggctttgctatcttaagtctgctctgaatcccctgatctattactggcgcatcaagaagtttcacgacgcctgtctagacatgatgcccaagtcttttaagttcctgcctcagctgcccggccacactaaaaggaggatcaggccgtcagctgtttatgtgtgcggggaacatcggacagtggtctag

SEQ ID NO: 117883 - DNA, 2697 bp, Artificial Sequence
  Description of Artificial Sequence: Synthetic coding sequence
atggttttttcagtaagacagtgtggccatgtgggtcggaccgaggaggtactgctgaccttcaaaatattcttggtcatcatctgtctgcacgttgtactcgtgactagcctggaggaggacaccgacaacagttcgcttagtcctccccccgaggtggagacaaccagtcttaatgacgtgaccctaagtttgctgccatctaacgagaccggcgtaaagccccagaggaacatttgcaacctgtcttcgatctgtaatgactccgcctttttcaggggcgagataatgttccagtatgacaaggagtcaacggtgcctcaaaatcagcacatcaccaatggtaccttgacaggggtgctctccctatcagagctcaaaaggtcagagctgaataagacattacaaacactttctgagacatatttcatcatgtgcgcaacagcagaggctcagagtacactgaactgtacatttaccatcaagctgaacaatactatgaacgcctgtgccgttattgccgctcttgagcgggtgaagatcagacctatggaacattgctgctgctctgtacggattccttgtccttcaagcccagaggaattggaaaagctgcagtgcgaccttcaagatccgattgtgtgtctggctgatcatcctagaggtccccctttttcctcatcccagtcaatccctgtagtcccgagggctacagttctgagtcaagtacccaaagccaccagcttcgccgaaccacccgattattctccagtgacacacaacgttccatcccccatcggggaaatccagcccctgtcgccacagccgtcagctcctatagcctcttcgccagccattgatatgcctccgcaatccgagaccatcagttcccccatgcctcagacacacgtttcaggtactccaccccctgtcaaggcaagcttttcgagtccaacagtgagtgctcctgcaaatgtaaacaccacatcggctccacccgtgcagacagacatcgtcaatacttccagcatatctgaccttgaaaaccaggtactccagatggaaaaagccctgagtctaggaagtcttgaaccaaatcttgccggggagatgataaatcaggtgagcagactgctgcactcgcctccagatatgctggctcccctggcacagcgcttattgaaggttgtggacgatatcggtcttcagcttaacttttcgaacaccaccatcagcctcacttctccttcactcgccctcgctgtgatccgggtcaatgcctcttcatttaacacaaccacctttgtcgctcaggaccctgccaatctccaagatgagctgacggtacggtgcgttttttgggatttagggcgaaatggtggccggggagggtggagcgacaacggatgtagcgtgaaggaccggcggctgaatgagaccatatgcacctgttcgcatctgacgtctttcggagtcctcctggacctctctagaaccagtgtgcttccagcgcagatgatggcgctgacatttatcacctacattgggtgtgggctttcaagtattttcctgtcagtcactcttgttacgtatattgccttcgaaaagatcaggcgagattaccccagcaaaatcttaattcaactttgcgccgcgctgctgctcctgaatctcgtgtttcttttagatagttggatcgccctgtacaagatgcaaggcctgtgtatcagtgtcgccgtattcttgcattattttctgctggtgtccttcacatggatgggcctggaagcctttcatatgtatctggccctcgtgaaggtttttaatacatacatccggaaatacatcctcaaattttgtatcgtgggatggggagtacctgctgtggttgtgacgattatcctcactatatcacctgacaattatgggctgggctcttacggcaagtttccaaatggttcccccgacgatttttgctggatcaataacaatgccgttttctacatcacagtggtcggctacttctgtgtgatcttcctgctgaatgtgtctatgttcattgtggtcctcgtgcagctgtgccggatcaagaagaagaaacagctgggcgcacaacgaaagacgtcgatccaggacctcaggtctatcgctggcctgacgttcctactgggaatcacttggggattcgcgttcttcgcctggggtcctgtgaatgtaacgtttatgtatctgttcgccatcttcaacacacttcagggctttttcatattcatcttctactgtgtggcaaaagagaatgtgcgaaagcaatggcggaggtacctctgctgcggaaaattacgacttgcagagaacagtgactggtctaaaacggcaacaaatggcttgaagaagcagacggtaaatcaaggcgtaagtagctcttctaactccctgcaaagctcatctaactcgactaactctaccaccttgttagtcaataatgattgttctgttcacgcttccggtaacggcaatgcttctactgaacgaaatggtgtgtcattctccgtccaaaatggagacgtatgtctgcacgacttcaccggcaaacagcacatgttcaatgagaaagaagacagctgcaatggaaagggtcgcatggctctccgcagaacaagcaaacgcggatccttacacttcatcgaacagatgtag

SEQ ID NO: 117884 - DNA, 3006 bp, Artificial Sequence
  Description of Artificial Sequence: Synthetic coding sequence
atggtgttttctgtcaggcaatgtggccatgtcggacggacagaagaagtcctactcacattcaaaatatttttagtgatcatttgtctgcatgtcgtcctggtcacctcactcgaggaggacacagacaattccagtctctctccgccgcccgacgaggagactggtgcgtgttccgacgtgacactatcactgctccccagcaatgagacagagaaaacgaagataactatcgtaaagaccttcaatgcttccggcgtgaagcctcagcggaatatatgtaatttatcaagtatatgcaacgatagcgctttcttccggggcgaaattatgtttcagtacgataaggaatccactgtaccccagaatcagcacatcactaacggaaccttaactggtgtccttagcctcagcgaactgaagaggtcagaacttaataaaacactgcaaacgctgtccgaaacgtactttattatgtgcgctaccgctgaagcgcagtctactctgaattgcacctttaccattaaactgaataataccatgaacgcatgcgccgttatcgctgccctggagagagtgaaaattaggcccatggagcactgctgctgtagtgtcagaattccttgcccttctagccctgaagaactggagaagttgcagtgtgacctccaggatcccatcgtctgcctggcagaccaccctcgcggaccgccattttccagcagccagtccattcccgtagtcccaagagcgactgttctgagccaggtgccaaaggccacaagcttcgctgagcccccagactatagccctgtcactcataatgtaccatccccaatcggtgagatacagccactttctccacagcctagtgcacccattgcatccagtcccgctatcgacatgcccccccagagcgaaaccatctcgtcccccatgcctcagacacacgtttcaggaacccccccaccagtgaaggctagttttagttctcctaccgtgtccgcacccgccaatgttaataccacatcagcccctcccgttcagaccgacattgtaaataccagttctattagtgacctggaaaatcaggtactccagatggagaaggctttaagtctcggatcactggagcccaatctggccggcgaaatgatcaaccaggtttcacggctcttgcattctccaccggacatgctagccccactggcacagagactactcaaggtcgtggatgatattggattacagctaaacttcagtaacaccaccataagcttgacatccccttcacttgcactggccgtgattcgcgtaaacgcttcctccttcaataccaccacatttgtagcacaagaccccgccaacttgcaggtaagcttggagacacaagcgcctgagaactctattgggacaattaccctcccctctagtctaatgaataacttgcctgcccacgatatggagttggcctcaagggtccagtttaacttttttgagactccagctcttttccaggatcctagcttagagaatctgagtcttatcagttatgtcatctcatcgtcagttgcaaatttgactgttcggaatttaacccggaacgtgaccgtgactctgaagcacatcaacccgtcgcaggacgaattaactgttaggtgtgtgttctgggaccttggcagaaacggagggagaggcgggtggagtgacaatggctgcagtgttaaagatagaaggctgaacgagactatctgtacctgctcccacctgacaagcttcggggtgctcctggacctgtcccgaactagcgttctccctgcacagatgatggctctgacgtttataacatacataggctgtggtcttagttccatcttcctgtccgtgacgttggtgacttatatcgccttcgagaaaatccggcgagattacccatctaagattttaatccagttatgcgccgcgttgctgttgctcaatctggttttcctgttagactcctggattgctctgtataagatgcagggtctgtgcatcagcgtggccgtgttcctgcattactttttgctcgtgtcattcacttggatgggactggaggcatttcacatgtacctagcccttgtgaaagtgtttaacacttacatccgcaaatacatccttaagttttgcatcgtgggatggggagtgcctgctgtcgtcgtaacgatcattctcacgatctctccggacaattatggcctgggttcctatggcaagtttccaaatggtagccccgacgatttttgttggattaataacaacgcagtgttttacattaccgtagtgggatatttttgcgtgattttcctgcttaacgtgtctatgttcattgtagtgcttgtacagctctgccgcattaagaagaaaaagcagctgggcgcacagaggaagaccagtatccaggatcttcggtcaatcgccggtttaacatttttgctcggtataacttggggtttcgccttcttcgcatggggaccagtgaacgtgacctttatgtatctctttgctatattcaacactctgcaaggcttctttatattcattttttactgcgtggcgaaagagaacgtgcggaaacagtggcgacgctatctctgttgtggaaaactacgattggccgaaaattctgactggagtaaaactgctacgaatggactgaagaagcagaccgtcaatcagggcgtatcctcctcatctaacagcctccagtcatcttctaatagcactaactcaactacccttttggtgaataacgactgttctgtgcatgccagcggcaacggcaacgcgtccactgagcgtaatggggtctctttcagtgtacaaaatggggatgtctgtcttcacgatttcacagggaagcagcatatgtttaacgaaaaagaggacagctgtaacggcaaaggcaggatggcactacggcgcacatccaaacgcggatcccttcatttcattgaacagatgtag

SEQ ID NO: 117885 - DNA, 3012 bp, Artificial Sequence
  Description of Artificial Sequence: Synthetic coding sequence
atggtattctcagtgaggcagtgcggtcacgtgggtaggacagaagaagttctattgaccttcaagattttcttggtcattatctgtctgcacgtggttctcgtgacatctttggaggaagatactgacaacagcagcttgtcgccccctcctgcgaagcttagcgtggtgtccttcgccccaagcagtaacgggacccccgaggtggaaaccacttcactgaacgacgtcacgctaagtctgctgcctagcaacgagaccggcgtgaagccccagagaaatatatgcaacctttctagtatatgtaatgattcagcatttttccgtggagaaattatgttccagtatgataaggagagcactgttccccagaatcagcatataacaaacggcacgctgactggcgtcctcagcttatccgagctaaaacgtagtgagctaaataaaaccctacaaactttgtcggagacctattttatcatgtgcgccaccgctgaagctcagtccacattgaactgcactttcacgattaagctgaataacactatgaatgcttgtgcagttattgctgctctcgagagagttaagattcgtcctatggagcattgttgctgttctgtccgaatcccatgcccttccagtcccgaagagctcgagaagttacaatgcgacctgcaggacccaatcgtttgcctggcagatcaccctcggggaccacccttttcttcaagtcaatctattccagtggtgcccagagccaccgtgctatcccaggtgcccaaggcaacttccttcgcagaaccaccggattattcacccgtgactcataatgttcccagcccgatcggcgagattcagcccctgtccccgcagccctcggcaccaattgcatcctctccggccatcgatatgcccccccaatctgaaaccatatctagtccaatgccacagacccatgtgtccgggacaccccccccggtcaaggcctctttttcctccccaactgtgagtgccccagccaacgtgaataccacctccgcaccccccgtccagaccgacattgtcaacaccagttctatttcagacctcgagaaccaggttctgcaaatggaaaaagcactcagtctaggttctttggagcccaatctcgcaggggagatgattaaccaggtttctcgacttctgcacagcccacccgatatgctggccccccttgctcagaggctgttgaaagtagtggatgatatcggcctgcagttgaacttctcaaacaccaccatctccctgacatctccctctctcgccttggccgtgattagggttaacgccagttcctttaacacgaccactttcgttgcgcaggatcctgcaaacttgcaggtttccctagaaacacaggcacctgagaattcaatagggacgatcacactcccatcttcacttatgaacaatctgccagctcacgatatggagttggccagtcgagtccagttcaatttctttgaaacgcccgcgctatttcaggacccatcattggaaaacctgagtctgattagctacgtaatatcttcctccgtggccaatctgaccgtgcgcaatctgaccagaaacgtgacagtgaccctcaagcacataaatcccagtcaggacgagttaacggtaagatgtgtcttttgggatcttggccggaacggcgggcggggggggtggtccgataatggatgcagcgtcaaggacaggcgcctgaacgagacaatctgcacctgctcacatctcacgagttttggggttctgctggatctcagcaggacatctgtgctgcctgcccaaatgatggcattaactttcattacctacatcgggtgtggtctgagttctatcttcttatctgtcactctggttacctatatcgcattcgagaaaatacgccgggactacccctccaagatacttatccagctgtgtgccgctttgctgctgctcaatcttgtattcctccttgacagctggatcgctctctataaaatgcaggggctgtgtattagcgttgccgtcttcttgcattatttcctcctagtgtctttcacctggatgggcctcgaagctttccatatgtatcttgccctggttaaggtgttcaatacttacatccggaagtacatactcaaattctgcatcgtaggttggggagtgcctgccgttgtggtgactatcatactaaccattagccctgacaactatggcctggggtcatatggcaagttcccaaatggtagccctgacgatttctgttggattaacaacaatgccgttttctacattaccgtggtcgggtacttctgcgtcatcttcctcttgaatgtgagcatgttcatcgtcgttctggtccagctctgcaggatcaagaagaaaaaacagctgggcgcccagcggaaaactagtatccaggacctgagatccatcgctggcctgactttcctcctcggaataacgtggggattcgccttttttgcgtgggggccggtgaacgtgactttcatgtacctgtttgcaattttcaacacactgcaggggtttttcatattcatcttctactgcgtggctaaagaaaacgtgcggaagcagtggagacggtatctttgctgcggcaagctgagactggccgagaactccgattggagcaaaaccgcaaccaacggactaaaaaaacagaccgtgaaccaaggtgtgagctcatctagtaacagcctgcagagctcatctaatagcaccaattccactacactcttagtcaacaatgactgttctgtgcatgcctccggcaacggcaatgcctccacagagcgcaatggcgtgtccttttccgttcagaacggcgatgtgtgcctgcacgactttactggtaaacagcatatgtttaacgagaaagaggattcatgtaatggaaagggaagaatggcacttagaagaacatctaaacgcggaagtttacattttatcgaacaaatgtag

SEQ ID NO: 117886 - DNA, 2964 bp, Artificial Sequence
  Description of Artificial Sequence: Synthetic coding sequence
atggttttctcggtcaggcagtgcgggcacgtgggtagaaccgaagaggtcctattaacattcaaaatcttcctggtgatcatatgccttcacgtggtgctggtgactagtctcgaggaagataccgacaattcctccctcagtcctccgcccgaagtcgaaaccacgtcgcttaacgatgttaccctgagcctgctcccctcaaacgaaacaggggtgaagccccagcggaacatttgtaatcttagttcaatttgcaacgacagcgctttttttagaggagaaattatgtttcaatatgacaaggaatcaactgtgccacagaaccagcatattacaaatgggaccctgacgggggtgctatccctttccgagcttaagaggtctgaactcaacaagaccctgcagactctgtctgaaacttactttattatgtgtgcaactgcagaggctcagagcacactgaattgcaccttcaccatcaagctcaataacactatgaacgcctgtgcagtgattgcagctctggaacgtgttaagataaggcccatggagcattgctgttgttccgttagaattccctgcccaagttcgccagaggagcttgagaaactgcagtgtgatctgcaagaccctattgtctgtctggccgaccatcccagaggtcctcccttttcctcctctcagtctatccctgtggttcctcgggctacggtcctatcacaggttcccaaagccactagctttgcggaaccccctgattatagcccggtcacccacaacgtccctagccccatcggagaaatccagcccctatctccacagccgtcggcacctattgcctcatcaccagccatcgatatgcccccgcaatctgagacgatctcttcaccaatgccacagacccatgtgtccggaaccccacctcccgtaaaggcaagtttttcttctccaaccgtatcggcccccgctaatgttaatacgacgagcgcacctccggtgcaaactgacattgtgaacacttcctctataagcgatctcgagaaccaggtgttgcagatggagaaggcactaagtctgggctccttagagcccaacctggctggagagatgatcaaccaagtgagcaggctgcttcattccccgcccgacatgttggctccgctggcccagcgcttgctcaaagtggtagatgatattgggctacaactgaacttcagcaatacaactatctccctcacttcgccaagcctggcactcgccgtgattagggtgaatgctagttcatttaatactaccaccttcgtggctcaggatcctgcaaaccttcaagtgtccctggagacacaggcgccggagaactccatcggcactattacgttaccttcaagtcttatgaacaacctgccagctcatgacatggagttggcttctcgagtgcagtttaattttttcgagactcctgccctgttccaagaccccagcctggagaacttgagtctcatatcgtacgtgataagctcttccgtggccaaccttaccgtgcgcaacctgacaagaaatgtgactgtaacactgaagcatatcaatccttcccaagacgagctgactgttcgctgcgtcttctgggatcttggaaggaatggcggacgcggggggtggtccgataacggatgttcggttaaggatagaaggctcaatgaaaccatctgtacgtgttcgcatcttaccagctttggcgtattgcttgacctgtctagaactagcgtgctgcccgctcagatgatggcactgacttttatcacctacataggatgcggcctttcctcaatctttctctccgtgaccctagtgacgtatatcgcattcgagaaaatcaggcgcgattacccaagcaagatccttatacagctgtgtgccgcactgctgctattaaacctggtattcctcctggacagctggattgccctgtacaagatgcaaggtctgtgcataagtgtggcggtgttcttgcattactttctcttagtctctttcacttggatgggactggaggcatttcatatgtatctcgcgctggtcaaggtgttcaacacctacatacggaaatacattcttaagttttgtattgtcggctggggagtgcccgccgttgtggtaactatcatactaactattagcccagacaactacggcttgggctcctacggcaaatttcccaacggcagccctgatgacttttgctggatcaacaacaacgcggtgttctatatcacggttgtgggctatttttgtgtcatcttcttgctgaacgtgtcgatgtttattgtggttctcgtccagctttgccgtatcaaaaaaaaaaagcaacttggggcccagaggaaaacttccattcaagatctgagaagcatagcaggcttgactttccttctcgggattacctggggctttgctttctttgcttgggggccagtcaatgttacatttatgtacctctttgcaatttttaacaccttgcaggggttcttcatcttcatattttactgcgttgccaaagaaaacgtaaggaaacagtggaggcggtacctctgttgcgggaagttgcgtttggctgagaactccgattggagcaaaaccgccaccaacggcttgaaaaagcaaacggtgaaccagggagtgtcctcctcttctaatagtctccagtctagtagcaattcaaccaactcaacaaccttactagtaaacaatgattgttcggtacacgctagcggcaacggcaatgcttcaacagagaggaacggggtgagcttcagcgtacaaaacggggatgtatgtctgcatgatttcacaggcaagcaacacatgtttaatgagaaagaggactcatgtaacggtaagggtaggatggcgctgcggcggacatctaagcgtggttctctacacttcatcgagcagatgtag

SEQ ID NO: 117887 - DNA, 3045 bp, Artificial Sequence
  Description of Artificial Sequence: Synthetic coding sequence
atggtgtttagcgtgcgccaatgcggccacgttggcagaactgaggaggtgctgctgacatttaagatctttctggtgatcatctgtctgcacgtcgtgctggtgacctcacttgaggaagatacagataattcttcactgtcccctcccccagctaagctgtctgttgtctcttttgccccatcctcaaacgaagttgagacgaccagtttgaatgatgttacactctctctgctgcccagtaatgagactgaaaagaccaagatcactattgttaaaaccttcaacgcgagcggggtgaagcctcagagaaacatctgcaatctgtcctctatttgcaatgattccgctttctttaggggcgagatcatgttccagtacgataaagaaagcactgtgccccaaaatcaacatattacaaacggaacactgactggcgtgcttagtttgagcgagctgaaaaggagcgaactgaacaaaacactccagactctctctgaaacctatttcattatgtgcgccactgccgaagcccagtctacccttaattgtactttcactattaaactcaacaataccatgaatgcctgtgccgtgatcgcggccttggagcgtgtcaagatccgccccatggagcactgctgctgttccgtgcggattccctgcccctcctcacctgaagagctcgagaagctgcaatgtgaccttcaagatcccatcgtctgtctggcagaccacccccgtggacccccctttagcagctcgcagagcattcccgtcgtgccacgggcgacagtgcttagccaggtgccaaaagccacatcatttgctgaaccccccgactattctccagtgactcacaacgtccctagccccataggagagatccagccactgtcccctcagcccagcgcacccattgcttcttctccagctatcgacatgccaccacagtctgagaccattagcagtccaatgccccaaactcatgtgtcaggtacaccccctcccgtgaaagcttccttctcctcaccgaccgtctccgccccagcgaatgttaacaccaccagcgctccgcccgtacagacagatattgtgaacacatcgagcatatctgatctggaaaaccaggtgttgcagatggagaaagccctgagccttggctcactcgagccaaacttggccggtgagatgattaaccaagtgtcgaggcttttacactctcctccggacatgttagcacctctggcccaaaggcttttgaaggttgtggacgacatcggcctacagttaaatttctctaatacaaccatctccttgacctctccaagcttggccctcgccgtcatcagggtcaacgcctcaagcttcaatacaacaacttttgtagctcaggaccctgctaaccttcaggtttctctcgaaacacaagcccctgagaacagtattggcacgattactctaccaagctccctgatgaataatctaccagctcacgatatggaacttgccagcagggttcagttcaattttttcgagacccctgctctgtttcaggacccctcactagagaacctctcccttatcagttatgtgatcagttcttcagttgctaacttaacagtcaggaacctcacgcggaatgtgacagtgaccctgaaacatattaacccttctcaggatgaattaaccgtaaggtgcgtgttctgggacctgggccgaaacggcggccgggggggttggtctgataacggctgcagcgtgaaggaccgacgacttaatgagaccatttgcacctgcagtcacttgacatccttcggcgttctccttgacctcagcagaactagcgttttaccggcccaaatgatggccttgaccttcattacgtacatcggctgcggactctcctccatttttctgtcagtaactctcgtgacctatatagccttcgaaaaaatacggcgcgactacccatcaaaaatcctgatccaactatgtgccgctctgctcctcttgaatctagtcttcctccttgattcatggattgccttatacaagatgcaggggctctgcatctccgtggcggtgtttctgcattattttctgttagtgtcattcacatggatgggcctggaggccttccacatgtacctggccctggtgaaggtgttcaacacctacatccggaaatacatcttaaagttttgcatcgtgggatggggggtaccagccgtagtcgtaactatcatcctcacaattagtcctgataattatgggttgggttcatacggcaagttccctaacgggagccccgatgacttttgttggattaataacaacgctgtgttctatattacggtggtgggttatttctgcgtgatttttcttcttaatgtttccatgtttatcgtggtgctggtacagctttgcaggatcaaaaagaagaaacaactgggagctcaaagaaagacttccatccaggatctccgttctattgccgggttaacatttctgctgggtataacctggggcttcgccttttttgcctggggtcctgtgaatgttaccttcatgtacctgtttgcgatctttaacacactccagggcttctttattttcatcttctactgcgtagccaaagaaaacgttaggaagcagtggaggcggtatctgtgctgtggcaagttgcgactcgccgaaaatagtgattggtccaaaactgccacgaatgggctcaagaaacagaccgtaaatcagggagtgagttcatctagtaatagcctgcagtctagtagcaactcaaccaacagcacaacactgctggtcaacaacgactgtagcgttcacgcttctggaaacgggaacgctagtacagagcgaaatggcgtctcattctctgtgcagaacggtgacgtatgtctccacgactttactggcaagcaacacatgtttaatgagaaagaggactcctgtaacggtaaagggcgtatggccctacggcggaccagcaagcgaggttctctgcacttcattgaacaaatgtag

SEQ ID NO: 117888 - DNA, 2988 bp, Artificial Sequence
  Description of Artificial Sequence: Synthetic coding sequence
atggttttctctgtgcggcagtgcgggcacgtgggacgcacagaggaggttttgctcactttcaaaatattcctcgtaataatttgtctccatgtagtgctcgtcacgtcactggaagaggataccgacaacagcagtctctcccccccgccagcaaaactgagtgtggtgagcttcgccccgagtagcaacggaacccctgacgtgacactatcacttctgccatctaatgagacaggagtgaagccccagcggaacatctgcaacttgtctagcatctgcaacgactcagcattcttcagaggagaaataatgtttcagtatgacaaggagtctaccgtgccacagaatcaacatatcaccaatgggaccttaacaggggtcttaagtctctccgagctcaaaaggtctgagctgaataagactctgcagacgctgtccgagacatacttcattatgtgtgcaactgccgaggcccagtccacgctcaactgtacatttacaataaagctgaacaacacaatgaacgcttgcgccgtgatcgcggccctagaaagagtaaagataaggccaatggaacactgctgttgcagcgtccggatcccctgtccctcatcgccggaagagctggagaagctgcaatgcgacctgcaagacccgattgtgtgcctggcggatcacccacgcggaccaccctttagctccagccagtccattccagtcgtacccagagcaacagttctgtcgcaagtgcctaaggccacaagttttgcagagccccctgattacagccctgtaactcacaatgtgcctagtcctatcggagaaatccagccgctctcccctcaaccatcagctcccatcgccagttctcctgccattgatatgcctccacagtcagaaaccatcagttctcctatgccacagacacatgtttctggcacacccccaccggttaaggccagtttcagctcccccacggttagtgcacccgccaatgtgaacactaccagcgcccctcccgtgcagaccgacattgtgaatacttcctccatctctgatcttgagaatcaagtcctgcagatggaaaaagctctctccctcggaagtcttgagccaaatctggccggtgagatgatcaatcaagtctcacggctgttacatagtccacccgacatgttggctcccttggcccagcgtttactgaaggttgttgacgatattggcttgcagcttaatttttccaataccacaatcagtttaacaagcccaagccttgccctggccgtcattagagttaatgcatcgagttttaacaccactacctttgtcgcccaagatccagccaacctgcaggtatctttggagacccaagctcccgaaaactcgataggtaccataacgctcccgagcagtctgatgaataatctgcctgcccacgacatggagctagcctctagggttcagtttaacttcttcgagactcccgccctgttccaggacccaagtctggagaatctctctctgatctcttacgtgatctcatcctcagttgccaacttgacagtgagaaacctaacccgtaacgtgaccgttactctgaagcacattaatccctcacaggacgagctaacagtgaggtgcgtcttctgggatcttggccgcaacggcggacggggaggctggtcagataatggctgctccgtcaaagatcgtcgactcaacgagacaatttgcacatgttctcaccttacctcgttcggagtgctgctggatcttagtcggaccagtgtgctgcctgcccagatgatggccctgacgtttattacctatatagggtgcggactgtcaagcatatttttgtctgtcactcttgttacctacatcgctttcgagaaaataaggagagattaccccagcaagattctcatccagctgtgcgccgccttgttactcttgaaccttgtcttcctgttggatagctggattgccctgtacaaaatgcagggtctctgcatctccgtggctgtgtttctgcactattttttacttgtttcatttacctggatggggctggaggcatttcatatgtacctcgcactggtcaaagtgtttaacacctatataagaaaatacatcctgaaattctgtatagtgggctggggtgtgcctgcagtggtagttacaatcatactaaccattagccccgataattacggtctagggtcttatggtaaattcccaaacggttcacccgacgacttctgttggatcaacaataatgctgttttttatattactgtcgtcgggtatttttgcgtgatctttcttcttaacgtctccatgttcattgtggtcctcgtccaactctgccgcatcaagaaaaagaagcaactgggggcccagaggaagacttcaatacaggacctgcggagtatcgctgggctaacattcctgctgggaattacttggggattcgcattctttgcatgggggcccgtgaacgttacattcatgtacctgttcgcaattttcaatactctccaaggcttttttattttcatcttttattgtgttgcaaaagaaaatgtgcggaaacagtggagacgctatctgtgctgcgggaaactgcggcttgccgagaattcggattggtctaagactgccacgaatggtctgaagaaacagacagtcaatcaaggggtgtcgtcttcctccaactcactccagagttcaagcaattcaaccaattcaacaaccctgcttgttaataacgattgctcggtccatgcaagcggtaatggaaacgcttccaccgaaaggaatggcgtctctttttcagtgcagaacggagatgtttgcctgcacgatttcacaggaaagcaacatatgttcaacgaaaaggaagactcatgtaacggcaaaggtaggatggccttgaggcgcacatcaaagcggggttcactgcattttatagagcagatgtag

SEQ ID NO: 117889 - DNA, 3054 bp, Artificial Sequence
  Description of Artificial Sequence: Synthetic coding sequence
atggttttctctgttaggcagtgtggccatgtaggtcggactgaggaggtcttactgacattcaaaatattcctcgttattatttgtctgcacgtcgttctggtgacctcgctcgaggaagacactgataactccagcctgagtccaccacccgccaagctatcggtggtttcttttgctccctcctcaaacggcacgcctgaagttgaaaccacgagccttaatgatgtaacgttgtctcttctgccatccaacgagacagaaaagactaagataacaattgtaaagacgtttaatgccagcggtgtgaagcctcagcgcaacatctgcaatttgtcatctatttgtaatgacagcgcctttttcagaggagaaatcatgttccagtatgataaagaaagcaccgtaccacagaatcagcacatcaccaatggcactttaactggagtgctgagtttgtctgagctgaagagaagcgagttaaataagactctgcaaaccctttctgagacatatttcatcatgtgcgccacggccgaggctcaatccacccttaactgcactttcactatcaagctgaataatacaatgaatgcatgcgctgtaatcgcagcccttgagagagtcaagatcagacctatggagcattgctgttgctctgtgcggattccgtgtcccagcagccccgaggaactggaaaaactgcagtgtgatctccaggacccaatagtctgcctcgccgaccatcctcgcggtcccccattttcttcatctcagagcatccccgtggtgccccgtgcaactgtgctgtcccaggtaccaaaggccacctcttttgccgaaccgcccgattacagtcctgttacccacaacgtgccctccccaattggcgaaatccaaccactgtcccctcagcctagcgccccaatcgccagcagcccagctattgacatgccacctcaaagcgagaccataagttctcctatgccccagactcacgtcagtggcacccctccacccgtaaaagcatccttcagttcacctaccgtgagcgcccctgccaacgtaaatacaacaagtgcccccccagtacagaccgatattgttaacaccagtagtatctccgaccttgaaaatcaggtgttacagatggaaaaagccctgtcattaggatctcttgagccaaacctggccggagagatgataaaccaggtgtccaggctgctccatagcccaccagacatgctcgcaccactcgcacagaggttattgaaggtggtcgacgatatagggcttcagctgaatttcagtaacacaacaatctccctgacctcgccctcgctggccctcgctgtgatcagagtgaacgccagtagcttcaataccaccacttttgtcgcccaggaccccgccaatttacaggtaagcttagagactcaggctcccgagaactcaattggaaccattacattgccatcctctctgatgaacaatctgccggcccatgatatggagctggcgtccagggtgcaatttaacttcttcgaaactcccgccctgtttcaggatccaagccttgagaatctcagtttaatatcatatgtcattagttccagcgtggccaatctgacagtccgcaatttgacccgcaacgtgacagtcaccctcaagcacatcaacccctcccaagacgaattgactgtccgctgtgtattctgggacctgggacgaaatggaggaagaggcgggtggtcagacaacgggtgtagtgtcaaggatcgtaggctcaacgaaactatttgcacctgcagccacttgacaagtttcggtgtgttactggatcttagcagaacttcggtgctacccgcccagatgatggccctgaccttcattacttacatcggctgtggactaagcagtattttcctgtccgtgacgttggtgacgtacattgcctttgaaaagatccgacgggattatccttcaaagatcctgattcagttgtgtgcggcgctccttctactcaatctggtattcctcctggattcctggattgctctgtataaaatgcaagggttatgtatttccgtagccgtgttcttgcattatttcctgctggttagcttcacatggatggggctagaagccttccatatgtatctcgccctggttaaagtgttcaacacatacattagaaaatacattttaaaattctgtatcgtaggatggggtgtaccagctgtagttgtgaccatcatcttaactatcagccccgataactacggcttgggatcttacggcaaattccctaatggatccccggacgacttctgctggatcaataacaatgccgtgttttacataaccgttgttggatacttttgcgtcatatttcttctgaatgtttcgatgtttattgtggttctggtgcagctgtgccgaatcaagaaaaaaaaacaactcggagctcagagaaaaacatcaatccaagacctcagaagcattgccggtctgaccttccttctcgggataacttggggattcgcctttttcgcctggggtccagttaacgttactttcatgtacttatttgcgatctttaatacccttcaagggtttttcattttcatcttttactgcgttgccaaagaaaatgtgcgcaagcagtggcggcggtacctgtgctgtggcaagttgcggctggctgagaacagcgactggagcaagaccgctactaacggactcaagaagcagaccgtcaaccagggcgtctcgagctcctccaacagtttacagagctcctcaaactccacaaattctactacactgctggttaataatgattgcagcgtccacgccagcgggaatggaaacgcctccactgagcgtaatggtgtgagcttctcagttcagaacggagatgtctgtttacatgattttacgggcaagcagcacatgttcaacgagaaagaggacagctgcaacggtaaggggcggatggcgttgaggcgcacctccaagcgcggctccctgcattttattgagcagatgtag

SEQ ID NO: 117890 - DNA, 2901 bp, Artificial Sequence
  Description of Artificial Sequence: Synthetic coding sequence
atggttttcagcgttcgacaatgcggccacgtaggcagaaccgaggaggtgttacttacattcaagatcttcctcgtgatcatttgtctgcatgtcgtgctggtgacttcactggaagaagacacagacaattcatccctgtcccctccacccgcaaagctttcagtggtctcctttgcccctagttctaatggcacgccagaggttgagaccactagcttgaatgatgtcacgctgtcgctcctcccttctaatgaaacagaaaagacaaaaatcacaatcgtcaagacttttaacgctagcggggtgaagcctcagcggaacatctgcaacttgtcttccatttgcaacgactctgcgttctttaggggcgagatcatgtttcaatacgataaggagtccacagtgccgcagaatcagcatataaccaacgggaccctcactggcgtgttgtccctgagcgaactcaagcggtcggaactgaataagacactccaaacactgagcgaaacatactttatcatgtgcgccactgcggaggcacagtctaccctgaactgcacgttcaccatcaaattgaataacacaatgaatgcatgcgcggttatcgccgcgctggagagagtgaagatacgacctatggagcattgttgttgctccgtgcggatcccctgtccctccagtccagaggagctggagaagttgcagtgcgatcttcaagatcccattgtctgcctggccgatcacccaagaggcccccctttttccagttctcaaagcatccccgtggtgccaagagccacagtgctgagtcaggtgcctaaggccactagttttgcggagcctcccgattacagcccagtcacacataacgtgcccagcccaattggcgagatacagccactgagtccacagccctctgcccctattgcctcatcacccgctattgatatgccaccgcagtctgagaccatttcgtccccaatgccacagactcacgtcagtggcacacctccgcccgtgaaagcaagtttttccagcccaaccgtctcagcccccgccaacgttaacacaacgtctgcccctcccgtgcagactgacatcgtaaatacgtcctcaataagcgacctggaaaaccaagtcctacaaatggaaaaggcactctccctgggttcactcgaaccaaacttagccggagagatgatcaaccaggtatccaggttgctgcactcgccgccagatatgctcgcccctttggcacaacggcttctcaaagtggtggacgatattggattgcagcttaattttagtaatacaactatctcactcactagtccaagtctggcgcttgctgttatcagggttaacgcgtcttcgtttaacacgacaaccttcgtggcccaagatccagctaatctgcaggtatcactcgaaacccaagccccagaaaacagcatcgggaccattacactccctagctcactgatgaacaatttgcccgcacacgatatggaacttgccagtcgcgttcagttcaacttcttcgagacccctgcactgtttcaagatccatccttagaaaacctgagtctcatttcatacgtgatctcatcctcggttgctaatctgactgtgcgaaatttgacaaggaacgttacagtgactctcaaacatataaatccttcacaagacgaactgacagttcgatgtgttttctgggacctgggcagaaacggtggccgcggcggctggagcgataatggatgctccgtgaaggatcggcggctcaacgagacgatttgcacgtgctcccacctcacgtcttttggcgtacttctggatcttagccggactagcgtgctgcctgcccaaatgatggccctgacgttcataacatacattggctgcgggctgtcttctatttttttatcggtgactctggtcacatacattgctttcgaaaaaattaggagggattatccgtctaagattctgatccagttatgtgccgctctgctgctcctgaatctggtgttccttttagatagctggattgccctgtataagatgcaggggctgtgcatctctgtggcggtcttccttcactactttctgcttgtatccttcacctggatgggattagaggccttccatatgtatcttgcactggtcaaggtgtttaatacctacatcaggaagtatattctgaaattttgcattgtgggttggggagttccggccgtggtggtcaccatcatcctcacaatatcccccgataactatgggcttggttcctacggcaagttccctaatgggtcccctgatgacttctgttggattaataataacgccgtcttttatatcacggtggtgggctatttctgcgtcatttttctgctcaatgttagcatgttcatagtggttctcgtccaactgtgccgcatcaaaaagaaaaaacagttgggcgcccagaggaaaactagtattcaggatctgagatcaattgctgggctgactttcctactcggtataacatgggggttcgcctttttcgcttggggcccggtgaatgtgacattcatgtacctcttcgccatcttcaatactttgcaggggttctttatttttattttttattgcgttgctaaagagaatgtgcggaagcagtggcgacggtatctgtgctgcggcaagttaaggctggcagagaacagtgggaatgctagtactgaacgaaatggcgtctcatttagtgttcaaaatggagatgtctgtttacatgactttaccgggaaacagcatatgtttaatgagaaggaggacagctgcaacggtaagggccgaatggctcttcggagaacatccaaaaggggaagtctccatttcattgaacagatgtag

SEQ ID NO: 117891 - DNA, 2982 bp, Artificial Sequence
  Description of Artificial Sequence: Synthetic coding sequence
atggtgttctcagttcgacagtgtggccacgtcggccggaccgaggaggtgctgttaacttttaaaatttttctggtaatcatatgcctccacgttgtcctcgtcacctccctggaggaagacactgataatagtagcctttcccccccaccagacgtgaccctgtctcttcttcccagcaacgaaactgaaaagactaaaattactattgttaagacatttaacgccagtggggtgaagccacaacggaacatctgtaacctaagctcaatatgtaacgactcagccttctttcggggcgaaataatgtttcagtatgataaagagtctacagtgccccagaatcagcatattaccaacggcacccttaccggagtgctgagcctgagcgagctgaaacgttctgagctgaataagacactccagaccctctccgagacctactttatcatgtgcgcaactgcggaggctcaaagcacactaaattgcacatttaccatcaaactcaacaacaccatgaacgcctgtgctgttattgccgctctcgagagagtgaagatcagaccaatggaacattgctgctgctcagtgcgcataccctgcccgtcttcacccgaggaactggaaaaactccagtgcgacttgcaggaccccatagtttgcctggcagaccacccacgcggtcctccattttcatccagccagtctattcctgtggtgcctagggcaaccgtcctcagtcaggtgcctaaggctacaagttttgccgagccccccgattattctcctgtgacgcacaacgtgcccagccccattggcgaaatacagccgttatcaccacaaccatccgccccaattgcttcctcaccagcgattgacatgccacctcaatccgaaaccatttcttccccaatgccccaaactcacgtgagcgggacaccaccccccgtcaaggctagcttctccagccccactgtttcagccccagccaacgtcaataccacttctgctccacctgtgcaaactgatattgtcaatacctcttcaatatcagacttggagaaccaggtgcttcaaatggagaaggcactctccctcggatcacttgagcccaatttggcgggcgaaatgataaatcaggtgagtaggctgctgcattcacccccggacatgctggctccccttgcccagcgcttattgaaggtcgtggacgacatcggattgcagctgaattttagcaacacgactatctctctcaccagcccatcgctagccctggcggttatcagggtgaacgcaagctccttcaacaccaccactttcgtcgctcaagatcccgccaacttgcaggtttctctggaaacccaggccccagaaaactccattggtaccattacactcccttcatccctgatgaacaacctacctgcccatgacatggagctggccagccgcgtgcagttcaactttttcgagactccagctctgttccaggaccctagccttgagaatctctccctgatcagttatgtaatcagttctagcgtggccaatctcactgtcagaaaccttacacgtaacgttacagtgaccctcaagcatatcaatccttctcaggacgaactgacagttcgatgcgtgttctgggacctgggcaggaatgggggacggggcggttggtccgataatggttgctccgtcaaggataggagacttaatgagacaatctgtacctgcagccacctgacaagcttcggcgtcctcctggatctctcccgcacctctgtgctacccgcacagatgatggccctgacattcataacctacattggctgcggcctgtccagtatcttcctgtccgtaactctggtgacctacatagcctttgaaaaaatccgtagggattatccatcaaaaatcctgatacagttgtgcgctgcactcctgctactgaatttggtatttcttctggactcttggatcgctctctataaaatgcagggtctatgcatcagcgtcgcagtgttcttgcattatttcctcctagtgtcttttacttggatgggcctagaggctttccacatgtatctggctctggtcaaagtgttcaatacctacattcggaagtacatcctcaagttctgtatcgttggttggggggttcccgcagtggtggtgactatcatcctgacgattagtcctgacaattacggactaggaagttatggaaagtttccaaatggcagccccgacgacttttgttggatcaacaataacgcagttttctacattaccgttgtaggctatttctgtgttatcttcttgcttaatgtgtccatgtttatagtcgttctggtacagctctgccgtattaagaagaaaaagcagttaggagcccagaggaagaccagtatccaagacctaagatctattgctggacttacatttttgcttggcattacctggggattcgcctttttcgcttggggcccagttaacgtgacctttatgtacttattcgccatctttaatactcttcagggattctttatcttcatcttttattgcgtcgctaaagagaacgtacgcaagcaatggagaaggtatctttgctgtggaaaactccgtctcgccgaaaatagcgactggtcgaagaccgcgacaaacgggttaaaaaagcagactgtcaatcagggagtgagctccagttccaactccttgcagtcctcctcaaattctaccaattctaccacactcctggtaaataatgactgttctgtccatgcaagcggaaatggcaacgcttctactgagaggaacggcgtgtccttcagcgtgcagaatggcgatgtctgcctgcacgattttacagggaaacagcatatgtttaacgagaaagaagacagttgtaacggaaagggcaggatggctttgcgacggacatctaagcgtggatctctgcacttcatagagcagatgtag

SEQ ID NO: 117892 - DNA, 3006 bp, Artificial Sequence
  Description of Artificial Sequence: Synthetic coding sequence
atggtatttagcgttcgacagtgtggccatgtcggacgcacggaggaagttttgctgaccttcaagattttcttagtcattatatgcctccacgtcgtgttggtgacctcactcgaggaagacaccgacaactcatccttatcgccaccccctgaggtggagactacaagcctgaacgatgtgacgctctcactgttaccttctaacgagacggaaaagacgaagatcaccatcgtaaagacatttaacgcctctggcgtcaagccacagcggaatatctgcaaccttagcagtatttgtaatgacagtgctttttttaggggcgagattatgtttcagtacgataaagagagtaccgtccctcagaaccaacatattactaatgggaccctgacaggagtactgtctctctctgaattgaagcggtctgagctgaacaagactttacagactctgtcagaaacatacttcatcatgtgtgctaccgctgaagcccagtccacattaaactgcacttttacaataaagctaaataataccatgaatgcctgcgccgtaatcgccgccttggaacgggttaagattcgccctatggagcattgttgttgtagtgttcggattccctgtccatcctcccccgaggaattagaaaagctccagtgcgacttgcaggatcctatagtctgcctggcagaccaccctcgcggtccacccttctcttccagccagtcaataccagtcgttccgcgggcaacagtcctgtcccaggtgccaaaggctactagcttcgcggagcctcctgactacagcccagtaacccacaatgtcccatcccccattggcgaaatacagccactatctcctcaacccagcgcaccgatagcgagcagtcctgctatcgatatgcctccacaatcagaaaccatctcttctcctatgcctcaaacgcacgtgtccggcacaccaccacccgtgaaggccagcttctcctctccaactgtgagcgcccctgccaatgtgaataccacatcagcaccacctgtgcaaaccgacatcgtcaatacttctagcatcagcgatttggaaaatcaagtactacagatggaaaaggcgctgtctttgggcagcctggaacccaacctcgccggcgaaatgattaaccaggtgtctcggctcctccattcacctccagatatgctcgctcccttggcccaaaggttgcttaaagttgttgacgatatcggactgcagctaaatttctccaataccacaatttccttgacaagccccagcctcgccttggcggtgattcgcgttaacgccagtagcttcaacaccacaacatttgtggcccaggaccctgccaatctgcaagtctcattggaaacacaggcacctgagaattctatcgggactatcaccctccccagctcgctcatgaataatttgcccgctcacgacatggagctggcctctcgggtccagtttaatttttttgaaaccccggcactctttcaggaccccagccttgaaaacctgagtctgatctcatatgtcataagctcttctgtggccaatctgaccgtccggaatctgacaagaaatgttacagtgaccttaaaacatatcaatccctcacaggatgagctgacagttcgctgtgttttttgggaccttgggcggaacggggggagaggaggctggtcggacaatggctgttccgtgaaggaccggagactcaatgagactatctgcacttgctcccatctgacctccttcggagtgttactggatctgagcagaaccagtgtcttacctgcacagatgatggccctgacatttattacctatatcggctgtggcctctcctcgatcttcctgagcgttacactggtgacatacattgcgttcgaaaagattcggcgggattacccatcaaagatacttatccagctgtgtgctgctctgcttctgcttaatttggtcttcctgcttgacagctggatagcactttacaagatgcaggggctctgcatttctgtggccgtgtttctccactacttcctgctggtgtcattcacctggatggggctggaagctttccatatgtacctggcacttgtgaaggtgtttaacacatacatccggaaatatattctaaagttttgtatcgtcggttggggcgtgcctgcggtggtggtgacaatcattttgaccatctctcctgataattatggattggggtcctatggaaagttcccgaatgggtcacctgatgatttctgttggataaacaacaacgctgtgttctacatcacagttgtaggctatttctgtgtcatcttcctcctgaacgtatccatgttcattgtggtgctagtgcagttgtgccgcatcaagaagaaaaagcagctgggcgcacaacggaaaacttccattcaagatctccgctctatcgccggactgaccttcctgcttggcattacttggggttttgctttctttgcctggggcccggttaatgtaaccttcatgtacctctttgcgatatttaacacccttcagggtttttttatcttcattttttattgcgttgcaaaggagaatgtgcgcaaacagtggagaaggtatctctgttgcggcaagctccgcctggcagagaacagcgattggtctaagactgcaacgaacggtctcaagaagcagacagtcaatcagggcgtgtctagctcatcgaattcgctgcagtcttcatctaattcaacgaattctaccaccctgctggtaaataatgactgttccgtgcatgcttctgggaacggcaacgcctccactgagcgtaatggagttagcttttctgtgcagaatggcgatgtttgcctgcatgactttacaggaaaacagcatatgttcaacgagaaagaggatagctgtaatgggaagggtcgaatggcactcagacggacgtccaagcgcggctctctgcacttcattgagcaaatgtag

SEQ ID NO: 117893 - DNA, 354 bp, Artificial Sequence
  Description of Artificial Sequence: Synthetic coding sequence
atcctgttaaccatgcaacacattaataccggaatcgatatgctgaatcaactgggatgtgtcttcttcgctggcgtcaaaccccagcgaaacatctgtaacctttccagcatttgcaacgatagtgccttcttccgaggcgagattatgtttcaatacgataaggagtcaactgtgccgcagaaccagcatatcaccaacggaacattaacaggtgtacttagcttgagcgaattaaaacgcagtgagctaaataaaacgcttcagaccctctctgaaacatatttcatcatgtgtgccacagcagaggcccaaagacacatcaagttgtacatccataataagaccgaatag

SEQ ID NO: 117894 - DNA, 1014 bp, Artificial Sequence
  Description of Artificial Sequence: Synthetic coding sequence
atgaattccacatgtatcgaggaacagcacgacctggaccactacctgttcccgattgtctacatcttcgtaattatcgtctccatcccagcaaacattggatctttatgtgtctcttttctccaggctaaaaaagaaagcgaactaggaatttacctgttcagccttagcctgtctgaccttctgtacgcgctgacacttcctctttggattgattacacctggaataaggataactggactttttctcccgccctctgcaaaggcagtgcatttttaatgtatatgaatttttactcaagcaccgccttccttacgtgcattgcagtggaccgttatctagctgtcgtgtatcccctgaaattttttttccttcggaccaggagatttgcgctgatggtctcactttcaatttggatccttgaaactatcttcaatgcagtgatgctgtgggaggacgagaccgtggtcgagtactgcgatgctgaaaaatcaaacttcaccctctgttacgacaaataccccttggaaaagtggcagattaacctgaatctcttcaggacgtgcaccggttacgctatccccctggtcactatattaatttgtaacaggaaggtctatcaagctgttaggcataataaggccactgagaataaggaaaagaaacggattattaagctcttggtaagcataacagttacctttgttctttgctttacaccttttcacgtgatgctgctaataagatgcatcctggagcacgccgtaaacttcgaagaccatagtaatagcggcaagcgtacatatactatgtatcgcatcaccgtggcgctgacttccctcaactgcgtcgctgacccaattctctattgcttcgtgacagagacagggcgctatgatatgtggaacatcctgaagttctgtaccggcaggtgtaacacctcacagcggcaacgaaagagaatcttatccgtgagtacaaaggatacaatggaactggaggtgctcgagtag

SEQ ID NO: 117895 - DNA, 1623 bp, Artificial Sequence
  Description of Artificial Sequence: Synthetic coding sequence
atgaattcaacgggccacctgcaggacgcacccaacgccacaagcctgcatgtgccacatagccaagagggaaacagtaccagccttcaggaaggcttgcaggatttgattcacaccgccacgctggtgacttgcacttttctgttagccgtcatattctgccttgggtcttacggaaatttcatcgtattcctttcattttttgatcccgccttcaggaaattccggaccaattttgatttcatgattttgaatttgagcttctgcgatctgtttatctgcggggtcactgcacctatgtttacatttgtgttgttttttagttccgcctcgtccattccagacgctttttgtttcactttccacctgacctcaagtggcttcattatcatgagcctgaaaacagtcgctgtaattgccctgcacagactgaggatggttcttgggaaacagccaaatcgaacagcttcttttccctgcacggtcttgctaactttgctcctgtgggccacaagtttcactcttgcgacgctggcaacgcttaaaaccagcaagtcacatctttgtctgcctatgtcaagcctcattgccggcaaaggtaaggctattctcagtttgtacgtggtggactttaccttttgtgtcgccgtcgtgtccgtcagttacatcatgattgcacaaaccctccggaagaatgcccaggtgcgtaagtgccccccagtcatcacggtggacgctagtcgccctcagccatttatgggcgtacccgtgcagggcgggggagatcctatccagtgtgccatgcccgccctgtaccggaatcaaaattataacaagctgcagcatgtgcagactcgggggtacacaaagagtcccaaccagctggtgacacctgccgcgtcaagattgcagttagttagcgctatcaacctctctacggcaaaagactcgaaggctgtcgtgacatgcgtcatcatagtgttgagcgtactggtctgctgtttaccactgggtatcagtcttgtacaggttgtgttaagttcaaacggctcttttatcctctaccagttcgaactctttgggttcaccttaatcttctttaaatccggactaaatccgtttatttattccaggaattccgctggcctccgcaggaaggtgttatggtgtctccagtacatcggcttgggcttcttctgttgtaaacagaagacgaggcttcgcgccatgggcaaagggaacctggaagtgaaccgtaacaagtcttcacaccacgaaactaactctgcttatatgctttccccaaaaccccaaaagaaatttgtggaccaggcgtgcggaccttcacacagtaaggagtccatggtatcccctaagattagcgccggtcaccagcattgtggacagagtagcagtacaccaatcaacaccaggatcgagccttattactctatctataattcatccccaagtcaggaggaaagttcgccttgcaatctccagcctgttaactccttcggcttcgcaaatagctatatagcaatgcattaccatacaacaaacgatctggtccaggagtatgacagcaccagcgctaaacaaattccagtacctagcgtctag

SEQ ID NO: 117896 - DNA, 1092 bp, Artificial Sequence
  Description of Artificial Sequence: Synthetic coding sequence
atgggccctggggaagcactgttagcaggactactggtgatggtgctggctgttgcgttgctgagtaacgcccttgttctgctctgttgtgcatactctgctgagctgagaactagagcttccggggttttgcttgtgaatttgagtctcggacatctcctgctcgctgcattggatatgccattcacactgttaggggtcatgaggggaaggacccccagcgctcctggcgcctgtcaagtgataggatttttggacacattcctggcgagcaatgcagccctttccgtcgccgccctgtcagccgatcaatggctggccgtgggattcccactgcgctatgctgggcggttacgtcccaggtacgcagggctgctcctgggctgcgcgtggggtcagagcctggcattttcaggcgcggccctcggttgctcttggctcggttattctagcgcgttcgcgtcatgttcactccggctacctcctgaacctgagcggccccgctttgctgcattcacagcaactctgcacgctgtgggctttgtcttaccgctggccgtactctgcctgacctctttgcaggttcatagagtagcccgcaggcactgtcagagaatggacactgtgaccatgaaggccttagccctgttagccgacctgcatcccagtgtcagacagagatgcctgatccaacaaaaaagaagacggcaccgggccactcgcaagattggcatcgctattgccacttttctcatatgcttcgcgccatacgtgatgaccagattggcagaattggtgccattcgtgactgttaacgctcagtgggggatcctcagtaagtgtctgacctactcaaaagccgtagccgaccctttcacctactctttactccgccgacccttccgtcaagtgctggctggcatggtacatagactcctaaaaagaacaccacggccagcctccacgcacgattccagcttagacgtcgctggaatggtgcaccaactactgaagagaacgcctcgtcctgctagcacacacaatgggtcagtcgataccgagaacgattcttgcctgcagcaaacccattag

SEQ ID NO: 117897 - DNA, 1011 bp, Artificial Sequence
  Description of Artificial Sequence: Synthetic coding sequence
atgaataataatacaacttgcatccagccctccatgatttctagtatggccctgcctataatctacattctgctgtgcatcgtgggcgtgttcgggaatactctcagtcagtggattttcctcacaaagattggcaaaaagacctcaactcatatctacctgtctcacttagtgacggcaaatctgttagtgtgctcagccatgcccttcatgtctatttacttcctgaaagggtttcagtgggaataccagagcgcccagtgccgggttgtcaacttcctaggaactctgtccatgcatgctagcatgtttgtctcactgcttatactctcatggatcgccatcagtcggtacgccaccctgatgcagaaggacagttcacaggaaacgacatcttgttatgaaaaaatattttatgggcatctgctgaaaaagttccggcagcctaacttcgccagaaaactctgtatatacatttggggtgtagtccttggaatcattatcccggtcaccgtgtattacagcgtgattgaagcgaccgaaggagaggagagtctctgctacaaccggcagatggagctgggagcgatgattagccagatagcggggcttatcggcacaacgtttatcgggttctccttcctcgtcgttttgaccagttactattccttcgtcagtcatctgaggaagatcagaacctgtaccagcattatggagaaggatctcacctacagttcagtcaagcgacatctgctagtgatccagatcctcctgatagtgtgctttctcccctatagcatctttaagccaatcttttacgtactgcaccagagggataattgtcagcagctaaactaccttatcgagaccaagaatattctgacctgcctggcctcagccaggagttcgaccgatcccattatctttctgctcctggacaaaacgtttaagaaaactctttataacttgtttacgaagtccaactcagcccatatgcaatcatatggttag

SEQ ID NO: 117898 - DNA, 1272 bp, Artificial Sequence
  Description of Artificial Sequence: Synthetic coding sequence
atggtaccccatctgctgttactgtgtctgttgcctctggtcagagccaccgagccgcacgaaggaagagcagatgagcagtctgccgaggctgccctggcagtgcccaatgcttcccacttcttctcgtggaacaactacacattttctgattggcaaaacttcgtgggcaggaggcgctacggagccgagagccagaatccgaccgtgaaagcgctgttgatcgtcgcatattccttcattattgtgttttccctctttgggaacgtgctggtgtgtcacgtcatattcaaaaaccagcggatgcattcagcgacatctttatttatcgtgaatttggcggttgccgatattatgataactctgcttaacactccctttactctagttcggtttgttaacagcacttggatctttgggaaggggatgtgtcacgttagtcgctttgctcagtattgttcgctgcatgtttcggctctgaccctcacagccattgctgtggatcgtcaccaagtcatcatgcatcccctgaagccacgcatttcgataacaaagggcgtgatttacatcgctgttatctggactatggcaacctttttttctctgccccacgccatctgccagaagctttttacctttaagtactcagaggacatcgtgcggtcattatgcctccccgactttccagagccggctgatctcttctggaaatacctcgatctggccacattcatccttctttacattctacccctcctgatcataagtgtggcgtacgcacgagtagcgaagaagttgtggctctgtaacatgattggggatgtgactaccgaacaatacttcgctctgcggaggaagaaaaaaaagacaataaaaatgttgatgctggtcgtcgtgctctttgctctttgctggtttcctctgaattgctacgtcctgcttctttcatccaaagtgattcgtactaataacgctctttactttgcatttcattggttcgccatgagcagtacgtgctacaacccattcatctactgctggctgaacgaaaatttcaggatagaattaaaagcactgttatctatgtgccagagaccacctaagcctcaggaagatcgccccccatcaccagtgcctagctttcgggtggcttggaccgaaaagaatgacggccagcgagctcctctagcgaataatctgctgccgaccagtcaattacaaagcggtaaaactgacctctccagcgtcgagcccatcgtcactatgtcctag

SEQ ID NO: 117899 - DNA, 1191 bp, Artificial Sequence
  Description of Artificial Sequence: Synthetic coding sequence
atgtggaattcatcggatgcaaacttctcctgctatcacgaatcagtgctaggctatcgctatgtggccgttagctggggagttgtggtcgccgtgaccggtacagtcggaaacgtgctcacattgctggctttagctattcaaccgaaactccggacccgctttaacttgctcattgcgaatctgaccctggcggacctgttgtactgtactctgttgcagccattttctgttgatacctacctgcacctccactggagaaccggagcaaccttttgcagggtctttggtctgctactgttcgcttctaacagtgtttctatcctgaccctctgtctcatcgccctgggacgctacctgctgatcgcacacccgaaactcttcccacaagtgttcagcgctaagggtattgtgctagccctggtgagcacctgggtggttggcgtagcgtcctttgctcccctgtggcctatatacattttggtcccggtggtgtgcacctgttcctttgatcgaatcaggggacgcccctacacaaccatcctcatgggcatttatttcgtgctgggtctgtcctctgttgggatcttttattgcctgattcaccgtcaggtgaaaagagctgcccaggcacttgaccagtataagctccgacaggccagcatccacagcaatcacgtggccaggactgacgaagccatgccagggcggtttcaagagctggactctcggcttgcttctggcggaccgtcagagggtatcagcagtgagccagtgagcgccgcaacgacgcagaccctggaaggagattcatcagaagtcggggaccagatcaatagcaagcgagccaaacaaatggcagagaagagcccccccgaggccagcgcgaaagctcagccaataaaaggggcgcgacgggcccctgactccagttcggagtttggtaaagtgacgcggatgtgtttcgccgtcttcctgtgctttgctctttcgtacatccctttcctgcttttgaacatcctcgacgccagagtgcaagccccgagagtggtgcacatgctcgcggccaacctcacctggttgaacggatgcatcaaccctgtcctttacgccgctatgaaccggcaattccgccaagcctatggtagtatcctgaagcgcgggccgagaagcttccatcgcctccactag

SEQ ID NO: 117900 - DNA, 1191 bp, Artificial Sequence
  Description of Artificial Sequence: Synthetic coding sequence
atgtggaacagcagcgacgccaacttttcatgctatcacgaatcagtcctggggtatcggtacgtggcagtgtcctggggagtggtggtggctgtaactgggaccgtcggcaatgttctgacgctccttgcactcgcgattcaacccaaactcagaaccagatttaaccttctaatagctaatctcaccctggctgacctgctctattgtactctactgcagccattctcagtcgacacatacctgcatttacactggcgaactggggccactttttgcagggttttcggcctcctgctgttcgcaagcaacagcgtgagcatattaactctctgtctcatcgccttgggaaggtatttgcttatcgctcatcccaagctctttccgcaggtgtttagtgctaaaggaattgtcctggcgttggttagcacctgggtagttggcgtcgcgtcctttgctccactatggcccatctacatattagttccagtggtatgtacatgttctttcgaccgaattagggggaggccatacaccacaattctcatgggaatctatttcgtgctggggctgtcaagcgtcggaatcttctattgcttgattcatcgccaagttaaaagggcagcacaggccttagaccagtataaattgcgccaggcttcaatccactcaaatcatgtggcccgcaccgatgaggccatgccagggcggttccaggagctcgattcacgtctggccagcggcggtccaagtgagggaatcagctcagagccagtctcagccgccacgacccagaccctcgagggggattctagtgaagtgggggaccagatcaattccaagcgggccaaacaaatggccgaaaaatcccctcccgaagccagtgccaaagcccagcctatcaaaggggcacgaagagcccctgatagctcttccgaattcgggaaggtcactcggatgtgttttgcagtgtttctgtgtttcgcgctctcatatatcccattcctcctgctgaacatcctggacgcacgggtgcaggccccccgcgtcgttcatatgcttgcggcaaatttaacctggctgaacggatgcattaatccagttctgtacgctgccatgaatcggcagtttagacaagcatatggatccattctaaagagaggccctcgaagcttccacaggttgcactag

SEQ ID NO: 117901 - DNA, 1113 bp, Artificial Sequence
  Description of Artificial Sequence: Synthetic coding sequence
atggctaattactcacacgccgctgacaacatactacaaaacctctcacctttaaccgctttcctcaagctgacatcactgggtttcatcatcggtgtgtccgtggtgggaaacctactgatatccatcctgctcgttaaggataagactctgcacagagccccttactactttcttctcgacctctgttgcagtgatattctgcgcagtgccatctgtttcccctttgtcttcaacagcgtgaagaatggcagcacctggacttacggaactcttacatgtaaggtaatcgcattccttggcgtgctctcctgcttccacactgcatttatgctgttttgtatctctgtaacaaggtacctggctatcgctcatcatcgcttttatacgaagagactcacattctggacttgtctcgctgtcatatgtatggtatggacgctctcagttgctatggcatttccccccgtgctggatgtgggcacatattctttcatcagggaggaagaccagtgtacttttcagcatcgatcattcagggccaatgacagcctcgggtttatgctattattggccctgatcctgttggcgactcagctggtctaccttaagctgatcttctttgtgcacgatcgcaggaagatgaagccagtgcagtttgtggccgcagtatcgcagaactggaccttccacggacctggagcctccggacaggcggcggcgaattggctggctggctttgggaggggcccaacgccaccaacactgttggggatccgacaaaatgctaatactactggcagacgtcgactcctcgtcttggatgagtttaagatggaaaaaaggatttctaggatgttttatattatgactttcctcttcctgacactttggggaccgtacctggtggcctgctactggcgggtgttcgcaaggggtccagtcgtacctgggggtttcctgacagcggccgtgtggatgagttttgcacaggcaggcattaacccctttgtgtgcatcttctctaaccgggaactgcgtcgatgtttttcaacaacactgctgtactgcagaaaaagtcggcttccacgggagccttactgtgtcatatag

SEQ ID NO: 117902 - DNA, 1113 bp, Artificial Sequence
  Description of Artificial Sequence: Synthetic coding sequence
atggcaaattacagtcacgcagccgacaacattcttcagaatttgtctccactgaccgcattccttaaactaacttcactgggattcatcatcggggtgagtgtcgtcggaaacctcctcatctccatcctgttggtgaaagataagacccttcaccgggcaccttactactttctgttggacctctgttgttctgatatcctccgtagtgcgatatgcttcccgtttgtgttcaattcagtaaagaatggttcaacatggacttacggaactctgacatgcaaagtgatagcattcctgggtgtgctgtcatgtttccacacggcattcatgttgttctgtatctctgtcacacgatatctggccatcgctcaccaccgcttctacacaaaaaggttaacattttggacatgcttggctgtgatttgcatggtctggacgctgtctgtggcaatggcattccccccggtcctggatgtgggtacttactcttttatccgtgaagaggatcaatgtacctttcagcatcgatctttcagagctaatgatagtctgggattcatgctattgctcgctttaatcctgttagccacacaactggtatacctcaagttaatctttttcgtacacgaccggcgaaagatgaagcccgtccagtttgttgccgccgtctctcagaactggacattccacggaccgggggcatcagggcaggccgccgcaaattggctggccggtttcggacgaggcccgactccacccactctgctcgggatcagacaaaatgcaaacactactggtaggagacgcctgctggtcttagatgagtttaagatggaaaagagaattagtcgcatgttctacattatgactttcctgtttttgaccttatgggggccatatctggtggcctgttattggagagtctttgctcgcggccccgtcgtgccaggagggtttctgacagcagccgtgtggatgagctttgcgcaggcagggataaacccctttgtctgcattttttcaaatcgcgaactgcgcagatgtttcagcactacactgctgtattgtcgtaagtcgcggttacctagggagccatattgcgtgatttag

SEQ ID NO: 117903 - DNA, 216 bp, Artificial Sequence
  Description of Artificial Sequence: Synthetic coding sequence
atggctaattacagtcacgccgctgacaacatcctccaaaacctctctccactcaccgcctttctgaagctgacatccctggggtttatcatcggcgtctccgttgtcggcaacctgctgatcagcatactgctcgtgaaagataagacattgcatcgagcaccttactactttctgctagacctgtgctgcagtgatatccttcgatccgcctag

SEQ ID NO: 117904 - DNA, 1113 bp, Artificial Sequence
  Description of Artificial Sequence: Synthetic coding sequence
atggccaactattcccacgccgccgataatattcttcagaacctcagccccctcactgccttccttaaactcacttctttgggattcatcatcggggtcagtgtggtgggtaatttgctgatttctatcctactcgtaaaggacaagacccttcaccgcgcaccttattacttcctgttggacctgtgttgcagtgatatccttcggtctgccatttgctttccttttgtctttaatagtgtgaagaatggctctacttggacatatgggacgctaacttgtaaagtgatagcctttttgggggtgctttcgtgctttcatacagcgtttatgctcttttgcataagcgtcacacgttacttagcaattgcacatcaccggttctacactaaacggcttaccttctggacttgcctggctgtgatctgcatggtttggacgctgtctgtggctatggcttttccccctgtgctggacgtaggcacttacagctttatcagggaggaagaccaatgtacattccaacatcgtagcttccgggccaacgacagcttgggtttcatgctgctgctggctctcatcctgctggcgacccaactagtgtacttgaagttgatctttttcgtgcacgatcgacggaaaatgaagcctgtccagttcgtcgccgccgtgtctcagaactggacatttcacgggcctggcgcctctggacaggccgctgccaattggctcgcgggcttcggaagaggccccacaccaccgacgctactgggaatccggcagaatgcaaacaccacaggtcgcaggaggttgctggtgcttgacgagtttaagatggagaagcgtatttctcgcatgttttacataatgacattcctctttttaaccctctgggggccttatctcgtcgcctgctactggcgtgtgtttgccaggggtccggtggttcctggaggattcttgaccgctgctgtgtggatgtccttcgcacaggccggtatcaaccctttcgtctgcatattcagtaatagggagctacggaggtgcttctcaaccactttactctattgtagaaagagtcgattaccacgcgaaccatattgcgtgatatag

SEQ ID NO: 117905 - DNA, 366 bp, Artificial Sequence
  Description of Artificial Sequence: Synthetic coding sequence
atggcaaattactcacatgctgcagataacatactccagaatcttagtccactgaccgctttcttaaaacttacctctctcggcttcatcattggagtcagtgtagtgggtaatcttctaattagcattttattggtgaaggacaagacactccatcgggcgccttactactttcttttagatttgtgctgctccgacatactacgcagcgccatctgctttccttttgtctttaattccgtgaaaaatggtagtacatggacctacgggaccctcacttgtaaagttatcgccttcctgggcgtgctttcgtgctttcacaccgcttttatgctgttttgtattagcgtaaccaggtatctgtag

SEQ ID NO: 117906 - DNA, 1113 bp, Artificial Sequence
  Description of Artificial Sequence: Synthetic coding sequence
atggcaaactattcgcacgccgcggataacattcttcaaaatctgagccccctgactgcattcctgaaactgacctccttaggcttcatcatcggagtgtctgtcgtggggaaccttctcattagtattctgctcgtgaaggataaaactctgcatcgggcaccatattatttcttgctagatctgtgctgcagtgacatacttcgcagcgcgatctgttttccattcgtatttaatagtgtgaagaatggttcaacatggacctacggaacattgacatgcaaggttatcgcctttctgggggtgctaagctgcttccacaccgcttttatgcttttctgcattagcgtgacgcggtacctcgccattgcacaccatcggttttatacaaagcgtctgaccttctggacatgtctcgccgttatctgcatggtgtggaccctgagcgtagctatggcctttccaccagtcctggacgtgggcacctactccttcattagagaggaggaccagtgtaccttccagcataggagttttagagcgaacgattctctggggttcatgctgctgctggctcttatactgctcgccacacagctcgtctacttgaagctaatattcttcgtccacgacagacggaaaatgaaaccagtccaattcgtagctgcggtgtcacaaaactggacttttcatggcccaggcgcttcagggcaggctgctgctaactggctggctgggtttggtcgcggtcccacaccgcctaccctgctggggatcaggcagaacgctaatacaacaggccggcgacgactgcttgtccttgatgagttcaaaatggaaaaacggatttcccgcatgttctacatcatgacctttctttttctgaccctgtggggcccttatctcgtcgcctgttattggcgggtgtttgccaggggtcccgtcgtgcctggcggcttcctgactgccgccgtgtggatgtcgtttgcacaggccggaattaacccctttgtgtgcattttttccaatcgtgaactgaggagatgcttctccactacactcttgtattgccgcaagtctcggctgccccgcgaaccgtattgtgtgatctag

SEQ ID NO: 117907 - DNA, 1077 bp, Artificial Sequence
  Description of Artificial Sequence: Synthetic coding sequence
atgggctttaacctcacacttgctaaactcccgaataatgaactccacggccaagagagccacaactccgggaatcggtccgacggccccggcaagaataccacactccacaatgagttcgacactatcgttctgcctgttctgtacctcattatttttgttgcatctattctcttgaacggcctggcagtgtggatcttcttccacatccggaataagacatcttttattttttatttaaaaaacatagtggtagcagatcttataatgacgctcaccttccctttccgtatcgtgcatgatgccgggttcggaccatggtactttaagttcatcctgtgtcggtacacctcagtgctgttttacgctaacatgtacacaagcatagtcttcctcggattgatctcgattgataggtaccttaaagtggtcaaacctttcggagattccaggatgtactctatcacgtttactaaggtcctgagcgtctgtgtctgggttatcatggctgtccttagcctacccaacattattctcactaatggccagccaacagaggataatatccacgactgctccaagctgaaatcacctttaggcgtgaagtggcacacagctgtgacttacgtgaactcttgcctgtttgtggccgttcttgtgatccttatcggatgttacatcgccatttctcgctatatacacaaaagtagtaggcagttcatatcacagtcttcccggaagcggaaacacaaccagagcatccgcgtggtggttgcggtgttctttacttgctttctgccataccacctgtgcagaattccttttacattttctcacctggaccgactcctcgacgagtcagcccagaagattctttactactgtaaagagattactttatttctgtcagcgtgcaatgtatgcctggatccaatcatctatttcttcatgtgtcgctccttcagtcgaagactgttcaagaagagcaatatacgcacacgctctgagagcatccgaagcttgcagtccgtgaggagatctgaggtacggatatactacgactacaccgacgtgtag

SEQ ID NO: 117908 - DNA, 1368 bp, Artificial Sequence
  Description of Artificial Sequence: Synthetic coding sequence
atgtcctttcttatcgattcatcgattatgatcaccagtcaaatattatttttcggatttggttggctctttttcatgcgccagctgtttaaggattacgaaatccgtcaatacgtcgtccaggtgatcttcagcgttacgttcgccttctcttgtaccatgttcgaactcattatctttgaaatactgggcgtgttgaattcgagcagccgctacttccattggaagatgaacctttgtgtcattctgctgatcctggtctttatggtacccttttacatcgggtacttcattgtctccaatattcgcctcctccataagcaacggctactgttttcctgtcttctgtggttgacctttatgtactttttttggaaactgggagacccgttccccattttaagccctaagcatggtattctctctatagagcagctcattagcagggtgggagtgataggagtgacccttatggctctcctgtctggatttggagcagtcaactgtccttatacctatatgagctacttccttcggaacgttacagatacggatatcctggccctcgaacgcagactgttgcagacaatggatatgatcatttcaaaaaagaagagaatggcgatggcaagaaggactatgttccagaagggcgaggttcataacaagccttctggattctgggggatgatcaagagcgtgacaacttctgcttcaggcagcgagaatctgacactgattcagcaagaggtggatgccttagaggagctctctaggcagctgtttctggagactgctgacctatatgcaacaaaggagcggattgagtattccaaaaccttcaaagggaagtactttaacttcttaggctattttttcagtatctattgtgtgtggaagatctttatggctaccatcaacatagtctttgaccgcgtgggcaagacagaccctgttaccaggggtattgagatcactgtgaattatctcggaatacagttcgatgtgaagttttggtcacagcacatttccttcatccttgtcggcattatcatcgtaacatccattagggggctactgatcaccctgacgaagttcttctatgccatttccagcagcaagtcatcaaacgttatcgttttactgctagctcagattatgggaatgtatttcgttagctctgtcctgctgataagaatgagtatgcctcttgagtaccggacaataataactgaggtcttgggtgagctgcagttcaacttttaccacagatggttcgacgtgatattcctggtatccgcattgagctctatcctgtttctgtatctggcacacaagcaggctcctgaaaagcagatggccccctag

SEQ ID NO: 117909 - DNA, 1008 bp, Artificial Sequence
  Description of Artificial Sequence: Synthetic coding sequence
atgtacttcttttggaagctgggagatccatttccaattctgagcccaaagcacggtattctctctatagaacagttgatctccagggtgggagttatcggggttacactgatggccctgctatccggctttggggccgtgaactgcccctacacttatatgtcatattttcttcggaatgtcactgacactgacattctagctctggagcgtcggcttcttcagacaatggacatgatcatatccaaaaagaaacggatggccatggcaaggcggacaatgtttcagaagggtgaagtacacaacaagccctccggtttctggggaatgatcaaaagtgttacaacctctgcttctgggtccgagaacctgactctgattcagcaggaggttgacgccctcgaagaattgtctcgacagttgtttctcgaaacagctgacctttatgctacaaaagaacgaatcgagtattcaaaaacctttaagggcaagtattttaacttcttgggctacttcttctccatttactgtgtgtggaagattttcatggctaccattaacattgtgtttgatcgcgtgggaaagacagaccctgttactagaggaattgagattaccgtgaactatcttggtatccaatttgacgttaaattctggagccagcacatcagcttcatcctggtggggattattatcgtcacttcgattcgcgggctcctaatcacacttaccaaatttttttacgcaatctccagcagcaagtcctcaaatgtaattgttctgctcctggcgcagattatgggaatgtatttcgtgtcctcggtcttactcatccgtatgtctatgccacttgaatatcgcacaattattactgaggtgctgggcgagctgcagttcaatttctatcaccgatggttcgacgtgatctttctggtgtcagctctgtcttctatcctgtttctttatctggctcataagcaggcccctgagaaacaaatggccccctag

SEQ ID NO: 117910 - DNA, 1368 bp, Artificial Sequence
  Description of Artificial Sequence: Synthetic coding sequence
atgagttttctcatcgattcctctatcatgattactagccagatcctctttttcggctttgggtggttgttctttatgcgtcaactcttcaaggactacgagattaggcagtacgtagtacaggtaatcttcagcgtcacctttgccttttcctgtactatgttcgagctgattatttttgaaatcctcggcgtgctcaattccagctcccggtactttcactggaaaatgaacctctgtgtgatcctcctgattctagtttttatggtgcctttttatattggctatttcatagtctcaaatatccgcttgctacacaagcagcggctcctcttcagctgtctgctatggttgacttttatgtactttttttggaagttaggagacccgtttcccattttatcaccaaagcacgggattctctcaattgaacagcttatctcacgagtgggagttattggggttacactgatggctctgctgtccggcttcggagccgttaactgtccttatacctatatgagctacttcttgcgtaatgtgactgacacagatattctagccctcgagcggcgattgctgcaaacaatggacatgattattagcaagaaaaaacgtatggccatggccaggaggaccatgttccagaagggtgaagtacacaacaaaccttcaggcttttggggcatgattaagagcgtcacaacatcagcctcgggaagcgaaaacctgacactgatccaacaggaagtagacgctctcgaggagctcagccgtcaactgtttctcgaaacagccgatctctacgctactaaagaaagaatcgaatacagcaagactttcaaagggaagtactttaattttcttgggtatttcttctccatctactgtgtgtggaagatcttcatggcaacaattaacatcgtgttcgaccgggttgggaaaacagatccagttactcggggaatcgaaattacagtcaattacctgggcatccagtttgatgtcaaattttggtcccaacatattagcttcatcttggtcggcatcattatcgtgactagcattcgcggcttgttaatcactttgacgaaattcttctatgcaattagctcaagcaagagctctaatgtcatcgtgcttctgctggcacaaattatgggaatgtatttcgtatctagcgtactccttatccgcatgagtatgcccttagagtacaggaccatcattaccgaagtgcttggcgagctgcagttcaacttttatcataggtggtttgacgtcattttcctggtctctgccctgtcgagtatcctctttctctacctggcccacaaacaggcccccgagaagcagatggccccgtag

SEQ ID NO: 117911 - DNA, 18921 bp, Artificial Sequence
  Description of Artificial Sequence: Synthetic coding sequence
atggatatcttcctggtgttggggatgcccagtgcatcactcttagtgaacctgctttcggccctgctgatccttttcgtgttcggggaaaccgaaatccgattcacaggccagacagagttcgtggtaaacgagacatccactactgtgattcgcttaattatagaaagaatcggggaacccgcaaacgtaactgccatcgtgtcgctgtatggggaagacgccggagatttttttgatacatatgccgcagcctttatccctgcaggggagaccaataggactgtctacatagccgtttgtgatgacgatttacccgaaccagacgagacctttatctttcacctgacactgcagaagccgtctgcgaatgtcaaactggggtggccccggacagtgacagtaactatcctctccaacgataacgcctttggaatcatctctttcaacatgctgccatctatcgctgtgtccgagcccaaggggagaaacgagtctatgcccttgacacttatacgagagaaaggtacatacgggatggtcatggtgactttcgaggtggagggcggacctaatccaccagacgaagatctgtcccctgtgaagggaaacataacctttccaccaggcagagctacagtcatatataacttaactgtcttagatgatgaagtgcctgaaaatgacgagatcttcttgatacagctcaagagcgttgaaggcggtgccgagatcaacaccagccgtaacagcattgaaatcatcatcaagaaaaacgattcgccagtgcgattcctacagtctatatatctcgtgcccgaagaggatcacatactgattatccctgtggttcgcggaaaggataataatggaaacttaattggatcagacgaatatgaagtgagcattagctacgccgtgactaccggcaattctactgcccatgcccagcagaacctggacttcatcgaccttcaacctaataccactgttgtgttccctccattcatccatgaatcccatctgaagtttcagatcgttgacgacacaattccggaaattgctgaatcatttcatataatgttgctgaaagatactctgcaaggcgatgccgtgttgatcagtccgtcagtggttcaggtgacaataaagccgaatgacaaaccatacggtgtgctctcttttaatagcgtgctttttgagcgcactgtcatcattgacgaagaccgcattagccgttatgaggaaataacagtggtacggaatggtggcacccacgggaacgtttccgcaaactgggtgttgacgcgaaattcaaccgacccgtcacctgtgacggcagacattcgcccatcctctggggtgctgcactttgcccagggacagatgttggcaaccattcccctcactgtcgtggatgacgaccttcctgaggaggccgaagcataccttttacagatcctgccacataccatccgcggaggggctgaagtgtccgaaccggccgagctgctgttctatatccaggatagtgacgatgtttacggactcataaccttttttcccatggagaaccagaagatcgagagttcacctggggagaggtacttatctttgtccttcaccagactcggaggtactaagggtgacgtaaggctgctctattccgttttatacattcccgcaggagctgtggatccccttcaggctaaggagggtatcctgaacataagtagaagaaatgatctgatctttccagagcagaagacgcaggtcacgaccaagctgcctattcgcaatgatgccttcctccagaacggagcccacttcttagtgcagcttgagactgtcgaactgctgaacatcatcccgctcatccctcccatctctcccagattcggcgaaatctgtaacattagcttactagtcacgcccgctatcgccaatggagagatcgggtttttaagcaacctgcccattatcctgcatgaacctgaagattttgccgccgaggtagtgtatatacctcttcaccgcgacggaacggacggccaggcaacagtgtactggagtctgaagccatctggcttcaactctaaagccgtgacaccggacgatatcggaccctttaatggctctgtgctcttcctctccgggcagtctgacactaccataaacattaccatcaagggcgacgacattccagaaatgaacgagactgtgaccctctcattggaccgagtgaatgtcgagaatcaggttctcaagagtgggtatacatctagggatctaatcattttagagaatgatgacccaggcggagtgttcgagttttcacctgcctctcgcggtccttacgtgataaaggagggggagtcggtggagctgcacattatccgatctagagggagcctggttaaacaatttctgcactacagggtcgaacccagagattcaaatgagttttacggaaatactggtgtactcgagtttaagcctggggagagagaaatagtaatcacactactggcccgcctcgacggaattcccgaactggacgagcactattgggtcgttctttcatcacatggggagcgggagagtaaactcgggtctgcgaccattgtgaacatcacaatactcaagaacgatgatccgcacggcatcatcgagtttgtgtcagacgggttgatagtgatgattaatgaatccaaaggtgacgccatctatagcgcagtatacgatgttgtccggaaccggggtaatttcggagacgtgagcgtatcatgggttgtgagtcctgacttcactcaggatgtgtttcccgtgcagggaactgtggtgttcggagatcaggaattctccaaaaatattactatctattccttgcctgacgagatccctgaggagatggaagaatttacggtcattctcctgaatggaacaggaggcgctaaggtgggcaaccggactacagccacccttcggatccgacggaacgacgaccccatctatttcgccgaacctcgggtcgtgcgcgtgcaggaaggcgagactgccaacttcacagtgttgaggaacggcagtgtggatgtcacctgtatggttcagtacgcaacaaaagacggcaaggccactgccagagaaagggatttcatacctgtggagaagggcgagacactcatcttcgaagttggaagtagacaacaaagcatctccatcttcgttaatgaagatggtattcctgagaccgacgaacccttctacatcatcctgctaaatagcaccggggacaccgtggtctaccagtacggtgttgccaccgttattatcgaggcaaacgacgatcccaatggcatattttcactcgagccaattgataaagccgtggaggaagggaaaacgaatgctttctggatactccgccaccgggggtattttggctccgttagcgtgagttggcagctatttcagaacgactccgctctgcagcctggacaggagttttacgagacctccggcaccgttaattttatggacggcgaggaagcaaagcctatcatactgcacgcttttccggataaaattcccgaattcaatgagttttactttttgaagcttgtgaatatctcaggcggctctcctggacccgggggacagctcgctgagaccaatctccaggtgacggtcatggtccccttcaatgacgacccttttggcgttttcattcttgaccctgagtgcctcgagagggaggtggctgaagatgtgctgagcgaggacgacatgtcatatatcacaaacttcacaatcctgcggcagcagggcgtgttcggcgacgtgcagctggggtgggaaattcttagctcagaatttcctgcaggcttgcctcctatgattgacttccttctagtgggaatcttccctaccaccgtccatctgcaacagcacatgaggagacaccatagcggcaccgacgcactttactttaccggtcttgagggggctttcggcacagtaaatccaaaatatcacccatcacgcaacaataccattgccaattttaccttttcggcatgggtgatgccaaatgccaataccaatgggtttattattgccaaagacgacggcaacggatctatttactacggcgtcaagatccaaacgaacgaaagtcacgtgactttgtccctgcattacaagacactaggctccaacgccacttacatcgccaaaactacagtcatgaagtacttggaagaatccgtttggctgcatttactgattatcctggaggatggaataattgagttctacctggacggtaatgctatgcccagggggataaaatctttgaaaggcgaagcaattacagacggcccgggaatcctgcgcattggcgctggtatcaacggcaacgacaggttcacaggtttgatgcaggacgtgagatcctatgagcgtaagctcaccctggaggagatatatgagttacatgccatgccagctaagagcgacctccatcctataagtggatatctggaattcaggcagggggagacgaataagtccttcattatttctgccagggacgataacgacgaggaaggggaagagctgttcattttaaagttagtctcagtttacggaggagctcgcatctcggaagaaaacacaaccgcccggctaaccattcaaaagtccgacaacgctaacgggctgttcggcttcaccggcgcttgcatccccgagatcgccgaagagggctcaaccataagctgcgttgtcgagaggactaggggcgctctcgactacgtgcatgtgttctataccatcagtcagatagagacggacggaattaattacttggtcgatgactttgctaacgcttcggggacaattacctttctcccttggcaacggtcagaagtgctgaatatctacgtcctggatgatgatatcccggagctcaacgagtatttccgagtaaccttagtgagtgctatccctggcgacggaaagctgggttctaccccaacctccggagccagcatagaccccgaaaaggagactacggatattacaatcaaagccagcgatcatccatacggcttgctgcagttctccaccggcctgccaccgcaaccgaaggacgccatgacactgcccgcatcctcagtgccccatatcacagtagaagaggaggacggggagatcagactcctagtgatccgcgcccagggactgttgggcagagtgacggctgagtttagaaccgtttcactgacagcgttttcccccgaagactatcaaaacgtggcaggcacactggaatttcaaccaggggagcgctataagtacatatttatcaacatcaccgacaattccatcccagaactggaaaagtcattcaaggtcgagctccttaacctcgaaggtggtgtagcggagctctttagggttgacggatcaggttctggagatggggacatggagttcttcttacccactatccataaacgggccagcctcggagtggcttcccaaatcttagtgacaatcgcagcctccgaccacgcccacggggtgtttgagttttctccagagtctttgtttgtctccggtactgaacccgaggacggctattccactgtgaccttgaatgttataagacaccacgggaccctgtcccctgtcacgctccactggaatatcgactctgacccagacggcgaccttgcattcacttctggcaacatcactttcgaaatcgggcagacatccgcgaatataactgtcgaaatcctgcccgatgaagatcctgagctagataaagcattctcagtctcagtgttgagcgtctcaagtgggtctttgggagcccacatcaacgcaacactgacagtgcttgcttctgatgatccctacggaatttttatcttctctgagaaaaacagaccagttaaagttgaagaggctacgcaaaatattacactgtccatcataagattaaagggcttaatgggcaaagtgcttgtgagctacgcaactctagacgacatggaaaaacctccctactttcccccaaatctcgccagagcaacccagggtcgcgactacattccggcatcaggcttcgccctatttggagcaaatcagtccgaagcgacaattgcgatctctatcttggacgacgatgagccagaaagatcagagagtgtgtttatcgagctgctaaattcgactctggtggccaaggtgcagtctcgatccattcccaacagtccaaggttaggccctaaagtggagacaatcgcacaacttattatcattgccaatgatgatgcctttggcacgcttcagctgagcgcccccatcgtgagagtcgccgagaaccacgtgggccctatcatcaacgttacacgcactggcggagcattcgcagacgtgtcagtgaagttcaaggcagtccctattactgcaattgctggggaggattactctatagccagttctgatgttgttctgctggaaggggagacttcaaaagctgttccaatctacgtcatcaatgacatataccccgagttggaggagtccttcttggtgcaattaatgaatgaaaccactggaggagccagactcggggcgcttactgaggctgtcattatcattgaggcttcagacgatccctatggactattcgggtttcagattactaaacttatcgtagaggagcccgaatttaacagcgttaaggtgaatcttcctattatcagaaactctgggacgctgggaaacgttactgtgcagtgggtggccacaatcaatggacaacttgctaccggggacttaagagtcgtgtcgggtaacgtaaccttcgccccaggagagaccatccaaaccttgctgcttgaagtactggcagatgacgtgccagagatcgaggaggtcatccaggttcagctgacagacgcctccggaggcggaactatcggactggatagaatcgccaacatcattatccctgcaaatgacgatccctacgggaccgtggccttcgcccagatggtgtacagggttcaagagccattggaacgatctagctgtgctaatattacggtgagacggtcagggggtcattttggcaggctgctgctcttctactccaccagtgacatcgacgtcgtcgctctcgctatggaggagggacaagatctcctgtcatactatgagtctccaatacaaggcgtacccgacccattgtggcgtacttggatgaacgtttctgccgtcggcgagcccctgtatacatgtgcaacgctgtgtctcaaggagcaggcctgttcggccttcagctttttttctgcttctgaggggccgcagtgcttctggatgacatcctggatttcaccagcagtaaacaactctgatttctggacatatcgtaagaatatgacacgcgtcgccagtttattctcggggcaggctgtcgccggttcagattatgaacctgtgaccagacagtgggcgatcatgcaggagggcgatgaatttgctaacttgactgttagtattttgccagacgacttccccgaaatggacgagagctttttgatttccctgctggaagtgcacctgatgaatatctccgcctcacttaaaaatcagccaacgatcgggcagcccaacatttccactgtggtcatcgctctgaacggcgacgcattcggggtgtttgtgatttacaatattagcccaaatacctctgaagacggactgtttgttgaagtgcaggagcagccacagactcttgtagagttgatgatacacaggaccggcggctccctgggccaggttgcagttgagtggagagtggtgggtggcacagctaccgaaggactggattttatcggtgctggcgaaatcctcacttttgctgaaggcgagacaaaaaaaacagtaattctaaccattctggatgatagtgagcccgaagacgatgagtctatcattgtatcactcgtctatacagaaggaggatctcgtatcttaccatcgtctgacacggtgcgtgtgaatattctggccaacgacaatgtggccggcatcgtgagctttcaaacagcctctcgctccgtgatcggacatgaaggtgagatactgcaatttcacgtgatcagaacctttcctggaagaggcaacgtaactgtcaattggaagattattgggcagaatctggaattgaatttcgcaaactttagtggccagctcttctttcctgaaggctccctcaacactacgctatttgtccatctattggatgacaacattcctgaagaaaaagaggtctaccaggtcatactgtacgatgtccggacgcagggcgtgccccctgctgggatcgctctgctagacgcccagggatacgcagcagtattgactgtggaagcaagcgacgaaccccatggagtgttgaattttgccctttcaagtaggttcgtcttgcttcaggaagccaacattacgattcagttattcattaatcgggaatttggctctttaggagcaatcaatgtcacatacactaccgtgcctggtatgctgtcactgaaaaatcagactgtcggtaacctcgcagagcccgaggtggacttcgtcccaatcatcggatttctgatactggaggagggtgagaccgctgccgcgatcaacatcacaattctcgaggatgacgtgccagagctggaagaatattttctcgtcaacctcacgtatgtgggcctgacaatggccgccagtaccagcttcccccccagactcgatagtgagggactgacagcccaagtgatcattgacgccaacgacggggcgcgcggcgttatagaatggcaacagtctcggttcgaggttaatgagactcacggatcactgaccctggtcgctcagagaagtcgagagccactgggccatgtcagcctgtttgtgtacgctcagaatttagaagcccaggtaggactcgattatatttttacgcccatgatccttcattttgctgacggagaacggtacaagaacgtgaacataatgattcttgatgatgatattccagaaggtgacgagaaattccagctcatccttaccaacccgtccccaggcctggaactggggaagaacactatcgccctgatcattgtgctggcaaacgatgatggaccaggagtgctcagcttcaacaattccgagcacttttttcttagagagcctaccgctttgtatgtccaggaatctgttgctgtgttgtatattgtcagggagcccgctcagggactcttcggaactgttacggtgcagtttatcgtcaccgaggttaactcttcaaatgagagcaaagacttgactccatcaaaaggctatatcgtgttagaggaaggggtgaggttcaaagcattgcagatcagcgctattctggacacagaacccgagatggacgagtattttgtctgcaccttgttcaatccaactgggggggccaggcttggcgtccacgtacaaaccctgataacagttctgcaaaatcaggcaccgctgggtctctttagtattagcgcagtggaaaacagagcgacatcaatagacatcgaggaagcaaataggaccgtttatctgaatgtcagcaggacaaatggaattgaccttgcagtatccgtgcagtgggaaactgtgtccgagacagcgtttggcatgcgaggaatggacgtcgtgtttagtgtgtttcaatccttcttagatgagtctgcttcgggctggtgcttctttacacttgaaaacctcatctacggcatcatgctacgcaaatccagtgtgactgtgtatcgctggcaaggaatctttatccccgttgaggacctgaatatcgagaaccctaaaacgtgcgaagcttttaatattggttttagtccatacttcgttattactcacgaagagagaaacgaggaaaaaccttcccttaacagcgtgtttacctttacctctggtttcaaactgttcctggtgcagactatcattatccttgaaagctctcaggtacggtactttactagtgactcacaggattatctgatcattgcctcccagcgggatgactccgaactgacacaggtatttcgatggaacggaggaagctttgttttgcatcagaaactccccgttaggggagtcctaacagtagccctgttcaacaaaggcggatctgtattccttgccatatcacaagccaatgcacggcttaattctcttctgtttaggtggtctggatcgggctttattaatttccaagaagtgccagtgtccggaactaccgaggtggaagccctgagctcagctaacgacatttatctaatcttcgccgagaacgtgttcctgggcgatcagaatagtattgatatctttatatgggaaatgggccagtcctcattccgttacttccagtcggttgatttcgctgcagtcaataggatccactcattcacacccgccagtgggatcgctcacatcctgctcatcggtcaagatatgagcgccctatactgttggaattcagaaagaaaccagttttcgttcgtgctggaagtccctagtgcttacgatgtagcatctgttaccgtcaagtcgctgaattcctccaagaacctgattgccctcgtgggcgctcattctcacatttacgaactcgcgtatattagtagccatagcgacttcatccccagttccggagaacttattttcgaaccaggggagagggaggccactatcgccgtgaatatcctcgatgatacggtgcctgagaaggaagagagttttaaggtacagcttaaaaacccgaaggggggtgccgagatagggattaacgacagtgtgacaattaccattctgagtaacgacgatgcatacgggatcgtggctttcgcacaaaatagtctttataagcaggtggaggagatggaacaggattcactcgttaccctgaatgttgaaagactgaaaggcacgtacggacggatcactattgcctgggaggcggatggatcaatctccgatattttcccaacatcaggagtgattctgttcaccgagggtcaggtgttatccaccataacgctgacgatcctggcagacaacattcctgagctgtcagaggtggttatagttaccctcactcggatcaccaccgaaggggtggaagattcctacaaaggtgccactattgaccaagaccgctccaagtcagtcataacaacactgccgaacgacagtccattcggacttgttggctggcgagcagcgagtgtgtttattcgcgtggcagaaccgaaggaaaataccacaactctccagttgcaaattgctagagacaaaggactcctcggcgacattgccatccacttaagggctcaacccaattttctgctccacgtcgataaccaggcgacagagaacgaggattacgtgctacaggagactattattatcatgaaggaaaacattaaggaagcacatgccgaggtgtcaattctgcccgatgacttgccagagctggaggaaggcttcatcgtaactatcaccgaggtgaatctggtaaacagcgatttcagcacggggcagccttctgttcggcgccctggcatggagattgctgagattatgattgaagaaaatgacgatcctcgcggaatttttatgttccacgtaacgcggggggccggagaggtcattacagcctatgaagttcctcccccccttaatgtgctccaggttcctgttgtacgcctcgccggatcatttggcgccgtgaatgtctactggaaggcaagccctgactcagccggtctggaagacttcaagccatcacacgggattctggagttcgccgataagcaggtgacagcaatgattgagatcaccataatcgatgacgccgagtttgagctaactgaaacatttaatatctccttgatatctgttgctggcggagggaggctgggtgacgacgttgtcgtgaccgtggtaatccctcagaacgatagtccttttggcgttttcgggtttgaggaaaaaactgtcatgattgatgaatcactcagttctgacgatccggattcctacgtaacgctaactgtggttcgatcacccggaggtaagggcacggtgcgtctggagtggactattgatgaaaaggcaaaacacaacctgtctccgctgaatggtaccttacattttgacgagacagaatctcagaaaaccattgtccttcatacccttcaggacaccgtgttggaggaggatcgcaggttcaccatccagctcatcagtattgatgaggtcgaaatctctcccgtcaaggggtcagcctccatcattatacgcggggacaaacgggcaagtggagaagttggcatcgcccctagcagccggcatatcctgataggagagccctccgctaagtacaacgggacagcaatcatttcattagtgagaggacccgggattctcggtgaggttacagtcttctggcgaattttcccaccttctgtcggagagttcgccgagaccagcggaaagctaacgatgcgcgatgagcagagcgccgtgatcgttgttattcaggcactgaacgatgacatcccagaggagaagtctttttatgagtttcagctgactgctgtgagcgaaggcggcgtgctgtccgaaagtagtagcaccgccaatattacagtagtggcgtccgacagtccttacgggcgcttcgcattctctcacgagcagttgagggtgtctgaagctcaacgggtcaatattacaatcatccgctcttcaggggacttcgggcacgttagactgtggtacaagaccatgtcaggcactgctgaagccggtcttgattttgtccccgccgccggtgagcttttattcgaggctggcgagatgagaaagagtctccatgtcgaaatcctcgacgacgactacccagagggccccgaggaatttagtcttacgattaccaaagttgaactccaggggagagggtatgatttcactattcaggagaacggcctgcagatcgatcagcccccagaaatcggcaacatcagcatcgtgagaatcatcattatgaagaatgacaacgctgagggaataatagagttcgatccgaagtataccgcatttgaggtggaggaggatgttgggttgatcatgatccctgtggtcagacttcacgggacctacggctatgtcaccgccgatttcatcagtcagagctcctccgccagccctggaggggtggattacatccttcatgggtccacagtgactttccagcatggtcaaaacctatccttcatcaacatttccatcattgacgataatgagtccgagtttgaggaacccatcgagattctcttaacgggggcaaccgggggagctgtgcttgggcgccacctggtgtcacgaattataatagccaagagcgactctcctttcggcgtgatccgttttttgaaccagtcaaagatctccattgccaaccctaactcaactatgatcctttccttggtgttggagcggactggcggccttctcggtgaaattcaggttaactgggagaccgtagggcctaacagccaggaggcattgctgccacagaatagggatatcgcagatcctgtttccggcctcttctatttcggtgagggagaaggcggcgtaaggactattattttgaccatttacccacacgaggaaattgaagtggaggaaacatttatcattaagctgcacctcgtcaagggcgaagcaaagctggatagcagagctaaggatgtgacgttaaccatccaggaattcggggaccctaatggcgtcgtccaatttgccccagagacactatctaaaaagacctattctgagccattggccctcgagggccctctcttaattactttttttgtaagacgggtgaagggcacctttggggagatcatggtgtattgggaattgtcctccgaattcgatattactgaagactttctgtcaacatcaggttttttcactatcgcagatggtgaatccgaggcatccttcgacgtacacttgttaccagatgaggtcccagaaattgaggaagactatgtcattcaactagtgagcgtggaagggggcgctgagctagacctcgagaagtctattacctggttctccgtgtatgcgaatgacgatccccatggcgtgttcgcattgtactccgatcggcaaagtatcttgataggacagaacttaatcaggtcaattcagatcaatataacacgattagccggcaccttcggtgacgttgccgtaggattacggatctcctctgatcacaaggaacaacccatcgtgaccgaaaacgcagaaaggcagcttgtcgttaaggatggggccacatataaggtcgacgtggtgcctattaagaaccaggtcttcctgagcctgggctcaaacttcacactgcaactcgtgactgttatgctggtgggaggtcgcttttacgggatgcctaccatcttacaggaagcaaagtctgctgtgctgcctgttagtgaaaaagctgctaatagccaggttggtttcgagtcaaccgctttccagttgatgaatatcacggccgggacgtcccatgttatgatttcccgacgggggacttatggcgctctgtccgttgcctggaccaccggctacgcacccgggcttgagattcctgagttcatcgttgtgggaaacatgacgcccacactcggcagcctatcattctcccacggtgagcagcggaagggggtgttcctctggacttttccctctccagggtggccagaggccttcgtccttcatttgtcaggtgttcaatcctcggctcccggcggggctcagctccggtcaggcttcatagtggccgagatcgagccaatgggtgtgtttcagttcagcaccagctctcgaaatatcatcgtgagtgaggacacccagatgatccgactgcatgtgcagcgacttttcggatttcacagtgacctgatcaaggtcagctatcagacgaccgcgggcagtgctaaacccctggaggacttcgaaccagttcagaacggcgaactattttttcaaaagtttcaaacggaggtggattttgagatcactatcattaacgaccagctcagtgaaatagaggaatttttttacatcaatctgacgagtgtggagattcggggtttgcagaagttcgacgtaaattggtcccctcggctcaatctggactttagtgtagcagtgatcacaatcttagacaacgacgatctggccggaatggatatctcctttccagagactaccgtcgcagtcgccgttgacaccactctgattcccgttgaaactgaatctacgacatatctgtccacatctaagactaccacgatcctgcagcctaccaacgttgttgccatcgtcaccgaggccacaggagtttcagctatccctgagaaactggtcaccttacacgggacccctgccgtgtcagagaagcctgacgtggccaccgtaacagctaatgtgtctatccatggaactttctcactgggacccagcatcgtgtacattgaagaagagatgaagaacggcaccttcaatacagctgaagttctgattagacgcacggggggatttactggaaatgtatcaatcacagttaaaacatttggggagcggtgtgctcagatggaaccaaacgccttacctttcagaggaatctacggtatttcgaatttgacctgggccgtagaagaagaagacttcgaagagcaaactctcacgcttatcttcctggatggagaacgcgagagaaaggtaagtgtgcaaatcctggacgacgacgaacccgaaggccaggaattcttttacgtctttctgaccaatccccaaggcggggcgcagatcgtggaggaaaaggatgacaccggattcgcagccttcgccatggtgattatcactggatcagatctgcacaacggaataatcggattttcagaggagtcacaatcaggactggaactgcgggagggcgctgtgatgcgccgcctgcacctcattgtgacccgacaacccaatagggcgtttgaggatgtcaaagtgttctggcgagtcacgctaaacaagactgtggtggtgcttcagaaagacggcgtcaacctcgtcgaagaactccagtccgtttcagggactaccacctgcaccatggggcaaaccaaatgttttatctcaatagaacttaaacccgagaaagtcccccaggtggaggtctatttcttcgtggaactgtatgaggcaaccgccggcgcagcaatcaacaacagtgcacgctttgcgcagatcaaaatcctggagagcgatgaatcccagagcttggtttacttcagcgtgggctctcgtctagctgtcgcccacaagaaggccactctgatcagcctgcaggttgccagagattccgggacaggcctaatgatgtctgtcaactttagtacccaggagctcagatcggccgaaactattggaagaacaattatcagccccgctatctctgggaaagacttcgtaattacagagggaaccctcgtgttcgagcctggacagagaagcacggtgctggatgtcatactcacaccagaaactggtagcttaaactcattccctaagagattccagatcgtcctgtttgatcctaagggcggcgctcggatcgacaaggtttacggaacagccaatatcactttggtgtcggacgctgattctcaggccatttggggcctcgcagaccagctccaccagcccgtcaacgacgacatactgaatcgcgttctgcatacaattagcatgaaagtagcaaccgagaataccgacgagcaactttccgcaatgatgcaccttattgagaaaattacgaccgagggaaaaatacaggctttctcagtggcttccagaacgttgttttatgagatcctgtgcagccttattaaccctaaaagaaaggatacccggggattttcgcatttcgctgaagtgaccgagaattttgctttcagcttgctcacaaacgtcacgtgcggatctccgggcgaaaaatcaaaaaccatcctggattcttgtccttatctgtcaattctggctctccactggtacccccagcagatcaacgggcataaatttgaaggaaaagaaggggactacatccggatccctgaacgcttgcttgatgtgcaggatgcagagatcatggccggcaaatcaacctgtaagcttgtgcaatttaccgagtattcttctcaacagtggttcatctccggcaacaacctgcctaccctgaagaacaaagtgctgtccctctccgtcaagggacagagttcacaactcttgacaaacgataacgaagtattgtacagaatctatgccgccgagccccggatcatcccacagacgagcctctgtttgttgtggaatcaggctgcggcctcttggttgtccgacagccagttctgcaaggtcgtcgaggagacggccgactatgtggaatgtgcttgtagtcatatgtctgtgtatgctgtttacgcaaggactgataacctgtcctcatataatgaagcattcttcacaagcggtttcatctgcatcagcggactatgtctagcagtgctcagccacattttctgcgccaggtactccatgtttgctgccaaactgctgacacacatgatggccgcaagcttgggaacacagatactatttctggcttccgcttatgcctcacctcagctcgctgaggaatcctgctccgcgatggccgctgtaacccactacctttacctgtgccagttttcatggatgttgatacaaagtgttaatttctggtacgtgctggtaatgaatgacgagcataccgagcgacgctacctgctctttttcctcttgtcatggggtcttcccgcgtttgtcgtgatccttctgatagtgattctgaagggaatttatcatcagagtatgtcccagatctacgggctaattcacggagatttatgcttcatccccaatgtctacgccgcgctgtttacggcagcgcttgtccccctgacatgccttgtggttgtctttgtggtattcatccacgcttatcaggtgaaaccgcaatggaaggcatacgatgacgtattccgcgggcgcactaacgcagccgaaattccccttatcctttatctcttcgctctaatctccgtgacttggttatggggtggcctccacatggcataccgacatttctggatgttggtcctcttcgtgatatttaacagcctccagggactgtacgtgtttatggtctatttcatcttgcataatcagatgtgctgccctatgaaagcctcctacactgtggagatgaacggacaccctggaccgagcacggcattcttcaccccagggtctggaatgccgccggcgggcggtgaaattagtaaatcaacccagaatctgatcggagctatggaggaggtcccaccagactgggagcgggctagttttcagcaaggctcccaggcatcccccgaccttaaaccatctccccaaaatggagcaactttcccatcctctgggggctatggccaaggatctctgatcgcggatgaggaatcccaggaattcgacgacctcatctttgccctgaaaaccggagcaggcttgtctgtctccgacaacgaatccggtcaggggtctcaagaaggaggaactctgacggactcacaaattgtggaactcaggagaatccccatcgctgatacccacctatag

SEQ ID NO: 117912 - DNA, 6921 bp, Artificial Sequence
  Description of Artificial Sequence: Synthetic coding sequence
gtggatgtgttcatgttcctcggcatgccatcagcttcattgctagttaatttactgtccgcactattgattctgtttgtattcggagagactgagatccgattcacaggtcagacggagttcgtggtgaacgagacaagcactacagtcattcgcttgattatagagaggattggggagccagctaatgtgacggcaatcgtctccctgtatggggaggatgcaggtgattttttcgatacctatgcagcagcatttatccccgccggagagactaaccgaacagtgtatatcgccgtatgcgacgacgatctgccggagcctgacgagacgttcatcttccacctcaccttgcagaagccttccgctaacgtcaagctgggttggccccgcacagtgacagtgacaatcctgagcaacgacaatgcctttgggatcatatcttttaacatgctccccagtattgccgtgagcgaaccgaagggacgaaatgagtcaatgccactgacattgatccgggagaagggaacgtatggaatggttatggtgaccttcgaggtcgaaggcggacctaatccccctgatgaggatctgtcgcctgtcaaaggcaacatcacttttccgcccgggagagccaccgtcatttataatctgactgtccttgatgatgaggtcccagaaaacgatgagattttcctgatccaactgaagtctgtggagggcggcgctgaaatcaatacaagcaggaactccatcgaaattatcatcaaaaaaaacgattctcccgtcaggttcctgcagtctatttatctggtgccggaggaagaccacattttgataatccccgtggtgcgagggaaggataataacggcaatctgataggcagcgatgaatacgaggtatccattagctatgccgtgacaactggaaacagcaccgcccatgcccagcaaaatctggatttcatcgacctgcagccaaacacaacggttgtattccccccgtttatccatgaaagccacctcaagtttcagatagtcgacgatactattcctgagatcgctgaatccttccatattatgctgctcaaggataccctgcagggcgacgccgtgcttattagcccctcggtcgtccaagttaccatcaagcctaacgacaaaccctatggtgttcttagtttcaactcagttctgttcgaaaggacagtcatcatcgacgaagatcgcattagcaggtatgaagagattaccgtggtccgtaacggggggactcacggtaacgtgtctgcaaactgggtccttaccaggaattctaccgatcccagccccgttactgctgacatacgcccttctagtggagttttgcattttgcgcagggtcagatgctggcgacaatcccgctgacagtggtggacgatgaccttccagaggaggcggaagcctacctgctacaaatccttccgcacactatccgcggcggcgctgaggtcagcgaaccagctgaactgctcttctacatccaggattccgatgacgtttacggactcattacctttttcccaatggagaatcagaagatcgaaagtagccctggtgagcgctatctgtccctctccttcacccgacttgggggcacaaaaggggatgtgcggcttctgtactctgtgctctacatccccgccggcgccgtggatcccctgcaggctaaggagggcatcctgaatatttcccgacggaatgacctgatcttccccgaacagaagacccaggtcacaaccaagctgcctatccggaacgacgcttttctgcaaaatggcgcccatttcctggtgcagctggagacagtggagctcttgaatatcattcctctgattccacctatctccccgcgatttggcgagatatgcaatatcagcctgcttgtcaccccagcaatcgctaatggggaaatcgggtttctctccaacttacctatcattctgcatgaacccgaggactttgccgccgaggttgtgtacattcctttacatcgtgacggtaccgatgggcaggccaccgtgtactggagcctcaaaccttcaggctttaatagcaaggccgtcactcctgacgatatcgggccgtttaacggatccgtgctgttcctgtctggacagtctgacacgaccatcaatattaccattaagggggacgatatcccggaaatgaacgagactgtcaccctgagtcttgatcgcgtgaatgtagagaaccaagttctcaaaagcggctatactagccgggatttgatcatcctcgagaatgacgaccccggtggggtcttcgagttcagccccgcctccagggggccctatgtgatcaaggagggagagtccgttgaattgcacattatacggagcagagggtcgttggtgaaacagtttcttcattacagggtcgagccgcgcgattctaacgagttttatgggaataccggcgtgttagagtttaagcctggcgagcgcgagatagtcatcacactgcttgcacggctcgacggcatcccggaactcgatgagcattactgggtggttctatcctcccatggggagcgtgaatctaaacttgggtcagcgacaatcgtaaacattactatcctgaagaacgacgatccccatggtattattgaattcgtttcagatggcctgatagtcatgattaatgaatccaagggcgatgccatctatagcgccgtctacgacgtcgtcagaaacaggggtaacttcggcgacgtgtctgtatcatgggttgtctctcctgactttacacaggacgtgtttccagtgcagggcacagtagtgttcggggatcaggaattttcaaagaacattactatatattccttgcctgatgaaatcccagaagagatggaagaattcacagttatcctgctgaatggaaccggaggggcgaaggtggggaacaggacaacggcaaccctgcgaatccgcagaaatgatgatcctatttacttcgcggagccaagggtggtgagagttcaggagggagagaccgctaactttactgtgctgagaaatggttcggtggatgtcacttgcatggtacagtacgctacaaaagacgggaaggccactgctagagagcgagacttcatacctgtggagaagggcgagaccctgattttcgaagttggctccagacagcaatccatatctatttttgtaaacgaggatgggattcccgagacagacgagccattttacattatcctcctcaacagcactggagacacagtggtgtatcagtatggcgtcgccaccgtcattattgaggccaacgacgaccctaacggcatttttagcctcgagcctatcgacaaagctgtggaggagggcaagaccaatgccttttggatcctgcggcaccggggctacttcggttccgtaagtgtgtcttggcaacttttccagaatgatagcgccctccagcctgggcaggaattctatgagacttctgggacagtgaactttatggacggggaagaagccaagcctattatcctgcacgctttccccgacaaaataccagagtttaatgagttctacttcctgaagctggtcaacatctcaggagggagcccaggacctggcgggcagctcgccgaaacaaacctgcaggttaccgtcatggtgccttttaatgacgatcccttcggggtctttatcttggatccagagtgcttagagcgagaggtcgccgaagacgttctatccgaggacgacatgagctatattacaaattttacgattcttcggcagcagggggtgttcggagatgttcaactgggctgggaaattttgtcatctgaatttcctgccggcctgcctccgatgatcgacttccttctggtaggcatttttccaaccacagtgcatcttcagcaacacatgagacggcatcactctgggacagacgctctctattttactggtctagagggtgcctttggcactgtcaatcccaaatatcacccttcacggaataatactatcgcaaatttcaccttcagtgcctgggtcatgcccaacgcaaataccaatggcttcattattgccaaggatgatggaaatggaagcatctattatggggtcaagatccagaccaacgagtcacacgtcacactaagtctgcactacaagactctcggtagcaatgcgacgtatatcgccaagaccacggtgatgaagtatctagaggagtcagtttggctccacttgctgattatcctcgaagacggaatcatagagttctacctggatgggaacgccatgccccgaggcatcaagtctcttaaaggcgaagccatcacagatgggccaggaattctgagaataggcgctggaatcaacgggaacgatagatttaccggtcttatgcaggatgtgaggagctatgagaggaaattgacattggaggaaatatacgaattgcacgccatgccagcgaaatccgatttgcatccgatctccggttacctcgaattccgccagggggagaccaacaagtcctttattatttctgccagagacgacaacgacgaggaaggagaggagctattcattttgaaattagtttcggtttacggcggggcgcgcatatcagaggaaaacaccactgcccgattaacaattcagaagagcgacaacgcaaacgggttattcggtttcactggagcctgtattcccgagatcgctgaggaagggtccactataagttgcgtggtggaaagaacacggggggccctggattatgtacacgtattctatactatcagccagattgaaaccgacgggatcaattatttggtggatgactttgctaatgccagcgggacaattacatttttgccttggcagagatcagaagtgctaaatatctacgtgctcgacgacgacatccccgaactgaacgaatactttcgggtgaccctggtgtctgcaattccaggcgacggaaaactaggatcgacacccacgagcggcgcctctattgatccagaaaaggagactacagacataacgatcaaagcctctgatcacccttacggcctcctgcaattcagcacaggattgccacctcagccaaaggatgccatgacacttcccgcaagtagcgtcccccatataaccgtggaggaagaggacggcgagatccgactgctcgtcatccgcgctcagggactgttgggccgggtgactgccgagtttaggacagtctctctgacagccttttctcccgaagattaccagaatgttgcaggcacgcttgagtttcagcccggggaacgttataagtacatctttattaatatcacggacaacagcattccagaattagaaaaatcctttaaggtggagctgctcaacttagaaggcggggtggcagagctctttcgagttgacgggtcggggtctggagacggagacatggagtttttcctcccaacaatccacaaacgggcctctctgggagttgcttctcagatactggtcacaatcgcggcgtcagaccatgcacacggtgtgttcgagttctcccccgaaagcctgttcgtctccggcactgaacctgaggatggatactctacagtgaccctgaatgtcatccgtcaccacggcactctctcacctgtgacactccactggaatatagacagtgaccccgacggcgacttggcatttacgagcggtaatatcacattcgagatcgggcagacttcagcaaatataaccgtggagatcttaccagatgaggatcccgaactggataaagccttttcagtctctgtcctgagcgtcagttcgggctcccttggtgctcatattaatgccactttgaccgtgttggctagcgacgatccctatggtattttcatcttttctgaaaaaaatcggcccgttaaggtggaggaggcaacccagaatataaccctgtccatcatcagattgaaggggctgatgggcaaagtgctggtgtcctacgccacactcgatgacatggaaaagccaccatattttcccccgaacctggccagggctacacagggccgcgattacattcccgccagtggcttcgctctgttcggtgcgaaccagtcagaagccaccatagccatctctatactggacgacgacgagcctgagcgcagcgagtccgtttttatcgagctgttaaactccacacttgtggccaaagtgcagagccgaagcattccaaattcgccccggctaggtcccaaggttgagaccattgctcagctgattatcatcgccaatgacgacgcctttggcacattgcaactgagtgcaccaatagtgcgggtggcggaaaatcacgtgggccccattattaacgtcacgcggacagggggcgcttttgccgacgtctcagtgaaattcaaggctgtccccatcacagccatagctggagaggactattccatcgctagtagcgatgtggtgttgctggagggtgaaacaagtaaggccgtacccatttacgtcatcaatgatatttatcccgagctagaggagagtttcctagtacaactgatgaacgagaccaccggcggagctaggcttggggccctgacagaggctgtgattattatcgaggctagcgacgacccttatggtctcttcggcttccagatcacaaaactaatagtggaagagccggaattcaactccgtgaaggttaacctgccaattatcagaaactctggcaccctggggaacgttacggtccaatgggttgcaaccattaatgggcagctagccacgggagatctgcgggtcgtatccggcaatgtgaccttcgcccccggcatgagctcctaccccagtgccaccaactag

SEQ ID NO: 117913 - DNA, 18921 bp, Artificial Sequence
  Description of Artificial Sequence: Synthetic coding sequence
atgagtgtttttcttggccccggtatgccctccgcctccctgctggtgaatctgctcagcgctctactaattctcttcgtatttggggaaactgaaattcgctttaccggtcagaccgaattcgtggtgaatgagaccagcactactgttatccgactcatcattgagcgtatcggagagcctgccaatgtcactgcaattgtgtccctgtacggagaggacgcgggggacttctttgacacatacgccgccgcctttattcctgcgggcgaaactaatcggactgtttatattgccgtatgtgatgatgacctacctgaacccgatgaaacatttatttttcacctgactctgcaaaagccaagcgccaatgttaagctggggtggcccagaactgtgaccgtgactattctgtctaacgacaacgctttcggcattattagctttaacatgctgccctcaattgctgtgagcgagccaaaaggtcgcaacgagagcatgccccttacgctcattcgggagaaaggaacctacggtatggtgatggtcaccttcgaagtggaagggggacccaaccctccagatgaagatctgtccccggtgaaaggtaacattaccttccctccggggcgcgccacagttatttacaatttaactgttttagacgatgaggtgcccgaaaatgacgagatctttctaatccaactgaaatccgtggaaggcggagctgagataaacacgtctcggaactctatcgagataattatcaagaaaaatgactctcctgttaggttcttacaatccatctatttggttccggaggaggaccacatcctcatcattcctgtggtgcgcggaaaggataacaatggcaatctcatcggctccgatgaatacgaggtgtcaatttcctacgccgtcactactggcaacagtacagcccatgctcagcagaacctagatttcattgacttacaacccaatactacagtggtttttccccccttcatccacgaatcccatcttaagtttcagatcgtggacgacactataccagagatcgcggaaagttttcacattatgctgctgaaagatacactccagggcgatgccgtgttaattagcccttccgtggtgcaagttacgataaaaccaaatgacaagccctatggggtactgagtttcaattcagtgctgttcgagcggaccgttataatcgacgaagaccggatttctcgctacgaggaaataaccgtggtaagaaacggcggaacgcacgggaacgtcagtgcaaattgggttcttacaaggaactccactgacccttctcctgtcacggccgacattcgacccagctctggcgtgttgcatttcgcgcagggccagatgcttgccacaatccccctgacagtcgtagatgacgacttgcccgaggaagccgaagcatacctgctccagatcctgccccataccatccgtgggggagcagaagtcagcgaacccgctgaattgttattctacatccaagacagtgatgatgtatatgggctgattacatttttccctatggaaaaccagaaaattgaaagcagtccgggggagaggtacttgtccctgagtttcacaaggctcggaggtacaaagggcgacgtcagactgctatattcagttctttatatcccagccggggctgtggaccctctgcaggctaaagaagggattctgaatatctccagaagaaacgacctgatcttccctgaacagaagacccaggttacgacgaagctgccaattagaaacgacgctttcttgcaaaatggtgcgcacttccttgtgcaactggagactgtggaattgctgaatattatccctctaatcccacccatatcccctcgctttggggagatttgcaatatctccctcctggtcactccggccatagctaacggagaaatcggtttccttagtaacctgcctataatcttacacgaaccagaggactttgccgctgaggtcgtgtatatccccctgcaccgcgatggcaccgatggacaggccacagtatactggagcttaaagccgagtggctttaactctaaggccgttaccccagatgatatcggacctttcaatggaagcgttctgttcttgagcggacaaagtgatactacgattaatataacgatcaaaggagacgacattcccgagatgaacgagactgtgaccctgtcactggaccgagtgaatgtggagaatcaggttctcaagtctgggtatacatctcgggatctgatcatcctagaaaatgatgatcctggcggcgtgttcgagttctctccagcttcacgtggaccgtacgtgattaaagagggcgagtccgtagaacttcatatcataagatctcgaggcagcctggtgaagcagttcctgcactacagggtcgagccaagggatagtaatgaattctacggtaacacgggggtcctcgagttcaagcccggagaacgcgagattgtcatcacattgctggctcggcttgacggcataccagaactggacgagcattattgggtggtgctttcatcccacggggagagagaatccaagctaggcagtgcgaccattgtcaacattaccattctaaagaatgacgatccccacggcattattgaattcgtgagcgacggcctgatcgttatgattaacgagtccaaaggcgacgcaatatactccgccgtctatgacgtggtacgcaaccgtgggaacttcggcgatgtcagcgtgtcatgggtggtgtcccccgatttcacccaagacgttttccccgttcagggtaccgtggtgttcggcgatcaagaatttagtaagaatattaccatttattccctgccagacgagatccccgaagaaatggaggagtttactgtcatactcttgaacggtacaggcggggccaaagtcggaaacaggaccacagccactctgagaatcagaaggaatgatgaccccatttactttgccgagcctcgggtggtgcgggtgcaggagggtgagaccgcgaacttcaccgttttacgcaatggttctgttgatgttacttgtatggtgcagtatgctaccaaggatgggaaagccaccgcccgcgagcgggatttcattcctgtggagaagggggagacactgatctttgaggtaggctctcgacagcagagtatttctatttttgtaaatgaggacggaatccctgaaaccgacgagcctttctacatcattctattaaactcaacaggtgacacggtagtctatcaatacggcgtagccactgttattatcgaggctaatgacgatcccaacggcattttcagcctcgagccaattgataaagccgtggaagagggcaagacaaatgcattttggatcttgaggcatagggggtattttgggagcgtgagtgtgtcctggcagctctttcagaacgatagtgcactgcagccaggacaggagttctacgagaccagcggcacagttaactttatggatggagaagaagctaagcctatcatcctgcatgctttcccagataaaatcccggagtttaatgaattctactttttgaagctcgtcaacatctcaggtggatcaccagggcccggtggccagctcgccgagaccaaccttcaggtcacggtgatggttccattcaacgatgatccatttggcgtctttattctggatcccgaatgcctagagagagaagtcgccgaagacgttctctctgaagacgacatgtcctatatcaccaattttacaatcttgcggcagcagggcgtctttggtgacgtgcagttgggctgggaaattttaagctccgaattcccagccggcctgccccctatgatcgatttcctcttggtggggatctttcccaccactgtacaccttcaacagcacatgagacgacaccactccggaacagacgctttgtatttcaccggacttgagggggctttcgggactgtaaacccgaagtatcacccttccaggaacaatacgattgctaattttaccttctccgcttgggtaatgccgaacgccaatactaatggattcattatcgccaaagacgatgggaacggttcaatatactatggtgtgaaaattcagactaatgaatcccacgtgacgctgagcctacactataagacactcggaagcaacgccacttatattgccaagacaactgtcatgaaatacctcgaggagtctgtgtggctccatctcctcataattcttgaagacggtatcattgagttctatttggacggtaatgccatgcccagggggatcaagtccctgaagggcgaagccatcaccgacggtcctgggatcttgcgcatcggggcagggattaatggaaacgataggttcactggtctgatgcaggatgttaggtcttatgagcgcaagctgacactggaggagatttacgaattacacgccatgccggctaagagcgatttgcatcccatatcaggatacctggaattccggcagggtgaaacgaacaagtcttttattatcagcgctcgcgacgacaatgacgaggaaggcgaagagctgttcattctgaagctcgtgtctgtatacggaggggctcggattagtgaggagaacaccaccgcgaggctcaccatacagaaaagcgataatgctaatggactgttcgggtttaccggcgcgtgcatccccgaaattgccgaggagggctcaacaattagctgcgtagtcgagcgaacgagaggcgccctcgattatgtacatgtattctacactatatcacagatagaaactgatggcataaactacctcgttgatgactttgccaatgcaagcggtaccatcacctttttgccctggcagcgctccgaggtccttaatatctatgtgctagacgatgatattcctgaattgaatgagtattttagggtgacccttgtgtccgccatcccaggcgatggtaagctgggctccacccccacctcgggcgccagtatcgaccccgaaaaggaaacgacagacatcaccatcaaagcaagcgaccacccctatggattgctccagttcagtaccgggttacctccgcagcccaaggatgcgatgactcttcctgccagctcagtgccgcacatcactgtggaagaggaggatggcgaaatccgacttctggtgattcgtgcccagggcctgctcgggcgagtaacagcggagttccgcacagtgagcctgaccgctttctcgccagaggactatcagaatgttgctgggacactggagttccagcccggagaaagatacaagtacatattcatcaacatcaccgataactcaatccccgagcttgaaaagtctttcaaggtggaattgctgaatttagaaggcggagttgcagaactcttccgcgttgatggctccggttcaggggatggggacatggagtttttccttccaaccatacacaaaagagccagcttgggcgtggctagccagatcctggttactattgctgcctccgaccacgcacatggggtatttgagttcagccccgaatcactatttgtgtcaggaacggagcccgaagacggctatagtactgtaactcttaacgtaattcgacatcatgggacattatcacctgtgaccctccattggaacattgatagcgaccccgatggcgacctcgctttcacgtccggcaacattacctttgaaattggacagacgtcagcaaacattacagtggagatactgccagatgaagacccagagctggataaagcgttttctgtaagcgtgctgagcgtttctagcggtagcctgggagcccatatcaacgctaccttgacagtccttgccagtgatgacccttatggcatttttattttctccgagaaaaatcgccctgtcaaggttgaggaggccacacagaacatcacgctgtccattattaggctaaaaggactcatggggaaggtgctggtgtcgtatgctactctcgatgatatggaaaaacctccgtacttccccccaaatcttgcgagggcgacccaaggtagagattatataccagccagcggctttgccctgttcggtgcaaatcaaagcgaagccaccatcgcgatttcaatccttgacgacgacgaacctgagaggtccgagtccgtgtttatagaactcctcaactctactttggtcgccaaggtgcagtcccgctccattcctaattcacccagacttggtcctaaggtcgaaaccattgctcagctcataataatcgctaacgacgacgctttcggaaccctccagctgagcgcccccatcgttagagtcgcagagaatcatgtggggccaatcataaatgtcaccagaactggcggcgcttttgccgatgtgagcgtgaagtttaaggctgtgcctatcactgctatcgcaggagaagattactccatcgcgtcaagcgatgtggtacttttagaaggggaaacgtcgaaagcagtgccaatttacgtgattaacgacatatacccagagctggaagagtcttttcttgtgcaactgatgaacgaaactaccggtggtgctcgcttgggggccctgacggaggccgtgattattatagaagccagcgacgatccctatggattgtttggctttcagattaccaaactgatagtcgaggagcctgagtttaattcagtgaaagttaacctccctattattaggaacagtggcactcttggcaacgtcactgtacagtgggtggcaaccatcaacggacagctagccaccggggacttgcgggtggtcagtgggaatgtgacctttgcacctggcgagaccatccagaccctgctcttggaagtcctggcagacgacgtccccgagatcgaagaggtgattcaggtgcagctgaccgacgcgagtgggggaggcaccattggcttggatcggatcgcgaatattattatccccgccaacgacgacccttatgggacagttgctttcgcccagatggtatacagggtgcaagagcccctagagcgaagctcctgtgccaatatcaccgtgagacggtccgggggtcattttggcagattactgctcttctacagcacatccgatatcgacgtggtggcacttgctatggaagagggtcaggacctgctgtcctactacgaaagcccgattcagggcgtacctgatcctttgtggagaacttggatgaacgtgagtgctgtgggggagcccctgtatacctgtgcgacactctgtttaaaggagcaggcgtgtagcgccttctccttctttagcgcttccgagggtcctcagtgcttttggatgacaagctggattagccccgccgtcaataattctgacttctggacttaccgtaaaaacatgacacgagtggcctccctcttctccggccaggcagtcgctgggtcagactacgagcctgtgacaagacagtgggcaataatgcaagagggggacgagttcgcaaaccttacagtgtctatcttacctgacgactttcccgaaatggacgaaagcttcctcataagtctgctggaagtgcacctcatgaacatctccgccagcctcaagaatcagcccactatcgggcagcctaatatctctactgtggttatagcactgaatggcgatgctttcggtgtcttcgtgatatacaatatctcgcctaacacgtctgaggatggcctcttcgtagaggtccaggaacagccacaaaccctagttgagctaatgatacacagaactgggggatctctgggtcaggtggctgttgaatggagggtggtcggcggtaccgcaacagagggattggattttattggggccggtgagatcctgacattcgctgagggggaaactaagaaaacagtgatcctgactattttggatgacagcgagccagaggacgacgagtccataatcgtgagtcttgtatatacagagggcggatccaggatccttcccagctctgacactgtcagagtgaatattctcgccaatgacaatgtggctggtatcgtgtccttccagactgcctccagaagtgtcattggacacgagggcgagattctccaattccacgtgattaggacttttccgggtcggggtaatgttaccgttaattggaaaataattgggcaaaacctcgagctgaattttgctaatttctcaggccagctgttttttccagaaggctccctgaataccacactgtttgtgcatctgctggatgataatattcccgaagaaaaggaggtgtaccaagtcatcctgtacgacgtgagaacgcagggagtgccccctgccggaattgcactcctggacgcacaagggtatgcagctgtactcacagtcgaggcaagcgacgagccacacggggtgctgaatttcgcactgtctagcaggtttgtgctgctgcaagaggccaatattaccatccaacttttcatcaatcgggaatttggctctctcggcgccatcaatgtgacatatacaaccgttcctggcatgctgagcctcaagaaccaaacagtggggaatttggcagaacctgaagtggactttgtgccgattatcggcttccttatccttgaagaaggcgaaactgcagcagccattaatattactatactggaagacgatgtgccggagctcgaggagtacttcctggtaaacctaacctatgtagggctgaccatggcggcctctacatcattcccacctcgtctcgatagcgaaggactgacagcccaggtgatcattgacgcaaacgacggcgctcgcggcgtgatagagtggcagcagtcaaggtttgaagtcaatgaaacccacgggtccctaaccctggtggcccaacgatcgcgcgaacctctgggacatgtcagcttgtttgtctacgcacagaatctcgaagcccaggtcgggttagattatatcttcacgcccatgatactgcattttgcggacggcgagcgatacaaaaacgtgaacatcatgattctcgatgatgacattcctgaaggcgatgagaaattccagctcattctgacaaatccttcaccaggcctggagctgggaaagaacaccatcgcgctcattattgtcctggcgaacgacgacggccccggagtactgtctttcaataactccgaacattttttcctacgagaacctaccgcgctgtatgtgcaggaatccgtggccgtactctacatcgtccgagagcctgctcaggggctgttcgggacggtcaccgtgcagtttattgttactgaggtcaactcctccaacgaatctaaggatctgacaccaagcaaaggatacatagttctggaagagggggtgcggtttaaagcgctccagatctcagctatcctggacactgagcccgagatggatgaatacttcgtgtgcactctgtttaaccccacaggcggggctagactcggcgtgcacgttcagaccctgatcacggtgctccagaaccaggccccgttggggctgtttagcattagtgcggtggaaaaccgggccacctctatcgacattgaggaagcaaatagaactgtttatctcaacgtcagtcgtaccaacggcatcgacctggctgtctctgtccagtgggaaacagtctcggaaacggcttttggaatgagggggatggacgttgtgttcagcgtgtttcagagcttcctcgacgagagcgcttctggctggtgcttcttcaccctggaaaatcttatatatggaataatgcttagaaagtcaagcgttaccgtgtacaggtggcagggaatatttatcccagtggaagatctcaatatagagaaccccaagacctgcgaggcttttaacattggcttctctccatattttgttataacccacgaggagcgcaacgaagagaagcccagcctcaacagcgtgtttacattcacctccggctttaaactttttctggtgcagaccatcatcatcctggagtcgagccaggttaggtactttacatcagactctcaggactacctgatcattgcctcacagcgggatgactctgaattgactcaggtttttaggtggaatggaggctctttcgtcctgcaccagaagctccccgtgcgcggcgtacttaccgtggccttgttcaacaaaggtggaagtgtttttctcgcaatttcccaggccaacgctcgcctgaactccctattatttcgctggagcggttccggattcatcaactttcaagaagttcccgtgtcgggaactaccgaggtggaggcgttgtcctctgccaatgacatctatctgatttttgccgagaacgtctttttgggagatcagaactccatcgatatctttatttgggaaatgggccagtcttctttccggtatttccagagcgtggatttcgcggctgttaacagaatccacagttttacacctgcttcggggattgctcatattcttctgattggtcaagatatgtcagcactgtattgctggaatagtgagaggaatcagttctctttcgtgttggaggttccctctgcctatgacgttgcatccgtgactgtgaaatccctaaacagctctaaaaatttgatagctcttgtgggcgctcacagtcatatctatgagctagcctacatctctagccactctgacttcattccatcatctggtgaactaatatttgagccaggggagcgtgaggccacgatcgctgttaacattcttgatgatacagtccccgagaaagaagagtctttcaaggttcagctgaagaacccaaaaggcggtgccgagattgggatcaatgatagcgtcacaatcactatcctctccaatgacgacgcctatggtatcgttgcattcgcccagaacagtctatataagcaggtagaagagatggagcaggacagcttggtcaccctgaacgtggagcggctgaaaggtacctacggaaggattaccatagcctgggaagccgatggttctatcagtgacatcttccctaccagcggcgtgattctgttcacagagggccaggtgctgtccacaatcaccctgacaattctcgccgataatatcccagagctgagtgaggttgtgatcgtgacacttactaggatcacaaccgagggggtggaggacagttacaaaggcgctaccatcgatcaggatcggtcaaagtctgtaattaccactcttcccaatgatagcccatttggtctggtggggtggagagccgcctctgtgttcattagagtggccgagcccaaggagaacaccaccacgcttcagcttcaaattgcacgggacaagggcctcctaggcgatatagctatccacctacgcgcccaacctaactttttactccacgtcgacaatcaagccacggagaatgaggattatgttctccaagaaaccattatcataatgaaggaaaacatcaaagaggcccatgcagaggtcagtattctacctgatgatctccccgagctcgaggaaggcttcatagtaacgatcaccgaagtgaaccttgtcaacagtgacttttccactggacagccctctgtccgccggccaggcatggagattgccgagattatgatagaagaaaatgatgatccccgaggaatctttatgtttcatgtaactcgcggcgccggggaagtaattacagcttatgaggtgccaccgccgttaaacgtgcttcaggttcccgtcgtgaggctggctggatctttcggagcagtgaatgtctattggaaagccagcccagacagcgccggactggaggattttaaacctagccacgggattctggaattcgctgacaaacaggtgacagccatgatcgagattaccatcatagatgacgccgagttcgagctgacagaaacgttcaacatttctttgatctcagttgccggcggaggtagacttggagacgacgttgtggtgacggtggtgattcctcaaaatgacagcccattcggcgtgttcgggtttgaagagaagaccgtcatgatcgatgaatccttgagcagcgatgacccagattcatacgtgacccttactgtcgttcgtagtccaggagggaaggggacagtgaggctcgagtggacaatcgatgaaaaagccaaacacaacctcagccctttgaatgggacactgcattttgatgagaccgaatcgcagaagaccatagtactgcacacccttcaggacactgttcttgaggaagaccgccggtttactattcagctgatcagcatcgatgaagttgaaataagtccggtcaaggggtccgcctcgattattattaggggtgacaagagggcttcaggagaagttggtatcgcccccagcagcaggcacatccttatcggtgagccatcagccaagtacaatgggacagccattattagcttggtccgcggtccaggaattctgggcgaagttacggtcttttggaggatctttcccccatccgtgggcgagtttgcggaaacctccggcaaattaaccatgagggatgagcagtctgctgttatagtggtcatccaggcacttaatgacgacatacccgaagagaagtctttctacgagttccagctgacagctgtgagcgagggcggcgttctatctgagtcttctagcactgccaatatcacagtggtagcgtctgatagtccctatgggcgatttgccttcagtcatgagcagttgcgggtctccgaggcgcaacgcgttaacatcacaatcataagatcctccggcgacttcgggcatgttcgcctgtggtacaagactatgtctggaacagctgaggcggggctggacttcgtccccgcagcaggagagctgctttttgaagccggcgagatgcggaagagcctccacgtagaaatcctcgatgacgactacccggagggtccggaggaattctctctcacaattaccaaggtcgagctccaaggccgcggatatgatttcaccattcaggagaatggcctacaaatagaccagcctcctgaaatcggcaatatctccattgtccgcatcatcatcatgaaaaacgataacgccgaaggtatcatcgaattcgatccaaagtacaccgcattcgaggtggaagaagacgtaggattgataatgatcccagtggtccgcctgcacggcacatatggctatgtgactgctgattttatcagtcagagctcctcagcctcacccggtggggtggactatatcctccacgggagcacagtcactttccagcatgggcagaacttatcgtttattaacataagcattattgacgacaacgaaagtgaatttgaggagcccatcgaaatcctgttaacaggagcgaccggcggggcagttctcgggaggcacctggtgtcaaggatcatcattgccaagagcgattccccttttggagttattaggtttctcaatcagagcaagatctccattgctaatcccaactctacaatgatcctctcactcgtactcgagcggaccgggggtctgctgggcgaaatccaagtgaactgggagactgtcggaccaaattcacaggaggccttactgccacaaaatagggacatagcagatcctgtcagtggtcttttttattttggcgagggagagggtggagtgcgcacaatcatactgaccatatatccccatgaggagattgaagtcgaggaaaccttcatcatcaagctacatttggttaaaggcgaagcaaaactggacagcagggctaaggacgtgaccctgaccatccaggaattcggcgaccccaacggagtggtccagtttgcccctgagacactgtcgaagaaaacttactctgagccgcttgctctggagggccccctgctaatcacgttctttgtgcgacgggttaagggtacatttggcgaaatcatggtctactgggagcttagcagtgaattcgatatcacagaggactttctgagcacctcagggtttttcacgatcgccgacggtgagtccgaagcttcattcgatgtgcaccttctgccggatgaggtacctgaaatcgaggaagactacgttattcaactggtgtcagtcgagggcggcgccgaacttgacctggagaagtccatcacttggttttccgtctatgccaatgacgacccacatggagttttcgccttgtacagcgaccggcagtctattctgatcgggcagaatctcattaggagtatccagatcaacataacacgcctggcgggtacttttggcgatgttgctgttggactcagaattagcagcgaccacaaagagcagcccatcgtgacagagaatgcggaaaggcaattagtcgtgaaggacggagccacctataaagttgacgtagtacccatcaagaaccaggtgtttttgtcactcggctccaactttaccttacagctggtaacagtgatgcttgtgggtgggcgcttttacggcatgccaacgatcctccaagaggctaaatcagcagttctgcctgtgtcagagaaggcagctaacagccaggtggggttcgagagcacagcattccagttgatgaacattaccgccggcacttcccacgtcatgattagccgccggggtacctatggcgcactgtctgtcgcttggacgacaggctatgctcccggcctggaaatccctgaatttattgtagtgggtaacatgacacccaccttgggcagcctatcctttagccacggcgaacagcgaaagggcgtgttcctgtggacatttccttcaccagggtggcctgaggccttcgtgttgcacctctcaggcgtgcaaagctctgcccctggaggcgcccagctcagatccggtttcattgtggcagaaattgaaccaatgggggtatttcagttttccacatcttctcgcaacatcattgtgagcgaggatactcagatgatccggttacacgtgcagaggctctttggattccatagtgatctgatcaaagtctcctaccagacaactgctggcagtgccaagccgcttgaggactttgaacccgtacagaatggtgagctgttcttccagaaatttcagactgaagtggacttcgagatcacaattattaacgatcaactatctgaaattgaggagtttttctacatcaacttgacatcagtggagatcaggggcctgcagaagttcgacgtcaactggagtcctagactcaacctcgacttttctgtcgctgtcataacgatactggataacgatgatctggccggcatggatattagcttccctgagaccactgtggcagtggctgtcgacactactttaatcccagtggagaccgagtccaccacctatctgagcacctctaagaccaccacaattctccaaccgacaaacgtcgtcgctatagtgacggaagccacaggggtttctgctattcctgagaaacttgtgacactgcatggtactccagccgtaagcgaaaagcctgatgtggccaccgttactgccaacgtttctatacacggaacctttagtctgggacctagtatcgtctatattgaggaagaaatgaagaacgggacattcaatacagcagaggtgctgatccgaagaaccgggggtttcaccgggaacgtgtcaataactgtaaagactttcggggaacggtgtgcacagatggaacccaacgccttgccattccgaggaatctacggaatctccaatctcacctgggccgtcgaggaggaggacttcgaggaacaaaccctgacactcatttttttggacggggaacgggaaagaaaagtgtcagttcagatcctcgatgacgacgagccagaagggcaggaattcttttatgtgtttttgaccaacccccagggtggcgcccagatcgtggaggaaaaagatgatacggggttcgcagcctttgcaatggtgatcataaccggctcagatctccacaatggcattattgggttttctgaagagagccagagcggattggaattgagggagggagcagtcatgcggcgcctgcatctaattgtcaccaggcagcccaatagagccttcgaggatgtgaaagtgttttggagagtgacacttaacaaaactgtggtggtcctccagaaggatggagtgaacttggtggaagaactgcagagtgtatccggaacaacaacttgtaccatgggccaaacgaaatgcttcatctcgattgagctgaaacccgagaaggtgccccaggttgaggtctacttcttcgttgagctgtacgaggctaccgccggagctgcaatcaacaactccgccaggttcgcccagataaaaatccttgaatcggatgagtcacagtctctggtatacttcagtgtcggatctcgtctcgctgtggcccacaagaaagccactctgatttctcttcaggtggccagggatagtggcactggcctgatgatgtctgtgaacttcagcacccaggagttgcgcagcgctgagacaatcgggcgcacgattatttctccagctatcagtggcaaggacttcgtgatcaccgaggggaccctagtgtttgaaccaggtcaacggtccacagtgctggatgtgattttgactccagaaacgggctctctgaactccttccccaagcgcttccagattgtgctgtttgatcccaaaggaggggctcgtattgataaggtctatggaacagccaatatcaccttggtcagtgacgccgacagtcaagcaatttggggcctggcggaccagctgcaccaacccgtgaatgatgacattctgaaccgcgtgctgcacacgatcagtatgaaggtggccacagagaacaccgacgagcagctgtcggccatgatgcatctaatcgaaaaaattaccaccgagggaaagatccaggcattctctgtggcaagccggacactgttttatgagatcctgtgctctcttataaaccccaaaaggaaggacacacgaggtttcagccactttgcagaagtaaccgagaacttcgcatttagtttactgacaaacgtgacatgcggctctccaggagaaaagagcaagaccattcttgactcatgtccgtatttatccattttggctcttcactggtaccctcagcagatcaatgggcacaaattcgaggggaaggagggagattatatacgcattcccgaacggctgttggacgtacaagatgccgagatcatggccggcaagtccacgtgtaaattggttcagtttaccgaatactctagtcaacagtggtttatttcaggcaataacctcccaactctgaagaacaaggtgctaagtctgtccgtgaagggccagtcatcacaattactcacaaatgacaacgaggtgttataccgaatctacgccgccgagccacgaatcatcccacagacatccctttgtctgctgtggaatcaggccgccgcctcctggctgtccgattctcagttctgcaaggtcgttgaagaaaccgccgactatgtggaatgtgcttgttcgcatatgtccgtctacgccgtatatgccaggactgataacttgtcgagctataacgaggccttctttacctccggcttcatttgtatttcgggcctctgcctcgctgttctatctcatatattttgcgcccgatactctatgtttgctgccaaactcctgacccacatgatggcagcttcactgggcacacagatcctgtttttagccagcgcatatgcatccccgcagctggcagaggagagttgttctgccatggcagccgtcactcattatctctatctctgtcagttctcctggatgcttatccagagcgtgaacttctggtacgttcttgtcatgaatgacgaacacaccgaacgtaggtacctactgtttttcctcctttcctggggactgcccgctttcgtggtgatcctcctgatcgtcattctgaagggcatctaccaccaatctatgagccagatctatggtctcatacacggcgacctatgcttcatcccaaatgtgtacgcagccctcttcacggcagctctcgtaccacttacatgcctggtcgtcgtctttgtggtttttatccatgcctaccaagtcaagccccagtggaaggcttacgatgatgtgtttcgaggccgaactaacgccgctgaaattcccctgattctctatttgttcgcactaatcagtgtgacctggttgtggggcggcctgcacatggcgtatcggcatttctggatgctggtactgttcgtcatattcaattctctgcaaggtttatacgtgttcatggtctactttattctacataatcagatgtgctgtcccatgaaggcctcctacactgtcgaaatgaacggccatccaggtccgtccacggctttctttacacctgggtccggtatgccacctgctggtggggagatatctaaaagcacgcagaatttgatcggagcaatggaggaagtgcctcccgattgggaaagagcttctttccagcagggaagtcaagcctctcctgatctgaaaccttctccacaaaatggggccacattcccttcttcaggaggctacgggcagggatcactgattgcggacgaagagtcccaggagttcgatgatctgattttcgcactgaaaaccggtgccggcctgtcagtgtccgacaatgaatccgggcagggatcacaggagggtgggaccctcactgactcacaaatagttgaactcagacgaattccaatagccgatacccatctttag

SEQ ID NO: 117914 - DNA, 4188 bp, Artificial Sequence
  Description of Artificial Sequence: Synthetic coding sequence
atgactggcgcggagatagagagtggagctcaggtgaaacccgaaaaaaaaccaggagaagaggttgtcgggggagccgagattgaaaacgacgtgccactggttgtcaggcccaaggtgcgcacacaagcccagattatgccaggtgccaggcccaagaacaaaagtaaggtaatgcccggcgcctcaacaaaagtggagactagcgcagtcggaggcgctagacctaagtccaaggccaaggctatccccgtgtcccgatttaaagaggaggcccagatgtgggctcagcccagattcggggctgaacggcttagcaagacagagaggaattcccagaccaacattatcgccagtcctctggtctcaacagactccgtgctcgtggcaaaaactaagtatttgagcgaagacagggaactcgtgaacaccgatacggagtctttcccgaggcgcaaggcacactatcaagctgggtttcagccatcatttagaagcaaggaggagactaacatgggttcctggtgttgtccccgtcccacctccaagcaagaagcctctccaaactcagactttaagtgggtcgacaagtctgtgagctccttattttggtcaggcgacgaggtcacagctaaattccaccccggcaatagggtgaaggattcgaaccgatcaatgcacatggccaaccaggaggctaatacgatgagcaggtcccaaacaaaccaagagctatatattgccagtagttccgggagtgaagacgagtccgtcaagacgccatggttttgggcccgcgacaagaccaacacatggagcggtcctagagaggaccctaattcacgctccagatttcgcagcaagaaggaggtgtatgttgaatcaagttcagggtctgaacacgaggaccatctggaatcctggttcggcgcaggaaaggaagcgaagttccgcagcaaaatgagagctgggaaggaggctaacaatagggcccggcatcgggcaaaacgcgaggcttgtatcgatttcatgccggggtccattgatgtgatcaagaaggagtcctgtttctggcccgaagaaaacgccaacacgttctcccggcctatgattaaaaaagaggcccgagcgcgagcaatgacaaaggaggaggccaaaacaaaggcacgtgcccgagctaagcaagaggcccgaagcgaggaggaagccttgattggaacctggttctgggctaccgacgagtcaagtatggcagatgaagctagcatagaatcctctctgcaagtggaggatgaaagtataatcggctcatggttctggaccgaggaagaggcttcaatgggtaccggagcctcctcgaagagccggccccgcacggatggggaacgcatcggagactctctcttcggggcccgcgagaagacatctatgaaaacaggggcggaagcaactagcgaatcaattttggccgcagatgacgaacaagtgattattgggtcatggttttgggccggggaggaggttaatcaagaagctgaggaagagaccattttcgggtcatggttctgggtgatcgatgccgcctcagtggagagcggcgtgggcgtaagctgcgagtctcgcactaggtctgaggaggaagaagttattggaccctggttctggagcggggagcaggttgatattgaggcaggcataggggaggaagcgcgccctggagcagaagaagagacgattttcggatcttggttctgggccgagaatcagacgtatatggattgccgggccgagacaagctgtgatacaatgcagggagcagaggaagaggaaccgattatcggatcctggttctggacgagagtggaagcatgtgttgaaggagatgtcaattctaaatcttcgttggaagacaaagaggaagccatgattccctgtttcggcgccaaagaagaagtaagtatgaaacacggaaccggggtccgttgtagatttatggctggcgccgaggagacaaataacaaatcctgtttttgggccgagaaggagccatgcatgtacccagcggggggcgggagttggaagagccggccggaggaagaagaggatatcgtgaactcttggttttggtccaggaaatataccaagcccgaagccataatcggatcctggttatgggccacggaagaatctaacatcgacgggactggggagaaggccaagctgctgacagaggaggaaaccattattaacagctggttttggaaagaagatgaggccataagcgaggcaacagaccgggaagagtctagaccagaggccgaggaaggcgacattattgggagctggttttgggctggagaagaagaccggctggagcccgctgcagaaacacgcgaggaggaccgtctcgccgcagaaaaggaggggattgttgggtcttggtttggcgcccgagaagaaaccatccgtagagaagcaggttcatgttccaaatcttcccccaaggccgaggaagaggaggttataatcgggtcatggttttgggaggaagaggctagccctgaggccgtggccggggtggggtttgagagcaaacccgggacagaggaggaggaaattacagtcggatcttggttctggcctgaggaggaagcatctatccaggctggttcccaggcagtcgaggaaatggagtccgaaacagaagaggagactattttcggaagctggttctgggatggaaaagaagtgtccgaggaagcaggcccatgctgtgtgtctaaacccgaagacgatgaggagatgatcgtcgagtcatggttttggtcccgagataaagctataaaggaaaccggcaccgtagcaacatgtgagtccaaaccggaaaacgaagagggggccatcgtgggcagttggttcgaagcagaagatgaagttgacaaccggaccgataatggaagcaactgcgggtcccggacacttgctgacgaagatgaagcaatcgtggggtcttggttctgggccggtgacgaagcccacttcgagagcaacccgtcacctgtctttagggccatttgccggagcacctgcagcgtcgagcaggagcccgatcccagccgacggccacagagctgggaggaggtgacagttcagttcaaaccaggtccttggggaagggtggggttcccttctatatcccccttcagatttcctaaagaagctgcgtccctcttttgtgaaatgtttggcggcaagccaaggaatatggtgcttagcccagagggcgaggatcaggagagcttgttacagccagatcagccaagccccgaattcccgttccagtacgacccttcttatagatctgtccaagagatcagggagcacctgcgagccaaagagagtaccgaaccagagagttccagctgcaactgcattcagtgtgaactcaagataggctctgaggaattcgaggagctgttgcttctgatggagaagatcagggacccatttattcatgaaatatccaagatagccatgggcatgcgcagtgcctctcaatttacgcgcgacttcattagggattcgggggtcgtctccttgatcgagaccctcctgaattatccaagtagtagagttcgaacgtccttcttggaaaacatgattaggatggcaccgccctaccctaatctgaacatcatccaaacatacatctgcaaggtgtgtgaagagacgttggcatattcagtcgatagtcccgagcagctgtcgggcattagaatgatccgccatctgacaactaccactgactatcatactttagttgctaactatatgtcaggctttttgtcactcttggcaacaggcaacgccaagacacggtttcatgtcctgaagatgctgctgaacttatcagagaatctcttcatgaccaaggaactgttgtccgctgaggctgtgtccgaatttatcgggctcttcaacagagaggagactaatgataatatacagatagtcctagcgatctttgagaacattggcaacaacataaagaaagagacagttttttcagacgatgactttaatatagaaccactgatttctgcgtttcataaagtggaaaaattcgccaaggagctacaaggtaagacagacaatcagaatgaccctgagggcgaccaggaaaactag

SEQ ID NO: 117915 - DNA, 4188 bp, Artificial Sequence
  Description of Artificial Sequence: Synthetic coding sequence
atgactggtgccgaaatcgaatcaggagcccaggtcaaaccagagaagaagcccggagaagaagttgtggggggggcggagattgaaaacgacgttccgctagtggtgaggccaaaagttcggacgcaggcccagatcatgccaggggctcgccccaagaataagagtaaagttatgccaggcgcgtccaccaaggtcgagaccagtgctgtggggggagcacgcccaaaatctaaggcaaaagccatccctgtgtcaaggtttaaggaagaggcgcagatgtgggcccagccccggttcggcgccgaacgcttgagcaagacggaaagaaattctcagacaaatataatcgcatcacccctggtctccactgattccgtcctggtcgccaaaaccaaatacctgtctgaggacagagaactcgtgaacaccgacactgagtcattcccacggagaaaagcgcactatcaggccggatttcagccaagcttccgcagcaaggaggaaaccaacatggggagttggtgctgtcctcggcccacatcaaagcaggaggcctccccaaattccgacttcaaatgggtggataagtccgtcagcagcctcttctggtctggagatgaggtgactgccaagttccaccctggtaatagagtgaaggatagtaataggagtatgcacatggcaaatcaagaggcgaatactatgtcgcgatcccagactaaccaggagctgtacatcgcatcgagcagtgggtccgaagatgagagcgttaagaccccatggttttgggcccgagataagaccaatacctggtctgggcccagagaagaccccaattcgagatcccgcttcaggtctaaaaaagaggtgtacgtcgagtcttcttctgggtcagaacatgaggaccacctggaatcatggttcggagctgggaaggaagctaagtttcgaagtaaaatgagggcagggaaagaagcaaataaccgcgcaagacaccgcgcaaaacgtgaggcttgtatcgactttatgccaggatcgatcgatgtgatcaaaaaagaaagctgcttctggcccgaggagaatgctaacactttctcgcggccaatgatcaagaaagaagcccgcgcaagagccatgactaaggaggaagccaagaccaaggcaagagcgagagcgaaacaggaggcacgttctgaggaggaggccctgatcgggacctggttttgggcaaccgacgaatcttcgatggcagacgaggccagcatcgaatctagtctgcaggtggaagatgagagtatcatcggatcgtggttttggactgaggaagaggctagcatgggaacgggggccagctccaagagtcgtccacggactgacggggaaaggataggcgactcacttttcggggcgagagagaaaacgtccatgaagacgggcgctgaagcgacatctgagtcaattctggctgcggatgacgagcaagtcatcatcgggtcctggttctgggctggggaggaggttaatcaagaagctgaagaggagactatcttcgggtcatggttctgggtgatcgatgctgcatccgtcgagagtggtgtaggggtgtcgtgtgaatcccgcaccagatccgaggaggaggaagtaatcgggccctggttctggagtggggagcaagtggatatcgaggcaggcatcggggaagaggccagacctggtgcagaggaagagaccatcttcggatcctggttttgggccgagaatcagacatacatggattgccgtgcagagaccagttgcgacaccatgcagggtgcggaggaagaggaaccaatcatagggtcctggttttggaccagagtagaggcttgcgtggagggagacgtgaattctaaatcctcactggaagacaaggaggaggcgatgattccttgctttggggcaaaggaagaagtcagcatgaaacacggaacaggtgtacgctgtagatttatggctggagccgaagagaccaacaataagtcatgtttctgggctgaaaaagaaccttgcatgtatccggctgggggagggagttggaagagcaggccagaggaagaagaggatatcgtgaacagttggttttggtcccgcaagtacacgaagcccgaagctatcatcggctcgtggctctgggcgaccgaagagtctaacatcgacggcactggcgagaaggccaaattacttacagaagaagaaacgatcatcaattcatggttctggaaagaggacgaggccatttccgaagccactgatagagaggagtcgagaccagaagcagaagaaggtgacatcattgggagctggttttgggcaggggaagaggatcggttagagcctgctgcggagactcgcgaggaggataggctcgctgccgaaaaagagggcatcgtcggatcctggttcggggccagggaggaaaccattcgtcgggaagccggtagttgttccaaaagtagtcccaaagccgaggaggaggaggtgattattgggtcctggttctgggaagaggaagccagccccgaggcagtggccggtgttgggttcgaatccaaacccggcactgaagaagaggaaatcaccgtgggttcctggttctggcccgaagaggaagcctcaatacaggctggcagccaggctgtggaagaaatggagagtgagacagaagaagagaccatcttcggttcatggttctgggacggaaaagaagtttctgaagaggccggtccttgctgcgtgtcaaaacccgaagacgatgaggaaatgattgttgagtcctggttctggtctcgggacaaggctatcaaagaaaccggcacagtcgccacctgcgagtcaaagccggaaaacgaggaaggggccatagtcgggtcttggttcgaggcggaggacgaggtcgacaaccggacggataacgggtccaattgtggttctcggacacttgccgacgaggacgaggctatagtggggtcttggttctgggccggtgacgaggcccatttcgagtcaaatccttcgcctgttttccgggccatctgcagatcaacttgtagtgttgaacaggagcccgacccgtcgagaagacctcagagttgggaggaggtcaccgtgcagttcaaacccggcccctggggcagggtcgggtttccctccattagtccctttaggttccccaaggaggccgcgagtctgttctgtgagatgttcggcggcaagcccagaaacatggtgttgagtccggaaggcgaagatcaggagagtctcttgcagcccgaccagccttcgcccgagtttccgttccagtatgacccttcgtatcggtcagtacaggaaatcagagagcacctgcgggcaaaagagagcacagaacccgaatcgagcagttgtaactgtattcagtgtgagctaaagataggctccgaggaattcgaggagctccttctgttgatggagaagatacgagatccctttatccacgaaatatccaaaatagcaatgggaatgcggtccgcctctcaattcacccgggattttattagggactctggcgtagtgtccctgattgaaacactgctcaactatccgtctagcagagtcaggacatccttcttggaaaatatgatcaggatggcacccccttaccctaacctgaatatcatccagacctacatttgcaaggtgtgtgaggaaacgctcgcctacagtgttgactcgccagagcaactgtctggcatcaggatgatcagacatctaacaactaccacagattaccatacattagtggccaattatatgtcaggctttctatctttgttggctacaggcaacgcgaagacaagatttcacgtcctgaagatgcttttgaatctgtctgagaacctctttatgactaaggaactattgtccgccgaagccgttagtgaatttataggcctttttaatagagaggaaaccaacgacaacatccagattgtcctggctatcttcgagaacataggaaacaacatcaaaaaggaaacagtgttcagcgacgatgactttaacatagagccactgatctctgcatttcataaagtggagaaatttgctaaggagttgcaaggaaagactgataatcagaatgaccccgaaggggatcaggagaactag

SEQ ID NO: 117916 - DNA, 4188 bp, Artificial Sequence
  Description of Artificial Sequence: Synthetic coding sequence
atgactggcgctgagatcgagtcaggcgcacaggtgaagccagagaagaagccaggggaggaggtcgttgggggtgccgagatagagaatgatgttcccctggtggtccgtcccaaagtcagaacgcaagcgcagatcatgccaggtgccaggccgaagaataagtccaaagtgatgccgggggccagtactaaagtggagacatctgccgttggtggggcccggcccaagtcaaaggctaaggctatccccgtttcaagatttaaggaggaggcacagatgtgggctcagccccgctttggcgctgaaagactctctaagacggagagaaactcccaaactaatatcatagcctcccctctcgttagtactgattccgttctcgtcgccaaaacgaaatatctgtctgaagacagggagctggtgaatactgacacggaatcatttcccagaaggaaggcccactatcaggccggtttccaaccatctttccgcagcaaggaagagaccaacatgggctcgtggtgctgtccaagacccacatctaagcaagaagccagccccaactccgactttaagtgggtcgacaaatccgtgtcgagcctcttctggtccggagacgaagtgacggccaagtttcacccagggaatcgggtaaaggacagcaatagatcaatgcatatggcaaaccaggaagcaaacacgatgagccggtcccaaactaatcaggaactctacatcgcctcctcatcgggctccgaagacgaatccgttaaaactccttggttctgggcgcgagataaaacaaacacctggagcggacccagggaagaccccaattcgagaagtcgctttcgatcaaagaaggaagtctatgtcgaaagctcttccgggagcgagcatgaggatcatctcgagtcatggttcggggctgggaaagaggctaagttccgttccaagatgcgagcgggtaaagaggccaataatcgtgccaggcatcgcgccaaaagggaggcctgtatcgactttatgcccggctctatagacgtaattaaaaaagaaagttgtttttggcccgaggagaacgccaacactttttctcggccaatgattaagaaagaggccagagctagagcaatgactaaggaggaagccaagacaaaagctagagctcgtgctaagcaggaagctaggtccgaggaagaggcgctgattggcacatggttttgggcaaccgacgaatcctccatggctgacgaggcgtccattgaatcttccctccaggtcgaggacgagtccattattggttcttggttttggacggaggaagaggcctcaatgggaaccggcgcatctagcaaaagcagacctcgcactgacggcgagcggatcggtgactctctgtttggggctagagagaagacatcaatgaagaccggcgctgaagctacatccgaaagtattctggcagccgacgatgaacaggtgattatcggatcctggttttgggccggggaagaggttaatcaggaggctgaagaggagaccatttttggtagttggttttgggttattgatgccgcctcggtggagtctggtgtgggggtctcatgcgaatctaggaccaggtctgaggaggaggaggtaatcggtccttggttctggtcaggcgaacaggttgatattgaagcggggatcggcgaggaagcaagacccggcgctgaggaagagactatctttgggtcttggttctgggcagaaaaccagacttatatggattgccgcgccgagacctcctgtgacactatgcagggagccgaggaggaagagccaatcatcggtagctggttttggacccgggtcgaagcatgcgtagagggagatgtgaatagtaaatctagcctggaagacaaagaagaggccatgattccatgcttcggcgcaaaagaagaagtgtcaatgaaacacggaacgggagtgcgttgtagatttatggctggcgcagaggaaacaaataataagtcttgcttctgggctgaaaaagaaccctgcatgtaccctgctgggggaggcagctggaagtcacggcccgaagaggaggaggatatcgtcaattcttggttttggagccgtaaatacacaaagcccgaggctatcattggcagctggctgtgggccactgaagagtccaatattgatggcaccggggaaaaggccaagctattgaccgaggaagagacaatcatcaactcctggttctggaaagaggatgaggccatttctgaggccaccgatagagaagagagccgcccggaagctgaagagggtgatataataggctcctggttttgggcgggggaggaggaccgcttggagcctgccgcggaaacaagagaggaagaccggctcgccgccgaaaaggaaggaatcgtgggaagctggtttggcgccagagaagagaccatccggcgcgaagctggctcgtgcagcaaatcttcacctaaagccgaggaagaggaagttataattggctcttggttctgggaagaagaggcatcgccagaggcagttgcgggggtgggctttgaaagtaagcccgggacagaggaggaggagattacagtcggcagctggttctggccggaggaggaagcgtccatacaggcgggtagccaggctgtggaggaaatggagagcgaaactgaggaggagaccatcttcggttcatggttttgggacggtaaagaggtgagtgaagaagctggaccgtgctgcgtctcaaagcccgaggacgatgaagagatgatcgtcgagtcatggttctggagcagagataaggccattaaagagactggaactgtggccacttgcgagtccaagccagaaaatgaagaaggcgctattgtgggatcttggtttgaagccgaggatgaggtcgataatcgcaccgacaatggatcaaactgtgggtcacgtacgcttgcagatgaagatgaggccatcgtgggtagttggttctgggctggcgacgaggctcactttgaatcaaacccttcacccgttttccgtgccatttgccgcagcacctgcagtgtggagcaagagcctgatcccagccgcagacctcagtcatgggaagaggtgaccgtccaatttaagcctgggccgtggggacgcgttggattcccctccatcagtcccttcagattccccaaggaagctgcatcattgttttgtgagatgttcggcggtaaaccgcggaacatggtgctttctcctgagggcgaagaccaggaaagtcttctgcagccagaccaaccgtcacccgagttcccattccaatatgatccgtcgtaccggtctgtacaggaaattagggaacacctccgggcaaaggagtcaaccgagccagagtcttctagctgcaattgcatccaatgcgagctgaagataggtagcgaggagttcgaggagttactgttacttatggagaagattagggatcctttcatacatgagatctcaaaaattgctatgggaatgcgctctgcttcgcagttcacccgggactttatccgggacagtggggttgtgagcctcattgaaaccttgttgaattatccctcaagtagggtcagaacgagcttccttgaaaacatgattagaatggccccgccttatcccaacctgaacatcatccaaacttacatctgtaaggtgtgtgaggagaccctggcatattccgtggacagccccgagcaactctcaggcattaggatgattcgtcacttgaccacaactaccgactatcatacgctggtagccaactatatgtcgggattcttgtccctgttggccacagggaatgccaagacgaggttccacgttctcaagatgctgctcaatctgtctgaaaacttattcatgactaaagaacttctttccgctgaggctgtctcagagtttataggactgttcaatcgcgaggagacaaacgacaacatccagatcgttctggccatattcgaaaacatagggaacaacataaaaaaagaaactgttttctccgatgacgactttaacattgaacctcttatcagcgcatttcataaggttgagaagttcgccaaggagcttcaaggcaagacggataatcagaacgacccagaaggtgaccaggagaattag

SEQ ID NO: 117917 - DNA, 4188 bp, Artificial Sequence
  Description of Artificial Sequence: Synthetic coding sequence
atgacgggggctgagatagagtccggtgcgcaggttaagccagagaagaagccaggcgaagaggtagtggggggcgctgagatcgagaacgacgtcccgcttgtggtcaggcctaaggtacggacccaggctcagataatgccaggggcacgacccaaaaataaaagtaaggttatgccgggtgccagtaccaaggtggagacatctgctgtcggaggggcacggcctaagtccaaggccaaagccattccagtgagccgcttcaaggaagaagcgcagatgtgggcccagccacggtttggtgcagaaaggctgtctaaaactgagcgtaactcacaaacgaatattatcgcttctccccttgtgagcacagactccgtcctggtcgccaaaaccaaatacctgtcagaagatagagagctggttaatacggacacagaatctttccctcgtagaaaagcccattaccaggccggattccagcccagcttcaggtccaaagaagaaacaaacatgggctcgtggtgttgccctcgaccgacaagcaagcaggaggctagcccgaattccgactttaagtgggttgacaagtctgttagttcactcttctggagtggcgacgaagtgactgcaaagttccaccccggcaaccgcgtcaaggactcaaatcgcagtatgcacatggccaaccaggaggcaaatacaatgtcaagatctcaaacaaatcaagaactttatatcgctagctcttcaggctctgaagacgaaagcgtcaaaaccccctggttctgggccagggataaaaccaacacatggagcggcccacgtgaagatccaaacagtaggtcacggttccgcagcaaaaaagaagtctacgtcgagtcctccagcggcagcgaacacgaagaccatctggagtcttggtttggcgcaggcaaagaggctaaatttagaagcaagatgcgggctggaaaggaagctaacaaccgggctcgtcatcgtgccaagcgggaagcatgtatagattttatgcccgggtccatagacgttattaaaaaagaaagttgcttttggcccgaggaaaacgccaacacattttcccgcccaatgatcaagaaagaggctcgggcgagagcgatgaccaaagaagaagcaaagacaaaggccagggcacgggccaagcaggaagcacgaagcgaagaggaggcactcattggtacatggttctgggcaaccgatgaaagtagcatggcagatgaagcgtccattgagagttccctacaggtggaggatgagtcgattatcggatcgtggttttggactgaagaggaagccagtatgggaaccggcgcctccagtaagtctagaccaagaacagacggagaaagaattggggattctctattcggcgcccgtgagaagacatctatgaagacaggtgctgaagccacgtcagagagtatcttggccgctgacgacgagcaggtgattattggaagctggttctgggccggcgaagaggttaatcaggaagcagaagaggaaactatttttggctcatggttttgggtcattgacgcagcttcggttgaatccggtgttggcgtaagctgtgaaagtaggacccgatccgaggaagaagaggtaattggaccctggttttggtccggagaacaagtggacatcgaagctgggatcggtgaggaggccagaccgggagcggaagaggagaccatctttggatcatggttctgggcagaaaatcagacatacatggactgccgggctgagacgagctgtgacacgatgcagggtgccgaagaggaggagccgattatcggttcgtggttttggacccgggttgaagcctgtgtagagggcgatgtgaattcaaagagcagtctggaggacaaggaggaagccatgatcccatgtttcggggccaaagaggaggtaagcatgaagcatggcacaggcgtccggtgtcgattcatggcaggagccgaggagaccaataataagtcttgtttttgggcggagaaagaaccctgcatgtaccccgccgggggggggtcttggaaaagtagaccagaagaagaggaggatatagttaactcttggttctggtcacgcaagtataccaagccggaggcaattattggtagctggctctgggctacagaagaatccaacatcgatggcaccggtgagaaggccaaactgctgacggaggaggagacaatcattaatagttggttttggaaggaggatgaagctatttccgaagcaactgaccgcgaggagtcacggcctgaggcggaggagggtgatataattgggagttggttctgggccggggaagaagacaggctcgagccagctgcggagaccagagaggaggaccggttagctgctgaaaaagagggcattgtaggatcctggtttggtgcaagagaagaaacgataagacgtgaagcaggttcttgtagcaagagttcacccaaggccgaggaagaggaagtaattattggctcgtggttctgggaggaagaagcaagcccagaagctgtcgcgggagtaggtttcgagtctaagcccggaacagaggaggaagagattaccgtgggtagctggttttggcccgaagaggaagctagcatacaggctggctcacaagccgttgaggaaatggagtccgagactgaagaagagactatattcggtagttggttttgggacggcaaggaggtgagcgaagaagcagggccttgttgcgtttccaaacctgaagacgacgaggaaatgatcgttgaatcctggttttggagccgtgataaggcaatcaaggaaacaggcaccgtagccacctgcgagtctaaaccggaaaacgaagagggggcaattgtcggcagctggtttgaagcagaggacgaggtggataatcggaccgacaatggcagcaattgcgggtctaggactctggccgatgaagatgaggctattgttggatcatggttttgggccggagacgaggcgcatttcgaatccaatccctcacccgttttcagggccatttgcagatcaacctgctccgtcgaacaggaaccagatccatctagaagaccacagagttgggaggaggtgacagtgcagtttaaaccaggaccatggggacgagtcggttttcctagtatttccccctttagatttccaaaggaggccgcctctctgttctgtgagatgttcggaggcaaaccaagaaatatggttctgagcccagaaggagaggatcaagagtcactgctgcaaccagaccaaccttcaccagagtttcccttccagtatgacccaagttacagatcagtgcaggagattcgggaacatctgagggcaaaggagtcaactgagccggaaagctctagttgcaattgcatccagtgtgaattgaaaatcggatccgaagaatttgaagaattgttgctccttatggagaagatccgtgacccattcattcacgagatcagtaaaattgccatggggatgcgaagcgcctctcagttcacacgggacttcataagggattccggtgtggtgagtctgattgagaccctgcttaactacccttcctcacgagtccggacttcgtttcttgagaatatgattagaatggcacctccctacccaaacctgaacataattcagacgtacatctgcaaggtttgtgaggagacactggcctacagcgtagacagccctgaacagctgtctggtattaggatgattagacacttaaccacaactaccgactaccatacacttgtcgcaaattacatgagcggctttctctcgctcctggccacaggaaatgccaagactcggtttcacgttttaaaaatgttgctaaatctgagtgaaaatttgtttatgactaaagagctgctgagtgcagaagctgtttcagagtttatcggcctctttaatcgcgaagaaacaaacgataatatccagatcgtgttggccattttcgagaatattgggaacaatattaaaaaagagactgttttttcggatgacgacttcaacattgaacctctgatctccgcttttcacaaggtggaaaagtttgcaaaggaactccagggtaagaccgacaaccagaatgacccggaaggagatcaggagaactag

SEQ ID NO: 117918 - DNA, 1692 bp, Artificial Sequence
  Description of Artificial Sequence: Synthetic coding sequence
atggacttcggcagtctggagactgtcgtcgcgaacagtgcgttcatcgcagcacgaggttcgttcgatgggagctcttctcaaccatcaagggataagaagtacctagccaagctgaaactccctccgcttagcaaatgcgagtccctccgcgattctctgtctctggagtttgagagtgtttgcctcgagcagccaatcggaaaaaagctcttccagcagtttttacagtcagctgagaaacatctgcccgctttagagctgtggaaagatatcgaagattatgataccgctgacaatgacctgcaaccccagaaagcccaaaccatactagctcagtacttagacccccaggccaagctcttttgttcattcctcgacgaaggtattgtcgcaaagttcaaggagggaccagtagaaattcaggacggcctattccagccactcttgcaggccacccttgctcacttgggtcaggcaccattccaagagtacttaggatctctgtattttctcagattccttcagtggaaatggcttgaagcccaaccaatgggcgaggattggttcctagactttcgcgtactggggaaaggtgggttcggcgaagtctctgcctgccagatgaaggcaacaggaaaactctacgcttgtaagaaactaaacaagaagaggctcaaaaaaagaaagggataccagggcgccatggttgaaaagaaaatattaatgaaggtgcatagtagattcatagtaagcttggcttacgcctttgagactaaagctgatctgtgtctggtgatgacaattatgaatggaggggatatacgctaccacatctacaacgtcaacgaagagaatcccggcttcccagaaccccgagcgctcttctatactgcgcagataatatgcggtctagagcatctgcatcagcggcgaatcgtgtaccgagatctgaaacctgagaacgtccttcttgataacgatggcaatgtgcgcatttccgaccttggtctggctgttgaattgcttgatggccagagtaagactaaggggtatgcaggaacgccagggtttatggccccagagctgctccaaggagaagagtatgatttctccgtggattatttcgctctaggggtaaccctttatgagatgatagccgcacgagggccctttcgggctcgcggggaaaaggtggaaaataaagagctgaagcatcgtataatatctgagcctgtcaagtatcccgataaattcagccaagcttcaaaagatttctgtgaagctctgttggagaaggatcctgagaaaagactcggcttccgggatgaaacatgcgacaaacttcgggcgcaccccctgtttaaagatctgaattggaggcaactggaggccggaatgctgatgccccctttcattccagatagcaagaccgtttatgccaaagacatccaggacgtgggggcattcagtacggtaaagggggttgcgtttgataagaccgatacagagtttttccaggaattcgcaacggggaactgtccaatcccttggcaagaggagatgatcgagacgggcatctttggagaacttaacgtgtggcgttcagatggccagatgccggacgacatgaaagggattagcggcggctctagctccagctctaagagcggtatgtgccttgtttcttag

SEQ ID NO: 117919 - DNA, 285 bp, Artificial Sequence
  Description of Artificial Sequence: Synthetic coding sequence
atgattgctgccaggggccctttcagagcgcggggggagaaagtggagaacaaggagctgaagcatagaatcatctccgaacccgttaagtatcctgataagttttcacaagcaagtaaagacttttgcgaggctctcctggaaaaggatcctgagaaacgcttagggtttagagatgagacctgtgacaaactccgggcgcatccactctttaaagacctcaattggaggcaactggaagcaggaatgctgatgccaccctttatacctgattctaagacttag

SEQ ID NO: 117920 - DNA, 228 bp, Artificial Sequence
  Description of Artificial Sequence: Synthetic coding sequence
atggagttggaaaacattgtggcaaacacagtcctcctgaaagccagagagggaggcgggggtaaaagaaagggaaaaagcaaaaaatggaaagagatactgaaatttccacacatatctcagtgtgaagatctgcgtcgcactatcggggaactttccggaagcctcattagctggagtagctcaacaaaggagcacgggaggcccactgaaataaagatgaggtag

SEQ ID NO: 117921 - DNA, 1458 bp, Artificial Sequence
  Description of Artificial Sequence: Synthetic coding sequence
atgactaaatacctgacaccaaagagtcccgtcttcatcgcccaggtgggacaagatctcgtcagtcagaccgaagagaaactcctacagaagccgtgtaaggaattgttctctgcttgcgcacaaagcgtccacgaatacctgaggggagaaccttttcatgagtatctcgacagcatgtttttcgatcggttcttgcagtggaaatggttagaacggcaacccgtgacaaaaaacaccttccgtcagtacagggtactcggcaagggaggtttcggcgaggtctgtgcttgtcaagtccgagccaccgggaaaatgtatgcttgcaagcgcctcgagaaaaagcggataaaaaaaagaaaaggtgagagcatggcacttaatgagaagcagatactggaaaaagtcaactcacagttcgtggttaatctggcttacgcttacgagaccaaagatgctttatgcctggtgctcacaatcatgaacggcggggatctcaagttccatatttacaacatggggaaccccggctttgaggaggaacgcgccctcttctacgccgcagaaattttatgcgggctggaggacttgcatcgggaaaacacagtatatcgagatctgaagcctgagaacatactgctagacgactacggacatattcgaattagcgacctcggtcttgcggtgaaaatacccgagggcgaccttattcgaggccgggttggaaccgttggttacatggcccccgaggtccttaacaaccagagatacggattgtctcccgattattgggggcttggatgtctgatttacgagatgatagagggccaatcacccttccgcgggcggaaggagaaagtgaagagggaggaagtggatcggcgcgtgctggagaccgaagaggtttactctcataagttctcagaggaggcgaaatctatatgtaaaatgcttctcactaaagacgccaagcaacgactgggatgccaggaggaaggtgctgcagaggtcaagaggcaccccttttttcgaaacatgaactttaagcggttagaagccggaatgctggaccctccatttgtcccggacccacgggccgtgtactgcaaggatgtcttggacatcgagcagttttccactgtgaaaggggtgaacttggaccacacagacgacgacttttactctaagttttcgactggctctgtctcgattccctggcagaatgagatgatagaaactgagtgctttaaggagctgaacgtgttcggcccaaatggcaccttaccaccggacttgaatagaaatcaccctcccgagccgccaaagaaaggtttactgcaacgcctgtttaaaaggcagcatcagaataattcaaagtcctccccttcctcaaagacctccttcaaccatcacataaactccaaccacgtttcctccaactcaacaggatccagctag

SEQ ID NO: 117922 - DNA, 1773 bp, Artificial Sequence
  Description of Artificial Sequence: Synthetic coding sequence
atggagttagaaaacatcgtcgccaataccgtgctccttaaggctagggaagggggcgggggaaaacgtaaagggaagtccaaaaaatggaaagagattttaaaatttccacacatctcacaatgcgaggacctgagacgcactatcgatcgggactactgttccttatgtgacaagcagcctataggccggctgctgttcaggcagttctgcgagacacgacccggtctggagtgctacatccaattcctcgattccgttgctgagtacgaggtgacaccagacgagaaactgggtgagaaagggaaagagatcatgacgaagtacttgactcccaagagtccagttttcatcgctcaagtcggtcaagacttagtgagtcagaccgaggagaaactgttgcagaagccatgcaaagaactgttttctgcttgtgcccaatctgtccacgaatatctgcgcggggagcctttccatgagtacctggacagcatgttttttgacagattcctgcagtggaaatggctggaacgccaacccgtcacaaaaaatacctttcggcagtatagagttctgggaaagggtgggtttggcgaagtctgcgcctgtcaggtgagggcaacaggaaagatgtacgcctgtaagcgccttgagaagaaaaggatcaaaaagaggaagggcgagtctatggcattgaacgagaagcaaatcctggagaaagttaatagtcagttcgtggtcaatttagcgtatgcctatgaaacgaaagatgcattgtgcctggtcctcacgataatgaatggcggggatctcaaatttcacatctacaatatgggtaatccaggcttcgaggaggaacgtgcacttttctacgccgctgagatactgtgcggactggaggacttacatagggaaaataccgtctaccgcgacctgaagcctgaaaacatcctgctggatgattacgggcatatccgcatttccgatctgggcctcgccgtgaagatcccagaaggagacctgatccgcgggcgcgttgggacagtgggttacatggcccctgaagtgctgaataatcaacgctacggcctcagccccgattactggggtctgggctgtctaatctacgagatgatcgagggccagtcaccattcagaggcaggaaagaaaaggtcaaacgcgaggaagtggatagacgcgttctggaaactgaagaggtttactcccacaagtttagcgaagaggctaaatcaatttgtaaaatgctcttgaccaaagacgccaagcagcgactgggatgccaggaggaaggggccgcggaagtaaaaagacacccatttttccgcaacatgaacttcaaaaggctggaagccgggatgttggacccacctttcgttccagaccctagggccgtttactgtaaggacgtgctggacattgaacaattttctacagtgaagggagtcaatctggaccacactgacgacgatttctactccaaattttccaccggttcggtgtccattccatggcagaacgagatgatagagaccgagtgttttaaggaacttaacgtcttcggtccgaacggtactctgccacctgatctcaaccggaaccatcctccagagccccctaagaagggactgctgcagcgtcttttcaagaggcagcaccaaaataactcaaagtccagccccagctccaagacaagcttcaatcaccacattaatagcaaccatgttagtagtaattcgacaggcagtagctag

SEQ ID NO: 117923 - DNA, 1200 bp, Artificial Sequence
  Description of Artificial Sequence: Synthetic coding sequence
atgacaaagtacttaaccccgaaatcacccgtgttcattgctcaagttggccaggatcttgtgagccagactgaggagaaactgctgcaaaagccctgcaaagaactgttctctgcttgcgctcagtccgtacacgaatatcttcggggcgagcccttccacgaatacctggactcaatgttcttcgaccgctttctgcagtggaaatggttggaaagacagcccgtgacgaagaacacgtttagacagtaccgggtgttgggcaagggaggattcggagaagtatgtgcctgccaagtgcgcgcaaccggtaagatgtatgcatgcaagaggctggagaagaagagaataaaaaaaagaaaaggcgagtcaatggcccttaacgaaaagcaaatcctagaaaaagttaattctcagtttgttgtcaacctggcctatgcctacgagactaaggatgcgctatgtctagtcctgaccatcatgaatggaggggatttaaagtttcacatctataacatgggcaatccaggcttcgaagagggtgctgctgaagtgaagagacacccgttcttccgcaacatgaatttcaaacggctggaagctggtatgctggatcccccatttgtccctgatccgagggccgtctactgcaaagatgttctggacattgagcagttctcaaccgtgaagggcgtaaacttagaccataccgacgacgacttctatagcaaattctctaccgggtcggtgtccattccatggcaaaacgaaatgatcgaaacagagtgtttcaaggagttgaatgttttcggcccaaatggcacactacccccagacctaaatcgtaaccatccacccgagccccccaaaaaaggtctgctccagcgcctatttaagagacagcaccagaacaactccaaatcgtccccaagtagtaagtccacagtggagccagcacaaacactgcttttgcggtccggctcatccggggcacctgctctcgttgggctgcccggggagacccccggagccggcgagggcggtaggcctagtcgccgccggagaacatcgcgctttctcaaggaaatttctactcaagtttgcttcccaaggcgacctagacccggttggattggctttgtgttcggcgagcactgcaatagaaaccccataggttacgacaatctgcacgttttttag

SEQ ID NO: 117924 - DNA, 1731 bp, Artificial Sequence
  Description of Artificial Sequence: Synthetic coding sequence
atggaactggaaaacatcgtggccaacacagtactactgaaggcaagggaagggggaggcggtaataggaagggaaagagtaagaagtggagacagatgctgcagtttccccacatcagccagtgcgaggagcttcgcctgtccctggaaagggactatcacagcctctgcgaaagacaacctataggtcggttgctgtttcgagagttttgtgccacccgccctgaactgtcacggtgcgtggcctttctggacggagtggctgagtacgaagtgacccctgacgacaagcggaaggcctgtggcaggcagctgacccagaacttcctgagccacactggtcctgatttaatcccggaggtaccgaggcagctggtcacaaactgcacccagcgtctggaacaaggaccatgtaaggacctgttccaggaactgaccaggctgacacacgaatatctgtcggtcgcccctttcgcggattatctggatagcatctacttcaaccggtttcttcagtggaagtggctggaacggcagccagtgacgaaaaataccttcaggcaatatcgcgtgctggggaagggagggtttggggaagtctgtgcctgtcaagtgcgggccactggcaagatgtacgcctgtaagaaattagagaagaagaggatcaaaaagaggaaaggagaagccatggccctgaacgagaaacagatattggaaaaggtgaactctaggttcgtggtgagccttgcttacgcttatgaaactaaggacgcactgtgcctagtgctcacactgatgaatggtggcgacctgaagttccatatttaccatatgggacaggctgggtttccagaggcacgcgcagtgttttacgcggcagagatttgctgcggattagaggacctgcaccgagaaaggatcgtgtatagggacctgaagcctgagaatatcctgttagacgatcatggtcacatccgaatcagtgatctcggcctggcagtgcatgtccccgagggccagaccatcaaaggacgcgtggggacggttggctacatggcccctgaagttgtcaaaaacgaacggtatacattctcaccggattggtgggcgttaggatgtctgttatacgaaatgatagccggccaatctccctttcaacagagaaagaagaaaataaagcgagaggaggtggagcgcctcgtcaaggaggtcccagaagagtactcagaacgtttcagccctcaagcccgctctttatgttctcaactgctctgcaaagaccccgcagagcggctgggatgtcggggcgggtcagccagagaggtcaaagagcatcctctgtttaagaagttgaatttcaagagactcggtgctggaatgctggaacctcctttcaaacctgatccacaggcaatttactgtaaagatgtactcgatatcgagcaattctctactgtaaaaggagtggaactggaaccgacagaccaggatttttaccaaaagttcgctacaggatctgtcccgatcccctggcaaaatgagatggtggaaacggaatgtttccaggagctgaatgttttcgggctcgatggctcagtgccaccagacctggattggaagggtcagccccccgccccgcctaagaagggcctgctccagcgactcttcagtcggcaggactgttgcggcaactgttctgactctgaggaagagttacccaccagactctag

SEQ ID NO: 117925 - DNA, 1683 bp, Artificial Sequence
  Description of Artificial Sequence: Synthetic coding sequence
atggagctggaaaacatcgttgccaacaccgtcctcctgaaagcccgagaggggggtggcggcaatcggaagggtaagtcaaagaagtggagacagatgctgcagtttcctcatataagtcaatgtgaagaattaaggctttcgctcgagcgagactaccattccctttgcgagcgccaacccatcggacgactgctattcagagagttttgcgccacacggcccgagctgtcaaggtgtgtggctttccttgacggggtcgcagagtacgaggttacccccgacgacaagcggaaagcctgcggtaggcagcttacacagaacttcctatcacatacagggcctgatttgataccagaggttccaagacagctggtcacgaactgtacacagagactggaacaggggccttgtaaagacttgtttcaggagctgaccaggctgacccatgaatacctctcggtggctccctttgctgattatctggattcaatctacttcaatcgcttcttgcagtggaagtggctggagaggcagcccgttacaaagaacacgtttaggcagtatcgcgtattggggaaaggcggcttcggtgaagtatgcgcttgtcaagtacgggccaccggaaagatgtatgcatgcaagaagctggaaaaaaaacgaatcaaaaagagaaagggggaggcaatggcccttaatgaaaagcagatcctggaaaaagttaactcaaggtttgtagtttccctggcatatgcctacgaaactaaagatgctctgtgcttagtgcttactttaatgaacggtggcgaccttaaatttcacatttatcatatgggccaggcaggcttccccgaggcgagggctgtcttttatgcagcagaaatatgttgcggcctggaggacttgcaccgggaaagaatagtgtacagggatctaaagcccgagaacatcctgctcgacgaccacggccacatcaggattagtgatttaggacttgccgtccacgtgcctgagggccagaccatcaagggaagggtcggcacagtagggtacatggccccagaggtggtgaagaatgaacgctacaccttttcacctgactggtgggcccttggctgcctgctttacgaaatgatcgcgggtcagtctccattccagcagagaaagaaaaagatcaaacgagaggaggttgaacggcttgtgaaggaggtgccagaagagtattcagagagattctctcctcaggctaggagcctgtgcagtcaattactgtgtaaggatccagcagagcgtttgggttgcaggggcggtagcgcacgggaagttaaggaacaccctctctttaagaaactcaatttcaagaggctcggggcaggaatgctcgaacccccctttaagccagatccacaggccatctattgcaaagatgtgcttgacatcgaacagttttcaacagtcaaaggtgtggagttggagccaaccgaccaagatttttatcaaaagttcgccaccgggagtgttccgatcccatggcagaacgagatggtggaaaccgaatgttttcaagaattaaatgtcttcggtctcgatggctctgtgccacctgacctcgactggaagggccagccccccgcccccccgaagaagggtctcctccagcgcttgttctctcgccaaagatag

SEQ ID NO: 117926 - DNA, 1770 bp, Artificial Sequence
  Description of Artificial Sequence: Synthetic coding sequence
atggagttagaaaatatcgttgctaatactgtcctgctcaaagcgcgtgagggaggtggcggtaaccgcaaaggaaagtccaagaaatggagacagatgctgcagtttcctcacatttcacagtgcgaagagctccggctgtcactggaaagagattaccattctctgtgcgagagacaacctattgggcgtctcctgtttagagagttttgcgccacgcgcccagagttgagtcgatgcgtcgccttcctggatggcgtagccgagtatgaagttacccctgatgataaaagaaaagcatgcggccgacagcttacccaaaatttcctgtcacacacgggtccagacctgattccggaagtgcctcgccagctggtaaccaattgcactcagagactggagcaaggcccttgtaaagacctctttcaggaactcactcgcctcacccatgagtacctttccgtggctccgttcgcagattacctcgattccatttacttcaaccgttttttacagtggaagtggctcgagcggcagccagtcacaaagaacacctttaggcagtatcgagtgctgggcaagggagggtttggagaggtgtgcgcctgtcaagtgagggccaccggtaagatgtacgcttgtaagaagttagaaaagaagaggataaaaaagagaaagggggaggctatggccctaaatgaaaaacagatcctggaaaaagttaattcccgctttgtagtctcactggcttacgcctacgagactaaggatgcactgtgcttggttctcaccctcatgaacggaggcgacctaaagtttcatatatatcacatggggcaggcaggcttcccagaggcgagggccgtcttttatgcagcagaaatatgttgcggtcttgaagacctgcatcgggagcgaatagtttaccgagaccttaaacccgaaaacatcctgctagatgaccacggccacatcaggatcagtgatcttgggcttgccgtgcatgtgcctgaaggacagactattaagggacgggttggaacagtcggctacatggcccctgaggttgtaaaaaatgagcgctacacgttctccccagattggtgggcgttaggatgtcttttatacgagatgatcgccggacagtccccttttcaacagcggaagaaaaaaatcaaacgagaggaggttgaacgactagtgaaggaagtcccggaggagtactccgagcgtttcagtccacaggccagatcattgtgctcacagctgctgtgcaaggacccggctgagagactgggatgtaggggagggtctgcgagggaggttaaagagcatcctctgtttaaaaagctcaactttaaaagattaggagccgggatgctggagcctccattcaagccagaccctcaagcaatctactgcaaggatgtgttagatatcgagcagttcagtaccgtgaagggagtggaactggagcctacggaccaggacttttaccaaaaatttgccaccggaagcgtgcctatcccctggcagaacgagatggttgaaaccgaatgctttcaggagctgaacgtgtttggtttagacggcagtgtcccacccgacctggactggaaaggacaacctcccgcccctcccaagaaagggttactacaacggttattttcacgccagcggattgcggtcgaaacggcggccactgctaggaaaagctcacctcctgctagttcaccccagccagaagcaccaacgagctcctggaggtag

SEQ ID NO: 117927 - DNA, 1662 bp, Artificial Sequence
  Description of Artificial Sequence: Synthetic coding sequence
atggtggatatgggagcacttgataacctaatcgccaatacagcctacttgcaggccaggaagcctagtgattgcgacagcaaggaactgcagcggagacgacggtcactggcactccctggattgcaggggtgcgccgaactgaggcagaaattaagtctgaatttccatagcttatgcgagcagcagcccatcgggagacggctctttcgtgacttcttggcgactgtacccacattccgaaaggccgccacctttctggaggacgtgcaaaattgggaactggccgaggaaggaccaaccaaagatagcgcccttcagggcctggttgccacatgtgccagtgcaccagcgccaggaaatcctcaaccgttcctttctcaagcagtggctaccaaatgccaagcagctactacggaagaagagagagtggcagctgtgaccttggccaaggctgaggctatggctttcctgcaagaacagccctttaaggacttcgttacatctgctttttacgataagttcctccaatggaagctttttgagatgcagcctgtttcagataaatatttcacagagtttcgggttctaggcaaaggcggctttggcgaagtttgcgccgttcaggtaaagaacaccgggaagatgtatgcatgcaagaaactggataagaagcggctgaagaagaagggaggtgagaagatggccctcctggaaaaggaaattctggaaaaggtctcaagccccttcatcgttagcctggcgtacgcctttgaatccaagacacacctgtgccttgtcatgtccctgatgaacggaggggatctgaagttccacatttataatgttgggacccgcggactcgacatgagcagagtgattttctattcagctcagattgcttgcggcatgctgcacctacatgagctgggcatagtgtatagagacatgaaacccgagaatgtgctgctggatgacctcgggaattgcagactttctgacctgggcctggccgtggagatgaagggggggaaaccaatcacccagcgcgctgggacaaatggatatatggccccagagattctcatggagaaggtctcttattcgtaccctgtggattggttcgctatgggctgttccatctatgagatggtcgccgggaggaccccattcaaagattacaaagagaaggtttccaaagaggatcttaaacagcggaccctgcaggatgaggtgaaattccagcacgacaattttaccgaagaggccaaagacatctgtcggttgtttttggccaagaaaccagaacagcgactgggttctagggagaagtccgacgaccctcggaaacaccacttctttaagaccataaactttccccgacttgaggccggcttaattgagccaccattcgtccctgatcccagcgtggtttatgccaaagatattgccgaaatcgacgacttcagcgaggtacgcggcgtggagttcgatgataaggacaagcagtttttcaagaactttgcgaccggcgcggtaccaattgcttggcaggaggagattatcgagacaggcctgtttgaagagttaaatgaccctaaccgccctacaggatgcgaagagggtaactcatcgaaaagcggagtgtgcttgcttctatag

SEQ ID NO: 117928 - DNA, 2088 bp, Artificial Sequence
  Description of Artificial Sequence: Synthetic coding sequence
atggaggagaaacccgggcagccccagccacagcaccatcattcacatcaccacccgcatcaccaccctcaacagcaacaacagcagccgcatcatcaccatcattactacttctacaaccattcccacaaccaccaccatcaccaccatcaccagcagccgcaccagtacctgcagcacggggccgaagggtctcctaaggcacaacctaagcccctcaagcacgagcagaagcatactctgcagcagcaccaggagacacccaagaagaagaccgggtacggtgagcttaatggaaacgccggggagcgagagatttccctgaagaacttgagttccgacgaggcaacaaatcctatttctagggtgctgaacgggaatcagcaggtcgtggatacttctctgaaacagaccgtcaaggctaatacttttggtaaagcgggcatcaaaaccaaaaacttcatccagaagaatagcatggataagaagaatggaaagagttatgaaaacaagtcgggcgaaaaccaatctgtggacaagtcagacacgattccaattccgaacggagtcgttacgaataactccggttacatcacaaatgggtatatgggcaaaggtgctgataacgacggaagcggctctgaatccgggtatactacacccaagaagagaaaggcccggcggaacagcgcaaagggatgtgagaacctgaatatcgttcaagataaaataatgcaacaagaaacctcagtccccaccctcaagcagggcttggagacttttaagccagactactccgagcagaagggaaatcgggtggatggaagcaaaccgatttggaagtacgaaaccggtcctggagggacttcacgagggaagccagctgtgggcgacatgctgcgaaaatcttctgattctaaacctggcgtatcaagtaagaaattcgacgaccggcctaagggcaagcacgcatccgctgtggcatctaaggaagacagctggacgttgttcaaacccccacccgtctttcctgtagataactcgagcgccaaaatcgtccccaagatcagctatgccagtaaggtgaaagaaaatctgaataagaccattcagaactcctcagtctctccaacctcctccagctcttcctcttccagcaccggcgaaacgcagacccagtcatcaagccggcttagtcaggttcccatgagcgcgttgaaatctgtcacttccgccaactttagcaacggcccagtgctagccggcacggatggtaacgtgtatcctccaggtggacaaccactgctgacgactgcagcgaacactctgacacccatcagcagtggtaccgactcagtcctacaggatatgtccttgacatctgcagcggttgaacagattaaaacatctttgttcatttacccgagtaacatgcagactatgctgttgtccacagcacaggtggatctcccgtcccagacagatcagcagaacttgggtgacatatttcaaaatcagtggggacttagtttcatcaatgagcccagtgcagggcctgagaccgtgacagggaagtcttctgaacataaggtcatggaagttacatttcaaggggaatacccagctaccctcgtgtctcagggcgcagagattatccccagcggcaccgaacatcctgtgtttccgaaggcatatgagctggaaaagagaaccagtccccaggtgctggggagcatcctgaaatccggaacaacctctgaaagcggcgccctgagcctggagcccagccacatcggagaccttcagaaagctgacacctcatcccagggggccctggtgtttctgtctaaagattatgagattgaatctcagaaccccttggcgagccctactaatacactgctcggcagcgcaaaagagcagaggtatcaaaggggcctggaaaggaacgatagttggggatcctttgaccttcgagcagcaatcgtctatcacaccaaggaaatggagtctatctggaacttgcagaaacaggatcctaagcgcataattacgtacaacgaagccatggactccccagatcagtag

SEQ ID NO: 117929 - DNA, 534 bp, Artificial Sequence
  Description of Artificial Sequence: Synthetic coding sequence
atgtctcgcaaagggccaagagctgaggtgtgtgccgattgctccgcccctgatcccgggtgggccagtatctctagaggggtcttagtgtgcgacgagtgctgttccgtacacagatctctgggccggcatatatccatagtgaaacacctgaggcatagcgcatggcctcctaccctactgcagatggtgcacacactcgcaagcaacggcgccaactctatttgggagcacagcttgctcgatccagctcaggtacagagtggcagacgcaaagcgaatccgcaagacaaggtccatccaatcaagagcgagtttatcagagcaaaataccagatgttagcctttgttcacaaactgccctgtcgcgacgacgacggtgtcacagccaaggacgatctcacaggacacagaagctgggcaactcctgacatcaacccgcatcccaacagagctaccggtacaagtgctctctctgcagccacactgcccgggtcccaggtgccctggtgccccccattgtcatcgccctag

SEQ ID NO: 117930 - DNA, 2313 bp, Artificial Sequence
  Description of Artificial Sequence: Synthetic coding sequence
atgagccgcaagggccctcgggcagaagtgtgtgccgattgttccgctcccgaccccggatgggcatctatatcaagaggtgtgctggtctgtgatgaatgctgtagcgtgcaccgttcgctggggcgacacattagcattgtgaaacatctgcgccactcagcatggccacctactcttctgcagatggtgcacaccttagcctcaaacggggctaatagcatttgggaacattcactgctcgacccggcgcaagtccagagtggaagaaggaaagccaatccgcaggataaagtgcatccaataaagagcgaatttatccgcgcaaagtatcagatgttagcattcgtgcacaagttaccatgcagggacgatgacggggttacagcaaaagacttgtcaaagcagcttcatagctctgtgcgtaccggtaacctggagacctgtctgcgactgctgtctctgggagctcaggcaaatttttttcacccggagaagggaacgactcctctccatgtcgcggccaaagcaggtcaaacattgcaagcggagttgctggtggtctacggtgctgaccccggcagccctgatgtgaacggacgcacgcctattgactatgcgagacaagccggtcatcatgagttggccgaacggctggttgagtgccagtacgagttaacagatcggctggccttttacctctgtggccgcaagccagaccacaagaacgggcattacatcattccccaaatggctgatcggtctagacaaaagtgcatgagtcaatctctggacctctccgagctcgccaaggccgctaaaaagaaactgcaagccctctcaaatcggctgttcgaggagctggccatggatgtgtatgacgaagttgaccggcgagaaaacgacgcagtctggctggctactcagaaccacagtacgctcgtcaccgaacgctcagccgtccctttccttcctgtaaatcctgaatactccgctaccagaaaccagggcaggcagaaactcgcacggttcaacgctcgcgaattcgccacattgattattgacatccttagtgaagctaagcgacgtcaacaggggaaaagtctcagcagtccaaccgacaatctggagctgagtttgaggtcacagtccgatctggacgatcaacacgattatgattctgtcgcctccgacgaggacacagaccaagaacccctccgatcaaccggggccactagatccaatcgggctagatccatggactcatccgatctgagtgacggagcggtgacacttcaggaatacctggagctcaaaaaggcgctcgccacctcggaagccaaggttcaacagctgatgaaggtgaacagctctcttagcgacgagttacggcgcttgcagagggaaattcacaaacttcaggccgaaaacttgcagctaaggcaaccccccggcccagtgcctacgccacctctaccttcagaaagagccgaacacactccgatggccccaggcgggtcaacacaccgcagagatcgacaggccttttctatgtatgagccaggatcagccctcaagccatttgggggacctccaggcgatgaactgacgacgaggctccagccattccatagtacagaattggaggacgacgcaatatactcagtccacgttccagccgggctgtatcgtattcgcaaaggcgtctctgcatccgcagttccgttcactccgtccagcccactgctgtcttgttcgcaggaggggtcccggcacactagcaagttgtctagacacggaagtggtgcagacagcgattatgaaaacacccagtcaggagaccccttattgggactggaaggcaagcgtttcctcgagcttggcaaagaagaggatttccaccccgagttagagtccttggacggcgaccttgatccaggtctaccatctaccgaagatgttattctgaagaccgaacaggtcacaaagaacatacaggagctccttagagccgcacaggaattcaagcatgactctttcgtgccttgctccgagaaaatccacctggccgtgactgagatggcaagcctgtttcctaagagacccgccctggaacccgtccggagctctctacgtcttttgaacgcaagtgcctatcgattgcagtctgagtgcaggaagaccgtccctccagagcctggcgcacctgtcgacttccagctgctaacacagcaggtgattcagtgcgcatatgacatcgccaaggctgctaaacagctggttactattactactagggagaaaaagcagtag

SEQ ID NO: 117931 - DNA, 1212 bp, Artificial Sequence
  Description of Artificial Sequence: Synthetic coding sequence
atgttcgtagcaagtgagcggaaaatgagagcacaccaggtgctcactttcctccttttatttgtcattacctccgtggcatctgagaatgcctccacttctcgcggttgcggcttggatctcctgccgcagtatgtgtccctctgtgatttagacgccatctggggaatcgtggttgaagccgtggcaggcgcaggcgctctgattaccctgttgctgatgctaatactgcttgtcagactacccttcatcaaggaaaaagagaaaaaaagtccagttggactgcacttcttattcctactgggcacactcggcctgttcggcctcacgttcgccttcatcattcaggaggatgaaaccatctgcagtgttcggcgctttttgtggggcgttctcttcgccctttgtttctcttgcctgttaagtcaggcttggagggtccgaaggcttgtgaggcacggaactggccctgccggctggcagttggttggcctggccctctgccttatgctcgtccaggtaattatagcagtggagtggcttgtgcttaccgtcttgcgagatacccgcccagcctgtgcctacgagcctatggacttcgtcatggccctgatttacgatatggtcctgctggtggtgactctgggattggccctctttactctttgtggcaaattcaagcgctggaagttaaatggcgcgttcttgctgattacagctttcctgagtgtgctgatctgggtcgcttggatgacgatgtacctcttcggcaacgtcaagttacagcagggggacgcttggaacgaccccacactggccatcactctggccgcatccggttgggtgttcgtcatattccacgcaatacctgaaatccattgtaccttgctgcccgccctgcaggaaaacacacccaactactttgacacgtcccagccgaggatgagggaaaccgctttcgaggaagacgtgcagctaccaagggcttatatggagaataaagccttctctatggacgaacataatgctgccttgaggaccgccggattcccgaatggaagtctaggcaagagaccgagcgggagcctcgggaagcggccaagtgctccattccgctctaatgtgtaccaaccaacggaaatggctgtggtgctgaatggaggcactatcccgaccgcacctccgtcccacaccggtaggcatctatggtag

SEQ ID NO: 117932 - DNA, 1215 bp, Artificial Sequence
  Description of Artificial Sequence: Synthetic coding sequence
atgttcgtcgccagtgaacggaaaatgcgagcccatcaggtccttacgtttctactcctgttcgtgatcacaagcgtggctagcgagaacgcttcaaccagtcgcggctgcggtctggatcttctacctcagtatgtctctttgtgcgacttagacgccatctgggggatcgttgtcgaagctgtcgcaggtgctggtgccctgattacacttcttctgatgctgatcctcctggtcagactcccgttcattaaggaaaaggaaaaaaagagccctgtcgggctgcacttcctgtttctcctgggtactttagggttgttcgggctgacttttgcctttataattcaagaggatgagaccatatgcagcgtgcgtagatttctctggggagtgctttttgctttgtgctttagctgcctcttgtcacaggcctggagggtacggagactcgttcgacacggtaccgggcccgcaggttggcagctggtggggcttgccctctgccttatgcttgtgcaagtcattattgctgtggagtggttggtgctcacagtgcttagagacactcgaccagcctgcgcatatgagcctatggattttgtcatggctctgatctacgatatggtgctattagttgtaacacttggactggctctgttcaccctctgtggaaagttcaagagatggaaattaaacggggcgttcctcctgataactgccttcctgtcggtcctgatttgggtagcctggatgaccatgtacctgtttgggaatgtgaagctccagcagggtgatgcttggaacgatcccacccttgccatcacgcttgcagctagcggctgggtgttcgtcattttccacgcaatcccggagatacattgcactctgcttcctgcactgcaggagaacaccccaaattacttcgataccagccaaccgcgaatgcgcgaaaccgccttcgaagaagatgtccagctccctcgggcatatatggagaacaaggccttctccatggatgagcataatgctgctctgaggactgcaggcttcccaaatgggagcctcggaaaacgaccttctggcagtctcggaaagcgcccatcggcccccttcagatctaacgtatatcaaccaacggagatggccgtggtgctgaatggtggcacagagatggtcacccatcctaggtccctcgaatccttcggagctttttag

SEQ ID NO: 117933 - DNA, 1290 bp, Artificial Sequence
  Description of Artificial Sequence: Synthetic coding sequence
atgaaccctccttggtctgtagcctgggggcaagaggggttccgagcagggaccccaggcagtagatacctgccaaggatgtttgtggcttcagaacgcaagatgcgtgcccatcaagtgttgacctttctgctgcttttcgttatcacatcagtcgctagtgagaatgcttcaacgtcacggggatgtggactcgatttgctgccgcagtatgtgtcgttatgcgacctcgatgcgatttggggtatcgtcgtcgaagccgtggcgggtgccggtgccctgattacgctgttgttgatgctgattttgctggtgagactacccttcattaaggaaaaggagaagaagagccccgtcggactccatttcctctttctgcttgggaccctcgggctgttcggcctcacattcgcttttattatccaagaggacgagaccatatgctcggtgcgcagattcttatggggagttctgttcgctctctgctttagctgcctgctgtcccaggcctggagagttcgacgcttagtgcgccacgggacaggacctgccgggtggcagttggtgggactcgccttgtgcctgatgctggttcaggtcattattgccgtggaatggctcgtcctgactgtgctaagagacacacgacccgcatgcgcctacgagcccatggactttgtgatggctctcatctacgatatggttctgctggtggttacactcggacttgccctgtttacgctctgtggaaagtttaaaagatggaagctgaacggggcgtttctgctgattactgcatttctgagtgtgctaatttgggtggcatggatgacgatgtatctgttcggcaacgtgaaactgcagcagggtgacgcctggaacgacccaaccctggctattactctcgctgccagtggttgggtctttgtgatctttcacgctatcccagagatccattgcacactgctcccagctctccaggagaacacacccaactattttgacactagccaaccaagaatgagagagaccgccttcgaggaagacgttcagctgccgagagcatacatggagaacaaagctttctccatggacgagcacaacgctgctctcagaaccgcaggctttcctaatgggtctcttggaaagaggccctcgggaagtctgggaaaacgcccatccgccccgttcagatctaacgtgtatcagcccactgagatggccgtcgtcttgaatgggggaactatacccactgccccaccctcacatactgggagacacctttggtag

SEQ ID NO: 117934 - DNA, 759 bp, Artificial Sequence
  Description of Artificial Sequence: Synthetic coding sequence
atgtttgtagcatccgagcgaaaaatgagggcacaccaggtccttactttccttctgctatttgtgattaccagcgtggcttctgaaaacgcatccacaagtcggggatgcggcttggaccttctccctcagtacgtgtccttatgcgatttagacgccatttggggaatcgtcgttgaagctgttgccggcgccggagccctgattactttgctcctcatgctgattctgttggtaagactgccattttttctgcttatcactgccttcctgagcgtgcttatttgggttgcatggatgacgatgtatttatttggcaacgtcaaattacagcagggagatgcttggaatgatccaaccctggccattaccctcgccgccagtggatgggtatttgtaattttccacgctattcccgaaattcactgtactctgctccctgccttgcaggagaatactccgaattacttcgacacctcccagcccagaatgcgggagactgcgttcgaggaggacgtgcaactgccacgggcgtacatggagaacaaggcctttagcatggacgaacacaatgctgccctgaggaccgcaggatttcccaatggatctctaggtaaacggcctagcgggagtcttggaaaacgaccgtctgcacccttcaggtccaacgtctaccagccaacagaaatggccgtggttcttaacggcggaaccatccctacggctcctccttctcacactggcagacatctttggtag

SEQ ID NO: 117935 - DNA, 489 bp, Artificial Sequence
  Description of Artificial Sequence: Synthetic coding sequence
atggcaattcacaaggcgctggtcatgtgcttgggtctgccattatttttgttcccagaacagtcctaccagggcgatatgtaccctaccaggggtgtgggatatgagacaatcctgaaggagcaaaagggccagagtatgttcgtggaaaacaaagccttctccatggatgagccagttgcggcaaaacggccagtgtcaccctacagcggatacaacggccagctcttaacatccgtgtatcaaccgactgaaatggctttgatgcataaggtcccatccgagggcgcgtatgatataatcttgccgagagcgactgcgaacagtcaggttatgggctcggcaaattcaacccttcgcgctgaagatatgtactctgcacagtcccaccaggccgcaacgccacctaaggacggaaagaactctcaggtgtccgagctgacccagcgcggccaggcaaacacgaaccaggttttcttgcgcttgtag

SEQ ID NO: 117936 - DNA, 1461 bp, Artificial Sequence
  Description of Artificial Sequence: Synthetic coding sequence
atgcgagggcggggctcccagcagcaacagcctactcgaaggcagggccagaaactgccttcgccatcccccgctggaaaatatgaaagcgctcagcctgggggaacacagccagaaccaggccttggtgcgcggatggctatccacaaagctctggtcatgtgtctgggcctccctctgttcctcttcccaggggcctgggcacagggccacgtaccgcctggatgcagtcagggacttaaccctctgtactacaacctgtgcgaccgttccggagcatggggaattgtcttagaggccgtggccggggccggaatagtaactaccttcgtcctcacaatcatcctggtggcctctttacctttcgtgcaggacaccaagaaaagatcactgcttggaacacaggttttttttctgctgggcacactgggactgttttgcttggtgttcgcctgtgtggtcaagcctgacttttccacctgcgctagtcggcgatttctgtttggtgttctgttcgccatatgcttctcgtgcctagccgctcacgtgtttgccctgaacttcctggcccggaagaatcacggcccacgtggatgggtgatctttacagtggcacttctcctcaccctggttgaggttattatcaacactgaatggttgatcatcactctggttcgaggatccggggagggcggtccacagggtaacagttctgctggctgggctgtggcgtccccgtgtgctatcgcgaatatggatttcgtgatggcgcttatctacgtcatgctcctcctccttggggctttcctgggagcatggccagctttatgcgggagatacaaacgctggcgaaagcacggtgtgttcgtgctactgaccaccgccaccagcgtggcaatttgggtcgtctggatcgtaatgtatacctatgggaacaaacagcataactcacctacatgggacgacccaactctagcaatcgcactcgccgccaacgcgtgggcattcgtcctgttctacgtgatacctgaagtgtcccaagtgactaaaagttcccccgaacagtcatatcagggggacatgtaccctacacgcggcgttggatatgagacaatcctgaaggaacagaaaggtcaatccatgtttgtcgagaacaaagccttttcaatggatgagcctgtcgccgccaagcgccccgtgagcccatatagtggatataatggccagctgctgaccagcgtctaccaaccaacagagatggccctaatgcataaagttccatcagaaggtgcctatgacatcattctgcccagagcaaccgcaaactcccaagttatgggcagtgccaacagcaccctgcgcgcggaggatatgtacagtgcgcaaagtcaccaagctgcaacccccccaaaagatggcaaaaatagtcaggtatttcggaacccctacgtgtgggactag

SEQ ID NO: 117937 - DNA, 1326 bp, Artificial Sequence
  Description of Artificial Sequence: Synthetic coding sequence
atggccattcataaagctctggtaatgtgcttaggcctgcccctctttctgtttccaggggcatgggcccagggccacgtacctcctggctgctctcaaggactcaaccctttatattataacctgtgcgaccgctctggcgcatggggaattgttctcgaggctgtggctggagctggtatagtgactacgttcgtgcttaccatcattctggtggcctcactgcccttcgttcaggatacaaagaagaggagcctactcgggacccaagttttttttctgctaggtactcttggtctcttttgcctggtttttgcctgcgttgtgaagcctgatttcagcacttgtgcatctaggcggtttttgttcggggttctgtttgctatatgcttctcttgccttgccgctcacgtgttcgccctgaacttcctggcccgtaaaaaccacggacccagaggatgggtgatcttcactgttgccctgctacttacattggtagaggtcatcatcaacaccgaatggctgatcataacactggtccgtggatctggcgagggtgggcctcaggggaatagttccgctggctgggcagtggccagcccttgcgccattgcaaacatggattttgtcatggccttgatctacgtaatgctgctgctgctcggagcgtttttaggcgcttggccagcactgtgcgggagatataaaaggtggcgaaagcatggtgtgtttgtcctcttaaccacagcaacgagcgtcgccatatgggtcgtctggatcgtcatgtacacttacggcaataagcaacataactctcctacatgggatgaccctacgctggcaatcgccctggcagctaatgcctgggcatttgtgttgttctatgttatccccgaggtatcccaggtgacaaaatcttctcccgagcagtcttaccagggagatatgtatccaacacgcggggttgggtacgaaacgatcctgaaggagcagaagggacagagcatgttcgtcgagaataaggctttcagtatggatgagcccgtagcagcgaagagaccggttagtccctattctggttacaacgggcagctgctcacatcagtgtaccagcctaccgagatggcactgatgcacaaggtaccgagtgaaggcgcatacgacatcatcctcccacgggccaccgcgaattcccaggtgatgggatccgccaacagcactctgagggccgaggacatgtacagcgcccaaagccaccaagcagctacaccacctaaagatgggaaaaattcacaggtttttagaaacccatatgtgtgggattag

SEQ ID NO: 117938 - DNA, 1329 bp, Artificial Sequence
  Description of Artificial Sequence: Synthetic coding sequence
atggccatacacaaggccctggtgatgtgtcttggattgccactttttctattccctggggcctgggcgcagggacacgtcccacccggttgttcacagggattgaaccccctttattataatctgtgcgacagaagcggagcttggggcattgtgctcgaagctgtggccggcgccggaattgtgaccacatttgtgctgaccatcattctggtggccagtctgccctttgtgcaggacacaaaaaagcgctccctgctgggcactcaagtcttcttccttctcggtacactaggtctgttttgcctcgttttcgcatgcgtggtgaagccagatttctccacctgtgcatctcgacgattcctgtttggagttctcttcgccatctgcttctcctgccttgccgctcacgtgttcgccttgaatttccttgctaggaagaaccacggaccccgtgggtgggtgatcttcacagtggctctcctgttaacgctggtggaggtgatcatcaataccgaatggttgattatcacccttgtgcgagggtctggcgaagggggaccacaaggtaatagtagtgctggctgggcggtggcatccccctgcgctatagccaatatggattttgtgatggctctcatctatgtcatgttacttctgctgggtgcgttccttggcgcctggcccgcgctctgtggaaggtacaagaggtggcggaaacatggcgtgttcgtgctgctcaccacggcaacttcagtggccatttgggtggtgtggatcgtaatgtacacttatggaaacaagcagcacaatagtccgacctgggatgatcctacgctcgcgatcgcactcgccgccaacgcctgggcctttgtgctcttttatgttattccagaagtttcccaggtcacgaagtcctctcccgaacagtcataccagggcgatatgtaccccacacgtggtgtgggctacgaaactatcctgaaggaacagaaaggtcagagtatgttcgttgagaataaagctttttcaatggacgaaccagtggccgcaaaaagacccgtatctccctatagcggttataacgggcagctgctgacctctgtgtatcaaccaactgagatggcactgatgcacaaggtaccttccgagggcgcttacgacataattcttccacgggccaccgcaaatagccaggtgatgggaagtgccaactccaccctgagagccgaggatatgtactccgcacagtcacaccaggcggccacccctccaaaggacgggaaaaatagccaggcccagagcccacagtcaaaaacacgctggtag

SEQ ID NO: 117939 - DNA, 1362 bp, Artificial Sequence
  Description of Artificial Sequence: Synthetic coding sequence
atgggcacacaaccagagcctggccttggtgctcgaatggcgatacataaagccctggttatgtgcctggggttgccgctgttcttattccccggcgcgtgggcgcaggggcacgtgccacccggctgctcacaggggctgaacccactctattataatctttgcgatcgctctggagcttggggcatcgttctggaggcggtggcaggagccggcatcgtgactacatttgtcctgactattatcttggttgcatctctgcccttcgtgcaggataccaaaaagcggagcctgctaggcactcaggtgttcttcctgctcggcaccctgggccttttttgtctggtattcgcatgcgttgtgaagcctgatttctccacatgcgcgtctaggcgctttctgtttggtgtccttttcgccatatgtttcagctgtctggccgcccacgtgtttgcactgaacttccttgcgcgaaaaaaccacggccctagaggatgggtgatattcaccgtggctctgttgctcacactggtggaggttattattaacaccgagtggctgataattaccctggtgaggggcagtggcgagggaggccctcaggggaactcctcagccggctgggccgttgcctctccctgtgcgatcgccaacatggattttgtgatggccctgatatatgtaatgctactcctcctgggtgcatttctgggggcctggcctgcactctgtgggagatataaacgttggcggaagcatggtgtgtttgtgctcctgactactgcaaccagcgtggccatctgggttgtttggattgtcatgtacacatatggtaataagcagcacaactcgccaacctgggacgatccaacgctggctatcgctttggctgcaaatgcctgggcttttgtgctcttctatgtcatccctgaggtgagccaagtcactaaatcttcccctgagcagtcataccaaggcgatatgtatcccacaaggggcgtgggatacgagactattcttaaagagcagaagggtcagagcatgttcgtcgagaataaggccttttcaatggacgagcccgtggccgccaaaagaccagtcagtccctacagtggctataatggccagctcctcacctctgtttatcaacccaccgaaatggcgcttatgcacaaagttccgagcgagggagcctatgatatcatattgcctagggctaccgccaattcccaggtaatgggctccgcaaactcaaccttgcgcgcggaggacatgtactctgcacagtctcatcaggctgctactccccctaaagatggaaaaaatagtcaggtttttcgtaatccatatgtctgggattag

SEQ ID NO: 117940 - DNA, 597 bp, Artificial Sequence
  Description of Artificial Sequence: Synthetic coding sequence
atgagcaacgtccgtgtcagcaacggttcacctagcctcgagaggatggatgctcgacaggccgagcacccgaaaccctctgcgtgccgtaacctgttcggccctgtggaccacgaggagctcactagggaccttgaaaaacattgccgggacatggaagaggcctctcagaggaagtggaattttgactttcagaaccataaaccactcgaaggtaaatatgaatggcaggaagttgagaagggctctctccctgagttctactaccgccctccaaggccacccaagggggcgtgcaaggtcccagcccaggagagccaggatgtctctggatctagacccgccgccccacttattggcgcccctgcaaactctgaggatacacacctcgtagacccaaagaccgatccctccgactctcagactggtctagcagaacagtgtgcaggtatccggaaacggcccgctacagatgactcaagtacccagaacaaacgagcgaatcgtacagaggagaacgtgtctgatggcagccccaacgccggtagtgtggaacagactccgaaaaagcccgggctgcgtagaaggcaaacctag

SEQ ID NO: 117941 - DNA, 903 bp, Artificial Sequence
  Description of Artificial Sequence: Synthetic coding sequence
atgtataaggactgcattgaaagcacaggcgactacttcttgttatgcgatgcggagggaccatggggaataatattggaaagtctagccattctgggcattgtcgttacgatcttgctgttattggccttccttttcctgatgcggaagatccaggactgctcacaatggaacgtacttcctactcaactgctgtttttgttgtctgtcctcggactgtttggcctagcattcgctttcatcattgaactgaaccagcagacggcccccgttcggtacttcctttttggtgtgttatttgccctgtgttttagttgcttactggcccacgcgagcaatctcgttaagcttgtcagaggctgcgtatctttcagctggactaccattctatgcatcgctattgggtgcagcctcttgcagattataattgccactgagtatgtgaccctgataatgacgcgcggtatgatgttcgtcaacatgacgccctgtcagctcaacgtggatttcgtggtactgctagtgtacgtgctgtttctgatggccctcactttcttcgtttcaaaagctaccttttgtggaccctgtgagaactggaaacagcacggacggctgatctttatcacggtgctgttcagcatcatcatatgggtggtgtggatttctatgctcctccgggggaacccccagttccaacgccagcctcagtgggacgatcctgtggtgtgtatcgccctcgtgaccaatgcatgggttttcctcttgctatatatcgtgcccgaattatgcatcctatatcgcagctgtcggcaggaatgtccccttcagggaaacgcgtgtcctgtcactgcatatcagcactctttccaggtcgaaaatcaggaactgagccgcgattgctag

SEQ ID NO: 117942 - DNA, 363 bp, Artificial Sequence
  Description of Artificial Sequence: Synthetic coding sequence
atgtacaaagactgtattgagtcaacaggcgattacttccttctgtgtgacgccgaaggaccatggggtattatcctggagtccctggcgatcttaggtatcgtggtcaccattcttctgttgctcgctttcctcttcctgatgcggaaaatccaggattgctcccagtggaacgtgctacctacccagcttttatttttactatctgtgctgggactgtttggtctcgccttcgcatttataatcgaactcaatcaacagacagcaccggttcgctacttcctgtttggagttctgtttgcgctgtgcttctcctgcctccttgcgcacgctagcaatcttgtgaaattggtcagagggtag

SEQ ID NO: 117943 - DNA, 312 bp, Artificial Sequence
  Description of Artificial Sequence: Synthetic coding sequence
atggagactgtgcaagaactcatccctttagcgaaggaaatgatggcccaaaagagaaaaggcaagatggtgaaactttatgtgctcgggagtgtattggcattgttcggagttgttctgggactcatggagactgtgtgcagcccattcacagccgccagaagactccgcgatcaagaggccgccgtggctgaattgcaggctgccctggagcggcaggccttgcagaaacaggcacttcaagagaagggcaaacagcaagacactgtcctgggaggcagggcactatctaatcgccaacacgcctcttag

SEQ ID NO: 117944 - DNA, 1500 bp, Artificial Sequence
  Description of Artificial Sequence: Synthetic coding sequence
atggagctgagtgaacctatcgtggaaaacggagagaccgaaatgagtcccgaggagtcttgggagcataaagaagaaatctcagaagctgaacctggggggggatcactgggcgatggacggccaccagaggagtcagctcacgaaatgatggaggaagaggaggagatcccgaaacctaagtccgtggtggcccctcccggcgcccccaagaaggagcacgtgaacgtcgtgtttatcgggcacgttgacgctggaaaatcaactatcggggggcagataatgtacctgacgggtatggtagataaacgaacgttggagaagtacgagcgagaggccaaagaaaagaatagagagacttggtacttgagctgggccctcgacacaaatcaagaggaaagggataaaggcaagacagtggaggtagggcgggcctacttcgagacagagaagaaacatttcacgatactggatgctccaggtcacaaatccttcgtcccaaatatgatcgggggcgcctcacaggcagacctcgctgtgcttgttatttccgctaggaaaggcgagttcgagaccggattcgagaagggagggcagacacgggaacacgcgatgctggcaaaaaccgcgggggtgaaacacctgatagtgctgattaacaaaatggatgaccctacggttaattggtctaatgaacggtatgaagaatgtaaagagaagctcgttccattcctgaagaaggtggggtttaatcccaaaaaagacattcacttcatgccctgctctggcctaacaggtgcaaatctaaaagagcagtcggacttttgcccatggtatatagggctgccgttcattccatatctcgataacctgccaaacttcaaccgttctgttgatggccccataaggctgcccatcgtcgataagtacaaagacatgggcacagtagttttggggaaactagagagcggaagtatctgcaaagggcagcagctggttatgatgccgaataaacacaacgtagaggtgctcggtattctgtcagatgacgtggagacagataccgttgcccccggagagaacttgaagattcgtctgaaaggtattgaggaagaggaaattctgcccggctttattctttgtgatcctaataacctgtgccacagtggacggactttcgatgcccagatcgtcattattgaacacaaaagcattatttgcccgggatacaacgccgtcctccacatccacacatgcattgaggaggtagagatcaccgcacttatatgtttggtagataagaagagcggagagaaaagcaagacgcggccccgctttgttaagcaggatcaggtatgtatcgcaaggctgcggaccgccggcactatctgtttggaaacttttaaggactttcctcagatgggccgcttcacactgagggatgagggcaagactattgcaatcggaaaggtgttgaagctggtccccgagaaggactag

SEQ ID NO: 117945 - DNA, 1914 bp, Artificial Sequence
  Description of Artificial Sequence: Synthetic coding sequence
atggatcccgggtcaggtggaggcggcggcggcggtggtggcggaggaagcagctccggatcaagtagctcggattctgcaccagactgctgggaccaggctgacatggaggcccctggaccgggaccctgcggcggtggcggcagtctggccgctgcggcagaagctcagcgggagaatttgagcgctgccttctcgagacagttgaacgttaatgcaaaacccttcgtcccgaacgtacacgcagcagaatttgttcctagcttcctgcgcggaccagcagcgcctccacccccggtgggtggcgcagccaataaccatggtgctgggagtggcgccggcggccgagcagcccctgtggaatctagtcaggaggagcagtcgctatgtgaggggagcaactcagccgttagtatggagctgtcggagccgatcgttgagaacggggaaactgaaatgtcccccgaggagagctgggagcacaaagaggagataagcgaggctgagcctggaggaggaagcttgggtgacgggcgcccccccgaggagagcgcacacgaaatgatggaggaggaagaggagatcccaaaacccaagtcagtggtcgcaccccctggagcccccaagaaggaacatgtgaacgtggtctttatcggccacgtggacgctggaaagtcaaccattgggggccagataatgtacctcactggtatggttgataaacgaactcttgaaaagtatgagcgggaggccaaggagaaaaatcgagagacgtggtacctctcctgggccttggatacaaaccaggaagagagggacaagggcaagacagtcgaagtgggacgggcctatttcgaaactgagaagaagcactttaccattcttgacgcaccgggccataagtcatttgttcctaatatgatcggcggcgcatctcaggcagacttggcagtcctggtgattagcgcacgcaagggggagttcgagaccggttttgaaaaagggggtcagacaagagagcacgccatgctagccaagaccgctggtgtgaagcacttaattgttttgattaacaagatggatgatccaacagttaactggagcaatgagaggtacgaggagtgcaaggaaaaacttgtgccattcctgaaaaaggtcggatttaatccgaaaaaggacattcacttcatgccttgttccggcttgacaggagcaaatctcaaggagcagtctgatttttgtccctggtacatcggcttacctttcattccatatctagacaatctgcctaatttcaacagatccgtggacggtccaatccgactgcccatcgtcgataaatacaaggacatgggaacggtggtgctcggcaaactggaaagcggaagcatctgcaagggccagcaactcgtcatgatgcctaataaacataacgtcgaagtcttagggattcttagcgatgatgtggaaacagacaccgtggcacccggagagaatctgaaaatccggctgaaaggcattgaggaggaggaaatcctccccggcttcatcctttgcgatccaaataatctttgccattcgggaaggacttttgacgcccagattgtgattatagagcacaaatccataatttgtcccggttacaacgcagtgcttcacattcatacctgcatcgaagaggtcgagattactgctctcatatgcttggtggacaagaaatccggagaaaagtcgaagacaaggcccagatttgttaagcaggatcaagtttgcatagcaagactccgcacagcggggaccatatgtctggagaccttcaaagattttccgcagatgggtcgtttcactctccgggacgaaggaaagaccattgccatcggaaaagtattgaaactggtccccgagaaggactag

SEQ ID NO: 117946 - DNA, 1911 bp, Artificial Sequence
  Description of Artificial Sequence: Synthetic coding sequence
atggacccaggtagcggcggaggcggaggcgggggcggcggcggaggcagctcttcagggtcgtctagcagcgactctgcacccgattgctgggatcaggcagatatggaggctccggggcccggcccgtgcggcggcggcggcagtcttgccgccgcggccgaagctcagcgcgaaaacctatcggcagcgttctccagacagctgaatgtgaatgctaaaccttttgttcccaacgtacatgctgccgaattcgtaccatcatttttgcgcggtccggctgctccaccaccgcccgtgggcggggcagctaataaccatggagcaggaagtggggccgggggccgggctgctccagtggaatcctcccaggaagaacaaagcctgtgtgaaggctcaaattccgctgtttccatggaactgtctgaaccgatcgaaaacggagagacagagatgtctcccgaagaatcttgggaacataaggaagagatcagcgaagccgagcccgggggaggcagtttaggagatggtcgtccccctgaggagagtgctcacgagatgatggaggaggaggaggaaatccctaaaccaaaatcagtcgtcgctcctcctggagcccctaagaaagagcacgtgaacgtggtatttatagggcacgtcgatgcgggtaaaagcaccatcggcgggcagattatgtaccttaccggcatggtagataagcgaacccttgagaagtatgagcgcgaggcaaaagaaaagaacagagaaacttggtacttatcgtgggctctagatacgaaccaggaagagagggacaagggaaaaacagttgaagtcggtagagcatacttcgaaaccgagaaaaaacatttcacaatactggacgcccccggacataaatccttcgtccctaacatgatagggggggccagtcaggccgacttagcagtcctggtaataagtgcccgtaaaggagagtttgagacaggattcgagaaaggcggtcagacccgtgaacatgcaatgctggctaagacagctggtgtgaagcatcttatcgtgttaatcaacaaaatggatgatccaactgtgaactggtcaaacgagaggtacgaggagtgcaaggagaagttggtgccatttctaaaaaaggtaggcttcaatcccaaaaaggatatccacttcatgccttgttctgggctaactggcgcaaacttgaaagaacagtccgacttctgtccctggtatatcggattgccttttatcccttatctggacaacctccctaatttcaatcggtcagtcgatggccccattcggctccccatcgtggataaatataaggatatgggcaccgtcgtgttgggcaaactggagtctggaagcatttgtaaaggccagcagctagtgatgatgcccaataagcataatgtggaggtgctcggaattctgagtgatgatgttgaaacggatacagttgcacctggcgaaaatctgaagattcgcctgaagggcattgaggaagaagagatcttgcccgggttcatactctgtgacccaaataacctgtgtcattcagggagaacatttgatgctcagattgttattattgagcacaaatccattatctgccccgggtacaacgctgtgctgcacatccacacatgcatcgaggaagttgaaataactgccctgatttgcctagtggacaagaaatccggggaaaaatccaagacacgtcccaggttcgtaaagcaagatcaggtgtgcatcgctagactccggaccgcaggaacaatatgtctggaaacattcaaggacttcccacagatggggcggttcacccttagagacgaggggaaaaccattgctatcggcaaggtgcttaaattagtccccgagaaggattag

SEQ ID NO: 117947 - DNA, 1887 bp, Artificial Sequence
  Description of Artificial Sequence: Synthetic coding sequence
atggattcaggctcctcatcctccgatagtgccccagactgttgggatcaggtggatatggaaagcccaggaagtgccccttctggtgatggggtgagtagcgcggtggctgaggcccagcgcgagcccctaagctccgcattttcgagaaagttgaacgttaatgccaaaccgttcgtgccgaatgtgcacgctgcggagttcgtaccatctttccttaggggcccgacgcagcctccgacgctccctgcaggttctgggtccaatgacgagacttgtaccggcgcgggctacccccaaggtaagcgtatgggtagaggcgccccggtggaacccagcagggaggagcccttggtttccctcgagggatccaattcagccgtgaccatggaactgagtgagccagtcgtcgaaaatggcgaggtcgagatggccctcgaggaatcatgggagcacagcaaagaagtgagcgaggctgaacctggcggcggatcctccggggacagcgggccgccagaagagtccgggcaggagatgatggaggagaaggaggagattcgcaagtctaagagcgtaatagttccctcaggcgcaccaaaaaaggagcatgtcaatgtagtttttatcggccacgtggatgctggcaaaagtactattgggggacagatcatgttcctgacaggtatggtcgacaagcggacactggagaagtacgagcgagaggccaaagagaagaacagagagacctggtacctgagctgggctttggacactaaccaagaagaaagggataaaggaaagaccgtggaggttggtcgcgcttatttcgagactgagaggaaacactttaccattctggatgcaccaggccataaatccttcgtgcccaacatgatcggtggcgctagtcaggctgatctggcggtactcgttatctccgcccgaaagggcgaattcgagacgggatttgaaaaaggcggccagaccagggagcacgcaatgctggcaaagaccgccggagttaagcatctgatcgtgctgatcaataaaatggacgatcccaccgttaactggtctatcgagaggtatgaggagtgcaaggagaagctggtcccctttctcaaaaaagtgggattcagtccgaagaaggacattcacttcatgccttgttctggactgaccggtgccaacataaaggagcagagtgacttttgcccctggtatacgggcctcccatttatcccgtacctggataatctgcccaatttcaatcggtctatcgacgggcctatccggttgcccatcgtggataagtacaaagatatgggtactgtggtcttggggaagctcgagagcggctctatatttaaaggccagcagctcgtgatgatgccaaataagcacaatgtcgaggtcctgggaatcctgagcgatgatacagaaaccgatttcgtcgctcctggcgagaatttgaaaattcggctgaaggggatagaggaggaggaaattctgcccgggttcattctctgtgatcctagtaatctttgccactccggacggactttcgacgttcagatcgtgataatcgagcacaagtcaatcatctgtccaggctataatgccgttctccatatccacacatgtatcgaggaagttgaaatcacggctctgatcagtttggttgataaaaagtccggagagaagtctaaaactcgccccagatttgtgaagcaggatcaggtgtgtattgcccgcctgaggactgccggaaccatttgcctggagaccttcaaggattttcctcagatgggtcggtttacccttagagatgaggggaagacaatcgccatcggaaaggtcctgaagcttgttccagagaaagactag

SEQ ID NO: 117948 - DNA, 1638 bp, Artificial Sequence
  Description of Artificial Sequence: Synthetic coding sequence
atggattccggttcaaacgatgagacctgcaccggcgccggctacccccagggcaagagaatgggccgcggggccccagtcgaaccgagtcgtgaagagcctctggtgagccttgaaggctctaatagcgcagtcacgatggagctgtcagagccagtggtagaaaacggcgaggtggagatggctctcgaagaaagctgggagcattccaaggaagtgtccgaggctgagcccgggggagggagtagtggcgatagcggccctcccgaggagagcggccaagaaatgatggaggaaaaggaggagatccggaaatcaaaaagtgtgatagtgccctccggcgccccgaagaaagagcacgtgaacgtcgtttttataggccacgtagatgccggtaagagcaccatcggtggacagatcatgtttttgacaggcatggtggacaaacggaccctggagaaatacgagcgggaagctaaagagaaaaaccgagagacctggtacctaagctgggcgctcgacacaaaccaggaagagcgagataaagggaaaaccgtggaggtcggcagagcctacttcgagaccgagagaaagcattttactattctggatgcaccgggtcataagtcttttgtccctaatatgatcggcggggctagccaggctgacctcgcagtgctggttatctctgccagaaaaggagagttcgaaaccgggttcgagaaagggggacagacgagggagcatgccatgctcgccaagactgccggcgtgaagcacctaatagtactgataaacaagatggatgatccaacggtgaactggtccatagagcgatacgaggagtgtaaggaaaagctcgttcctttcctgaagaaggttgggttctcccctaaaaaggacatacactttatgccctgcagcgggctgacgggcgccaacatcaaggaacaatctgacttctgtccctggtacaccgggcttccctttatcccatacctggataacctccccaacttcaataggtccattgacggaccaattagattgcccattgtggacaaatataaagacatgggtaccgtggttctgggaaaacttgagagtggcagcatctttaagggccaacagctagttatgatgcccaacaagcacaacgtcgaggtgttgggcattctgtcggacgacactgagaccgactttgtggctccgggtgagaatctcaagatccgtctgaaggggatcgaggaagaagaaatcctccccggtttcattttgtgcgacccctccaatctctgccactctggccgcacttttgacgtgcagattgtcattatcgaacataagtctatcatctgcccagggtacaacgcggtgcttcacatccacacatgcatcgaggaagttgagattactgctctgatctcattggtggacaagaaaagcggcgaaaagtcaaaaacacggcctcgttttgtcaagcaggaccaggtgtgcatcgcaaggctgcggaccgcagggacaatctgtctcgaaaccttcaaggacttcccccagatgggccgcttcacactccgcgacgagggaaagaccatcgcaatcggaaaggtgctgaaactggtacccgagaaagattag

SEQ ID NO: 117949 - DNA, 1365 bp, Artificial Sequence
  Description of Artificial Sequence: Synthetic coding sequence
atgaccaaaagggaggccgaggagttaattgagattgagatagatggtaccgaaaaggccgaatgcaccgaggagagtatcgtcgagcagacatacgctccagctgaatgtgtgagccaggccattgacataaacgagccgataggcaatctgaaaaaactcctcgagcctcggctgcagtgcagcttggacgctcacgaaatttgtctccaggacattcagctggatcctgagagatcgctatttgatcagggagtgaaaacagacgggacagtccagctgtccgtgcaagtgatatcataccaaggtattgaacctaaactgaatatcctggaaattgtgaaacctgctgataccgtggaggtagttatcgatccagatgcccaccacgctgagtcagaagcccatttagttgaagaagcacaggtcatcactctcgacggcacaaagcatatcaccacaatcagcgacgaaacaagcgaacaagtgacccggtgggccgcggccttggagggctatcgtaaggaacaggagagacttggaatcccatatgatcccatccagtggagcacagatcaggttctgcattgggtcgtttgggtgatgaaggaattctcaatgacggatatcgaccttaccacgctgaacatcagcgggcgagagctctgctctctgaaccaagaggatttctttcagagggtgcctcgcggagagatcctctggtcccacctggaactgctccggaaatatgtcctggcatctcaggagcaacaaatgaatgaaattgtgacgatcgatcaacccgtccagatcatcccagcctccgtccagtcagccaccccaacaactatcaaagtaatcaattcctcggcaaaggcagcaaaagtccaaagagctcccaggatttcgggagaggacaggtcctctcccgggaatcggaccggtaataacggccagatccagctctggcagtttctgctggagcttctcacagataaagacgccagagactgcattagttgggttggagacgagggtgagttcaagcttaatcagcctgaattggtggcacagaagtggggtcagaggaagaataagcccaccatgaattatgagaagctgtctcgcgccttgcggtactattacgacggagatatgatttgcaaagtccagggcaagaggtttgtgtacaagttcgtatgcgacctgaagaccctgatcgggtattctgctgccgagttaaacagacttgtgaccgaatgcgagcagaagaaattggccaagatgcagctgcacggaatagcccagccagtgactgctgttgccttggcaaccgctagcctgcagaccgaaaaagacaactag

SEQ ID NO: 117950 - DNA, 1365 bp, Artificial Sequence
  Description of Artificial Sequence: Synthetic coding sequence
atgacgaaacgggaggcagaagagctgatcgagatcgaaattgatggaacagagaaagcggaatgtacagaggaaagcattgttgagcaaacttatgcacctgctgagtgtgtgtcccaggctatcgatattaacgaacccatagggaacctgaagaagctgctggagcctagactgcaatgctctttggacgctcatgaaatctgtctccaggacatccagctggatccagaaaggtctctctttgaccagggcgtgaaaaccgacgggacagtgcaattatctgtccaggtgattagctatcagggcatcgaacctaagttgaacattctcgagatagtgaaacccgctgacaccgtcgaggttgttatcgatcctgatgcccaccacgcggaaagcgaagctcacttagttgaggaagcgcaggtgattacactggatggaaccaagcatataacaacaattagtgacgaaacaagtgagcaggtcactagatgggcagcggccctggagggctacaggaaagagcaggagagactgggaattccatatgatcctattcaatggagtaccgaccaggttctgcactgggtggtgtgggtgatgaaggaattttccatgaccgacatcgatctcaccactctaaacatttctgggagggaactgtgcagcctcaatcaggaagacttcttccaacgggtcccccgaggcgaaattctctggtctcatctggagcttcttcggaagtatgttctggcatcgcaggaacagcagatgaacgaaattgtcaccatcgaccagcctgtgcaaattattccggcttccgtccaaagtgctacgcctacaacaattaaagtgatcaattctagcgcaaaagcggccaaggttcaaagggccccccgcatctcgggtgaagataggtcatcgcccgggaatcgcacaggcaacaatggccagatacagctctggcaattcctgctcgagctgctaaccgataaggatgctagagactgcattagctgggtgggtgatgaaggagaatttaagctcaaccagccagagctggtggcacagaagtggggtcaacggaagaacaaaccgacaatgaactacgagaagctgtctagagctctcagatactattatgacggtgacatgatttgcaaggtgcaaggaaaaaggttcgtgtacaaattcgtgtgtgatctgaaaacgctgatcggctatagtgctgccgagttgaatagactagtaaccgagtgcgagcaaaaaaagttggctaaaatgcagttgcatggtattgcccaaccggtcactgcagtagctctcgccaccgcatccctgcaaacagaaaaagataactag

SEQ ID NO: 117951 - DNA, 2163 bp, Artificial Sequence
  Description of Artificial Sequence: Synthetic coding sequence
atggcccagggcctagaggtggctctaacggatttgcaatcctccagaaataatgtgagacatcataccgaagagatcaccgtggaccacctattggtgagaagaggacaggctttcaacctcacgctttacttccgcaataggtccttccagcccggacttgacaatattatctttgttgttgagactgggcccctacccgatctggccctaggcacgcgggctgtgttctctttagccagacatcatagcccatctccgtggattgcctggctagagacgaatggggcaacgagcacagaagtgtccctttgtgctcctcccaccgccgctgtgggcaggtaccttctcaaaatccacattgattcctttcaaggatctgtcaccgcctaccagctgggggagtttattctgctcttcaatccttggtgcccagaggatgccgtttacctggatagcgagcctcaacggcaggagtatgtcatgaacgattatggatttatttaccagggatctaaaaattggattaggccctgcccatggaattatgggcagtttgaggacaagatcatagacatctgcctgaagcttctggacaagtcattacacttccaaactgatccagccactgactgcgctctgagaggctctccagtgtatgtctcgagggtcgtatgcgccatgattaacagcaatgacgacaacggcgtactgaatggcaactggtctgagaattataccgatggggccaacccggccgagtggaccgggtccgtcgccatcctgaagcaatggaatgctaccgggtgtcagccagtgagatacggtcaatgttgggtgttcgcagctgtcatgtgcacagtaatgagatgtttgggcatccctactagagtaatcacgaattttgattccggacacgataccgatgggaacctgattatagacgaatactatgacaacacagggaggatcctgggaaacaagaaaaaggatacaatctggaactttcacgtgtggaatgagtgctggatggccagaaaggatcttcctccggcttatggaggctggcaggttctggacgcgactcctcaggagatgagcaacggcgtttactgctgcggacctgcttccgttcgcgccatcaaggagggcgaagtggacctgaattatgatactccattcgttttttcaatggttaacgccgactgcatgagttggcttgtccaggggggcaaggaacaaaagctgcaccaagacacatcgagcgtcgggaacttcattagtacaaagtcaatccagtccgatgaaagagacgacatcacggagaactacaagtatgaggagggctctctgcaggaacgacaggtctttctgaaggccctccagaaattgaaggcacgcagcttccatgggagccagcgcggagcggaactccagccctctcggcccacgagtctcagtcaggactcccccagaagtttgcatactccttctctaagaccatccgatgtggtacaagtgagcctgaagttcaagttgttagacccaccaaatatgggacaagacatttgcttcgtgcttctggctctcaatatgtccagtcagtttaaagatctcaaagtcaacttatccgctcagtctctcctgcacgatggatcccctctctcccccttctggcaggataccgcctttattactttaagcccaaaggaagccaaaacctatccttgcaagatttcgtatagccaatactcccagtacctgtctacagataaactgattcgaatatctgccctcggggaagagaagtcctccccagaaaaaatcctggtcaataagattattactctgtcttacccgtcaattacaattaacgtattgggcgcagccgttgtaaatcagccattgagcatacaggtcatatttagtaaccccctctctgaacaggttgaagactgcgtactcaccgtggagggctcagggttattcaagaaacagcaaaaggttttcctcggcgtgctgaagccacagcatcaggcaagcatcattctcgagactgtccctttcaagtccggccaacgacagatacaggcaaatatgcgtagcaataagtttaaagacattaagggttaccgaaacgtgtacgtggattttgcactgtag

SEQ ID NO: 117952 - DNA, 1047 bp, Artificial Sequence
  Description of Artificial Sequence: Synthetic coding sequence
atgtccttggtcgaccttgggaagaagctgttggaggctgcgcgcgctggacaggacgacgaggtcaggatccttatggccaacggggcaccatttacaaccgattggctgggaacaagcccactgcacctggcggcccagtacgggcactactcaactaccgaagtgttattacgcgccggcgtgtcccgggatgccagaaccaaagtggacaggacgcctctgcacatggccgcttccgaagggcacgcttccatagtggaagtgctccttaagcacggtgcggacgtgaatgctaaagatatgctgaaaatgaccgcactgcactgggctacggaacacaaccaccaggaggtggtggaattgcttattaagtatggcgccgatgtgcacacgcagtccaagttttgcaagactgcattcgatatcagcattgacaatggaaacgaagacctcgcggagatcttgcaaatcgcaatgcagaatcagattaacacaaaccctgagtcaccagatactgtcacgatacatgccgccacccctcagttcattattgggcctggtggagtcgtcaatctgacagacgaaacaggcgtatccgccgttcaatttggcaattccagtacttcggtgttagcaaccttggctgctttagccgaggctagtgcccctttgtcaaatagttccgagactcctgtcgtggccacagaggaagtagttactgctgagagtgtggatggggctatccagcaggtggtttcttcagggggtcagcaggtgataaccattgtcaccgatggaattcaactaggaaaccttcattcaattcctaccagcggcatcggccaacctattatagtcacgatgcccgacggacagcaggttctcacagtcccagccacggacattgctgaggagactgtgatttcagaggagccgcccgcgaagagacagtgcatcgaaatcatcgaaaaccgcgtggaatccgcagaaatcgaagtacggtcactcctgcccggagtattgtgccggagtcaccccaaatag

SEQ ID NO: 117953 - DNA, 1152 bp, Artificial Sequence
  Description of Artificial Sequence: Synthetic coding sequence
atgagtctcgttgatttgggcaagaaactgctggaagcggctagagccggacaggacgatgaagtgaggattctgatggcaaacggggcccctttcaccacggattggttaggtacaagccctcttcacctcgcagctcaatacggccattattccactaccgaggtgttactgagggccggagtttctcgagatgcgagaactaaggtggaccggacaccactgcatatggccgcctcagagggccatgcaagcatcgtcgaggtgttattgaagcacggagccgatgtgaatgcgaaggatatgctgaagatgactgcgcttcactgggcaacggagcataaccaccaggaggttgtggagctgctcattaagtacggcgcagatgtccatacccagtctaagttctgcaagaccgcattcgacatctcaatcgataacggcaacgaggatctcgccgagattcttcagatcgccatgcaaaatcagattaacaccaatcccgaatcacctgacacagtcacaattcatgcagccaccccccagtttattattggacccggcggagttgtcaatctcaccgacgagaccggcgtgtctgcagtgcaatttggcaattctagcacatccgttctcgcaactctggccgccctggctgaggcttccgctccactcagcaatagttctgaaaccccggtggtggccacagaagaggttgtgacagcagaatctgtagacggcgctatccagcaggtggtaagttcgggcggacagcaggtcatcaccatcgtcaccgatggcatccagttgggaaaccttcactcgatccccaccagtggtattggccagcccatcatcgtcacgatgcctgatggacagcaagtcctgaccgtgccggccacagatatcgctgaagagactgttataagcgaagaacctcctgctaagagacaatgtatcgagatcatcgaaaatcgcgtcgagtctgctgaaatcgaggagagagaagcactgcagaagcagctcgacgaagcaaaccgggaagcacagaaataccgccaacagttactgaaaaaagagcaagaagcagaggcttaccggcagaaactcgaagcgatgacacgcttacaaacaaataaagaggccgtctag

SEQ ID NO: 117954 - DNA, 1047 bp, Artificial Sequence
  Description of Artificial Sequence: Synthetic coding sequence
atgtccctagtagacctgggcaaaaaattattagaagccgcgagggcaggacaggacgacgaagtcagaatactcatggctaatggcgcccccttcacgacagactggctgggaacctcccccctacaccttgctgctcagtatgggcactacagcactacagaagtcttgctgcgggccggtgtgagtcgtgatgctcgtactaaagtggaccgaactcccctccatatggctgcctccgaggggcacgccagtatagttgaagtgttacttaagcatggcgccgatgtaaacgccaaggatatgttgaagatgactgccctgcattgggccaccgaacacaatcatcaggaagtggttgaattgctgataaaatatggagccgatgtacatacacagtccaaattttgcaagacagcgtttgatatttcaatcgacaatggtaatgaggatctcgctgagatactgcagattgcaatgcaaaaccagatcaatacaaatccagagtctcccgacacagtcaccattcacgcggcaacccctcagtttataatcggacctggcggggtggtgaatctgacggacgaaacaggcgtgtcggcagtccaattcggcaattcatccaccagtgtgctcgccactctcgctgccctggccgaggcctccgctcctctgagtaacagcagcgagacaccagttgtcgctactgaggaggtagtcaccgctgagtcagtcgatggtgctatccagcaggttgtttcgtcgggaggacagcaggtgatcaccattgtcacggacggaatccaactgggaaatcttcactccattcccacgtcaggtattggacaacccattatcgtgacgatgccagacggtcagcaggtgcttaccgtccccgccaccgatattgccgaggaaacagtcataagcgaagagccacctgcgaaacgccagtgcatagagataattgagaatcgtgttgaaagcgctgaaattgaagtaaggagtttgcttccgggagtgctatgccgttcacacccaaagtag

SEQ ID NO: 117955 - DNA, 1083 bp, Artificial Sequence
  Description of Artificial Sequence: Synthetic coding sequence
atgtcgcttgtggatctgggtaaaaagctcctagaagccgcccgcgccgggcaggatgatgaagtgcggatcctcatggctaacggagccccctttaccaccgattggcttggtacaagcccactccacctggctgcccagtacgggcactacagcaccaccgaggtgctgcttagagccggagtaagtcgggacgctagaactaaggtggatcggactcccttgcatatggccgcatccgagggtcatgcctcaatcgtggaagtgctgctgaagcacggggccgacgtgaatgcaaaagatatgctcaagatgacggccctgcattgggctactgagcataatcatcaagaagttgtggagctgctcattaaatacggagctgacgtgcacacacaatcgaaattctgcaaaactgcctttgatatctccatagataacggcaacgaagatttggcggagatcctgcagatcgccatgcagaatcagattaataccaaccccgagagccccgacactgtgacaatccacgctgcgaccccacagtttattatcggccctggcggcgtggtgaacctcactggtctcgtgagttcagaaaacagctctaaggccaccgatgagacaggggtttctgccgtgcagtttggtaacagcagtacgtccgtgttagccactctggctgccctggcggaagcaagcgcgcctctgagcaactcctctgagactccagtagtggcaacagaagaggtagtgaccgccgaatcagtggatggcgccattcagcaggttgtttccagcggggggcagcaggtcatcaccatcgttacagacggaatccagttgggtaatttgcatagcatcccaacatccgggatcgggcagcccatcattgttactatgccagacgggcagcaagtacttacagtgcctgcaacagacattgccgaagaaacagtgatctccgaagagcctccggcgaagcgccagtgtatcgagatcatcgagaatcgcgtggagtccgcagagattgaggtacggagccttcttcccggggtgctgtgcagatctcaccccaaatag

SEQ ID NO: 117956 - DNA, 270 bp, Artificial Sequence
  Description of Artificial Sequence: Synthetic coding sequence
atgtccctggtcgatctcggaaagaaacttctggaggctgctcgggcagggcaagatgatgaggtcagaattctgatggccaacggagcgccttttactaccgactggctaggcacatctccattgcatttagctgctcagtacggccactattcaacaaccgaggttctcctccgggccggtgtgtctagagatgctagaaccaaagtggaccgcaccccccttcatatggccgcaagcgaaggacatgcaagcattgtggaggtgtag

SEQ ID NO: 117957 - DNA, 270 bp, Artificial Sequence
  Description of Artificial Sequence: Synthetic coding sequence
atgtctctcgttgaccttggcaaaaaactccttgaagcagcacgggccgggcaagacgatgaggtcaggatcctcatggccaatggcgccccctttacaacagactggttagggacatctccattgcacttagccgctcaatacggtcattacagtacgaccgaggtgctactgagggccggcgtctctcgtgacgcgcggactaaggtggatcgcaccccactgcacatggcagcctcagaggggcacgcctcaatcgttgaagtttag

SEQ ID NO: 117958 - DNA, 354 bp, Artificial Sequence
  Description of Artificial Sequence: Synthetic coding sequence
atgaagtttgtatacaaggaagaacatcctttcgaaaaacggaggagtgagggtgagaagattaggaaaaagtatcccgaccgcgtcccggtgatcgtggaaaaagccccaaaggcacggataggcgatctggacaaaaagaaatatctggtgccctcagacctgactgtgggacagttttactttttgatccgcaagaggattcatctgcgcgccgaagacgcattattctttttcgtaaataacgtcattcctcctacatccgcaactatgggccagctgtatcaggaacaccacgaggaggactttttcttgtatatcgcctattccgatgaatctgtgtacgggctgtag

SEQ ID NO: 117959 - DNA, 354 bp, Artificial Sequence
  Description of Artificial Sequence: Synthetic coding sequence
atgaagttccagtacaaggaggaccaccccttcgaataccgcaagaaggagggcgagaagatcaggaagaagtaccctgacagggtgcccgtgatagttgaaaaggccccaaaggccagggtgcctgatctggacaagcggaaatacctcgtccccagcgatctgactgttgggcagttctattttcttattcggaaacggatccatctgcgtcccgaggatgccctgtttttttttgtgaataataccattccaccaacatctgcaactatgggtcagttgtatgaggacaatcatgaagaagactatttcctgtacgtcgcttattcagacgagtctgtttacggtaagtag

SEQ ID NO: 117960 - DNA, 441 bp, Artificial Sequence
  Description of Artificial Sequence: Synthetic coding sequence
atgaagttccagtataaggaggaccacccatttgaatacaggaaaaaggagggagaaaagattcggaaaaaataccccgatcgcgtgccagtgattgtcgagaaggcccccaaggcccgggtcccggatctggacaaacggaaatacctggtgcccagcgatctgaccgtgggtcagttttatttccttataaggaagcggatccatctgagacccgaagatgcattatttttcttcgtgaataataccatacctcccacctcagcaacgatggggcaactctacgaggtcatggttctagtggcccagtactggatgccctcttcggccgtttggcatccactcgcactcgtgctcgatgccctgattacacacctccggagcggagctgagggcgtgatctatccagacccactgacctatggaagcgttcgactctag

SEQ ID NO: 117961 - DNA, 441 bp, Artificial Sequence
  Description of Artificial Sequence: Synthetic coding sequence
atgaagttccagtataaagaagaccacccattcgaataccgcaaaaaagagggcgagaagatcagaaaaaaataccccgaccgggtgcccgttattgtggagaaagctccaaaagctagggtccctgacctggacaaacgcaagtatctggtgccatctgacctgacagtcggacagttttacttcctaattagaaaacggattcacctgaggccagaagatgccctgttcttttttgttaacaatactatccctcctacctcagctacaatgggacaattgtacgaagtgatggtgctagtggcccagtattggatgcctagctcggcagtgtggcacccactggccttggttcttgacgcactgataactcacttgcggagtggcgcagaaggcgtcatttaccctgaccctcttacttatggttcggtgcgactatag

SEQ ID NO: 117962 - DNA, 213 bp, Artificial Sequence
  Description of Artificial Sequence: Synthetic coding sequence
atgaagtttcagtacaaggaggaccacccgtttgaatacagaaagaaggagggggaaaaaatcagaaagaagtaccctgatcgagttcccgtcatagtagaaaaggctcccaaggcacgcgtaccagatctagataaacgaaaatacctagtcccctctgacctgactgtaggacagttttatttcctaatcaggaaacggattcacctctag

SEQ ID NO: 117963 - DNA, 354 bp, Artificial Sequence
  Description of Artificial Sequence: Synthetic coding sequence
atgaaattccagtacaaggaagaccatccctttgagtataggaagaaggagggtgagaaaattcggaaaaagtatcctgatagggtccctgtaattgtggagaaagcccctaaggctagagtccccgacctcgacaaaaggaaatatctggtgccatctgacttgacagtcggacaattctatttcctgattcgaaaaagaatccatctaagaccagaagacgccctgttcttcttcgtaaacaacaccattcccccaacttccgcgacgatgggtcagctttatgaagacaaccacgaagaggactatttcctgtatgttgcgtacagcgacgaatcggtttacggaaagtag

SEQ ID NO: 117964 - DNA, 354 bp, Artificial Sequence
  Description of Artificial Sequence: Synthetic coding sequence
atgaagtggatgtttaaagaagaccatagccttgaacataggtgcgttgagtcggccaagatcagagcgaagtacccagatcgagtgcccgtgattgtagaaaaagtgagcggctcccagatcgtggatatagacaagcgaaagtatttggtcccatctgatatcacggtggcacagttcatgtggataatccggaaaagaattcagctgcctagtgagaaagcgatttttttgttcgttgacaaaaccgtgccacaatcatctttaacaatgggccagttgtatgaaaaagagaaggatgaggacggctttctgtacgtcgcctacagtggggagaatactttcggattttag

SEQ ID NO: 117965 - DNA, 1344 bp, Artificial Sequence
  Description of Artificial Sequence: Synthetic coding sequence
atgcccgtcctttacgatagacttctgaaattaaaggaaatgtttaattccaagtttgggtccatacctaaattctacgttcgtgccccaggcagagttaatattattggggaacacattgattactgcggttatagtgtgctcccgatggcagtggaacaggatgtgctgattgcagtcgaacccgttaaaacatacgctctgcagcttgccaatactaaccccttgtacccagacttcagtacttctgcgaataatatccaaatagacaaaacgaagccactgtggcataattatttcctgtgcgggctgaaggggatccaggagcatttcggactgagtaatttgactggaatgaactgtctcgtcgatgggaacattcccccaagttccggactgagctcctcttctgccctagtatgctgtgctggtcttgtgacactgacagtgctgggcaggaacctgtctaaagtagaactggcagaaatctgtgccaagagcgaacgttatattgggactgagggaggcgggatggatcagagtatcagctttttggccgaggaaggaaccgcaaaactgatcgaatttagccccttgagagccactgacgtcaagttaccctctggtgctgtcttcgtcatcgctaactcttgtgttgagatgaacaaggcagccacatcccacttcaatattagagttatggagtgcagattagctgcaaaactcttggcaaagtacaaaagcttgcaatgggataaggtgctgcgcttggaggaggtacaggccaaactcggaatttctctagaggagatgctgctagttacagaggatgccctgcaccccgaaccctataaccccgaagaaatctgcagatgcctgggaatcagcctcgaggagttacgtacccagattctgtcaccaaacacacaggacgttctcattttcaaactttatcagcgtgctaagcacgtgtattcggaggctgcgagggttttgcagtttaagaagatttgcgaggaggctcctgagaatatggtccagcttctcggggagctgatgaaccagtctcacatgagttgtcgcgacatgtatgaatgttcctgcccagagttggatcaactggtggatatttgtagaaagtttggagcccagggaagccgactgaccggtgccggctggggaggctgtacagtaagtatggtgccggctgacaagctgccttcctttctggcaaacgttcacaaggcttactatcagaggagcgacggttctttggccccagagaaacagtcgctcttcgcgaccaagcctggcggaggcgcactggtcttgctggaagcttag

SEQ ID NO: 117966 - DNA, 1305 bp, Artificial Sequence
  Description of Artificial Sequence: Synthetic coding sequence
atgttcaattctaagttcggaagtatccccaaattctacgtgagggcacctggccgggtgaacataataggcgaacacatagactactgtggttactccgttctgccgatggccgtggagcaggatgtgctgatcgcggtggagcccgtcaagacctatgccctgcagttggctaatacaaatcctctttaccctgactttagtacatctgctaataacattcagatcgacaagacaaagccactgtggcataattactttctttgcggcctgaagggaatacaggaacacttcggactgtctaatctgactggcatgaactgtctcgtagatggaaatattccccctagtagcggcctttcttcttcatcagcccttgtgtgttgtgctggactggtaaccctgaccgtactcggccgcaacctgtctaaagtggagctcgccgaaatttgcgcgaagtctgagcgttatataggaacagagggaggcggcatggaccagagcattagcttcttagccgaggagggaacggcaaagctcatagagttctctcccctgagggctaccgacgtgaagttgccttccggggctgtgttcgttatcgcaaactcctgcgtggagatgaataaagctgctaccagccattttaatattcgcgtgatggagtgccgtctggcagcaaagctgctggcaaagtataagagtctgcagtgggacaaagtactcaggctggaggaggtccaagctaaactgggaatctctctggaagaaatgttgcttgtcaccgaggatgcactccacccggaaccgtacaatcccgaggaaatctgtaggtgcctgggcatatccctggaagagctccggacacagattctgtcacccaatactcaagatgtcctaatcttcaagctttaccaacgggctaagcacgtgtactcagaagcggccagggtgctgcagttcaagaagatctgcgaagaggcccccgaaaacatggtccagctgctgggcgagctgatgaaccaaagccacatgtcgtgcagggacatgtacgaatgtagctgtccggaactggaccagctggtagatatctgtagaaagtttggcgcacaggggagcagactgacaggggcaggttgggggggatgcacagtgtcaatggtgcctgccgacaagcttccttctttcttggccaacgtgcacaaggcttattaccagaggtctgacggctccttggcacccgagaagcaatctctgtttgcgaccaagcctggtggaggtgccctggttctcttggaagcttag

SEQ ID NO: 117967 - DNA, 624 bp, Artificial Sequence
  Description of Artificial Sequence: Synthetic coding sequence
atgaactgcctcgtcgacggaaacatcccccccagctcaggactgagctcttcatcggccctggtttgttgtgccgggctcgttacgcttactgtgctggggaggaacctgagtaaagtggaattggccgagatctgcgccaagtccgagagatacatcgggactgaaggcggcggaatggaccagagtatctcttttttagccgaggagggtactgcgaagttaatagagttcagtcccctccgcgccacagacgtgaaacttccttctggggctgtcttcgtcatagctaattcttgcgtagaaatgaacaaagccgctacttctcatttcaatatccgcgtgatggagtgtcgactggctgccaaactcctcgccaaatataaatccctccaatgggacaaggtgctacgtttggaggaggttcaggctaaactgggtattagcctggaagaaatgctgctggtcacagaagacgccttgcatccagagccttacaaccctgaagaaatttgtcgatgcttaggaatctccctagaggaactccgaacccagatcctgagccccaacacacaggacgacggggttgtgctctatcgaccgggctggagcgccaccgcctag

SEQ ID NO: 117968 - DNA, 1305 bp, Artificial Sequence
  Description of Artificial Sequence: Synthetic coding sequence
atgttcaatagcaaatttggctcgataccaaagttctacgtccgggcgccgggccgcgtaaacattatcggggagcatatcgattactgtggctattccgtgttgcctatggctgtcgagcaggacgtgctgatcgccgtagaacctgtcaaaacatatgctctgcaattggctaacaccaatcctctttatccggacttctccacatccgccaataatatccagatcgacaaaaccaagcctctgtggcacaactactttctttgtgggttgaaaggaatccaagagcactttggcttatcaaatctgaccggcatgaattgtctggtagatggtaatattcccccaagctccggcctgtccagctcttcggccctggtatgttgtgctgggctggtgacactcaccgtgctgggacggaatttgtcaaaggtggaactggccgagatctgtgcgaaatcggagcgatatatagggacagaagggggcggcatggatcagagcatctcctttctggcagaggagggcactgcaaagctcattgagttcagtccactgcgggcgactgacgtgaagcttccgagcggcgcggtgtttgttattgctaacagttgtgtcgagatgaataaggctgctacttcccactttaatattcgagtcatggagtgtagattggcggcgaaactgctcgccaaatataagagcctgcagtgggacaaggtgttaagattagaagaggtgcaagctaagctcgggatttccctagaagaaatgctgttggttaccgaggacgctctgcacccagagccttacaaccctgaagagatttgccggtgcctcggcatctcacttgaggaattgaggacgcagatacttagcccgaacacccaggatgtccttatctttaagctctatcagcgggcgaagcacgtgtacagcgaggcagcacgagtgttgcagtttaagaaaatctgcgaggaagcccccgagaacatggttcagctgctgggggaactgatgaaccagtctcacatgtcctgtcgggatatgtatgaatgctcatgtcccgagctggaccagctcgtggatatttgccgcaagttcggcgcccaggggtctagactaactggcgcggggtggggcggctgtacagtatccatggtccctgcagataagctgccgtcattcctcgctaacgtgcacaaagcctactaccaacgatcagatggctctcttgcacctgaaaagcaatcgttgttcgcaactaaacccggtgggggtgcactcgttctcctagaggcctag

SEQ ID NO: 117969 - DNA, 1305 bp, Artificial Sequence
  Description of Artificial Sequence: Synthetic coding sequence
atgttcaactcaaagtttggctctattccaaagttttacgttcgagcccctggtagagtgaacatcattggagaacacattgattactgcggctatagcgttctcccgatggccgtggaacaagacgtactcatcgccgtggaaccagttaagacatacgcgctgcaactcgcaaacactaacccactgtatcccgacttcagtacgtctgcaaataacatccagattgataagaccaaaccactttggcataactacttcctgtgcggacttaaaggaatccaggaacacttcggactgtcgaacctgacaggaatgaactgtctcgttgacggaaatattcccccaagcagcgggctgtccagctcatccgcgctggtgtgctgcgcgggtcttgtgactctgactgtactgggacgaaacctctccaaggtcgagctggccgaaatctgcgccaaaagcgaacgttatatcgggactgagggcggtggtatggatcaaagtatctcctttctcgcggaggagggtactgccaagcttatagagttcagcccattgagggccaccgacgtgaaactcccttcaggggcagtgttcgtcatcgctaacagctgtgtcgaaatgaataaggccgctacttcacacttcaacatccgggtgatggaatgtaggctggccgcgaagttgctggctaaatacaagagtctgcagtgggacaaagtgcttaggttagaagaagtacaggccaagctggggatttctctggaggaaatgcttcttgtaaccgaggacgcgttgcatcctgagccgtacaatccagaagagatatgccggtgtttgggtatcagcctggaagaactgagaacacagatattatctcccaacacccaggacgtcctgatctttaaactgtatcagcgggctaagcacgtatactcagaggccgccagagtactccagtttaagaaaatctgcgaagaagccccggaaaacatggtccagctattaggagaactgatgaatcagagtcatatgtcctgtcgcgacatgtacgagtgctcttgtcccgaactggaccaactggtggacatctgcagaaagttcggcgctcaggggagcaggctgaccggggccggttggggtggatgcactgtcagcatggtaccagcagataagctgccatcctttctggcgaatgtgcacaaggcctactatcagcgttccgatgggtccctcgcccctgaaaagcagtcattgttcgctacaaagccggggggaggcgctctggtgcttctggaggcctag

SEQ ID NO: 117970 - DNA, 1377 bp, Artificial Sequence
  Description of Artificial Sequence: Synthetic coding sequence
atggccactgagtctcctgccactcgacgcgttcaggttgcagagcatccccggttattgaaactaaaggagatgtttaactctaaatttggctcaatcccaaaattctatgtgagagccccagggcgggtgaatataatcggcgagcacatcgattactgcggttattcagtcttgcccatggctgtcgaacaggatgtcctgatagccgtggaaccagttaagacatatgccttgcaactggctaatactaacccactgtatcccgacttcagtaccagcgccaataatattcagatcgataagactaagccgttgtggcacaactacttcttgtgcggtctcaagggcattcaggagcattttggtttgtctaacttaacaggaatgaattgccttgttgacggaaatattcctccctcctctgggctgtctagctctagcgccctcgtgtgttgtgccggtctggtgaccctgacggtgctcgggagaaatcttagtaaagtggagctggcagagatttgtgctaagagcgaaagatatattggcacagagggtggcggcatggaccagtccatctcatttctggctgaagaaggcactgcaaagctgatcgaattctccccgttaagagccactgacgtgaagcttcccagtggagctgtgtttgttatcgctaactcatgcgtggagatgaacaaggcagctacctcccatttcaatatcagggtcatggagtgtcggctcgctgcgaagttattggcaaaatacaagtccttgcagtgggataaagttctacggctggaggaggtccaggcaaaattggggattagcctggaagaaatgctgctcgttaccgaggacgcactccatcctgagccctacaatccagaggagatatgccgctgcctgggcattagcttagaagagttgcggacccagattttgagcccaaacacccaggatgtactcatcttcaagctgtaccagagggcaaaacacgtgtattctgaagccgccagagtgctacagttcaagaaaatttgcgaggaagccccagagaatatggtgcagctgctgggcgaactgatgaatcaatcacatatgtcttgtagggatatgtatgaatgctcttgtcccgagctcgatcagttggtggatatttgccggaagttcggtgcacaagggtcgcggcttacaggtgctgggtggggcgggtgcaccgtaagtatggtcccagccgacaaactgcctagcttcctggctaacgtgcacaaggcctattatcagcggtctgacggcagcctggccccagagaagcagtccctgttcgcaaccaagcctgggggcggcgcgctggtcctgctggaggcatag

SEQ ID NO: 117971 - DNA, 1272 bp, Artificial Sequence
  Description of Artificial Sequence: Synthetic coding sequence
atgttaccgccacagaagaagccatgggaaagcatggccaagggtctggtcctgggggccctgttcacctctttcctgctgctcgtgtactcttacgccgtgcctcctctacacgctgggctggcatcaacaacacctgaggccgctgcctcatgtagcccacccgccctggagcctgaggctgtcatacgagccaacggctcagctggagaatgtcaaccaaggaggaacattgttttccttaaaacccacaaaaccgccagcagtaccctcctgaacatcctctttcgctttggtcaaaagcaccgcctgaaatttgcattccccaacggaagaaatgacttcgattatccgaccttcttcgctcgcagcctggtgcaggattaccggcctggtgcctgtttcaatatcatatgtaatcacatgagattccactacgatgaagtgcgcgggcttgtgcccacaaatgccattttcatcacagtcctgagggacccagcaagactctttgaaagttcttttcactactttggtcccgtagtgcccttgacttggaaactgagtgccggagacaaactcaccgagtttctccaagaccctgacaggtactatgacccaaacggatttaacgcccactatctcaggaatcttttgttctttgaccttgggtatgataacagtctggatccatcatctcctcaggtgcaggagcatattttggaagtggagagaagatttcacctagtgctccttcaggagtacttcgatgaaagtctcgtgctgcttaaagatctcttatgttgggagctggaagacgtgctgtattttaagctgaatgcacgaagagacagccctgtgcccaggttaagtggagagctatacgggagagccacggcgtggaacatgttagactctcatctatatcggcactttaacgccagcttctggcgaaaagtggaggcttttggccgggagcggatggctagggaagtcgcagcattacggcatgcgaatgaacgcatgcggacaatatgtattgacggtggtcacgctgtggacgccgccgcaatccaggacgaagcaatgcagccctggcagcctctgggcactaagagcatcctggggtacaacctgaaaaaatcgattgggcagagacacgcccagctctgtcgccggatgttgacacctgagattcagtatctgatggatctcggggccaacttgtgggtcaccaagctctggaagtttattcgagattttttacgatggtag

SEQ ID NO: 117972 - DNA, 1272 bp, Artificial Sequence
  Description of Artificial Sequence: Synthetic coding sequence
atgctacctccccagaaaaagccctgggagagtatggccaagggtttggtcctcggcgccctgtttactagcttcctcctgttggtttattcctacgcagtgccacccctgcatgctggcctagcatcaacaactccagaagcagcagcaagctgttcacctcctgccctcgaacctgaggctgttatcagggctaatggtagcgccggcgagtgtcaaccacggcgaaatatagtgttcctgaagacccataagaccgcctcctccacactcctgaacatcctctttaggtttggacagaagcatagactcaagttcgcctttcccaatggccggaatgatttcgactatcctacattctttgcaagatcactggtgcaggactatagacctggagcgtgcttcaacattatctgtaatcacatgaggttccactacgacgaggtccgaggcctggtccccaccaacgctatctttataaccgttctgagggatcctgcccggctgttcgagtcttctttccactattttggaccagtcgtgccattgacgtggaagctctcagctggggataaacttaccgaattcctacaggatcctgatcgatactatgatcccaatgggttcaacgcccactaccttcggaacctgttattttttgacttaggctacgataattcactggaccccagttccccccaggtgcaagaacacatactcgaagttgagaggcggtttcacctcgtgctgctgcaggaatactttgacgagtcactcgtgctcctgaaggacctgctttgttgggagttggaggatgttctgtatttcaagctgaatgccaggcgggatagtcctgtgcccaggctaagcggtgagctctatggacgggccactgcatggaacatgctggattcccacctttatcgccacttcaacgctagtttctggcgcaaggtggaagcttttggcagagaacgtatggcgcgcgaagtcgcggctctccgacacgcaaatgagcgaatgagaacgatatgcattgacggtggccacgctgtggacgcagctgctattcaggacgaagccatgcagccatggcaaccactgggaactaaaagtatccttggctacaatctcaaaaagtctatcggacagcgccacgctcagctgtgccgcagaatgctgacccctgagatccagtatctgatggatctaggcgctaacctttgggtaaccaagttgtggaaatttatcagagattttctgcgatggtag

SEQ ID NO: 117973 - DNA, 1272 bp, Artificial Sequence
  Description of Artificial Sequence: Synthetic coding sequence
atgctcccaccacaaaaaaagccctgggagtcaatggccaagggcttggttcttggcgcattgtttaccagtttcctgctactggtctattcgtacgcagtcccccccctgcacgcgggcttggcttctaccacaccagaagcagccgcctcatgcagccctcccgccctggagcccgaagccgtgatccgagctaatggcagtgccggcgaatgccagcccaggcggaacattgtctttctgaagactcataaaaccgcgtcttcaacattgctcaatattttgtttcggtttggccagaaacaccggctcaaattcgcctttccgaacgggcgcaatgacttcgactatccgacattttttgctaggtcattagtacaggactatagacccggcgcatgttttaatattatatgtaaccatatgcgctttcactacgatgaagttcgcggactggttcccaccaacgccatctttattacagtgctaagggacccagcaaggttattcgagtccagtttccattattttggacctgtggttcctttaacttggaagctttccgctggggacaagttgaccgagttccttcaggaccctgatcggtactatgatcccaacggttttaacgcacactacctccgaaatctgttattttttgaccttggatacgataatagtctagacccctccagtccccaggtccaggagcacattctggaggttgagagacggtttcacctagtcttgcttcaggagtatttcgacgagtcactggtgttgttaaaagatttgttatgttgggagttggaggacgtgctgtatttcaagctgaacgcgcgcagggacagcccagtgcccaggctgtcaggtgaattatacgggcgtgcaaccgcctggaatatgctggactcacatctgtatcgccacttcaacgcctccttctggaggaaagtagaggcgttcggccgggaacgtatggcacgggaggtcgcggccctgcgacacgccaacgagcgcatgcgcactatatgcatcgacggaggccacgccgtggatgccgccgcaatccaggatgaagcgatgcaaccgtggcagccactcggaaccaagtccattctaggctacaacctcaaaaaatcaataggacagcgtcatgcccagttatgtagaaggatgcttacacctgaaatccaatatctgatggacctgggggccaacctctgggtcacgaagttatggaagtttattcgtgacttcctccgttggtag

SEQ ID NO: 117974 - DNA, 1272 bp, Artificial Sequence
  Description of Artificial Sequence: Synthetic coding sequence
atgctgcccccccagaagaagccatgggaatccatggccaaaggcctggtattgggggccttattcacatcatttctgcttctcgtctactcttatgcagtcccacccctacacgcaggtttggcatctactacgcctgaggcggctgcatcttgttcccccccggcactggaaccggaagctgttatcagagctaacggatctgcgggggagtgtcagccaaggcgcaatatcgtgttcctcaagacccataaaacagccagtagtactctgttaaacattctgttcaggtttggacaaaagcacaggttaaaattcgccttccccaacgggaggaatgacttcgactatccaacttttttcgcacggagtcttgtgcaggactacagacccggagcctgttttaatattatttgtaaccatatgcgttttcattacgatgaggttagagggctggtgcccacaaacgccatatttattaccgtgctgcgggatccagcccggctttttgagagctcctttcattacttcggccctgttgtccctctgacatggaaactgtctgccggggataaactcacggagttcctgcaggacccagaccggtattacgatccaaacggatttaatgcgcactatcttaggaacttgttgttttttgatctcggctatgataattccctcgatccctctagccctcaggtccaggaacacatcctggaggtcgagagacgatttcacctcgttcttctgcaggaatactttgatgaaagtttagtcttattgaaagatctcctctgctgggaactggaggatgtactgtacttcaagctcaacgcccggagggatagtcccgtgccacgactgtcgggagagttatatggtagagcaacagcctggaacatgctagactcccatctgtacaggcatttcaatgcttctttttggaggaaagtggaggcctttgggcgggaacgtatggcccgagaagttgccgccctccggcatgcgaacgagcggatgaggacaatttgcatcgatggggggcacgccgtggacgctgcagcaatacaggatgaagctatgcagccgtggcagccccttggtacaaaatctatcctgggctataacctcaagaaatctattgggcagaggcatgcgcagttgtgtaggagaatgttgaccccagagatacagtacctaatggacttgggggctaatctctgggtgacgaaactgtggaaatttattagggactttcttcgatggtag

SEQ ID NO: 117975 - DNA, 1272 bp, Artificial Sequence
  Description of Artificial Sequence: Synthetic coding sequence
atgctacctcctcagaagaaaccttgggagtcaatggctaagggcttggtgctgggggccttatttacatcattccttctcctggtctactcgtacgccgtgccccctcttcatgccggcctggcctccaccacgccagaagccgccgcttcctgctcacccccagctttagagcctgaggctgttataagagccaatgggtccgcaggtgaatgccagccccgcaggaatattgttttcctgaagacccataaaacggccagttcaactctgctgaatattttgtttaggtttgggcaaaagcaccgtttgaagttcgcttttccgaatggccggaacgattttgattacccaaccttcttcgcgcgctccctggtgcaggactacaggccgggcgcgtgctttaatatcatttgcaatcacatgaggttccattatgatgaagtgcgtgggctcgtgccaaccaacgctattttcatcaccgtgctacgggaccctgctagactgtttgagagctcgtttcattacttcggccctgtggtgcctctgacatggaagctgtcagcgggcgacaagctgaccgaatttctacaggatccagaccgctattacgatccaaacggattcaacgcacactatttgaggaacttgcttttcttcgacctggggtatgataactcactggatcccagtagtccccaggtccaagagcatatattggaggtggaaaggcggtttcatttagtgctcctacaggagtacttcgacgaatccctagttctccttaaggacttgctgtgctgggaactcgaggatgtgctttattttaagctgaatgccaggcgcgactcccctgttccccgcctcagcggagagttgtacggcagagctaccgcttggaatatgctggactctcacctctaccgacacttcaacgccagtttctggcggaaggttgaggcctttggcagagagaggatggctcgtgaagttgcagctctcagacacgcaaacgagagaatgcgcaccatttgcatagacgggggccatgccgtggatgcggccgcaattcaggacgaagctatgcagccttggcagcccttaggcactaagtcaatcctgggttacaacctgaaaaagtcgataggtcagcgacatgcccaactgtgtcgtcgtatgttgacccctgagatccagtatcttatggatctaggggccaatttatgggtaaccaaactgtggaagtttataagggactttttgagatggtag

SEQ ID NO: 117976 - DNA, 1272 bp, Artificial Sequence
  Description of Artificial Sequence: Synthetic coding sequence
atgttgccaccccagaaaaaaccctgggagtccatggctaaaggcctggtattaggcgctctgtttacaagctttctccttctggtgtattcctacgccgttcccccactgcacgctggcctcgcttccaccactcctgaggcggctgcttcttgctcaccgccggctctggaacctgaggctgtgattcgggcaaatggctctgctggcgagtgccagcctcgtcggaacatcgtattcttgaagacacacaagacggcgtcatcaacactcctaaacattctcttccgattcgggcagaaacacaggctgaagtttgctttcccaaatgggcggaatgatttcgactacccaaccttttttgcccgctccctcgttcaggattacaggccaggcgcatgctttaacattatctgtaatcacatgaggttccactacgatgaggtgaggggtttggtgccaacgaacgccatctttataaccgtgctcagagaccccgcccgcctgttcgagagtagcttccattatttcgggcccgtggtccctcttacctggaagctgtccgccggggataagcttactgagttcttgcaagacccggataggtattatgatccaaacggcttcaacgctcattacctgcgcaatctgctcttcttcgacctgggttatgataacagcctagacccatcgtccccgcaggtgcaggagcacatactcgaagtggaaagacgttttcatcttgttttactgcaagaatattttgacgaaagcctggtcctgctgaaggacctcttgtgctgggaattggaagatgttctatatttcaaactcaatgctcgccgcgattcacctgtccctcgcttgtccggagaactctatggacgcgcgacagcttggaacatgctcgattctcacctgtatagacattttaacgcatctttttggcgcaaagttgaagccttcggacgagagagaatggcccgcgaggtggcagcattacgacatgctaacgaaaggatgcgcacaatttgtatagatgggggccacgccgtagatgctgctgcaatacaagacgaggcaatgcagccctggcagcccttggggacgaaatccatactgggctataacctcaagaagtccattggtcagagacacgctcagctgtgtcggcgcatgctcacaccagagatccaatatctgatggacctgggcgcgaatttatgggttactaaactttggaagttcattcgcgattttttgcgttggtag

SEQ ID NO: 117977 - DNA, 258 bp, Artificial Sequence
  Description of Artificial Sequence: Synthetic coding sequence
atgctgccaccgcagaagaagccatgggagtcaatggccaagggcttagtgcttggtgccctctttacctcttttcttctcctggtctactcttacgctgtgccaccccttcatgccggattagcctccaccaccccagaggccgcagcttcttgttcccctcctgccctcgagccagaggcagtgatccgggcaaacggcagcgccggagagtgccagcctaggagaaacatcgtctttctcaaaacacataaatag

SEQ ID NO: 117978 - DNA, 513 bp, Artificial Sequence
  Description of Artificial Sequence: Synthetic coding sequence
atgctacctccgcagaagaagccttgggagagtatggccaaaggattggtcctcggagctttgtttacctcattcctgctgcttgtgtacagttacgcggtacctcctcttcacgccggcctagcaagcaccaccccagaggccgcagccagctgcagcccgcctgccttggaacctgaagctgttatacgggccaacggaagtgcaggagagtgccagccccggagaaacatcgtctttttaaaaactcacaagaccgcatccagtacgttgctgaacatacttttcagattcggccagaagcaccgcctcaaatttgccttcccaaatggcaggaacgattttgattaccccacctttttcgcaaggagcctggtgcaggattataggccgggagcatgtttcaacatcatctgcaaccatatgcgctttcactatgacgaagtcagaggcctggttcctacaaatgccatatttataactgtcctcagagaccctgcccggcttttctag

SEQ ID NO: 117979 - DNA, 450 bp, Artificial Sequence
  Description of Artificial Sequence: Synthetic coding sequence
atgctgcccccccagaaaaaaccctgggagagtatggcaaaaggcctcgtgctgggagccttgttcacttctttcctacttctggtatactcttatgctgtcccgcctctccacgctggcctggcaagtaccactcccgaagctgccgctagctgctctcccccggcgctcgagccagaggccgtaatccgagcaaacgggagcgccggagaatgtcagcctcgtcgtaatatcgttttcctgaagacccataagacagcatcaagtaccctgctcaacattctcttccggttcgggcagaaacatcgtttaaaattcgcctttccaaacggtcgcaacgactttgactaccccactttctttgcacgatctttggtccaagattaccggccgggggcgtgttttaatatcatctgcaaccatatgcgatttcattatgatgaagtgtag

SEQ ID NO: 117980 - DNA, 300 bp, Artificial Sequence
  Description of Artificial Sequence: Synthetic coding sequence
atgctaccccctcaaaagaaaccttgggaatcgatggcaaaagggctagttctgggcgccttattcacctcctttctgctgttagtgtactcttacgcagtgccccccctgcacgcgggcctagcctcaactaccccggaagccgcggccagttgctcccccccggcgctggaaccggaagccgttattagagcaaatggtagtgccggcgaatgccaaccgcgacgcaatattgtattcctcaagactcacaaaactgcttcctccactctactgaacatacttttccgctttggctag

SEQ ID NO: 117981 - DNA, 312 bp, Artificial Sequence
  Description of Artificial Sequence: Synthetic coding sequence
atgcttcctcctcagaaaaaaccctgggaatcaatggcgaagggacttgtgctcggggctttgttcacatccttcctgctcttagtgtactcctatgctgtcccccctctccacgctggactggcctcaacgaccccagaggctgccgcctcctgctcaccaccagcactcgagccagaggcagttattcgggccaatgggtccgccggcgaatgccagcctcggcgtaacattgtgttcctgaaaacacataagacggccagtagtacgttacttaatatcctgttcagattcggccagaagcaccgttag

SEQ ID NO: 117982 - DNA, 600 bp, Artificial Sequence
  Description of Artificial Sequence: Synthetic coding sequence
atgctcccgccacaaaagaaaccctgggaatccatggccaaaggcctagtgctcggcgccctgtttacctcgttcctcctgctagtgtactcatatgccgtcccaccactgcacgccgggctagccagcaccacccctgaggccgcggccagctgttcaccgcctgcgctggagccagaggctgtgatccgggcaaacgggagtgcgggcgagtgccagccaagacggaatatcgtctttctgaagacacataagacagccagtagtacactgttaaacatcctgtttagattcggccaaaagcacaggctgaagtttgcctttccaaacggtagaaatgacttcgactatccaacttttttcgccaggtccttggttcaggactacaggcctggtgcatgctttaacatcatctgtaatcacatgaggttccactacgacgaagtcagaggccttgtgccaaccaacgcgatctttattaccgtgctgagagatccagcccggctctttgaaagctctttccactacttcggaccagtcgtgccccttacatggaagctgtcggccggcgacaaactgacagagtttctccaggactag

SEQ ID NO: 117983 - DNA, 840 bp, Artificial Sequence
  Description of Artificial Sequence: Synthetic coding sequence
atgctaccccctcaaaaaaaaccttgggagagcatggctaagggactcgttttgggagcgctgtttacatcttttttactcttggtctacagctacgcggttcctcccttgcatgcgggtctcgcaagcacgacgcctgaagccgcagcttcatgcagtcctcctgctctagagcccgaagcagttattcgggctaacgggtccgctggggagtgtcagccaagacgtaacattgtcttcctcaagacccacaagactgctagtagcacgctcctcaacattctatttcgctttggtcagaaacatcgcctgaaatttgctttccccaacgggcgaaatgatttcgactatcctacatttttcgcacgctccttggtccaggattacagacccggggcatgtttcaatatcatttgtaatcacatgcgcttccactacgacgaggtgcgaggactggtccctacaaatgccatttttatcacggtgctcagggatcctgcccgcctgtttgaatcgtccttccattatttcgggcctgtggttcctcttacctggaaactgtccgccggcgacaagttgactgagtttctacaggatcccgataggtattacgatccgaatggctttaacgcccactacctgcggaatttgctgtttttcgaccttggctacgacaatagcctagacccgtcctcacctcaggtccaggagcacattcttgaggtggaaagaagattccatcttgtgttgctgcaagaatacttcgatgaatcactggtactgctgaaagatctgttgtgctgggagctcgaagatgttctgtacttcaagctgaactag

SEQ ID NO: 117984 - DNA, 1272 bp, Artificial Sequence
  Description of Artificial Sequence: Synthetic coding sequence
atgctgccaccccagaagaagccttgggaatccatggccaaaggattagttttgggagcgctcttcactagctttctgctcctcgtgtatagctatgccgtgcccccgctacatgccgggcttgcctctaccacacctgaagccgccgccagctgctcaccccctgcactcgaacctgaagccgtgatccgggcaaatggtagcgccggcgagtgtcagcctcgccggaacattgtgttcctaaagacacataagaccgcttcaagcacactattgaatatcctgtttaggttcggccagaaacacaggctgaagtttgcctttccgaacgggcgcaacgattttgactacccaacattctttgcccggtccctagtgcaagactatcgtccaggggcatgcttcaacatcatttgcaatcacatgcgcttccactacgacgaggtacgaggcctggtgccaaccaacgcaattttcatcactgttctgagagatcctgcaaggctgttcgagagcagcttccactattttggtcccgtcgtgccattgacgtggaagctaagtgccggcgataagctcaccgagtttctgcaggatccagatcggtactacgacccaaacgggtttaatgcacattatctgaggaatctactcttcttcgatctggggtacgataatagcctcgacccatctagcccccaggtgcaggagcacatcctcgaagtggaaaggcgtttccatctcgtgctgttgcaggaatatttcgacgaaagtctcgtgctgctaaaggacctgttatgctgggagctagaggacgtcctttacttcaaattgaatgcacggagagattccccagttcccagactcagtggggaactttatggacgtgccaccgcctggaacatgctggattctcacctgtataggcactttaacgcttctttttggagaaaggtcgaagcttttggacgtgaacggatggctagggaggtggctgctctgaggcacgccaatgaaaggatgcgtacaatatgcatcgatggcggccacgcagtcgacgctgccgccattcaggatgaggccatgcagccatggcagccacttggaactaaatcaatcctgggttacaatctcaagaaaagcatcggacagaggcacgctcagttatgccgacgcatgctcactcctgagattcagtatctgatggatctgggggccaacctgtgggtgacaaaactgtggaaatttattcgggatttcctacgctggtag

SEQ ID NO: 117985 - DNA, 432 bp, Artificial Sequence
  Description of Artificial Sequence: Synthetic coding sequence
atgttgcctccccagaagaagccttgggagagcatggcaaaagggctggtcctcggggccctgttcacaagcttcctgcttctcgtgtattcttatgcagtgccccctctccatgccggcttggcatctaccacacccgaggctgccgcaagctgttcaccaccagcactggagccagaagccgtcatccgcgcaaatgggagtgcgggcgagtgccagcctcggcgcaacatagtgtttttgaaaacacacaaaacggcttcatcgactttgttgaatattctttttcggttcgggcagaagcaccgcctgaagttcgctttccccaatggaagaaatgacttcgactaccccactttctttgctcgaagcctagtccaagactaccggcctggcgcatgttttaacatcatttgcaatcacatgcgatag

SEQ ID NO: 117986 - DNA, 231 bp, Artificial Sequence
  Description of Artificial Sequence: Synthetic coding sequence
atgttgcccccacagaaaaagccatgggagtccatggcgaaggggctggtcctgggcgccctatttacaagtttcttgctcctggtgtattcttatgccgtcccccccttacacgcaggccttgcttctactactccagaagccgctgccagctgttccccccccgctctagagccagaggcagtcatccgggctaatggatctgccggcgaatgtcagcctcgcagatag

SEQ ID NO: 117987 - DNA, 288 bp, Artificial Sequence
  Description of Artificial Sequence: Synthetic coding sequence
atgctgccgcctcagaagaagccgtgggagtcaatggctaaagggctggtgctaggcgcccttttcacaagtttcttactcctggtttattcatacgcggtccctcctctgcatgccggcctggccagcactacgcccgaggccgctgcctcctgctctcccccagcactggaaccagaggccgtgattcgagctaacgggtcagctggagaatgtcagcctagacgcaacattgtattcctgaaaacgcataaaacggctagctcaacattgctgaatattctttag

SEQ ID NO: 117988 - DNA, 216 bp, Artificial Sequence
  Description of Artificial Sequence: Synthetic coding sequence
atgctgccccctcagaagaaaccgtgggagagtatggctaaaggactggtgctcggcgctctgttcaccagcttccttttgctcgtttacagctacgccgtaccgcctctacacgccgggctggcctccacaacgcccgaagctgctgcatcttgttctcccccagccttggaacccgaggcggtgatacgtgcaaacggatcagcaggagagtag

SEQ ID NO: 117989 - DNA, 729 bp, Artificial Sequence
  Description of Artificial Sequence: Synthetic coding sequence
atgctacccccacagaaaaaaccctgggaatccatggccaaaggtctggtcctaggagccttgtttacaagtttcctgctgctggtgtatagctatgccgtccccccccttcacgctggactggcctctaccacccccgaagccgccgcaagctgcagcccccctgccctcgagccggaagcagttatccgtgccaatgggagcgcaggggagtgccagccaagacgcaatatcgtgtttctcaagacccataaaacagcaagctctactcttcttaatattctatttaggttcggccagaaacaccggttgaagtttgccttcccaaacggccgtaatgacttcgattatcccaccttctttgcaaggtccctggtacaggattaccgacccggggcatgtttcaacattatttgtaatcacatgagattccattatgatgaagttaggggcctagtccccactaatgccattttcataactgtgttgagagaccctgcaaggctcttcgagtcttccttccactacttcggacctgtggttccactgacctggaaactgtctgcaggggacaagttgactgaattcctccaagatcccgaccggtactacgaccccaacggctttaatgctcactatttgaggaatctgttatttttcgacctcggatatgacaattcgcttgatcccagtagccctcaggtgcaggaacatattctcgaggtgtag

SEQ ID NO: 117990 - DNA, 303 bp, Artificial Sequence
  Description of Artificial Sequence: Synthetic coding sequence
atgctgccccctcagaagaagccttgggagagcatggctaaaggactggtgctgggcgccctatttacaagctttctgcttttggtatatagttatgccgtgccgccactgcacgcgggattggcaagcaccacacccgaagctgctgcctcatgttcacccccggcgctggaacctgaagccgtaattagggccaacgggtcggcgggggaatgtcagcctagaagaaatatcgtattcctgaaaacacacaaaacagcatcatccacacttctcaatatcctcttcaggtttggacagtag

SEQ ID NO: 117991 - DNA, 1197 bp, Artificial Sequence
  Description of Artificial Sequence: Synthetic coding sequence
atgatgagcatgctgggaggtttacaacgctatttcagagtaatcctgctgctgctgttggcattgaccttactattgttggccggtttcctgcattctgatctggagctggacacccctctcttcgggggacaggccgagggacctcccgtaacgaatatcatgtttctgaagactcataagaccgctagctcaaccgttctaaacattctttatcgttttgctgaaacccacaatctgtcagtcgctctgcctgccgggtccagggtgcaccttggatacccctggctgttcctagctaggtacgttgagggcgtcggtagccagcagagattcaatatcatgtgcaaccacctgagattcaacctaccgcaagttcaaaaggtgatgcccaatgacaccttttactttagtattctccggaatcctgtgtttcagctggagtcctcttttatttattataaaacttatgcacctgcattccgcggcgcccccagcctcgatgccttcttggcttcacctaggacattttataacgattcaaggcatctgcgcaacgtgtatgcaaagaataatatgtggtttgatttcggctttgatcctaacgctcagtgtgaggaaggttacgtgagggctcggatcgccgaagtagaacggaggtttcggctggtgctgatcgccgaacacctcgatgaatccctggtcctgctccgtagacggttgcggtgggctttagatgacgtggtcgccttccggctgaacagccggtctgcacgaagcgtggccaggctttccccagaaacaagagaaagagcacgatcctggtgtgctcttgattggaggctgtacgaacactttaatcgcacactttgggcacagctgcgggccgagctaggcccccggcgactccgaggggaggtggagagactaagggctcggcgtagagagctcgccagcctctgtctgcaggatgggggcgcattgaagaatcacacacaaatccgcgacccgagacttcgtccctatcaatccgggaaggctgacatcctgggatataacttacggcctgggctggacaatcagacgctgggggtgtgtcagagacttgtgatgcccgaattgcagtacatggcccgtttgtatgctcttcagttcccggaaaaaccactgaagaacatcccgtttctgggcgcctag

SEQ ID NO: 117992 - DNA, 1296 bp, Artificial Sequence
  Description of Artificial Sequence: Synthetic coding sequence
atgccaccgattctccagagactgcagcaggctaccaagatgatgtcacgcagaaaaattctattattggtgctcgggtgtagtacggtgtccttactgatccaccaaggggcccagttgtcatggtatccgaagctatttcctttaagctgtccacctttgaggaatagccccccccgccctaaacacatgacagtcgcatttctgaagactcacaaaactgccggaaccaccgtgcaaaacatcctgttccgcttcgccgagcgccacaacctcacagtagctctcccgcatccttcttgtgagcaccaattttgctacccaagaaacttctctgcccactttgtacatcccgccacccgaccccctcatgttcttgcgagtcacctgagatttgatcgcgctgagcttgaacgcctgatgccgccgtctactgtgtacgtgaccatccttcgtgaaccagcggctatgtttgaaagtctctttagctattataatcagtactgccccgcattcaggcgtgtaccaaatgcctctctggaagcgttcctcagagcccctgaagcatactaccgggctggggagcacttcgctatgtttgcacataatactcttgcttacgatttgggcggcgacaacgagagaagcccaagagacgatgcagcctatttagctggactcatccgacaggtagaagaggttttctccctcgttatgatagccgagtatttcgacgagagccttgtgctactgagacggctgctggcatgggatcttgacgatgtcctttatgctaagctgaacgcgcgcgcagcctcatcaaggctagccgctattcctgcagcgctcgctagagccgctcgtacatggaacgccctggacgccggcctttacgaccacttcaacgcgactttctggcgccacgtcgcccgtgcaggccgggcctgcgtggaacgagaggcccgtgaactaagagaggctcgtcaaagattgctgcgccggtgttttggcgacgagccgctcctgaggcccgccgcccaaatccgtacaaaacagttgcagccatggcagccatcccggaaagttgacatcatgggttatgatttgccaggcggtggagcagggcctgctactgaggcctgtctgaaactcgcaatgcccgaggtacagtacagcaactatcttcttcggaaacagaaacgcaggggcggcgccagagcgaggcccgagcctgtgctggacaaccctcccccccgacccatcagagtccttccccgggggccccaggggccctag

SEQ ID NO: 117993 - DNA, 1296 bp, Artificial Sequence
  Description of Artificial Sequence: Synthetic coding sequence
atgccccctatcctccagagactccagcaggcaaccaagatgatgtcaagaagaaaaatactgttgctggtgctcggctgttctaccgtaagtctcctgatccatcagggggcccaactgtcctggtacccgaagctgttccctctgtcctgtcctcctttacggaacagtcctcctcggccaaaacacatgaccgtagccttcctcaagacacataaaactgccggcactacagtccaaaacattctgtttagatttgctgaacgccacaacctcacagtggcccttcctcacccatcctgcgaacatcagttttgttaccctcgcaattttagcgcacacttcgttcacccagccacacggcccccccacgtgctggcatcccatctgaggttcgacagagctgaactagagagactgatgcccccctcaacagtgtacgtgacaattctgagggaacctgctgccatgttcgaatcactgtttagttattacaatcagtattgccctgccttcagaagagttccgaacgcttctctggaagcgtttcttcgcgctccagaggcgtattaccgggcaggggaacatttcgctatgtttgctcacaatactctggcatacgatctgggaggagacaacgaacggagtccgagggatgacgcagcttatttggcaggcctcataaggcaggtggaggaggtattctcactcgtgatgatagccgagtactttgacgagtctttagttctgcttagaaggctactggcctgggacctggatgacgtgctgtacgcaaagctaaacgctcgcgctgctagcagccgcttagctgctatccccgcagccctagcgcgggctgctagaacctggaacgctctggatgccgggctctacgatcattttaacgctacattctggcgacatgtggctcgtgctggccgggcgtgcgtcgaacgggaggctagagagcttcgcgaggcacgccaaagactgctgcgcaggtgttttggtgatgaacctctgttaagacccgcggctcagataagaacaaagcagctgcaaccttggcaacccagtaggaaggtggatattatgggttatgacctgcctgggggcggggcgggaccagcaactgaggcctgcttaaaattagctatgcctgaggtgcaatattccaactacttgttgcggaagcagaaacggcgagggggcgccagagcccgtcctgaaccagttctggacaacccgccccccaggcccattagggtgttgcctagaggtcctcagggcccgtag

SEQ ID NO: 117994 - DNA, 1461 bp, Artificial Sequence
  Description of Artificial Sequence: Synthetic coding sequence
atggggcccctgagccctgcacgtactctgaggttatgggggccacgctcacttggagtggccctcggagtcttcatgaccataggattcgctttgcaactgctcggcggtcccttccagcgacgattgcccggcctgcagctccggcagccctctgcgccttcccttcgtccggctctgcctagctgtccaccacgtcagcgcctcgtgttcctcaaaactcataagtctggatccagtagcgtgctgtctctgctgcataggtacggggaccagcacgggctgcgttttgctctacccgcccggtatcagtttgggtacccaaagctttttcaggcctctcgggtgaagggctatcgccctcaagggggagggactcagctgcccttccacatcctgtgccaccacatgagatttaatttgaaagaagtgctgcaagtcatgccgagcgattcgttcttctttagtatagtgagggatccggctgcgctggctcggtcggccttctcttactataagtcaacgtcgagcgcgttccggaaatctccttcattggccgccttcctcgctaacccgagagggttttacagaccaggggcacggggcgaccattatgcccgaaatctcttatggtttgactttggacttccatttccccctgagaagagggctaagagaggtaacatccatcctccccgcgatcccaacccaccacaactgcaggtcctcccaagcggggctgggccgcgggcccagacgttaaatccaaacgcgctcattcaccccgtgtcaacagtgactgatcacaggagtcagattagctctccagcaagcttcgatctgggaagttctagtttcattcagtggggtttagcatggctggatagtgtgttcgacctggtgatggtggctgaatactttgatgagtcacttgtactgcttgcggacgctttgtgttggggtctggacgatgttgtgggattcatgcataatgcacaagccggccataaacagggcttatcaacagtctccaattccgggttgacagctgaagataggcaactgaccgctcgtgcccgggcgtggaacaacttggactgggccctgtacgtacattttaatcggtccctgtgggctcggatagagaaatacggacaggggagactgcagacggctgtggcagagctccgggctcgccgcgaggcactggctaagcactgtctcgtgggcggggaagccagcgatccaaaatacataacagaccgtaggttcagacctttccagtttggctctgccaaggtgttggggtatatacttagaagcgggctgagtccacaggaccaagaagagtgtgagcgactggccacacccgagctgcagtacaaagataaacttgacgcaaaacagttccccccaactgtgtcgttgcctttaaaaacatctcgtcctctctctccttag

SEQ ID NO: 117995 - DNA, 1461 bp, Artificial Sequence
  Description of Artificial Sequence: Synthetic coding sequence
atgggaccactgtcccccgcgcgtaccctgcgtctttggggacctagatccctcggggtggctctgggagttttcatgacaatcggattcgcgctgcagctgctgggagggccatttcagcgacggctacccggcctgcagctgcggcagccttcggctccatctctgcgccccgctcttccttcgtgtccaccccggcagagacttgtctttctgaagacacacaagtctggatcttctagtgtactctctctgctgcatcgctacggggaccaacacggcttacgctttgccctgcccgcaaggtaccagtttggttacccaaaattgttccaggcctcacgagtgaagggataccgcccgcaagggggagggacacagctgcccttccatatattatgtcaccatatgcggttcaatctcaaagaagtgttacaggtgatgccatccgactccttctttttcagcatcgtgcgtgaccccgcagcattagcaaggagcgctttctcctattacaagtctacttcatcagcctttagaaaaagcccgtctttggctgcattcctggccaatcccaggggtttctatcggcccggtgccaggggcgatcactatgctagaaatctgttatggttcgatttcgggcttccgttccctcccgagaagagggcaaaaagggggaatattcaccccccaagagaccccaacccaccccagctgcaagtgctgccctctggcgccggcccccgtgcacagacacttaatcctaatgctctgatacacccagtgtccaccgtgacagaccaccggagccagatttcttcccctgcaagctttgacttaggctcatctagcttcatacagtggggcctcgcgtggctggacagtgtttttgacctcgtgatggtggctgaatacttcgacgagagcctcgtgctgctggccgatgctctgtgttggggactcgatgacgtcgtgggtttcatgcacaatgctcaggccggtcacaagcaaggcttgagtacagtgtccaacagtgggctcaccgcagaagaccgacaactaactgctagagctcgtgcatggaataacctggactgggcgttgtacgtgcattttaacagatccctctgggctaggatagagaagtatggacaaggtaggcttcagacggcagtggcggaattgcgggcccgacgggaggctttagctaagcattgtcttgtgggaggggaggcctctgatcctaagtacattactgacaggcgttttcgacctttccagttcggatctgctaaggtcttgggctacattcttagaagtggcctgtcacctcaggatcaggaggaatgcgagcggctggcgactccagagctgcagtataaagataaactcgacgccaaacaattccctccgacagtcagcctccccctgaagacctcacgacctctcagtccgtag

SEQ ID NO: 117996 - DNA, 1275 bp, Artificial Sequence
  Description of Artificial Sequence: Synthetic coding sequence
atgaccccaaggagtcccacaagcgccttccggtcctgcaccgccgttagctcgtgtctgtgtccttctagttggccctggctgcacctgagtgtgacctcgcccttcccagtccctcacggtccatctctgtcctgccaggatgccgctgcgctagggacttccgagcctggaggaggaagcggatccttgcatgatcactggctgtgcacccctgctctgggaagagccctgcccgaggaagttctgcaagtcatgccaagcgattctttttttttttccatagttagggatcccgcagccctggccagatcagcattttcgtattataagtctacgtccagcgcttttcgcaagtcgccttcccttgccgcctttctggcaaacccaaggggtttctaccgccccggtgctcggggcgatcactatgcccgcaatcttctttggttcgacttcgggctaccatttccacctgagaagcgcgccaagcggggcaacattcatccccctcgcgatcccaaccctcctcagcttcaggtgctcccatcaggagccggtcctcgggctcagacgctgaatcccaacgcattgatccatcccgttagcacagtcacagaccaccggagtcagattagcagccctgctagttttgacctgggcagcagctccttcatccagtggggtctcgcctggctcgacagtgtattcgacctcgttatggtggcggagtactttgacgaatcactggttctgttagccgacgctctgtgctggggactggacgatgtggtgggcttcatgcataacgctcaggccgggcacaaacaggggcttagcaccgtgtctaattccgggctaactgcagaggatagacagctgaccgcacgagccagagcttggaacaatctcgattgggctctgtacgtacattttaacagatcgctatgggctagaatcgaaaagtacggccagggccggttgcagacagccgtggcagaactgcgcgcgcgccgcgaggcactggcgaagcattgcttagtcgggggcgaggcctctgacccgaagtacataactgatcggcgttttaggccctttcagtttggcagtgctaaggtgctgggctacatcctgcggtctggcctatcacctcaggaccaagaagagtgtgaaagactcgccacacctgagttacagtataaagataaactagacgccaagcagttccctccaaccgttagcttgcccctgaaaacatctcgtcctctgtccccatag

SEQ ID NO: 117997 - DNA, 1641 bp, Artificial Sequence
  Description of Artificial Sequence: Synthetic coding sequence
atgccagggttcctggtgcgtatcctgcctctgttattggtgctgctgctgctgggtcctacaaggggtctccgcaatgctacgcaacgaatgttcgaaatagactattctcgggattcattcctcaaggatggccagccatttcgctatatcagtggatctatccactattccagagtgcctcggttctactggaaagaccggctccttaagatgaagatggccggtttaaatgcaatccaaaccttgcccggctcctgcgggcaggtggtgggaagccccagtgcccaggatgaggccagtcccctgtccgagtggagagcttcgtacaacagtgccgggagcaacatcactgatgcatttctgtcccagcggaaatgtgaacccaaaggaccactgataaattccgagttctatactgggtggctcgatcactggggccagccccatagcactataaaaactgaggctgtcgcctcaagtctgtacgacatattggcacgcggcgccagcgtgaatctttatatgtttattggcggtactaacttcgcatattggaatggtgccaactcaccttacgccgcacagcccaccagctatgactacgatgccccactgagcgaggccggagatcttaccgagaaatatttcgccctgagaaatatcatccagaagttcgaaaaggtccccgaaggcccaattcctccctcaacaccaaaatttgcatacggtaaggtcaccctcgagaagctgaagaccgttggagccgctcttgacattctgtgccctagcggacctattaagtccctgtaccctctgacattcattcaggttaagcagcattatggtttcgttctttaccgcacgaccctgcctcaggactgctcaaaccctgcacctctgtcctcccctctgaatggggtccacgatcgcgcctatgtcgcagtagatggcatcccccagggagtgcttgaaagaaacaacgtgatcacattaaacatcactgggaaagctggtgccactttggatttgctggtggaaaatatgggacgcgtgaactatggcgcatacataaatgacttcaagggtctggtctccaatctgacactatccagtaacattctcaccgactggaccattttccctctagacactgaagacgcggtgtgctctcatctggggggatggggacaccgggattccggacaccatgacgaagcttgggcccataattcctccaactacacgttgccggcattttatatgggaaatttcagcattccatctggtatcccagacttaccccaagatacttttattcagtttcccggctggacaaagggtcaggtatggattaacgggttcaacttaggccgctactggcctgcccgaggcccccagttgacactgttcgtgccccagcatatcttgatgacctccgctcctaataccattaccgtgctggaactggaatgggccccgtgcagttctgacgatcctgaactctgtgccgtaacttttgtggaccgaccagtgattgggagcagcgtgacctatgaccatccctcgaagcccgtggagaagcgacttatgcctcctccgccacagaagaacaaggatagctggctcgaccatgtgtag

SEQ ID NO: 117998 - DNA, 1944 bp, Artificial Sequence
  Description of Artificial Sequence: Synthetic coding sequence
atgtttgagatcgactactcaagagactcctttctcaaggacggccagcctttccgctacatcagtggcagcatacattattcaagggtaccacgcttttactggaaggatcgtttacttaagatgaaaatggcaggactcaatgctattcagacctacgtgccatggaatttccacgagccgtggcccggacagtatcagttctcggaggaccatgacgtggaatattttcttagactggcccacgaactcgggttgcttgtcatactaagaccaggcccatatatatgcgcggagtgggaaatggggggcttgccagcatggctgctcgagaaggagagtattttactaagaagtagcgaccccgattatctcgctgctgtggacaaatggctgggagtcctgctgcctaagatgaagcctctgctctatcagaatggaggacccgtgattacagttcaggtggagaacgagtatggctcgtactttgcctgtgattttgattatctccggtttctccagaagagattcaggcaccacctgggtgacgacgtggtactctttacgaccgatggagcccataaaacctttcttaagtgtggggccctgcaggggctttacaccaccgtggactttggtaccggtagcaacattacagacgctttcctttcccagaggaagtgtgagcctaaagggcctctgatcaacagcgagttttacaccggctggctcgatcactggggacagccacatagcactatcaagaccgaggctgtggccagttctctgtatgacattctggcgcgaggcgcctcagtgaacttatatatgttcatcggaggaacaaatttcgcctactggaacggggctaattctccttacgccgcccagccaaccagttatgattacgatgcccccctgagcgaggctggagacctcaccgagaaatacttcgcactgcgcaatattattcagaaatttgagaaggtgccagagggaccaatcccccccagcactccgaaattcgcttatggaaaggttactctcgagaagctgaaaaccgtcggagctgccctcgacatcctttgcccttccgggcctattaaatccctgtaccctctgacctttattcaggtgaagcagcactacggatttgtgctgtataggactactttaccccaagactgctccaatcctgcacctttgtcatcccccctaaacggagtgcacgatcgggcatatgtcgccgtggatggcatccctcagggtgtgttggaacgtaacaatgttatcaccctcaacattaccggaaaggctggcgccactcttgacctgctagtggagaatatgggtagagtcaattacggagcgtatataaacgattttaagggcctggtgtctaatcttaccctcagcagcaatatccttactgattggaccatattccctcttgatactgaagacgccgtatgttcccatctaggaggctgggggcaccgggattcaggtcatcatgacgaagcatgggcgcataatagcagcaattacacactgccagccttttacatgggcaacttttccataccatctggaatacctgatctaccacaagatacatttattcagttccctggctggacaaagggccaggtgtggattaatggcttcaatctcggtcgctattggcctgcccgtggccctcaactcacccttttcgtaccacaacatatccttatgacaagcgcccctaacacaatcactgtcctcgagcttgagtgggcaccctgcagctctgacgaccccgaactatgcgctgtgaccttcgtggatcgcccagtgatcggatccagcgtgacctacgaccacccctcaaaaccggtcgagaaaaggttgatgccccctcctccacagaaaaataaggatagctggcttgaccatgtctag

SEQ ID NO: 117999 - DNA, 2034 bp, Artificial Sequence
  Description of Artificial Sequence: Synthetic coding sequence
atgcctgggttcctggtgcggatcctccctttgctgctggtcttactcctgctgggcccaactcgggggctgagaaatgccacacaacgtatgttcgagattgactactcacgggactcattcctcaaggatggccaaccattccgctacatctctggatctatccactacagtagagtacctagattctactggaaagatagactgctcaaaatgaagatggctggtcttaacgccatccagacctacgtgccctggaatttccacgagccatggcccgggcagtaccagttctctgaagaccacgacgtggaatattttctccggctcgctcacgaactcggactcctggtgattcttcggcctggaccatatatttgcgctgagtgggagatgggcggtctccccgcctggttacttgaaaaagagtcgattctattgaggtcttcagaccccgattacctcgcagccgtagataagtggctcggtgttctcttgcctaagatgaagccactactttaccaaaacggcgggccagtgatcacagtccaggtcgagaacgaatacggttcttacttcgcatgcgactttgactacctccgcttcctgcaaaaacgatttcggcaccacctgggcgacgatgtcgttctctttacaacagatggcgcccacaaaacatttctgaaatgcggcgcactgcaagggctgtacaccacggtggatttcgggaccgggtcaaacattactgacgcctttctaagtcagcgcaaatgcgaacctaaagggccactgattaatagcgagttttatacaggttggctcgaccactggggacagcctcactcaacaattaagacagaggcggtcgcgagttccctatatgatatcctcgcacgcggggcaagcgtgaatctgtacatgtttatcggcggtacaaattttgcctattggaatggcgcgaacagcccctacgccgctcagcccaccagctatgattatgatgccccactatccgaagctggagacctgaccgagaagtactttgctctcagaaacatcatccagaagttcgaaaaggtgcccgaaggtccaatccctccttctactcctaagttcgcctacggcaaagttacattagaaaagctgaagaccgtcggtgctgcactggatattctatgtccatctggacccatcaaaagtttgtacccactcacattcattcaggtgaagcaacactacgggtttgttctatatcggaccacccttccccaagattgttcaaaccccgctcctctctcttccccgctcaatggcgtgcatgaccgagcctatgtagccgtagacggcatcccacagggtgtgctcgagcgtaacaacgttattacgctgaatatcactggaaaagcgggagcaactctcgatctgcttgtggagaacatgggtcgcgtaaattacggagcgtatattaacgatttcaagggcctggtatctaatttgaccctcagctcgaatattctgacagattggactatcttcccccttgacacggaggatgcagtgtgtagccacctaggaggatggggacaccgcgattccggccatcatgacgaggcctgggcacacaattctagcaattacactttgccagccttctacatggggaacttttcaataccctcaggcatccctgacctgcctcaggatacctttattcagttccctggttggacaaaaggccaggtatggatcaacggattcaacctgggcagatactggcctgctcggggacctcagttaactttgttcgtgcctcaacatatattgatgactagcgctcccaacaccattaccgtgctggagttggagtgggccccgtgctcaagtgatgatccagagctatgcgcagtgaccttcgtagaccggcctgtaattgggtcctccgtcacctatgatcaccctagtaaacctgtggaaaaacgcttaatgccacctcccccacagaaaaacaaggactcgtggctggatcacgtttag

SEQ ID NO: 118000 - DNA, 2178 bp, Artificial Sequence
  Description of Artificial Sequence: Synthetic coding sequence
atgcctggttttctcgtgcgaatcctacctcttctgctcgtgcttcttctgctgggtccaacacgcggacttcgttcaagattcctgccatgggcttttcaccttccaaggcaagcgcccaaatcccagttgcccctgcataagagaggcacaaagaccgcaccgaacgagcacgcttcctccaaccgaagtgggcggcgccggcgcagacaacagtggaatgccacacagcgcatgttcgagatcgattatagccgagatagctttttaaaagatggccagccctttcggtacattagtggctcaatccattactcacgggtgccccggttttactggaaggacaggctcttaaaaatgaagatggcgggtttgaacgccatacagacatatgtgccgtggaattttcatgaaccctggcccggccagtatcagttcagcgaggaccacgatgtcgagtactttctacgcctagcccacgagctcggcctgctggtcatccttcgccctggcccatacatctgcgccgagtgggaaatgggcggcttgcccgcttggctcctggaaaaggaatctattctgctccgatcctctgaccccgactacctggctgccgtggataaatggcttggagttttgctgcccaagatgaagccgctactttaccagaatgggggtccggtcatcacggtgcaggtagaaaacgaatacggctcatactttgcatgtgactttgattacttacggtttttgcagaaaaggtttagacaccacttgggcgacgatgtcgtactgtttaccacagatggcgcccacaagacctttcttaagtgtggcgccctacaggggctgtatacaacagtggatttcgggacaggttcaaatatcaccgatgcctttctgtcccaacgcaagtgtgagcccaaaggcccactaatcaatagcgaattttatactggctggctggaccattggggacagcctcattccaccatcaagactgaggcagtcgcatcttcactatatgatattttggctcgcggagcgagcgtgaatctttatatgtttataggcggcacgaattttgcttactggaatggcgctaatagcccttacgcggcccagccaacctcttatgactatgacgccccgctgagtgaagccggagatttgacagaaaagtacttcgcccttcgaaacattattcagaagttcgagaaggtccccgagggccccattcccccatctacgcctaaattcgcttacggaaaggtgactcttgaaaaacttaagaccgtgggcgctgcacttgacattctgtgtccctccggtccaataaaatctctgtaccctctgaccttcatccaggtgaaacagcactacggctttgtgctgtataggacaactctgccacaggattgttctaaccccgctcctctgagttcgcccctgaacggagtgcatgatcgagcctacgtcgctgtggacggcatccctcagggagtactggagaggaacaacgtgatcactttgaatatcacagggaaagccggcgccaccctagatctgctagtggagaacatggggcgagttaactatggcgcctacataaacgatttcaagggcttggtgtcaaatttgaccctgtcatcaaatattctcaccgactggaccatctttccattagacacagaggacgctgtttgctcacatctcgggggctggggacatagagattctggtcaccacgatgaagcttgggcgcataactcttcaaactatacactgcctgctttctatatgggaaattttagtatcccatccggcatccccgacctgccccaagatacgttcatacagttcccaggctggaccaaggggcaggtatggattaacggctttaacttagggaggtactggcctgccaggggtccccagctgaccctcttcgtccctcaacatatcctgatgactagcgcccctaacacaatcactgtcctggaactagagtgggcaccgtgttcttctgacgaccccgaattatgcgccgtcaccttcgtcgaccggccggtgattggatcttccgtcacatatgatcatcctagcaagccagtggaaaaacgactgatgccaccccctccacaaaagaataaggactcatggctggatcatgtgtag

SEQ ID NO: 118001 - DNA, 2058 bp, Artificial Sequence
  Description of Artificial Sequence: Synthetic coding sequence
atggctgagtggctgctgtccgcttcctggcagcgccgcgctaaggccatgacagctgcggctggctccgccggaagagccgcagttcctctattactgtgcgcgctgctcgcacctggcggtgcctatgtacttgacgactctgacgggctgggcagagagtttgacggcattggtgcagtgagcggggggggcgccacttcacgcttgctcgtgaactaccccgaaccttatcgatcacagattctcgactacttattcaaacctaactttggggctagtctgcacatactcaaagtggagattgggggagacggccagaccacagacgggactgagcccagccacatgcactatgccctggacgaaaactattttagaggatatgaatggtggctgatgaaggaggctaaaaagcggaatccaaatatcaccctcatcggactgccctggagcttcccgggctggctgggtaaaggcttcgactggccctacgtcaatctgcaattaacggcctattacgtggttacttggatcgtgggagccaaacgctatcacgatctcgacatcgactacatcggaatttggaatgagaggtcatacaatgcaaactatatcaagatcctgaggaagatgttgaactatcagggactccagcgggtgaagattatagccagtgacaatctgtgggagtcaatctcagccagcatgcttctggacgccgagctattcaaggtcgtggacgtcataggtgcccattatcctggcactcactctgcgaaagacgctaaactaaccggtaaaaagctttggtcaagcgaggacttctcaaccctgaactcagatatgggtgctggctgctggggaaggatcctcaaccagaattacatcaatggttatatgacctcaaccatcgcgtggaacctggtggctagttactatgagcagttaccgtacggtcgatgcggtctcatgacagctcaagagccttggagcggccactatgtggtcgaaagtccagtctgggtgagcgcccacacgacacagttcacacagccaggatggtattacctcaagaccgtgggacatcttgaaaagggcggatcatacgttgctctcaccgatggcctcggcaacttaacgatcattattgagacaatgtcgcacaagcactctaaatgcattcgtcctttcctgccgtacttcaatgtatcccagcagtttgccacatttgtccttaaaggtagctttagtgaaatccctgaactgcaagtgtggtataccaaattggggaagacaagtgaaaggttcttattcaagcagctggactccttgtggctgctggacagtgatgggtcatttactctcagtctccatgaggacgaactgtttacactgaccacacttaccaccggacggaaagggtcttatccactgccgcccaagtcccagccatttccgtctacttataaggatgatttcaacgtggactatcctttcttttcagaagctccgaactttgctgatcagaccggtgtatttgagtactttaccaacatcgaggatcccggtgagcaccatttcacactcaggcaagtactcaaccagcggcccatcacttgggctgccgatgcctctaataccatctctattatcggagactacaattggacaaatttgactatcaaatgcgacgtatatatcgagacccctgatacgggaggggtatttatagcgggacgggtcaacaaggggggtatactgattcgatctgccaggggcattttcttttggatcttcgcgaatgggtcttatcgagtcacaggtgatcttgcaggctggataatttacgccctgggacgagtcgaggtaactgccaaaaaatggtacaccctgaccctgactatcaaaggtcactttacgagcgggatgcttaatgacaaatctctgtggactgacattcccgtaaatttccccaaaaacggttgggccgccattggaacacacagcttcgagttcgcccagttcgacaattttctcgtagaggcaacccgttag

SEQ ID NO: 118002 - DNA, 1989 bp, Artificial Sequence
  Description of Artificial Sequence: Synthetic coding sequence
atggccgagtggctactaagcgcaagttggcaaaggagagctaaagctatgaccgccgctgctggatcagctggaagagcagcagtcccattgttgctgtgcgccctcctggcgcctggaggcgcctatgtgctcgacgattctgatggcctggggcgggagtttgacggcataggcgctgtaagcgggggaggccctaacttcggcgcaagtttgcacatcctcaaggtggaaatcgggggagatgggcagaccaccgatggtaccgaaccatctcacatgcattatgccctggacgagaactattttcgaggatatgagtggtggctcatgaaagaagcaaagaaaagaaaccctaacatcactctaatcgggcttccgtggtctttcccgggatggctcggcaaagggttcgactggccctacgtgaatctgcagctgactgcctactatgtcgtgacatggatcgttggggccaaacggtatcatgatttagacattgactacataggcatttggaacgaacgctcttataacgctaattatattaaaatcctccggaaaatgctgaattaccagggattgcaacgcgtgaagataattgcgagtgataatctctgggagagcatcagtgcaagcatgcttctagatgccgaattattcaaggtcgtggacgtaataggagcccattatcccgggacacacagtgctaaggatgccaaacttaccggcaagaaactttggtcttccgaggacttctcaacactgaatagtgatatgggggccgggtgctggggccgaatactgaaccagaactatataaacgggtatatgactagcacaatagcgtggaaccttgtcgcgagctactatgaacagctgccctacgggaggtgtgggttgatgactgcccaggagccctggtcaggccactatgtggtggagagcccggtgtgggtgtcagctcacaccacccagtttacccagcccggatggtattacctgaaaaccgtggggcatctggagaagggcggtagttatgtggctttgaccgacggactcgggaacctgactataataatagagactatgtctcataagcatagcaaatgtatacggccattccttccgtactttaatgtcagccagcagttcgcaacttttgtgctcaaaggcagctttagtgaaatacccgagctgcaggtgtggtacacaaagctgggtaaaacctccgaacgatttctgtttaaacaattagactcactctggcttctcgactcggatggcagttttacattatcgctgcatgaagacgagctctttacactgactacactcacaacgggacgcaagggtagctatcctctcccccccaagtcacaacctttcccaagcacttacaaggacgactttaacgtcgactatccgttctttagcgaagcgcctaacttcgctgaccaaactggggtctttgagtactttaccaacatcgaggatcccggagaacaccatttcaccctgcgccaagttctcaaccagcgccctatcacatgggccgctgatgccagcaacacaatctcaatcatcggagactataattggaccaatctgaccataaagtgtgatgtttacatcgaaaccccggacaccgggggtgtttttatcgcagggcgcgtcaacaaaggcggcatcttgatcagatcagctagagggatcttcttttggattttcgcaaacggatcatatcgcgtgacaggtgacctcgcgggatggatcatctatgcccttggacgagtggaggtgacagcaaagaagtggtatacgttaacattgaccattaaaggccacttcacctcaggaatgctaaatgataagagtctctggaccgacatcccagtcaacttccctaagaatggttgggctgctatcggcactcattccttcgaatttgctcaatttgataattttctggtcgaagctacaagatag

SEQ ID NO: 118003 - DNA, 1980 bp, Artificial Sequence
  Description of Artificial Sequence: Synthetic coding sequence
atgctcggcaaaagccatggtagagctactcatggccccttgccactggcagacctcgggattcatttgccttgtgttaaagtgttgcaccaagtgacgcctgaagaaaaacccgccgctacctcaagattgcttgtgaactacccggaaccttatcggagccaaattttggattacctcttcaaaccaaattttggagctagccttcacatcctgaaggtcgaaatcggcggagacgggcagaccacggatggcacagaaccctcccacatgcactatgcattggacgaaaattatttcagaggatacgagtggtggctcatgaaggaagcaaaaaaaagaaatcctaacatcactttgataggcctaccctggagtttcccggggtggttaggaaaaggattcgactggccatatgtgaacctacagttgacggcctattatgtcgtgacatggatcgtgggagcaaaacgctaccacgatctggatattgactacatagggatctggaacgagcggtcctacaacgcgaattacatcaaaatcctgcgaaagatgctgaattaccaggggctgcaaagggtaaagatcatcgcatcagataatctctgggagagcatcagtgcttccatgctgttggatgctgaactgttcaaggttgtcgatgtcatcggtgctcattatcccgggacacacagcgccaaagacgccaagctcactggcaagaagctgtggtcctctgaagatttctcaacactgaacagcgacatgggggctggctgttggggcaggattcttaaccagaattatattaatggctatatgacctcaaccattgcttggaatctcgttgctagctattatgagcagttgccttacgggagatgtggcctgatgaccgcacaggagccatggtcggggcactacgtcgtagaaagtcctgtgtgggtgtctgcccataccacacagtttactcaaccaggctggtattaccttaagacagtcggtcacctcgagaaaggtggaagctacgtggccctgacagatgggttaggtaatttgacgattattatcgaaacaatgtctcataagcattcaaaatgcattcgtccttttctcccatactttaacgtgtcacaacagtttgccacgtttgtcctcaagggaagtttctccgagattccagagctgcaggtctggtacacaaagcttgggaagaccagcgagcgttttttgtttaagcagcttgactctctgtggctcctcgatagcgacgggtcctttacactgtctttgcacgaggacgaactgttcaccctgaccacactgacgaccggccgaaaaggctcctacccgctcccgcccaaatcacagccatttccatccacatataaggatgacttcaacgtggactacccattcttttccgaggctccaaactttgccgaccagaccggggtctttgagtacttcactaacatagaggaccccggggagcatcatttcacgttacgacaggtgctcaaccagcgcccaatcacttgggccgcagatgcctcaaatacaatctcgatcattggagactataattggacgaaccttaccattaaatgtgacgtgtacattgagaccccagacactggcggagtgttcattgcgggaagagttaacaaaggagggatcctgatccggtcggcgagaggcatctttttctggattttcgccaacgggagttatcgggtgactggcgatctggctggatggattatctatgccctgggccgcgtcgaagttacagccaaaaaatggtataccctaactctcactatcaagggtcacttcaccagtggtatgctgaacgacaagtccttatggaccgatatcccggtgaacttccccaaaaacggctgggcggctatcggaacccattcctttgagtttgcccaattcgacaattttctggtggaggccactcgctag

SEQ ID NO: 118004 - DNA, 1425 bp, Artificial Sequence
  Description of Artificial Sequence: Synthetic coding sequence
atgctgaattaccagggtcttcagagggtaaaaatcattgcaagtgataacctctgggaaagcatttccgcgagcatgctgctggatgccgagctgttcaaagtcgtggatgtcattggggcccattaccccggcactcatagcgcaaaagatgccaaactcacagggaaaaagctctggtcatcagaagatttctcgacgttaaacagtgatatgggtgctggttgctggggtcgaattctcaatcagaactacattaacggatatatgaccagcacaatcgcatggaatctggtagcaagttactacgagcagttaccctacgggcgatgcgggttgatgaccgcgcaagagccctggtcaggccactacgtggtggaatctcctgtttgggtgagcgcccacaccactcaatttacacagcccggatggtactaccttaagaccgttggtcacttagagaaagggggctcctatgtggccctgaccgatggacttggtaatttgaccataatcatcgaaacaatgagtcacaagcactcaaaatgcattcggccattcctcccctattttaacgtgtcccaacagtttgctaccttcgttctgaaggggagctttagtgagataccggagctgcaggtgtggtacactaagctgggcaaaacctctgagaggttcttgtttaaacaactggactctctttggctcctggactccgacggctcttttacgctgagccttcacgaagatgagttatttaccctgaccaccttaacgacgggtagaaaggggagctatccgctgcccccgaaaagtcaaccttttccaagcacttacaaagacgacttcaacgtagattatcctttttttagtgaagcccccaatttcgccgaccagaccggggtgttcgaatactttacgaacatagaggatcccggcgagcaccactttacattgagacaggtcctgaatcagaggcctattacctgggctgccgacgctagcaatactatttccattattggggactacaactggaccaacctcacaatcaaatgcgacgtgtatatagagacacctgatactggtggagtcttcatcgccggcagagtgaataaaggcggaattctgatcagatcagcgagggggattttcttctggatctttgcaaatggctcctatagggtgacaggcgatctcgcaggctggattatctatgccctgggccgcgtggaggttaccgccaaaaagtggtacactttgaccctgacgattaagggccattttacttctggaatgcttaatgacaaaagtctctggaccgatataccagtgaacttcccaaagaatggctgggccgccatcggtacacactcttttgagttcgcgcagtttgacaactttttggtggaggccactcgctag

SEQ ID NO: 118005 - DNA, 1770 bp, Artificial Sequence
  Description of Artificial Sequence: Synthetic coding sequence
atgggctttatggttgctgatctatgggctacttccagactattggtgaactatccagagccttaccgctctcaaattcttgattatctcttcaagccgaattttggcgcgagtctgcatatccttaaggtcgagatcggcggcgatggccaaactaccgatggcacagagccgagccacatgcattatgctctggacgaaaactactttcgaggttacgagtggtggctgatgaaggaggccaagaagcgtaaccctaatattaccttaattgggctaccttggtcttttccaggatggctgggcaagggctttgattggccatacgtcaatctgcagttaactgcatattatgtggtgacctggatcgttggagccaaacgataccatgacttggacattgactacatcggaatttggaatgagaggagctacaacgctaactacataaagattcttcggaaaatgctcaactaccaggggctgcagcgagtgaagattatcgccagcgacaacctatgggaatccatctcagcaagtatgctgctggatgccgagctgtttaaggttgtcgatgttatcggagctcattaccccggaacccactctgccaaagacgccaaactcacagggaagaagttatggagctccgaagatttttcgacattgaattccgacatgggggccggctgctggggcagaatcctgaatcagaattacatcaacggatacatgacttccactattgcatggaatttggtagctagctactatgaacagctgccttatggacgctgtggccttatgaccgcacaggaaccttggagcgggcattacgtggtggagtcccctgtgtgggtcagcgcacataccacccagttcacacaacccggttggtattatctaaagacagtcgggcatttagaaaaaggtgggtcgtacgtcgccctgaccgatggtcttggcaacttaactattattatagaaacaatgtctcacaaacacagcaagtgcatccggccttttttgccctacttcaacgtctcacaacagttcgctacttttgtactgaaaggcagcttttccgaaataccagaactgcaagtttggtacactaagctgggcaaaacaagcgaacgctttctctttaaacagctcgattctctttggttgctggactccgatggctccttcactttatccctgcatgaggatgaactcttcaccctgacaacattgacaactgggcgcaaagggagctatcccctgccaccaaaatcccagccattcccctctacatacaaggatgattttaatgtggactaccccttcttcagcgaggcccctaatttcgctgatcaaacgggagtgtttgagtatttcacaaatatcgaagatcctggggagcaccactttacccttaggcaggtgcttaatcagcgtccgattacatgggccgccgatgcgtccaacactatctcaatcattggagattataactggacgaatctgacgataaaatgcgatgtttatatagaaactcctgacacggggggggtgttcattgccgggcgggtgaacaaaggaggcatattgattagatctgctaggggaatttttttttggattttcgccaatgggagttatcgcgtgaccggcgatctggccggatggataatttatgccttgggtcgcgtggaggtcacagccaaaaagtggtacacactcaccctgacaataaaggtggctgggaggaggaagaagacctag

SEQ ID NO: 118006 - DNA, 372 bp, Artificial Sequence
  Description of Artificial Sequence: Synthetic coding sequence
atggcccgaggtagcgccctgctcctggccagcctcctgttagccgcagccttgtcggcatctgctgggttgtggtctccagcgaaagaaaagcgcgggtggacacttaacagtgccgggtacctattaggccctcacgcagtggggaaccaccggtccttcagcgataaaaacggcctcacctccaaacgggagttgcgccccgaggatgatatgaaaccagggagcttcgatcggtcaatacccgagaataacatcatgagaacaatcatcgagttcctgtctttcctgcatctgaaagaagccggggcgctggaccgcctgttggacctgccagctgccgcctcatcggaggacatcgaaagatcctag

SEQ ID NO: 118007 - DNA, 1050 bp, Artificial Sequence
  Description of Artificial Sequence: Synthetic coding sequence
atggagttggcagtggggaatttgtctgaggggaatgcatcttggcccgagcctcccgcaccagagcccggccccctgtttggaatcggagtcgaaaactttgtcaccctggtcgtgtttggtttgatcttcgctctaggcgtgttgggaaattcacttgtcattacagtgttggcacgctctaaaccgggtaaaccaagatctacgaccaacctgttcattcttaacctctctatagcggatctcgcttatctgctgttctgtattcctttccaggcaacagtttacgcccttcccacctgggttctgggggcatttatatgtaagtttatccactacttcttcacagtatccatgctcgtctctatatttacactggctgccatgtcagtggaccggtacgtggctatcgttcattcccggcgaagtagcagcctgagggtgagcaggaacgcactgcttggcgtgggttgcatatgggcgcttagcattgccatggcgtctcctgtggcctatcaccagggcctttttcaccctcgtgcaagtaatcaaactttctgctgggagcagtggcctgatccccggcataagaaagcatatgtggtttgcacttttgtgttcggatatctgctccccctcctcctaatctgcttctgttacgctaaagtactgaatcacctgcataaaaagctcaagaacatgtctaagaagagtgaagcttcgaaaaaaaagaccgcccagactgtgctggtggtagtggtcgtgttcggaattagttggctccctcaccatataatccatctgtgggcagagttcggcgtgttcccacttactcctgccagctttctgttcagaataactgcacattgcctcgcctacagcaacagttctgttaaccctatcatctacgcctttctctccgagaactttaggaaagcatacaaacaggtttttaaatgccacattcggaaagactcacatttgagcgacaccaaagaatcaaagtcgagaatcgatactcctccctcgaccaattgtacacacgtgtag

SEQ ID NO: 118008 - DNA, 1164 bp, Artificial Sequence
  Description of Artificial Sequence: Synthetic coding sequence
atgaatgtgtccggctgccctggcgccggtaacgcttcccaggctgggggcggaggagggtggcaccccgaagccgtgattgttcctctgctctttgctttgatcttcctggtgggaacggtcgggaacactctcgtgctggctgtgctgctccgcggaggccaagctgtcagcactactaacctttttattctgaatcttggtgtggctgacctttgcttcattctttgctgtgtcccgtttcaagccaccatttataccctggatgggtgggtatttggtagcctcttgtgcaaggctgtgcacttcctgatcttccttacaatgcacgctagcagttttacactcgctgcagtgtcacttgaccgatatctggctatccggtaccccctgcactcgagggagctgcggaccccccgaaacgccctcgcagccattggtttgatatgggggttgtccctcttgttttccggaccttatctcagttattataggcagtcacagctcgcaaaccttactgtctgccacccagcttggtccgccccgagacgcagggctatggacatatgtaccttcgtcttttcatacctgctccccgtcctggtgctgggcttgacatatgcacgcactttacgatacctctggagggcagtggacccggttgcagccggatcaggggcccgacgtgccaaacgaaaagttacgaggatgattttaatagtggcggccctgttttgcctgtgctggatgccacatcacgcactaatcttgtgcgtctggttcggacagtttccactcacaagggctacgtatgcccttcgaattttgtctcatcttgtgagctacgcgaacagctgcgtgaaccccattgtttacgctctagttagtaagcattttcgaaagggatttcggaccatttgtgctggactgctgggacgagcaccaggcagggccagtgggagagtgtgtgcagctgctagaggcacccattccggctctgtcctggagcgagaatcgtctgatctgctacacatgtctgaagccgctggcgctctgcgcccttgtcctggggcctctcaaccctgcattttagaaccgtgcccaggaccttcatggcaggggcccaaggcaggcgactcaattctaaccgttgatgtggcctag

SEQ ID NO: 118009 - DNA, 1107 bp, Artificial Sequence
  Description of Artificial Sequence: Synthetic coding sequence
atggctgatgcccagaatatctccttggatagtcctggatctgtgggagctgtagccgtacctgtggtatttgctttgatatttctcctcggaaccgtgggaaatggcctggtcctggcagtgctactgcaacccggaccttccgcgtggcaggagcccggcagcacaacagatctgttcattttgaaccttgcggtggcagacttgtgtttcatcctttgttgtgttccgttccaggctaccatctataccctagacgcctggctgtttggtgcacttgtctgcaaagccgtacatttgctcatttatcttacgatgtatgccagcagcttcactttggctgcagttagtgtcgatcggtatctggccgtgcgccatcctcttcggtcaagagccctaaggactcctcgtaatgcgagagctgctgtgggcttagtctggcttctcgcggctctcttctccgcaccatatctgagctactatggaactgtcagatacggggcgttggaattatgcgtccctgcctgggaagacgctcggaggagagcacttgacgtggctaccttcgctgcagggtacctgctccccgttgccgtcgtctctctagcatacggccgtacgctgcgcttcctgtgggccgctgtcggccctgccggggctgcagccgctgaggctcgccgtcgggcaacaggccgtgcgggcagggccatgctggctgtcgccgctctgtacgcactctgctgggggccacatcatgccttgatactctgcttttggtatggtcgtttcgccttttcccccgctacttatgcatgtagattagcatcccactgcctggcctatgccaacagctgtctgaatccactggtgtatgcccttgccagccgacatttccgcgctcgattcaggcgcctctggccttgcgggagaagaagacggcacagggccagacgggccctgaggagagtgcgacccgcctcttcaggacccccagggtgtccaggggacgctagaccctctggccgcctcctggccgggggcggacaaggcccggagccacgtgagggccccgttcacgggggcgaggcagcccggggacctgagtag

SEQ ID NO: 118010 - DNA, 1959 bp, Artificial Sequence
  Description of Artificial Sequence: Synthetic coding sequence
atgggcaaccttcagtccgagcctagcgccggtggggggtcaagaaaggtgcagccttctgatagggcccccgacagcagaaggacttctctcgtggaacccgagatgacgagtcaggcgatgagactgacacggggtctcggagtgtggtttcccggcagtgctactccacccggtctgatggtgccccgtgaacctcaggcatctccatcaacattaccgcttacactggagaggccgtctcctgtgatgccacctccagaggaagccgccgctgtgagcgctccacccccggctcccgctggcaccctgctccctggtcccagtaagtggcagaagccagcgggaactccagtacctcgaatcaggagattgctggaagcttcccatcgaggccaaggagacccaccttcactgaggcccttaaagcctccgcccccccctaggcagttgtcagttaaggataccgtgcccagggccccaagccaatttccaccacccctagagacctggaaacctccacctccactcccatcggaaagacagccagccgatagacgaataacccctgcactggccacgccggccagcccaccaaccgagtctcaggcaggacctagaaatcagggccaaaccgccggacgagcacgcggaggtgcccccccccacgccggagagggcgagatggcccaacccgcagattcggaatcaggcctcagccttttatgtaaaatcaccttcaaatctcggccgagcctggcaccacccgcggcctccagcagcttggcagccaaggcctccctgggtggcggcggtggaggaggactcttcgcagcctccggagccatcagctacgcagaggttttaaagcagggaccccttccccccggcgccgctagacccctgggtgaagtatctaggggcgctcaggaggccgagggaggcgacggagatggagagggatgttccggaccgccatccgcccctgccagccaggccagggcattgcctcctcccccttacacgacgttcccaggcagcaagcctaagttcgactgggtttccgcgcccgatggacctgaaagacacttcagattcaatggggccggcggtggcatcggtgcaccacgcagacgggccgctgccctctccggtccctggggtagcccgcccccgcctccagaacagatacactccgcaccaggcccccggcgccccgcccccgctctgctggccccccctacctttatatttccagccccaacgaacggtgaacccatgagacctgggccaccaggtttgcaagagctgccccccctccctccccctacccccccccccacactacagccgccggccttgcagccaacccctctgccggtggctcccccacttacccccggtctgggccacaaggagtctgcacttgcacccaccgctgccccagccctcccgcccgcccttgccgctgatcaggcccccgctccctcccccgcaccagcacctactgtggctgagccttctcctccggtctcggcccctgcccctgccgcagcgccaattaaaacccgcactcgacggaacaaaggctcccgtgccgccagaggcgctacgcggaaagatggcttgcacggggatggtcctagagagagagctactgcaactgttccggatagctccggaggcggaggtgggggaagtggagcctctcagactggcgcagccaacactagggcggctcgtcactggctgcctttccaagtcctgaacagctgcccctgtaagtgttactgtcaccaccagcccagacataggaggctcccaaggaacgtgtccgcctggttgagcacttctacaaatcacttaggcgagccaccttgggtagctacaattaaactgagcggaagtcttgtcgcaaagctcgaacattatgatcttcaagcaacacactccaattag

SEQ ID NO: 118011 - DNA, 675 bp, Artificial Sequence
  Description of Artificial Sequence: Synthetic coding sequence
atgggaaacctccaaagcgagccgagcgccggcggtggttccaggaaagtgcaacccagcgaccgggcccctgattccaggcgaaccagcctggtagagcctgagatgacatcccaggcaatgcggctgactagaggtttaggggtatggtttcccggtagcgcgacacccccgggattgatggtcccgcgggaacctcaagcaagcccaagtacactgcccctcacactggagagaccaagtcccgtgatgcctccccctgaagaagccgctgccgtctctgcccctcccccggccccagccggaacgttgctgcctgggccttctaagtggcagaagccagccggtacgcctgtgcctaggatcaggcgtctgctggaggcctctcaccggggccagggcgatcctccatccctccgccccctcaaaccacccccccctccacggcagctgtcagtaaaggatacagtacccagggcacctagtcagttccccccccccctggaaacttggaagccaccacctccactcccctccgagaggcagccagccgaccgccgtataactcccgcactagccacacccgcatgtgttcgagccagaaccaggggctgtgcccaccaggacccgcacgcgcaagaacaggggttcccctgtagccctggccgagactag

SEQ ID NO: 118012 - DNA, 2094 bp, Artificial Sequence
  Description of Artificial Sequence: Synthetic coding sequence
atggccaggctggtggcagtttgtcgggatggagaggaggaattcccattcgaaagacgccagattccgctgtacatcgacgatactttaacaatggtgatggagttccctgacaatgtattgaatctggatggtcatcagaataatggcgctcaactgaagcagttcattcagaggcacggaatgctgaaacagcaggatctcagcatcgctatggtggtcacgtcccgagaagtcctatctgccctctcccaactggtgccttgtgtgggttgccgtagatccgtggagagactgttcagccaactagtcgagtctgggaaccccgcgctcgagccccttactgtggggccgaaaggtgttctctcagtgacaagatcctgcatgactgacgctaagaaattatatactctgttctatgtgcacgggtcgaaattaaacgatatgatagatgccatacccaaaagcaaaaagaacaaacggtgccagctccattctctggacacccacaaacccaagccgctgggcggctgttggatggatgtgtgggagctaatgtctcaggagtgcagagacgaggtagtgctgattgactcgtcctgtctcttggagaccctggagacctatctacgcaaacaccgattttgtacagactgcaagaacaaggtcctcagagcctataacattctgattggtgagttggactgttccaaagagaagggatactgtgccgcactgtacgaggggctgcgctgttgcccgcacgagaggcacattcacgtctgttgcgagaccgactttatcgctcatctgcttggccgcgcagagcctgaattcgctggaggccgtcgggaaaggcacgcaaagacaatcgatatcgcccaggaggaagttctgacttgtctcggtatccatctgtatgagcgcttacaccgaatctggcagaagttgcgggcggaggagcagacctggcagatgttgttttaccttggcgtcgacgcccttcggaaaagtttcgagatgacagtggagaaagtccagggcatcagcagactggagcaactgtgtgaggagttcagtgaggaggaacgggttagggagcttaagcaggaaaagaagaggcagaagcgcaagaataggcgtaagaacaaatgcgtgtgtgacatcccgacccctctccagactgcagacgagaaagaagtgtcccaagagaaagaaactgacttcatagagaacagttcatgcaaggcctgcggaagtacagaggatggaaacacctgcgtagaagttattgtgaccaatgagaatacctcttgcacatgcccatcatctggtaatctgcttggtagccccaaaatcaaaaaggggttgtccccacactgcaatggctcagactgtggctattcttccagtatggaggggtcggaaactggctcaagggaaggctccgacgtggcctgcaccgaaggcatttgcaaccacgatgagcatggtgacgatagctgcgtgcaccactgcgaagacaaagaagatgacggcgactcctgtgtggaatgttgggccaatagcgaagaaaacgacaccaagggcaaaaataagaagaaaaagaagaaatcgaaaatcttaaagtgcgacgagcacattcagaagcttggctcttgtattacagatcccggaaatagggaaacatctggtaataccatgcacactgtattccacagagataaaactaaggatacacatccagaaagttgctgttcatcggaaaaaggcggccagccgctgccctggttcgagcaccgaaagaacgtgccgcaatttgctgagccaacagaaacactctttggccctgattcggggaaaggagctaagtctctggtggaacttctcgacgagtctgagtgtactagtgatgaggagattttcatctcacaagatgagatccaatccttcatggcaaataaccaatcattttacagtaacagggaacagtatcgccaacacctcaaggagaagtttaataaatactgtcgcctgaacgatcacaaaagacctatttgcagcggctggctgacaacggcaggggctaactag

SEQ ID NO: 118013 - DNA, 1548 bp, Artificial Sequence
  Description of Artificial Sequence: Synthetic coding sequence
atgtcatctccaaacatttggtcgacaggatcttcagtgtactctacccctgtgttcagccagaagatgaccgtgtggatccttctcctgctctctctatatcctggcttcacttctcagaaatccgacgatgattacgaagactacgcgtcgaataaaacctgggtactcacacccaaagtcccagaaggagacgtcactgtgatcttaaataacctgcttgagggatatgataacaaactgcgtccagatatcggagtgaagcccaccctcatacataccgatatgtatgtcaactccatcggcccagtcaatgcaataaacatggagtatactattgatatattttttgcgcagacctggtatgaccgtcgattgaaattcaatagcacaatcaaggttcttcgcttaaactcgaatatggttggaaaaatctggataccagacaccttcttccggaactctaaaaaggctgacgcgcattggatcacaactcctaacaggatgcttaggatttggaatgacggaagggttctgtatacactcaggctgacgattgatgccgagtgccaattgcaactgcacaattttccaatggacgagcactcttgccctttggaattctccagttggtctcggagtattgcccaggccggcatgtgttctggagtcatttcagcccactactcgcttcgcttttggggttcaacggatcctcctacactcgcatcccgtgtggccggcataagcgacggatacccccgggaagaaattgtttatcagtggaaacgttcatcagttgaggtgggcgatactagatcctggcgcctgtaccagttctcgtttgtcggtttaaggaacacgactgaagtcgtgaagacgacatccggagactatgtcgtgatgtctgtatattttgacctcagccggcgcatgggatacttcaccattcaaacctacataccatgtaccttaatcgtcgtgcttagctgggtctcattttggataaataaagatgcggtgcccgcgcgcaccagccttgggatcaccacagttcttactatgactaccttgtccaccatcgctcgcaagtctttgccaaaggtttcctacgtgacggcaatggacctcttcgtgagcgtgtgttttatttttgtgttttcagccctggtggagtatggtactctgcactatttcgtgtcaaataggaaaccaagtaaggacaaggataagaagaagaagaaccctcttctccggatgttctcctttaaagccccaaccatcgatattagaccccggtcagccacaatacaaatgaataatgccacacacctacaggagagggacgaggagtatggttatgagtgcctggacggaaaggactgcgcgtcctttttctgctgtttcgaggactgtagaactggtgcctggcgtcacggacggatccatatccggatcgctaaaatggactcttacgctaggatattctttccgacagcattctgtttattcaatttagtatattgggttagttacttatatctgtag

SEQ ID NO: 118014 - DNA, 762 bp, Artificial Sequence
  Description of Artificial Sequence: Synthetic coding sequence
atggcccccaaactgctgctcctcctctgcctgtttagcggcctgcatgctaggagccggaaggtcgaggaggacgaatacgaggattctagctcaaatcaaaagtgggtgctggcccctaaatcccaagacacggacgtcacactcatcctgaacaagctcctccgggagtacgataagaagcttagacccgacataggaatcaagccaacagtaattgacgtggatatctacgtgaacagtattggtccagtcagtagcatcaatatggagtatcagatagacatctttttcgcccagacctggacggacagcagactgcggttcaactctaccatgaagattctcacgttaaactctaacatggttggtctcatttggatcccggacaccatatttaggaattccaaaaccgctgaagcccattggataacgacgccgaaccagcttctgcgaatatggaatgacggcaagattttatacactctcaggcttactattaatgctgagtgtcagctgcagctccacaacttccccatggatgaacattcatgtccgctgattttttcatcttacggctatcctaaagaggagatgatctacaggtggcgtaaaaattctgtcgaggctgccgatcagaagagctggaggctataccagttcgattttatgggtttgcgtaatacaaccgagatcgtgacaacttctgccgggaggaacctgcttaaggaggctcagctttccaaagcacgcgaggcttag

SEQ ID NO: 118015 - DNA, 1371 bp, Artificial Sequence
  Description of Artificial Sequence: Synthetic coding sequence
atgcgcaaaagtcctggcctcagtgactgcttgtgggcttggattctgttattgtctacactgaccggccggagctatggccagcccagtctccaggatgagctgaaggataatacaactgtgtttacgcgaattctcgaccgccttctcgatggatatgacaatagactgcgaccggggctgggggaaagggtgaccgaggtgaagacagacatatttgtgacaagcttcgggcctgtctctgatcatgacatggaatatactatagacgtcttctttcggcaatcatggaaggacgagagattgaaatttaaagggccaatgactgtactgcgcctgaataacctgatggctagtaaaatttggacacccgatactttttttcataacgggaagaaatccgtggctcacaatatgaccatgccaaataagttgctgagaattactgaagatggaaccttgctctacaccatgagactgaccgtgagggctgaatgtccgatgcatctcgaggacttccccatggacgctcatgcctgtcctctgaagtttggctcttatgcctatacgagggctgaagtggtgtatgagtggacccgggagccagctaggtcggtcgttgtggcagaagacggctcccgacttaatcagtacgacctgttgggccaaactgtcgatagcgggatcgtccaaagcagtaccggggagtacgtggtgatgactacccactttcacctcaagcggaagatcggctattttgtgattcaaacttaccttccttgcattatgactgtgatcctgagccaggtctcattctggcttaacagagagtctgtgcccgcccggactgtctttggcgtgacgacagtcctgaccatgactacccttagcatcagtgcgaggaacagtttgccaaaagtagcctacgccacagctatggattggttcatcgcagtttgctatgcctttgtgttctctgcgctgatcgaattcgccacagttaattacttcacaaaaaggggttacgcatgggacggtaaaagcgtggtgcccgaaaagcctaagaaagtgaaagaccctctcattaagaaaaataacacctacgcaccaaccgccactagctatacacccaacttagctaggggggatccagggctggccacgatagccaaaagcgctacaattgagccaaaggaggtgaagcccgagaccaagcccccagagccaaagaagactttcaattctgtgtcaaaaatagacagactatcaaggattgcttttcctctgcttttcggaatcttcaatctcgtttactgggctacatacttgaacagggagccacagctgaaggctcccactccccaccaatag

SEQ ID NO: 118016 - DNA, 1371 bp, Artificial Sequence
  Description of Artificial Sequence: Synthetic coding sequence
atgcggaaatctcctggtctctccgattgcctctgggcctggatcctcctgctgtctaccttgacggggcgctcttatggtcagccctccctacaagacgagctgaaggataacacaaccgtgttcactcgcattctcgataggttgcttgatggctatgacaatagactgagaccaggcctcggagagcgggtgacagaagtgaaaactgacatcttcgtcacctcttttggtcccgtcagcgatcacgacatggaatataccatcgacgtattctttaggcaaagctggaaggatgaacggctgaaatttaaagggccaatgacggtgctccgtctcaacaacttgatggcaagcaagatttggacccctgatactttcttccacaacggtaaaaagtcagtggctcataatatgaccatgccgaataaactcctgcgaattacagaggacggcacactcctttacaccatgaggctgaccgtgcgtgcagagtgtcccatgcacctggaggatttccctatggacgcacatgcttgtcccctgaaatttggatcttacgcatatacacgggccgaggtagtgtacgagtggactcgcgagccagccagatccgtggtggtggctgaggacgggtctcgtcttaaccagtacgacctccttgggcagaccgtcgatagtggcatcgttcagtcgtccaccggcgaatacgtggtaatgaccacccatttccatctgaaaagaaaaatcgggtacttcgttatccagacgtacctgccatgtattatgaccgtgattctgtcccaggtgtctttttggctgaatcgggagtccgtaccggcgaggacagtcttcggcgtaaccacagttcttaccatgactaccctatctatttcagctcggaactctctccccaaggttgcatacgctacagctatggactggttcattgcagtttgctacgcatttgtattctctgccctcatagaattcgccactgtcaactactttactaaaagagggtacgcctgggacggcaaaagtgtggtgccggaaaaacccaaaaaagtgaaggatcccctcattaagaagaataatacatatgctccgactgcgacgagctatactcctaatctggccagaggcgaccctgggcttgccaccatagcaaaaagtgctaccattgagcccaaggaagtgaagcccgagaccaaaccaccagagcctaaaaagaccttcaattccgtgagcaagatcgacagactgtcccggatcgccttcccattgctgtttggcatattcaacctggtgtactgggccacttaccttaaccgggaaccgcaactgaaagcgccaactccgcaccaatag

SEQ ID NO: 118017 - DNA, 1371 bp, Artificial Sequence
  Description of Artificial Sequence: Synthetic coding sequence
atgcggaaaagtcccggactcagcgactgcctgtgggcttggatactgctgctgtcaacactgaccgggcggtcatatggacagcccagcctgcaggatgaacttaaggataataccactgtgtttacccgcatcctggatcgcctcttggacggctacgataacaggctccgccccggtttgggcgagcgcgtgacagaggtcaaaacagatatcttcgtaacctcctttggaccagttagtgaccacgatatggaatacacaattgatgttttcttcagacagagttggaaggacgaacggcttaagttcaagggccccatgacagtgctgagattaaataatttaatggcttcgaaaatctggacgccagatacattctttcataacggaaaaaagagtgtggcgcacaacatgaccatgccaaataagttgctacggatcactgaagatgggacgcttctgtacacgatgcgactgacagtgcgagctgagtgtccaatgcatctggaagacttcccaatggacgctcacgcttgccccctgaaattcggatcatacgcctatacccgggccgaggtggtatatgagtggacaagagaacctgctcgtagcgtggtggtcgcagaagacgggtctcggcttaaccagtatgacctgctgggacagactgtggactcaggaattgtgcagagttctacaggggagtatgtggtgatgacaacccatttccatctcaaacgcaagatcggctacttcgtaatccagacgtatcttccctgtattatgaccgtgatccttagtcaggtgtccttttggctcaatagagagagcgtgccagcacgcaccgtgtttggagtgactactgtcctaacaatgaccaccttgtcaattagcgcacggaatagccttccgaaggtggcttacgcgacagctatggattggttcattgcagtgtgttatgcgttcgtcttttcagcactgattgagttcgccacagtcaactacttcacgaaacggggctacgcatgggacgggaaatcggttgtacccgagaagccaaaaaaggtgaaagatcccctcataaagaaaaataatacctacgctccgacagccaccagctacacccctaacctcgcccgtggcgatccaggacttgcgactattgctaagtctgccacgattgaacctaaggaggtcaaacctgagacgaagccgcctgaacctaaaaagacctttaatagcgtctcaaaaattgatcggctgtcacgcatcgcatttccccttctgttcggtatattcaatcttgtgtactgggctacgtatctcaacagggagccccagctgaaagcccccacccctcatcagtag

SEQ ID NO: 118018 - DNA, 1371 bp, Artificial Sequence
  Description of Artificial Sequence: Synthetic coding sequence
atgcgcaagagtccgggtctctccgattgtctgtgggcctggattctgctgctgtccactctgaccggtagaagctacgggcagccaagtttgcaggacgaactaaaggacaatacgaccgtatttactcgcatccttgataggctactagacggctatgataatagactcagacccggtctgggagaaagagtgaccgaggttaaaacggatattttcgttacctcttttggacccgtgtccgaccacgacatggagtataccatcgatgtgtttttccgccagtcttggaaggatgagcgactgaagttcaaggggccgatgaccgtgttgagattaaataatctgatggcttcgaagatttggacacctgacactttctttcataatggcaaaaagagtgtagcacacaatatgaccatgccgaacaaacttttaagaataaccgaggatggaaccctgttgtacacaatgaggctgaccgttcgcgccgaatgtcctatgcacctcgaggattttccaatggatgcgcatgcctgcccgctcaaatttggttcttacgcctatactcgtgcagaggtcgtgtatgagtggacccgcgagcccgcccgtagtgtggttgtcgccgaagacggctcgcggcttaatcagtatgatcttctgggccagaccgtggattccggtatcgtgcaatctagcacgggcgagtatgtagttatgactacccatttccacctcaagcgaaaaatcggctacttcgtgatacaaacatatcttccgtgcatcatgacggttattctgtcccaggtcagcttttggctgaacagagagtctgtccctgccagaaccgtgtttggcgttaccaccgtgttaacaatgactaccctctcaattagcgccaggaattcacttccgaaggttgcttatgccacagccatggactggttcattgccgtgtgttatgctttcgtattcagcgccctcatcgagtttgcgactgtgaattatttcacaaagcgcgggtacgcgtgggacggcaagagcgtcgtaccagaaaaacctaagaaagtgaaggatcctcttataaagaagaacaacacatacgcacccactgctacttcttacactcccaacctagctcggggcgacccggggttagccaccattgctaaatccgcaactatcgaacccaaggaggtgaaacctgagacgaagcctccagagccaaagaaaaccttcaattcagtgtccaagattgaccggctgagccgcatagcttttccccttcttttcgggatctttaatctggtgtactgggccacctaccttaacagagaaccacagttaaaggccccaacgccccaccagtag

SEQ ID NO: 118019 - DNA, 1371 bp, Artificial Sequence
  Description of Artificial Sequence: Synthetic coding sequence
atgcgtaagagccccggtctgtccgattgcttgtgggcctggattctgcttttatccactctgacgggaaggagttatggccagccaagtctgcaggatgagcttaaagacaacactacggtcttcacccgcatattagacaggctgcttgacggctacgataaccgcctgaggccagggctcggggaacgtgtcacggaggtcaagaccgacatctttgtgacatcttttggaccggtgagcgatcacgatatggagtacaccatcgacgttttctttcggcagtcttggaaggatgagcgtttgaagttcaagggcccaatgaccgtcctacgactcaataatttgatggcttcaaagatctggacgcctgacaccttcttccacaacggcaagaagtccgttgctcacaacatgaccatgccaaataaattattgcggattacggaggacggcactctcttatacaccatgcggttaaccgtgcgagcagaatgtccaatgcatctcgaggattttcctatggacgcccacgcttgtcctctgaagtttgggtcctatgcatataccagggcagaggtggtgtacgagtggacaagagagccggccaggagcgtagtggtggcagaagacggatctagactgaaccaatacgatctccttggacagacagtggacagcggaattgtgcagtcaagcacaggtgagtatgtggtgatgactactcattttcatctgaagcgcaagattggatatttcgtgatccaaacctaccttccctgcattatgactgtgatcctgtctcaagtgagcttttggttgaacagggaatctgtgcctgctagaactgtttttggcgtcacaactgttcttaccatgaccactctctcaatcagcgcccgaaatagcttaccaaaggttgcctatgccactgccatggactggtttattgctgtctgttatgccttcgtgttcagcgcactgatcgagttcgctacagtgaactacttcactaaaagggggtatgcatgggacggaaagtcggtggtgccagagaaaccgaagaaggtcaaagaccctctgattaagaaaaacaatacttacgcgccaacagccacctcctacaccccgaacttagctaggggggatcccggcttggcaaccatcgctaagtcggcaactattgagccgaaggaagtgaaacccgagacaaagccgccggagcccaagaagacttttaactccgtgagtaagatcgatcgactgagtcgcatagctttcccactgctgttcggaatcttcaacctcgtctactgggcaacctaccttaatagggaacctcagttgaaagctccgacaccgcatcagtag

SEQ ID NO: 118020 - DNA, 1371 bp, Artificial Sequence
  Description of Artificial Sequence: Synthetic coding sequence
atgagaaagagccctgggctctcagactgcctatgggcctggatacttcttctgtcaaccctgactgggcggtcttacggacaaccttccctacaggatgagcttaaggacaacacaacggtattcactaggatcttagataggctgctggacggctatgacaacagattgcgtcctggcctgggtgaaagagtaaccgaagttaagaccgatatctttgttacttcctttgggccagtatctgaccatgacatggagtatactatcgacgtgtttttccggcagtcatggaaggacgaacgattgaagttcaaagggccgatgacagtgctgcggctgaacaatctgatggcaagcaaaatatggactcctgacaccttctttcataatgggaagaaaagcgttgcacacaacatgaccatgcctaacaagctgttacgcattaccgaggacggaaccttgttatacaccatgaggttaacagtccgagctgagtgtcctatgcacctagaggatttcccaatggatgctcacgcatgtcccctaaagtttggatcctatgcctacacccgcgcagaggtcgtctacgaatggacccgcgaaccagcccggtcggtggtagtggcagaagacggcagccgcctcaaccagtacgatctgctaggccagaccgtcgactccggaattgtccagtctagcacgggcgaatatgtagtaatgactactcattttcatttgaaacgcaagatcggctatttcgtgattcaaacctatttaccctgcatcatgaccgtgatattgtcacaggtctccttctggcttaatagagagtcagtgccagccaggaccgtcttcggtgtcactacggttctcaccatgacgactctttccatatcggcaaggaactctcttccaaaagtcgcctatgcgacagccatggactggtttattgctgtgtgttatgcctttgtcttctcggccttgatagagtttgccactgtcaattacttcactaagcgtggctatgcctgggatggtaagagcgttgtgcctgagaaacccaaaaaggttaaagatcctctgattaagaaaaataatacgtacgctccaaccgccacaagttacaccccaaaccttgcccgaggggatcctggactggccacaattgccaagtcagcgaccatagagcctaaggaggtgaagcccgagactaagcctccagagcccaagaagacctttaattctgtatctaagattgatcgactgagccgcattgcctttcccctgctctttggaatattcaatttggtctattgggccacttacctcaaccgtgaaccacagctgaaggctccaacaccgcatcagtag

SEQ ID NO: 118021 - DNA, 372 bp, Artificial Sequence
  Description of Artificial Sequence: Synthetic coding sequence
atgcgaaaatccccaggccttagcgactgcctctgggcctggattcttctattatctaccttgaccgggcgaagctatgggcagccaagtctacaagatgagctgaaggacaacacaacagtgtttactcgaattctggaccgactgctggacggatatgacaatcgtttacggcctgggctgggggaaagggtaaccgaggtgaagaccgatatattcgtcacttcattcggtccggtgtctgaccatgatatggagtacacgatcgacgttttcttcagacaaagctggaaggatgagcggctcaagttcaaaggtcccatgactgtgctgcgtcttaacaatcttatggccagcaagatctggacctag

SEQ ID NO: 118022 - DNA, 1356 bp, Artificial Sequence
  Description of Artificial Sequence: Synthetic coding sequence
atgaaaactaagttgaatatttacaatatgcagtttcttctgttcgtgtttctcgtgtgggatcctgcccgactggtgcttgccaatattcaagaggacgaagctaagaacaacattaccattttcacccgaattctggatagactgctagatgggtacgataaccggctcaggcccggactgggtgactctatcactgaggtttttaccaatatttatgtgaccagctttgggccagtatctgatactgacatggagtacactatcgatgtcttcttccgtcaaaaatggaaggacgaacgtctgaagtttaagggccctatgaacatactcaggctcaataacctcatggcctccaagatctggactcccgacacattctttcataatggaaaaaagtcagtggcccacaatatgacgatgcccaacaagttgctccgaatccaggatgacgggacactgctctacactatgaggctgacagtgcaggctgagtgcccaatgcatcttgaggactttccaatggacgctcattcctgcccactgaagttcggtagctacgcctatacaacgagtgaggttacctacatttggacatacaacgctagtgacagcgttcaggtcgcccccgatggtagtcggttgaatcaatacgacctgctggggcagagtataggcaaggagacaatcaagtcttccaccggcgagtacaccgtcatgactgctcattttcaccttaagaggaagattggatattttgttatccagacctatctgccatgcatcatgaccgttattttgagccaagtgtcattttggttgaatcgggagtcagtaccagctcggaccgtattcggtgtgaccacagtccttacaatgacgaccctctcaatttccgccagaaactccttgcccaaggttgcctacgcaacagcgatggactggtttatcgccgtttgctatgcctttgtgttcagcgctctcatcgaattcgccacagtcaattattttacaaaacgggggtgggcatgggacggaaaatctgtcgttaatgacaagaaaaaagaaaaggcatcagtgatgatacaaaacaatgcctacgccgtggccgttgccaactacgctccaaatctgtctaaggatcccgtactcagtaccataagtaaaagcgccactaccccggaaccgaataaaaaaccagagaacaagcctgctgaagccaaaaaaacttttaacagtgttagcaagattgatagaatgtccaggatcgttttccccgttctgtttggcacctttaatctggtgtactgggcaacatatttaaacagagaacccgtgctgggggtcagtccgtag

SEQ ID NO: 118023 - DNA, 1356 bp, Artificial Sequence
  Description of Artificial Sequence: Synthetic coding sequence
atgaaaacaaaactgaacatctataatatgcagttccttctttttgttttcctggtttgggacccagccagattagtgttggccaacattcaggaggatgaggccaagaataatataaccattttcacgcggatcctggatcgcctattagatgggtacgataatagacttagacccggtctcggtgactctattactgaggtattcactaatatctacgtgacatcttttggccccgtgtccgataccgatatggaatacaccatcgacgtattctttcgccaaaaatggaaggatgagcgcttgaagttcaaaggccccatgaacattctacggcttaacaatctaatggcttctaagatctggaccccagacacctttttccacaacggaaagaaaagtgttgcccacaacatgaccatgcccaacaagctgctgcggatccaggatgatggcactttgttatatacaatgcggctgacggtgcaggccgagtgccctatgcacttggaggattttcctatggatgcacactcatgccccctgaaattcgggagctatgcctataccacctctgaggtgacctatatctggacctacaacgccagtgattccgtgcaggtggcccctgacggaagccggctcaaccagtatgatctgctggggcagagtatcggaaaagagactataaagagcagcacaggggagtacacagtgatgactgctcattttcaccttaaacgcaaaatcgggtatttcgtcattcagacatatctgccatgtataatgaccgtcatcctcagccaggtttccttttggctgaacagagaatccgtccccgcaaggactgtgttcggagttaccaccgtgctcactatgactaccctgagcatttcggcaagaaactctctgcctaaagtagcatatgcaaccgctatggattggttcattgcagtgtgctatgccttcgtattttcggcactgatcgaatttgctactgtcaactattttaccaagagagggtgggcatgggatggcaaatcagttgtgaatgacaaaaagaaagaaaaagccagtgtgatgattcagaacaatgcttatgccgtcgctgtggctaactatgcaccgaatttgtccaaagatccggtgctatccactatcagcaaatcagcgacaacgcctgaacccaataaaaaacctgagaacaaacctgctgaagcaaaaaagactttcaactcagtgtctaaaatagataggatgtccaggatcgtcttccctgtactatttggtacatttaatctagtgtactgggccacatatctgaatcgggagcctgtattgggcgtttcaccgtag

SEQ ID NO: 118024 - DNA, 459 bp, Artificial Sequence
  Description of Artificial Sequence: Synthetic coding sequence
atgaaaactaagttgaatatctacaatatgcaatttctattattcgtgttcttggtctgggatcctgcacggctggtattagcgaatattcaggaggatgaggccaaaaacaatattaccattttcacgcgcatcctggatcggctactagacggctatgataaccggctaaggccaggtctgggcgattcgatcactgaagtcttcaccaatatctatgtgacatcatttggccccgtgtctgataccgacatggagtacacgatcgatgtgttttttcggcagaagtggaaagatgaacgcctaaaatttaagggcccgatgaatatccttcggctaaacaatctgatggcgagcaagatttggacgcctgacacatttttccacaacggcaaaaaatccgtggctcacaacatgaccatgcctaataaactgttgcgcatacaagatgacggctag

SEQ ID NO: 118025 - DNA, 414 bp, Artificial Sequence
  Description of Artificial Sequence: Synthetic coding sequence
atgaagacaaaactaaatatctataatatgcaatttctgctcttcgtgtttctggtgtgggacccagcgcggttggtcctagccaatatacaggaagatgaggccaagaataacatcactattttcactcgcattctggatagactactggatggatacgataatcgtttaagaccaggtctgggtgatagcatcactgaggtctttacaaacatatacgtaacctcattcggccccgtgagcgacactgacatggagtataccattgatgtgttctttcggcagaagtggaaagatgaacgcctgaagtttaaggggcccatgaatatcctgaggctaaataacctgatggcgtccaaaatatggacacccgacacattttttcataacggtaaaaagagcgttgcccattag

SEQ ID NO: 118026 - DNA, 1536 bp, Artificial Sequence
  Description of Artificial Sequence: Synthetic coding sequence
atgaaaaccaaactgaacatttataatatgcaattcctgttgttcgtcttcctggtttgggatcctgcaaggctcgtgctagctaatatccaagaggacgaggcaaagaataacatcactatatttacacggatcctagaccgccttctggatgggtatgataaccgccttaggcctggcctgggcgactctatcactgaagtatttacgaacatttatgtgacatcattcggcccggtgagtgacacagacatggagtacacgatagacgtgttctttaggcaaaagtggaaggacgagcgtctgaaatttaaggggccgatgaacattctgcgccttaacaacctcatggccagcaagatttggactccagacaccttctttcataatggcaaaaaaagcgttgctcacaatatgaccatgcccaacaagctcctgcgcattcaagatgatggcactctcctttacactatgcggttgacagtgcaagcagagtgcccaatgcacctggaggatttcccgatggatgcccatagctgccccttgaagttcggcagctatgcatatactaccagtgaagtaacttacatctggacttataatgcgagcgacagcgtgcaggtggccccagatggctcccgtctgaatcagtatgatcttctgggacagtctatcgggaaagagaccattaagtcttcgaccggcgagtatactgtgatgacagcacactttcacctgaagaggaaaatcggttactttgttattcaaacatacctaccctgtatcatgacagtcatattgtcccaagtgagcttctggctaaaccgcgagagcgttcctgccaggactgtgtttggcgttactactgtgttgacaatgaccaccctatccatcagtgcccgcaactctctcccaaaagtggcctatgcaaccgctatggattggtttatcgcagtctgttacgcctttgtcttcagtgccctcatcgagttcgccacagtcaattacttcaccaaacggggctgggcctgggacggtaaatcagtcgttaatgataagtcccctagcatcaaagccgaggggatcactctgacctacaactctgtgaaggccatattgcaaggcgcgaagctcatttggagtaagtacattgcattttcttggccatcactttttcaggaaaagactctggagtatctggagaaatggatggattgtttgacgttcaaacaaagttccaagaaggagaaggcaagtgtgatgatacaaaacaatgcatatgccgtggccgttgctaactatgcacctaatctgagcaaggatccagtactgagtacgatttcaaaaagcgccacgaccccagagccaaacaagaagcccgaaaataagcccgcggaagccaagaagacctttaattccgtgagcaagatcgaccggatgtccaggatcgtgtttccagtacttttcggtaccttcaacctggtgtactgggcaacttatctgaatagagagcccgtcctgggtgtctcgccctag

SEQ ID NO: 118027 - DNA, 1356 bp, Artificial Sequence
  Description of Artificial Sequence: Synthetic coding sequence
atgaagaccaaattgaacatctacaacatgcaatttctcctcttcgtcttcctagtgtgggacccagcaaggctcgtgctcgcaaatatccaggaggatgaggctaaaaataacattacaatattcacacggatattggatcggctcctggatgggtacgataaccgccttcggccagggctgggtgactccataacggaggtgtttacaaatatctacgtaaccagcttcggtcccgttagtgatactgatatggaatacaccattgatgtcttctttaggcagaagtggaaggacgaacgcctcaagtttaaaggcccgatgaacattctgcgactgaataacttaatggccagtaagatatggacacccgacacattcttccacaacggtaaaaaatccgtggcacacaacatgaccatgcccaataagttgttgagaatccaggacgacggaactctcctctatacaatgagactcacggtgcaggccgaatgtccaatgcaccttgaagattttcccatggacgcccactcttgtccactgaagttcggcagttacgcctatactactagcgaggttacatatatatggacttacaacgcttccgatagcgtgcaggtggctcccgacggctctaggcttaatcaatacgatctcctggggcagtcaatagggaaagagactatcaagtcctcgaccggcgaatatacagttatgacagcgcactttcacttgaagcgcaaaataggctacttcgtcatccagacctatttaccatgcataatgacagtgatcctctcccaggttagcttctggctgaatcgcgaatccgtgcctgcacgcactgtgttcggagttacaaccgtgctcactatgacaactctgagtataagcgctcggaattcactgcccaaggtcgcatacgccactgctatggactggtttatcgctgtctgttacgcttttgtgttcagtgcactgatcgagtttgctaccgtgaactattttactaagagaggatgggcttgggacggcaaatctgttgtcaatgacaagaagaaagagaaggccagcgtcatgattcaaaacaacgcttacgcagtcgccgttgcgaactacgcccctaacctgtctaaggacccagtgctgtccacaatttctaagagtgcaacaacaccagaacctaataagaagccagaaaacaagccggcggaggcgaaaaagacctttaactccgtgagtaagatcgaccgcatgagtcgaattgtgtttcctgtgttgttcgggaccttcaatttagtgtattgggcgacctacttaaatcgggagccggtgctaggcgtgtctccctag

SEQ ID NO: 118028 - DNA, 1356 bp, Artificial Sequence
  Description of Artificial Sequence: Synthetic coding sequence
atgaaaaccaaactcaacatctacaatatgcaatttctcctgtttgtattcctggtgtgggaccctgcacgtctggtgcttgcaaacattcaggaggacgaggctaagaataatattaccattttcacaaggattctcgataggttgctcgacggctacgacaacaggctaaggccaggactgggagatagcatcacagaggtattcaccaacatctacgtgaccagctttggacccgtgtctgacaccgatatggagtatacgattgatgtgttcttccgtcagaaatggaaggacgaaagactaaagttcaaggggcctatgaacatcctaagactgaacaacttgatggccagcaagatctggacccccgatacattctttcataatggtaaaaaaagtgtagcccacaacatgacgatgcccaataagctcttgaggatacaagacgatggtactcttctttacaccatgcgactgactgtgcaggcagagtgtccaatgcatctggaggactttcctatggatgcccattcctgcccgctgaaatttgggagctacgcatatactacatccgaagtaacctacatctggacctataacgcttctgacagcgtccaggtcgccccagacgggtcccgattaaaccaatacgatctgcttggacaatccataggcaaggaaaccatcaagtccagtacgggcgagtacacggtgatgacagcacacttccacctgaaacgaaagatagggtacttcgttattcagacatacttgccctgtataatgacggtgatcttgtctcaggtgtccttttggctgaatcgggagtccgtgccagcccgaactgtgtttggcgtgacaaccgttctgactatgacgaccctgtccattagtgcgcgaaactcactccctaaggttgcatatgctactgcaatggattggtttatcgccgtttgttacgccttcgtcttctcagccctgatcgaattcgcgactgtcaactatttcactaaacgcggttgggcatgggatggaaaatctgtggtgaacgataaaaaaaaagagaaagcctctgttatgatccagaacaatgcctacgcagtggctgtggcaaattatgcccccaacctctccaaggatcccgtgctcagcaccatttctaaatctgccactactccagaaccgaacaaaaaacctgaaaacaaacctgccgaggcaaagaagacatttaactctgtcagtaagatagacagaatgagccggatagtctttcctgtgcttttcggtacctttaatctggtttactgggctacatatctcaatcgcgaaccagtcctcggagtgtcaccatag

SEQ ID NO: 118029 - DNA, 1104 bp, Artificial Sequence
  Description of Artificial Sequence: Synthetic coding sequence
atgaagactaagctcaatatttataacatgcagtttttactgttcgtgtttttagtgtgggacccagcccgcttagtcttagccaacatccaagaggacgaggcaaagaacaacataacaattttcacgcgtatactggataggttgctggatggctatgacaacagactgcgccctgggctcggtgacagcattactgaggtcttcacaaatatctatgtcacgagcttcggtcctgttagcgataccgatatggaatacactatcgacgtctttttccgccaaaagtggaaggatgagaggctcaagtttaagggcccgatgaatatactgagactgaataatttgatggcctcaaagatttggactccagacactttcttccataacgggaaaaaatccgtcgctcataatatgaccatgcctaacaaattgctgaggatacaagatgacggcactctcctgtataccatgaggctgaccgttcaagctgaatgcccaatgcacctggaggattttcccatggatgcccattcttgtcctctcaaatttgggagttacgcatataccacctctgaggttacctacatttggacctataacgccagcgattctgtccaggtagctccagatggaagtaggcttaaccagtatgatttactggggcaatcaattggcaaggaaactattaaatcatccactggggagtacacagtgatgacagcacactttcatctgaagaggaaaatcggatattttgtgatacagacctacctgccctgcataatgacagtcatcctgagccaggtgtctttctggcttaatagagaaagcgtgccagccagaactgtcttcggtgttactaccgtgctgacgatgacaactctgtccatcagtgcccgtaacagtctgcccaaggtggcctatgcaaccgccatggattggttcatcgctgtttgctacgcgtttgttttttctgcactgattgagttcgcaacagtgaattatttcaccaagcgcggttgggcctgggacggcaaatcagtggtgaacgataaagtctcggaatcttttcgcgtgattatcatcaagaaaatcccatag

SEQ ID NO: 118030 - DNA, 1371 bp, Artificial Sequence
  Description of Artificial Sequence: Synthetic coding sequence
atgaggctgaagatcacgctccccagtctcagggagttccttactgacttctggatggtgaccatcataggcctggaccaagattgggaagagtacacaatcgatgtattctttcggcaaaaatggaaagacgagcggctgaagttcaaaggacctatgaatattttgcggctgaataacctgatggcctctaaaatctggacaccagacacctttttccacaacggtaaaaagtccgtagcacacaacatgactatgcctaacaagctgttgcggatccaagacgatggaacgttgctgtatactatgaggctcacagttcaggcggagtgccctatgcatctcgaggacttccccatggatgctcactcttgccctcttaagtttgggtcctatgcgtacacaacctccgaagtcacctacatttggacctacaacgcctcggattctgtccaggttgcccctgacggcagtcggcttaatcagtacgatctactcggtcagagtattggcaaagaaacaatcaagtcgagcacaggggaatacacagtgatgacagctcacttccacctgaagcgaaaaataggatactttgtcattcagacctacctgccctgcatcatgaccgtgatccttagccaggtctcattctggcttaatcgcgaatcggtgccagcaagaaccgtattcggagtcacaactgtgttgaccatgacgacgctctcaatatccgcacggaattcattaccaaaggtggcatacgccaccgccatggactggttcatagccgtttgttatgccttcgtttttagcgccctgatcgagttcgctacggtcaactacttcactaagcggggctgggcatgggacgggaaatccgtggtaaatgataaatctccaagtattaaagcggagggtattaccttaacctataatagtgtgaaggcaatcctgcaaggcgccaagctcatctggtccaaatatatcgctttctcttggccgagtctctttcaagagaagactcttgaatacctggaaaaatggatggactgcctcacattcaagcaatcatcgaaaaaagagaaggcctcagtcatgattcagaataacgcttacgccgtggccgtagctaactatgctcccaacctcagcaaagatcccgtgttgagcaccatctccaaatccgctacaacgcctgagccaaacaagaagcccgaaaataaaccagccgaggccaaaaaaacatttaactccgtgagcaagatcgatcggatgtccagaatagtttttccagttctgtttggtacattcaatctggtatattgggccacctatctgaaccgcgaaccagttctaggagtatccccatag

SEQ ID NO: 118031 - DNA, 1479 bp, Artificial Sequence
  Description of Artificial Sequence: Synthetic coding sequence
atgatcattacccagacctcccactgctatatgacttcactcggaattcttttcctgattaacattctacccggaacaaccgggcaaggagagagcagacgtcaggaacccggagatttcgttaagcaagatatcggcgggttatctcccaagcatgcccccgatatcccggacgactcaaccgacaatattacgattttcaccagaatccttgatcgcctattggatggttacgataaccgcctcagaccaggtttgggggacgcagtcaccgaggttaagactgatatttatgtcacatctttcggccctgtttcagacacagacatggaatacacaatcgacgtattctttcgccagacctggcatgatgagaggctcaagttcgatggccccatgaagattctgccactgaacaatttgctggccagtaaaatctggacaccagacactttctttcataatggcaagaaatccgtcgctcacaacatgaccacaccaaataagttgttgcggctggtggataacggcacactgctgtatactatgaggttgacgatccatgcagagtgccccatgcatcttgaggacttcccgatggacgtacatgcctgtcctttgaaatttggctcttatgcctacacaaccgccgaagtggtgtacagttggacactaggtaaaaataaatccgtggaggtggctcaagacgggtcaaggttaaatcagtacgacctgttgggccacgtggtcggcactgaaatcatcaggtcatctactggggaatatgtcgtgatgaccacacattttcacctgaaaagaaagattggctattttgtgattcagacatacctcccatgtataatgactgtaattctctcccaggtgagcttctggctgaatagagaaagtgtgcccgcgcgcaccgtgttcggtgtgacaacggtgctcacgatgacgaccctttccatctccgcccggaattccctgcccaaagttgcttatgctactgccatggactggtttatcgcggtttgctacgcttttgtcttctctgccctgattgagttcgccacagtcaattacttcaccaaaagaagttgggcgtgggaagggaaaaaggttccggaggcactggagatgaagaaaaaaaccccagccgctcccgccaagaagacatccaccaccttcaacattgtggggaccacgtatcccattaacttggccaaagacaccgagttcagcactattagtaagggggcagccccgtctgcatcctctaccccaactattattgcctcccctaaggctacctatgtgcaggacagtcccactgaaacaaaaacatacaactctgtgagcaaggtggacaaaatttcccgcattatttttccggtgctgttcgccatcttcaatctagtatattgggcaacctatgtaaatcgcgaatcagcgatcaaagggatgatccgcaaacaatag

SEQ ID NO: 118032 - DNA, 1479 bp, Artificial Sequence
  Description of Artificial Sequence: Synthetic coding sequence
atgataataacgcagacctcccactgctacatgactagtctgggtattctgttcttgattaatatcctaccagggacaacagggcagggcgagagccgacgtcaggaacccggcgatttcgtcaagcaagacatcggcggtctgagtccaaaacacgcccctgacatcccagacgactccacagacaacataacaatattcaccaggatcctagacagactgctcgatgggtatgacaacaggctgcgccctggcctgggggacgccgtgacagaggttaaaactgacatctacgtcaccagcttcggtccagttagtgacacggatatggagtacaccattgatgtgttctttcggcagacctggcacgatgagaggcttaagtttgacggaccaatgaaaatcctgccattaaataacctgctggcatcaaagatttggacgcccgacactttcttccataacggtaaaaagagcgttgctcacaatatgacaacccctaataagttattgcgcctcgtagacaatgggactttgctctatactatgaggctgactattcatgcagaatgccctatgcacctagaagacttcccgatggatgtgcacgcttgtcctttgaagtttggcagctatgcttatactaccgccgaggtggtctattcctggaccctcggcaagaataagtcagttgaggtggcacaggacggctcgcgtctcaaccaatacgacttgctgggtcatgtggttgggaccgaaatcattaggtccagcactggcgagtacgtggtgatgacaacccattttcatctaaaaaggaagatcggctactttgtgatccagacataccttccttgcataatgaccgtgatcctgtcccaggtgtcgttttggctcaacagggaatccgttcccgcaaggaccgtgttcggcgttaccacagtgctgactatgactacgttatccatttcagcaagaaactctctgcctaaagtggcgtatgccactgctatggactggttcattgccgtctgctatgccttcgtgttttccgcccttatcgagttcgccacggtgaattactttacaaaacgttcctgggcatgggaggggaaaaaagtgcccgaggccttggagatgaaaaagaaaaccccagcggccccggctaagaaaacctccaccaccttcaatatagtgggaaccacatatccaatcaacctcgccaaagacacggagttttcgactatttcaaaaggcgccgccccttccgcaagttcgacgcccaccattattgccagccctaaagccacgtacgtacaggactcaccaacagaaaccaagacctataattctgtcagcaaagtggacaagatttctaggatcatcttcccagttctgttcgccatcttcaatcttgtttactgggctacttacgtaaatcgcgaaagtgccataaagggcatgatacggaagcagtag

SEQ ID NO: 118033 - DNA, 339 bp, Artificial Sequence
  Description of Artificial Sequence: Synthetic coding sequence
gaatacaccatcgacgtgtttttccgacagacttggcacgatgagcgccttaaatttgatggccctatgaagatactccctttaaataacttgctagctagtaaaatatggacccctgacacctttttccacaatgggaagaagtccgtggcccacaatatgaccactcccaacaagcttcttaggctcgtcgacaatggcaccctgctgtatacaatgagaattgaagaagtccaaaaacatcggagtatgatgaagccttcagtgtcttacacagtggcaccgtggatccaagaggggggccccggtggccgccacaggctgaaaatggaaaagtag

SEQ ID NO: 118034 - DNA, 1479 bp, Artificial Sequence
  Description of Artificial Sequence: Synthetic coding sequence
atgatcattacacagacatcacactgttacatgactagcctgggtatactgttccttattaatatacttcccgggacaactggccagggagagtctagacgccaggagcccggggattttgtcaagcaggatatcgggggtctttcccctaaacatgcaccagatatcccagacgactcaactgataatatcaccatcttcactcgcatcctggacagattgctggacggttatgataatcggctgcgcccaggtctgggggacgctgtaacagaagtgaagaccgatatttacgtgactagctttggacctgtctccgatacagacatggagtacactatcgacgtttttttcagacagacttggcacgacgaacgactgaaatttgatgggccaatgaaaatcctgcccctgaataatctcctcgcaagcaaaatctggactcccgatactttcttccacaacggtaaaaaatccgtggcccacaacatgacgacgcccaataagctcctcagattggtggacaacggtactctcctgtacactatgcgcctcactattcacgctgaatgtcccatgcatctggaggactttccaatggacgtacacgcctgccctttgaaatttgggtcatacgcctacaccactgcagaggtggtatattcgtggactctgggtaagaacaagtctgtcgaagtggcccaggacggcagccggctaaaccagtacgacctgctaggacacgtggtcggcactgagattatccgcagcagcacaggtgagtacgtggtcatgacgacccacttccatttaaagaggaagattggatactttgtgattcagacctacctcccctgtattatgactgtaatcctgagtcaggtgagtttctggttgaatagggagagcgtgccagctagaaccgtctttggcgtgacaaccgtgctcactatgacgacactgagcatcagcgctaggaattcacttcctaaagttgcctacgcaacagccatggattggttcatcgcagtgtgctacgcctttgttttttcagccttaatcgagttcgccacagttaactatttcaccaaacgctcttgggcctgggaggggaaaaaagtgcccgaagctctcgaaatgaaaaagaaaaccccagcagcccccgccaaaaaaaccagtacaacgtttaatatagttggaacaacttatcccattaacctggctaaagataccgagttctctactatatctaaaggggctgcgccgagcgcttctagcacccccactatcatcgcctcaccgaaagctacctatgttcaggattcacctacagagactaagacatataacagtgtgtctaaggtcgacaaaatatctcggataattttcccggttctgtttgctatctttaatcttgtctattgggcgacctacgttaacagggagagtgccatcaaagggatgatcagaaagcagtag

SEQ ID NO: 118035 - DNA, 1665 bp, Artificial Sequence
  Description of Artificial Sequence: Synthetic coding sequence
atggttagcgctaagaaagttccggctatcgcgttgagtgccggcgtatcctttgcacttctgcgctttctctgcctggccgtttgcctcaacgagtcacccgggcagaatcagaaggaagagaagctgtgcactgagaacttcacccggatcctggactcgttgcttgacggctacgacaatagattgagaccggggttcggcgggccggtcaccgaagtgaagacagatatctacgtgacgagctttgggcccgtaagtgatgttgaaatggagtatactatggacgtctttttccggcagacgtggattgataagagactcaagtacgatggacccatcgaaatcttgcgtctcaacaatatgatggtgactaaggtgtggacccctgacacattttttcgcaacggcaaaaagagcgtctctcataatatgaccgcaccgaataagctctttagaataatgcgtaatggcaccatcctgtatacgatgcgactgaccataagcgccgagtgtccaatgaggctcgttgactttcctatggatggtcacgcttgccccctgaaatttggaagctatgcttatcctaagagcgaaatgatttatacgtggaccaagggccctgaaaagagcgtggaggttcccaaagagagcagctccttggtccagtacgacttgatcggccaaacagtgtcctccgaaaccattaaatccataactggagagtatatcgttatgacggtttactttcacctgagacggaagatgggatatttcatgattcaaacctatatcccatgcatcatgaccgtcatcttatctcaggtgagcttctggatcaataaggagtcggtcccagctcggaccgtatttggcattaccactgtgctaaccatgaccaccctatcaatctctgcccgccattcactgccaaaagtgagttatgccactgcaatggactggttcattgcggtttgttttgctttcgtcttctcggctcttattgaattcgcagctgttaactattttacaaacatacagatggagaaagctaaacgcaaaacatctaagcccccgcaagaggtgccggccgcccctgtgcagcgtgagaagcaccccgaagcacctttgcagaatacaaacgccaacctaaacatgcgaaagcgcaccaacgcactggtgcactcagagtcagacgtgggtaatcggactgaggtgggcaaccatagctcaaaaagctcaacggtggtgcaagagagctccaagggaacccccagaagctatctggccagcagtccaaatcccttcagtcgcgcaaacgccgcagagacaatctcagctgccagagccctgccaagcgccagccctacttccatccgcacggggtatatgccccggaaagcatcagttgggtcagcgagcacacggcacgtgttcgggtccaggctccagaggattaagacaaccgtaaacacaattggtgccaccggcaagttgtccgcaaccccaccaccgtcggcgcccccaccctccggtagcggcacgagcaagatcgataaatacgctagaatcctctttcccgtcacgttcggagcatttaatatggtgtattgggtggtttacctgagcaaggatacaatggagaaaagcgaaagcttaatgtag

SEQ ID NO: 118036 - DNA, 1389 bp, Artificial Sequence
  Description of Artificial Sequence: Synthetic coding sequence
atggacaatggcatgttttctggatttattatgatcaagaatctgctcctgttttgtatttcaatgaacctgagtagccatttcggtttcagtcagatgccgacaagcagcgttaaagatgagactaatgataatatcaccatatttactaggattctggacggcctgctagatgggtatgacaataggttgcgcccaggtcttggggagaggatcacacaggttcgtacagatatttatgtaacaagcttcgggccagtgtcggacacagaaatggaatacaccattgacgtcttctttcgacagagttggaaggacgagaggcttcggttcaaaggaccaatgcaaaggctgccactgaataacctgcttgcttctaagatatggacccccgacaccttttttcacaacgggaaaaaaagtattgctcacaacatgacaaccccgaacaagctgctccgtcttgaagatgacggcacattactgtatacaatgcggcttactattagtgctgaatgccccatgcagctggaggatttcccgatggatgcccatgcatgtcccctgaagtttggctcttatgcctatccaaacagtgaggttgtgtatgtgtggaccaacggatcaactaaaagtgtggtagtggccgaagacggttcccgtctgaaccagtatcacctgatgggacagactgtaggtaccgagaacataagcacctcaacaggcgagtataccatcatgactgcgcactttcaccttaaaaggaagattgggtatttcgtaatacagacctacctgccatgtattatgaccgttatattgagccaggtaagcttctggctgaatcgtgagagtgtgcctgcgagaactgtcttcggggtgacaactgtactgacaatgacaacattgtcaatctcagcccgcaactcccttcctaaggtggcctacgcaactgccatggactggtttatcgccgtgtgttacgcattcgtgttcagcgccctcattgagtttgctacggtgaactacttcactaagaggggttgggcttgggatgggaaaaaggccttggaggccgcaaaaattaagaaaaagcgggaggtcatactcaataaatctaccaacgcatttacaacgggaaaaatgagccatccacctaacatacccaaagaacagacacctgccggaacctccaatactaccagtgtttctgtgaaacccagcgaagagaaaaccagcgagtccaagaaaacttataattccatttcaaaaattgacaaaatgagtaggattgtctttcctgtgctcttcggaactttcaacttggtctactgggcaacatatctgaaccgggagcccgtcattaaaggggcggcttctcctaaatag

SEQ ID NO: 118037 - DNA, 1389 bp, Artificial Sequence
  Description of Artificial Sequence: Synthetic coding sequence
atggataacggcatgttctcgggctttataatgattaagaatctcctgctgttttgtatcagcatgaacctgagtagccattttggtttcagccagatgcctacatctagcgtgaaagacgagacgaacgacaacattactatttttacacggattctggatggcctattggacggatacgataaccgcctccgccccgggctcggagagaggataactcaggtgcgaaccgacatttacgtgacctctttcggtcccgtttccgataccgaaatggaatacacgatagatgtgttttttcggcagtcctggaaggatgagagactccggtttaaaggacccatgcaacgcctgccgctcaacaacctgctggcctcaaaaatctggacacccgatactttctttcataacggcaaaaagagcattgctcacaacatgaccacacccaacaaactgctcagacttgaagacgacgggactctgctgtacacgatgaggctgaccatcagtgctgagtgtccaatgcagctcgaggacttccccatggacgcccacgcatgtccgctcaagttcggaagctacgcctaccccaattctgaagtggtctacgtgtggacaaacggcagcaccaaatccgtcgtagtagcagaagacggctcgcggctgaaccagtaccatctgatggggcagactgttggcaccgagaacatctccactagcaccggggaatacaccattatgactgcccacttccacctcaaacggaagatcggctatttcgtgatacagacctaccttccctgtataatgacagttatcttgagccaggtgtcgttttggctgaacagggagagtgtgccggccaggacggtgttcggcgttactacagtactcacaatgactactctcagtatatctgctcgaaatagcctgcccaaagtggcatacgcaaccgctatggactggttcatcgccgtgtgttatgcatttgtcttcagcgccctaattgagtttgccacggtgaattacttcactaagcgcggatgggcttgggacggcaaaaaggctctcgaggccgccaaaattaaaaaaaagcgagaagtgatcttgaacaaaagcaccaatgcattcacaacaggcaaaatgtctcatcctcccaatattcccaaagaacaaactccggccggaactagcaacactactagtgtttcagtgaaacctagtgaggagaagaccagcgagagtaaaaagacatacaacagcatctccaagatagacaagatgtctaggatcgtgttccctgtgctttttggtacctttaacctcgtttattgggcgacatacctcaatcgagaacctgtaatcaaaggggcggcctctccaaaatag

SEQ ID NO: 118038 - DNA, 1389 bp, Artificial Sequence
  Description of Artificial Sequence: Synthetic coding sequence
atggataacggtatgttcagcggctttattatgatcaagaatttgctgttattctgtatatctatgaacctgtccagtcatttcggattcagtcagatgcccacctcttcagtgaaggacgaaactaacgacaatatcacaatcttcacccgcatcctcgacggacttctcgacggctatgataataggttacggcccggattaggagaacgcatcacacaagtgcggacagacatctatgttacatcttttggtccggtttctgacaccgagatggagtatacaatcgatgtttttttccggcaatcttggaaagatgaacgactccgctttaagggtcctatgcaacggcttccactgaataacttgctggcctcaaaaatctggactcctgatacgttttttcataacgggaaaaaatccattgcgcacaatatgaccactccgaacaagttactcaggctggaagatgacggtactcttctctacacaatgaggttgacgatttccgccgaatgtcccatgcagctcgaagattttcctatggacgcccacgcctgtcctttgaaattcggctcatacgcttatcctaacagcgaggttgtgtacgtctggactaatgggtccacaaaatccgttgtcgtggctgaggatggttcccgcctgaaccagtaccacctgatgggccagacagtcggtaccgaaaatatatcgacatctaccggagaatataccattatgacggcccacttccacctgaaaagaaaaattggatactttgtgatccaaacttacttaccatgcatcatgaccgtaatcctatcccaggtgtctttttggttgaacagagagtcggtgccagcgaggaccgtcttcggcgtgactacggtgctaaccatgacaacactctctatatctgcgcggaattctctgcccaaagtcgcctacgcgacggccatggactggtttatcgccgtgtgttatgcgttcgtcttttcagccctcatcgaattcgcgacagtcaactacttcactaaaaggggctgggcttgggacggcaagaaagcactagaagccgcgaaaatcaaaaagaaacgagaggtaatcctgaataagagcactaatgcctttactaccggcaagatgtcgcatcctcccaacatcccaaaggagcagacacctgcggggaccagcaatactacgtccgtttcagtgaagcctagtgaagagaagacctcggaatctaagaagacttataatagcatttccaagattgataagatgtcccgcattgtctttcctgtattatttggcaccttcaatttggtatactgggcgacctatctcaatcgtgagccagtcatcaaaggcgcggcttctccaaagtag

SEQ ID NO: 118039 - DNA, 261 bp, Artificial Sequence
  Description of Artificial Sequence: Synthetic coding sequence
atggataacggcatgttttccggctttatcatgatcaagaatttgttgctcttctgcatcagcatgaacctgtctagccatttcggatttagccaaatgcctacttccagcgttaaagacgagactaacgacaatattactatctttacacggatcctcgacgggctattagatgggtacgacaacagactacggcctggactcggcgagcggatcactcaagtgagaacggatatctacgtgacgtctttcggaccttag

SEQ ID NO: 118040 - DNA, 450 bp, Artificial Sequence
  Description of Artificial Sequence: Synthetic coding sequence
atggataacggaatgttttcggggttcatcatgattaagaaccttctgttattctgcatttccatgaaccttagctctcatttcggattctctcagatgcctacaagcagcgtcaaggacgaaaccaacgacaacataaccatctttactcgcattttagatgggctcttggatggctacgacaatcgcttgcgccctggcctaggagaacgcatcacgcaagttcgcaccgatatctatgtcacctcattcgggcctgtgagcgataccgagatggagtatactatcgatgtgttttttcgccagtcctggaaagacgagagacttagattcaagggaccaatgcagcggttgcctctgaacaatttacttgcctctaagatttggacaccagacacattttttcacaatggtaagaaatctatcgcacataatatgaccacgccatag

SEQ ID NO: 118041 - DNA, 501 bp, Artificial Sequence
  Description of Artificial Sequence: Synthetic coding sequence
atggacaatggtatgttttcaggattcataatgatcaaaaacctgctgctgttttgcatttccatgaacctgtccagccatttcggcttcagccagatgcctacgagttccgtaaaggatgagacaaacgataacattactatctttaccaggatccttgatggtctgcttgatgggtacgataatagactgaggccaggcctaggggaacgaattacacaggtgcggaccgacatctacgtgacctctttcgggccggtgagcgatacggagatggagtataccatcgacgtgttcttccgacagtcctggaaagatgagaggctgcgtttcaagggtccaatgcagaggctccctctcaataatctcttagcaagtaaaatatggactccagacactttctttcacaacggaaagaaatctatcgctcacaatatgaccacccctaataaactgctgcgccttgaggacgacggcaccttactctacacaatgcgatag

SEQ ID NO: 118042 - DNA, 51 bp, Artificial Sequence
  Description of Artificial Sequence: Synthetic coding sequence
atggataacggaatgtttagtggcttcatcatgatcaagaacctgctttag

SEQ ID NO: 118043 - DNA, 1362 bp, Artificial Sequence
  Description of Artificial Sequence: Synthetic coding sequence
atggcaagctctctgccctggctgtgcattattctgtggctggagaatgccctcggcaaattggaggtggagggcaacttttactccgagaatgtttcacggattttagacaatctcctggagggatacgataatcgcctgcggccaggattcggtggggccgtaacggaagtcaaaacagatatttatgtgacttcgttcggtccagtcagtgacgtggaaatggagtacacgatggacgtgttctttcggcaaacctggacagacgaacggctcaagttcggcggtcctacagagatcttatccctgaataatttaatggttagtaagatatggactcctgacacattcttcaggaacggtaaaaaatccattgcccataacatgactacccccaacaagctcttccggataatgcagaacggcacaatcctgtatacaatgcgtcttaccattaatgcagattgcccgatgcgcttggtcaactttccaatggatggacacgcatgccccctgaagtttggctcctacgcctaccccaaatcagagatcatttatacgtggaagaagggacctctctacagcgttgaggtgcccgaggaatctagctcactgctgcagtacgatctgattgggcagaccgtgagctccgaaactatcaagagtaataccggggagtacgtcattatgactgtttacttccacctgcagcgcaaaatgggctactttatgattcagatctacacaccctgcattatgacggtgattcttagccaggtcagcttttggattaataaagagtcagtccctgcgcgcaccgtctttggcatcactacggtgttaaccatgaccacactttctattagtgctcggcacagcctgcccaaagtatcgtatgcaactgctatggattggtttattgcagtttgcttcgccttcgtcttcagtgccctgatcgagtttgctgcggttaattatttcacgaacctgcaaacacagaaggccaagcgcaaggcccagttcgcagcacctccaacagtgacaatcagcaaggccacagagcctctggaagcagagattgtgctgcaccctgactccaagtatcatcttaagaaacgcatcacaagcctgagcctgcctatagtgtcttcctctgaggcaaacaaagtgttaactcgtgctcctatcttacagagtactcccgtgacacctccacctctgtctcctgcttttggaggtacatctaagatagaccagtattcgcgcattttattcccagtggcgttcgcggggttcaatctcgtatactgggtggtgtacctgtccaaggataccatggaggtgagcagtagtgtggaatag

SEQ ID NO: 118044 - DNA, 1332 bp, Artificial Sequence
  Description of Artificial Sequence: Synthetic coding sequence
atggctagctcactgccatggctgtgcattattctttggcttgagaacgctctggggaagctagaggtggagggaaacttttatagcgagaatgtctccaggatcttggataatctgctggagggctacgacaaccggctgcggccaggatttggcggcgccgtcacagaggtcaaaaccgatatttacgtgaccagcttcggtcccgtgagtgatgtagagatgacctggactgatgagaggctgaaattcggtgggccaaccgagatcctatcacttaacaacttgatggtttctaagatatggacccctgacacgttttttcgcaacggaaaaaagagtatcgcacataacatgaccacccccaacaagctatttaggatcatgcagaacgggaccatcttgtataccatgcgtctcacgatcaatgcggattgccctatgaggctggtgaactttccaatggatggccacgcgtgccctttgaagtttggatcatatgcctatccaaagagcgagattatttatacctggaaaaagggaccgctctactcagtcgaagtaccagaagaatccagttcattattgcagtacgatttgattggccagaccgtgagcagcgaaaccataaaatccaacaccggggagtacgtgatcatgacggtctacttccatcttcaaaggaagatgggctactttatgattcagatttatacaccttgcataatgaccgttatcctgtcacaggtgtccttctggatcaataaggagtccgtccccgcgcgcactgtcttcgggatcactacagtcttgaccatgacaacactttctatttcggcaaggcatagcctcccaaaagtcagctacgccaccgccatggactggtttatcgccgtatgcttcgcattcgtcttttcggctcttatagagtttgccgctgtgaactacttcacaaatctccagactcagaaggccaaaaggaaggctcagttcgctgccccgcccacggttacgatctcaaaagccaccgaacctctcgaggcagagatcgtgttacaccccgattcgaaatatcatctgaaaaagaggattacctcgctctcactgcccatcgtatcctcctccgaggccaataaagtactaactcgtgcgcctattcttcaatccacccctgtgacaccaccacctctcagcccagccttcggggggacttcaaaaattgaccagtattctcgcattctgtttccagttgcatttgcagggttcaacctggtgtattgggtggtatacctgtctaaagacacaatggaggtaagcagcagtgtggagtag

SEQ ID NO: 118045 - DNA, 1425 bp, Artificial Sequence
  Description of Artificial Sequence: Synthetic coding sequence
atgtggaccgtccaaaatcgggagtctctaggactcctgtcttttccagtgatgatcaccatggtctgctgtgctcatagcaccaatgaacctagtaacatgagttacgtgaaagaaacagtggatagactgctaaagggctacgacatccggctgcgacctgactttggtggaccccccgtcgacgtgggcatgagaattgacgttgcctctatcgatatggtttcagaagtgaatatggattataccctcaccatgtatttccagcagtcttggaaagacaagcgcttgtcctacagcggcatccctctcaatctgaccctggacaatagggttgcagaccagttgtgggtgcctgacacttacttccttaatgacaaaaaatcgtttgtgcacggcgtgaccgtaaaaaatcgcatgattcgcttgcatcctgacggcacagtcctttatggactgcgtatcacaacaacagcggcttgtatgatggatctgagaaggtatcctctcgacgagcaaaactgtacactggaaatcgagtcatacggctacaccactgacgacattgaattctattggaacggaggagagggagcagtcactggagtcaacaaaatcgagttgccacaattctcaattgtcgattacaagatggtcagcaaaaaggtcgaatttaccacaggggcgtatccaagactctcattgtcctttagactcaagcgtaacatcggatatttcattctgcagacgtacatgccatcgacgctgatcacgatcctcagttgggtttccttctggattaactatgacgcctccgcggcacgcgtcgcgctggggataaccaccgtgttaactatgactacgatatctacgcatctgcgagaaacgttaccaaagataccctatgtaaaggctattgacatctacctcatggggtgctttgtattcgtttttctggccctcctggagtatgccttcgtcaactatatcttctttggaaaaggcccacagaagaagggagcttcaaaacaggatcagagcgccaacgagaagaacaagctggaaatgaacaaggtccaggtggatgcccatgggaatatcctactctcgacactggaaatacgcaatgaaacttctggttctgaagtgctcacatccgtgtccgatcccaaggccacaatgtatagttatgattccgcgagtatccagtatcgcaagcctctgagctctcgcgaagcctacggacgtgccctggaccgacacggcgtgccaagcaaaggccggatccgccgaagggcctcccaactgaaggtcaagattcccgaccttactgatgtgaactccatagataaatggtcgcggatgttttttcctatcacttttagcctgttcaatgtggtgtactggttatattatgtccactag

SEQ ID NO: 118046 - DNA, 1215 bp, Artificial Sequence
  Description of Artificial Sequence: Synthetic coding sequence
atgacttttgcctgtgggcgcactagcgaggactacactctcacaatgtatttccagcaaagctggaaagataaaagattaagctatagcggcattcccctcaatctcaccctggataatagggtggccgatcaactgtgggtgcccgatacctatttcttgaatgacaaaaaaagctttgtgcacggagttacggtgaagaacaggatgatcagactacatcccgatggcaccgtcttatatggccttaggatcaccacaactgctgcttgcatgatggatctacgcagatatcctctggacgagcaaaactgcacccttgaaatcgagtcgtacgggtataccactgatgatatcgaattctattggaatgggggagaaggggcagtcactggagtcaataagatcgagttgccccaattttcaattgtggactacaaaatggtatccaagaaagtggagttcacaactggggcctaccctagactgtccctcagttttcggttgaagagaaacattggctatttcatccttcagacgtacatgccctccacattaatcacaatcctgtcttgggtatcattttggataaattatgatgccagtgccgcccgtgtggccctgggcattacgacggtgctcacaatgacaacaatttctacacacctgagggaaactcttccaaaaataccttatgtcaaagccatcgatatctacctgatgggatgctttgtgtttgtttttttggcgctcttggagtatgcattcgtcaactacattttctttggcaaaggccctcagaagaaaggcgcgtcgaagcaagaccagagtgctaacgagaagaacaaattggaaatgaacaaggtgcaagtggacgctcatggtaacatcttgctctctaccttggagattcgtaatgagaccagtgggagcgaggtgctgacctccgtgtctgatcctaaggcaaccatgtactcatatgattccgcaagcatccagtacagaaaacccctttcttcacgggaagcatacggacgggcattggacaggcacggtgtgccaagcaagggtaggattcgacgtagagcatcccagttaaaggtcaaaatacctgacctcaccgatgttaacagtatcgataaatggtcccgcatgttcttccccattaccttctctttgtttaacgtggtttactggctgtattacgtacactag

SEQ ID NO: 118047 - DNA, 1539 bp, Artificial Sequence
  Description of Artificial Sequence: Synthetic coding sequence
atgtggagagtgaggaagcgcgggtacttcgggatatggagctttcctctgataatcgctgcagtgtgcgcccagagcgtcaacgatccctccaacatgagtttggtgaaagagacggtggacaggctgctgaaggggtacgacattcggctgcggcctgattttggcggtccacctgtggccgtggggatgaacattgacatcgccagtatcgatatggtgtcagaagtaaacatggattatacactgaccatgtactttcagcaggcttggagagataagagactgtcctacaatgtcattcccctgaacttgacactggacaatcgcgtcgcagaccaactgtgggtgccagacacttacttccttaacgataaaaaaagctttgtccatggcgtgactgtcaagaacaggatgatccggctccaccccgacggaaccgtactctacggactgcggattacgaccactgccgcctgcatgatggacctgcgccgttacccactcgatgaacagaattgtacactcgaaatcgagagttatggctataccactgatgatatcgaattttattggaggggtgacgataacgccgtgacgggggttacgaagatcgagttaccacagttttccatcgtcgattataaactgatcaccaagaaggtagtttttagcacgggcagctacccaaggctgtcgctgtctttcaagctgaaacgaaatataggctactttatattgcagacatacatgccctcaattctcattaccatcctctcctgggtcagcttctggataaactacgacgcctcggctgctcgagtcgccctcggcatcaccacagtgctcactatgactacaattaatacgcatctcagggaaacgctgcctaaaatcccctatgttaaagcaattgatatgtacctgatgggatgcttcgttttcgtttttatggccctgcttgagtacgctttggtgaactatatcttctttggacgtggaccacaacgccaaaaaaaagctgccgagaaggcagcttcagcaaacaacgagaagatgagacttgatgtcaataagattttttacaaagatatcaaacagaatgggacacagtatcggtctttgtgggaccccacagggaatctgtcccccacgagaagaacgaccaattacgatttcagtctgtacaccatggaccctcatgaaaacatccttctgtctacactagagataaaaaatgagatggcaacttcagaggctgtgatgggtcttggagatcctagaagcactatgttggcctatgatgcttcttctattcaatatagaaaggccgggttgcctcgacacagtttcgggcgcaatgcgctcgaacggcatgtcgctcagaaaaaatccaggctgagacgccgggcctcccagctcaaaatcacaatccctgatctaacggatgtgaacgccattgacagatggagccggatttttttccccgtggttttctcattttttaacatcgtctactggctatactatgtaaactag

SEQ ID NO: 118048 - DNA, 1425 bp, Artificial Sequence
  Description of Artificial Sequence: Synthetic coding sequence
atgtggcgagtgagaaagcgtggttacttcgggatttggtcttttccacttataatcgcggccgtgtgtgcccagagcgtcaatgatccaagtaacatgagcctcgtgaaagagacggtggatcgtcttttgaaaggctatgacatcagactgcggccagacttcggtggtccaccagtcgctgttggaatgaacatcgatatcgctagcattgacatggtttctgaggttaatatggattacaccttgacaatgtacttccaacaggcctggcgcgacaagcgcttgtcctacaatgttatcccactcaatctgacactggataacagagtggccgaccagttatgggttccagatacctattttctgaatgacaagaagagtttcgtgcacggtgtgacagtcaagaacaggatgatccgcctccaccccgacggcacagtcctgtatgggttacggattacaactacggcggcctgtatgatggatctgcggcggtacccccttgacgaacagaattgtaccctggagattgaatcttacggatatacgacggacgatatcgagttctactggaggggtgatgacaatgctgtgaccggcgtgacgaaaatagagctgccgcaattctctattgtcgattacaagttgatcacaaagaaggtggtgttctctacagggtcatacccaagactgtcactctccttcaagctgaagcgcaatataggatacttcatcctacaaacttacatgccatctattctaataacaatcctgagctgggtctccttctggattaattacgatgcctccgctgctcgcgtcgcactggggattactactgttttgacgatgactaccattaatactcacctgcgtgagactctgccaaagatcccatacgttaaggcaatagatatgtacctgatgggctgcttcgtctttgtttttatggccctgttagagtatgcattagtgaattatatctttttcggcaggggtcctcagcggcagaagaaggccgctgagaaggccgcctcagctaacaatgagaaaatgcgtctcgatgtgaacaaaatggatccccatgagaacattctgctctcgacgctcgagattaaaaatgaaatggccacaagtgaggccgtgatggggctgggggacccgaggtcaactatgttggcctatgatgcttcctctattcagtaccgaaaggcgggactcccccggcactcgttcggtagaaatgccctagaacgccacgttgcccagaaaaagtctcgactgagacgcagggcatcccagttaaagattaccatacctgacttaacggatgtaaacgccatcgatcgatggagtcgaatttttttccctgttgtattcagcttttttaacatagtatactggctgtattatgttaattag

SEQ ID NO: 118049 - DNA, 1539 bp, Artificial Sequence
  Description of Artificial Sequence: Synthetic coding sequence
atgtggagagtgcgcaagcgtggatactttggcatatggagcttccccctgatcattgctgcagtatgcgcccagtctgtgaacgatcctagtaacatgagcctcgtgaaggaaacggttgaccgtctgctgaaaggttacgacatccggctgcggcctgacttcggaggaccaccagtagctgtggggatgaatatcgatatagcaagtattgacatggtaagtgaagtgaacatggactatactctcacgatgtactttcagcaagcttggagagataagagactttcctataatgttatacccttaaatcttactctggataaccgggtcgcagatcagctatgggtccccgacacctatttcctgaacgataagaagtcctttgttcacggggtaacagtcaaaaatcggatgattagactgcatccagatggaaccgtgctttatggtcttaggatcaccaccacggcagcatgcatgatggatctgaggaggtatccgctcgatgagcagaactgcaccctggaaattgagagttacggatacacaaccgatgatatagaattctattggcgaggcgatgacaacgcagtgacaggagtcacaaaaattgagctcccacagttttctatcgttgattacaaacttataaccaagaaggtcgtattttctaccggctcatatccacggctcagcctgagctttaagctgaagcggaatatcggttatttcatcctgcaaacttacatgccgtcaatccttataacgatcctgtcctgggtgtctttttggatcaattatgacgcttcggccgccagggttgctttggggattaccaccgtgctcacaatgaccacaattaacacccaccttcgagaaacactgccaaagatcccctatgttaaggctatcgacatgtacctaatgggatgcttcgtgtttgtttttatggccctgcttgagtacgcgttggtcaattacatcttcttcggtcgcggcccccaaaggcagaagaaagccgctgaaaaagccgcttccgccaataacgaaaaaatgagactcgacgttaacaagatcttttataaagacatcaagcagaatggaacccagtacagatccctgtgggacccaaccggcaacctcagccctactcggcgaaccactaactacgattttagcttatacaccatggacccacacgaaaacatactattgtctacgctggagataaagaatgagatggccacatctgaagcagtgatgggcctgggagacccacgatctaccatgctggcttatgacgcctctagcatccagtatagaaaggcggggctgccgcgccactctttcgggaggaacgccctggagcggcacgtggctcagaaaaaatctaggctccgccggagggccagtcagctgaaaattacaataccagatttgaccgacgtcaatgctatcgacagatggtctcgtatattctttcctgtcgtattcagcttcttcaacatcgtgtattggttgtattatgtgaactag

SEQ ID NO: 118050 - DNA, 945 bp, Artificial Sequence
  Description of Artificial Sequence: Synthetic coding sequence
atgatggacctgcggagataccctctggacgaacagaactgcacgcttgaaattgagagttacgggtataccaccgatgacattgagttttattggagaggtgacgataacgcagttactggcgtaactaaaattgagcttccccagtttagtatcgtggattataagctgatcactaaaaaggtagtcttttccaccggcagctacccaagactgtccctcagttttaagttaaagcggaatataggttacttcatcctacagacatatatgccctccatcttgattacaattcttagttgggttagcttctggataaactatgatgcatcagccgcaagagtcgctcttggcattaccaccgtattaaccatgaccaccattaatacccacctcagggagactctgcctaagatcccatacgtgaaagctattgacatgtacctcatgggttgttttgtttttgtattcatggcgctgctggagtacgctctagtcaattatattttctttgggcgtggcccacagcgacaaaaaaaggctgctgagaaggctgccagcgccaacaacgagaagatgagactcgacgtgaacaagatggacccacacgagaacatattgctgagcaccctggaaatcaaaaatgagatggctacctctgaggcagtgatgggtctgggggatccccgtagtactatgctggcttacgacgcaagcagtattcaataccggaaagccggactgcccaggcactcattcggcaggaacgctttggaacggcacgtcgcccagaaaaaaagtcgtttgcggaggagggcaagtcaattgaagatcaccataccggacttaacagacgtcaatgccatcgaccgatggagcagaatctttttcccggtcgtattttcattttttaatattgtgtactggttgtattatgtgaactag

SEQ ID NO: 118051 - DNA, 1236 bp, Artificial Sequence
  Description of Artificial Sequence: Synthetic coding sequence
atgaatatcgacatagctagcatcgacatggtgagcgaagttaatatggactacacgctgaccatgtactttcagcaagcttggagggacaagagacttagctacaatgtaatccctctgaacctgacgctggacaaccgagtagctgaccagctgtgggtgcccgatacatactttcttaatgataagaaatcgttcgtacatggtgtgacggtaaaaaatcgaatgatccggctccaccctgacggcacggtgctgtatgggctgaggataaccacaactgcagcttgcatgatggatttgaggaggtacccccttgacgagcagaactgtacactggagatcgaatcctatggatatactacagatgacatcgagttttactggagaggcgacgacaacgctgttacaggcgtgacaaaaatcgaactgccacagtttagcattgtcgactataagctgattaccaagaaggtggtttttagcacaggatcttatcctcgcttatctttgagctttaagttaaaaagaaacatcggatattttatcctccaaacctacatgccaagcatcctgataactattctgagctgggtttcattctggattaattacgatgccagcgcagcccgggtggccttgggcatcaccactgttctgactatgactactattaacacacatctcagggagacactgccaaagattccttatgtaaaagctatcgatatgtacctgatgggctgttttgtgtttgtatttatggctttgctcgaatacgccctcgtgaattacattttttttgggcgggggccccagagacagaagaaagcagcagaaaaggcagcgtcggccaacaacgagaaaatgaggctggatgtcaataaaatggacccgcatgaaaacattctgctctctacactggagattaagaatgagatggccacctctgaagcggtgatgggattgggagacccacggtccacaatgctggcctatgatgcatccagcatccagtacaggaaggctggtctcccacgacactcttttggaaggaacgcactcgagagacacgtggctcaaaaaaaaagtcgtctgcgacggagagcatcacagttgaagatcacaatccctgatcttaccgacgttaacgctattgaccggtggtcccggatcttttttccagtggtcttcagtttctttaatatcgtgtactggctttattacgtcaactag

SEQ ID NO: 118052 - DNA, 1425 bp, Artificial Sequence
  Description of Artificial Sequence: Synthetic coding sequence
atgtggcgggtacggaagcgaggatatttcggcatctggtccttccctttaattattgccgcagtatgcgctcagagcgtgaacgaccctagcaacatgagcttggtaaaggagacagtggaccgcctccttaaggggtatgatattcgcctgcgccctgatttcggtggaccaccggtcgccgtggggatgaatatagacatcgccagcatcgacatggtctctgaagtcaacatggattacacacttactatgtacttccagcaggcttggcgcgacaaacgcttaagttacaatgtgatcccgcttaacctgactttggacaaccgcgtcgcggatcagttgtgggtccccgacacatacttcctcaatgacaaaaaaagtttcgtccacggcgtaaccgtaaagaaccgcatgatccgtcttcacccagatggaaccgtcctttatgggttgaggattaccactacagcagcctgcatgatggatcttcggcgctacccactcgacgaacagaactgcacactagagattgaaagctacgggtacactacagacgatatcgagttctactggcggggggatgataatgcagtaacaggcgttaccaaaattgaacttccacaattctccatagtggattacaagctgatcactaagaaagtggtgttttccacaggcagttatcctcgactatccttgtcgtttaagcttaagagaaatatcggatacttcatcttacagacatacatgccttcaatcctcatcacgattctgagttgggtctctttttggattaactatgacgcctctgcagctagggtagctctgggtatcaccaccgtgctcactatgacgactattaacacgcatttacgcgagacacttcctaagatcccatacgttaaagcaatcgacatgtacctgatggggtgttttgtcttcgtttttatggccctgttagagtacgctcttgtgaattatatctttttcggacgggggcctcagcgccagaaaaaggcagccgaaaaggcagccagtgccaataatgagaaaatgcggttggatgtgaacaagatggatccccacgagaacatcctgctgagtacccttgaaattaaaaatgaaatggcaacttccgaagccgtcatgggcctcggagacccacggtcaacaatgctggcttatgatgcttcttccatccagtatagaaaggcggggctgccacgacactccttcggacggaatgcgctggaacgacatgttgcacaaaagaaatctcgactcaggcgcagggccagtcaattgaagatcaccattccagacctgaccgacgtcaacgctattgataggtggagtaggattttttttcctgtcgtgttctcatttttcaacatcgtgtattggctatattatgtcaactag

SEQ ID NO: 118053 - DNA, 1422 bp, Artificial Sequence
  Description of Artificial Sequence: Synthetic coding sequence
atgtgctctggactgctggagctgctgttgccgatatggctgtcttggacactgggcacaagggggtctgagccaagaagcgttaatgatcctggtaacatgtcattcgtgaaggagacagtagacaagctgctgaaaggatacgacattcgcctcagacctgattttggtggcccccctgtatgcgttgggatgaacattgatatcgcgtctattgacatggtctctgaggtaaatatggactacaccctgactatgtatttccagcagtattggagggataagagactcgcctactccggcatcccattaaatctgacgttggacaatcgcgttgccgaccagctgtgggtgcccgatacatatttcctgaacgacaaaaagagctttgtgcatggcgtgacggtcaagaatcgcatgataaggctgcaccccgatggtacagtcttgtatggacttaggatcaccacaacagctgcctgcatgatggatctgcgtagataccccctggatgagcaaaattgcacactcgaaattgaaagctacgggtataccactgatgacatcgaattttattggcgcggaggggataaggcagtgacgggcgttgagcgaatcgagcttccacagttttcaattgtggaacaccgtctggtctccagaaatgtagtgtttgccacgggagcttaccctaggctgtcattgtctttccggctgaagaggaacattggatattttatattgcagacatacatgccctctatactaatcaccattctttcttgggtttcattctggataaattatgacgcgtccgccgcgcgtgtggctttggggatcactacagtgttgacgatgacaactatcaacacccacctgagggagaccctgccaaagatcccctacgtgaaggccattgacatgtacctgatgggctgttttgtgttcgtcttcttggcccttctcgagtatgcatttgtaaattacattttcttcggcaggggtcctcagcgccagaagaagcttgctgaaaagacggcaaaggcaaaaaacgatcggtctaaatcagagtcgaacagagtggacgctcatggcaacattttacttacgtctcttgaggtgcacaacgaaatgaatgaagtgagtggcggcataggcgacaccagaaattcagctatttcttttgataatagtggcattcaatatcggaaacagtctatgccccgggagggacacggacggttcctgggagacaggtctctgccccacaaaaaaacacacctgaggagaagatcaagccagttaaaaatcaaaattcctgacctcaccgacgtcaatgctatagacagatggtctcgcatcgtgttcccttttaccttctcccttttcaacctggtctactggctttattacgtcaattag

SEQ ID NO: 118054 - DNA, 1422 bp, Artificial Sequence
  Description of Artificial Sequence: Synthetic coding sequence
atgtgggggctggctggcgggagattgtttggcattttttccgctcccgtcttagtcgccgtggtatgctgtgcacagtctgttaatgatcctgggaatatgtccttcgtcaaggagacagttgacaagctcctcaaaggttatgatatcaggctgagacccgatttcggtggaccacccgtatgtgtcggcatgaacattgatattgcgagtatcgatatggtctcggaggtgaacatggactacaccctcacgatgtatttccagcagtactggcgcgataaaagattggcctactccggaatcccactcaacctgacactcgacaaccgcgtagccgatcagctatgggtgccggacacttatttcctaaacgacaaaaaatcctttgtccatggggtcacggtgaaaaaccggatgatcaggctgcatcccgacgggactgtgctgtacggccttcggataacaacaaccgcagcatgcatgatggacttacggcgctatcccctggatgaacagaactgcacgcttgaaatagagtcctatggctacacaactgatgacatcgagttctattggcgcgggggcgacaaggcagttactggagtagaacgcattgagctgccacagttttctattgtggaacaccggctcgtgtccaggaacgtcgtgtttgcgactggcgcttatccccgactgtcactgtctttccgactaaaaaggaacataggttactttattctgcaaacatacatgccttcgatactcatcacaattcttagctgggtgagcttctggattaattacgatgccagtgctgctagagtagccctggggatcacaaccgtcctgacgatgacaaccattaacacgcacttgcgcgagaccctacctaagattccctacgttaaagctatcgacatgtacctgatgggttgtttcgtcttcgtcttcctcgccctattagaatatgcgttcgttaattacatattcttcggacgggggccacaacgacagaagaaactcgcagaaaagacagcgaaggctaaaaatgatagaagcaaaagcgagtccaacagagttgatgcccacggcaatatcctgctgactagcctggaagtacacaacgagatgaacgaagtatctgggggcatcggagatacacggaattctgccatctcctttgacaacagtggcattcaataccggaaacagtcgatgccccgcgaaggacatggcaggttcctcggcgaccgttccctgcctcacaagaagacgcatctccggcgcaggtcctcacagctaaagattaagatccccgatctgacagacgtcaatgccatcgacagatggagccggatagtattcccctttaccttctctctgttcaacttagtctattggctgtattatgtgaattag

SEQ ID NO: 118055 - DNA, 1209 bp, Artificial Sequence
  Description of Artificial Sequence: Synthetic coding sequence
atgtgggccacttatcagactgaggaagactataccctgacaatgtatttccaacagtactggcgcgataaacgcctcgcttacagcggcatccccctgaacttaactctagataaccgggtcgctgatcagctctgggttcccgacacatatttcctgaatgacaaaaagtctttcgtgcacggcgtgacagtcaagaaccgtatgattcggcttcaccccgacggcaccgtactttatggtttgcgcatcaccacaaccgctgcatgcatgatggacttaaggagatacccacttgatgaacagaactgtactcttgaaatcgaatcatacggatacacaaccgacgatatcgagttttactggcgaggcggcgataaagccgtcacaggtgtggagcgaattgaactaccccagttcagcatagtcgagcataggctcgtgagtcgcaatgtagtgtttgccacgggagcttacccgagactgagcctgtcgtttagactcaaacggaatattggctactttatcctgcaaacatatatgccaagcatactaattacaatattgtcctgggtttccttttggatcaactacgacgcatctgcagcgagagtcgcacttgggattaccactgtgcttacaatgaccactatcaacacccacctgcgcgaaacgctcccaaaaatcccatacgtgaaggcgattgacatgtaccttatgggttgtttcgtgtttgtctttctcgccctcctggagtatgcctttgtgaactacattttttttggccggggtccacaacgccagaagaaactcgcagaaaaaacggccaaagccaaaaacgacagatccaagtcagagagtaatcgtgtggacgctcatgggaacattctgcttacatccctcgaggtccacaatgagatgaacgaagtgagcggggggatcggcgatacacggaactcggcaattagcttcgataacagcggcattcagtaccgcaagcagtcaatgccacgcgagggacacggacgattcctcggggatcgctctctccctcacaaaaaaacccacttgagacggcgctctagccaattaaagataaagatccccgacttgactgatgtgaatgctattgacaggtggtccaggattgtatttccgttcacattttcattgtttaacttggtatattggttgtattacgtcaactag

SEQ ID NO: 118056 - DNA, 1167 bp, Artificial Sequence
  Description of Artificial Sequence: Synthetic coding sequence
atgtatttccaacaatattggcgagataaacgccttgcttactcaggaattcccttgaatttaaccctcgataacagagtcgcggaccagctgtgggtacctgacacatactttttaaatgataagaaaagtttcgttcacggggtaacagttaaaaacagaatgattagactccatcctgatggaactgtcctgtacggactgcgtatcacaacaactgcagcgtgtatgatggacctgcggcggtacccactggacgaacagaattgcacgctcgaaattgagtcgtatgggtatactacggacgacatcgagttttattggagggggggcgataaggccgtgacaggagtcgaacgcattgaactcccccagtttagtatagtggagcacaggttagtgagccggaacgtggtgttcgcgacgggggcatacccaagactctcgctgtccttcagacttaagaggaatatcggttactttatccttcaaacctatatgccctccatcctgatcacgattctctcttgggtttcattttggataaattacgatgcttccgctgctagggtggccttagggatcaccacagtgcttacaatgacaaccatcaatactcacttgcgtgagacgttgcccaaaattccctacgttaaggccattgacatgtacctgatggggtgtttcgtctttgtctttctcgccttactggagtacgcctttgttaattatatattcttcggtcgagggccacagaggcagaagaagctagctgaaaagactgcaaaagccaagaacgatagaagcaagtctgagtccaaccgggtggacgcccacggtaatatactactgactagcttagaggttcacaacgaaatgaacgaagtttctggcggcattggggacactagaaattccgccatttccttcgataactctggaatccagtaccggaaacagtccatgcctcgcgagggacacggccgttttctgggcgataggtctctgccacataaaaagacccacttgcgccgaaggtccagccagctgaaaataaaaatcccggatctgaccgatgttaacgcaatcgacaggtggagtcgcatcgtgttcccctttacattttcccttttcaatcttgtatattggctctattacgtaaactag

SEQ ID NO: 118057 - DNA, 417 bp, Artificial Sequence
  Description of Artificial Sequence: Synthetic coding sequence
atgtactttcagcaatactggcgcgataaacgattagcctattccggtatacccctaaacctaactctcgataatcgcgtggccgatcagctgtgggtgcccgatacctactttctgaatgataagaaatccttcgtacatggggtcaccgtaaaaaatcgtatgatacggctgcacccggatggaacagtcctctacggcctgagaattacgacaacagcagcctgcatgatggacctgaggcgctaccctctagacgagcagaactgcaccttggagatagagtcgtatggctacacaacagacgatatagaattttactggcgcggcggcgataaggctgtcactggagtggagaggatagaactcccacagttttcaatagtggaacaccgcctcgtgtccagaaatgtgtag

SEQ ID NO: 118058 - DNA, 1359 bp, Artificial Sequence
  Description of Artificial Sequence: Synthetic coding sequence
atggacgccccagcacggctgctcgccccgctgctcctgctctgcgcccagcagttgcgaggcactcgggcgatgaacgatatcggtgattatgtcggatccaatttagagatttcttggctccctaacctcgacggcctgattgcaggctacgcacgcaattttaggccggggatcggtggcccgcccgtgaacgtcgcactggcattggaggtcgcatcaatcgaccacattagtgaagccaacatggaatatacaatgactgtgttcttacatcagtcgtggcgcgattcccgtctgagttataaccacaccaacgagaccctgggccttgacagccgattcgttgacaagttgtggcttcccgacaccttcattgtgaacgccaagtccgcctggttccacgatgtcactgtggagaacaagctaattcggctgcagcccgatggtgttattctgtactccatcaggattaccagtacggtggcctgtgacatggacctggctaaataccccatggacgagcaggaatgcatgttggatctggaatcatacgggtactcttcagaagatattgtgtattactggtcagaatcacaagagcacatccatggactcgataaactccagctggctcagttcactattacttcataccgattcacgacagagcttatgaactttaagtcggccgggcagtttcctcggctttccctgcactttcatctcagacggaaccgtggagtgtacatcatccagagttacatgccctcagtactgctcgtggcgatgtcttgggtgtccttttggatttcacaagctgcagtccctgcccgtgtctctctcgggattaccacggttctgacaatgacgaccctgatggtgagtgcccggtctagccttccacgcgcctcagctattaaggccctggacgtatacttctggatttgctacgtttttgtgttcgctgctctggtggagtatgctttcgcccactttaatgctgactatcgcaagaaacaaaaagccaaggtgaaagtttcccggccaagggcagaaatggatgtgcgaaacgcaattgtcctctttagcctcagcgctgcaggagtgacccaggagctggccatctctcgcaggcagcgtagggtgcctggtaacctgatggggagctatcgctcagtcggggtcgagacaggggaaacaaagaaagagggagccgcccgcagtggaggacagggggggatccgggccaggctccgccctattgacgccgatacgattgacatctacgcccgggccgtttttccagccgccttcgctgcagtaaatgtgatttactgggctgcctacgccatgtag

SEQ ID NO: 118059 - DNA, 1521 bp, Artificial Sequence
  Description of Artificial Sequence: Synthetic coding sequence
atgctgtccaaggttctgcctgtgttgctggggatcttactcatcctgcagtcgcgcgtggaagggccacagacggaatcgaaaaacgaggcgtccagcagggatgtggtctacggcccacaaccgcagcccctggagaaccagttactgtccgaggagacaaagagtactgaaacagagactggctctcgggtgggtaaactgcccgaggcatctcggatcctgaataccatcctgtctaactatgaccacaagctccggcccggcattggagagaaaccaacggtggtaacagtcgagattagcgtaaatagcctgggaccactcagcatcctcgatatggagtatacgatcgacattatcttttcacaaacgtggtatgacgagcgactatgctacaacgatacttttgagtccctagtcctgaatggaaacgtggtttcacagctttggattccggatacctttttcaggaatagcaagcgtactcacgaacacgagattaccatgccgaaccaaatggtgagaatttacaaagatggtaaagtcctgtacactatcagaatgactatcgatgctggctgtagcctgcatatgctgaggtttccgatggactcccacagctgtcctctgtcattctcgagcttcagctaccctgaaaacgaaatgatttacaaatgggaaaacttcaaactggagattaatgaaaagaactcttggaagctgtttcagtttgatttcactggtgtatctaacaaaacagagattatcacgacaccagttggggatttcatggtaatgaccattttttttaatgtgtccaggaggttcgggtatgttgctttccaaaactacgtgccttctagcgtgaccacaatgctgtcatgggtaagtttctggataaagactgagagcgcccccgcaagaaccagcttgggcattaccagcgtcctgacaatgacaacacttggaacgttcagccgtaaaaatttcccccgagtatcatatataacagctttagacttttacattgccatctgctttgtgttctgcttctgtgctctcttggaatttgccgtgctgaatttcctgatctacaaccagaccaaggcccacgcaagtcctaaattaaggcacccaaggataaacagtagggctcatgcaagaacccgggctaggtctcgtgcctgtgctcgtcagcaccaagaagccttcgtatgccagatcgttacgaccgagggaagcgatggcgaagagcggccgtcttgttctgcgcagcaacccccaagcccggggagcccagagggcccacgcagcctctgctccaagctggcatgttgtgaatggtgtaaacgctttaagaaatatttctgcatggtgcccgactgtgagggaagcacctggcagcaggggaggctctgcatccacgtttatcgacttgataattattctcgagtagtattcccagtgacctttttctttttcaacgtcctgtactggctggtgtgcctaaatctgtag

SEQ ID NO: 118060 - DNA, 420 bp, Artificial Sequence
  Description of Artificial Sequence: Synthetic coding sequence
atgaggtccccctgtcccaccaggtggagtgcctctaccaggatggcgcggtgttgtacccagctggtgtcataccccgagaacgaaatgatttacaagtgggagaacttcaagctagaaatcaacgaaaaaaatagctggaaactttttcagtttgatttcaccggagtttctaacaaaaccgagatcatcacaacccctgttggagacttgaatgaggaacctcgagacctgcctcgagtcgccccacgggcgaccttggagacactatttacgcaccctgatcaggtgcagggcagtgagggtacggcactgattgtttcccgcatgtggatggagcccgtgacccaacccgcaatctgtcgggagaggcatctggtgctgctcccctttaaaataccgaggcaagaagacttctag

SEQ ID NO: 118061 - DNA, 1398 bp, Artificial Sequence
  Description of Artificial Sequence: Synthetic coding sequence
atgggccctctgaaggcatttctcttttcacccttcttgctgaggagtcagagtcggggcgtgaggcttgtcttcttgctactgactctccatttaggtaactgtgtggataaagctgacgatgaagatgatgaggatttgacagtgaacaagacttgggttctggccccaaaaatccacgagggtgacatcactcagatcctgaactctctacttcaagggtatgataacaagctcagaccggacatcggcgtcaggcctacggtaattgaaacagacgtctatgttaactccattggcccggttgatcccattaatatggagtatactatcgacatcattttcgctcaaacgtggtttgattctcggctaaaatttaactccaccatgaaggtactcatgctcaactctaatatggtgggcaaaatctggattccagacacctttttcaggaactcccgaaagtccgatgcacattggatcaccacccctaacagattgcttaggatatggaacgacggtagagtactgtataccctgaggctgacaataaacgctgaatgttacctgcagcttcataatttccctatggatgaacacagctgcccattagagttctcttcatacgggtatccgaaaaatgaaatcgaatacaagtggaaaaagccatcagtggaagtcgcagatcccaagtattggcggctttaccagtttgcttttgtcggcctccgtaactctactgaaataacccatacgatttccggagactatgtgattatgaccatttttttcgatctcagcagacgcatgggctactttaccatacaaacatacattccatgcatcctcaccgtggtgctctcatgggtgagtttctggataaacaaggatgctgtcccggcccggacatctttaggcatcacaaccgttctgaccatgacgaccttaagcacgatcgcccgtaaatctctgcccaaagtgtcctacgtcaccgccatggacctttttgtgtctgtgtgtttcatctttgtgttcgctgccttgatggaatacggtacgctgcactattttacctccaaccagaagggaaagaccgccaccaaggatcgaaaattgaagaataaagctagcatgacacctggtcttcatccaggaagtacactgatccctatgaataatatttccgtccctcaggaagacgattatggctaccagtgcctggaaggcaaagattgcgcaagtttcttttgttgtttcgaggattgtcgcactggaagctggcgagaaggacggatccatatccggattgctaagatagattcatatagccggattttctttccaaccgccttcgctttgtttaacctcgtctactgggtgggatacttatatctgtag

SEQ ID NO: 118062 - DNA, 1260 bp, Artificial Sequence
  Description of Artificial Sequence: Synthetic coding sequence
atggggccactgaaggcttttttgttttcaccttttcttcttaggagccagagcaggggagtgagactggttttcctcctgcttacactgcaccttggaaactgcgttgacaaggcagacgatgaggatgacgaggacttgacggtaaataaaacttgggtgctggcccccaagattcacgagggcgacatcacacagattcttaattccttgttgcagggctatgacaacaagcttagaccggacattggtgtgcgccccaccgtaatagagaccgacgtatacgtcaactctattgggcccgtggatcccataaatatggagtatactatcgatatcatcttcgctcaaacatggtttgacagccgtctgaaatttaactccaccatgaaggtcctgatgctgaatagcaacatggtagggaagatttggattccggacacattcttcagaaactcacgcaaatctgacgcacactggattaccaccccaaacagactcctccggatatggaacgacgggagagtgttgtataccctaagacttactatcaatgccgaatgctatcttcagctgcataacttccccatggacgagcactcttgcccgctagagttctcctcctatggctaccccaagaatgagatcgaatataaatggaagaagccaagtgttgaagtggccgatcctaagtactggagactgtatcaattcgcgtttgtagggctgagaaattctactgaaatcactcataccatatcaggagattatgtcattatgacaattttctttgacttaagtcggaggatgggctacttcacgatccagacctatataccatgcatcttgaccgttgttctcagttgggtcagcttctggatcaacaaggacgctgtgccggcaaggacctcactcggcataaccaccgtcctcaccatgacgaccctgtccactatcgctcggaagtccctgccgaaggtgagctatgtgacggctatggatctatttgtaagtgtgtgcttcatcttcgtctttgcggccctcatggagtacgggaccttgcattatttcactagtaatcaaaagggtaagacagcaaccaaagatcggaaactgaaaaacaaggcatctatgacgcctgggctgcatcctgggagcactttaatccctatgaacaacatttcagtaccacaggaagatgactacggctatcagtgtttagagggacggaaagacacccacactcactgtcagaattag

SEQ ID NO: 118063 - DNA, 1428 bp, Artificial Sequence
  Description of Artificial Sequence: Synthetic coding sequence
atgtctagtccgaacatctggtcgaccgggagttctgtttattctacccccgtgttttctcagaagatgaccgtgtggatcctcttgttgctgagcctgtaccctggtttcacctctcaaaaatccgacgatgattacgaggactatgcatcaaacaaaacttgggtgctaacacccaaagtgccagagggggatgtcaccgtgatactgaacaatctgctggagggttatgataataagctgcggcctgatataggggtgaagccgacactaatacatacggacatgtacgtcaactccatcggcccagtgaacgccatcaacatggagtacaccatcgacatcttttttgcccagacctggtatgatcgccgccttaaatttaattctacaatcaaggtactcaggttgaacagcaatatggtgggcaaaatatggatcccggacacattcttcaggaatagcaagaaggcagacgcccactggattaccacccccaataggatgctacgcatttggaatgacggccgcgtcctctatacactgcggctgactatagatgctgagtgccaactgcaattgcacaattttcccatggatgagcatagctgcccactcgaatttagcagttacgggtaccctagggaagagatcgtctatcaatggaaaagaagcagtgtcgaagtcggcgacacaagatcttggaggctgtatcaattttcatttgtgggcctgcgaaatactaccgaggttgtcaagactaccagtggcgactacgttgtgatgtccgtgtacttcgacctgagccgacgcatgggatatttcacaattcagacctatataccttgcacactgatcgtggtcttgagctgggtcagtttctggatcaataaggacgccgtgcctgcccggaccagtctgggcataacaaccgtccttaccatgacaaccctatctacaattgccaggaaatccttaccaaaggtgtcctacgtgacagcaatggatttgtttgttagcgtgtgtttcatcttcgtgtttagcgcactagttgagtatgggactttgcactatttcgtctccaatagaaagccttctaaagataaagacaagaaaaagaagaatcctctgctacgcatgttcagtttcaaggcccctactatcgacatccgccccaggtctgctaccatccaaatgaataacgctacccacctgcaggagcgagatgaagaatatggctacgaatgtctggacgggaaggactgtgcttcttttttttgctgcttcgaagactgtcgcaccggagcctggagacacggtcgaatccatatcaggatagccaaaatggatagctacgcgaggatcttctttccaaccgcgttctgcctgtttaacctggtgtactgggtgagctacttgtatctgtag

SEQ ID NO: 118064 - DNA, 1404 bp, Artificial Sequence
  Description of Artificial Sequence: Synthetic coding sequence
atgtccagtccaaatatttggagcactggtagcagtgtgtactctacccccgtattcagccagaagatgacagtgtggatcctcctgttactgtctttgtaccccggcttcaccagtcagaagtccgatgacgactatgaggattacgcctccaacaaaacatgggtactgacaccgaaagtgcccgagggcgatgtgacagtaattctgaataacttgctcgaaggttatgataacaagctgcgaccggacataggcgttaagcctaccctgatccacacagatatgtacgtcaatagtattggccccgtgaatgctattaacatggaatacaccatagacattttctttgcgcaaacctggtatgatcggaggctgaagtttaactcgacaattaaagtcttgcgtctgaacagtaacatggtggggaagatctggattcctgacaccttcttccgcaacagcaaaaaggctgatgctcattggatcacaaccccaaaccggatgttgcgaatctggaacgacgggcgagtcctctataccctcagactgacaattgatgccgaatgtcagttgcagctccataacttcccaatggacgaacatagctgtcctctcgaattcagcagctatggctacccgcgtgaggagatcgtgtaccagtggaaacgatccagcgtcgaggtcggcgacaccaggtcttggcggctgtatcaatttagcttcgtggggctcaggaacacaaccgaggtggtaaagacaaccagcggcgactatgtggtaatgagtgtctacttcgatctatcacggagaatggggtacttcacgatacagacctacataccttgcacgctgattgttgtgctcagctgggtcagcttttggattaacaaggacgccgtccctgcaaggaccagccttgggatcaccactgttctgaccatgactacactcagcacaatcgcgcgaaaatcccttccaaaagtctcctatgtgactgctatggacctgttcgtgtctgtttgttttatttttgtgtttagcgccctggtagagtacggcacactgcattacttcgtctcaaataggaaacccagcaaggacaaggacaagaaaaagaaaaacccagcccccaccatagacattagaccaaggtccgcgaccatccaaatgaataatgcgactcatctgcaagagcgtgatgaagagtacggatatgaatgtctcgacggcaaggattgtgcaagcttcttctgttgctttgaagattgtaggaccggtgcttggaggcatggcagaatacacatcagaatcgccaagatggattcgtatgcacgaatattctttcctactgccttctgtctgtttaatctcgtctattgggtgtcttatctttatctgtag

SEQ ID NO: 118065 - DNA, 1119 bp, Artificial Sequence
  Description of Artificial Sequence: Synthetic coding sequence
atgtatgtcaattctattggtcccgtcaacgcaataaatatggaatacaccatcgacattttcttcgctcaaacatggtacgaccgcagactgaagttcaatagcacaatcaaggtgttgcggcttaactctaacatggtgggcaagatttggatccccgacacattcttcagaaactcgaagaaggccgacgcccattggataacaacacctaatagaatgctgaggatatggaacgatgggcgcgtgctgtataccctgagactgactattgatgcagaatgccagttgcagcttcacaacttccctatggacgaacattcttgccccctcgagttctctagctacggatacccaagagaagagatcgtgtaccaatggaaaagaagttccgtggaggtcggcgacaccagatcctggagactgtatcagttcagttttgtgggcctgcgtaatactaccgaggttgtgaaaacgaccagcggagactacgtagtaatgagtgtctacttcgacctttccaggcgcatgggatacttcactatccaaacatacatcccttgcacgctgatcgtcgttctcagttgggttagcttctggataaataaggacgctgtgcccgccaggactagtttgggaatcactactgtactgacaatgaccacgctatccacaatcgccaggaagtctctgcctaaggtgtcgtatgtcacagctatggatctgttcgtgagcgtctgtttcatctttgtttttagtgcgctcgtcgaatacggcactttgcattacttcgtttccaataggaaaccctcaaaagataaggataagaagaaaaagaacccggcccccactatagatatcaggcctagatctgccaccattcagatgaataacgccacgcacttacaggaacgcgacgaggaatacggctacgagtgcctggatggcaaggactgcgcctccttcttttgctgttttgaagactgtcgcacgggggcatggcgacacgggcgtattcacattcgaattgctaaaatggacagctatgccagaatattcttcccaacagctttttgtctgtttaatctcgtttactgggtgtcgtatctctacctatag

SEQ ID NO: 118066 - DNA, 1404 bp, Artificial Sequence
  Description of Artificial Sequence: Synthetic coding sequence
atggcacctaaattgttacttctactctgcctcttctccgggttgcacgctcggagcaggaaagtggaagaagatgagtatgaagactcatcatcgaatcagaagtgggtattggcaccgaagagccaggatactgacgttacgctaattttgaacaaactcttgagggagtacgacaaaaaattgaggccagatatcgggattaaaccgacagtaatcgacgtcgatatctatgttaattccattggcccagtctctagcatcaatatggagtatcaaatagacattttcttcgcgcagacttggacggattcgcgattaaggtttaattccacgatgaaaatacttaccctgaatagcaacatggtgggcctcatatggattcccgacacaatctttcggaatagcaaaaccgctgaggcccattggattacaactcctaaccagctgctgcggatctggaacgacggcaagatcttatacacgttgagactgacaatcaatgcagaatgtcagctgcagctacacaatttccctatggatgaacacagttgccccctgatcttctcaagctatggctaccccaaagaagagatgatctatcggtggcgcaagaactcggtggaagcagctgaccagaaaagctggcggctttatcaattcgattttatgggtctccgaaataccactgagattgtgacaacaagtgccggcgattacgtagtcatgacaatctacttcgagttgtcccgacgaatgggttacttcacaatccaaacatatatcccttgcatactcaccgttgtactgtcatgggtttcattttggattaagaaggacgcaacccctgccaggaccgcactcggcatcaccacagtgctcacaatgactaccctgtccacaatcgctcgcaaaagcctgccccgcgtttcgtacgtgaccgcgatggacctgtttgttacagtgtgcttcctttttgtgtttgccgctctgatggagtacgcaaccttaaactactacagcagctgcaggaagcctactactactaaaaagaccacctcactgcttcatccagatagttccaggtggatcccagaacgtatttctctccaggcaccatcaaattattctctgctggacatgagaccgccaccaacggctatgatcactttgaacaattcagtgtattggcaggagtttgaagatacctgcgtgtatgagtgtctcgacggcaaggattgtcaaagtttcttctgctgctatgaagagtgcaagagcgggagctggagaaaagggagaatacacattgacatcttagagctggactcatactctagggtcttttttccaacaagtttcctgttattcaacctggtgtactgggttggttatctttacctttag

SEQ ID NO: 118067 - DNA, 1323 bp, Artificial Sequence
  Description of Artificial Sequence: Synthetic coding sequence
atgaattactcactgcatctcgcattcgtgtgtttgagtttgtttacggaacgtatgtgtatccaaggatcccaatttaacgtcgaagtggggagatctgacaaactctctctcccaggattcgagaatctcaccgctgggtataacaagttcctgagacccaatttcgggggcgagccagtgcagattgccctaacactcgacattgcgagcatttcatccatatctgagagtaacatggactataccgcaacaatttatctcagacagcgctggatggaccagcggctcgtgttcgaggggaataagagtttcacactggacgctcgcttggtggagttcctctgggtgccagacacatatattgtggaaagcaaaaagagcttcctgcatgaagtgactgtgggtaatagactaatccgcctattctcaaacggtaccgtactgtacgccttacgcatcacgacgaccgttgcgtgcaatatggatttatccaagtaccctatggacacccagacctgtaagcttcagctggagagttggggctatgacggcaacgatgtagaattcacttggctccgagggaacgattccgtgcggggcctggagcatttacgtctggctcaatacaccatcgagagatatttcacgctcgtaactcggagccagcaagaaacaggcaattacacccggcttgttcttcaattcgaactgcggcgaaatgtgttatatttcatacttgagacgtacgtccccagtacattcctggttgtcttgagttgggtgagcttttggatctcactagactcggtaccagcacggacatgcataggagtcacaactgttctgtccatgacaaccctcatgatcggctcgcggacatccctacctaacactaactgtttcattaaagccatcgacgtgtatctcggcatatgtttttctttcgtctttggggcgctactggagtacgccgtggcacattactcttcgcttcagcagatggccgctaaggacagagggacaactaaggaggttgaggaggtgtctataactaacattattaacagcagcattagttcgttcaagagaaaaatctcctttgcctccatcgaaatttcgtccgacaacgtggactactctgacctgaccatgaagactagcgacaaatttaagtttgtctttcgtgaaaagatgggcagaattgtggactattttactattcaaaaccctagcaatgtagatcactatagtaaattgctgtttccgctgatttttatgctggccaatgtcttttactgggcctattacatgtatttttag

SEQ ID NO: 118068 - DNA, 159 bp, Artificial Sequence
  Description of Artificial Sequence: Synthetic coding sequence
atgaattattcgttacacttggcttttgtttgtctgtccttgttcacagaaagaatgtgcatccaaggaagccaatttaatgttgaggtcggaaggtctgataagttaagcctacccgggttcgagaatttgaccgccggttataacaaattcctctag

SEQ ID NO: 118069 - DNA, 1323 bp, Artificial Sequence
  Description of Artificial Sequence: Synthetic coding sequence
atgaactattccctgcatctggcctttgtatgcctgtctctatttaccgaacgcatgtgcattcagggatcacagttcaacgtggaagtaggcagatccgataaactttctttaccgggtttcgagaacctgaccgctgggtataacaagttccttcgcccgaattttggcggcgagcccgttcagattgccctgaccctagatatcgcatctatcagctctatcagtgaatcgaatatggactatacagcaactatttatctgcgccaaaggtggatggaccagcggttggtgttcgaagggaataagagtttcacactggacgcccgactggtggagttcctgtgggttcctgatacctacatcgttgagagtaaaaaatctttcctacacgaagtcaccgtgggcaaccggctgataaggctcttttcgaatgggacagtcctttacgccctgagaatcactacaaccgtggcatgtaatatggatctcagcaaatatccgatggatacccagacctgcaagctgcagctcgagtcctggggttacgacgggaatgatgtggagtttacttggctccgcgggaacgatagcgtgcgcggactcgagcatctgcgtcttgctcagtacactattgagaggtactttacattggtcaccagaagccagcaagagactgggaattacacaagactggtgctccagtttgaacttcggcgcaacgtgctgtatttcatattagaaacttatgtgccctcaactttcctggtagtgctgagctgggtcagcttctggatctccctggacagtgttccagcgcgcacatgcattggagtgacaacagttctctctatgaccactctgatgatcggatcacgaacaagcctccctaacacaaactgcttcattaaggcaatcgacgtttatctgggcatctgcttctcattcgtttttggtgcactgctggagtatgcagtcgcccactattcatctttgcagcagatggcagcaaaagaccgaggaaccaccaaagaagtggaggaggtctcaatcaccaatatcattaatagtagtataagttccttcaagaggaagatcagtttcgccagcattgaaatcagttctgataacgtcgattacagtgatctgacgatgaaaaccagcgataaatttaagtttgtttttagagaaaaaatgggccgtatcgtggactatttcaccatccaaaatccgagtaacgtggaccactactcaaaacttctgtttccccttatcttcatgctggctaatgtcttttattgggcatactatatgtatttctag

SEQ ID NO: 118070 - DNA, 180 bp, Artificial Sequence
  Description of Artificial Sequence: Synthetic coding sequence
atgaactattcacttcacctcgcctttgtgtgtctctctctattcactgaacgtatgtgtatccagggatctcagtttaatgttgaagtcggcagaagtgacaagctgtcccttccagggttcgagaatttgacagcaggttataacaagttcttgcgcccaaacttcggtggtgaatag

SEQ ID NO: 118071 - DNA, 279 bp, Artificial Sequence
  Description of Artificial Sequence: Synthetic coding sequence
atgaattattcactccatctggcttttgtctgcctgtccctcttcacggaacgcatgtgcatccaaggatcccagtttaatgtggaggtagggagatcagataagctcagcttacctggattcgaaaacctaacagcagggtataataagtttcttcgtcccaactttggaggtgagcctgtgcagattgcactcactttggacatcgcaagtatctcctccattagtgaatccaacatggactataccgccactatctatctgagacagcgctggtag

SEQ ID NO: 118072 - DNA, 516 bp, Artificial Sequence
  Description of Artificial Sequence: Synthetic coding sequence
atgaattatagcttgcacctggctttcgtgtgtctgtcactctttacagaacgcatgtgcatccaggggtcccagtttaatgtcgaagtgggaaggtcggataagctgtccctgcctggattcgagaatctgaccgcggggtataataaatttctgcgcccaaactttggcggggaacccgtccagatcgctctgactctggacattgctagtattagttccatctctgagagtaacatggattatacagcaactatttacctgagacagcggtggatggaccagcggctcgttttcgagggcaacaagtccttcacacttgacgcccggctagtcgaatttctgtgggtgcctgacacatatattgttgagagcaagaagtctttcctgcatgaggtgactgtcgggaacaggctcatccgtctgttctcaaatggtaccgttctttacgccctgagaattacaacaactgtggcctgcaacatggacttgtcaaagtacccaatggacacgtag

SEQ ID NO: 118073 - DNA, 570 bp, Artificial Sequence
  Description of Artificial Sequence: Synthetic coding sequence
atgaattacagcctccatttggctttcgtctgtttaagcctcttcaccgaacggatgtgtatccaaggttctcaattcaacgtggaagtgggacgtagcgacaaactcagcttacccggctttgaaaacctgacggcagggtacaacaagtttctgagacccaactttgggggcgagccagtgcagatagccctgacgctggacatagcaagtataagctcaatttctgagtctaatatggactacaccgctaccatatatttacgtcagcggtggatggatcaacggttggtattcgagggcaataagtctttcactctagacgctaggctcgtggagttcctgtgggttcccgatacttacatcgtggaatccaaaaagtcttttctgcatgaagtgaccgtgggaaataggcttattcggctgtttagtaatggtacagtcctatacgctttgcgaattacaaccaccgtcgcctgcaacatggatctgagcaaatatccaatggatacgcagacctgcaaattacaactcgagtcttggggttatgatgggaatgatgtggagtag

SEQ ID NO: 118074 - DNA, 564 bp, Artificial Sequence
  Description of Artificial Sequence: Synthetic coding sequence
atggattataccgctacaatttacctccggcaacggtggatggaccaaaggctggtgtttgagggtaacaagtccttcaccctggacgaagtgacggtggggaatagattgatacgcctattctctaacgggacggtcctgtacgccttgaggatcaccactaccgtagcctgcaatatggacttatctaaatatcccatggacactcagacctgcaagctgcaattggagagttgggggtatgatggtaatgatgttgaattcacttggttacggggaaatgactccgttaggggcctcgaacacttacgacttgctcagtacaccatcgaacggtatttcaccttagtcactagatcgcaacaggagaccggaaactacactaggctcgtgctccaattcgagctgagacgcaatgtactctattttatcctggaaacctatgttccttccacctttctggtggtactctcgtgggtgtctttttggatttcacttgattctgtgcctgcccggacctgtatcggtgataataagggaagtcgacgatctcaatactattag

SEQ ID NO: 118075 - DNA, 2826 bp, Artificial Sequence
  Description of Artificial Sequence: Synthetic coding sequence
atggcctccccaaggtcctctggacagcccggcccgcccccgccaccaccccctccacctgcacgtctgctgcttctgctgctgctaccacttctcctcccgctggcccccggggcttggggttgggctcggggcgctccacggcctccaccttcctccccacctctcagcattatgggactgatgcctctgaccaaggaggttgcaaaagggtcaatcggacggggcgtgctgcctgccgttgagctggctatcgagcagattcgcaacgagtcactgctgcggccatacttcctcgatttacggctgtacgacaccgagtgtgacaatgcaaaggggttaaaagccttttatgatgcgatcaaatatggaccaaatcatctgatggtgttcggaggtgtgtgtccaagcgtgacctctatcatcgccgagagtttacagggttggaatctggtccagttgtcttttgcagccaccaccccagttctcgctgataagaaaaaatacccttacttctttagaactgtgccttccgacaatgccgtaaaccctgccatcctgaaactactaaagcactaccagtggaaacgagtgggaactctaacccaagatgtgcagcggtttagcgaggtaagaaacgatctgacaggtgtgctgtacggtgaggatattgagatctcagacactgaaagcttttctaatgacccttgtacaagcgttaaaaagctgaagggtaacgacgtgagaatcattttgggacagttcgaccagaatatggctgccaaggttttctgctgtgcttacgaggagaacatgtatggctccaaatatcagtggatcatacctggttggtacgaaccttcctggtgggagcaggttcacaccgaagccaacagctcacggtgcttacgcaaaaatctccttgcagccatggagggctacattggggttgacttcgagccactgtcaagtaagcagattaagaccatatccggtaaaaccccgcaacagtacgagagagagtataacaacaaaagatccggggtgggcccttctaagttccacggctacgcctacgacggcatctgggtgatcgctaagaccctacagcgtgctatggagacacttcatgcctcctcacggcaccaacggatccaggactttaattacacagatcatacactcggaaggattatccttaacgctatgaacgagacaaacttcttcggggtgaccggacaggtggtctttcggaatggcgaacgcatggggaccatcaagtttacccaatttcaagattcccgcgaggtgaaagtgggcgaatacaacgcagtcgcagatacactcgaaatcattaacgacaccattcgctttcagggctccgaacccccgaaggacaagaccatcatccttgaacagctccgcaaaattagtctccccctgtattctatcctctctgccctgactatactaggcatgatcatggcgagcgccttcctgttctttaacattaagaataggaaccagaagctaatcaagatgagctctccatatatgaacaatctcatcatcttgggcgggatgctttcgtacgccagcatcttcctgtttgggctcgacggttctttcgtctctgaaaagactttcgagaccctgtgcacagtgcggacatggatactcaccgttggatatacaacagcctttggcgccatgttcgccaagacttggagggtccacgctatcttcaaaaacgtcaaaatgaaaaagaaaattattaaagatcagaaactcctcgttattgtggggggtatgctgctcatcgatctttgtatcctcatttgctggcaggccgtggacccgctgagaaggaccgtcgagaagtactccatggaaccagatcctgccgggcgggacatttcaataagacctctcttggagcattgtgaaaacacccatatgacaatttggctaggtatagtttacgcatacaagggcctcctgatgctgttcggatgttttctggcatgggagacgcgcaatgtcagcatccctgccctgaatgattcgaaatatataggtatgagtgtctacaatgtgggcatcatgtgtattattggcgccgctgtttcatttcttactcgagatcagccaaatgtgcagttttgcatcgtggctttagttatcatcttctgttccacaatcaccttatgtctagtttttgtccccaaactgatcactcttcgcaccaatcccgacgcagccacccaaaatcgcagatttcaattcactcaaaaccagaagaaggaggatagcaaaactagtacatcagttacatccgtgaaccaggccagcacatcccgcctggagggccttcaatccgagaatcatcggcttagaatgaaaatcacagaattggacaaagacctggaggaggtgaccatgcagctgcaggacacaccagagaaaaccacttacatcaagcagaatcactatcaagaactgaacgacatcctgaatttgggcaattttactgagtcaactgacggaggcaaggctatactgaagaaccaccttgaccagaacccacagctacagtggaacacaacggagccgtcccggacttgcaaggaccccattgaggacatcaatagtcctgagcatattcagcgtaggctatcactccagctgcccatcctgcaccacgcctatctgccctccataggaggggtggacgcaagctgcgtctccccttgtgtgtccccaacagcttccccgaggcacagacacgtgcccccgtcatttagagtgatggtttccggcttatag

SEQ ID NO: 118076 - DNA, 1179 bp, Artificial Sequence
  Description of Artificial Sequence: Synthetic coding sequence
atgcggcctggcttcgggggtcccgccatccccgtcggggtggacgtgcaagtggagagtctggatagtatatctgaagtagacatggacttcaccatgaccttgtatctgagacattattggaaagacgaacggctgtctttcccctccaccaacaatctgagtatgacgtttgacggcagactagttaagaagatttgggtaccagacatgtttttcgtccactctaaacgatcatttattcatgacaccaccacagataacgtaatgctgagagtccagccagacggcaaggtgctgtattctctgagggtgaccgtcaccgctatgtgtaatatggacttttccaggtttcctctcgacacacagacatgtagcctggaaatcgaaagttacgcttatacagaggatgatctgatgttgtactggaagaaggggaacgactccctcaagacagatgagaggatatcgctgagtcagtttcttattcaggaattccatactacaacaaaactggctttttacagctctacagggtggtacaatcgcctgtatatcaactttacactccgacgccacatttttttctttcttttgcaaacctattttcctgccacattgatggtaatgctttcctgggttagtttctggatcgataggcgcgcagtgccagcacgggtcccattaggaatcaccaccgtgctgacaatgtccaccatcattacaggcgtgaacgcatccatgccgagagtgtcttatataaaggctgtcgacatctacctatgggtcagtttcgtgttcgtgtttttgagtgttctggagtacgccgccgttaattatctaacgacagtacaagagcgaaaggagcagaagctcagagaaaaacttccatgtacttctgggttgccaccccctagaacagccatgcttgatgggaactattcagatggcgaggtgaatgatctggataattacatgccagagaacggcgagaaaccagaccgcatgatggttcagctaaccctcgcctcagagaggagctctccacaacgaaagagccaaagatcttcatatgtttctatgcgcattgacacgcatgccatcgataaatattcaaggatcatatttcccgccgcctacatcctgttcaacttgatctattggtctattttcagctag

SEQ ID NO: 118077 - DNA, 1389 bp, Artificial Sequence
  Description of Artificial Sequence: Synthetic coding sequence
atgctggctgtgcctaatatgcgcttcggaatattcttgctctggtggggctgggtgcttgcgaccgagtctcgcatgcattggcccggaagagaagttcatgagatgagtaaaaagggcagccccattcttagaaggtcccccgatattacaaaatcccccctgaccaaaagcgagcaactgctgcgcatcgatgatcacgatttctcaatgcgaccgggattcggcggccccgctattcctgtgggcgttgatgtccaggtggagagcctggactctatttcggaggtcgacatggacttcactatgacgctttaccttaggcactactggaaggatgaaaggctgtcatttccttctactaataatctgtcaatgacattcgacgggagactggtgaagaaaatctgggtcccggacatgtttttcgttcatagtaagcgctcctttatccatgatacaactactgataatgtcatgttaagggtgcaaccggatgggaaagtgctctactccctccgggtaaccgtgacagccatgtgtaacatggacttctcccgattcccccttgacacacagacctgttccctggaaatcgaaagctacgcttacaccgaggacgacctcatgctctactggaaaaagggtaacgacagtttaaaaacagatgagaggatcagtctgtcgcaattcttgattcaggagttccatactactaccaaactagccttctacagcagcaccggttggtataaccgcctttacataaacttcactttgcggcggcatatattctttttcctgctccaaacatatttcccagctactttgatggtcatgctgtcctgggtgtccttttggattgacagacgggcggtcccggcacgcgtgcccttgggcattaccacagtgctgaccatgtccactatcatcaccggggtcaatgcttctatgcctcgggtcagttacatcaaagctgtcgatatctatctgtgggtgagcttcgtctttgtcttcctttcagtgttggaatacgccgctgttaactacctcaccaccgtgcaggaaagaaaagaacaaaaacttagagagaagctgccctgtaccagcggactgccacctccccggactgccatgctagatggaaactactctgacggggaggtgaatgacttggataattacatgcccgagaacggtgagaaaccagaccggatgatggtgcagttgactctagctagcgaaagaagctccccccaacgtaagtcccagagaagctcatacgtgtccatgaggatcgacacccatgcgatcgataagtattccagaattattttccccgccgcctatatcctgtttaatctgatctattggtccatttttagttag

SEQ ID NO: 118078 - DNA, 1179 bp, Artificial Sequence
  Description of Artificial Sequence: Synthetic coding sequence
atgcgcccgggattcggagggcctgcgatacctgtgggggtcgatgtacaggtggaaagtctggactctataagtgaggtggatatggattttacaatgacgctgtacttgcgtcattattggaaggatgagagattgagctttcctagtaccaacaacctgagcatgaccttcgatggccgcctcgttaagaagatttgggtacccgatatgttttttgtgcatagcaaacgctcctttatccacgatacaactacagacaatgttatgctgagagttcagccagatggcaaggtgttgtattcgctgcgggtgacagtcactgccatgtgcaacatggacttttcaagattcccactggacacgcagacatgcagccttgagatagagagttacgcttacacagaagatgacctgatgctgtactggaagaaaggcaatgattctctcaagacagacgagcggattagtctgagccagttccttatacaggagttccacacgacgactaaactggctttctatagctcgacaggatggtataacaggctgtatataaactttacactgcgccgtcatatcttctttttcctactgcagacttattttcccgctacccttatggtgatgctgtcgtgggtatctttttggatcgatagacgtgccgtccctgcacgcgtgccacttgggatcacaactgtgctaaccatgagtacaattattactggagtgaacgcaagcatgcctagagtgtcctacatcaaagctgtcgacatttatctctgggtgtcgtttgttttcgtgttcctgagcgtcctggagtacgctgcagttaattatctgactacggtgcaggaacgtaaagagcagaaattgcgcgaaaaattgccctgtacaagtggtctcccccccccgaggaccgccatgcttgacgggaattactccgatggcgaggtgaacgacctggacaactatatgcctgagaatggggaaaagcccgatcgcatgatggtacaattgaccttggccagcgagagatccagcccccagagaaagagtcaaaggagttcttatgtgtctatgcgcattgacacccatgccatcgacaaatacagcaggatcatctttcccgcagcctatatattatttaacctcatttactggagcatcttcagttag

SEQ ID NO: 118079 - DNA, 1440 bp, Artificial Sequence
  Description of Artificial Sequence: Synthetic coding sequence
atgctggccgtgccaaacatgcggtttggtattttcttgctgtggtgggggtgggtgctggctacagagtctaggatgcactggcccgggcgcgaagtgcacgagatgtcaaaaaagggtcgtcctcagcgccagagaagagaggtgcatgaggacgcacacaagcaggtgtctcccatcctgcggaggagtcccgacatcacaaagtcgcctttaacaaaaagcgagcagttattacggatcgatgaccatgacttctccatgaggccgggctttggcggaccagctatcccagtgggagttgatgttcaggtggagtccttggactcgatatcagaggtggatatggatttcacgatgaccctgtacttgcgccactattggaaggacgagcggctgtccttcccaagcactaataatctgagcatgacctttgacggccgcttagtgaagaagatctgggtgcctgatatgttttttgtccactctaaacggtcattcatccacgatacaaccacagataatgtgatgctccgggttcaacctgacggaaaggtgctgtactcccttcgtgtgacggtaacggccatgtgtaacatggacttctcccgctttcctctggacacacagacatgcagccttgaaatagagtcttacgcctatactgaggatgacttaatgctctactggaagaagggcaacgatagtctgaaaacggatgagcgaatctcattatctcagttcctgatccaggagtttcacacgactaccaagctggccttttacagctcaacggggtggtacaatcgattgtacatcaacttcaccctccgaaggcatattttcttctttcttctgcagacatatttcccggctaccctgatggtgatgttatcctgggtgagcttttggattgaccggcgtgcagttccagccagagtacctctcgggattactacagtcctgactatgagcaccataatcacaggggttaacgcttctatgccccgtgtgagctatatcaaggccgtagacatatatctgtgggtgagctttgtttttgtgtttcttagcgttttagagtatgccgcagtcaattatcttaccacagtgcaggaacggaaggaacagaaattacgcgagaagctaccctgtacatctggtctccctcccccccggactgccatgctggatggcaattactcagacggtgaagttaacgacttggataactatatgcccgagaatggtgaaaaacccgacagaatgatggtgcagctgactctcgcctcggagagatcctctccccaaagaaagtcgcagagatcctcatatgtctcaatgaggattgatacccatgctattgataaatacagtcgaatcatattccctgcagcatacattctgtttaatttgatctactggagcattttcagttag

SEQ ID NO: 118080 - DNA, 1473 bp, Artificial Sequence
  Description of Artificial Sequence: Synthetic coding sequence
atggtcaagcccggaggaatctgcagtgctaccggctactggaaggcagcattttgtctcacggacgtccacaaaatgccgtacttcacgcgactcatcttatttctgttttgcctgatggtgctggtggagtcaagaaaaccaaagcgaaaacgctggaccgggcaggtagagatgccaaagcccagtcatctgtataagaagaacctcgacgtgaccaagattcgcaaagggaaaccccagcagctcctgcgcgtcgatgagcatgatttcagtatgaggcctgcttttggagggcccgccatccctgtgggcgtggacgtgcaagtagaaagtttagattcaatatctgaagtggatatggatttcacaatgacactctacctccgccactattggaaggacgagagactggcattctcatctgctagtaataagtcaatgacattcgatggtaggctggtgaaaaagatctgggtgccggatgtattcttcgttcattctaagcgttccttcacccatgacaccaccacggacaatattatgctcagggtcttccctgacggacacgtactgtattccatgcggataaccgtgacagcgatgtgtaatatggacttctcgcatttcccactggacagtcagacatgttcattagaactggagtcttatgcgtatactgacgaagacttaatgctttattggaaaaatggcgacgaatctctgaagaccgacgaaaaaatctccctgagccagttcctgattcaaaagtttcacacaacgtctcgtctggctttctacagttccacaggatggtacaacagattgtacatcaatttcaccctgcggcgacacatttttttttttctactgcagacttactttccagcaaccctgatggtaatgctctcctgggttagcttctggatagacagaagagccgtgccagctcgtgtcagtctgggaattactacggttctgactatgaccactataatcacgggggttaacgcgtcaatgccccgggtaagttacgtgaaggccgtggatatctacctctgggtgagcttcgtgtttgtgttccttagtgtgctcgagtacgcagcagtgaattatctcaccaccgtgcaggaaaggaaagaaaggaagctccgcgagaagttcccatgcatgtgtgggatgctgcacagcaaaacaatgatgttggatgggtcctactccgagtccgaagcaaattctctcgctgggtacccccggtcacacattttgacagaagaggagcggcaggacaaaattgtcgtgcatctcggcttaagcggcgaggccaatgccgcccgtaaaaagggattactgaaggggcagaccggttttcgtatctttcagaacacacacgcaatagacaaatactcccgcctgatcttcccagcaagttatattttttttaacctcatctactggtcggtgttcagctag

SEQ ID NO: 118081 - DNA, 453 bp, Artificial Sequence
  Description of Artificial Sequence: Synthetic coding sequence
atgcttcgcgccgctgtcatccttctactcattaggacttggctggcagaaggtaactaccctagtcccatcccgaagtttcactttgagttttctagcgcagtcccagaggtggtgctgaatctatttaactgtaagaactgtgcgaacgaagccgttgtacagaagatcctagaccgggtgttaagtcgttacgatgttcggcttcgtcctaatttcggaggcgtacttgaaactaactccacgtggggcctcaacgacgacgagctaatggcacatggccaggagaaagattcgtcatccgaaagcgaggacagctgccccccttctcctgggtgtagcttcaccgaaggctttagctttgatctgtttaatccggattatgtgcctaaagtggacaagtggtccaggttcttgttcccgctggccttcggtttatttaacatcgtgtag

SEQ ID NO: 118082 - DNA, 1899 bp, Artificial Sequence
  Description of Artificial Sequence: Synthetic coding sequence
atgggtatccggggcatgttacgcgctgcagtgattttgcttcttatcagaacgtggctcgccgaaggcaactatcctagccctatcccaaagtttcacttcgagtttagcagtgctgttcccgaggtcgtcctgaatttgttcaattgcaagaactgtgctaacgaagccgtggtacagaaaattctggatagagtcctgtcccgatacgacgtaagacttcgccccaatttcgggggggctcctgtcccagtgcgcatctcaatttacgtgacctccattgagcagattagcgagatgaatatggactacaccatcacaatgtttttccatcagacctggaaagacagccggcttgcttattatgaaacaaccctgaatctgactctagattaccgcatgcacgagaagctgtgggtgccagactgttacttccttaacagcaaagatgcctttgtgcacgacgtaacagtcgaaaacagggtcttccaactgcacccagacggcaccgtacgctacgggattagactgacgacaacggccgcctgtagtctggatctccataaatttccaatggacaagcaggcgtgcaatcttgtcgttgagagttatgggtacactgtcgaagacattatcctgttttgggatgataacgggaacgccattcatatgacagaggagttgcacattccacaattcacattcctgggccgcactatcacatctaaagaggtgtacttttatactggctcatacataaggcttatcttgaaattccaagtgcagagagaagtcaactcttatctggtgcaggtctactggcccaccgtgctgacgaccattaccagctggatctctttttggatgaattacgactcttcagctgccagggttactatcggacttacttctatgctgatactgacaacgatcgacagccacctaagagataaactgccaaacatttcatgtatcaaagccatcgatatctacatcctagtgtgcctgtttttcgtgtttctgtcccttctcgagtatgtgtacatcaattacctgttttacagtaggggcccgaggaggcagccccgtaggcataggaggcctaggcgggtcattgcaaggtataggtaccaacaagtggtggtgggaaacgtgcaggatggcctcattaatgtggaggacggcgtgtcttcactaccgataactccagcccaggcaccccttgcctcacctgagtcattgggcagtctgacttccacatcagaacaggcgcagttagccacctctgagagcctctctcccttgacatcactatcaggccaggctcctctggcgactggagaaagcctgtctgacctcccaagtactagcgaacaagcgcgccattcttacggcgtaaggtttaacgggttccaggctgatgatagcatttttcccactgagatacgtaaccgggtggaagcccacgggcacggggtaacacacgaccacgaagattcgaacgaatcactgtcctccgacgagcgccatggtcacggtccatcgggcaaaccaatgttacatcacggcgaaaagggtgtgcaagaggcagggtgggacctggatgacaacaacgacaaaagtgactgtttagccatcaaggaacagttcaagtgtgacacaaactccacgtggggccttaacgatgacgaactgatggcacatgggcaggagaaagactcctcttccgaatccgaggactcgtgcccaccttctccaggttgttctttcaccgaaggctttagctttgacctctttaacccggactacgtgccaaaggtcgacaaatggagcaggttcttgttccctctggcattcgggctgttcaatattgtatattgggtctaccacatgtactag

SEQ ID NO: 118083 - DNA, 1083 bp, Artificial Sequence
  Description of Artificial Sequence: Synthetic coding sequence
atggatagctcaaactgtaaggtaatcgcgcctttgttgagccagagataccggcgaatggtaacaaaggatggccactccactcttcagatggacggcgcccagcgtggactggcctacctgcgggacgcatggggaatcctgatggatatgagatggaggtggatgatgctcgtattctctgcctcattcgtggttcattggctggttttcgctgtgctgtggtacgtcttagccgaaatgaacggtgatctggagctggaccacgacgccccgcccgagaaccacaccatctgcgtaaaatacatcactagtttcactgccgccttcagtttcagcctggaaacgcagttgaccataggatacgggacaatgttcccgagtggggattgcccttctgctatcgccctgttagccatccagatgctgctgggcctcatgttagaggcttttattacaggcgcatttgtcgctaagatcgccagacccaagaacagagcgtttagcattaggttcacagacactgcagtcgtcgctcacatggacgggaaaccaaatctgattttccaagtagctaatacacgtccatctccattgacctcagttagagtaagcgcggtgctttatcaagagagagagaacggtaaactctaccaaacttctgtggattttcaccttgatggcatctctagcgacgagtgtccattcttcatctttcctctgacctattaccactctataacaccaagctccccattggctaccctcctgcaacacgaaaacccgtcccactttgagctggtggtttttctgagcgctatgcaagaaggaactggcgagatttgccaacgcaggaccagctatttgccgagcgagatcatgctacatcactgctttgcatcgttgttgactcgcggttctaagggcgagtaccagatcaaaatggaaaactttgataaaaccgtgcctgagttccccacaccactcgttagtaaatccccaaatcgaactgatttggatatccacatcaatggtcagtctattgataactttcagatctcggagacagggttgaccgagtag

SEQ ID NO: 118084 - DNA, 2106 bp, Artificial Sequence
  Description of Artificial Sequence: Synthetic coding sequence
atggctgtctcagccggctcggcacggacgagcccctcaagcgggtttctgatggttctggatataccccaggaaagagggctgagtagtctcgacaggaagtacctggatggtcttgatgtgtgccggttcccgctattagacgcattgagaccccttcctttagactggatgtatctggtgtatacaattatgttccttggcgccctgggcatgatgcttgggctgtgctataggataagctgtgttctgtttctccttccctattggtatgtgtttcttctcgacaaaacaagttggaataaccacagttacctttacggcctactggcgttccagttaaccttcatggatgccaatcactactggtcggtagatgggctgctgaacgcccaccggcggaatgcccatgtgccactgtggaattatgcagtgctgcggggtcagattttcatcgtctatttcatcgcaggcgtaaaaaaactggacgcagactgggtggagggctactccatggaatatctgagccggcattggctattttccccttttaaattactcctcagcgaggagcttacctcgctgctggttgtccattggggcggactactgctggacctgtcagcggggttcctgttattcttcgatgtgagcaggtcgattgggctgttcttcgtgtcctacttccactgcatgaactcacaactcttcagcatcggcatgttttcgtacgttatgctggcaagcagccccctgttttgttctcctgaatggcctaggaagctggtgtcctactgtccccgcaggttgcagcagttattgccgttgaaggccgccccccaaccaagtgtgtcttgcgtctacaagcggagccgcggcaaaagcgggcagaagcctggacttagacatcagttaggagctgcctttacgctgctgtacctactggaacagctcttcctgccgtatagtcacttcctgacacaaggttataataactggaccaatggactgtatggatactcttgggacatgatggtgcattcacgttctcaccagcatgtgaagatcacttatcgggacggacggaccggggagttagggtatctcaatccaggagtattcacccaaagtcgccggtggaaagatcacgccgatatgctaaagcagtacgctacctgtctctctaggcttttgccaaagtacaatgtcacagagccacagatttactttgacatttgggtgtccattaacgaccgcttccagcagagaattttcgacccccgggtggatattgttcaggccgcatggagcccttttcagagaacctcctgggtccaacccctgctaatggatcttagcccctggagggccaaactccaagaaataaaatccagtctggacaatcataccgaggtcgtgtttatcgccgactttccgggactccacctcgagaacttcgtttcagaggacctgggcaacaccagtattcagctgctacagggggaggttacggtcgaactagtggcagagcagaaaaatcagacgctgcgggaaggggagaagatgcagctgcccgccggggaatatcacaaagtgtacacaacttcccctagtccttcatgttatatgtacgtatacgtcaatacgacagagctggctctggaacaggatctcgcctatctccaggagctgaaagagaaagtggagaatggatccgagactggtccattgcctcccgaactgcagccactgctcgaaggagaggtgaagggtggccccgaacctacacctctggtacagacctttcttagaagacaacaacggctccaagaaatagagaggcggagaaatacaccatttcacgaaaggttttttagattcctgctgagaaagctgtatgtgttcaggcgcagttttctcatgacttgtattagtctgcggaacctgatcctgggcagacctagcctagagcaactggcccaggaggtaacctacgctaatttaagaccgtttgaggcagtaggagaattaaatccatccaacacagactcctctcactcaaatccacccgaatctaatcctgaccccgttcatagcgaattctag

SEQ ID NO: 118085 - DNA, 957 bp, Artificial Sequence
  Description of Artificial Sequence: Synthetic coding sequence
atggcttcccccggatgtttgctatgtgttctaggcctgctgctctgcggagccgcttccctggagcttagtaggccacacggggatacagctaaaaagcccatcatcggcattcttatgcagaagtgtaggaataaggtcatgaaaaactacgggcggtattatatcgccgcatcttacgtcaaatacctcgaaagcgctggagctagggttgtccctgtgcgccttgacctcactgagaaggattacgaaatcttgtttaagtcaattaacggcatcctttttccaggaggtagcgttgacttacggcgctccgactacgcgaaggtcgcaaagattttctataacttatctatccagtctttcgacgacggagactatttccccgtttgggggacttgtcttggcttcgaggaattgagtctgctgattagcggagaatgtctgctgaccgccacagacaccgtggatgttgctatgcctctgaactttaccggaggacagttgcattcacgaatgttccaaaacttcccaactgagctactgctgtccctggctgtggaaccactgaccgccaacttccataaatggagcctctccgtcaaaaacttcactatgaacgagaagctcaaaaagttttttaatgtgctgaccaccaacaccgatgggaagattgaatttataagtaccatggaagggtacaagtaccccgtgtacggcgtccaatggcaccccgaaaaagccccctatgaatggaagaaccttgatggaatcagccatgcgccaaatgctgtaaagactgctttttatttggcagagttcttcgtgaacgaagctaggaagaataaccaccactttaaatccgaatctgaagaggaaaaagccttgatctatcagttttcaccaatctacacaggaaacatctctagcttccagcaatgttacatctttgactag

SEQ ID NO: 118086 - DNA, 345 bp, Artificial Sequence
  Description of Artificial Sequence: Synthetic coding sequence
atggccaatagcggctgcaaagacgtgaccggcccagacgaggaaagctttctctacttcgcctacggtagcaacctcttaacagagcgaatccatctgcgcaacccgagcgccgcgtttttttgtgtggcacgactgcaggattttaagctcgattttggtaattcccagggcaagacttcacagacttggcatggggggattgcgacaatcttccagtctcccggcgacgaggtttggggggttgtctggaagatgaacaaatccaacctgaatagtctggacgaattattcgcctgggtgcaaaaaaagatggtctgtaggtggtccatcaaaagaagttag

SEQ ID NO: 118087 - DNA, 567 bp, Artificial Sequence
  Description of Artificial Sequence: Synthetic coding sequence
atggctaacagcgggtgcaaggatgttaccggaccagatgaagagtcttttttgtacttcgcttatgggagcaatctcctgaccgagcgaatccacttacgaaatccaagcgctgcatttttttgcgtcgcgcggctccaggatttcaagttggactttggaaactctcagggaaagacctcgcagacctggcacggtggtatcgccaccatattccagagccctggagacgaagtctggggagtagtgtggaaaatgaacaaaagtaatcttaactccctggacgaacaggagggtgtcaaaagcggaatgtatgtagtcattgaggtgaaggtggcaacacaggagggcaaagagatcacctgtcgatcttacttgatgacaaattatgagtccgctcctcctagcccacagtataaaaagattatctgcatgggggcaaaagagaacggcctccctcttgaatatcaggaaaagcttaaggccattgagcccaacgactacacaggtaaggtttccgaagagatcgaagacattattaagaaaggggaaacccagaccttatag

SEQ ID NO: 118088 - DNA, 384 bp, Artificial Sequence
  Description of Artificial Sequence: Synthetic coding sequence
atgttcaacccgatccaccatttggactactataaaaagacccttccttctgaactgaactggttggggcagatgtggttgaaatttgggtgctctggtttccgccaggagggtgtgaaaagcggtatgtatgttgttatcgaggtgaaagttgcaacacaggaaggaaaggagattacttgtcgttcatatctgatgacaaattacgagtccgcccccccctcccctcaatataagaagatcatatgcatgggtgccaaggagaatggcctgcccctggagtaccaagagaagttaaaggcgatcgagccaaacgactacacaggtaaggtttccgaggaaatagaagacatcatcaaaaagggagaaacgcaaacgctctag

SEQ ID NO: 118089 - DNA, 285 bp, Artificial Sequence
  Description of Artificial Sequence: Synthetic coding sequence
atggccaacagcggatgtaaggacgtaacaggcccggatgaggagagctttctgtattttgcttacggctccaacctgttgaccgaacggattcaccttaggaatcccagtgctgctttcttctgcgtggcccgcttgcagatcatttgcatgggggctaaggaaaatggtctgcctcttgaatatcaggaaaaactcaaggctatagagcctaacgactataccgggaaggtatctgaggagatagaggacataatcaaaaaaggggagacccagaccctctag

SEQ ID NO: 118090 - DNA, 501 bp, Artificial Sequence
  Description of Artificial Sequence: Synthetic coding sequence
atggccaactccggatgtaaagacgtaactgggccagatgaggaatccttcctgtattttgcctatgggtcgaatcttctgacagaacggatccacctcaggaacccctccgcggcatttttttgcgtggcccgcttgcaggactttaaactggattttggcaattcgcaggggaagaccagccaaacgtggcatggtggaatcgcaactatctttcagtcccctggtgacgaagtttggggcgttgtctggaagatgaataagtctaacctgaacagcttggatgaatggagaaagaagaggcacactgctttccaaaatcagggaaatcatccctgtaagcacaagacaaggatgtgggaccgcgatcctaagatcccggtgcagaacttatccctggccttatgttggcaggcgcaatcagggcatggaacttgcaatcgcttattcgcttgggtgcaaaaaaagatggtttgcagatggtctattaagcgatcctag

SEQ ID NO: 118091 - DNA, 1710 bp, Artificial Sequence
  Description of Artificial Sequence: Synthetic coding sequence
atgaagaagaaacttgtcgtgctcggattactggccgtggtgctggtgctggtgattgtcggcctatgcctgtggctgccatctgcctctaaagaaccagataatcatgtatacacaagagccgcagttgccgccgatgctaaacagtgctcaaaaataggtcgggatgcactgcgggatggcggcagcgccgtcgatgctgccattgccgcactgctttgcgtgggtttaatgaacgcacactccatggggatcggtggtggccttttccttacaatctacaacagcacaactagaaaggcagaagtaattaacgcccgggaagtggcacctcggctggcatttgcaactatgttcaattcctccgagcaatcacagaagggggggctgtcggttgccgtgccaggggagatcaggggctacgagctggctcaccagaggcacgggaggctgccttgggcaaggctttttcagccatcgatacaattagcacgtcagggtttccctgtgggcaagggtttagccgcggccctggagaacaaaaggaccgtcatcgagcagcagcctgtcctgtgcgaagtattctgccgggaccggaaagtgctgcgagaaggtgagaggttgaccctgccccagcttgcagacacctatgagacattggctatagagggtgcccaggctttctacaacggatcattgactgcgcagatagtcaaggatatccaagcagctggcggaatcgtgacagctgaagatctcaataattaccgtgccgagttaatcgaacacccccttaatatctccctcggagacgtcgtcctgtatatgccttcggctcccctgagcggtccagttttggcgttgatcctaaatattctgaaaggctataatttttcccgagaatctgttgagtcaccggaacagaagggtttgacgtaccataggattgtcgaggcattcaggtttgcttacgctaagcgcaccctgctgggagaccccaaatttgtcgacgtgaccgaggtcgtgaggaacatgacctccgaattttttgccgcgcagttgcgcgcccaaatttcggacgacacaactcatcctatctcatactacaagccagagttttacaccccagacgatggcggcaccgcccatcttagcgttgtcgctgaggatggcagcgctgtgagcgccacttccacaatcaacctgtatttcggctcaaaagtgcggtctccagtaagtggcatcctctttaataatgaaatggacgacttctcaagcccgagcataacaaacgaattcggagttccccccagccccgcaaattttatacagccggggaagcagccactctccagcatgtgccctacaatcatggtcggacaggacggacaggtgcgtatggttgtcggagccgctggcggaacacagattactacggcaactgccttagccatcatctataatctgtggtttggatacgacgtcaaaagggccgtcgaggagccccggcttcacaatcaactcctgcccaacgtgaccacggtcgaacgaaacattgatcaagcggtgactgctgcactcgagacccgacatcatcacacccaaattgcttcgacgttcattgctgtggtgcaggccatcgtcagaaccgccggcggatgggccgcagcctctgattcacggaaaggaggggagcccgccggctactag

SEQ ID NO: 118092 - DNA, 1710 bp, Artificial Sequence
  Description of Artificial Sequence: Synthetic coding sequence
atgaaaaagaaactagtcgtcctgggccttctcgctgtggttcttgtcctcgtgattgtgggactgtgcttatggctcccaagtgcatcaaaagagccagataaccacgtatatactagggcagccgtagcggccgatgcaaaacaatgttctaaaatcggccgagacgccctgcgtgacggcggctcggccgtcgatgccgcaatcgccgctttgctatgtgtgggcctgatgaacgctcactccatgggaattggggggggtctgttcttgaccatatacaattctacaacaaggaaagctgaagttatcaacgcacgcgaagtcgctccaagactcgccttcgcaacaatgtttaacagttcagaacagtcgcagaaaggcggactttccgtcgccgtccccggggagatacgcgggtacgagctggcccatcagaggcacggaagactgccttgggcacgtctttttcagccatcaatccaactcgccaggcaggggttccctgtgggcaagggcctggcggcggcactggaaaacaaacggaccgtgatcgaacagcaaccagtcctgtgtgaagtcttctgtcgggatagaaaggtgttgcgtgagggagaacgattgaccctgcctcagcttgccgacacctatgaaacattggctatcgaaggcgcgcaagcattttataacggcagtttaactgcacagatcgtgaaggacattcaggctgctggaggaatcgtgaccgcagaggatctgaataactatagagcggaactgatcgagcaccccctcaacatcagcctgggtgatgttgtcctatatatgccgagcgcgcctctgtctgggccagtgctcgcactcatcctgaacattctcaaaggctacaacttctcacgagaaagcgtggaatcaccagagcagaagggcttgacctatcacaggattgtcgaagcctttcggtttgcctatgccaagcgtaccctgctgggggaccccaagttcgtggatgtgacagaagtggtccggaatatgacgagcgagttttttgccgcacagttaagggctcaaatttcagatgatactactcaccccatatcttactacaagcctgaattttacacccctgatgatggcgggacagcccatcttagcgttgtcgccgaagacggttctgctgtatcagctacttcaaccatcaatctgtatttcggatccaaggtgaggagccccgtgagtgggattctcttcaataacgaaatggacgatttcagtagcccaagcattacaaacgagtttggagttcccccttctccagcgaactttatccagccaggcaagcagccactttcaagcatgtgccccaccattatggtgggacaggacgggcaagtacgtatggtggttggcgctgctggagggacccagatcaccaccgcaaccgctctcgccataatttataacctgtggtttgggtacgacgtcaagcgggctgtggaagagcccagattgcataaccaactgctccccaacgtgactacggtggagcggaacatagaccaggccgtcaccgccgcgctagaaacaagacaccaccatactcagatagcatcaaccttcatagccgtggtgcaggccatcgtaaggaccgccggtggatgggccgcggccagcgatagccgcaaaggaggggagccggccggatattag

SEQ ID NO: 118093 - DNA, 1710 bp, Artificial Sequence
  Description of Artificial Sequence: Synthetic coding sequence
atgaagaagaagttggtcgtactaggactgcttgccgtagtgctcgtgcttgttatagtagggctttgcctctggctgccatccgccagcaaagaacctgacaaccacgtttatacacgcgcggccgtcgcggccgatgcgaagcagtgttccaagattggcagggatgccttgcgggatggtgggtctgccgtcgacgccgccatcgcagccctgctctgcgtaggcctgatgaatgcccattcaatgggaattggtggagggttattcctgaccatctataatagcacaacccggaaggctgaagtgatcaatgcccgggaggtagctcctcgcctcgcattcgcaacgatgtttaatagctctgagcagagccagaagggtggactgagtgtggcagtacccggcgagatacgaggatacgaactggctcatcaacgacatggtcggctgccatgggcccggcttttccagccaagtatccagctggcccggcaggggttcccagttggtaaggggctggctgctgcgcttgagaacaagagaaccgtaattgaacagcagcctgtcctgtgcgaagttttctgtcgggacagaaaagtcctcagagaaggggagcggcttaccttaccccaactggccgacacttacgagactttggccattgaaggcgcccaggccttttacaatggtagtctgaccgctcagattgtaaaggatatccaggccgccggcggaatcgtcactgctgaggacctgaacaattaccgggcagaactgatcgaacatcctctgaatattagcctcggagacgtggtactttacatgcccagtgcacctttgtcagggcccgtgttggcactcatcctaaatattttaaaaggttataatttcagtcgggagtccgttgaatcgcccgaacagaagggactcacttaccataggattgtggaggctttccgattcgcgtatgcaaaacgcactcttctcggcgaccccaaatttgtcgacgtcactgaggtggtaagaaatatgacgtccgagttcttcgcggctcagctgcgggcccaaatcagtgatgacacaactcatcctatctcctattacaaaccagaattttatacacctgacgacggcggaacagcacatctctcagtggtggccgaggacggatctgcggtctctgctacttctaccatcaacctgtactttggaagcaaggtgcgttcccccgtctctggcatcctgttcaacaacgaaatggatgatttcagcagcccctcaatcaccaacgagtttggcgtccctccctctcctgctaactttatccagcctggaaaacaaccattaagtagcatgtgtcccaccattatggttggccaggatggacaagtgcgcatggttgtgggtgctgccggcggcacacagataacaaccgcaactgccctcgccatcatatacaatctctggttcggttacgacgtgaaacgcgcggtggaggagcctcgtttgcataatcaacttttgcctaatgtaactactgtggagagaaatattgaccaggcagtaaccgccgcactagagacacgacaccaccatacacaaatagcctcgactttcatcgctgtcgtacaagcaatcgtcagaactgccgggggctgggccgccgcatccgattcccgaaagggaggtgagccagctggctattag

SEQ ID NO: 118094 - DNA, 1710 bp, Artificial Sequence
  Description of Artificial Sequence: Synthetic coding sequence
atgaaaaagaagttggtggttttaggactattggcagtggtgctggtgctagtgatagttggcctttgcctctggctcccctccgcgtctaaggagcctgataaccacgtctacacaagagctgcggttgctgccgacgccaagcaatgttctaagattgggcgagacgctctgcgcgacgggggaagtgccgtggatgccgctatcgctgctctattatgtgtagggctcatgaatgcccattccatggggatcggaggcgggctttttctcaccatctataatagtaccacccggaaagctgaggttattaatgctcgcgaggtagcaccccgactggcttttgctaccatgtttaacagttcagaacagtctcagaagggcggtctctccgtagcagtgcccggggagatcagaggctacgagcttgctcatcaaagacatggtcggctcccttgggccaggttattccaaccgtccatccagctggcccgccagggcttccccgtgggtaaaggcctggccgccgccctggagaataagaggaccgtgatagagcagcagccagtgctctgcgaggtcttttgcagggacagaaaggtattgcgggaaggagaacgcctgacactcccccaattagcagacacctatgaaacccttgccatcgagggagcacaggccttttacaacggaagcctgacagctcagatcgtgaaagatatccaagccgctggggggatcgtgaccgcagaggacctgaacaactaccgagctgagctcatcgaacatccgctcaatatttctctcggggacgtggtgctttatatgccatctgcaccccttagcggcccagttctggcactgatcctcaacattcttaagggatataactttagtcgcgaatcggtagaatctccagagcagaaggggctcacctatcacaggatcgtggaggcctttcgttttgcatacgcgaaaaggacactcttgggggatcccaaatttgtggacgtaaccgaggtcgtgcgcaacatgaccagtgaattctttgccgcgcagcttcgggcccagatctctgatgataccacccatccaatttcctactataagccagagttctatacacctgacgacggaggtactgcgcatctttccgttgtcgcagaagacggatcagcagtgtccgcaactagcactattaacctgtactttggcagcaaagtgagaagccctgtctctggtatcctctttaataacgaaatggacgacttttctagcccctctatcacaaatgaattcggggtacctccctcaccagcgaatttcattcagccgggaaagcagccgttgtcatcgatgtgtccgacgattatggttggacaggatggccaggtgcgcatggttgtaggggccgctggcggaacacagatcaccaccgccacagccctcgcaatcatttacaatctatggtttggttatgacgtcaagagagccgtcgaggaaccacgattgcacaatcagctcctccctaacgtgactactgtggaaagaaacattgaccaggccgtcaccgctgcccttgaaacaaggcaccaccatacacagattgcaagtacattcattgccgtcgttcaggccatcgttaggacagccggcggttgggccgcggcttccgacagtaggaaagggggggaacccgccggatactag

SEQ ID NO: 118095 - DNA, 678 bp, Artificial Sequence
  Description of Artificial Sequence: Synthetic coding sequence
atgacatccgaattttttgctgctcagctgcgcgctcaaatctccgacgacaccactcatccgataagctactataaacctgaattctatactcctgatgacgggggcaccgcccatctctctgttgtggcggaggacggatcggccgtgtcagcaaccagcacaattaacttgtactttggctcaaaggtgagaagtccggtgagcggtatcctgtttaacaatgagatggatgacttctctagcccttctattactaatgaatttggtgttcccccttcacccgcaaactttattcagcccgggaagcaaccccttagttcaatgtgccctactattatggtaggtcaggacgggcaagtcaggatggtggtaggcgctgctgggggtactcagattaccaccgctaccgctttagcaattatctataatctgtggtttgggtacgacgtgaagagagctgtggaagagccaagactccacaaccagctgttgcctaatgttacaaccgttgaacgcaacatcgatcaagccgtgaccgccgcactggagacccgccatcatcatacacagatagcatccaccttcatcgctgtggtgcaagctatcgtgaggactgccggtggttgggccgccgcttccgattcaaggaaagggggcgagcctgccggatattag

SEQ ID NO: 118096 - DNA, 678 bp, Artificial Sequence
  Description of Artificial Sequence: Synthetic coding sequence
atgactagtgaattttttgctgctcaattacgggcccagatttcggatgacaccacccaccccatttcctattacaaacccgagttttatactccggacgatgggggcactgctcacctcagcgtagtcgccgaggacggttcagctgtgtctgctacctccaccataaatctgtactttggctcgaaggtgcgcagtccagtctccggcattctgtttaacaatgaaatggacgattttagtagcccgagcattaccaatgaatttggtgtcccacctagccccgccaactttattcagccggggaagcaaccgctctcctcaatgtgtcctacaatcatggtcggacaggatggtcaggtcaggatggtggtgggagccgctggtgggactcaaattaccaccgctaccgcactggctatcatttataacttatggttcggatatgacgttaaaagggctgttgaggaaccccggctgcataatcagctacttcctaatgtcaccacagtagaacgcaatattgaccaagccgtcaccgcagcccttgagacacgccatcatcacacccaaattgcatctacttttatcgccgttgttcaggcaattgtacggaccgctggaggctgggctgcagcttccgactccaggaaaggtggtgagccagcggggtactag

SEQ ID NO: 118097 - DNA, 678 bp, Artificial Sequence
  Description of Artificial Sequence: Synthetic coding sequence
atgacctcggaattcttcgctgcccagttgagagctcaaattagtgacgataccacacaccccattagctattacaaacccgagttttacacccctgacgacggcgggactgcccacctatccgtcgtagctgaggacgggagcgccgtttctgcaacatccaccatcaatctgtattttggttctaaagtgagaagtccggtgagtggcatcctttttaacaatgaaatggatgatttctctagcccttctattacgaatgagtttggcgtgcctccaagcccagctaattttatacaacctggtaagcagcccctgagctcaatgtgccccacgattatggtaggccaagacggccaggtacgcatggtggtaggagcagctggcgggacccagattacaaccgctaccgcactggccatcatctacaatctctggtttggatacgatgtcaaaagggccgtcgaggagccaaggttgcataaccagttgctgcctaacgttacgacagtggagcggaatatcgaccaggctgtgactgcggctctggaaacaaggcaccaccatacacagatcgcttccacctttatcgcggtggtgcaggctatcgtgcgaactgcagggggatgggccgcggcctccgactctaggaaagggggcgagcccgcgggatattag

SEQ ID NO: 118098 - DNA, 1710 bp, Artificial Sequence
  Description of Artificial Sequence: Synthetic coding sequence
atgaaaaaaaaacttgtggtgctcggcctactggcagtggtcttggtgttggtgatcgttgggctgtgcctgtggctcccaagtgcctcgaaagaacctgataaccacgtgtacactcgggccgccgtggctgccgacgccaagcaatgtagcaagatcggacgggatgcattgagagatgggggatctgcggtggacgctgcaatcgccgcactgctgtgtgtgggcctgatgaatgcacactctatgggcatcgggggtggtctctttttaaccatctacaattccacgactaggaaggcagaggtcattaacgcgcgcgaggtagccccccggcttgcgtttgccacaatgtttaacagttccgagcagagccagaagggagggttgagcgtcgctgtgcccggcgaaatccggggttatgagttagcacaccagaggcacggtcggctgccatgggcccgtttgttccagccttccatccagttggcgaggcagggtttccctgttggcaagggactagccgccgcactcgagaataaaaggacagtcatcgagcaacagcctgtcttgtgcgaggtattttgtcgggatcgcaaggttctccgggagggggagaggttaactctgccccagttagccgatacttatgagaccctcgccatcgagggggcccaggccttttataacggttctctgacagcacagatagtgaaagatatccaggctgcagggggtatcgttaccgccgaggatttaaataattatagggccgagttaatcgagcacccacttaacatctccctgggtgacgtagtgctgtacatgcccagcgccccactgagcggacctgtgctcgctcttattcttaatatccttaaagggtacaatttttcccgcgagagcgtcgaatcccccgaacagaaggggcttacctatcatcgaatcgtggaggcctttcggttcgcctatgccaagaggactcttctgggagaccctaaattcgtcgacgtcactgaagtcgtcagaaatatgacgtctgagttttttgccgcccagctcagagcccagatttcagatgataccacccatccaatctcttattataagccagaattttataccccagacgacggtgggaccgcacacctgagtgtggtggccgaggatggctctgcagtgagcgcaacatccactattaacctgtacttcggttcgaaggtgcgctcccccgtgtccgggatcctgttcaataacgaaatggatgacttttcatccccaagcatcactaatgaattcggcgttccaccatccccagcaaatttcattcagcctggaaaacagcctctcagcagcatgtgtcccactatcatggtgggacaggacgggcaggtgaggatggtggtcggcgccgctggtggcacccagatcaccacggcaactgccctggctattatttataacctctggtttggctacgatgtgaagagggcagtggaggagccaaggttacacaatcagctactgcctaacgtgacaactgtcgagcgcaatatcgaccaagccgtcacagcagccttagagacaaggcatcaccacacacaaatagcctccaccttcatcgcggtcgtgcaggcgatcgtacgcacagcgggtggctgggctgctgcatccgactctcggaagggcggggagcctgcgggttactag

SEQ ID NO: 118099 - DNA, 363 bp, Artificial Sequence
  Description of Artificial Sequence: Synthetic coding sequence
atgaaaaagaagttggtcgttctgggactcttagcagtagtcctcgttctggtgatcgtaggactctgtctttggctccctagcgcttccaaagagcctgacaaccatgtttacacccgagcggccgtcgccgccgatgccaaacagtgttccaagattggtagggacgccctgcgtgacggtggctctgctgtagacgccgcaatcgcagcccttctgtgtgtggggcttatgaacgcccactccatgggcattggaggcggtttgttcctgaccatttacaattccacgacacgtaaagccgaagtgattaacgcccgcgaagtcgctccacgactggccttcgcaactatgtttaactag

SEQ ID NO: 118100 - DNA, 1392 bp, Artificial Sequence
  Description of Artificial Sequence: Synthetic coding sequence
atgaagaagaagctggttgttttgggccttctggccgtggtgttggtgctcgtcatcgtgggcctctgtctgtggctgccttcagcctctaaggagccagataaccatgtgtatacccgtgccgcagttgctgcggacgctaagcaatgctcgaaaatcggtcgcgacgcattgagggatggggggtccgcagtcgacgccgcaatcgccgcgctgctctgcgtggggctcatgaacgcccattctatgggaatcggcggggggttatttctaacaatctacaatagtacaacacggaaggccgaagtgataaacgcaagggaggtggcacctagattggcctttgccacaatgttcaacagttccgaacagtctcaaaaaggcggcctgtccgtggctgtgcccggcgagattcgcggctacgagttagctcaccagagacatggaagactcccgtgggcgagactgtttcagccctcaatacagctcgcacgccaaggatttcctgttgggaaaggactggcggccgcactcgagaacaaacgaacagtgattgagcagcaacctgttctgtgcgaggtgttttgtcgagatcggaaggttctgagggagggggagcgcctcaccctaccgcagcttgcggatacttatgagacacttgccattgaaggggctcaggcgttttacaatggctcactcacagcgcaaatagtgaaggacatacaggcagctgggggaattgtgactgcagaggacttgaataactaccgtgccgagttgattgaacatcctctgaatatttccctcggcgatgttgttctatatatgcctagcgccccactcagcggccctgtcttggctctgatcctgaacatactcaaagggtacaacttctccagagaatctgtggaatcgccagagcagaaagggctgacttatcaccgtatagttgaggctttccggttcgcttatgccaagcgaactctccttggcgaccctaaattcgtggacgtgaccgaggttgtccggaacatgactagtgagtttttcgccgcccagctgagagcccagatcagcgacgatacaacgcaccctataagctactacaaaccggagttttatacaccagatgatggaggtacagcacacttgagcgtggtggctgaggacggttctgctgtgtccgccacgagcactataaatctgtacttcggtagcaaggtccgcagccccgtgtccgggatactctttaataatgaaatggacgacttcagctccccaagcattaccaatgagtttggtgtacctcccagccctgccaattttattcagcctggaaagcagcccctgagttcaatgtgtcctacgatcatggtgggccaggacgggtag

SEQ ID NO: 118101 - DNA, 243 bp, Artificial Sequence
  Description of Artificial Sequence: Synthetic coding sequence
atgaaaaaaaaactagtggtccttggtctgttggcagtcgtgctggttttagtgattgtagggctttgtctctggctcccgtctgcctctaaggaaccggataaccatgtctacacacgagcagcagtggcagcagacgcaaagcaatgttccaagatcggacgtgacgctcttcgcgacggcggaagtgctgtggatgcagcgatcgccgctctgctgtgtgttgggctaatgaatgcctag

SEQ ID NO: 118102 - DNA, 525 bp, Artificial Sequence
  Description of Artificial Sequence: Synthetic coding sequence
atgaagaagaagctggtcgtcctaggcctcctggcagttgtcctcgtgctcgtcattgtaggcctgtgtctgtggctcccttcagcttccaaggagcctgacaaccatgtgtatacccgggcagccgttgccgccgacgctaaacagtgtagcaagatcggtagagacgccctcagggatggagggtccgccgtggacgccgccatcgctgccctgctgtgcgtcggccttatgaacgctcatagcatgggaatcggcgggggtctgttcctcacgatctacaactcgactacaaggaaagctgaggtgatcaatgctagggaggttgctcccagactcgcctttgccactatgtttaatagttcagagcagtcacagaagggtgggttaagtgtagctgtgccgggtgaaatccggggatacgagctggctcaccagagacatggcaggttgccctgggcccgcctttttcagccttctattcagctggctaggcaaggcttccctgtaggtaaagggttgtag

SEQ ID NO: 118103 - DNA, 381 bp, Artificial Sequence
  Description of Artificial Sequence: Synthetic coding sequence
atgaagaaaaaactggttgtcctgggattactagccgtggtgctggtgctcgtaatagtaggattgtgcttgtggttaccgtccgcaagtaaagagcccgataatcacgtgtacacccgagccgccgtggctgcagatgctaagcaatgctcaaaaattggcagagatgccctccgggacggcggatccgctgtggatgccgctatcgctgcactcctctgtgttggcctgatgaacgctcattccatgggaattgggggagggctgtttttgacgatctacaatagcacgacccgcaaggcagaggtaattaacgcacgggaagtagctccacgtcttgcattcgccaccatgtttaactcatctgagcagtcccagtag

SEQ ID NO: 118104 - DNA, 330 bp, Artificial Sequence
  Description of Artificial Sequence: Synthetic coding sequence
atgaagaagaaattggtggtgctcggtctcctggccgtggtgctggtgctggtgattgtgggactgtgcctatggttgccctccgccagtaaagagcccgataatcacgtttacaccagagccgctgtggctgcagatgccaaacagtgctccaaaataggacgcgatgcccttcgggatggcgggtctgctgtcgatgctgccattgcggccctgctctgtgtcggcctcatgaatgctcacagtatgggaattgggggtggtctatttcttaccatctacaactcgacaaccaggaaggccgaggttatcaatgctagagaggtttag

SEQ ID NO: 118105 - DNA, 336 bp, Artificial Sequence
  Description of Artificial Sequence: Synthetic coding sequence
atgaagaaaaaacttgttgtactgggactgttggctgtcgtattggttctggtcatcgtgggcctgtgcctgtggctgccttcggcctccaaagaacccgacaaccacgtgtatacacgggcggctgtggctgctgacgcaaagcagtgctcaaagattggcagggacgctctgcgggacggcggctcagcggtagatgccgccattgcggctctgctctgcgtgggcctcatgaatgcccacagtatgggcatcggtggcggtctgttccttaccatttataatagtactacacggaaggccgaggtgatcaacgcaagagaggtcgcaccctag

SEQ ID NO: 118106 - DNA, 114 bp, Artificial Sequence
  Description of Artificial Sequence: Synthetic coding sequence
atgaagaagaagctggttgtcctgggcctgttagctgtagttctggtcctagtcattgtggggctgtgtttgtggcttccgagcgctagtaaagagccagataatcatgtatag

SEQ ID NO: 118107 - DNA, 207 bp, Artificial Sequence
  Description of Artificial Sequence: Synthetic coding sequence
atgaagaagaagctggtggtgttggggttgctcgctgtggtattggtgctggttatcgtaggactgtgcttgtggttgccctccgcttccaaagagcctgacaatcacgtatatacacgtgccgctgtcgcggcggatgctaagcaatgcagcaaaattggtcgcgatgcactccgtgacggggggagcgccgttgacgcggcttag

SEQ ID NO: 118108 - DNA, 381 bp, Artificial Sequence
  Description of Artificial Sequence: Synthetic coding sequence
atgaagaaaaaactagtggttcttgggctgctagccgtcgtgctggtgctcgtgattgtggggctctgtctttggctgccgagtgcctctaaggaaccagataaccatgtgtacaccagggctgccgttgccgctgatgctaaacagtgctcaaagattggccgggacgctctcagagatggtggatccgctgtggatgcagctatcgccgcactcctgtgtgtaggactgatgaacgcccatagcatgggaatcgggggcggcctcttcctcaccatctataatagcacaacaaggaaggccgaggtgatcaatgcccgagaggtggccccccgcctggccttcgccaccatgttcaactcctccgagcagtctcaatag

SEQ ID NO: 118109 - DNA, 351 bp, Artificial Sequence
  Description of Artificial Sequence: Synthetic coding sequence
atgaaaaagaagctggtggtgttgggtctgctggctgtggtgctggtcctggtgatcgtgggcctgtgcctttggctgccctccgcttccaaggaaccagataaccacgtctatacacgcgctgcagttgccgccgatgctaaacagtgctcgaagattggcagggatgccctgcgcgatgggggatcagctgtggacgccgccattgcagcactgctctgtgtgggccttatgaacgctcatagtatgggcattggcggtgggctcttcttgactatttataattcaactacccggaaagccgaagtgatcaacgcccgcgaagtggcgcctcggcttgcatttgcttag

SEQ ID NO: 118110 - DNA, 384 bp, Artificial Sequence
  Description of Artificial Sequence: Synthetic coding sequence
atgaaaaaaaaacttgtcgtactggggctcctcgcagtcgtcctggtgctggtaatagtggggctttgtctctggttgccaagcgcatcaaaggaaccggacaatcatgtgtacactcgcgctgccgtcgctgccgacgccaaacaatgctctaaaattggtcgcgacgcactgcgggacggcggttcagccgtagatgccgcaattgccgctttactgtgtgtaggccttatgaacgcccacagcatgggaatcggcggtgggctgttcctaacaatttataactctactactagaaaggctgaggttataaatgcccgggaggtcgcccctcgactcgcattcgctactatgtttaattcttccgagcagtcacagaagtag

SEQ ID NO: 118111 - DNA, 297 bp, Artificial Sequence
  Description of Artificial Sequence: Synthetic coding sequence
atgaaaaagaaattagtggttctgggacttctcgcggtcgtgcttgtgttggtcatcgtcggcttgtgtttgtggctgccaagcgcaagtaaggaaccggataaccacgtgtataccagagccgcagtggcggccgatgccaaacagtgctccaaaatcgggcgagatgccctgcgggacggaggcagtgctgtagacgccgccatcgccgcccttctgtgcgtaggacttatgaatgcccacagcatggggattggagggggtctcttcctgaccatttacaacagcactacctag

SEQ ID NO: 118112 - DNA, 93 bp, Artificial Sequence
  Description of Artificial Sequence: Synthetic coding sequence
atgaaaaaaaaactagttgtcttgggactcctcgcggtggtgctggttctggtcatagtggggctctgcctgtggcttcccagtgcttcctag

SEQ ID NO: 118113 - DNA, 1710 bp, Artificial Sequence
  Description of Artificial Sequence: Synthetic coding sequence
atgaagaagaaattggtggtactcggtttattggccgtagtgttggttctggtgatcgtgggtctctgtctttggctgccatctgcatccaaggagcctgataatcacgtatataccagagctgctatggccgccgacgcaaagcagtgcttggaaattgggcgcgacacactgcgggacggtggcagcgccgtggatgccgccattgctgcgctgctatgtgtgggtcttatgaatgctcactccatgggaatcggagtgggactcttcctgacaatctacaatagcactactagaaaggccgaagtgattaacgcccgcgaggttgccccacgcctagctttcgcctctatgttcaattcgtctgaacaatcccaaaagggaggactgtcagtggctgtgccaggggagattcgcggttacgaactagcccatcaaaggcatgggcgcctcccctgggcgcggctgttccagccttccattcaactggcccggcagggattccccgttggcaagggcctcgctgctgttctggagaataaaagaaccgtgattgaacagcagccggtgctgtggtatgtgttctgccgcgacagaaaggttcttcgggaaggggagcgtctcaccctccccaggctggctgacacatacgagatgctcgctatcgagggtgcccaagctttttacaatggtagtcttatggcgcaaattgtgaaagacatccaagcagctggaggaattgtcacagccgaggatcttaataactaccgggcggaacttatcgagcaccccctgaacatctcactgggcgacgctgtgctctatatgccttctgcccggctaagcggccccgtgttagcgcttatattaaacatcctcaaggggtacaatttcagcagagaatcggtggagactccagagcagaaaggattgacatatcacagaatagtggaggctttccgcttcgcctatgctaaacggactctcctgggcgaccccaagtttgtcgatgtgactgaagtggtgagaaacatgaccagcgagttcttcgcagctcaactgcggagccagataagcgaccacacaacgcaccccatctcgtactataagccagagttttataccccggacgacggcggaacagctcatctctccgtggtagccgaagatggcagcgccgtttctgcaacttcaacaataaacctctactttgggtccaaagtttgcagccccgtctcaggtattctatttaacaatgagtggacaacgagcgccctgcccgccttcactaacgaattcggagctcccccctcacctgccaactttatccaacctggcaagcagccactgctctctatgtgtctcacaatcatggttggccaggacggtcaggtgaggatggtggtcggcgcggcgggcggcacacagattacaacagacaccgctctggccatcatctataatctatggtttggatatgacgtgaagagagccgtggaagagccacggctgcataataagctgcttcccaatgtcacaaccgttgagcgcaatatcgaccaagctgtaaccgctgctctcgagacacgacatcaccatactcagattgcctccactttcattgccgtcgttcaagccatcgtccgtaccgccggtggctgggccgctgccagcgactcacggaagggcggagaacctgccgggtactag

SEQ ID NO: 118114 - DNA, 1680 bp, Artificial Sequence
  Description of Artificial Sequence: Synthetic coding sequence
atgaagaaaaagctggtagttctcggactactcgctgttgtgttagtgctggttattgtggggctgtgtctgtggctgccctccgcgtccaaggaacctgataatcacgtctataccagagccgccatggcggcagatgcaaagcagtgcctggagatcggccgggataccctgagagatggggggagcgcagtggacgccgccatagcggcgcttttgtgcgtcggactgatgaatgcccactcgatgggcatcggcgtagggctgttcctaacaatttacaattccactactagaaaggccgaagttatcaatgcccgggaagttgcgcctaggctggcttttgcctcaatgttcaacagttctgagcaaagccagaaaggcggattgtctgtggccgtgccaggcgaaatcagaggctatgagttagcccatcagagacatgggcgattgccttgggcgcgcctgttccaaccctcaatccagctcgctcgacagggctttcccgtgggaaaaggcctcgctgcagtgttagagaataagcgaaccgtgatagaacagcaaccagtgctttggtatgtcttctgccgagaccgtaaggttttgcgcgaaggagagcggctcaccctgccccgactggctgacacctatgaaatgctcgctatagagggagcacaggctttttacaacggctcacttatggcacaaatcgtcaaggacattcaagccgccggagggatcgttaccgctgaggacctcaacaattatcgtgctgaacttatcgagcatcccctgaacatttccttaggcgatgcggtgctgtatatgccctctgcacggctgtctggcccagtactcgcacttatcctgaatattttgaagggttacaatttcagccgcgaatcagtggagacccctgagcagaaaggccttacttatcaccgaatcgttgaggccttccgattcgcatacgccaagcgtacattactgggcgaccctaaatttgtcgatgtaaccgaggtggtgcgcaatatgacctctgaattcttcgcagcccagctcagatcccagattagcgaccacactacccacccaatctcttactataagcccgaattttatacacccgacgatggcggaaccgctcacctgtcggtcgttgctgaggatggatctgccgtgtccgcaacgagtaccatcaacttgtacggcatactattcaataacgagtggaccacaagcgcccttcctgcctttactaatgaatttggcgccccaccttctcccgcgaactttattcagcccgggaagcagcctttgctgagcatgtgtctcaccataatggtaggccaggatggtcaggtgcggatggtagtgggagcagcaggtggaacacaaattaccacagatacagcactcgccatcatctacaacctttggttcggttatgatgtgaaacgagctgtggaggagcctagactgcataataaactattgccaaacgtgacaacagtcgaaagaaatatagatcaggcggtcaccgccgccctagaaacaagacatcatcacactcagatcgccagcacgttcattgctgttgtgcaggccattgttagaacggccggaggctgggccgccgcctccgatagcaggaaaggaggcgaaccagccggatactag

SEQ ID NO: 118115 - DNA, 1710 bp, Artificial Sequence
  Description of Artificial Sequence: Synthetic coding sequence
atgaagaagaagctcgtcgtcctgggactgctcgcggttgtactcgtgctcgtcatcgtgggcctgtgtttgtggctgccctccgcaagtaaagagccagacaatcatgtgtatacccgggctgccatggctgccgatgctaagcagtgtttggagatcgggcgcgatacgttgagagatggcgggtcggccgtcgatgctgcaatagccgccctgctctgtgtaggactcatgaacgctcacagcatgggaatcggagttggtctatttctgaccatctataactcaacaacccgcaaggcggaagttattaatgcgagagaagtcgcaccccgcctcgcctttgcgtctatgttcaattcttctgagcaatcgcagaagggcggcttgtcagtggccgttccaggggaaattagaggctacgaacttgcccaccagagacacggcaggctaccctgggcccggctgtttcagccaagcatccaactcgctcggcagggttttcccgtaggcaaagggctggctgccgtgttggagaacaagcggaccgtgattgagcaacaaccggttctgtggtatgttttttgtagggatagaaaggtactgcgagaaggagagaggctcactctgccaaggctggcggatacttacgagatgctggccatcgaaggtgcccaagcgttctataacgggagtcttatggcgcagatcgtcaaggatatacaggccgcagggggcattgtgacagctgaagatctgaataattaccgcgccgagctaattgaacatccccttaacatatcgctgggcgatgcagtgctctatatgccctcagcccggctgagcggcccagtactggcgctgatccttaacatcctaaaaggctataacttctctagagaatctgttgaaaccccagaacagaaagggctgacttatcaccgaatcgtggaggcatttaggttcgcttatgcaaagaggaccctcctcggggaccctaaatttgtggacgtaactgaagtcgtcaggaatatgacttctgaattcttcgccgcgcagctccggtcacaaatatcagaccacacgacacaccccatttcctactataaaccagagttttacacacctgacgatggagggaccgcccatctcagcgtggtggctgaggacggctctgcagttagcgcaactagtacgatcaatctttacttcggatcaaaagtgtgttccccggtgagtgggattttgtttaataacgagtggaccactagtgcactgcccgcctttaccaacgaatttggagctccccctagcccagccaacttcattcagcccggaaaacagccactactaagtatgtgcttgaccattatggttgggcaggacggacaggtccgcatggtggtgggtgctgccggcggcactcagatcacaaccgacacagctttggctattatctacaatctgtggtttgggtatgacgtcaaacgggcagtggaggaaccgagactgcataataagcttctgccgaatgttacaactgtcgaacgcaatatcgatcaggccgtcacagccgccctggagaccagacatcatcatacacagatcgcaagtacatttatagctgttgttcaggccattgtgagaaccgcaggggggtgggcggccgccagcgattctagaaagggcggggaaccagctgggtactag

SEQ ID NO: 118116 - DNA, 1665 bp, Artificial Sequence
  Description of Artificial Sequence: Synthetic coding sequence
atggctcggggctacggcgcaaccgttagtctggttctgctgggccttggccttgctctggctgtcattgtcctggcggtggtcctgtctagacaccaggctccttgcggaccgcaggctttcgcccacgcagctgtcgccgccgatagtaaggtgtgctcagatatcggacgggccatcctgcagcagcagggcagccctgtggacgccactattgctgctctagtatgcaccagcgtcgtcaacccgcagagcatgggactggggggtggtgtgatcttcaccatctataatgtgaccaccggcgcccagtggattggagtgcctggcgaacttcgcggctacgccgaggcccatagacgccatgggagactgccatgggcacaattattccagccaaccatagcactcctgcggggaggacacgttgtggctccagtgctgtcccgcttcctgcacaacagcattcttcggcccagcctccaagcctctacactgcgccagctgtttttcaatggtaccgaaccactgagaccccaggatccactgccatggcctgcgcttgctaccaccctcgagactgtcgcaaccgagggcgtcgaggtgttttataccggaaggctggggcagatgcttgtcgaggacattgctaaagaagggtcccagctgactcttcaggatctcgccaaatttcagcccgaggtggtggatgcccttgaggtgccccttggggactacacgctctactcgccgccaccgccagccgggggagccatccttagcttcattctaaatgttttgagggggttcaatttttccactgaatccatggcccggcccgaaggacgcgtgaacgtctaccaccacctggtcgaaaccctgaaatttgccaagggccaaaggtggaggctgggagacccgaggagtcaccctaaactgcaaaatgcctcaagggacctgttgggcgagacattggctcagctcatccggcagcaaattgatgggcggggggaccaccagcttagccattatagcctggcagaggcttggggccatggaaccggaacatcccatgtgtccgtcctcggcgaggacggctctgccgtggccgctacctcaactatcaatacccccttcggagccatggtatattctccaagaacagggattatattaaacaacgaactgttagatctgtgtgagcgctgcccacgaggcagcggaaccacccctagccctgtgtccggagatagagtcggtggtgcccctggacggtgttggcccccagtgcccggggagcgcagccctagtagcatggtcccttccatcctgattaacaaagcccaaggatcaaagcttgtcatcggcggggcaggcggtgagctcattatctctgctgtcgcgcaagctatcatgtcgaaattgtggttaggattcgatctacgggctgcgatcgctgcccccatcctgcatgtgaacagcaaaggatgtgtggaatatgagcctaatttctcccaggaagtacaaaggggactccaagatcggggccaaaaccagacacagcgacccttctttctcaatgtggtgcaagccgtttcgcaagaaggggcctgtgtgtatgcggtcagcgaccttaggaagtcaggtgaggccgccggctactag

SEQ ID NO: 118117 - DNA, 1761 bp, Artificial Sequence
  Description of Artificial Sequence: Synthetic coding sequence
atggcgcgcggttatggagcgaccgtgagcctggtgctccttgggctgggactggctttagccgtgattgtgctggcagtggtcctaagcaggcatcaggccccatgcgggcctcaggcttttgctcacgcagccgtggcagccgattctaaggtatgctccgatataggccgggcaatattgcagcaacaaggctcccccgttgacgctacaatcgccgcattggtgtgcacttccgttgtaaacccacaaagtatgggactgggcggtggagtgatttttacaatatacaatgtgacaactggcaaagtagaggtaatcaatgcgcgcgaaaccgtgcctgcgagccatgctcctagcttactggatcagtgcgcccaggccctgcccttggggactggggcacagtggatcggggtcccaggcgagctcagaggttatgcagaggcccacagacgccatggacgtcttccatgggcccagctgtttcaacctaccatagccttgctgcggggcggacacgtggtggcacccgtgctgagccgcttcttacataatagcattcttcgaccatctctccaggctagcactctgcggcagctcttcttcaacggcacagaacccttaaggcctcaagaccccctgccttggcccgcattggccacaactctagagacggtggctaccgaaggcgtcgaggtgttttataccggcaggctggggcagatgctggtcgaagacatcgcaaaagagggatcacagttgacgctccaggaccttgcaaaatttcaacccgaggttgtggacgctttggaggtaccactcggcgattataccctgtactctcctcctcccccagctgggggagccatattaagctttattttgaacgtgctgcgcgggttcaatttctccaccgagtcaatggcccgcccagaaggaagagtgaacgtgtaccatcacctggtggaaaccctgaagtttgcgaaaggccaacggtggcgattgggggatccccgcagtcaccctaagctccagaatgcctccagagacttactgggagagaccctcgcccagttaattcgccaacaaattgatggccgcggagaccatcagctgtcacactattctcttgctgaggcttggggacatggaactggaacaagccatgtttcagtgttgggcgaggatggctcagcagtggccgccacaagcaccatcaatactccttttggtgcaatggtttacagtccccggacaggcattattttgaacaatgagctgctggacctttgcgagcgttgtcccaggggctctggtaccaccccaagccccgtttcaggtgacagggtgggaggggctccaggacgctgttggccaccggtcccaggtgagcgctcacccagctctatggtgccgtctatactaatcaacaaggcgcaggggagcaaactagtgatcggaggagcaggtggcgaactgatcattagtgccgtcgcccaggctattatgtcaaaactctggctcggtttcgaccttagagccgccattgcagcgcctatattgcacgtcaatagcaagggctgtgtggaatacgaacccaacttctcccaggaggtgcagagaggcctgcaggaccggggtcagaatcagacacagcggccatttttcttaaatgtcgtgcaggctgtgtctcaggaaggggcctgtgtgtacgccgtcagtgacttgagaaagtcgggagaagccgccggctattag

SEQ ID NO: 118118 - DNA, 1764 bp, Artificial Sequence
  Description of Artificial Sequence: Synthetic coding sequence
atggcacggggatacggagcaacagtttcgttagtgctactgggacttggtctggccctggctgttatcgtgcttgcagttgtgctctccagacatcaagccccatgtgggcctcaggcttttgcccacgctgcggtagcagcggactccaaggtatgcagcgacataggcagggccatcctacagcagcaaggtagccctgtcgacgcaacaattgccgcactggtatgcacaagcgtggtaaatcctcagagtatgggcttgggtggcggagtcatctttacaatttacaacgttacgaccggaaaggtggaggtgatcaacgctagggagactgtgcccgcaagccacgcacctagtctgcttgaccaatgcgcccaggccctgcccctgggcaccggggctcaatggatcggggtcccgggagagctccgggggtatgctgaagcccatagaaggcacggccgcttaccatgggctcagctctttcagcccacaatagccctcctgcggggaggacacgtagtggccccagtactgagtcgatttctccacaacagcattttgcgtccatctctccaggctagtactcttagacagttgttttttaatggcactgagcctctgagaccacaagatccactgccttggcccgcgctggccaccaccctcgagaccgtggccaccgaaggagtggaggtcttttataccggacgcttgggacagatgcttgtggaggacatcgccaaggagggcagtcaactgaccttacaggatttggctaagttccagcccgaggttgtggatgcccttgaggttcccctaggcgattacacactctactctccaccacctcccgcgggaggcgccattttgtcttttattctgaatgttctacgaggatttaacttctccacagagtcaatggcaagacctgaaggaagggtgaacgtgtaccatcatttggtcgagacccttaagttcgcaaagggtcagcgatggcggctcggtgatccccgctctcatccaaagctgcaaaacgcgtctagagacttgcttggagagactttggcccaactaattaggcagcagattgatggacgcggcgaccaccagctcagtcactactctctggcggaggcttggggtcacggaacaggcacatctcacgtgagcgtgctgggcgaagacgggtcggccgtggcggccacttctacaatcaacaccccgtttggagcgatggtttactccccccgaacaggaattatccttaataacgagctcctggacctgtgtgagagatgcccaagggggagtgggaccacaccctctcccgctgtgagcggagatcgcgtcggcggcgcccccggcaggtgctggcccccggtccccggggagcgttcaccttcaagtatggtgccgtctatccttatcaataaggctcaaggttcgaaactagtcatcggcggcgcaggtggcgaattgattattagtgccgtggcacaggcaatcatgtccaaactgtggctagggtttgacctaagagctgcgatagccgctccaatcctccatgtcaatagtaagggttgcgtagaatacgagcccaattttagccaagaggtccaaaggggactgcaggaccgagggcagaaccaaacccagagacctttcttcttgaatgtggtgcaagccgtttcacaggaaggagcatgcgtttatgccgtatctgacctcaggaaatctggcgaggcggcgggctattag

SEQ ID NO: 118119 - DNA, 1533 bp, Artificial Sequence
  Description of Artificial Sequence: Synthetic coding sequence
atggccaggggatatggcgctacagtgtcattggttctccttggcttaggtctcgcacttgctgtcattgtccttgcagtggtactgtcgagacaccaggcaccatgtggtccccaggccttcgctcatgccgccgtcgcggctgatagcaaagtatgcagcgacattggccgcggaccagttgacagaggcgcgcgcggcgctccatggctctgtcgcgggccaccccctccttggccccctgccctcggggccgctgtgcctgcccatcatcgcgcggcgccccggggagcgtgcggtggaccctgcccacagcccttcccagcccaacagcatccagcggcatttctggccggcgtgaaccctgccctgtttttcaacgggactgagcctctgcgaccgcaggatccacttccctggcccgcactagctaccaccctggagaccgtggcaacagagggagtggaagtgttctacaccgggagactgggccagatgcttgtcgaggatattgcaaaggaggggtctcagctaacgctgcaggatctcgccaagtttcagcccgaggtcgttgacgccctggaggtgccactgggcgattataccctgtactccccgccaccaccggcgggcggcgccattctaagttttattctcaatgtgttgcgcggcttcaactttagcacagagtctatggccagacccgaaggtagggtcaatgtctatcaccacctggtcgaaaccctcaagtttgccaagggccagagatggagactaggggatccgcgtagtcacccaaagttacagaacgcctcgcgcgatctgctgggcgaaaccttggcacagctcatcaggcagcaaatcgatgggagaggggaccaccagctgtcacactattcactggccgaggcttggggacacggaaccggtacaagccacgtgtcagtgctgggggaggacggctccgctgtggccgcaaccagcaccatcaacactcctttcggggcaatggtgtatagccctaggactgggataattctgaataatgagctgttagatctctgcgagcggtgccccaggggcagcgggacaacaccttcacctgccgtgtcaggagaccgtgtcggcggcgcccccggaaggtgttggccacctgtccctggcgagaggtccccatcctctatggtacccagcattttgatcaataaggcgcagggctctaaactggtcataggcggggcgggcggcgagctgatcatttcagctgtagcacaagcgatcatgtctaaactttggcttgggttcgacctgcgggctgccatcgccgcacctattcttcacgtgaactccaaaggttgtgttgagtacgaaccaaatttttcccaggaagtgcaacgaggtctccaggatagggggcagaaccaaacccagaggcccttcttcctgaatgtggtgcaggcagtgtcgcaggagggcgcttgtgtatacgcggtcagcgacctaaggaagtcgggcgaggcagccggatactag

SEQ ID NO: 118120 - DNA, 1506 bp, Artificial Sequence
  Description of Artificial Sequence: Synthetic coding sequence
atgggcctggggggtggagtgatcttcaccatttacaatgttaccaccggtaaggtagaggttataaacgctagagagacggttcctgcatcccatgcgccctcccttctggaccagtgtgcacaggcattgcctttagggacaggcgcccagtggatcggcgttccaggagagctccgtggttacgcagaagcccaccgcagacatgggcggctgccttgggcgcagcttttccagcccacaatcgccctgctaaggggtgggcatgtggtcgctcccgttctttccagattccttcataactcgatcctaagaccctcactccaggcctcaacactgaggcagttgttttttaatggaaccgagcctttgcgtcctcaagaccccctgccctggcccgcgttggctacgactctcgagactgttgcaacagaaggcgtggaggtcttctatacaggccggctggggcagatgctggtggaggatatcgccaaggaaggaagtcaacttaccctccaggatctcgccaagttccagcctgaagtcgtggatgcgttggaggtgcccctgggagactacactctttatagtcctcctccccccgccgggggggctatcttatcttttatactgaatgtgctgaggggcttcaacttcagtaccgaaagtatggcaaggcctgaaggtagagtaaacgtgtaccaccatctggtcgagacactaaagtttgccaagggacagaggtggcgcttgggcgatcccaggtctcatcctaagctgcagaatgcctcacgggatctcctgggcgagaccctggctcaactcattagacagcagatcgatggtcgtggggaccaccagctcagccactactcactggccgaagcctgggggcacggcaccgggacgtcccatgtgagcgttctgggtgaggacgggtctgccgtagctgccacttccactataaataccccctttggcgccatggtgtactcacctagaaccggcatcattcttaacaatgagttgcttgatctctgcgagagatgtccgcgaggttcgggaacgacgccctcgcctgtgtccggcgacagagtgggtggcgcccctgggcggtgctggcctccagtgcccggggagcgaagtccctctagcatggttcccagcatcctcattaataaagcacaaggcagcaagctagttatcgggggggccggcggcgaactgattatttcagccgtcgcacaggccataatgagcaagctttggctgggctttgatctccgggctgcaatcgccgcacccatcctgcacgtgaattcaaagggctgtgtagagtatgagcctaatttttcccaggaggtccagagagggctgcaggatagaggtcagaaccagactcagcgtccatttttcctcaatgtcgtgcaggcggtctcgcaggagggggcctgtgtttacgcagtgtctgacctacggaagtccggggaagccgcaggctattag

SEQ ID NO: 118121 - DNA, 1386 bp, Artificial Sequence
  Description of Artificial Sequence: Synthetic coding sequence
atggagagagccgaagaacccgtcgtttaccagaagttgcttccatgggagcccagcctcgaaagtgaagaagaagtggaagaagaggagacgagtgaggcgctagtcttgaatcctcgtaggcaccaggattcctcacgtaataaagcgggtggactgccagggacttgggctcgcgttgtggccgcgctgttgctgcttgccgttggatgtagtctggcggtccggcagctccagaaccaaggccggtccactgggtccctggggtctgtggcaccaccgccggggggtcacagtcacgggcccggtgtctaccaccacggtgccattatctcccccgctggagctatgttttggggtttgttccatgattcttcctccggcaactcaaccgccctcacctccggccccgcccagacgctcgctcccggcctgggcctccctgctgccttgcctactctgcatctactccatgcacgctttgggagactgccctggccacgattgttggtaggtccaaccaccctggctcaggagggtttcttagtggacacccctctggcccgtgccttggttgctcggggtacggaggggctgtgcccgctactttgtcacgctgacgggacaccgctgggcgcaggtgctagggccacaaatcctcagctagctgcagtgctgcgtagtgctgctctggccccgacatcggacctggccggcgacgcgctgctgtccctgctggctggcgatttgggcgttgaggtgccctccgccgtgcctagacccacactcgagccagctgaacagctgcctgtcccacagggaatactgtttactacccctagcccaagcgcaggaccagagctactcgccctgctggaggccgctttaagatccggcgccccgattccagacccctgtcctcctttcctgcagacagccgtctcgcctgagtcatctgctcttgccgcagtggactcttccggatccgtgctgttactcacatcctcccttaattgtagctttggcagcgctcacctaagtcccagcacaggtgtcctgttatccaacctcgtggccaaaagcacaacttctgcctgggcctgtcccctgatcttgcgagggtccttggatgatactgaagcggatgtcctgggcctggtcgcctctggtacccccgacgtcgctcgggctatgacccataccttgctgagacacctagcagctagacccccaactcaagcacagcaccaacaccagggacagcaggagcctacagagcacccgtctacttgcgggcagggaactctcttacaggtcgctgcccacactgaacatgcccacgtaagtagtgtaccccatgcctgttgtccattccagggcttctag

SEQ ID NO: 118122 - DNA, 1482 bp, Artificial Sequence
  Description of Artificial Sequence: Synthetic coding sequence
atggaacgcgctgaggagcctgtggtttaccaaaagctattaccatgggaacccagcctggagtctgaggaagaggtcgaggaggaggaaacatctgaggcccttgtgctgaaccccagacgccaccaggacagtagccgcaataaggcaggcggacttcccggaacctgggctagagtcgtggctgccctactgctgcttgcagtcggatgtagcctggctgtacgccagctccaaaaccagggtcgttctacaggttctcttgggtccgtagctccacctcccggggggcacagccatggtcccggagtgtatcaccacggagcgattataagcccggctggccgcgagttgctggtggcaggcggcaatgtggttgatgccggtgtgggagctgccctgtgtctggccgtggtccacccacacgcaaccggcctgggcgcgatgttttgggggttgtttcacgacagctcttccggaaattctacagcactcacttcaggtcccgcacagactctggctcccggactcggcctgccagctgcactgccaacactccacctgcttcacgccagatttgggaggttgccttggcctcgcctgctggtcgggcccacaaccctcgcgcaggaaggattcctcgtggacacaccactggcccgcgccctggtcgcgcgtggaaccgaaggactgtgtcctctgctttgtcatgcagatgggactcccctgggcgctggcgcccgggccaccaaccctcagctggcagctgtgctgcgctcagccgccctggcccctaccagtgatctggccggcgatgccctgctgagcctgctcgcaggagacctgggagttgaggtgccctctgccgttcccaggccaacgctggagcctgccgagcaattacctgtccctcagggaatattgtttaccactcccagcccatcagcagggccagaactcctggcactgctggaggcagccttgaggtcaggcgcccccattcccgacccatgcccacctttcctccagacggcagtctcacctgagtcctctgccctggctgcagtggacagcagtggcagcgtgctgctgctcactagtagcctgaactgctcttttggatcagcacacctttctcccagtacgggcgtgttgctgagcaatctcgtggcgaagtcaactacctcagcctgggcttgcccccttatcctgagagggtctttagatgataccgaagcggacgttctgggccttgtggcaagcggaacccccgatgtagccagagccatgactcataccttgctgcgacatttggctgctaggccaccgacacaggcacagcaccaacaccagggtcagcaggaacccacagaacaccccagcacttgcggacagggaactcttcttcaggtggccgcccacactgaacacgcccacgtttcctctgttcctcacgcctgttgtccttttcagggtttctag

SEQ ID NO: 118123 - DNA, 1038 bp, Artificial Sequence
  Description of Artificial Sequence: Synthetic coding sequence
atgttttggggcttgttccacgacagctcttcaggcaattccacggccttgacgagcgggccagcccagacgcttgcgcccggactggggctaccagccgcgctgcccaccctacatctgctccacgccaggtttggccgtttgccttggcctcgcctgctggtgggacccaccacactggcacaagaagggtttttggtggacacccccctggcgcgagctctagtagccaggggaacggaagggttgtgccctctgctgtgtcacgccgatggcacacccctgggagccggcgcacgtgcaacgaacccacaactggctgccgtcctgcggtctgccgcactggccccaacctccgacctcgcaggggatgcactcctgtcactcttggctggggacctaggggttgaagtgccctctgctgtcccccgacctacgcttgaacccgctgaacagctaccagtcccacagggcatccttttcacgacaccatccccgtctgcggggccagaactgctggctctactagaggcggcccttcgatccggagctcccatcccagacccctgtcctccttttttgcagaccgccgtcagccccgaaagctcagcattggctgcagtggactccagcggttctgtccttttgctgacctcctcattgaactgttcattcggtagtgcccatttatcacctagtacgggggtgcttttgagcaatcttgtcgcaaaatctactacctccgcgtgggcttgtcccctaattctcagaggcagcttggatgacactgaggcggacgtgctgggcctggttgcaagcggcacacccgatgtcgccagggctatgacacacaccctgctgaggcatctggctgcaaggccgcccacccaggctcaacatcagcaccagggccaacaagagccaacagaacacccctctacctgcgggcaaggcaccctgttgcaggtggccgctcacacagagcacgcccacgtgtcttccgtgccacacgcctgttgccctttccagggattctag

SEQ ID NO: 118124 - DNA, 1482 bp, Artificial Sequence
  Description of Artificial Sequence: Synthetic coding sequence
atggaaagggccgaagaacccgtggtttaccagaagctgctgccatgggaaccttccctcgagtctgaagaggaggtggaggaggaagagacctcggaggcattagtcctgaatcccagaagacaccaagatagtagcaggaacaaggcaggcggactgcccgggacttgggcgagagttgtggccgcgctgctcctactggcggtggggtgcagcctggcagtgaggcagctgcagaatcaaggccggtcaacaggatcattgggaagcgtggccccacccccagggggacactctcacggacctggtgtgtaccatcacggcgctataattagcccagccggccgagagctcttggtggcaggaggaaacgtagttgatgcaggcgttggcgcggctctttgcctggccgtggtgcacccgcacgctaccggattgggggccatgttttggggcttgttccacgatagctctagcgggaattcaaccgcccttacttctgggcctgcacagacgcttgctcctggccttggactgccagcagccctacccactttgcaccttttgcatgcgaggttcggccgcttgccatggccacgcttactggtgggacccacaaccctggcacaagaaggatttttggtggacactcccctggctcgcgccctcgtcgctcgtggtactgagggcctctgcccactgctctgtcacgcagacggcacgcctctaggcgctggagcacgagccacaaatccacagttggctgcggtgctcaggagcgctgctctggctcccacctccgacctggccggggatgcacttcttagtctgcttgccggggacctaggcgtcgaagtgcctagtgctgtccctcggccaaccctagagcccgcggagcagcttcccgtgcctcagggaattttgtttactactccttctcccagcgcgggacccgagcttttggccctacttgaagccgccttgcgttccggggctccaatccccgatccctgcccgcccttcttgcaaactgcagtgagtccagagtctagcgccctggccgccgttgattcaagtggatctgtgctgctcctgacctcctccctcaattgttctttcggctctgcccatctcagcccctcgactggcgtgctgctctcaaatctggtggctaagtccactactagtgcctgggcatgtccacttatactgaggggatctctggatgacactgaagccgacgtcctcggcctggtggcctcaggcactcctgatgtcgcccgggcaatgacgcacactctcctgagacacctggctgcacgccccccgacgcaagcacagcaccagcatcagggccaacaggagccgacagagcacccctcaacgtgtggccagggtacgcttctgcaggtggctgcccatactgaacatgctcatgtgtcttctgtcccccacgcttgctgtcctttccagggcttctag

SEQ ID NO: 118125 - DNA, 678 bp, Artificial Sequence
  Description of Artificial Sequence: Synthetic coding sequence
atgacaagcgagttcttttctgctcagctcagggcccagatttctgacgatactacccacccgataagttactacaaaccagaattttacatgcctgatgacggaggaacggctcacctgtcagtcgtggccgaggacggctcggctgtgagcgccacctccacaatcaatttatacttcggatctaaggttaggagccccgtgtcagggattctcttaaataacgaaatggacgattttagctctacaagtatcacaaatgaattcggagtgcctccctcccccgccaactttatacagccagggaagcagccactttcgagcatgtgtcccaccattatggtcgggcaagacggccaggtgaggatggtggtcggtgcagccggcggtacacaaatcacaatggccacagcactggccattatctataacctgtggtttgggtacgatgtgaaatgggctgtcgaggagccgcggctgcataatcagttgcttcctaacgtgaccaccgtcgaacggaacattgaccaggaggtcacagccgcattggaaacgcgccatcatcacactcagatcacatcgacgtttatcgccgtcgtacaggcgatcgttcgcatggctggggggtgggcagctgcatccgactccaggaaagggggcgagcccgccggatactag

SEQ ID NO: 118126 - DNA, 678 bp, Artificial Sequence
  Description of Artificial Sequence: Synthetic coding sequence
atgacttccgaattcttctcggcacagctgagagctcagatctccgatgacacaactcacccaatctcctactacaaacccgagttttacatgcctgacgacgggggcacagctcatctatctgtggtcgctgaagatgggtccgctgtatctgctacatcaacaatcaacttatatttcggatctaaagtgcgatcacctgtgtccgggattctcctgaacaatgagatggacgatttttcaagtacgtccattactaatgaattcggcgtgccaccatcccccgctaattttattcaacccgggaaacagcctctgtccagtatgtgtccaaccataatggtggggcaggatggccaggtgcgaatggtggtcggcgccgcgggcggaacccagatcaccatggcaacagccctggctattatttataacctctggttcggctacgatgtgaagtgggctgtggaagaaccaagactccacaatcagctcctcccaaacgtgacgactgttgaacggaacatcgaccaggaagtcacagcagccctcgaaactagacaccatcacacgcagatcacgagcacttttattgccgtggtccaagctattgtgaggatggcgggcggatgggctgccgcaagcgactctagaaagggcggtgagccggccggatactag

SEQ ID NO: 118127 - DNA, 678 bp, Artificial Sequence
  Description of Artificial Sequence: Synthetic coding sequence
atgacttcagagttctttagcgcccagctgagggcacaaatttcggacgacacgacacacccaatcagctactataaacccgagttctatatgccagatgatggaggcaccgcacacctgagtgtagttgcggaggacggcagtgcggtgagcgccacgtcaacgattaacctgtacttcgggtccaaggttcggtctcccgtgtcagggattctactcaacaacgagatggacgacttctctagcacatcaatcactaatgagttcggggtccccccttcgccagccaacttcatccaacctggaaaacagccactgagttctatgtgccctacgattatggtcggccaagacgggcaggtgagaatggttgtgggtgctgcgggggggactcaaattaccatggctacggcattggccattatctacaacctctggtttgggtacgatgtcaagtgggctgtggaggagcctaggctacataaccagttactccccaatgtcactacagtggagcggaatattgaccaggaggttaccgcggcgctggagacccggcaccatcacacccagattactagcaccttcatcgctgtggtgcaggccattgtgcgaatggcaggtgggtgggccgccgcttccgactcccgcaaggggggggagccagcaggttattag

SEQ ID NO: 118128 - DNA, 678 bp, Artificial Sequence
  Description of Artificial Sequence: Synthetic coding sequence
atgacatctgagttctttgccgcccagctgcgggcacagataagcgacgataccactcatccaatctcctattataagccagagttttataccccagtggatggggggacagctcacctcagtgtcgtggccgaggacggctctgcggtttctgctacctccaccatcaacctttattttggctcgaaggtacgttcacccgtgagcgagatcctctttaatgacgaaatggacgactttagctctcccaacattacaaacgaatttggcgtcccgcccagtccagctaacttcattcagcccggaaaacaacctctgtcctccatgtgccccaccataatggtgggacaggatggacaagtaaggatggtggtgggcgcagccggcggtacacagattaccaccgctacagctttagccatcatatacaatctatggttcggttacgacgttaaacgtgcagtggaggagccccggctacataaccagctcctgcctaatgtaacaaccgtagagagaaatatcgatcaagcggtaaccgctgcccttgaaaccaggcatcatcacactcagatagcctcaacttttattgccgtggtgcaggcgatagtgcgcactgccgggggttgggctgctgcatcagacagccgtaaggggggtgagcctgccggatactag

SEQ ID NO: 118129 - DNA, 657 bp, Artificial Sequence
  Description of Artificial Sequence: Synthetic coding sequence
atgacttctgagttcttcgccgcccagttgagagcccagattagcgatgacacgacccatccgatttcgtactacaagcccgagttctatactcccgtcgacggtggcacagctcatttatctgttgtggccgaagacggttcagcggtatccgccacgtctaccattaatctgtatttcggttccaaagtgaggtctcccgtgtctgaaattctctttaatgacgagatggatgactttagtagcccaaatattacaaacgaatttggtgttccacccagtcctgccaactttattcagccaggaaaacagcccctgagcagcatgtgcccaactataatggtgggacaggacggccagcccccttcccacgccgatcacacgcctatgccccaagcgattatttacaacctatggtttggctatgacgtgaaacgagccgtggaagagccccgacttcacaatcaattgctccccaacgtgaccacagtggagcggaacatcgatcaggctgttacagccgcgctggaaacaagacatcatcatacacagatcgcctccacatttatcgcggtggtgcaggccatcgtgcggactgccggcggctgggccgcagcatccgactctcggaagggcggggagccggcaggttattag

SEQ ID NO: 118130 - DNA, 678 bp, Artificial Sequence
  Description of Artificial Sequence: Synthetic coding sequence
atgacaagcgaattcttcgcagcccagctgcgcagtcagatctccgaccacaccacgcatccaatatcctattacaaacctgagttttatacaccagacgatgggggaaccgcgcatctgtcagtagtggcggaagacggttccgcggtcagcgctacttccaccatcaatctttatttcggctcgaaggtttgttcacccgtcagcgggatcctgtttaacaacgagtggacgactagtgcactgcccgcttttactaacgagtttggcgcgccgcccagcccagcaaacttcatacaacctggtaagcagcccctgctgtcaatgtgccccactataatggtgggtcaggacgggcaggtgcgaatggtcgtgggagctgctggaggcacccagatcacaaccgacaccgctctcgcaatcatttataatctgtggttcgggtatgacgtcaaacgcgcagtggaagagccaaggttgcataacaagcttctacccaatgtgaccacggtggagaggaacatcgaccaggcggtgacggccgcgttagagacaaggcaccaccatacacagatagcgagtacattcattgcggtggtccaggccattgtcagaacggctggaggctgggccgccgcttccgactctcgcaagggcggcgagccagcaggctactag

SEQ ID NO: 118131 - DNA, 711 bp, Artificial Sequence
  Description of Artificial Sequence: Synthetic coding sequence
ccagccctgggcagtcagcaggttgtaagaaatatgaccagcgagttttttgcggcccagctgcggtctcaaatatctgaccacactacacacccaatatcttactacaagccagagttctatacaccagatgacggcggtaccgctcatctgtccgtagtggccgaggatggaagcgcggttagcgccactagcaccattaatctgtacttcggtagcaaggtatgcagtccagtgagcggcatacttttcaacaatgaatggactacttcggctctgccagcgttcaccaacgagtttggggcccctccatccccggccaacttcattcagcctgggaagcagccgttgttaagcatgtgcccaaccattatggtgggtcaagacggtcaggttcgcatggtcgtgggagcagctggaggcacccagatcacaacggacactgcattggcgatcatctataacttgtggttcggatatgatgttaagcgggccgtcgaggagccccgtctgcacaataagctcctgccaaacgtaaccacagtggaaaggaatatcgaccaggccgtgacagctgcattagagaccagacaccaccatacacaaattgcctctacattcatcgcggtcgtgcaggctatcgtgcgaactgccgggggatgggctgccgcctctgattccaggaaaggcggcgagccagccggctactag

SEQ ID NO: 118132 - DNA, 675 bp, Artificial Sequence
  Description of Artificial Sequence: Synthetic coding sequence
atggtggctgcggttttgctcggcttgagttggttgtgttccccactcggggcgcttgtcctggatttcaataacatccgcagtagcgcggatctgcatggcgcccggaaggggagtcagtgcctgtcagatacagactgtaataccagaaagttttgtctgcagcctagggatgaaaagcctttttgcgctacatgcaggggcctgcgacgccgttgccagcgggatgccatgtgttgtccggggaccctgtgtgtgaacgatgtgtgtaccaccatggaagacgccacacctatcctggagagacagcttgacgagcaggacgggactcacgccgaggggaccactggccaccctgtccaggagaaccaaccaaaacggaagcctagcatcaagaagagccagggtcgtaagggccaggaaggggagtcctgtttacgcacatttgattgcggtccagggctctgctgcgcccggcacttctggaccaaaatttgtaaaccggttttgctcgagggacaagtgtgtagtagacggggccacaaagacactgctcaggctcctgaaattttccagcggtgcgattgcggacctggccttttgtgccgcagccaactgactagcaatagacagcatgctcgactgcgggtatgccaaaagattgagaaactttag

SEQ ID NO: 118133 - DNA, 873 bp, Artificial Sequence
  Description of Artificial Sequence: Synthetic coding sequence
atgcggctcaattccaccggtgaagtgcccgtcttgattcacggggagaacattatctgcgaagccacccagatcatcgactaccttgagcagacgtttctggacgagcgcactccccggttgatgccggacaaagaaagcatgtattacccccgtgtccaacactaccgcgaactcttagatagtctgcccatggatgcctacactcacggctgtattctgcatcccgagctcacagttgactccatgattccagcctacgccactacccggatcaggagtcagatcggaaataccgagtctgagcttaaaaagttggccgaggagaatcctgacctacaagaggcatatatcgctaaacaaaagcgccttaagagcaagctgcttgaccatgataatgtcaagtatttgaagaagatcttggacgagttggagaaggtcttggatcaggtggaaaccgaactgcagcggagaaacgaggaaacccctgaagaaggccagcaaccatggctttgtggcgagtctttcacattagccgacgtgtccctggccgtgactctgcatcgtttgaagttcctgggcttcgctaggagaaactggggcaatggcaagaggcccaacctcgaaacctattacgagagagtgttgaaacgtaaaacttttaacaaagtgttgggccatgtaaacaatatcttgatctccgcagtcttgcccaccgccttccgggttgccaaaaaaagggcaccaaaggttctgggaacaactctcgtggtcggcctgctcgcaggggttggatatttcgctttcatgctattcagaaagagactggggtcaatgattctcgccttcaggccccggccgaattatttctag

SEQ ID NO: 118134 - DNA, 1632 bp, Artificial Sequence
  Description of Artificial Sequence: Synthetic coding sequence
atgggagactggaatctgctgggaggaatcctggaggaagtccacagccacagcacaatcgtgggaaagatctggctgacgatcctcttcatttttcgtatgctagtactgcgggtggcagcagaagacgtttgggatgatgaacagagcgccttcgcctgtaacacccgccagcccggctgtaataacatctgttacgatgacgcgtttccaatttccctaatccgtttttgggtgcttcagatcattttcgtctcttctccttcactggtgtatatgggtcatgcactgtataggctcagggccttcgagaaagaccgccagagaaagaaaagccacctgagggcccaaatggagaacccagatctggatctggaagagcagcaacgcattgaccgagaactgcgcaggttagaagaacagaaaagaatccacaaggtgcccttgaaggggtgcctcctccggacatatgtgttacacatcctcacccgctccgttcttgaagtgggctttatgattggccagtacatcctctacggatttcagatgcatcccctctacaagtgtacgcagccaccatgcccaaatgcggtggactgcttcgtctcaagacctacggaaaaaaccatttttatgctgtttatgcactctattgccgctattagcttactgctgaatatcctggagatcttccatctggggattaggaaaatcatgcgcaccctgtacaagaaatccagctctgagggaatcgaggatgaaactggaccaccatttcatctgaaaaaatacagcgtggcccagcagtgtatgatctgttccagcctgcctgagaggatctctccactccaagctaataaccagcagcaggttatccgggtgaacgtccctaagtccaagactatgtggcagattccccaaccaaggcagctggaagtggacccatccaacggtaagaaggactggtccgaaaaggatcagcactccggccaactacacgtgcacagcccttgcccgtgggctgggagcgcaggaaatcaacacctggggcagcagtctgaccactctagctttggactgcaaaatacaatgtcacaatcatggcttggtactactaccgccccccgaaactgtccctcatttgcagtgggtacctgggagcagtcacaggatccagagcctagtggcgagccactgaccgatctccactctcactgccgggactccgaggggtctatgcgcgaatccggagtgtggatcgatagatctcgtcccggctctagaaaggcctcattcttgagtcgactcctttccgaaaagcgccacttgcattctgattcaggaagttctgggtctaggaactcatcatgcttggacttcccccattgggagaatagtccctctccgttgccaagcgtcactgggcatcgtacttccatggtgaggcaggctgccctccctatcatggagttgagccaagagctgttccattctggctgcttcctctttccctttttcctacccggggtgtgcatgtatgtatgcgtggatcgagaggctgatggtggaggcgattatctctggcgcgataagatcattcattccatccattccgtcaaattcaactcctag

SEQ ID NO: 118135 - DNA, 1308 bp, Artificial Sequence
  Description of Artificial Sequence: Synthetic coding sequence
atgggtgactggagctttctggggcgcctcttagaaaacgcccaggaacattcaactgttatcggcaaggtgtggctcactgtgctctttatcttcagaatcttagtgctgggcgccgctgccgaagatgtttggggagatgagcagagtgatttcacttgtaacacacagcaacccggatgcgagaacgtctgctatgacagagccttcccaatcagtcatatccgattctgggcactgcagatcatttttgtttcaacccctaccttgatttacttaggccacgttctccacattgtgagaatggaggagaagaaaaaggagcgcgaggaggaagaacagctcaagcgggagtcaccttcacccaaagaacctccccaggataaccccagctccagggacgacagaggccgtgttcggatggcaggcgcattgctcagaacttacgtatttaacatcatttttaagactctgttcgaagtaggattcatcgctggccagtatttcctgtatgggtttgagctcaagcccctgtaccggtgcgataggtggccttgtccaaacacagtagactgtttcatttcccgtcccactgaaaagacaattttcatcatatttatgctcgcagtggcctgtgcctccctgctgttaaacatgctggagatctaccacttaggctggaagaagttaaagcagggggtgacatcccggttaggtcctgacgcctctgaggcacctctgggaaccgcggatcccccccccctcccaccctcgagtcgccctcccgcagtcgcgattgggttccccccgtactacgcccacaccgcagctcccctggggcaggcaagagcagtgggataccccggtgcacctccacccgccgcagactttaaactgctcgccttgacagaagccagaggcaagggccaaagtgccaagctctacaacggtcatcaccacctgcttatgacagagcagaattgggccaatcaagccgctgaacgtcagccccccgcattgaaggcatacccggccgcctcaacccctgctgccccatccccagtgggatcttcgtctccaccactcgcccatgaagcggaggctggggccgcgcccctcttgttggatggcagtgggtcatcattagaaggaagcgcacttgctggtacacccgaagaggaagagcaagccgtgactactgctgcacagatgcaccagccaccgctccccttaggagatccaggtcgcgccagcaaagctagccgcgcttctagcggccgggcacgccccgaggacttagcaatatag

SEQ ID NO: 118136 - DNA, 1002 bp, Artificial Sequence
  Description of Artificial Sequence: Synthetic coding sequence
atgggggactggggattcttggaaaagctgttggaccaggtacaagaacacagtacagtcgtcggcaagatctggctaacggtccttttcatctttcgcatccttattctcggcctggcgggcgaaagcgtgtggggcgatgagcagagcgactttgaatgtaataccgcccagcccgggtgcaccaatgtctgctacgatcaggcatttccaatctcccacatcaggtactgggtgctgcagtttctgtttgtcagcacacccacactggtgtacctgggccatgtgatctacttgtcccgcagagaggaacggctacggcagaaagagggtgagctaagagccttgccagccaaggacccgcaggttgaaagggccctggctgccgtggagcgacagatggccaaaatcagcgtagccgaggatggtcgcctgcgcattcggggagcactcatgggaacgtacgttgcctccgttctctgcaaatcagtcctggaagccggcttcctgtacggacagtggagactgtacggatggaccatggaaccagtgtttgtgtgtcaacgtgcgccttgcccatatctggtagactgttttgtgagtagaccaacggaaaagacaattttcatcatcttcatgctggtagtcgggctgatttcactggtgcttaacttgttggaactcgtgcacctattgtgccgttgcctgtcaagaggaatgagagcccggcagggccaggacgcccctccaacccagggtacgtcgtcagacccctatactgaccaagttttcttttacctgccagtggggcagggacctagctcaccgccttgcccaacctacaacgggctttcctcctcggagcagaactgggccaatttgacgacagaggagaggctcgcttcctctcggccacccttattcctggaccctcctccacagaacggccagaagcctccatctcgcccctcatctagcgcaagcaaaaagcagtatgtgtag

SEQ ID NO: 118137 - DNA, 879 bp, Artificial Sequence
  Description of Artificial Sequence: Synthetic coding sequence
atgggcgactggggcttcctggagaaactcctggaccaggtacaggagcactcgaccgtggttggcaagatttggctgacagtgctgtttatctttcgcatattgatcctgggcctcgctggcgagtccgtctggggcgacgagcaaagcgattttgaatgcaatacggcacagcccggatgcaccaacgtttgttatgaccaggcgttccccatatcccatattcgatattgggtattacagtttctgttcgtcagcactcctacactggtctacctggggcacgtgatttatttgagtcggcgggaggagcgactccggcagaaggagggggagttacgtgcattgcctgccaaggatccccaagtagagagagccctggccgctgtcgagagacagatggctaagatttcagtggctgaagatgggaggcttcggattcgtggggcactaatgggcacgtacgtcgctagtgtgctctgcaagtcggtgttagaagctggctttttatacggacagtggcgactctatggctggacaatggagcctgtgtttgtgtgtcagagagctccttgtccctatcttgtggattgtttcgtctccaggcccactgagaaaactatctttattatctttatgctggttgtgggtttgattagccttgtccttaacctgctagaactcgtccaccttctgtgccgttgtctctcaaggggcatgcgggccagacagggccaggatgcccctccaactcagggcactagctctgacccctacacagaccaagtcttcttttatttacccgtcggccaagggccgagcagccccccttgtcctacctacaatgggctgtcctccagtgagcaaaattgggcttag

SEQ ID NO: 118138 - DNA, 882 bp, Artificial Sequence
  Description of Artificial Sequence: Synthetic coding sequence
atgggcgactggggatttctggagaagttgctcgatcaggtccaagaacatagcactgtggtcggcaagatctggctcaccgtattgttcatctttcgaatactaatcttggggctcgccggggaaagtgtgtggggggacgagcagagcgatttcgaatgcaacacagctcagcccggttgcacaaacgtatgttatgaccaggcttttcctataagccatattaggtattgggttctgcaatttctctttgtatcgacacctaccctagtttatttgggtcacgttatttatctgtctcggagagaagaacgtcttaggcagaaggagggggaactgcgggcccttcccgctaaagacccacaggtcgagcgggccctcgcggcggtcgagcgtcaaatggccaaaatctccgtcgccgaagacggccgtctgcgaattcgcggtgccctaatgggtacatacgtggcctctgtgctttgtaaatctgtacttgaagcaggttttctgtatggtcaatggaggctttatggatggaccatggaacctgtattcgtttgccagcgtgccccttgcccttatctcgtggactgttttgtgagtcggcctactgaaaaaaccatatttatcatctttatgcttgtggtcgggctgatatccctcgtgctcaacctgctagagctggttcacctgctttgccgctgtttgtcccgcggcatgagggccagacagggccaggacgcacctccaacccaggggacaccacagacactcacccgaaccaggtcctcatccacatcaccctgggcccgtggaccacaccctcatcatgcccctccaacaatggggtcccatcccgtcagtcgcaccggacccacatag

SEQ ID NO: 118139 - DNA, 1077 bp, Artificial Sequence
  Description of Artificial Sequence: Synthetic coding sequence
atgggcgactggtcctttctgggtaactttttagaggaggtccataagcacagtactgtcgttggcaaggtgtggctaactgtgcttttcattttccggatgctggttcttggaaccgcagcagaaagcagttggggtgacgaacaggctgattttcgatgtgatactatccaacctgggtgccagaatgtctgttatgaccaagccttccccatcagccatatacgttactgggtgctgcagattatcttcgtctcaacacctagcctagtgtacatgggacatgctatgcatacggttcggatgcaggagaagcggaagctccgcgaagcagaacgcgccaaagaggtcagaggatctggaagctatgaataccccgtagccgaaaaggccgagttgtcatgttgggaagaggggaacggtcggatcgcgcttcagggcaccttgcttaacacctatgtgtgcagcatcctgattcgcacaacaatggaggtggggttcatcgtaggacagtactttatatacggtatattcctgacgacgctccacgtgtgccgtcggagcccttgcccccaccctgtgaattgttacgtctcccgtcccactgaaaaaaacgtgtttatcgtcttcatgttagccgtcgccgcattgtccctgctgctttcgctggcggagctttaccatttgggttggaagaaaatacgccagcggttcgtaaaaccaagacaacacatggctaaatgccagctgagtggtccttccgtcggaatcgtccaatcctgcaccccacccccagactttaatcagtgtctggagaatggcccaggtggaaagttctttaatccattctctaataacatggcctcccagcagaataccgataatctcgtgacagaacaggtacgcggtcaggaacagactcctggggaaggcttcatccaggtccgctacggccaaaaacccgaggttcctaatggagtctcaccaggtcaccgattgccccacggctatcactctgataaaagacggctaagcaaggcatcctcaaaggcgaggagtgacgatctttcagtgtag

SEQ ID NO: 118140 - DNA, 1077 bp, Artificial Sequence
  Description of Artificial Sequence: Synthetic coding sequence
atgggagattggtcgttccttggcaatttccttgaagaagtacataagcacagcacggttgtgggaaaggtctggctgactgtgttgttcatctttcgcatgcttgtgctcggtaccgccgccgaatctagttggggggacgagcaggcagacttcagatgcgacacaatccagcctgggtgccagaatgtatgttacgaccaggcttttcctataagccacatccgctactgggtacttcaaatcattttcgtttccacgccatcattggtatacatgggacacgctatgcacacggtgagaatgcaggagaagaggaaactgcgggaggctgaaagggctaaagaggtgaggggttctgggtcatacgagtacccagtagctgagaaggccgaactcagctgttgggaggaagggaatggtaggatagcacttcagggaactctcctgaacacatacgtgtgctctattctgatccggacaacaatggaagtgggctttattgtaggacagtatttcatctatggcatctttctcacgacactacacgtgtgccgccggagcccatgcccccaccccgtgaattgctatgtctcccgccccaccgagaagaacgtgtttattgtcttcatgctagcagtcgccgccctcagcctactgcttagcctcgctgagctctaccatctcggttggaaaaaaatcagacagagatttgttaaaccccggcagcacatggcaaaatgtcagttgtccggacccagcgtgggtatagttcagtcttgcaccccccctccagactttaaccagtgccttgagaacggccctgggggcaaattttttaatcctttctctaacaacatggccagtcagcagaacaccgataacctcgttacagaacaggtgcgtggccaagaacagactcctggagagggttttatccaggtgaggtatggccaaaagcctgaggtcccaaacggcgtgtctccagggcatcgactgcctcatggatatcactcagacaaacgccggctgagcaaagcttcatctaaggccagaagcgatgatctttctgtgtag

SEQ ID NO: 118141 - DNA, 759 bp, Artificial Sequence
  Description of Artificial Sequence: Synthetic coding sequence
atgggcgattggagtttcctgggtaattttctggaggaagttcacaagcacagtaccgtcgtggggaaagtgtggctgacagtcctgtttatctttagaatgctcgtgcttggcactgccgccgagagttcgtggggggatgagcaggccgatttccgatgtgatactatacagcccggctgtcagaatgtgtgctacgaccaggcatttcccatctcccacatccgctactgggtcctgcagatcatctttgtgagtacgcctagcctggtgtacatgggccacgctatgcacacagtgagaatgcaagaaaaaagaaaactacgtgaagccgagcgtgccaaggaggttcgcggatcaggctcctacgaataccctgtggctgagaaggctgaattgtcatgttgggaggaggggaacggacggatcgcccttcagggcacactgctcaacacctacgtgtgctctatcttgattagaaccactatggaggtgggctttatcgttggacagtacttcatttacggcattttcctaactactctgcacgtgtgccggcgctcgccatgcccccaccccgtaaactgctatgtaagtagaccaacggaaaagaacgtgttcattgtgttcatgctcgccgtagcagccctgtcacttctgttgtcgttggcagagctataccacttggggtggaagaaaattcggcagaggttcgttaagcctcgccagcatatggcaaagtgtcaactgtcgggctag

SEQ ID NO: 118142 - DNA, 1302 bp, Artificial Sequence
  Description of Artificial Sequence: Synthetic coding sequence
atgggcgactggagctttcttggcaatatcctggaagaagtaaatgaacatagtactgtcataggacgcgtttggcttacggtgctgttcatctttcggatactcattcttggtaccgcagcagaatttgtgtggggtgatgagcaatctgatttcgtgtgtaatacgcagcagcccgggtgcgaaaacgtctgctatgacgaggccttccccatttcccatatccgcctatgggtactccagatcatatttgtgagcaccccgagcctgatgtacgtcggccacgccgtgcattacgttcgaatggaagagaaacgtaagagtagggaagccgaagagcttggacagcaggcaggcacgaacggcggccctgaccagggctctgttaagaagtcttccggctctaaagggactaaaaagtttcgcctagagggtactctcctacggacctatatctgtcacattatattcaaaaccctgttcgaggtggggtttatcgtgggtcattatttcctctacgggtttcgcatactgcccctataccgttgtagccgctggccatgtcccaacgtggtggattgcttcgtgtctaggcctaccgagaaaacaatttttatcttgtttatgctgagcgtggcaagtgtgagcctgtttctgaacgtcatggaactgggacatcttggtcttaaaggaatccgctctgccctcaaacgccccgtggagcagccgctgggggagattccagagaagagcctgcacagcattgccgtttcctctattcaaaaggcaaaaggctatcagctgctggaagaagagaaaatcgtctcccattatttcccattaaccgaggtgggcatggtggagacctcaccactccctgccaaaccatttaaccagttcgaggagaagatatcaactgggcctcttggagatctgtcccgtggataccaggagaccctcccatcatatgcccaggtcggcgctcaggaagttgaaggggagggaccacccgctgaagagggagcagagccagaagtgggggagaagaaagaggaagccgagcgcctgaccacagaggaacaagaaaaagtggccgtccccgaaggagaaaaagtagaaacccccggtgtggacaaggaaggtgagaaggaggagccccagtccgagaaggtgagcaaacaggggctgccggccgaaaagacaccaagtctctgtccggaattgacaacagacgacgctcggcctctttctagactgagcaaggcgagttctagagcccggtccgacgatctaaccgtgtag

SEQ ID NO: 118143 - DNA, 1302 bp, Artificial Sequence
  Description of Artificial Sequence: Synthetic coding sequence
atgggagactggtctttcttgggaaacatcttggaagaagttaacgaacactcaaccgttatcggacgggtgtggctgaccgtgctatttatattcagaatcctgatcctggggacagctgctgaatttgtatggggtgacgaacagagcgactttgtttgtaacacccaacagcctggctgcgagaatgtttgttatgacgaggcgttccctatttcccacataagactatgggtacttcagatcatctttgtgtctaccccgtcgctgatgtacgtgggccatgcggtccactacgtgagaatggaagagaagcgaaagtcacgcgaggctgaggaactgggccagcaggcaggtaccaatggtggcccagaccagggatcagttaaaaaaagctcagggagcaaaggcaccaagaagtttcgtcttgagggcaccctactgcgcacgtacatttgccatattatattcaaaaccctctttgaagtcggctttattgtgggacattattttctttatgggtttagaatattacctctgtaccgctgttcccgctggccttgccctaatgtggtggactgctttgtgagccgcccaaccgagaagacgattttcatactgttcatgctctccgtggccagcgtgagtctgttcttgaatgttatggaattagggcatctgggcctaaagggaatacgctcagccctgaagcgcccagtagaacagcctctgggtgaaatccctgaaaaaagtcttcactctattgctgtctcatcgatccagaaggccaagggttatcaattattggaagaggagaagatcgtgtcccactattttccgttgacggaggtgggaatggtcgaaaccagccccttaccggccaagccttttaatcaattcgaggagaaaatcagcaccggtcccctgggggatctgagccgaggctatcaggagaccctaccctcgtacgcccaggtgggagcacaggaagttgaaggcgaagggcctccagccgaagagggggccgagcccgaggtcggagagaagaaggaagaggcggaaaggttgacgactgaagaacaggagaaagtagccgtgccggaaggcgaaaaggtggaaacaccgggtgtcgataaagaaggggaaaaggaagagccccagtctgagaaagtctccaaacagggtcttccagctgaaaaaacgccgagcctgtgtcccgaactgactaccgacgatgctcgacccttaagccgactgtcaaaagcaagcagccgtgcacgatctgacgacctgacagtgtag

SEQ ID NO: 118144 - DNA, 1548 bp, Artificial Sequence
  Description of Artificial Sequence: Synthetic coding sequence
atgggggattggaacctcctgggcgatacccttgaggaagtccacattcactccaccatgatcgggaaaatctggttgaccatactgttcattttcagaatgctggttctgggagttgccgccgaggacgtgtggaacgacgagcagagcggtttcatctgcaacaccgagcagcccggctgccgaaatgtttgctacgaccaggcctttcccatcagtctgattcgatactgggtgcttcaagttatcttcgtatcaagccccagtctcgtgtatatgggacacgccctctaccggttgagagtacttgaggaggagcgtcagaggatgaaggctcaattaagagtcgagctggaagaggtcgagtttgagatgccccgtgaccggcggcggctggaacaggagctgtgccagctggagaagcggaagctgaacaaagcaccgctccgcggtacactcctctgcacgtatgtgattcatatattcaccagaagcgtcgtagaggtcgggttcatgattggccaatatcttctgtacggattccaccttgaacccttgttcaagtgtcacggccatccctgtccaaacatcatcgattgctttgtgagtcgaccaaccgagaaaacaatcttcttgctctttatgcagagcatagccactataagtctgttcttgaatatcctcgagatcttccatctcgggtttaaaaagattaaaagagggttatgggggaagtacaaactgaagaaggagcataacgaattccacgcaaataaggcaaagcagaatgttgcgaagtaccagtctaccagcgctaatagtctgaaacgattgccttctgctcccgactataatcttctcgtggagaagcaaacccacaccgcagtttatccctcactcaattcatcgagtgtcttccaaccaaaccctgacaaccactccgtcaatgatgagaagtgtattcttgatgagcaggagactgtgctgtctaacgagatttctactctgtccacttcttgctcccacttccaacatatatcatctaacaacaacaaggatacgcacaaaattttcgggaaggaactcaacggcaatcagctgatggaaaagcgcgagacggaaggcaaggatagcaagagaaactactactcccgagggcaccggagcatcccaggggtggctattgacggcgagaataacatgaggcagtcccctcagacagttttcagcctgccggcaaactgtgattggaaaccaagatggttaagggcaacatggggctctagcaccgaacacgagaatagggggtctcctcctaaaggaaacttgaagggacaattcaggaagggaaccgttaggactctgcccccctcccaaggtgattcccagagtctggatattcctaatacagcagatagcctgggcggcctctcattcgagccagggctggtccgaacatgtaacaatcccgtgtgccctccaaaccatgtcgtctctctcaccaataacctcattggcagaagggtgcctaccgacctgcagatctag

SEQ ID NO: 118145 - DNA, 1548 bp, Artificial Sequence
  Description of Artificial Sequence: Synthetic coding sequence
atgggggattggaatctgctaggcgacactctggaggaggtgcacatccattccaccatgatcggcaaaatctggctaacaattctgttcatatttcgtatgctggtcctgggagtggcggccgaggatgtttggaacgatgaacagagcggctttatttgcaataccgagcagccgggctgcaggaatgtgtgctatgatcaggcctttccaatctctctaattcggtactgggtactgcaggtgatttttgtctcaagtccttcccttgtgtatatggggcacgccctgtaccggcttcgcgtcctggaggaggagcgtcaacgcatgaaagctcagttgagggtcgagttggaagaagttgagttcgagatgccgcgggaccgaagaagactggaacaagaactttgtcagctggaaaagcgtaagttaaacaaagcccctctgcgtggtacacttctgtgcacatacgtgattcacatctttacccgttctgtagtggaagtgggcttcatgatcggccagtacctcctgtatgggtttcacttggaaccattgttcaagtgccatgggcatccttgtcccaacatcatcgactgcttcgtgtctagacctactgagaaaacaatttttctcttatttatgcagtctattgccaccataagcctgtttctaaacatccttgaaatctttcatctaggtttcaagaagataaagcgcggactgtgggggaagtataagctgaagaaggagcataacgagttccacgcgaataaggctaaacagaacgttgctaagtaccagagtacctctgccaacagcctgaagagactcccctctgcgccagactataacttgcttgtggagaagcagacccacactgccgtctacccgtcattaaattcatcctcagttttccagcccaaccccgataatcactcagtgaacgacgagaagtgcattcttgacgaacaagagactgtactcagcaacgagatcagtaccctctctacgtcatgcagtcatttccagcatatttcgagtaataataacaaggatacccacaagatatttggcaaggagctgaacggcaaccagttaatggagaagcgggagacagaaggcaaagatagtaaacgcaactattactcacgcggccaccggagcattccaggcgtggcaatagacggggagaataatatgaggcaaagtccgcaaacggtgtttagcctgcccgccaattgcgactggaaaccgaggtggctaagagccacctggggcagctcaacagaacacgaaaacagaggatcccccccaaaaggcaatctgaaaggtcaatttagaaaaggaaccgtgaggactctcccacctagtcagggagattctcagagccttgacatcccaaacacagctgactctcttggaggattatctttcgaacccggcctcgtgcggacttgcaacaaccccgtgtgtccgcccaaccacgtggtgtcccttactaataatctgatcggccggcgggttcccactgatctgcagatttag

SEQ ID NO: 118146 - DNA, 1545 bp, Artificial Sequence
  Description of Artificial Sequence: Synthetic coding sequence
atgggagactggaatctcttgggcgacacgctcgaggaagtgcatattcattccactatgattggaaaaatctggctgaccattctgttcatttttcggatgcttgtacttggggtagccgctgaggacgtgtggaatgacgaacagtccggcttcatctgcaatacagaacagcctgggtgccggaatgtatgttacgatcaggctttccctatctccctgattaggtactgggtgctccaggttatctttgtgtcgagcccttctctggtgtacatgggacacgccctgtatcggctcagagtactcgaggaggagcgacaacggatgaaagctcagcttcgcgtcgagttggaagaggtggaattcgaaatgcctcgcgacaggaggcgcttggagcaggaactgtgccagctggagaaaaggaagctcaataaggcacctctgaggggcactctcttatgcacttacgttattcacatctttaccaggtcagtggtcgaagtggggtttatgatcgggcagtatctgctgtacggatttcatctggaacccttgtttaaatgccacggtcacccgtgcccgaacattatagactgttttgtaagcaggcctacagaaaaaaccattttcctcctattcatgcagtccattgcgacgatttccctgttcctcaatatcctggagatttttcatctgggcttcaagaagattaaaaggggcttgtggggtaaatataaactgaagaaggagcataacgaatttcacgccaacaaagccaagcagaatgtagccaaatatcagtctacatctgcaaacagtttaaagagactcccatccgctccagactataacctccttgttgaaaagcagacgcatacagcagtctacccttctttaaacagctccagtgtcttccagccgaatcccgataaccactctgttaacgacgagaaatgtatactcgatgagcaggagaccgttctctctaacgagatcagtacattgagtacgtcatgctcacatttccaacacatcagctctaataataacaaggacacacacaagatttttggcaaggagcttaacggaaaccagttaatggaaaagagagaaacagaagggaaggactcaaagcggaactattatagcagaggtcaccgatctattccaggtgtggctatcgacggcgagaataatatgcgccagtctccccagactgtcttttctttaccagctaactgtgactggaaacccagatggttgagagccacttggggtagtagtaccgaacacgagaataggggcagccctcctaaagtccctggcagtaaagccaccgcctccagtctgctgctgatattgcagaggcccaccagctcccaaccccgcttgaaggagacacccaagatcaaggctgaggccaaaatctacgactccaagcaccccccgcggctgcttcagagcactgtctccacatttagtggtcgagagccccgatctcctgcccccatggggcatcattcctttagagggccccgctag

SEQ ID NO: 118147 - DNA, 852 bp, Artificial Sequence
  Description of Artificial Sequence: Synthetic coding sequence
atgaactggaccgggctgtacactttgctgagtggagtgaaccgtcattccacagcgatcggccgggtctggctctcagtgatttttatctttagaattatggtccttgtggtagctgccgagtccgtgtggggagatgaaaaatcctctttcatttgcaacaccctgcagccaggctgcaattccgtgtgttacgatcagttctttcctatttcacacgtgcgcctgtggagtctgcagctgatactggtttcaaccccagccttactggtggctatgcatgtggcacaccagcagcatatcgaaaaaaagatgctccgcctggaggggcacggagaccccctccacctggaagaggtcaaacggcacaaagtacatatctcagggaccctctggtggacctatgtgatttccgtcgtgtttcggttgctgttcgaggcagtgttcatgtatgttttctacttgctgtatcctgggtatgcaatggtgcgcctggtgaagtgcgatgtgtacccatgcccgaacacagtggactgcttcgtgagcaggccaaccgagaagacagttttcaccgtgttcatgctggctgcctctggtatttgcatcatcctcaacgtcgcagaagtcgtgtacctaattatcagagcctgtgctcgccgcgcacaacgcagatcaaatcctccgtccaggaaaggctctggattcggacacaggctgtccccggaatacaagcagaatgagattaacaagctgttgtcagagcaggacggctccttgaaagatatactcaggaggtctccgggtaccggagccggactagccgaaaagagcgatagatgcagcgcttgctag

SEQ ID NO: 118148 - DNA, 852 bp, Artificial Sequence
  Description of Artificial Sequence: Synthetic coding sequence
atgaattggacaggcttatataccttgttgtccggggttaacaggcactctacagccataggcagagtctggctgtccgtcatttttattttccggatcatggtccttgtggtcgcagctgaaagcgtttggggggatgagaaaagttcgtttatctgtaataccctccagcccggttgtaacagcgtgtgttatgaccagttcttcccgatcagccatgtccggttatggagtcttcagcttatcctggtgagcacaccagccctgctagttgcaatgcacgtggctcatcaacagcacattgagaaaaagatgctgagactggaaggtcatggcgatcctcttcatttagaggaggttaagcgccacaaagttcatatttccgggacgttatggtggacctacgtgatcagcgtcgtgttccgccttttatttgaggcagtgttcatgtacgtgttctatcttctctatcccggctatgccatggtgcgattggtgaaatgtgatgtttatccctgtccgaacacagtcgattgttttgtgtcacggcctacggaaaagactgtcttcacagtgttcatgctggccgcttccgggatttgtatcatcctgaatgtggcagaggtggtgtatctgattattcgggcatgtgcacggagagcacagaggaggtccaacccccctagtaggaagggctctggctttgggcatcgtctctctcctgagtacaagcagaacgagataaataaactgctgtcagagcaggatggttccctaaaagatatcctccgccgatccccaggaacgggagccgggctggctgagaaatctgatcgctgtagcgcctgctag

SEQ ID NO: 118149 - DNA, 852 bp, Artificial Sequence
  Description of Artificial Sequence: Synthetic coding sequence
atgaattggacgggcctatataccctgctgagcggcgtgaacagacattctaccgctatagggagggtttggctatcggtgattttcatcttccggatcatggtgttggtcgtcgccgcagaatctgtgtggggcgatgagaaatcatcattcatctgtaataccctacagccagggtgtaactccgtgtgttatgatcagttcttccccatctcacatgtgcgcttatggtccctccaactgattctggtctccacaccggccctcctcgttgctatgcatgtggcacatcagcagcacatcgaaaaaaaaatgttacgtcttgagggacatggcgacccactccatttggaagaggttaagagacacaaggtacatatcagcggcacactatggtggacctacgtgatttctgtggtctttagattgttgttcgaggccgtgtttatgtacgtcttctatttgctgtaccccggatacgctatggtgagactggttaagtgcgacgtctatccgtgcccgaacaccgtggattgctttgtatctcgccccactgaaaagaccgtttttaccgtgttcatgctagcggcctctgggatctgtatcatactcaatgttgctgaagtggtgtacctcatcatcagggcttgcgcaaggcgagcccaacgaaggtctaaccccccttctcggaagggctccggtttcggccatcgcctgtcacctgaatacaaacagaatgaaatcaacaagctactgtccgaacaagacgggagcttgaaggatatcctccggagaagcccaggaaccggcgccgggctggctgaaaagtccgataggtgctcggcctgttag

SEQ ID NO: 118150 - DNA, 255 bp, Artificial Sequence
  Description of Artificial Sequence: Synthetic coding sequence
atgaattggactggcctgtatactctgctatctggagtgaataggcacagcaccgcaataggtagagtgtggctgtcagttatctttatattcaggataatggtgctggtcgtggcagccgagagtgtgtggggcgacgagaagtctagttttatctgcaataccctgcaacccggttgtaactcagtgtgttatgaccagtttttcccaatctcccacgtaagactgtggtctttgcagctgatcctggtgtag

SEQ ID NO: 118151 - DNA, 681 bp, Artificial Sequence
  Description of Artificial Sequence: Synthetic coding sequence
atggactggggcactctgcagactatcctgggaggggtcaacaaacacagcacctccattggaaagatctggttgacagtgctgttcatatttcggatcatgatcctggtcgtcgccgccaaggaggtctggggggacgaacaggccgacttcgtctgtaacaccctccagcccggctgcaagaacgtgtgctatgaccactacttccctattagccatatccgattgtgggctctgcagttgattttcgtttctacccccgctcttctggtggccatgcacgtcgcttacagaaggcacgaaaagaagaggaaattcattaaaggagagataaaatccgagttcaaggacatcgaggagatcaagacacaaaaggtcagaattgaaggctctctatggtggacctatacatcctccatcttttttagggtgattttcgaagccgctttcatgtatgtgttttacgtaatgtacgacggtttctcgatgcaacggctcgttaaatgtaatgcctggccatgtccaaatactgtggactgctttgtgtctaggcccactgagaagaccgtgtttacagtctttatgatagctgtgagcggaatttgtatacttctgaacgtgaccgaactatgttacttgttgatcagatactgctccggaaaaagtaagaagccagtgtag

SEQ ID NO: 118152 - DNA, 681 bp, Artificial Sequence
  Description of Artificial Sequence: Synthetic coding sequence
atggactgggggactttacaaacaatcctgggcggcgtgaacaaacattctacgagcattggaaagatttggctgacagtgctttttatctttagaatcatgatcttggtggtggcagctaaagaggtctggggcgacgaacaggctgactttgtgtgcaacacattacagcccggctgtaaaaacgtctgctatgaccactacttcccgatctctcatatcaggttatgggccctgcagttaatcttcgtgtcaaccccagccctgttagttgccatgcacgtggcctaccgcagacatgagaagaagcgcaaatttattaagggcgagatcaagtcagaattcaaggacatcgaagaaatcaagacccagaaggtgcgaattgaaggctcattgtggtggacttacacatcaagcattttttttagagtgatcttcgaggcagcttttatgtatgtcttttatgtgatgtacgatggcttttctatgcagcgcctggtaaagtgcaacgcatggccatgccccaataccgttgattgtttcgtgtccagacccaccgagaaaactgtgtttaccgtcttcatgatcgctgtctcagggatctgcatcttgctgaacgtcacagaattgtgttatctgttaattcgttattgtagtggcaaaagcaagaaaccagtttag

SEQ ID NO: 118153 - DNA, 813 bp, Artificial Sequence
  Description of Artificial Sequence: Synthetic coding sequence
atggactggaaaactctccaggccctgttatctggagtgaacaaatattccactgcattcggcagaatttggctttccgttgtgttcgtgttccgcgtgttagtgtacgtagtggctgccgagcgggtgtggggagacgagcagaaggactttgattgcaataccaagcagcctggatgcacgaacgtttgctatgacaattactttccaataagcaacatccggctatgggcccttcaactgatttttgttacttgcccctccctactggtaatcctccatgtcgcctatagggaagagagagagaggcgccaccgtcagaagcacggggaccaatgtgctaagctgtacgacaacgccgggaaaaaacacggtggattgtggtggacctacctattttcattgatcttcaaactgattatagagtttctcttcctctacctcctccatactctttggcacggatttaacatgccccgcttagtccagtgtgcaaatgtggctccgtgtccaaacatcgtagattgctacatcgctcgccccaccgagaaaaagatctttacatattttatggtcggcgccagtgccgtttgcatcgtgctcaccatttgtgagctgtgctatctgatatgccacagggtacttcggggactgcacaaggataagccgcggggcggttgtagcccatcctctagcgcttccagagctagtacctgtcggtgtcatcacaaactggtggaggctggcgaggtagatcctgatccaggcaataataagctgcaggcatcagcacccaatttgacacccatttag

SEQ ID NO: 118154 - DNA, 813 bp, Artificial Sequence
  Description of Artificial Sequence: Synthetic coding sequence
atggattggaagactctgcaggcattactaagcggcgttaataagtatagtacagccttcggtaggatctggttgagtgtggtcttcgtgttccgggtcttagtgtacgttgttgcagcagagcgggtgtggggcgacgagcagaaagacttcgattgtaacaccaagcagcccgggtgcactaatgtctgctacgacaactactttcccatctccaacattcgactgtgggcattgcagttgatttttgtgacctgtccttctctgctggtgatactccacgttgcttaccgggaagagcgtgaaaggcggcataggcagaaacacggggaccaatgtgctaagctctatgacaatgctggcaaaaaacacggtggcctgtggtggacttacctcttttccctcatctttaagctcatcatagaatttttgttcctgtacctactacataccttgtggcacggatttaacatgcctcgtttggtgcagtgtgctaatgtggccccctgccctaacatcgtcgattgttatattgccaggcccacagagaaaaaaatttttacatacttcatggtgggtgcctccgccgtgtgtattgtgctgacgatttgcgaactgtgttacctgatttgccatcgggtgttgcgaggtcttcacaaggacaagccccgcggcggatgctctccgagttcctctgctagtagggcctctacttgccgatgtcatcataagctggtggaagccggagaggtggatcccgatccagggaacaataagttgcaggctagtgcacctaaccttactccgatatag

SEQ ID NO: 118155 - DNA, 765 bp, Artificial Sequence
  Description of Artificial Sequence: Synthetic coding sequence
atggattggaagaccttgcaggctctgctgtctggcgttaataagtattccaccgcgttcggaagaatatggctgagcgtggtctttgtctttcgggttctggtctatgtggtggctgccgagcgcgtgtggggcgacgagcagaaagattttgattgcaacactaaacaaccaggctgcacgaacgtatgttacgacaattactttcccatatccaacatccgactttgggccctacagttgatctttgtcacctgtccgagcttgctggtcatccttcatgttgcctacagggaggagcgcgaacgaagacaccgccagaagcacggagaccagtgcgcgaagctgtacgacaacgccgggaagaagcatggaggcctttggtggacctacctgctgcatacactgtggcatggtttcaatatgccaagactggtgcaatgcgcaaacgtggcaccctgccctaatatcgtggattgctacattgcaagacccacagaaaagaagatctttacctatttcatggttggtgccagcgccgtctgcattgttctcactatatgcgagctgtgctacctaatttgccaccgcgtcctccgaggattacacaaggacaagccccggggggggtgttcaccatcttcatctgctagcagagccagtacttgcagatgccatcataagctggttgaagctggagaagtggaccccgaccccggcaacaataagctgcaggcctctgcacccaatctgacgcctatttag

SEQ ID NO: 118156 - DNA, 801 bp, Artificial Sequence
  Description of Artificial Sequence: Synthetic coding sequence
atgaactgggcattcctgcaaggcctactctcgggcgtcaacaagtatagcactgtcctttcacgtatttggctgagtgtggtgttcatcttccgcgtgttggtgtatgtagtagccgccgaagaggtctgggatgacgagcaaaaagatttcgtgtgtaacacaaagcagccgggctgcccaaatgtgtgctacgacgaattttttccagtatctcacgtacggttatgggcgcttcagctaatcctggtgacctgcccatccttgcttgtggtcatgcatgtagcctatcgggaggagcgggagcgcaaacatcacctcaaacatggtccaaatgcccccagtctgtacgacaatctgagcaagaaacggggcggactgtggtggacctacctcctgtctttaatattcaaggcggccgtcgacgcaggctttctgtatattttccaccggttatataaagactacgatatgcccagggtggtagcctgcagcgttgaaccatgccctcataccgttgactgttatatctcaagacccacagagaaaaaggttttcacttattttatggtgacgactgccgcaatttgtatcttactcaacctttcggaagtgttctaccttgttgggaaacgctgtatggaaattttcggtcccagacatcgcaggcccaggtgcagagagtgtctcccagatacttgtccaccctatgtgttaagccagggagggcacccagaagatggaaactccgtgctgatgaaggctggctccgcccctgtggatgcaggaggatacccctag

SEQ ID NO: 118157 - DNA, 822 bp, Artificial Sequence
  Description of Artificial Sequence: Synthetic coding sequence
atgaactggtccatcttcgagggtctcttgtccggagtcaataagtactctaccgcattcgggaggatatggctttctctggttttcatcttccgcgtgttggtgtacctcgttaccgctgagcgggtatggtctgacgaccacaaagacttcgactgcaacactcgtcaacccggttgctccaacgtttgttttgacgagttctttcccgttagtcatgtccgtctctgggcactgcagctgatactggtgacttgcccgagcctcctggtggtaatgcacgtggcataccgcgaagttcaggagaagagacatcgtgaagcccatggagaaaactccgggagactttacttgaaccccggaaaaaagcgaggcgggctgtggtggacatacgtctgttcacttgtgttcaaggctagtgtggacatcgcctttctgtatgtgtttcactccttctatcctaaatacatactgccccccgtcgtgaaatgccatgctgacccatgtccgaatatcgtggattgtttcatctctaaaccaagtgagaaaaacatatttaccctgtttatggtggctacagccgcaatctgcattcttttaaatctagtggagctgatctacctcgtaagcaagcggtgtcacgaatgtctcgcagcccgtaaggctcaagctatgtgcaccggacaccatccgcatggtactactagttcatgtaaacaagatgatctgctgtccggagacctcatctttctcggatctgactcacatcctcctctcctcccagataggccaagggaccatgtcaagaagacaatcctgtag

SEQ ID NO: 118158 - DNA, 786 bp, Artificial Sequence
  Description of Artificial Sequence: Synthetic coding sequence
atggattggggtacactccatacttttattggtggagtcaacaagcatagtacgtctatcgggaaagtttggatcaccgtgatttttatcttcagagtgatgattctggtggttgctgctcaggaggtgtggggtgatgagcaagaggatttcgtctgcaataccttacagccaggatgtaaaaacgtgtgctacgatcatttcttccccgtgagccatatccgcctttgggcactgcagctcattttcgtgagtacacctgctttgctcgttgccatgcacgtcgcctactataggcacgagacgacacggaaattcagaagaggtgagaagagaaatgactttaaggacattgaggatatcaagaagcagaaagttcgcattgagggaagcctgtggtggacttatacgtcgagtattttcttccggattatattcgaagctgctttcatgtacgtattctactttttatacaatggataccatctgccgtgggtgttaaaatgcggtattgacccatgcccgaacctagtggactgcttcatttctcgaccaaccgagaagaccgtgtttactattttcatgattagcgccagcgtcatctgtatgctgttgaatgtggcagaactgtgttatctgctcttgaaagtttgcttccgaagatccaagagagcccagacccagaaaaaccatccaaaccacgctttgaaggagtcaaaacagaacgagatgaatgaactcatcagtgatagcgggcagaatgctattacaggcttcccctcctag

SEQ ID NO: 118159 - DNA, 786 bp, Artificial Sequence
  Description of Artificial Sequence: Synthetic coding sequence
atggactggggaacactacatacctttatcggtggcgtgaacaaacactctacaagcattggaaaagtatggataacggtgatctttatatttcgcgttatgatcctggtggtcgctgcccaggaagtctggggtgatgagcaggaagatttcgtgtgtaatacgctgcagccagggtgtaagaatgtttgctacgaccatttctttccagtttcccatattcggctgtgggcactgcagctgatattcgtatccacgccagcactgctcgtggctatgcatgtcgcgtactaccgacatgaaactaccaggaaatttaggcggggggagaagagaaatgacttcaaagatatcgaagacatcaaaaagcaaaaggtccgtatcgagggaagcctgtggtggacctacactagcagcatattttttcggatcatctttgaggccgcctttatgtacgtgttttacttcctgtataacggctaccatctaccttgggtgctcaaatgcggtatcgacccttgcccaaatctggtcgactgcttcattagccggccaaccgaaaagactgtcttcactattttcatgatctcagctagcgtaatctgcatgctgttgaacgtggcggagttatgctacctgctgctcaaagtctgtttccgtcgctccaaaagagcacaaacccagaagaatcatccgaaccatgctctgaaggaaagcaagcaaaatgaaatgaatgagctcatctccgactctggccaaaacgccattaccggcttcccatcatag

SEQ ID NO: 118160 - DNA, 786 bp, Artificial Sequence
  Description of Artificial Sequence: Synthetic coding sequence
atggattggggaacactacacacattcattggcggagtgaataaacattcaactagcatagggaaggtgtggattacagttattttcatatttcgggttatgatcttagtggtcgcagctcaggaagtgtggggtgatgagcaggaggactttgtgtgcaatactcttcagcctgggtgcaagaatgtgtgctacgaccacttctttcccgtctcacatatccggctctgggccctgcagttgatattcgtttccacgcctgcattactggtggctatgcatgtagcctactatagacatgaaaccacccggaagttcaggcgaggggagaaacgcaacgactttaaggacatcgaagatatcaagaaacagaaggtgaggatcgaaggttcgctttggtggacttatacaagctctattttcttccgcatcatttttgaagcggcctttatgtacgtcttctattttctctacaatggctatcatctcccatgggtgctaaagtgcggcattgacccctgcccaaatttggtcgactgcttcatttcaagaccaactgagaagacagtcttcactatcttcatgattagcgcatcagttatctgtatgctactgaacgtcgccgaactctgctatctcctgttgaaagtttgctttagacgctctaagagagcccagacgcagaagaaccaccccaaccacgcccttaaagagtctaagcagaatgagatgaatgagttgataagtgacagcggccagaacgctatcacagggttcccaagttag

SEQ ID NO: 118161 - DNA, 786 bp, Artificial Sequence
  Description of Artificial Sequence: Synthetic coding sequence
atggactggggcaccctgcacacgttcatagggggcgttaacaagcatagcacttctattggaaaagtatggatcacggtaatttttattttcagggtgatgatactggtggtggccgcacaggaagtctggggggatgagcaggaagactttgtctgtaatacccttcagcccgggtgtaagaatgtgtgctatgaccactttttccctgtgtcccacatccggttatgggcactccaattgatttttgttagtaccccagcattattggttgccatgcacgtggcatactatcgtcatgagacaactagaaagtttcgccggggagagaagaggaatgactttaaagatatcgaggatataaagaagcagaaggtacgaatcgaagggagcctgtggtggacctatacaagctctatattcttcaggatcatatttgaggctgcctttatgtacgttttttacttcttatacaatggctatcacttaccttgggttttaaaatgtggcatcgatccttgcccaaacctggtcgattgttttatatcccggcccaccgaaaagaccgtgttcaccatatttatgatttcggcatcagtgatttgcatgttgctaaacgtggccgaactgtgctacctgctgctgaaagtgtgttttcgtcggagtaaacgggcacagacacaaaagaatcaccccaaccacgccttgaaggagtccaagcagaacgagatgaacgagttgatcagtgattctggccaaaacgctatcactggctttccttcttag

SEQ ID NO: 118162 - DNA, 672 bp, Artificial Sequence
  Description of Artificial Sequence: Synthetic coding sequence
atgtcctggatgttcctgagggacttgttatctggagtaaacaaatatagcacgggcaccggctggatctggctcgccgttgtctttgtgtttcgtctcctggtgtatatggtggcggctgagcatgtgtggaaggacgaacagaaagagtttgagtgcaatagtaggcagcccggctgtaaaaatgtctgtttcgacgattttttcccgatttctcaggttagactctgggctctgcagcttattatggtgtctacgcctagccttctcgtggtgctgcacgtggcatatcatgagggccgggagaagcggcaccggaaaaaactttacgtttcccccggcactatggacggcggcctgtggtacgcataccttattagtctgattgtcaaaaccggattcgaaattggattcttagttctattctacaagctctatgatgggttcagcgtaccttatttgataaagtgtgacctgaaaccctgtcctaacactgtggactgtttcatatctaaacctactgagaagacaatcttcatactatttttggttatcacttcatgtctgtgcattgtgctgaacttcattgaactgtcgttcctggtattgaaatgtttcataaaatgctgcctacagaagtacctgaagaagccccaagtgctttctgtttag

SEQ ID NO: 118163 - DNA, 492 bp, Artificial Sequence
  Description of Artificial Sequence: Synthetic coding sequence
atgagctggatgttcttgcgggatttgctctcgggagtgaacaaatacagcacagggacaggctggatttggttagctgtggtctttgtatttcgcctgctagtttacatggtcgctgcagaacatgtctggaaggatgaacaaaaggagttcgaatgtaactcccgacagcctggctgcaagaacgtctgttttgatgactttttccccatcagtcaggttaggctttgggccctacagctgataatggtgagcaccccaagtctgctggtggtgcttcacgtggcctaccacgaaggacgcgagaagcgtcaccggaagaaattgtatgtaagcccagggacaatggatggcggactttggtatgcttacctgatttccctcatcgtgaagactggtttcgagattggctttttggtattgttttataaattatatgacggattcagcgtgccatacctgatcaagtgcgacctgaaaccatgtccctag

SEQ ID NO: 118164 - DNA, 672 bp, Artificial Sequence
  Description of Artificial Sequence: Synthetic coding sequence
atgagctggatgtttctgagagatctgttaagtggcgtgaataagtattcaactggaacgggctggatctggctagccgtggtgttcgttttccgactgctcgtgtatatggtagccgccgaacacgtttggaaagacgagcagaaggagtttgagtgcaactcacgccagcctggctgcaagaatgtgtgctttgacgacttttttcctatttctcaggtgcggctgtgggcactgcaactaattatggtatccacaccatccttgcttgtggtgttacacgttgcatatcatgaggggagggaaaagcggcaccgcaagaagctgtacgtttccccgggtactatggatggcggattgtggtacgcatacctcatctctctgattgtgaaaacaggcttcgagattgggttcctggtgttattctacaagttgtatgacggtttctctgtcccctatctgattaaatgtgacctgaaaccatgtccgaatacggtggactgtttcatctccaaaccaaccgagaaaacgatcttcatcctcttcctggtcattacttcatgtctgtgtattgttctgaattttattgagctgtcatttctggtgcttaagtgcttcatcaagtgctgcctgcagaagtacctgaaaaagcctcaagtgctgtccgtctag

SEQ ID NO: 118165 - DNA, 966 bp, Artificial Sequence
  Description of Artificial Sequence: Synthetic coding sequence
atgggcgagtggacaatcctggagcgactgctcgaggccgccgttcagcagcacagcactatgattggtaggatacttttaacggtggtggtgatcttcagaattttaattgtggccatcgtgggagagactgtgtacgatgatgaacagaccatgtttgtgtgcaatactctccagccaggctgtaaccaggcctgttacgaccgagcatttcccattagtcatatccggtactgggtgttccaaattatcatggtttgtacaccttccctctgcttcattacctatagtgtccaccaatctgccaagcagcgtgaaagacggtactcaaccgtgttcttggccctcgacagggacccacctgagagcattggtggtcccggggggaccgggggaggagggtctggcggcggaaaacgggaggataagaaattgcagaacgcaatcgtgaacggggttctgcagaacactgaaaacacttcaaaggagacggagcctgattgtctggaagtcaaggagctgacccctcacccatctggcttgaggaccgcttctaagtccaagctcagaagacaggaaggaatatccagattttacatcatccaggttgtgttcaggaatgctctggaaattggtttccttgtcggacagtacttcttgtatggcttctccgtgccaggcctgtacgagtgcaaccggtatccatgcattaaagaagtagagtgctacgtgtctcgaccaactgagaagacagtgtttcttgttttcatgttcgcagtctcagggatttgtgtcgtgctgaatctcgcagagctgaatcacctaggctggagaaaaataaaacttgcagtgcggggggctcaagctaaaaggaaatctatatacgaaattcgtaataaggacctgccgagagttagcgtccctaactttgggcgcacgcaatcctcagatagtgcgtacgtttag

SEQ ID NO: 118166 - DNA, 891 bp, Artificial Sequence
  Description of Artificial Sequence: Synthetic coding sequence
atgggcgagtgggcttttttaggctcgcttttagacgccgtacagctgcaatcgccactggtcggaaggctgtggctggttgtcatgctcatcttcagaattctcgtcctggccactgtcggaggtgcagtattcgaggatgaacaggaagagtttgtttgcaacactctgcagcccggttgccgtcagacctgctatgaccgtgcgtttccggtgtcccattaccgcttctggctgtttcatatcctgttgctgagtgccccgccagtgctgtttgtcgtttatagcatgcatcgcgctgggaaagaggctggaggcgcggaagctgcggcacaatgtgcccccggcctgccagaagctcagtgcgcaccttgcgccctgcgggcccggcgtgctcgaagatgctatttgctgtccgtcgcccttaggctgctggctgaactcacttttctcggagggcaggccctcctgtacggatttcgcgttgctccacacttcgcctgtgcgggaccaccctgtccacataccgttgactgttttgtttcgaggcctacagagaagaccgtattcgttctgttctactttgctgtggggctgctgtccgccctcctcagcgtcgcagagttgggccacttgctttggaagggcaggcctcgcgcaggcgaaagggataaccggtgtaacagagctcacgaggaggcacagaagctgctgccacctccaccacctcccccaccaatcgtcgtaacatgggaggagaataggcacttgcagggggaaggttctccagggtcccctcacccaaagactgaattggacgctcctcggttccgacgcgagtcaactagcccggctgggtggcactgtagcctgccctttcatggcacatag

SEQ ID NO: 118167 - DNA, 1113 bp, Artificial Sequence
  Description of Artificial Sequence: Synthetic coding sequence
atggagggtgttgatctgcttggattcctaattattacgctcaactgcaatgtaactatggttggtaaactttggtttgtgctaacaatgttgttgagaatgcttgttattgtgctagccggtcggcctgtctaccaggacgaacaggagcgcttcgtttgcaatactctccagcccggttgtgccaatgtgtgctatgatgtattcagtcccgtgtctcaccttcgcttttggctgattcagggcgtgtgcgtccttctgccatctgcagtgttctccgtgtacgtcctgcatcggggagctaccctggccgccctcggaccacggcgatgccccgatcccagggagcctgcttctggtcaaagacgctgcccaaggccctttggagagcggggggggcttcaggtcccagatttttccgctgggtatattatccatcttctcctgagaacccttttagaagctgccttcggggccctgcactactttctttttgggtttttggccccaaaaaagttcccgtgcactcgccccccatgcactggcgtggtggactgctacgtgtcacgtcccacggagaagagcctcctcatgctgtttctgtgggcggtgtctgcgctctcctttttactgggactggcggacctggtctgttccctgcgaaggcgcatgcgtagacgcccaggccctcctactagcccatctatccgaaaacagagtggcgcatctgggcacgccgaggggcgcagaaccgatgaagaaggcgggagagaggaggaaggtgctccggcccctcccggagcacgggcagggggcgaaggagctggatcccctagacgaacttcacgtgtgtccggccacaccaagatccctgatgaagacgaatctgaggtcactagttcagcctcagaaaaattgggtcgccagccacgcgggagaccgcatagggaagccgcgcaggacccgagggggagtggttccgaggaacagccttcagctgcacccagtcgattagctgctccgcccagctgttcctctttacaaccccctgacccccctgctagtagcagtggcgccccgcatctacgcgccaggaagtccgaatgggtgtag

SEQ ID NO: 118168 - DNA, 1191 bp, Artificial Sequence
  Description of Artificial Sequence: Synthetic coding sequence
atgagttggagctttcttacaaggttgctggaagaaatccataaccactctacgtttgttggaaaaatctggctcacagttttgatcgtctttaggatcgttctgactgctgtggggggagagtctatttactatgacgagcaaagcaagttcgtctgcaacaccgagcagcctggatgtgagaatgtctgttacgacgcctttgcacctctgtcgcatgtccgattctgggtatttcagattatccttgtggctacgcccagcgttatgtacttgggttacgccatccacaaaatcgccaagatggaacacggcgaggccgataagaaggccgcccggagtaagccttatgctatgcgatggaagcaacacagggctctggaggaaacagaggaagacaatgaggaggacccgatgatgtacccagagatggaactggagtccgataaagagaataaggaacagagccagcctaagccaaaacacgatggacgcaggcgtattagggaggacggccttatgaagatctacgtgctccagcttcttgcacgcactgttttcgaggtaggttttttaattggacagtactttctgtacgggttccaggtgcatcccttctacgtctgctcaaggctgccttgtcctcacaagatcgactgtttcatctccagaccgaccgagaaaaccatatttctcctgatcatgtacggagttaccggcctttgtttattactgaacatctgggaaatgctgcatctggggttcgggactatccgcgactctctgaatagcaaacgtcgggagctggaggatcctggcgcgtacaattaccccttcacctggaatacaccttcagccccaccaggctacaatattgccgttaaacctgaccaaattcagtacacagaactgagtaatgctaagatcgcttacaagcagaataaggccaatacagcccaagagcaacaatacgggagtcatgaggagaacctcccagcggatctggaggcgctgcagcgagagattagaatggcccaggagcgcctggacctagctgtccaggcctatagccaccagaacaaccctcacgggccaagggagaagaaggcaaaggtggggagtaaggccggttccaacaagagcacagcctcctctaaatcgggcgacggaaaaacatccgtgtggatctag

SEQ ID NO: 118169 - DNA, 1191 bp, Artificial Sequence
  Description of Artificial Sequence: Synthetic coding sequence
atgtcatggtcctttctcacccgcctgctggaagagatacataaccattccacgttcgtcggaaagatttggctgaccgtgctcatcgtgttcagaatcgtcctgaccgccgtaggaggggaatctatctactacgatgagcagagcaaattcgtgtgcaatacagaacagcctggttgcgaaaacgtgtgctacgatgcatttgctcctctgtcccacgttagattttgggtgtttcaaatcattctcgtggcaaccccctcagtcatgtatttgggatacgccattcacaagatcgcgaagatggagcatggagaggcagacaaaaaagccgcccgatcaaagccttatgctatgcggtggaagcagcaccgtgcgcttgaagaaactgaggaggacaacgaggaggaccccatgatgtatcctgaaatggagctcgagtcggacaaggagaataaagagcagagccaaccgaaacccaaacacgacggtagaagacggattcgggaagacggtctgatgaagatatacgtgctgcagctcctggcccgaacagtattcgaggtgggatttctgatcggccaatacttcctatatggatttcaggtacatcctttctatgtatgtagtcggttgccatgtccacacaaaattgactgttttattagtaggccaactgagaaaacaatcttcctgctgattatgtacggagtaacaggcctctgcctgcttctgaacatttgggagatgctgcatttgggcttcggcaccatacgagattccctaaacagtaagaggcgggagctggaggacccgggagcttacaactatccattcacttggaataccccatctgcccctccggggtacaatattgccgtgaagcctgaccagatccaatacaccgagttgagcaatgccaaaatcgcctataagcagaacaaggccaacaccgcccaggaacaacagtatggctcacacgaagagaacctgccggccgaccttgaagctctccaacgggagattagaatggcccaagaaagactggatctggccgtccaggcttattctcatcaaaacaatccacacgggcctcgtgagaagaaggctaaggtcggctctaaggctggatccaacaagtctacagctagctccaaatctggcgacggcaaaactagcgtgtggatttag

SEQ ID NO: 118170 - DNA, 1320 bp, Artificial Sequence
  Description of Artificial Sequence: Synthetic coding sequence
atgaccaacatgagctggagcttccttaccagactgttagaagagatacacaaccactctacctttgtcggtaaggtgtggctaacagtgctggttgtgttccggattgtactgactgccgtcggcggcgaggctatctactccgacgagcaggccaagttcacttgtaacacacgccagcctgggtgcgataacgtatgctacgacgcctttgccccactttcacacgtacgtttttgggttttccaaatcgtggtgatttctacaccatctgtaatgtacctgggctacgccgttcacagactagctagagcgagcgagcaggaaaggcgaagagccttgcggagacgccctggtccccggagagctccgcgggcccatctgcctccccctcacgccgggtggccggagccagccgaccttggagaggaggagccgatgcttgggctcggcgaagaagaggaagaggaggagaccggtgcagccgaaggagcaggcgaggaagccgaggaggccggagcagaagaagcttgtacaaaggctgtgggggcagatggcaaagctgcggggacgcccgggccgactggccagcatgatgggagacgtaggattcagagagagggactcatgcgtgtttacgtagctcaactggtcgcaagagcagcatttgaagtcgcattcctggtaggccagtatttgctctatggattcgaagttcgcccttttttcccatgttcacggcagccctgtccacatgttgtagactgcttcgtatcgcgcccaacagagaaaacagtatttttactggtgatgtacgtggtgtcttgcttgtgtctccttctgaacctgtgtgagatggctcatctgggactcggatctgcgcaagacgcagtacgcgggcgaaggggcccccccgcttcggcccccgctcctgcacccaggccaccaccttgcgcatttcccgccgccgccgctggactggcctgcccacctgactactccctcgtggtcagggccgcggagcgggcccgggcgcatgatcagaatctggcaaaccttgcgctccaggctttaagagatggagcagctgcaggggacagagaccgtgactccagtccctgcgtggggctccccgcggcgagtcgcgggccccctcgcgctggggctcctgcttccagaaccggaagcgccacctcagctggaactgttggcgagcagggtcgccctgggactcacgagagaccgggagctaaaccgcgggccggaagcgagaaggggtcagcctcaagtcgagatgggaagacaaccgtgtggatatag

SEQ ID NO: 118171 - DNA, 840 bp, Artificial Sequence
  Description of Artificial Sequence: Synthetic coding sequence
atgtgcgggaggttccttcggagactgctggctgaggaatccagaagatcgacccccgtgggtagactgctgctgcctgtgctgctcggcttccgtcttgtactgctggctgctagcgggccgggtgtttatggcgatgagcagtcggaatttgtctgtcacacccagcaacctggttgcaaagcagcttgtttcgacgcttttcaccccctgagcccattgcgcttttgggtgtttcaagtgatcctggttgcagttccatctgccctctatatgggcttcaccctctaccacgtcatatggcattgggagctcagtggcaagggcaaagaggaggaaactttaattcaaggaagagagggtaacacggatgtgcctggggcagggagtctgcggttattgtgggcctatgtagcccagctcggtgctagacttgtgctggagggtgccgccctcggacttcagtaccatttgtacgggtttcagatgccctccagcttcgcatgtagacgggagccatgtctgggaagcattacctgtaatctgtctcggcccagcgaaaagacaatctttctgaaaactatgttcggtgtatctgggttctgcctcctgttcacatttctggagcttgtgctgcttggactcggacgctggtggcgaacctggaagcataaatcctccagctctaaatacttcttaaccagcgaatctacccggcgacataagaaagctaccgactctttgccagtagtggagacaaaagaacagtttcaggaggccgtgcctgggaggagtctggcacaagaaaaacagcgaccggttggccccagagacgcttag

SEQ ID NO: 118172 - DNA, 1338 bp, Artificial Sequence
  Description of Artificial Sequence: Synthetic coding sequence
atgacaatgttcgaaaacgtgactagagccttggcccgacagctgaacccgcgtggagacctgactccccttgattcactgattgatttcaaacggttccaccctttttgtctggtgttgagaaaacggaagtctacccttttttggggagctaggtatgttagaacagactacactctcctcgacgtgctggagcctgggagctcccctagtgacccgacagataccggcaacttcgggttcaagaacatgttggacactcgcgtggaaggcgacgtcgatgtccccaagacggtgaaggtcaaaggcactgccgggctgagccagaacagtaccttggaggtccaaaccctgtccgtcgcaccgaaggcgttggagaccgtgcaggaacgcaagcttgctgccgaccacccatttctcaaagaaatgcaggatcagggagagaacttgtacgttgtgatggaggtggttgagaccgtccaagaggtgacgctggagcgggccggcaaggcagaagcatgcttttctttgccattttttgctcccttaggcctgcagggtagcatcaaccacaaggaagcagtgacaatacctaaaggatgcgtgctggctttccgtgtgcgccagctgatggtaaaggggaaagatgaatgggacatccctcatatctgcaacgacaacatgcagacttttccacctggcgaaaagagcggagaagagaaagtgatcctgatccaggcatctgacgttggcgacgtgcacgagggctttcggacactaaaggaggaggtgcagagagagacgcagcaggtcgaaaaactgagccgtgttggccaatcctctctccttagtagtctctcaaagctactgggtaagaagaaggaactgcaggacctggagctggccctcgagggagctctcgacaaaggtcacgaggttacattggaggctctcccaaaagatgtgctgctgagcaaagaggctgtaggcgccattctgtacttcgtaggcgccctgactgagctgtccgaagctcaacagaagctcctggtgaagtctatggaaaagaaaatactgcccgtgcagttgaagctggtggaatcaactatggagcagaactttttacttgacaaagagggggtgttcccattgcagccagaattgctcagcagtttgggtgacgaggaactcaccctgactgaagcactggtggggctgagcggccttgaggtccagcgatcaggaccacaatacatgtgggacccagataccttgcccagattatgcgcgctatacgccggactgagtctcctgcagcaattaactaaagcttcttag

SEQ ID NO: 118173 - DNA, 1212 bp, Artificial Sequence
  Description of Artificial Sequence: Synthetic coding sequence
atgttttcagtgtttgaagagattacacgaattgtcgtcaaggagatggatgcaggcggcgatatgatcgccgtgcgctccctggttgatgctgatcgtttcaggtgttttcacctggtaggtgagaagaggaccttcttcggctgccggcattatactacagggctgacgctaatggatatcttggatacagacggcgacaagtggctggatgaacttgattccggcttgcagggacagaaagccgaattccagatcttggataacgtcgacagtactggcgaactgatagtgaggctgcccaaagaaatcactataagcggcagcttccagggctttcatcaccagaagatcaagatctctgaaaaccgaattagccagcaatatctagcaacactcgagaacagaaaactcaagcgcgaactcccattcagctttcgaagcatcaacacaagagaaaatctctatttagtaacagaaacattagaaactgtgaaggaagagaccctcaagtccgaccgccaatacaagttctggagtcagatttcccaaggacacctgtcgtataagcacaaggggcagcgtgaagtaacaatccctcccaaccgtgtcctctcttacagggtaaaacagctcgtgttccccaataaagagacaatgaaaaaggatggagcttcgtcgtgcttgggaaaatcactcggctctgaggacagcagaaacatgaaagaaaaattggaagacatggaatcagtcctcaaagatctgactgaggagaaaaggaaggatgtgctgaacagtctcgccaaatgcctcggaaaggaggacatacgccaagaccttgagcaaagagttagcgaggtactgatcagtggcgagctacatatggaggacccagataaacctctgctcagctcactgttcaacgccgcaggggtgctggtggaggcccgagctaaggcgatcttggactttctggatgcccttctcgaactgagcgaggaacaacaattcgtcgcagaagccctcgaaaagggcacactgccgcttttgaaagatcaagtgaaatctgtgatggagcagaactgggacgaacttgcttcctccccacctgatatggattacgaccccgaagccagaattctgtgcgctctgtatgtggtcgtttctatacttttggagctggctgaggggccaacctccgtcagcagttag

SEQ ID NO: 118174 - DNA, 1236 bp, Artificial Sequence
  Description of Artificial Sequence: Synthetic coding sequence
atgttcagcgtgtttgaagagatcacaaggatcgtcgtgaaggagatggacgcaggcggcgacatgattgccgtccgcagcctggtcgatgctgacagattccgttgtttccaccttgtgggcgagaaacgaaccttcttcggctgccggcattacactactggcttaacgttgatggacatcctagacactgacggagataaatggcttgatgagctggatagtggccttcaagggcagaaggctgaattccaaattttagataatgttgatagtaccggtgaactgattgtgcgcctccctaaggaaattacgattagcggatcctttcagggatttcatcaccaaaaaatcaagattagcgaaaaccggatttcacaacagtacttagccacactggaaaataggaagttgaaacgggaattgccattctccttcaggagcatcaatacccgcgaaaatctgtaccttgtgaccgaaaccctggaaacagtcaaggaagagaccctgaaaagcgaccggcagtacaaattctggtctcagatttcccaggggcacctatcatacaagcacaaaggtcagagggaggtgaccattccacccaacagagtgctttcttatagagtaaaacaactcgtgtttccaaataaagagaccatgagcgcaggcctggacatacatttcaggggaaagacgaagtcattccccgaaggaaaatctctgggcagtgaggactctaggaatatgaaagagaaactggaagatatggaatctgtactcaaggatctaacagaggaaaagcgaaaggatgtcctgaactcccttgccaaatgcctgggcaaggaggatataaggcaagatctggaacagcgagtgagtgaagttctgatttcaggtgagctgcacatggaggaccccgacaaaccccttctgagtagcctgttcaatgccgccggagtcctggtagaggctcgcgccaaggctatcctggacttcctggatgcattgcttgaactgtctgaagaacagcaatttgtagccgaagcattagagaagggaacccttcccctgctaaaggatcaggttaagagcgtgatggagcaaaattgggacgaacttgcctccagtcctcctgacatggactacgacccagaggctaggatactgtgcgcactgtatgtggtggtctcaatcttgctggagctggctgaaggtccgacaagtgtgagcagctag

SEQ ID NO: 118175 - DNA, 1185 bp, Artificial Sequence
  Description of Artificial Sequence: Synthetic coding sequence
atgttttccgtgttcgaggaaataactaggatcgtggtaaaagaaatggatgcgggaggtgacatgatcgccgtgagatccctagtcgacgcggatcggttcagatgctttcatctggtgggagaaaaaagaacgttcttcgggtgccgacactacactactggcctaactctgatggacattcttgataccgacggcgataagtggctagatgagctcgatagcggcttacaaggccagaaagccgagtttcagatcctggacaatgttgattccactggcgagctgatagtccggttgccaaaggaaataaccatcagcgggtcctttcagggttttcaccaccagaagattaaaattagtgagaaccgaatctcacagcagtacctcgcgaccctcgaaaatcgtaagctgaagagggagctgccattcagctttagatcaattaataccagagagaatctgtacctcgttacagaaaccctcgagaccgtgaaggaggaaactcttaaaagcgaccggcagtacaagttctggtctcagatttcacaaggacatctctcgtacaagcacaagggacaacgggaggtaactatccctcccaatcgcgttctgagttacagggtcaagcagctggtgttccctaacaaagagacaatgagaaagtcattaggaagtgaggattccagaaacatgaaagaaaagctcgaggacatggagagcgtgttaaaggatctaacagaagaaaaacgcaaggacgtgctgaatagcctggctaaatgcctcggcaaggaggatatacggcaggatttggagcagcgcgtttcagaggtgctcatcagtggggagctgcatatggaggacccggacaagccattgcttagctccctgtttaacgccgccggcgtgctcgtggaggccagggccaaagcaatcctggacttcctcgatgccctcctggagttatcagaggaacagcagtttgtggccgaagccctggaaaagggcacattaccgttgcttaaagatcaggttaaatccgtcatggaacaaaactgggacgaactcgcaagtagccccccagatatggattacgaccctgaggcgaggatactgtgcgcactgtacgtcgtggtctccatcctgttggagctggctgagggccccacatcagtctcatcgtag

SEQ ID NO: 118176 - DNA, 1236 bp, Artificial Sequence
  Description of Artificial Sequence: Synthetic coding sequence
atgttctccgtcttcgaggaaatcacaagaatcgtggtcaaggaaatggatgccggaggagatatgattgctgtaaggagcctggtggacgctgataggtttcgatgtttccatctcgtcggtgagaagcggacgttttttggctgccgccattatacaacagggttaactctgatggatatcttggacaccgatggagataaatggctggacgagctcgatagcgggcttcagggccagaaggccgagttccagattcttgataacgtggattcgaccggcgaactaatcgtgcgtctcccgaaggagattaccattagtggttccttccagggcttccatcaccagaagatcaagataagcgaaaacaggattagccagcaatacctcgccactctggagaaccgcaaactgaagcgggaactgcctttctctttccggagtatcaacaccagggagaacctatacctcgtgactgagacactggagacggtaaaagaagagactctcaaaagcgatagacagtacaagttctggagtcagatctctcagggtcatttgtcgtataaacataaaggacagagagaggtaacaatcccgcctaacagggtcctgtcatacagagtgaaacagctggtgtttcctaacaaagagacaatgtcggctggacttgacatacattttagaggaaagacaaagtcatttcccgagggaaaaagcctagggagcgaggattcaagaaacatgaaagaaaagcttgaggatatggaatctgtcctgaaggacctcactgaggagaagagaaaggacgtcctgaatagtcttgctaagtgcctgggaaaggaagacatcagacaagatctggaacagagggtgagcgaggtgctcatcagtggcgagctacacatggaggacccagataaacctctgctgtcttctctgtttaacgccgctggggtgctcgtggaagctcgtgctaaagcgatcttggacttcttggacgcactgctcgaattatcagaggagcaacaattcgtggccgaggcactggaaaagggcacgctgccccttctgaaggaccaggtgaaaagtgtgatggagcagaactgggatgaacttgcgtcttctcctcccgatatggattacgacccggaggccaggattctctgcgctctatacgtcgtggtgagcatcctacttgagctggctgaagggcctacttcggtcagctcatag

SEQ ID NO: 118177 - DNA, 1251 bp, Artificial Sequence
  Description of Artificial Sequence: Synthetic coding sequence
atgttttccgtctttgaggagataacacgtatcgtggttaaggagatggacgccggaggggacatgattgcggttaggtcacttgtcgatgccgatcggtttcggtgctttcacctggtcggagagaagcgcacgttctttgggtgtcggcactacacgactgggctgactctaatggacattctggatacggacggggacaagtggctggacgagctggacagcggacttcaggggcagaaagctgaatttcagattctggacaatgttgattcaactggcgagctgatcgtaagactgccgaaggagatcactatcagcggatctttccaggggttccatcaccagaaaattaaaatctctgagaatcgtatctcccagcagtaccttgctacactagagaatcggaagctgaagcgcgaattgccttttagtttccgttccatcaacacccgtgaaaatctctacctggtcacggagaccctcgaaaccgtcaaggaggagaccttaaagagtgatcggcagtataaattctggtcacagatctcccaagggcacctaagctacaaacataaggggcaaagagaggtgaccatacctccaaacagagtgttgtcctacagggtaaagcagctcgttttccctaacaaggaaactatgaacattcatttccgggggaagaccaagtcattccctgaggagaaggatggagcctcatcctgccttgggaagtccttaggtagcgaggatagcaggaatatgaaagaaaagctggaggatatggagtcagtcttaaaagacctgactgaggagaaacgaaaggatgtgctgaacagtctagccaaatgtcttggcaaagaagacatccggcaagacttagaacagagagtaagtgaggtgctgataagcggcgaactgcatatggaagaccccgataagccgcttctgtccagcttgttcaatgctgcaggggtcctggtggaagcacgggcgaaggccattctggattttttggacgccctgctcgagctatcggaggagcagcagttcgtggcagaggccctcgaaaagggcaccctgccactcctgaaagaccaggtcaaatccgttatggagcagaattgggacgagctggcgtcgtcgccacccgacatggactacgatccagaagcccggatcctgtgcgccctatatgttgtagtctcaattttgttggagctcgcagagggaccaacatcggtctctagctag

SEQ ID NO: 118178 - DNA, 1047 bp, Artificial Sequence
  Description of Artificial Sequence: Synthetic coding sequence
tagctggatgagctggacagcggattacaggggcagaaagccgagtttcagatcctggataacgttgactccacaggggaactcatagtgcgattgccaaaggagatcacgattagcggctctttccagggctttcatcatcagaagataaagatttctgaaaatcggatctcacaacaatatttggcaacactggagaacagaaaattgaaaagagagttacccttttccttcagatccattaatacacgggagaatctgtacctggttaccgagaccctggagaccgtcaaggaagagaccctgaagtcagacaggcagtataagttttggagccagatttcgcagggccacctcagttacaaacacaaggggcaaagagaggtcacgatcccacctaatcgcgtactgtcctaccgcgtgaagcagctggtcttccccaacaaggagactatgaatattcactttaggggaaagaccaaaagttttcctgaagaaaaggacggagcctccagctgcctcggaaagtctctgggatccgaagacagcagaaatatgaaagagaagttggaagacatggagtccgtcctcaaagacctaactgaggagaagagaaaagacgtcctgaattccctggctaaatgcctgggaaaagaggacatcagacaggatctggaacagagggtgagcgaggttctgattagtggggagctgcacatggaagacccagacaagcccctgttatccagtctctttaatgcagccggggtgctggttgaggcaagggcaaaggcaattctggacttcctcgacgcgctcttggagctgtcagaggagcagcagttcgttgctgaagctttagaaaaaggaaccttgcctctcctcaaagatcaggtgaagtcagtcatggagcagaactgggatgagctggcttcttcccctccagatatggactatgatccggaggccagaattctttgtgctttgtatgtcgtggtgtccatcctactggagctggccgaaggaccaacttctgtgtcgtcctag

SEQ ID NO: 118179 - DNA, 1224 bp, Artificial Sequence
  Description of Artificial Sequence: Synthetic coding sequence
atgtttagcgtctttgaggagataacgcgcattgtggtgaaggagatggacgccggcggcgacatgatcgcagtccggtcattggtcgatgctgaccggtttcgatgtttccatttggtaggtgagaagcggacatttttcgggtgccggcactatacaaccggactaaccctcatggatattctagatactgatggcgacaaatggctagatgagctggactcgggactgcaggggcagaaagctgagttccagattctggataatgtcgatagtaccggcgaactgatcgtgcgtctgcccaaggagattactatttctggatcttttcagggctttcaccaccaaaaaattaagatctctgagaatcgcatctctcaacagtatttagcaacattggaaaaccggaagctgaagcgcgagctgcctttctcctttcgctcgatcaacacgagggaaaatctgtatctggtgaccgaaaccctggagactgtgaaggaggagactctcaagtctgaccgccagtataagttttggtcgcagattagtcaaggtcatctctcctataaacacaagggccagcgtgaagtcactatccctcccaatagggtcctgtcatatagagtgaagcagctggtcttccccaataaagagaccatgaatatacactttcgcggtaaaacaaaaagcttccccgagggaaagtccctgggttctgaagatagcagaaacatgaaggaaaagctagaggatatggaaagtgtccttaaggatctgactgaagagaagcggaaagatgtgctgaacagtctggctaaatgcctgggtaaggaggatattagacaggacctggagcaacgagtctccgaggttctgataagcggcgagctgcacatggaagatccagataagcctctactatcttccctattcaacgccgccggcgtgctggtggaggccagggccaaggcaatacttgacttcttagatgccctgctcgaactgtccgaagagcagcagttcgtcgctgaggcccttgaaaagggcaccctgcccctgcttaaggaccaggtaaaaagcgtgatggaacagaactgggatgagctggcatcctcaccccccgacatggactacgaccccgaggctagaatcctatgtgccctctacgtcgtagtcagtatacttctcgagctggccgagggccccacttctgtgtcaagctag

SEQ ID NO: 118180 - DNA, 1527 bp, Artificial Sequence
  Description of Artificial Sequence: Synthetic coding sequence
atgccctctatgctggaacgcatctccaagaacttagtcaaagagatcgggtctaaggatttgacccccgtgaagtacctgcttagtgccactaagctccgtcagttcgtgatcctgaggaagaagaaggacagtcgatccagtttctgggagcagtctgattacgtgccggttgagtttagcttgaacgacattctggaaccctcgtcaagcgtgctggaaacggtggtgacaggccctttccacttcagcgatataatgattcagaagcacaaggccgacatgggggttaacgtgggaattgaggtgtccgtgagcggcgaggccagtgtggatcatggctgttccctcgaattccagatagtgaccattccttccccgaatctagaagacttccagaagaggaaactgctggatcccgagccctccttcctgaaggaatgtcgacgcaggggcgacaatctgtacgtcgtcacagaagcagtcgagctgatcaataacacagtgctctatgactcttcctccgtcaatatcctggggaagatcgcgctctggatcacctacgggaagggccagggccagggtgagtctctacgggtcaagaagaaggctttgactctccagaagggaatggtgatggcgtataaaagaaaacagctggtgattaaagagaaggcgatacttatcagtgatgacgatgagcaacgaacatttcaggatgagtacgagatcagtgaaatggttggctactgcgcagctagaagcgaaggcctcctgccttccttccacacaatcagtccaaccctcttcaatgcttccagcaacgatatgaagctgaagccggaactctttttgactcagcaatttttgagtggccacctcccgaagtacgagcaggtgcatatactgcctgtgggcaggattgaagagcctttttggcaaaacttcaaacacttgcaagaggaggtatttcagaaaatcaagaccctggcccagctgagcaaagatgtccaagacgtaatgttctatagtattttagccatgctccgggacagaggcgcccttcaggacttaatgaacatgctggagctggattctagcggccacctggacggccctggtggcgccatccttaaaaaattacagcaagactccaatcacgcctggtttaatcctaaggatcctattctgtacctgctggaggccatcatggtcctgtctgacttccaacacgatctgttagcatgctctatggagaagaggattttgctgcaacagcaggagctggtgcgtagcatcctggaacccaacttcaggtatccttggagtatccctttcacccttaagcccgaactgctcgcacctctccagtctgaagggttggcaattacatacgggctgcttgaagaatgcgggctcaggatggagctggacaatccccggtcaacatgggacgtggaagctaagatgcccctgagcgctctctatggcacgttaagcttattacaacagctagccgaagcttag

SEQ ID NO: 118181 - DNA, 462 bp, Artificial Sequence
  Description of Artificial Sequence: Synthetic coding sequence
atggtggccacaaagaccttcgcactcctcctgctgtccctgttcctggccgtgggactgggcgaaaaaaaggaggggcacttctcggctctgccttcactccccgtagggtcccatgctaaagtgagttcaccacagcctcgaggcccccggtatgccgagggcacgttcatctcagactactcgatcgccatggacaagattcatcagcaggactttgtcaattggctgttagcccagaaaggaaaaaagaacgattggaaacacaacatcacccagcgagaagctcgggcgctggaactggctagtcaggcaaacagaaaggaggaggaagcggtggagccccagagtagccccgcaaaaaacccgtctgacgaagaccttctaagagacctgttgattcaggagttgttggcatgtctcctagaccagaccaacctctgccgactaaggtccagatag

SEQ ID NO: 118182 - DNA, 1401 bp, Artificial Sequence
  Description of Artificial Sequence: Synthetic coding sequence
atgactacgagccccattctgcagttactgctcagacttagtctgtgtggcctgctgcttcagcgggccgagaccggaagcaaaggtcaaaccgccggggagctgtatcagagatgggagaggtatcggcgagagtgtcaggagacccttgccgctgcagagcccccttctggtctggcgtgtaacggttcatttgatatgtatgtatgctgggattacgcagcgcctaacgcaacagcccgcgcctcctgtccttggtacctgccatggcaccaccacgtggctgctgggttcgtgctccgtcaatgcgggtccgatggtcagtggggcctgtggagagatcacacacagtgtgaaaaccctgaaaaaaacgaagccttcctggatcagcgactcattcttgaacgcctgcaggtgatgtataccgttggatattccctgtccctggctacgctgctgctggctttgctaatcctgagccttttccgccgcttacactgcactcggaactacatccacatcaacttattcacctcctttatgctccgtgctgctgcaatcctatcccgcgacaggttgttaccaaggcccggcccttatctgggagaccaagcattggccctctggaaccaggcgctggctgcttgtcggactgcccaaatagtcactcaatactgtgtgggtgccaattacacttggcttctagtcgaaggggtttacctgcactcccttcttgtgcttgtgggggggagtgaggagggccattttcgctattatctgcttttgggttggggtgcccccgccctttttgtgatcccatgggttatagtgagatatctgtatgagaacacccaatgttgggagcggaatgaagtgaaggccatatggtggatcatcagaacacccattttgatgaccatcctgatcaatttccttatttttatccgaattctgggcattctgctttccaagcttcgtactcggcagatgcggtgccgagattaccggcttcggctcgctcggagcacactcacactggtgcccctactaggagttcacgaagttgtcttcgctcctgtgaccgaggagcaggctcggggggccctgcgcttcgcgaagctgggatttgaaatattcttgagcagctttcagggctttctggtgagcgtcctctattgcttcataaataaggaggtgcagtctgagattagacgaggatggcaccactgcaggctcaggcgctccctgggcgaggaacagaggcagctgcctgaacgcgccttcagggcgcttcccagtggaagcggacctggcgaagtgcccacctctaggggcctttcttctgggactctgcccggccctggcaatgaggcatctcgtgaactggagtcttattgttag

SEQ ID NO: 118183 - DNA, 1293 bp, Artificial Sequence
  Description of Artificial Sequence: Synthetic coding sequence
atgactacgagccccatcctgcagctgctgctgcgcctgtccctctgcggcttattacttcaacgagctgagaccggcagtaagggacagactgctggcgagttatatcagaggtgggaacggtatagacgagaatgtcaagaaactttggccgctgctgagccgccttctgtagctgccggattcgtgctgcgtcagtgcggctcagacggacagtgggggctctggcgggaccatacgcagtgcgagaacccagaaaagaatgaagcattcttagaccagcgcctgattctggagagacttcaggtgatgtacacggtcggttactccctcagcctcgcgaccctgctgctggctctgctcatactgtccctgttccggcgcctgcattgcacaagaaattatattcatataaacctgtttaccagcttcatgcttagggccgccgctattctgagtcgcgacaggctccttccacggccgggtccatacctcggcgaccaagcccttgccctgtggaaccaggctctggccgcctgtaggacagctcaaatcgtgacacagtattgcgtgggcgccaattacacctggcttctggtggaaggtgtctatcttcactccctactggtgctggttgggggaagcgaggaggggcactttcgctactatttactattggggtggggggcccccgctctatttgtcattccctgggtgatcgtgagatatctctacgagaatacccaatgttgggaacgcaacgaggtgaaagctatctggtggatcatcagaactccgattttgatgacaatccttattaatttcctaatatttattcggattctgggtatcttattgtctaaactgcggactagacagatgaggtgtcgtgattatagattaaggctggcacgtagtaccctcacactagtcccactgctaggtgtgcacgaggtggtcttcgcaccggtcactgaggaacaagcgcgaggggccctgagatttgcgaagttgggcttcgagatttttctgagtagttttcaggggtttctcgtgtccgttctgtattgctttatcaataaggaggtgcagtctgaaatcaggcggggctggcaccattgtaggctcagaaggagcctgggagaagagcagcgccagctgcctgagagagcattccgcgcgcttccctccgggtctggtcctggggaagtgccaacgtcaaggggcctgtcctcaggcaccctgccagggcccggaaacgaagctagccgggagctggagtcatactgttag

SEQ ID NO: 118184 - DNA, 1401 bp, Artificial Sequence
  Description of Artificial Sequence: Synthetic coding sequence
atgacaaccagtcccattctgcagctgctgctgagattatccctgtgcgggctgcttctgcagagagcggaaacaggttctaagggccagacggctggggaactttaccagcgctgggagagatatcgtcgagagtgccaggaaacgctggctgccgcggagccaccaagcggtctggcatgcaatgggagctttgacatgtacgtgtgttgggattatgccgcacctaacgccaccgcccgggcctcctgtccttggtatctcccttggcatcatcacgttgcagcaggcttcgtccttagacagtgcggatctgatggccagtggggcctttggcgggaccatacgcaatgtgaaaacccggaaaagaacgaagcttttctggaccaaagactcattttggagagattgcaggttatgtacacagtgggctattctctgtcactcgcaacactattgctggcactgctgatcctgagtctgtttcgccgtctgcactgcacaagaaactacatacatatcaatctgtttacttccttcatgctgcgagccgccgccatcttatccagggataggctgctgcccaggccaggcccgtatctaggcgaccaagctctcgccctctggaaccaggcactggctgcttgccgcacagcacagattgtgacccagtactgcgtgggcgcgaactatacttggctcctcgttgaaggcgtctatttgcatagcttgcttgtgctggtcggggggtccgaggaagggcacttccgctattatctgctgctcgggtggggggcccctgccttattcgtcattccttgggtgattgtgagatatctgtacgagaatacacagtgctgggagcgcaacgaagtgaaggcgatctggtggatcattaggaccccgattctcatgacaatcttaattaatttcctcatttttatcaggatattggggatccttctctcaaagttacgaacccgacagatgcgatgccgggactaccggttgcggctggccaggtccacactgacccttgttccgctcctgggagtgcacgaggtggtgttcgctccagtcactgaagaacaggcacgtggcgccctcagattcgctaagttagggtttgaaatttttctttctagctttcagggattcctggtgtccgttctgtactgctttatcaataaggaggtgcagtctgagatacggcgcggttggcaccattgtagactccggaggagccttggcgaggaacagagacagttgccagaaagggcattccgggcgcttccatccgggagcgggccaggcgaagttccaacatcaagaggtctgtcttccgggaccttgcccggtccaggtaatgaggcaagcagagaactcgagtcttactgctag

SEQ ID NO: 118185 - DNA, 1254 bp, Artificial Sequence
  Description of Artificial Sequence: Synthetic coding sequence
atggcctggtttgctttgtatctgctctctctgctctgggccacagctggaacctctacccagactcagtcgtcttgcagtgtaccaagcgcccaagaacccctcgtcaacggtattcaggtcttgatggaaaattctgtaacttctagcgcatatcccaatcctagcattctcattgccatgaatctcgccggcgcgtataatttgaaggctcaaaagctgctgacctatcagcttatgtccagtgataacaacgatctcactatcggtcaactgggattgacgatcatggcactcacatcatcatgccgcgatcccggcgacaaggtgagtatccttcagaggcagatggagaattgggctccatcgtctcccaacgccgaagcgagtgctttctatgggcccagtctggctatcctggctctgtgccagaagaactccgaggcaacgctccctatagccgtgcggtttgccaaaacactgttggccaactcctctccctttaacgtggacacgggcgctatggctaccctcgcactcacctgtatgtacaataagattccggtgggaagcgaggagggatacagatccctgttcgggcaggtgcttaaggacatcgtagagaagatttcaatgaaaattaaggacaacggaataatcggggacatttatagtactggcctggccatgcaggccttgagcgtcacgcctgagccctcaaagaaagagtggaactgcaaaaaaaccaccgatatgatcctgaacgaaataaagcaggggaaatttcacaaccctatgagcattgcacagattttgccctcattaaaagggaagacttatctggacgttcctcaggtgacttgctcaccagatcatgaagtgcagcccacactccctagcaacccgggtcccgggcccactagcgcgtcaaacatcaccgttatctatacgattaataaccagctgcggggtgtggagcttttattcaacgagacgattaatgtatccgtgaagagtggatccgtcctgctggttgtgctggaagaggcccagagaaaaaacccaatgttcaagttcgagaccacaatgacatcatggggcctcgtggtgagctctatcaataatatagccgagaatgttaaccacaaaacatactggcaatttctttccggggtgacgccgctgaacgagggagtggctgattacattccattcaatcatgagcacatcactgcgaattttacacagtactag

SEQ ID NO: 118186 - DNA, 1179 bp, Artificial Sequence
  Description of Artificial Sequence: Synthetic coding sequence
atggccgtgccttcagcccaggaaccactggtgaatggaatccaggtgcttatggagaactctgtcacttcttccgcctatccaaatcccagcatactcatcgcgatgaacctggctggcgcctacaatttgaaggcccagaaactgctcacatatcagctgatgtccagtgacaacaatgatctgaccattgggcagctcggtctcacaatcatggctctcacctcctcctgtcgggacccaggggacaaagtgtcaattctacaaagacaaatggagaactgggccccaagtagtcccaatgcagaggcttcagctttctacggaccaagtttggccatcctcgcactctgtcaaaaaaactccgaggctactctacctatcgccgttcgtttcgctaagaccctgctggctaattcgagcccttttaacgttgatactggagccatggccactctggctctaacctgcatgtacaacaagatacccgtcggatcggaggaaggctaccgaagtctgtttgggcaggtgcttaaggacatcgtggaaaaaatctccatgaaaatcaaggacaatggcatcattggggatatctactcgacaggcctggcaatgcaggcgctctccgtgacccccgagccttctaagaaggagtggaattgcaaaaagaccaccgatatgattttgaatgagataaagcagggcaaatttcacaaccccatgtccatagctcagatccttccttctcttaaaggcaaaacctatctcgacgtgcctcaggtgacctgtagtcccgatcacgaggtgcagccaacacttccgtccaacccaggcccaggccccacttctgcttctaacatcaccgtcatctatacgatcaataaccaacttagaggcgttgagttgctgttcaatgaaacaatcaacgtgtcagtaaaatctgggtcagtgctcctagtcgtgcttgaggaagcgcagcgaaagaatcccatgtttaaatttgagacaacaatgactagttggggtctggttgtgtcatccatcaacaacatcgccgaaaatgtgaaccataagacctactggcagttcttgtcgggggtgacgcccttaaacgagggtgtggctgattatatccctttcaaccatgagcacattacagcgaacttcacccagtactag

SEQ ID NO: 118187 - DNA, 306 bp, Artificial Sequence
  Description of Artificial Sequence: Synthetic coding sequence
atgcagcgcctttgtgtttacgttcttatttttgcacttgcattagccgccttcagtgaggcctcctggaaaccaaggagtcagcagcccgatgcccctctaggaacaggtgcaaatagggacctcgaacttccctggttggagcagcagggtcccgcatctcaccacaggcgtcagttaggtccgcaagggccgcctcacctggtagccgacccgagcaaaaaacagggcccatggctggaggaggaggaagaggcctacggctggatggacttcgggcggcgaagcgccgaagatgaaaactag

SEQ ID NO: 118188 - DNA, 447 bp, Artificial Sequence
  Description of Artificial Sequence: Synthetic coding sequence
atgagaggtagggagcttcctctggtccttctggcactcgtgctgtgtttggcgccaagggggcgggccgttcccctgccagccggcggagggaccgtcctcactaagatgtatccccgcgggaatcattgggcggttgggcacttaatggggaagaagtctactggcgagagtagctcggtgagtgaaaggggctccctgaaacagcagttacgcgagtacatccgctgggaagaagcggcacgcaatctgctagggttaattgaggctaaggaaaacagaaaccaccaacccccacagcccaaagctctaggcaaccagcagccttcctgggacagcgaagatagttctaactttaaggatgtgggcagcaaaggaaaggtaggccgcctcagcgctcctggaagtcagcgcgagggacgcaacccccagctgaaccaacagtag

SEQ ID NO: 118189 - DNA, 426 bp, Artificial Sequence
  Description of Artificial Sequence: Synthetic coding sequence
atgcggggccgggaattgcccctggtactacttgccctagtcctgtgcctggctccgcgcgggagggccgtgcccctcccagctggcggaggaacagtgctgacgaagatgtacccaagaggtaaccactgggccgtcggccatctgatgggcaaaaaatcaaccggggaatcctcctcggtcagtgaacgcggtagccttaagcagcagttgagagagtatatacgctgggaagaagccgcacggaatcttctggggctcattgaagcaaaggaaaacagaaatcatcagccaccacagcctaaggctctaggaaatcagcagccttcttgggactccgaggactcttctaattttaaagatgtgggctcaaaaggtaagggtagccagcgcgaaggacgaaatccccagctgaaccagcaatag

SEQ ID NO: 118190 - DNA, 417 bp, Artificial Sequence
  Description of Artificial Sequence: Synthetic coding sequence
atgaggggaagagagctgccactggtgctacttgcccttgtgctgtgtctcgcacctcgtggacgggccgtgcccctccctgccggaggaggcacagtacttaccaagatgtatccaagaggaaatcattgggccgtgggacatctgatgggaaagaagtccacaggtgaaagttcctccgtctcagagcgaggatccttgaaacaacagcttagggagtacatcagatgggaggaagcggctcgcaacctgttgggacttatcgaggcaaaggaaaaccgcaatcatcagcctccacaacctaaagccctgggaaaccagcaaccaagctgggactctgaggactcgagcaactttaaggacctggtggatagtctgttacaggtgctgaacgtcaaggaaggcactccctcatag

SEQ ID NO: 118191 - DNA, 1155 bp, Artificial Sequence
  Description of Artificial Sequence: Synthetic coding sequence
atggccctcaacgactgttttcttctgaatctggaagttgaccattttatgcattgtaatattagtagccatagtgctgatctccccgtcaacgatgactggtctcatcccggaatcttatacgtcattccagcagtgtacggtgtgatcattctcatcggactgatcggcaatataaccctgatcaaaatattctgcaccgtcaagtccatgcggaatgtcccaaatttgttcatctcatccctggctctcggggacttactcctcctgattacatgtgcccctgtggacgcctctcggtatctggctgataggtggcttttcggccgtatcggctgtaagctgatcccattcatccaactgactagcgtcggtgtcagtgtgttcacgttgactgcactctcagccgacaggtataaggctatcgtaagacctatggacatacaggcttctcatgctcttatgaagatatgcctgaaagcggccttcatttggatcatctctatgttactggcaatcccagaggcggtgttctctgatctgcacccgtttcatgaggagtccaccaaccagacttttatatcctgcgctccctatccacacagtaacgaactgcatccaaagatccacagcatggcaagttttctagtcttttatgtgattccgctctctattatctccgtctactactattttatcgcgaaaaacttaatccagtctgcctacaacctgcctgtcgaggggaacattcatgtgaaaaagcaaatcgaatctcgcaaacgcttggccaagaccgtgcttgtcttcgtcgggctattcgccttctgttggcttccgaatcatgtcatttatctttaccgtagttatcattattccgaggttgacacaagcatgcttcatttcgttacctctatctgtgcaaggctgcttgcctttacgaactcctgcgtaaaccccttcgcactctatctcctgagcaaatcctttagaaaacagtttaatacacagctcctgtgctgtcagccagggctgattatacgatcgcatagtactgggagatctaccacatgtatgacctcccttaaatccacaaaccccagtgtcgccacatttagcctgataaatggcaatatttgccacgagcgttatgtgtag

SEQ ID NO: 118192 - DNA, 480 bp, Artificial Sequence
  Description of Artificial Sequence: Synthetic coding sequence
atggcctcattccttgtgttttatgtcattccactatctattatttcagtgtattactattttattgcaaaaaatctgatccaatcggcgtataacctgcctgtggagggaaatattcacgtaaagaaacagattgagagccgcaaacggctggcaaaaacagtcctagtgtttgtgggcctgttcgccttttgctggctccctaatcatgtaatatacctatatagatcgtatcactactccgaggtggacacctcaatgctgcacttcgtaacttctatttgcgcgcggctgctagctttcaccaattcctgcgtgaatccttttgccctctatctgttgagtgagtttcaggaaaccgtgcaacacagcgctgctctccttcctgcatggcccgatcaccctgtgtcacaacattggaaagaatataacctccacgatctcccccaagaataccagcctctgagaggacacctttag

SEQ ID NO: 118193 - DNA, 600 bp, Artificial Sequence
  Description of Artificial Sequence: Synthetic coding sequence
atgttggcatattcctcagttcactgctttagggaggacaagatgaagtttactatcgtctttgcgggcctgctcggcgtgttcctcgctccggcactggctaactacaacatcaacgtcaatgacgataacaacaacgctggatctggtcaacaatctgtatcagtcaacaatgagcataatgttgcaaacgtggacaacaacaatggctgggattcgtggaattccatctgggactatgggaatggctttgcagctacccgcttgtttcagaaaaagacctgtatcgtccacaagatgaacaaagaagtcatgccatctatccagtccttagacgcgctcgttaaagagaagaaacttcaggggaagggccccggcggaccccccccaaagggtctcatgtactccgtcaatccaaacaaggtggatgatctatcgaaatttggaaaaaatatcgcaaacatgtgcagggggatacccacatatatggctgaggaaatgcaggaagcctcactttttttttactctggaacatgctataccacttctgtcctgtggatcgttgacatctctttctgtggcgatactgtggaaaactag

SEQ ID NO: 118194 - DNA, 1092 bp, Artificial Sequence
  Description of Artificial Sequence: Synthetic coding sequence
atgcagagggctggaggtggaagcgcccctgggggtaacggcggcgggggcggaggaggaccggggaccgccttttccatcgactccctgattggtccaccccctcccagatccggccaccttctctataccgggtaccctatgttcatgccgtacagaccgttggttctcccccaggccctagctccggccccgctgcccgccggactccccccattagcgcctctggcttctttcgctggtcgcctaacgaacacattctgtgcaggcctgggccaggctgtgccttctatggtggccctgacaaccgccctcccgtctttcgcggagccgcctgacgccttctatggcccacaagagttagccgccgctgccgctgccgccgccgcaacagccgcacgcaataatccagaacctgggggtcggagaccagagggcgggttggaggctgatgaactattaccagcccgggagaaggtagcagaacctccacccccccctccaccccacttttccgaaactttccccagcctgcccgccgaagggaaggtatactcctccgacgaggagaagttagaggccagtgccggagatcccgccggttctgagcaggaggaagaaggttccggcggggacagtgaggatgacgggttcttggactctagcgccgggggccccggggccttgcttggacccaaacctaagttaaaagggtcactcggcactggggccgaagagggagctcccgttacagctggagtaactgcaccaggcgggaaatccagacggaggaggacagcttttacctccgagcagctgctcgaactagaaaaggaatttcactgtaaaaaatacctctcactgaccgagagaagccaaatcgcacatgctctgaagctgagtgaggtacaggtgaagatctggttccagaatagaagagcaaaatggaaacgtatcaaggccggcaacgtgtcgagccgctccggtgagcctgttcgcaatccaaagatagtggtgcccattcctgtacacgtgaatcgatttgccgttagatcacaacaccagcagatggagcagggtgctcgcccctag

SEQ ID NO: 118195 - DNA, 1047 bp, Artificial Sequence
  Description of Artificial Sequence: Synthetic coding sequence
atgtccgcagctttccctccctccctgatgatgatgcagcgtccgctcggcagttctacagccttttctatcgatagtcttattgggagccccccacagccgtcccctggtcatttcgtttataccggctatccaatgtttatgccataccgccctgtggttctgcctccaccaccacctccaccaccagctctgccccaggccgctctgcagccagccttgccgcccgcccacccccaccatcaaattccatcacttcctaccggattttgctcctcactggctcaaggaatggcattaaccagcaccttgatggctacactgccaggcggtttctctgcgtctccacaacatcaggaggctgcagctgctaggaaatttgccccgcagcctctgccgggaggaggaaattttgacaaagccgaagcactccaggctgacgctgaagatggaaagggcttcttggcaaaggaaggcagtcttcttgccttctctgctgctgagaccgttcaggcttcactcgtcggggctgtgagaggtcagggcaaagatgaaagcaaagtggaagatgatcctaaagggaaggaagagtccttctccttagagagcgatgttgattacagcagcgatgataacctaacgggtcaggccgctcataaggaagaagaccccggccatgccctggaagaaaccccccccagtagcggcgcagctgggtctacaacctcgaccggaaagaatagaagacggagaacagcattcacgtctgagcagctgctggaactggaaaaggagttccattgtaaaaaatatctctcattgactgaacggagccagattgcccatgccctcaagttgagtgaagttcaggtcaagatatggttccagaatcggagagccaagtggaaaagagtgaaggccggtaatgctaacagtaagacaggcgaaccatctcggaatcccaagattgtggtccctatccccgtgcacgtgtccagatttgccatccgcagtcagcaccagcagttggagcaggctcgaccctag

SEQ ID NO: 118196 - DNA, 1443 bp, Artificial Sequence
  Description of Artificial Sequence: Synthetic coding sequence
atggaggtcgcacccgagcagcctagatggatggcccaccctgcagtgctgaatgcacaacacccggactctcatcatccaggcctggcgcataattatatggagccagcacaactcctgccacctgacgaggtcgatgtcttctttaatcacttggattctcagggaaacccttactacgctaaccctgcacatgctagagcccgagttagctatagtcctgctcacgcgcggctgaccggagggcagatgtgccggcctcacctgttacattcacctggtttgccgtggctggacggcggtaaggctgctttatccgcagccgccgcccaccaccacaatccctggacagtcagccccttctccaagacccccttacatccctcggctgcgggcggccccggaggtcctctttcagtgtacccaggggcaggaggtggttccggaggggggagcggttcgagtgtagcatcactgacccccactgccgcgcactcggggagtcatctgttcgggtttccgcccacacctccaaaggaggtgtctcctgatcctagcacaactggagccgctagtcccgcctcaagttcagccggcggctccgctgcccgtggagaagacaaggatggcgtcaagtatcaggtgagcctcaccgaaagcatgaagatggagagcggcagcccattgcggcccggcctggcaactatgggcacccaacccgcaacacaccaccccatcccaacttacccatcctacgttcctgccgcggcacacgactattcttccggtctgtttcaccccgggggatttctcgggggccctgctagttctttcactccaaaacagaggtctaaagcccgctcttgcagtgaagggcgcgagtgtgttaattgtggcgctactgcaacacccctgtggcgacgggatgggaccggtcactacctatgtaacgcctgtggattgtatcacaaaatgaatgggcaaaaccgacctttgattaagcccaagagacgactgagcgcagcccgccgcgcagggacatgctgcgcaaattgccaaacaacgactacaactctctggagaagaaacgcgaacggcgaccctgtatgcaatgcttgcggattatactataagttacacaatgtgaacaggcctctcacaatgaagaaagagggtattcaaactcggaatagaaagatgtccaacaagtctaaaaagtctaaaaaaggcgctgagtgctttgaagaactctcaaagtgcatgcaagagaagagctccccattcagtgcagcggcgttggctggacatatggcgcccgtcggccaccttccaccattcagtcatagtggccatatcctgcctactcctactccaatccacccaagcagtagtttaagttttggccacccccacccaagtagtatggtcaccgcaatgggatag

SEQ ID NO: 118197 - DNA, 1401 bp, Artificial Sequence
  Description of Artificial Sequence: Synthetic coding sequence
atggaggtggcccccgaacagccacgctggatggctcatcccgctgttcttaacgcccaacaccctgatagccaccatcccggtctagcccacaactatatggaacctgcacagctgctgccaccagacgaagttgatgtcttcttcaaccaccttgactcccagggaaatccgtactacgcaaaccccgcacacgctcgcgcgcgggtgagttactcgccagcccacgctagactgacaggaggacagatgtgtagacctcacctgctgcacagccccggactgccatggctggacggaggtaaagctgcactgtcggcggccgcggcgcaccatcacaatccgtggactgtgagtccattttccaaaactccattgcaccccagtgcggcaggcggccctggcggacccctgtccgtctatccaggcgccggcggggggtcaggcgggggcagcggctcttcggtggccagccttacaccaacagccgcacacagtgggtcacacttattcggctttccccccacaccccccaaggaggtatctcctgacccttctactaccggcgcagcttctccggcctcaagcagcgcaggcggatcggctgcccgcggcgaggacaaggacggtgtgaagtaccaggtgagccttacggaaagcatgaagatggagtccggttctccactgaggcctgggctggctacaatgggcacccagcctgctacccaccacccaatccccacctatcctagctacgttccagcagccgctcatgactattcatctggattgttccacccaggtgggtttctgggcggacccgcaagctcatttacccctaaacagagatccaaggctcggtcatgttccgagggacgtgagtgcgtaaattgcggcgccaccgccacccccttgtggaggcgcgatggcaccggccattatctgtgtaatgcttgcggactgtaccataagatgaacggccagaacagaccactaattaagcccaagagacgcttgaccacaactacaaccctgtggcgtcggaatgcaaatggggatcctgtgtgtaacgcctgcgggctgtattataagctacataacgttaaccggcctctgactatgaaaaaggagggaatccaaacacgaaatcgcaaaatgagcaacaaatcaaagaagagtaaaaagggcgcagaatgttttgaggaactgtcaaaatgcatgcaagaaaagagttcccccttctcagcagccgccctggctggccacatggctccagtagggcatctccctcctttttctcattccggccacatcttaccaacacctacccctatccacccatctagctccctgagctttggccacccacaccccagttcgatggtgactgctatgggctag

SEQ ID NO: 118198 - DNA, 1443 bp, Artificial Sequence
  Description of Artificial Sequence: Synthetic coding sequence
atggaagtcgcccccgaacagccccgctggatggcccacccagccgtcctcaatgctcagcatcccgattcacaccatcctgggctagcacataattacatggagcctgcccagctcttgcccccggatgaggtggatgtcttcttcaatcatctagactcccaaggcaacccttactacgcaaatcctgctcacgctagagctcgcgtctcctactccccggcccacgccagactcacagggggtcagatgtgtaggccccacctacttcactcgccaggcctcccctggctcgacggcggcaaagctgctcttagcgccgccgccgcgcaccatcacaatccttggacagtctcccccttctcaaagacccccctgcaccctagcgctgcgggcggacccgggggaccattaagcgtttaccccggagccgggggagggtccggcggaggatccggatcttccgtcgcatcactgactcctactgccgctcatagcggaagccatctcttcggctttccacccactccacccaaagaggtgtcacctgaccctagtaccaccggggctgcgtcacccgcctcgtcctccgccggcggatccgccgcacggggagaggataaggacggagtcaaataccaggttagtctgaccgagtccatgaaaatggagagcggctcacccctgagaccaggtctggcgaccatgggaactcagccagcgacccatcaccccatcccaacctatcccagctacgtcccagccgctgcacatgattattcttccggacttttccatccagggggctttctcggaggccctgcctccagtttcaccccaaagcaaagatccaaggctcgctcatgttctgaaggcagagaatgcgttaactgcggtgctacagcaacccccttgtggcgtcgcgacgggaccggccattacctgtgtaatgcctgtggactctaccacaaaatgaacggccagaacaggccccttatcaaaccaaagagaaggctgtctgcggcccgtagagccggcacttgttgtgctaactgccagaccacgactactaccctgtggaggagaaatgccaatggagacccagtctgcaatgcatgcggcctttactataagctgcacaatgtcaaccgccctcttactatgaagaaggaaggcatacagacacgtaaccgcaaaatgtcaaacaaaagcaaaaaaagcaagaaaggagctgagtgtttcgaggagcttagcaagtgcatgcaagagaaatcttctcctttcagtgccgcagctttggcaggccacatggcacctgtcggacacctgccacccttttctcattcagggcacatcctacctaccccaacccccatccacccaagctcgagcttgtcgttcgggcacccccatccctcgagcatggtgactgccatgggctag

SEQ ID NO: 118199 - DNA, 453 bp, Artificial Sequence
  Description of Artificial Sequence: Synthetic coding sequence
atggaggttgcccctgaacagccacgctggatggcccacccggccgtacttaatgcacagcaccctgactcacaccatccaggcctggcacacaattatatggagcccgcacagctcctccccccggacgaggtagatgtcttctttaaccacctggatagccaaggcaacccttattacgcaaatcccgcgcacgccagagcccgggtgtcatatagccccgcccacgccaggctcacaggcggacagatgtgtcggccacacctgttacactctccaggcttgccatggttggacggcggcaaagctgctttaagcgccgccgctgcccaccaccacaacccctggactgtatcgcctttttctaagactcctctgcacccaagcgccgccgggggtcccggaggccccctgagtgtgtacccaggggctggcggggggtccggaggctag

SEQ ID NO: 118200 - DNA, 27 bp, Artificial Sequence
  Description of Artificial Sequence: Synthetic coding sequence
atggaagtagctccggagcaaccttag

SEQ ID NO: 118201 - DNA, 1326 bp, Artificial Sequence
  Description of Artificial Sequence: Synthetic coding sequence
atgtaccagagtctgccatggcctcccactactggtcgacctcctgtgcccactcggcgagccgcccccgcgccttcctgcactgcccgggctccccgaccccgtcagtctacctgcccacacagaggtgcattgctgagggccgggcctgtcttaccccccggccgaaggaggggtttgtgcgttcgtcgggcaagtggtgggtcctccggcggcgccgcctcaggagcggggcccggaacacagcagggcagtccagggtggtcccaggccggagccgatggtgcggcatatacccctcctcctgtaagcccaagatttagctttcctggcacaaccggcagtctcgccgccgctgcagccgccgctgccgctagagaggctgccgcctattctagtggcggcggggcagctggggctgggctggccggccgcgagcaatacggacgcgcagggttcgccgggtcttatagcagcccctatcccgcctatatggccgacgtgggcgcctcatgggccgctgcagcggccgcatccgctggtcctttcgatagtccagtactccactcccttcctggacgcgcaaacccagccgcacgccaccctaatttggatatgtttgatgactttagtgagggaagagagtgcgtgaactgcggagccatgtcgacaccactgtggcgaagagacggcaccggtcattacctttgcaacgcctgcggattatatcataagatgaacggaataaatcgtccactcatcaaaccacagcgccgtctatctgcctctcggagggtcggattatcttgcgccaattgtcagacgactacaactaccttgtggcgcagaaatgctgagggtgaacccgtgtgcaacgcatgtggactttatatgaagctccacggagttccgcggccactcgccatgagaaaggagggtatccaaaccaggaagcgtaagcctaaaaacctcaacaagtccaagacccccgctgccccatccggcagcgaatcactgccacctgcctctggcgcttcaagcaatagctcaaatgccacaacctcctcttcagaggaaatgagaccaatcaagacagagcctggcctgagcagccactatgggcactcctcaagtgtttcgcagaccttctctgtgagcgcaatgagcggccacggaccttcaattcacccggtgttatccgcccttaagcttagcccacagggctacgcgtctcctgtcagtcaatcgccccagacctcatcgaaacaagactcttggaattcgctcgtcctggctgactcgcatggagacataatcaccgcttag

SEQ ID NO: 118202 - DNA, 1329 bp, Artificial Sequence
  Description of Artificial Sequence: Synthetic coding sequence
atgtaccagtctctggccatggcagcaaaccatggtcctcccccaggcgcatacgaagctggagggcccggagccttcatgcacggcgcaggagctgccagctctcccgtatacgtgcccacacctcgggttccaagctccgtcttagggttgtcatacttgcaggggggcggggccgggtccgcaagtggtggtgcatccggtggatcttccggcggagccgcgtctggagccggacctgggacacagcaaggatctcccggatggtcccaggcaggcgccgacggcgcggcttacaccccccctcctgtgtctccacgcttcagctttccgggaacaacaggcagtctggccgccgccgcagcagccgccgctgctagagaagcagcggcctattccagtggcggaggcgctgcgggcgcaggacttgccggccgtgagcaatacggaagagctggcttcgctggctcctattcttctccataccccgcctatatggccgatgttggcgcaagttgggccgcggccgccgccgctagtgccggtccatttgacagccccgtattgcactctcttccaggaagggcgaatcctgcagccagacaccctaacctagacatgtttgacgacttttccgagggccgtgaatgcgtgaactgtggggctatgagcactccactgtggcgacgcgatggaaccggccactatctctgtaacgcctgtggactctaccataaaatgaatggcattaacagacctttaattaagccccagaggcgcctgtcagcaagtcgacgtgtggggctgtcctgcgctaactgccagaccaccacaaccactctgtggcggcgcaatgccgagggcgaacctgtgtgtaacgcttgtggtctgtacatgaagctgcacggcgtgcctcggcctttagctatgcggaaggaagggatacagaccagaaagcggaaacccaaaaaccttaataaatctaagacccctgcggcgccgagtggctctgagagcctcccccctgcctcgggtgcttcgtcaaattctagcaacgccactaccagttcaagcgaagagatgcggcccatcaagaccgagcctggattatccagccattacggtcactcttctagcgtgtcccagacatttagcgtgagtgcaatgagtggccatgggcccagcatccatccagtattgtcggcactgaaattgtcccctcagggatacgcctctccagtgagccagagcccacaaacatcatcaaaacaggacagctggaattccctggtgcttgccgactcccacggcgacatcatcactgcatag

SEQ ID NO: 118203 - DNA, 528 bp, Artificial Sequence
  Description of Artificial Sequence: Synthetic coding sequence
atgtttgacgatttctctgaagggcgcgagtgcgttaattgcggagctatgtcaacccccttgtggagacgcgacggaaccggccactatctgtgtaatgcatgtggactctatcataaaatgaacggcatcaaccgccctctaattaagccacaacgaagactgagtgccagtaggcgtgtgggattatcctgcgccaattgtcagacaaccaccacaaccctctggagaagaaatgctgaaggagaacctgtgtgcaatgcctgcggcctttatatgaaactgcatggggtgccacgtccacttgccatgaggaaagagggcatacagacgagaaaacgcaagccaaaaaacctcaacaagtcaaagacaccagctgctcccagcggatcagagagcctgccccccgcttcaggagcctcctccaatagttccaacgcgacaacttccagctcagaggaaatgagacccatcaagactgagccggggttgtcaagccactacggtcatagttctagtgtgtcgtag

SEQ ID NO: 118204 - DNA, 354 bp, Artificial Sequence
  Description of Artificial Sequence: Synthetic coding sequence
atgtaccaatcccttgcgatggctgcgaatcacggccctcctcccggcgcatacgaggcaggtggcccaggggccttcatgcacggcgccggagcagccagtagtccagtttatgtccccaccccacgggttccttctagtgtgctgggactctcgtatctgcagggaggaggagccggatcagcttccggaggcgcttctggtggatccagcggcggagccgccagcggcgcagggcccggcacgcagcaaggctccccaggatggtcacaggccggggccgacggagcagcctataccccacctcctgttagtccaaggttctcattcccaggcactacgggctccctgtag

SEQ ID NO: 118205 - DNA, 711 bp, Artificial Sequence
  Description of Artificial Sequence: Synthetic coding sequence
atgtttgacgactttagcgaggggagggagtgcgttaactgtggtgctatgtctactcctctgtggagacgagacggtacaggtcactacctgtgtaacgcctgtggcttatatcataaaatgaatggcatcaatcgccccttgatcaaaccacaacgccgcctcagtgcttccagaagagtgggcctgtcatgtgcgaactgccagaccaccactactactttgtggagaagaaacgctgaaggagaacccgtgtgcaatgcatgcgggctttatatgaaacttcatggagtacccagacctctggcaatgcggaaggaaggcatacaaacacggaaacgtaaacctaaaaatctgaataaatcaaagactccagcagccccaagtgggtccgagtccctgccaccagcctccggtgcctcctccaattcctctaacgccacaacgagctcctccgaggagatgaggcccatcaaaacagaacctgggctgtcctcacactatgggcatagctcctccgtttcccaaactttcagcgtgagtgctatgtccgggcacgggccatccatccacccagtcctctccgcgctcaaactgagcccgcagggatacgctagccccgttagccagtctccacagaccagctcaaagcaggacagttggaatagtctcgtcctggctgattctcatggggacatcattaccgcatag

SEQ ID NO: 118206 - DNA, 1332 bp, Artificial Sequence
  Description of Artificial Sequence: Synthetic coding sequence
atgtatcaatccttagctatggccgctaaccacggtccaccacctggtgcttacgaggcaggtggacctggtgctttcatgcacggggcaggagcggctagttcccccgtgtacgtgccgactccccgggtgccgtcatccgtgcttggactgagttacctgcaagggggtggggccggatccgccagcgggggtgcgtctggcggtagctcagggggggcggcctcaggggcgggacccggcactcagcagggtagtccaggctggtcccaggcaggagcagacggagccgcttacactcccccccccgtgtctccgagattcagtttcccagggaccacaggcagcctggccgccgccgcagctgcagcagctgcacgagaagccgccgcctatagttccggaggcggtgcagcaggtgcagggttggcagggagagagcaatacggccgggctgggttcgccgggagttattccagtccgtatccggcttacatggcagatgttggcgccagctgggctgccgctgccgccgctagcgccggacccttcgacagtcctgtcctacatagcctccccgggcgcgcaaatcctgccgccaggcatcccaacttggtggacatgttcgacgattttagcgaagggagagaatgtgttaactgtggagccatgtctacccctttatggagaagagatggaactggccactacctatgcaacgcatgcggcctatatcacaaaatgaacggaatcaatagaccgctgattaagcctcaaagaagactcagcgctagccgcagggttggactgtcttgtgccaactgtcaaacgaccacaactacattgtggcgccggaacgccgagggggaaccggtctgcaatgcctgtggactttacatgaagctacacggcgtacctcgtcccctggctatgcgaaaggaggggatccagactaggaagcgcaagcctaaaaatctgaataaaagcaaaacacccgccgctccgagcggctccgagagcctccccccagcttcaggtgcctcttccaactcttcaaatgcgaccacgagcagctcagaagaaatgaggcctattaagactgaacctggcctgagctcccactacggccactctagcagcgttagtcagactttttctgtctctgctatgtcaggccatgggccctccatacatccagttctatccgccctaaaactgagccctcaaggatacgccagccccgtgagccagtcccctcagacctctagtaagcaggatagctggaattccctggtactggctgattcccacggggacatcatcactgcatag

SEQ ID NO: 118207 - DNA, 1194 bp, Artificial Sequence
  Description of Artificial Sequence: Synthetic coding sequence
atgtaccagtctctagccctcgccgcctcacctcgccaggctgcgtacgccgactctggaagcttcctgcacgcaccaggagccggctcacctatgtttgtccctccggcccgcgtcccatccatgctgagctatctgtccggatgcgagcctagtcctcagcccccggagctcgccgcccgccccggctgggcccagacagcaaccgcagacagctctgcatttggtcccggttcccctcaccctcctgcagcccaccctcccggagccactgcttttccttttgctcacagtccttctgggcctggatccgggggttccgcgggcggtcgtgacggaagcgcgtatcagggtgcattactgcctcgggagcagtttgccgctccgctcgggcgtcccgtgggcacgtcctactccgccacctaccccgcctatgtgtctcccgatgtagcccagtcgtggaccgccggcccttttgatggaagcgtgttacatggactgccggggcgcagacccacattcgtctcagactttttagaggagttccctggagagggtagggagtgtgtgaattgcggagccctgagtacgcccctttggcggagggacggcacaggtcactacctgtgtaacgcttgcggattatatcacaaaatgaatggcgtcaataggcccctcgtgcgcccccaaaagcggttatcctcaagtaggagggcaggactctgctgtaccaattgccacaccacgaatacaacactgtggagacggaatagtgaaggggaaccagtttgtaatgcttgcgggctgtacatgaagctgcatggcgtgccccgtcctctcgccatgaagaaagaaagcattcaaaccagaaagcggaaacccaaaacaatcgctaaggcccgcgggtctagcgggagcactcgcaacgcttcggcgtctccttcggcagtggcatctaccgactctagcgccgccaccagcaaagccaagccaagcttagctagtcctgtttgtccaggtccgtccatggccccacaggcctccggccaagaggatgattcgctggcccctggccacctggaattcaagttcgaacccgaagatttcgcttttccttcaactgctccctcaccccaggctgggctgagaggggccctgcgccaggaagcttggtgtgctctggccttggcttag

SEQ ID NO: 118208 - DNA, 1194 bp, Artificial Sequence
  Description of Artificial Sequence: Synthetic coding sequence
atgtatcaatctctagctctggccgcaagcccgcgccaggcagcctatgccgactcaggaagtttcttgcacgcaccgggggctggaagtccgatgttcgttcccccagccagggtgccctcaatgttgtcatacctctctgggtgcgagccttccccgcagccgcccgagctcgcggcacgtcccgggtgggcccaaacagctacagcagattccagtgcctttggcccagggtcaccccatcccccagcggctcatcccccgggcgccactgcctttcccttcgcgcattcccctagtggacccgggtctggaggcagtgcaggagggcgagacgggtctgcctatcagggtgcgttgctgccaagagagcagtttgctgcacccctgggaaggcccgtgggcacgtcctacagtgctacctatccagcatatgtgtctcccgacgtggcccagagttggaccgcgggaccctttgacgggagtgtcctccacggcctcccagggcgtcggcctaccttcgtctctgatttcctcgaggaattccccggtgagggcagagagtgtgtgaactgcggcgctttgagtaccccgctgtggcggagggacgggacaggccactacttgtgcaatgcctgcggactgtatcataaaatgaacggtgttaatagacccctcgtcaggccacagaagcggctgtccagcagcagaagggctggcctctgctgcaccaactgtcacactacaaatactactttatggagaagaaacagcgaaggggagccggtctgtaacgcatgcggtctttacatgaagctgcatggagtcccacggcccctcgcaatgaagaaggaatccattcaaaccaggaaacgaaaacctaaaaccatcgctaaggcacgaggctctagcggctctactcgaaacgcctcagcctccccttcagcggtggcttccacagactcctccgcggcgacgtcaaaggctaagccaagcctggcaagccctgtctgccctggaccctccatggccccccaagccagtggtcaagaagacgattcactggcacccgggcatctcgagttcaagttcgagccggaggatttcgctttcccttccactgctccaagcccgcaggctggcctgcggggcgccctccgacaggaagcttggtgcgcactggcactggcatag

SEQ ID NO: 118209 - DNA, 1254 bp, Artificial Sequence
  Description of Artificial Sequence: Synthetic coding sequence
acagcgacagcagtgccttgtagacccccctgccctctcgtaaagaccactcccgggagaatgtaccaaagccttgccttagccgcgtcacccagacaggcggcctacgctgactcgggctcttttctgcatgcccctggcgccgggtcccccatgtttgtccctcctgctagggtcccttctatgctttcctacctttcgggctgtgagccgtcccctcagcctccagaactggccgcgagacccgggtgggctcagactgcaaccgcggattcatctgcatttgggccggggtctccacaccctcccgctgcacaccctccaggtgcaaccgcattcccctttgcgcattctccatcaggccccggcagtggcggtagcgcaggcggtcgagacggcagcgcgtatcaaggggcgctgctcccaagggaacaattcgcagccccgttggggcgccctgtaggcacaagctacagtgctacctacccggcttacgtctccccagatgtagctcagtcctggacagcgggacctttcgacggctctgttctccacggactgcctggaagacgccccacctttgtctcagacttcctcgaagagttccccggcgagggacgggagtgcgtaaattgcggcgccttgtcgacgcctctatggagacgagatggcaccggacattacttgtgtaacgcgtgcggcttgtatcacaaaatgaatggggtcaaccgcccccttgttaggcctcagaagcgcttatcttcatcacgccgggccggactctgttgtactaactgccacaccactaacactaccttgtggcgccgcaattcggagggcgagccagtatgcaacgcttgtgggctttatatgaaattacacggcgtgcctcggccactggctatgaagaaagaaagcatccagacccgcaagcggaagccgaagaccatagccaaggcacggggcagttccggctccactcgcaacgcttcagctagtccttccgcggtggcatccactgattcttccgcagccacgagcaaggccaaacccagcctggcctcacctgtctgcccaggcccctctatggccccccaagcaagtggtcaggaagacgatagtctggcgccaggacacctggagtttaagttcgagccagaggactttgcatttccatcaactgctccaagccctcaggctggcctgcgaggagccctcaggcaggaagcgtggtgtgccttagctttggcttag

SEQ ID NO: 118210 - DNA, 1788 bp, Artificial Sequence
  Description of Artificial Sequence: Synthetic coding sequence
atggctttgactgatggaggttggtgcctgcctaaaagatttggagctgcaggggccgatgctagtgattcacgcgcgtttccagcgagggaaccgtccactcccccatccccaatttcaagcagcagctcttcttgttcgcgtggaggtgagcgtggcccaggtggcgcatcaaactgcggcacaccacagctcgacacggaagctgctgccggcccccctgccagatccctgctcttgagttcctacgcgagccatcctttcggggctccacacggcccatctgcacccggagtcgccggccctggcggtaacctgagtagctgggaagaccttcttcttttcacagatcttgaccaggccgccactgcgtcaaagctgctatggtcgtcgcggggcgccaaattgtctccattcgctcccgaacagcccgaggaaatgtaccagacactcgctgcactttcctcccaaggacctgccgcttatgacggggcacctgggggcttcgtccactccgccgctgctgctgccgctgccgccgccgctgcgagtagccccgtgtacgtcccaactacaagggtggggagcatgttacctggcctcccctaccacctgcaggggtcgggaagcggccctgctaatcatgccggcggggctggagctcatccaggctggccacaggcctctgctgatagtccaccctacgggtcggggggaggggcagccggtggcggagctgctggcccagggggggcaggctcagctgccgcacacgtgtcagcaagattcccttacagcccttccccccccatggccaacggcgcagccagagagcccggagggtatgcagccgctggctccggtggcgctggcggggtatcaggaggtggcagcagtctcgcagccatgggcggcagagagccacagtattcctcgttaagcgctgcgcggccactcaacggaacatatcaccatcaccaccatcatcaccatcatcatccatccccctactccccatacgtgggcgctccactcacccccgcctggccagctggccccttcgagactcctgtcttgcattcactgcagagtagagctggagcaccgctgccagtcccccggggccctagtgctgacctcctggaagacttgtccgagtcacgggagtgtgtgaactgcggatcgattcagacgccgctgtggcggcgagatgggactggccactacctctgcaacgcatgcgggttgtactcaaagatgaacggcctgtcccgacccctgattaagcctcaaaaacgcgtcccctccagtagacgcctgggtctgtcttgcgcaaattgccacaccacaaccacaactctttggcggcgcaacgccgagggtgaacctgtgtgtaacgcttgcggattgtacatgaaattgcacggagtgccccggcctctggctatgaagaaggagggcatacagacacggaaacgcaagcccaagaacattaataaaagtaagacatgtagcggcaatagtaacaactcaattcctatgactcctacctctaccagcagcaacagtgatgattgctcgaagaataccagtcccactacccagccgaccgcctccggggcaggagccccagttatgactggcgccggggaatccaccaaccctgaaaacagcgagctgaagtattccggtcaggacggcctgtacatcggagtgtccttggcctctccagccgaagtaacgagtagtgtcagacccgatagctggtgtgctctggccctggcgtag

SEQ ID NO: 118211 - DNA, 8016 bp, Artificial Sequence
  Description of Artificial Sequence: Synthetic coding sequence
atggcagccgacactcaggtgtctgagacactcaaacggttcgctggaaaagtcaccacagcctcggtgaaggagcggcgcgagatacttagcgagctgggcaaatgtgtcgcgggcaaggacttacccgagggggcagttaaagggctgtgtaagctcttttgtctcactttgcatagatacagagatgcagcatcgcggagggccctgcaggccgcaattcaacagctggcggaggcccagcccgaggcgaccgccaaaaacttactgcacagtctccagtcctccgggattggatccaaagccggggttcctagtaaatccagcggaagtgcggcactactggctctgacatggacctgcctgcttgtgcgtatagtctttcccagtagagcgaaacgccagggtgacatttggaacaaactcgtggaagttcaatgtctccttctgctcgaggttttaggaggctcccacaagcacgctgtggacggggccgttaaaaagttgaccaaactatggaaggaaaaccctggcctggtggagcagtatctgagcgccatactttcactggagcctaaccagaactacgccgggatgctggggctcttggtccagttctgcacatcccacaaggagatggacgtcgtgtctcagcacaagagcgcactcctggatttctacatgaaaaacattctaatgtctaaggtgaagccacctaagtatctgttggacagttgcgcgcccctactgcggtacctgagccactccgaattcaaagatcttatcttgcctacaatccagaaaagtctactgcgaagtcccgaaaatgtgatcgagacaattagctcactcctggcaagcgttacccttgacctcagccaatacgccatggatatcgttaaagggctggctggccacctgaaaagcaacagcccgcgacttatggatgaagccgtgctggcgctgcggaatctggcgcgccagtgcagcgattcctcagcgatggaaagtttgacaaaacatctgttcgccatactcggcggctccgaggggaagctgaccgtggtggcccagaagatgtcagttctctccggtattgggagtgttagccaccacgtggttagtggcccctcctcccaggtgttgaacgggatcgtggcggaactcttcattccctttttacagcaggaagtgcatgaagggactctcgtgcacgccgtgtctgtactcgccctgtggtgcaaccggttcactatggaagtgcccaaaaaactgaccgaatggttcaaaaaggcattctcccttaaaaccagtactagcgctgtcaggcacgcttatttgcaatgtatgctggcaagctacaggggagatactctccttcaggccctggacctgttaccactgctcatacagaccgtggagaaagccgccagccaaagtacccaggtgccaaccataaccgagggcgtcgctgctgccctcctgctgttgaagctaagcgtggcagattcacaagctgaggccaagctgtccagcttttggcagctcattgtggacgagaaaaagcaggtcttcacatccgagaagtttcttgtgatggcctcagaggacgcgttgtgtaccgtgttgcacctcaccgagagactattcctcgatcaccctcaccgcctcacaggcaacaaagttcagcaatatcaccgtgcgctagttgcagttctgttgagtagaacctggcacgtgcgccgacaggcccagcagacagtccggaagttgttgtcctccctcggggggttcaagctggcccacggcctcctagaggagcttaaaaccgtgctgagcagtcacaaggtcctacccctggaagccctagttacggatgccggtgaggttaccgaagccgggaaggcttatgtgccccctcgtgttcttcaggaggcgctgtgcgttatttcaggagtgcctgggcttaagggagatgtaacagacactgaacagctcgcccaggagatgcttatcatctctcatcatcccagtcttgtagctgtacaatccggcttatggcccgccctccttgcaaggatgaaaatcgatcccgaggcctttatcacccgccatctggaccagattattcccagaatgactacgcaaagtcccttgaatcagagctccatgaacgctatggggagcctgtctgtcctgagccctgacagggtccttccacaactcattagcacaatcactgcgagcgtgcagaatcccgccctgaggttagtgactcgggaagagttcgctatcatgcagactcctgctggagagctgtacgacaagtccatcatccagagcgcacaacaggacagcatcaagaaagctaatatgaagcgtgaaaataaagcctactccttcaaggagcagatcattgaactagagctgaaagaagagatcaaaaagaagaagggcattaaagaggaagtccagcttacatcaaaacaaaaggaaatgcttcaagcccagcttgaccgggaggcccaggtaagacggaggctccaggaactggacggggaactagaggccgctctgggcctgctcgacattatcttagctaagaatccatctggcctgacgcagtatatccccgtgttggtggacagtttcctccctctgctcaagtctcccctcgctgctcctcgcataaagaatcccttcttaagcctagcggcttgcgtgatgcctagcaggctgaaggcactcggtaccctggttagccatgtaacattaaggctccttaagccagagtgtgtgctcgataagtcttggtgtcaggaagaattaagcgtggcagtgaaacgggccgtaatgctgttgcacacgcataccattacctcccgggtcgggaagggtgagcccggagcggcgcccttgagcgctccggcattctctctggtgttccctttcctgaaaatggtgttaactgagatgccccaccattccgaggaagaagaggagtggatggcgcagatcctgcagatactgactgtgcaggcccagcttcgtgcaagtcctaacacacccccgggacgcgtcgacgaaaatggaccagagctgctgccgagggtagctatgctgcggctcctaacttgggttattggcaccggctctccacgactgcaggttctggccagcgataccctgaccactttgtgtgcctctagcagtggggacgatggttgcgcattcgccgaacaggaggaagtggatgtcttactgtgtgctctgcagagcccatgtgcctctgttagggaaactgtgttgcgcgggctgatggagctgcatatggttcttcccgcacccgatactgatgaaaagaacgggctgaacctgcttcggagactgtgggtggttaaattcgataaggaggaagagatcaggaaacttgcagaacggctatggagcatgatgggcctggatctgcaaccagatctgtgctccttgttgattgacgacgtgatctaccatgaggccgccgtgaggcaggccggagcagaggccctgagccaggccgtcgcgcgataccaaaggcaggctgctgaggttatgggccgactaatggagatataccaggagaagctatataggcctcctccggtgctcgatgcactcggacgcgtgatttcagagagccctccagaccaatgggaggctagatgcggcctagcactcgccctaaacaaactcagccagtatctcgactcttctcaggtcaagccacttttccagttttttgtgcctgacgcgttgaatgataggcaccccgacgtcaggaaatgtatgctggacgcagctctggcaacgttgaatacacatggaaaggagaatgtgaatagtctcctgcctgtattcgaggagtttttgaaaaacgctccaaatgacgcatcttatgatgctgttcggcaaagtgttgtggtgctcatgggatcactggcaaaacacttagacaaaagtgacccgaaagtaaagcccatcgtggccaaattaatcgccgcactgtcaaccccgtcgcagcaggtgcaggagtcggttgcctcatgtctgccacctttggtgccggctataaaggaggacgctggaggcatgatccaaagattgatgcagcagttgctggagtctgacaagtacgcagagcgcaagggtgcggcttatggactggccggcctggtcaaagggctcggtattctgtcactcaagcagcaggagatgatggcagctctgacagacgcaatccaggacaaaaaaaactttaggagacgtgaaggggctctttttgcattcgagatgctctgcaccatgctcggcaaactatttgaaccatatgtggtccacgtgttgcctcatctgctcttatgttttggggacggtaaccagtatgtgagggaagccgccgatgattgcgcaaaagcagttatgtctaacctgagcgctcacggcgttaaattggtcttgccaagtctgttagccgcgcttgaagaagaatcatggaggacaaaagccgggtcagtggaactactgggcgcgatggcctactgtgctcctaagcaactgagctcttgcttaccaaatatcgtcccaaaactgaccgaggtgcttacagactcccatgtgaaagtgcaaaaggccgggcagcaggccctccgtcagatcggaagtgtgattcgcaacccggaaattttagccattgcccccgtgttactagacgcactgacggatccttctcggaagacgcagaaatgtctgcaaactttgctggatacaaagttcgtgcatttcatcgatgctcccagcctggcactgatcatgcctatcgttcagagggcttttcaggatcggtcaaccgatacgagaaagatggcggcacagattatcggaaatatgtattccctaaccgaccagaaggatttggccccctatctgccaagcgttaccccggggcttaaggctagcctgctggaccctgttcccgaagtgcggactgtcagcgccaaagcactcggtgctatggttaaaggcatgggagaaagctgcttcgaggatctcctcccttggctgatggagactcttacctatgagcagagttcagtggaccgcagtggcgccgcccaggggctggcagaggtcatggcggggcttggggtcgagaaacttgagaagcttatgcccgagatcgtggctactgccagcaaggtggacatcgctccacacgttagagacgggtacattatgatgtttaactatctccctatcaccttcggtgacaagttcaccccatacgtgggacctataatcccctgcatcctcaaggcgttggcagacgaaaacgagtttgttagagacaccgcactgcgggctgggcaaagagtaatcagcatgtacgccgagacagcaatcgccctgctgctcccacagttggagcagggactttttgacgatctgtggcggatcagattttcgtccgtccagctgctgggagaccttttgttccacatctccggtgtgaccggaaagatgaccactgagacggctagtgaagatgacaactttggcaccgcccagagcaacaaagctatcataacagccttaggtgtagagcggcgcaacagggtgcttgctggcctatatatgggccgaagtgatacacagctcgtggtgagacaggccagcttacatgtatggaaaatagttgtgagtaacaccccacgtacactcagagagatcctccctaccctgtttggcctcctgcttggcttccttgcctctacctgtgcggataagaggactatagccgctaggaccctgggcgatctggtcaggaagttgggggaaaagatactgcctgaaatcatcccgattctggaagagggtctgcgctctcaaaagtccgatgagcggcagggagtatgcatcggtcttagcgagatcatgaagtccacctcccgggatgccgtgctgtacttcagcgaatctctcgtgcctactgccagaaaggccctctgtgaccctctggaggaggtgagagaggccgccgctaaaacatttgaacagcttcatagcacaattggccaccaagcccttgaggatattctgccgttcctcttgaaacagcttgatgatgaggaggtttccgaatttgctctcgacggtttgaaacaagtgatggctatcaaaagccgagtggtcctgccctacctggttccaaaactgactaccccacctgtgaataccagagtcctggccttcctgagtagtgttgctggcgacgcacttacccgccatctgggcgtcatcctgcctgcagtcatgctggctctgaaggagaaactgggcacccccgatgagcagctcgaaatggctaactgccaggcagtgatcctcagcgtggaagatgacaccggccaccgtattatcatagagtatctgctcgaggccacacgctctcccgaagtgggcatgcgccaggccgccgccattatcctgaatatctattgtagcaggtccaaggccgattatacatcacacttgagatctctggtgtcaggactgattcgcctatttaatgacagctcccccgttgttctggaagagtcttgggacgctcttaacgccataactaagaaactcgacgctgggaaccaactcgccctgattgaggaactgcataaagagatcaggctgattggtaacgagtccaagggcgaacacgtgcctgggttctgcttaccaaaaaagggagtgacttcaatcctgcccgtgctgcgcgagggagtccttactggttctcccgaacagaaagaagaggccgcgaaggccttgggccttgtcatcagacttaccagcgccgacgcactcagaccctccgtagtatccattaccgggccgctgattcgtatcctgggagacaggttttcctggaacgtaaaggctgccttactggagaccctgtcattactgcttgccaaagttgggattgccctcaagcccttcctgcctcaactgcagacgacctttactaaggccttgcaggactcaaaccgtggcgtacgcctgaaggccgcggatgcactcgggaaacttattagcattcacattaaggtagatcctctgttcactgaactactgaacggtatacgggccatggaggaccctggagtgcgggacaccatgttgcaggccctgcgatttgtgatccagggcgctggcgccaaagtggatgcagttataagaaagaatatagtcagtcttctcttgtcaatgctggggcacgacgaagacaacactagaattagcagtgcgggctgtctcggcgaactttgcgctttcctgacggaagaggaactcagcgcagtcctccaacagtgcctgcttgccgacgtttctggtatagactggatggtacgccacgggagaagccttgccctcagcgtggctgtcaacgttgctccaggacggctctgcgcaggccggtactcttccgatgtgcaggagatgatactgtctagcgccacagctgataggattccaatcgcggtttctggggtgcgcgggatgggctttctgatgcgtcatcatatcgagactggtggagggcagctgccagcaaaattgtcaagcttgtttgttaaatgtctgcagaatcccagcagtgatatcaggttggttgccgaaaagatgatttggtgggcaaataaggatccactgccccctctggatcctcaggcaattaagcccatcctaaaggcactgttggacaacaccaaggataagaataccgtggtcagagcttactccgaccaagctatagtgaatctcctcaaaatgcggcagggtgaagaagtgttccaatctttaagcaagattctagatgtggcctctcttgaggtacttaacgaggtgaataggcgaagcctgaaaaagttggcctcacaggctgactctaccgagcaagtggatgacacgatcctgacgtag

SEQ ID NO: 118212 - DNA, 1443 bp, Artificial Sequence
  Description of Artificial Sequence: Synthetic coding sequence
atggcacaacacgatttcgcccctgcgtggctgaacttccccaccccaccgtcaagtaccaaagtcttaacgtccagtctcaagtcttccctcaattttgaaaaacattctgagaatttcgcctggacagagaacagatacgacgtaaacaggcgacgtcataacagttccgacgggtttgacagcgccataggtcgacctaacggcggtaattttggcaggaaagagaagaatgggtggagaactcatggacgaaacggtactgagaacattaaccaccgaggcggataccacggcggctcgtctcggtcgcggtcctctatctttcatgctggtaaaagccaggggctgcacgagaacaacatcccagataatgaaaccggacgaaaagaagataagcgagagcgcaagcagtttgaagcagaggatttcccctcgctcaatcctgagtacgagcgagaacccaaccataacaagagtctagctgcaggagtctgggagtaccccccaaaccctaaatctcgcgcccccagaatgctcgtgatcaagaaggggaacaccaaagacttgcaactgtctggattcccggtggtggggaatctaccctcacaacccgtcaagaacggcaccggcccaagcgtctacaaaggtctggttcccaagcctgctgcaccaccaaccaagcctactcagtggaagtcgcagacgaaggaaaataaggtcggcacaagcttccctcatgagtccacgttcggagtgggcaactttaacgcctttaagtccactgcaaaaaacttttccccctccactaactcagtgaaagagtgtaataggagtaattcaagttctccagttgataagcttaaccagcagcctaggctcactaagctgactcgcatgaggaccgacaagaagagcgagttcctgaaagcattgaaaagagacagagtggaagaggagcatgaggatgaatctcgagccggcagtgagaaggatgacgactccttcaatctgcacaattccaattctactcaccaggagcgagatataaacagaaacttcgacgagaatgagattccccaagaaaatggtaatgcttccgtgatctcccagcagatcatccgatcctcaactttcccgcagaccgacgtgctgtcttccagcctcgaggctgaacacagactgttaaaggaaatgggatggcaggaggatagtgagaacgatgaaacctgtgcacctctcacggaagatgaaatgcgcgagtttcaggtaatttcagaacagctgcaaaaaaatggcctgagaaagaacgggattctcaaaaatgggctgatctgtgactttaagtttgggccttggaaaaattcaaccttcaagcctaccacggagaacgacgacactgagacctcttcatctgatacatccgatgatgacgatgtgtag

SEQ ID NO: 118213 - DNA, 1482 bp, Artificial Sequence
  Description of Artificial Sequence: Synthetic coding sequence
atggcccagcatgactttgctcctgcatggctgaactttcccacccctccctcttctactaagtcttcactgaactttgagaaacacagcgaaaactttgcgtggactgaaaatcgctacgacgttaaccggcgcagacacaattcgagtgatgggtttgactccgctataggcagacctaacgggggcaacttcggtagaaaggaaaaaaatggctggaggacccacggtcgcaatggcaccgagaacattaaccataggggtggctaccacgggggctcttctcggtcgcggtcatccatcttccatgcggggaaatcccagggcctgcatgaaaacaacatccccgacaacgagacgggccgtaaggaagacaagagggagcgtaagcaatttgaggctgaagattttccgagcctgaatcccgagtacgaacgggagccgaaccataacaagagtctggccgccggggtgtggggactccatgcccagactcatacatacccaaccaagaagatctctcaagcccctttgctggagtatccacccaatccaaagagcagggcgcctcgcatgctggtaatcaaaaaggggaacactaaggacttgcagctgtctggcttcccggtcgtcggtaatctcccgagccagcctgtgaagaatggaaccggaccctcagtttacaagggacttgtacccaaaccagcagcacccccaacgaagcctacacagtggaaaagtcaaaccaaggagaacaaggtcgggactagtttcccacatgagtccacctttggtgtggggaacttcaatgcctttaagtcaaccgccaaaaatttcagcccatcgacaaactccgtcaaagaatgtaatcgatccaacagcagctctcctgtggacaagctaaaccagcaaccgcggctcaccaagctgactagaatgcggaccgacaaaaaaagcgaattcctgaaggcactgaaaagagaccgggtcgaggaagagcacgaagacgaaagtagagcaggctccgaaaaggacgatgactcttttaatctccacaacagcaacagtactcaccaagaacgcgacataaatagaaatttcgacgaaaacgagataccgcaagagaacggtaatgcgtccgtgatttcacagcagatcatccgcagcagcacattcccccagactgatgtgctgtctagctcactcgaagcggaacatcgacttctgaaagaaatgggatggcaagaagattctgagaatgacgagacctgcgccccactgactgaagacgagatgcgcgaattccaggtcatctccgaacaactccagaagaatggtctaaggaagaacggaatcctcaaaaacgggcttatttgcgacttcaaattcgggccttggaagaattcgacgttcaaacccaccacagagaacgatgacactgaaacctccagcagtgatacctccgacgacgatgacgtctag

SEQ ID NO: 118214 - DNA, 1482 bp, Artificial Sequence
  Description of Artificial Sequence: Synthetic coding sequence
atggcacagcatgacttcgcccccgcctggctcaattttcccacccccccctcaagcaccaagtcgtcattaaacttcgaaaaacattctgagaatttcgcctggacggaaaatcgctacgatgtgaaccggcgtcggcacaattcttcagacgggtttgatagcgctatcggacgcccaaacggagggaattttggccgaaaggaaaaaaacgggtggaggactcatgggcgcaacggcactgagaacataaaccacagaggcgggtaccacggtggctctagccggtcacggagtagtatattccacgcaggcaaatcccaaggtttacacgagaataacatcccggataatgaaacaggccggaaggaggacaaacgtgaacggaagcagttcgaagctgaggactttccgtctctgaatcccgaatatgagcgcgagcctaatcacaataagtccctggccgccggggtgtggggtcttcacgcccagacccacacataccccacaaagaagatttctcaggccccactcttagaatacccgcctaaccctaagtcaagagcccccagaatgctggtcatcaagaaaggtaacacgaaggacctccaactcagtggttttccggtggttggtaacctcccgagtcagccggtgaagaacggcacagggcctagtgtctataaaggacttgtgcctaagcctgccgccccccccaccaagcctactcagtggaagagtcagaccaaagaaaacaaggtcgggacctcttttccccatgagagtacctttggcgtggggaactttaatgcattcaagtcaacagccaaaaatttctcccctagtaccaacagtgtgaaggagtgtaatcgcagcaacagctccagccctgtggacaagctcaaccagcaacctcggttaactaaattaacgcgcatgagaacagacaaaaagtccgagtttttgaaagcgttgaagagggacagggtggaggaagagcacgaggacgagagccgtgcgggttcagagaaggacgacgattctttcaatctgcacaactccaactccactcaccaagagcgggatattaacaggaattttgatgaaaatgagatccctcaggagaacggcaacgcttctgtgattagccagcaaattatccggtctagcacttttccccaaacagatgttcttagctcttccctggaggccgagcatcgattgctgaaagaaatgggttggcaagaagatagcgaaaacgatgagacatgtgctccactgactgaggacgagatgcgggagtttcaagttataagtgagcaacttcagaagaacgggctgcgcaagaacggcattttaaagaacgggctgatttgcgactttaaatttgggccatggaaaaatagtacatttaaacccactactgagaatgacgatacagaaacctcctcatccgacacaagcgacgacgacgatgtttag

SEQ ID NO: 118215 - DNA, 1422 bp, Artificial Sequence
  Description of Artificial Sequence: Synthetic coding sequence
atggcacagcacgactttgcgcctgcctggctgaattttccaactcccccttctagcacaaaatcatcactgaatttcgaaaaacacagtgaaaactttgcctggactgaaaacaggtacgacgtgaacaggaggaggcataatagttccgatgggttcgattcagccatcggcagaccaaatgggggcaacttcggccgtaaagagaaaaatggatggaggacacacggtcgcaatggcaccgaaaatatcaaccacagaggaggttaccacggaggaagttcaaggtctcgtagctccattttccacgccgggaagtcccagggcctccatgagaacaacattcctgataacgagacaggtcgaaaggaggataagagggagaggaagcagtttgaggctgaggacttcccaagcctgaatcccgaatacgagcgtgagcctaaccacaataagagcctggcagctggagtgtgggagtaccctcccaatcctaaatcacgggcaccgcgcatgctggtgatcaagaaaggcaataccaaggacctgcagcttagcggatttccagtggtgggcaatctgcccagccagcctgtcaagaatggcactggtccctccgtgtataagggactggttccaaagcccgcagcaccccctactaagcctacacagtggaagtctcagacaaaggaaaataaggtgggtacttccttcccacacgaatcaacctttggggttggcaatttcaatgctttcaaatccacagccaaaaactttagtcctagcactaactcagttaaagagtgtaataggtctaactcttcatctcctgtggataaactgaatcaacaacccagactgacaaagctgacacgaatgcgtaccgacaaaaaaagcgaatttttgaaagctctaaagcgggatcgagttgaggaggaacacgaggacgaatctcgtgcaggctctgagaaggacgatgactcttttaacttgcataatagtaactcaacccaccaggagagggacatcaataggaactttgatgaaaacgagataccccaggagaatggcaatgcgtcggtgatctcccaacagattattcgttcctccaccttcccgcagaccgatgtcctctcctcaagtctcgaggccgaacatcggctgctaaaagaaatgggctggcaggaagacagcgaaaacgacgaaacgtgtgcccctctgacagaggatgagatgagggaatttcaggtcattagcgaacagctacagaaaaacgggctaagaaagaatggcatcttaaagaacggtctgatctgcgattttaaattcggaccttggaagaacagcacgttcaaacccactacagaaaacgacgatactgagacgagttcctccgatacttctgacgatgatgacgtctag

SEQ ID NO: 118216 - DNA, 1398 bp, Artificial Sequence
  Description of Artificial Sequence: Synthetic coding sequence
atggcacagcatgatttcgccccggcatggctcaactttcctacccccccttcttcaacaaaagtgctcacctccagtctgaagtcgtccctaaacttcgaaaagcatagcgaaaacttcgcctggacagagaataggtatgatgtgaatagacgcagacacaatagttctgatgggttcgattcagctatcggacgtcctaatggaggaaattttggccgtaaggagaaaaatgggtggagaacacatggccggaatggcacggagaatatcaaccatcgggggggttaccatggaggatctagcaggtctagatcaagcatcttccatgccggcaagtcccagggcctgcacgagaataatataccagacaatgagactggacgcaaagaagacaagagggagaggaagcaattcgaggccgaagatttcccgtctctgaatcctgaatatgagagggaaccaaatcacaataagtcgctggctgctggtgtttgggagtacccaccaaaccccaagagccgcgccccccgaatgctagtcattaaaaaggggaacacaaaggatctgcagctgtccggtttcccagtcgttggaaatcttccatcccagcctgtgaaaaacgggaccggcccaagcgtttataagggccttgtgccaaagcctgccgctccacctacaaaacccactcagtggaaaagccagactaaagagaataaggttggaacaagctttccacacgagtcgacttttggcgtgggcaacttcaacgcttttaagtcgacggccaagaattttagtccatccacaaattctgtgaaagagcagccacggctgactaaacttactcgcatgcgaacggacaaaaagtctgaattcctgaaggccctcaagcgcgaccgagttgaggaggagcacgaggacgagagccgtgccggtagcgagaaagatgatgactctttcaatctgcacaattcaaactcaacgcaccaggagagggacataaaccggaattttgacgagaatgagatacctcaagaaaacggtaatgcaagtgttatttcgcagcagatcattcggtcctctaccttcccccagaccgatgtgctatctagcagcttagaagcggagcatcgtctcctgaaagagatggggtggcaagaagacagcgagaatgacgagacctgtgcaccactcacagaagatgagatgcgcgagtttcaggtcatctccgaacagctgcagaaaaatgggctcagaaagaacgggattctgaaaaatggcctgatctgcgattttaagttcggcccctggaaaaactccacattcaagcctactaccgaaaacgatgacaccgagactagctcaagtgatacctcagacgatgacgatgtctag

SEQ ID NO: 118217 - DNA, 909 bp, Artificial Sequence
  Description of Artificial Sequence: Synthetic coding sequence
atgttggttatcaaaaaggggaatacgaaagaccttcagctaagtgggttccccgtggtgggcaatctgccctcacagccagtcaagaatggaactggtccaagcgtctacaagggcctcgttcccaaacccgctgcccctccgaccaagcctacacagtggaaaagccagaccaaggagaataaagtgggcacgagcttcccccacgaatccacctttggggttggcaactttaacgcctttaaaagcaccgctaagaacttctccccttctacgaattccgtgaaggagtgtaaccgaagcaatagttctagccccgtcgacaagctcaaccagcaaccaagactcacaaaactgactaggatgcggaccgataagaaaagcgaattcctgaaagccctgaaaagggatagagttgaggaagaacacgaggatgagtcaagagccggcagcgagaaggatgatgactccttcaatttgcataactccaattccactcaccaggagcgtgacatcaaccgcaattttgatgaaaacgagattccgcaagagaacggaaatgccagcgtgatttctcaacaaatcatccgctcctctacgttccctcagactgacgttctttccagcagcctggaggccgagcataggttgctgaaggaaatggggtggcaggaagactctgagaatgacgaaacttgcgcccccctcacagaggatgagatgcgcgaatttcaggtgattagcgagcagctgcagaagaacgggctccgaaagaacgggatattaaaaaatggacttatatgtgacttcaagtttggtccctggaagaactccacgtttaagcctaccacagagaatgatgatactgaaacctccagttccgacacgagcgatgacgatgatgtgtag

SEQ ID NO: 118218 - DNA, 1443 bp, Artificial Sequence
  Description of Artificial Sequence: Synthetic coding sequence
atggctcagcacgacttcgctccagcgtggctcaactttcctactccccctagctcaaccaaagttctgagtaacaccttgaagtcttctctgaactttgaaaaacattcagagaactttgcttggaccgaaaaccgatacgacgttaatcgcagaagacacaactcatctgacggcttcgacagcgccattgggcgcccaaatggcggaaattttggccggaaagaaaaaaatggatggcggacacacggccggaatggaaccgaaaacatcaaccacagggggggataccacggaggctcctcgcgctctcgatcaagtatttttcatgccggcaaaagccaggggttacacgagaacaatatcccagataatgagaccgggcgcaaagaagataaacgtgaacggaagcaatttgaggccgaggatttccccagcctgaaccccgaatatgaacgcgagccaaatcacaataagagcctggccgccggcgtgtgggagtatcccccaaaccctaaatcccgcgcgcccagaatgctcgtcatcaaaaaagggaataccaaggaccttcagctgtcagggtttcccgtggtcggaaatttgccgagccagccggtaaagaatgggaccggtccgagcgtgtataaggggctagttccaaagcccgccgcgccccctacaaagcccacccagtggaagtcccagaccaaggagaataaggtgggcacatctttccctcatgaatccacatttggcgtaggcaacttcaacgcctttaagtctaccgccaaaaacttcagtccatcaactaactcagtcaaagaatgcaacaggtcaaatagttcgagtccggtggataaacttaaccagcagcctcggttgaccaagctgacgcggatgcgaacagacaagaaaagcgagttcttaaaagccctcaagagggatcgagtagaagaggagcacgaggatgagtcaagggccggctctgaaaaggatgatgactcttttaatcttcacaattccaatagcacacaccaagagagagacattaaccgcaacttcgatgagaatgagattccccaggagaacgggaatgcctccgtgatttctcaacagattatccgctcaagcacatttccccaaactgatgtactgagttcctctctcgaagcagagcatagactgctgaaggaaatgggctggcaagaagacagtgaaaacgacgagacatgtgcccccctgaccgaggatgagatgcgggaattccaggtgatatccgagcagctgcagaagaatggcctccggaagaatgggattctgaagaatggcttgatctgcgattttaaattcggtccatggaaaaacagtacgtttaagccaaccaccgagaatgacgataccgaaacctcctcatctgacaccagtgacgacgatgatgtctag

SEQ ID NO: 118219 - DNA, 1383 bp, Artificial Sequence
  Description of Artificial Sequence: Synthetic coding sequence
atgtttctcgcgaccttgtatttcgctctgcctctgctcgacttgcttctgtccgccgaggtgtctgggggcgaccggctcgactgcgtgaaagcaagtgaccagtgcctgaaggagcagagctgctccactaaatatcggacactgagacagtgtgtggccggaaaagagaccaatttctctcttgccagtggccttgaagctaaggacgagtgtcggtccgcaatggaggcgctgaaacagaagtcactgtacaattgcagatgcaaacggggcatgaagaaagagaagaactgcctgcgaatctactggagcatgtatcagagtttacagggtaatgaccttctggaggacagtccatacgagcctgtaaattctagattgtccgatattttccgggtggtgccctttatctcggtggaacatatacctaaaggcaacaattgcctggacgctgctaaagcgtgcaatttggatgacatatgcaaaaagtacagaagtgcatacatcacgccgtgcacgacctccgtttctaacgatgtgtgtaatcggagaaaatgccataaagccctgcgccaattttttgataaggtgccagccaagcactcatacggaatgttgttctgctcttgcagggacatcgcctgcactgagagaaggaggcaaacaatcgtccccgtgtgtagttacgaggaacgggaaaaacccaattgtcttaatctgcaggacagttgcaaaaccaactatatctgccgctcccgccttgccgatttttttactaattgccagccggaaagtcggagtgtgtcctcatgcctgaaggaaaattacgcagactgtctgctggcctactccggattaatcggcacagtgatgacgccaaattatatcgattcttcatcattgtccgtcgccccatggtgtgactgctctaactcaggtaacgatttagaggagtgccttaagtttttaaacttcttcaaggacaatacttgccttaaaaatgccatccaggcattcggtaacggatcagacgtgacggtctggcagcccgcttttccagtgcaaacaaccactgctacgacgaccaccgcactgcgggtaaagaacaaaccattgggccccgctggcagcgagaatgagatccctacccatgtgctgcccccctgtgccaatctgcaggcacagaagctgaagtccaatgtctccggcaatacccatttatgcatcagtaacggcaattacgaaaaggagggcctcggcgccagcagccacatcactacaaaatccatggctgcccctcccagctgcgggttgtcccctcttctggttctggtggtcaccgcactttcaactctcttatcgctgaccgaaacttcatag

SEQ ID NO: 118220 - DNA, 1383 bp, Artificial Sequence
  Description of Artificial Sequence: Synthetic coding sequence
atgtttctggccacactttacttcgctctcccgctgctagatctgctgttgtcagcggaagtgtccggcggcgacagattggattgcgtaaaggcatctgaccagtgcctgaaagagcaatcttgcagtacgaagtacagaacactgcgccagtgcgtggctgggaaggagaccaacttctcactcgccagtgggctagaggccaaggatgaatgtaggagcgccatggaggctttgaagcagaagagcctttacaattgtagatgcaaacgcggcatgaaaaaagagaagaactgtttgcgcatctactggagcatgtatcagtcactccagggtaacgacctgctcgaggactctccatatgaaccggtcaactcaaggctgtcagacattttccgtgtggtacccttcatttccgtggagcatattccaaagggcaacaactgcctggacgctgccaaggcatgcaacttggatgacatctgcaaaaaatatcgttcggcatacattacaccctgcaccacgtctgtgagcaacgatgtatgcaataggagaaaatgccataaggcacttcgccagtttttcgacaaagtgcctgctaagcattcctacggaatgttattctgcagctgccgggacattgcctgtaccgaacgaagacggcagaccattgtcccagtgtgcagctacgaagaacgggagaaaccgaactgccttaacctacaggactcatgcaagactaattatatctgtcggtcacggctagctgatttcttcacaaactgccaacctgagtccaggagcgtgtcctcgtgccttaaagagaactatgccgattgccttcttgcttatagcggcctcataggtaccgtgatgactccgaactatatagactcctcttccctgagtgtcgccccatggtgcgattgctctaacagcggcaatgacctggaagaatgcctcaaattcctgaacttcttcaaggataacacatgtttgaagaatgcgatccaggcatttggcaacgggtccgatgttacagtttggcaacctgcttttccagtgcagaccaccaccgctaccaccacaaccgcgctgagagtgaaaaacaaacccctcggacccgcaggctctgaaaatgaaatccccacgcacgttctccccccgtgtgctaatctccaagcacagaagctcaagtcgaatgtgagcggaaacacccacctgtgcatttccaatggcaattacgaaaaagaaggcttaggggcatcctcgcacattaccacaaagtccatggccgccccaccaagttgtggtctcagccccctgcttgtcctggtggttacagccctgagcacattattgtcgctcaccgaaactagctag

SEQ ID NO: 118221 - DNA, 1383 bp, Artificial Sequence
  Description of Artificial Sequence: Synthetic coding sequence
atgtttttagcaaccctgtacttcgccctgcctcttctggatcttctcctttccgctgaagtgtctggaggagatagactggattgcgtgaaggcctccgaccagtgtctcaaggagcagagttgctccacaaaatacagaaccctgaggcagtgtgtcgccgggaaggagaccaacttttctttggcctcaggcctggaggctaaggacgagtgccgcagcgcaatggaggcgttaaagcagaaaagtctgtataattgccgctgcaagcgcggcatgaaaaaagagaaaaattgtttgaggatttactggtccatgtaccagagtctgcagggcaatgatctgttggaggactctccttatgaacccgtcaacagtaggttgagtgacatattccgggtggtgccattcatcagcgtagagcacattcccaagggtaacaattgtctggatgctgccaaagcttgcaacctagacgacatctgcaagaaataccgatctgcatatatcacaccatgtactactagcgtctccaacgacgtatgcaatagaagaaaatgccacaaagctctgagacagttctttgataaggtacctgcaaagcattcatatggcatgctgttttgtagctgccgcgacatcgcttgtacagaaaggaggcgccagacgattgttccggtgtgctcatacgaagagagagaaaaacccaattgcctgaacctccaggactcctgtaaaacaaactatatctgtcgctccaggctggctgattttttcaccaactgtcagcccgagagccgtagtgtgtccagctgcctgaaggagaactatgctgactgcctcctcgcctacagcggactcatcggtactgtgatgacccctaattacattgacagtagcagtctgtccgtggctccctggtgtgattgctctaactctggcaacgatcttgaggaatgcctgaaattcctgaactttttcaaggacaacacatgcctcaagaacgcaatacaggctttcgggaatggctccgatgtcaccgtctggcagccagcttttccagtccagactacaaccgctaccacgaccactgctcttcgtgtcaaaaacaaacctcttggcccagcaggatccgagaacgagatccccacacatgtgctgcccccttgcgccaacctgcaggcacagaaactgaaatccaatgtgagcgggaatacccacctctgcatatctaacggaaattatgaaaaagaaggcttaggggccagtagccacattactaccaagagtatggcagctccgccatcctgtggcttgtcccccctgttggtcctcgtcgtcaccgcactgagtaccctgctcagtctcaccgagacctcctag

SEQ ID NO: 118222 - DNA, 1398 bp, Artificial Sequence
  Description of Artificial Sequence: Synthetic coding sequence
atgtttctggcaacactgtactttgccctacctctcttggacctgctcctctccgctgaagtgagtggcggagataggctcgactgtgtaaaggcctccgatcaatgcttaaaggagcagagttgttcgactaagtatcggaccctgagacaatgcgtggccggcaaggaaacaaacttttccctggcctctggactggaagctaaggacgaatgtaggtctgccatggaagcactcaagcagaaatctctctacaactgcaggtgcaagcgtggcatgaagaaggaaaagaattgcttacgcatctattggagcatgtaccagagtctgcagggcaacgacctacttgaggatagtccctacgagcccgtgaacagcagactctccgacatctttcgagtggtgccatttatttcggacgtcttccagcaggtggaacatattccaaagggaaacaattgtcttgatgccgcgaaagcatgcaacttggacgacatatgtaaaaagtatagatcagcttatattacaccatgtaccactagcgtgtctaatgacgtgtgcaaccgccgtaaatgtcataaagccctgcggcagtttttcgacaaagttcctgcaaagcactcttatgggatgctgttttgtagttgtcgggatatagcatgcaccgagcgtcggagacagaccatcgtgcccgtgtgctcatatgaagagagggagaagcccaattgcctgaacttgcaggattcctgcaaaaccaactatatatgtcgtagtagactcgctgattttttcacaaactgtcagccagaatcgcggagtgtcagctcgtgtttgaaggagaactacgccgactgcttactggcttattccggattgatcggaacggtcatgacacctaactatatcgactccagctctctgagcgtcgcaccgtggtgtgactgcagcaactcaggaaacgatctggaggaatgtctgaagtttctgaattttttcaaggataacacctgcctcaagaatgctatccaggccttcgggaatggcagcgacgtgacagtttggcagcccgcatttcctgtgcagactaccacggccacaaccactaccgctctgcgcgtaaagaataagcccctggggccggcgggtagcgaaaacgagatcccgacccacgtgttgccaccgtgtgcaaatctgcaggctcagaaactgaagagtaacgtctcaggtaatacacatctctgcatcagtaacggaaactatgaaaaggagggactgggtgcttcctcacacattactacaaaatcaatggcagcccctcctagttgcgggctgtcccctttgctcgtcctggtggtcaccgcacttagtactctgcttagcttgaccgaaacatcatag

SEQ ID NO: 118223 - DNA, 1035 bp, Artificial Sequence
  Description of Artificial Sequence: Synthetic coding sequence
atgcaagagggtaaattctggaagggcatggccgagacaggcatgtggggatgtggcgaatggattcccgtggagcatatccccaagggcaataattgtctagatgccgccaaggcctgcaacctggatgacatctgcaagaaatataggagcgcttacattaccccttgcaccactagcgtgtctaacgacgtttgcaaccgaaggaaatgccataaggcgctacggcagtttttcgataaggttccggcaaagcatagctatggaatgctgttttgcagttgtcgggacattgcctgcactgaacgccggagacagacaatagttcctgtgtgtagctatgaagagagagaaaagccaaactgcctgaacctgcaggacagttgcaagacgaattatatttgcaggagcaggctagctgatttcttcacaaactgtcaacccgagagcaggtcagtctcctcatgtcttaaggaaaactatgcagattgtctgctcgcatattcgggccttattggcaccgtgatgacaccgaactacatcgacagcagcagcttgagcgttgcaccgtggtgcgactgcagcaattccgggaatgatctagaggagtgtctgaagttcctcaacttttttaaagacaacacatgtctgaagaacgctatccaggctttcggaaacggcagtgatgtcactgtgtggcagccagctttccctgtgcagacaacaacagctacgaccaccactgccctgagagtgaaaaataagccgctggggcccgcgggcagcgagaatgaaatcccaacacatgtgttgcctccatgcgccaatttacaggcacaaaaactgaagagcaacgtgtctggcaatacacacctgtgtatttcaaatggaaattacgaaaaggaaggccttggggccagcagccatataactacaaagtccatggcggcacccccatcttgtgggctgtcaccccttctcgtcctggtggttactgctctctccactctgctgagcctgactgagactagttag

SEQ ID NO: 118224 - DNA, 1080 bp, Artificial Sequence
  Description of Artificial Sequence: Synthetic coding sequence
atgatcttggctaacgtattctgtttgtttttttttcttggagaggagttctatgaagcttccccttatgaacctgtcacttcacgactctctgatatcttccgcctagccagtatctttagtggtacaggagctgatcctgtggtctcggccaagagcaaccattgtttggacgccgctaaggcgtgtaacttaaatgataactgtaaaaaactgaggtctagctacatctcaatctgcaacagagagattagtcctaccgaaagatgcaatcgcagaaagtgtcacaaagcattgagacagttttttgacagagttccgtcagaatacacctacaggatgctattctgctcttgccaagatcaggcgtgcgctgaaaggcgcagacagactatcctcccttcgtgctcatacgaggataaagaaaaacccaattgcctcgatctgcgcggggtgtgcagaacagaccatctttgtcgttctcgactggccgattttcacgccaactgccgggcttcataccagacagtgacgagttgtcctgccgacaactaccaggcctgcctcggcagctacgcgggtatgattggtttcgatatgacccctaactatgtggatagttcacctaccgggattgttgtgtcaccgtggtgctcatgcagaggtagcgggaacatggaagaggagtgtgagaaattcctgcgcgactttaccgaaaacccttgtctccggaacgccattcaggcctttggtaacggaaccgacgtgaacgtttctcctaagggaccctcctttcaggcaacacaggcaccccgcgttgagaaaactccctctctacccgatgatctttccgactctacatccttgggcacaagcgttataactacctgcacgagcgtccaggagcaggggcttaaagcaaacaattctaaagaactgtctatgtgctttacagaactgaccacgaacataatcccaggatccaacaaggttattaagcccaatagtggacccagccgggctcggccaagtgctgccctcactgtgcttagcgtgttgatgttgaaactcgcgctgtag

SEQ ID NO: 118225 - DNA, 1395 bp, Artificial Sequence
  Description of Artificial Sequence: Synthetic coding sequence
atgattctcgcgaacgtgttctgcctgttctttttcttggatgagacccttcgctccctggcatccccgtcttctcttcagggccctgagctccacggatggcgcccaccggtggattgtgtacgcgctaatgagctctgtgctgcagaatccaactgttcatcgcgatatcggactttgcggcagtgcttggcgggaagggacagaaataccatgctcgccaataaggagtgccaggccgccttggaggtactccaggagtcaccactttacgactgtcgctgtaaacgggggatgaaaaaagagcttcaatgcctgcaaatttactggagcattcacctgggtcttacagaaggggaggaattttacgaggcttctccatatgaacctgtaaccagccggttaagcgacatcttccgtctagcctccatcttcagcgggacgggggcagacccagtcgtgtcagcaaagtctaaccattgtttagacgccgccaaagcctgcaatttaaacgataattgtaagaagctgagaagcagctacattagcatttgtaaccgcgagatatctcctacagagagatgcaatcggcgcaaatgtcacaaggcactgaggcagttttttgaccgagtgccatcggaatatacataccgaatgctcttttgctcgtgccaggaccaggcctgcgccgagcggaggcgtcagactatcctgccaagttgtagttatgaagacaaggagaagcctaattgtctggacctccgaggtgtgtgtagaacggaccatctgtgccgctctcgcctggctgatttccatgcgaactgcagagccagctatcagactgtcacatcttgtcccgctgacaattaccaagcctgtttgggttcctatgcagggatgatcggctttgacatgacaccgaactacgttgatagtagcccaactgggattgtcgtaagcccctggtgttcctgccggggatccgggaatatggaggaagaatgtgagaaattcctcagggattttaccgaaaacccttgtctccgcaatgctattcaggctttcggcaacggcactgatgtcaatgtgtcccccaaaggaccatcttttcaggccacacaggcaccacgagtcgaaaagactccgtctttacccgatgatctgtccgattcaacctccttagggacctcagtcatcaccacctgcaccagcgtccaggagcagggtctgaaagcaaataacagcaaggaactgagcatgtgcttcaccgagctgacaacgaatattatacctggtagcaacaaagtgattaaaccaaatagcgggcccagccgggctagacctagtgccgcccttacagtcctgagcgtccttatgctgaagctggctctctag

SEQ ID NO: 118226 - DNA, 996 bp, Artificial Sequence
  Description of Artificial Sequence: Synthetic coding sequence
atgatacttgccaacgtgttctgcctcttcttttttcttgggacaggggcggatccagttgttagcgccaagtccaaccattgtctcgatgcggccaaggcttgtaacctcaatgacaattgcaagaagttgagatcatcatatatttctatctgtaatagagaaatctcacctacagaacgatgtaacaggagaaagtgccataaagctctgcgtcaattctttgatcgggtcccgtctgaatatacttatagaatgctcttctgcagctgccaggaccaggcttgcgctgagagacgtagacagaccatcctcccatcttgtagctacgaggataaagagaaacccaattgtctggacttaaggggtgtgtgccggaccgaccatctctgtcgctcgcgcttagctgattttcacgctaactgtcgcgcgtcttatcaaacagtgacgtcttgccccgcggataattaccaggcctgcctgggatcctacgcaggaatgatcggctttgatatgaccccgaattatgtggatagtagccccaccggaatagtagtgtccccttggtgctcgtgccggggctccgggaatatggaggaggaatgtgaaaaatttcttagagatttcacagaaaatccttgccttagaaatgctatccaagcttttgggaatgggacagacgtcaacgtatcccccaagggcccctccttccaagcaactcaggctccccgcgtggaaaaaacgccgagcctcccagacgacttatcagacagcacgtccctgggaacaagcgtgatcaccacgtgtacaagtgtgcaggagcagggtctgaaggctaacaactcaaaagaactttcaatgtgtttcactgaattaacaacaaatatcattccaggttctaataaggtgattaagcccaatagtgggccatctagggctaggccgtccgccgctcttaccgtgctgtctgtgctgatgttgaagctcgcactctag

SEQ ID NO: 118227 - DNA, 798 bp, Artificial Sequence
  Description of Artificial Sequence: Synthetic coding sequence
atgattctagcaaatgttttttgtctgttcttcttcttggacgagactcttaggtctctcgccagccccagcagcctgcaggggccagaactgcatggatggaggccacccgtggactgtgtcagggccaatgagctgtgtgccgccgaatccaactgtagcagccggtataggactctcaggcaatgcctggctggcagggatagaaataccatgttagccaacaaagaatgtcaagcagcccttgaagtacttcaagaaagcccgctgtacgattgtagatgtaagcggggcatgaagaaggagttgcagtgcttacagatttattggtctatccacctgggactaacagagggtgaggagttctatgaagcctctccatacgagccggtcacatcccgtctaagcgatatatttagactggcctcaatattcagcggaaccggggccgatcccgtcgtgtcagcaaaatctaaccactgccttgacgccgccaaagcttgcaatctcaacgacaattgcaagaagctaagaagctcatatatatccatttgcaatagagaaatttcaccaacggagagatgcaacagacggaagtgtcacaaagccctgcgacagttctttgatcgggttccgtctgaatacacctatcgaatgctgttctgtagctgccaggaccaggcgtgtgcagagcggcggagacagaccattcttcccagttgcagctacgaggacaaggaaaaacctaactgtctggatctccggggggtatgcagaacagatcatctgtgtcgatag

SEQ ID NO: 118228 - DNA, 1395 bp, Artificial Sequence
  Description of Artificial Sequence: Synthetic coding sequence
atgattctagcgaacgtgttttgtctcttttttttcctggatgagacactccggagcctggctagcccctcatcactgcagggcccagagctgcatggctggcgtcctccggttgactgtgtcagagccaatgaactctgcgccgcagaatccaattgttcttctcgctaccgcacgcttagacagtgtctagctggcagggatagaaatacaatgctggccaataaagagtgccaagcagccctcgaagtcttacaggaaagccccctgtacgattgtaggtgtaagagggggatgaagaaggaactgcagtgtctgcagatttattggagcatccatttgggtctgacagagggcgaggagttctacgaggcatccccctatgaacctgtgactagtcggctgtcagacatttttcgcctcgcctcaattttttctggcaccggggcagaccccgtcgtgtcagcgaaatcgaatcattgtcttgacgccgcgaaagcatgtaacttgaatgacaactgtaagaagttaagaagctcatacatcagcatttgcaatcgcgagatcagcccaaccgagagatgtaataggcggaaatgccataaagcactgcggcagttcttcgatcgcgtcccatcagagtatacatatagaatgctgttttgctcatgtcaggatcaggcctgcgccgaacgacgccgccagactatactgcccagctgctcctacgaagataaggagaagccaaactgtcttgatctaagaggggtatgtagaacagaccacctctgtaggagcagattggcggattttcacgccaactgtagagcaagctatcaaactgtgacctcttgtccagccgacaattaccaggcgtgcctgggcagttatgccggcatgatcggatttgacatgaccccaaattatgtagatagcagtcctacaggaatcgttgtgtctccttggtgctcatgcagagggagtggcaacatggaagaagagtgtgagaaattcctaagagacttcactgaaaatccatgcctcaggaatgccatacaggcctttggcaatggcaccgacgtcaatgtgtcacccaagggtccctctttccaggccacccaggcccctcgagtcgagaaaaccccatccctgcccgacgacttatcagatagcacatccttgggaacctcagtgataaccacctgcacaagcgttcaggagcaaggcctgaaggcaaacaactctaaggaactgtctatgtgcttcacagagctcacgaccaacattatccctggctcgaacaaggtcattaaaccgaactccggaccctccagagcccggccgagcgctgctcttacagtactctctgtcctcatgctaaagctcgccctgtag

SEQ ID NO: 118229 - DNA, 1203 bp, Artificial Sequence
  Description of Artificial Sequence: Synthetic coding sequence
atggtgcggcctctgaatcctcgccctcttccacctgtcgttcttatgctgctacttctacttcctccatcacccctgccactggcggccggggaccccttacccacagagtcaaggctgatgaactcctgcctgcaagcaagacggaagtgccaggccgatccaacctgctccgccgcctatcaccacttagattcttgcacaagcagtatcagtacccctctaccatctgaagaaccatcagttcctgccgattgtctggaggccgcccaacagctcaggaactcgagccttattggatgtatgtgtcatcgccggatgaagaaccaggtcgcatgcctggacatctactggaccgtgcatagagcccgttccttgggcaactacgagcttgatgtgtctccctacgaggacactgtgacctccaaaccctggaagatgaatctgtctaagcttaatatgttgaagcctgactcagacttgtgcctgaaattcgccatgctgtgtacgctgaacgataagtgcgataggctgagaaaggcctatggcgaagcatgttctgggcctcactgtcagcgacacgtctgcctgagacagcttctgacctttttcgagaaggcagctgaaccccacgcacagggtcttctgctatgcccatgcgcgcccaacgacagaggctgcggcgaacggcggagaaacaccatagcccctaactgtgccctgcctcctgtggcaccgaattgcctcgagctgcggcgcctgtgtttctctgatccgttatgtagaagccggctcgtcgattttcagacccactgccaccccatggatatcctgggaacatgtgctaccgaacagagcagatgcttgcgagcttatctaggcttgatcggcactgccatgacccctaactttgtgtctaatgttaacacctcggtggccttaagttgtacctgccggggtagcggcaatttacaggaagagtgcgagatgctggagggattcttttcacacaacccctgtttaaccgaggcgatcgcagccaagatgcgattccacagtcagcttttttcgcaggattggccccaccctacatttgccgtgatggcacaccagaatgaaaatccagctgtccgcccacaaccatgggtccccagccttttcagctgtaccctgccgctcattctgttactctccctctggtag

SEQ ID NO: 118230 - DNA, 1110 bp, Artificial Sequence
  Description of Artificial Sequence: Synthetic coding sequence
atggtgcggccactgaacccccgtccgctgcctcccgtagtacttatgctgcttctcttgctccccccttctccgctgccactggccgctggtgatcctcttccaaccgaatcccgactaatgaactcatgtctccaggccagacggaagtgtcaggctgacccgacatgttctgctgcctatcaccacttggattcctgcacttccagcatctccacaccgctaccgtccgaggaaccgagtgtacccgctgattgtctggaagcagcacagcaactgcgcaattcaagtcttattgggtgcatgtgtcatcgcagaatgaagaatcaggtagcgtgcctggatatctactggacagtgcatcgtgccaggagcttggactcagatctctgcctaaagttcgcaatgttgtgcaccctgaatgacaagtgtgacagactgagaaaagcctacggcgaagcttgtagtggccctcactgccagcggcatgtttgccttcgacaattgcttacctttttcgagaaggccgcggaacctcacgcccaggggctactgctgtgcccgtgcgcccccaatgaccgcggctgcggggagaggcgccgaaacacaattgctccaaactgtgccctacccccagttgcccccaattgcctcgaattaaggagactgtgcttctcagacccactttgcagaagccgtcttgtcgattttcagactcattgtcaccctatggatatcctagggacatgcgctacggagcagtctagatgtctgagagcgtacttgggattaattggaactgccatgacaccaaatttcgttagcaacgtcaacacttcagtggctctttcttgtacctgtaggggttccggtaatctgcaggaggaatgcgagatgctggaaggtttttttagccataatccctgccttaccgaggccatcgctgccaaaatgcggttccacagccaactgttttcgcaggactggccacatccaacattcgctgtcatggcccaccagaatgaaaatccggccgtcaggccccagccatgggttccgtccctattttcatgcactctgccattgatcctgctgttgtctctctggtag

SEQ ID NO: 118231 - DNA, 2136 bp, Artificial Sequence
  Description of Artificial Sequence: Synthetic coding sequence
atggagagcggagctgtgttgctggagtccaagtcctctcccttcaatctgctgcatgagatgcacgaattacgcctgttgggacatttgtgcgatgtaacagtctctgtggagtaccagggggtgcgtaaggacttcatggctcacaaagcagtgttagccgccacaagcaagttcttcaaggaggtttttttgaatgagaagagcgtggacggcacacggactaatgtctacctcaatgaggtgcaagtcgcggactttgcatcattccttgagttcgtatacacagccaaagtgcaggtggaagaggaccgcgtccagcgcatgctggaggtcgcggagaaactgaagtgtctagatttgagcgaaacatgttttcagctcaaaaagcagatgctggaatcagtccttctcgagttacaaaacttctctgagagccaggaagtggaagtgagctcaggctcccaggtgagcgctgccccagcccctagagcctctgtcgccaccgatggccctcacccctcaggactgaccgactctctcgattatcctggcgagcgggcttcaaatggcatgtccagtgatctcccaccaaagaaatcgaaagacaagctagacaagaagaaggaggtggtgaaaccgccttatcccaagataagacgggctagcggccgactagctgggcggaaagtgtttgtggagattcctaagaaaaagtacacacgacgccttcgagagcagcagaaaaccgcagagggggacgtcggcgattacaggtgcccccaggaccagagccctgacagggtaggaactgagatggagcaggtgagcaagaacgaggggtgccaggctggagcagaacttgaggaattgtcaaagaaggcgggacccgaggaggaggaggaggaagaagaagaggacgaagaaggagaaaagaagaaatccaactttaagtgttcaatctgtgagaaagcctttctgtacgagaagtcatttctaaagcactcaaagcaccgtcatggcgtggctactgaggtggtgtacagatgtgatacctgtggtcaaaccttcgccaatagatgcaatctgaagagtcatcagagacatgtgcactcttccgaacgtcacttcccctgcgagctgtgtggtaaaaaattcaagcggaagaaggacgttaagcgacatgttctgcaggtgcatgagggcggcggcgagaggcaccggtgcggacaatgtggaaaagggttgtcaagcaagacagccctccgcttacatgagcggacacacacaggggaccgaccatatgggtgcacagagtgcggagctcgcttttcccagccaagcgcactaaaaactcatatgcgcatacataccggcgagaagcccttcgtgtgcgacgagtgcggtgcccgattcacacagaatcacatgctcatatatcataaacgctgccataccggagagagacccttcatgtgtgagacttgtggcaaatctttcgcaagcaaagagtacctcaagcatcataaccgcattcatactgggtcaaaacctttcaagtgcgaagtctgtttcaggacgttcgctcagcgcaacagtctctatcaacacatcaaagtccatacgggcgagcgcccatactgttgtgaccaatgtggcaaacagtttacgcaactgaacgccctccagcgacatcggaggatccacactggggaacgtccctttatgtgtaatgcctgcggccgcacttttaccgataagagtaccctgcgcaggcacacgtcaatacatgacaaaaacaccccatggaaaagcttcttggtaattgttgacgggagcccgaagaacgacgacggacataagactgagcagcctgatgaagagtacgttagctcaaaactatcggacaagttattgagctttgccgagaatggacactttcataacctggcggctgtgcaggacactgtgccaaccatgcaggagaatagctcagctgacacagcttgcaaagcggacgactccgtggttagccaagataccctgcttgcaacaaccatttctgaactgtccgaattgactccccagaccgacagcatgcccacccaattgcattcactttctaatatggagtag

SEQ ID NO: 118232 - DNA, 2136 bp, Artificial Sequence
  Description of Artificial Sequence: Synthetic coding sequence
atggaatcgggcgcagtactgctggagtccaaatcatcccccttcaacctgctccatgagatgcatgaactgcgactgctcggccacctgtgtgacgtgaccgtgagtgtggaataccaaggagtgaggaaagacttcatggcacataaagctgtcctcgcagccacttcaaaatttttcaaagaggtgttcctgaacgaaaagtctgttgatggcacccggaccaacgtttaccttaacgaagtgcaggtggccgactttgctagtttcctggagttcgtgtacaccgccaaggttcaggtggaagaggacagggtccaaaggatgctggaggtggcggagaaactgaagtgtctggatctgagcgagacttgtttccagcttaagaaacagatgttggagtcagtcttgctggagctccagaactttagtgagtcccaggaagtggaggtgagcagcggcagtcaggttagcgccgctccagcgccccgggccagcgtggcaaccgatggcccacacccaagtggacttaccgactcactggactacccgggagaacgcgcctcgaacgggatgagcagcgatctgccccccaagaagtcaaaagacaagttggataagaagaaggaagtggtgaagccaccgtaccctaagatccggcgggcgtctggccggttggccggacgtaaggtctttgtggaaatccccaagaaaaaatacacacgacggctgcgagagcagcagaagaccgcagagggtgatgtgggggattacaggtgccctcaggaccagtcaccagatagagtgggtaccgaaatggaacaggtgagtaaaaacgaagggtgtcaggctggcgctgaactcgaggagttatcaaaaaaggcgggacccgaggaggaggaggaggaggaggaagaagatgaagagggcgagaagaagaaatctaatttcaaatgcagcatctgcgagaaagcctttctctacgaaaagtcctttttgaagcattccaagcaccggcacggagtagctacggaggtggtttaccgatgtgacacctgcggccagaccttcgctaaccggtgcaacctgaaatctcaccagcggcacgtccattcctctgagcggcatttcccatgcgaactctgcggcaaaaagtttaagaggaaaaaagatgtcaaacggcacgtactccaagtgcatgaaggcggcggtgaacgacaccggtgcggacaatgcggcaagggtctgtcctcaaaaactgcactaagactgcatgagagaacgcatacaggcgaccgtccatacggctgcacagagtgcggcgcgcgtttctcccagccctctgcgctgaaaacacatatgagaatacatacaggagagaagcctttcgtgtgcgacgagtgtggggctcgatttacccagaatcatatgctgatttatcacaagcgttgtcatactggcgagaggccatttatgtgcgagacatgtgggaaatcattcgcaagcaaggaatatctgaagcaccacaataggattcatacaggcagcaaacctttcaagtgcgaagtgtgcttccgaacgtttgcgcaaagaaattccctttatcagcatattaaagtgcacacaggagagcggccctactgttgtgatcaatgtggcaaacagtttacccagcttaatgctctccagcgacaccggcggattcacactggagagcgcccattcatgtgtaacgcctgtgggagaacctttactgataagtctacactccggaggcacacatccatccatgataagaatactccctggaaaagcttccttgtcatcgtggatggttcccctaaaaacgatgacggccacaagaccgaacagcctgatgaagaatacgtgtcctcaaagctgtcagataagctgctgagctttgccgaaaacgggcattttcacaaccttgccgcagtgcaggacaccgtacccactatgcaggaaaacagctccgcagacactgcatgcaaggctgacgatagtgtagtgagccaggatactcttctggccacaaccatctctgaactgagtgagctgaccccccagacagactctatgcccacgcaactgcatagcttatccaacatggaatag

SEQ ID NO: 118233 - DNA, 147 bp, Artificial Sequence
  Description of Artificial Sequence: Synthetic coding sequence
atggaatccggagccgtcctgctggagagtaagtccagcccctttaatctgctccacgaaatgcacgagttacggctgttggggcatctgtgtgatgttacagtgtcagtagagtaccagggagtgcgaaaggactttatggcctag

SEQ ID NO: 118234 - DNA, 663 bp, Artificial Sequence
  Description of Artificial Sequence: Synthetic coding sequence
atgtgtgaaacgtgtggcaagtcttttgcatcaaaagagtacctcaagcatcataaccgcatccataccggttccaaaccttttaagtgcgaggtgtgcttccggacattcgcacagaggaattcactctatcagcatattaaagtccacaccggtgagaggccctactgttgtgaccagtgcggcaagcagttcacgcagctaaacgccctgcagcggcatcgccggattcacaccggagagcggcccttcatgtgtaacgcctgtggacggaccttcaccgataagagcacactcagacgccatacctcaatccacgacaaaaacacaccctggaaaagtttcctggtcattgtggatggtagtcctaaaaacgacgacggacacaagacagaacaaccagacgaagagtacgtctctagcaaactctctgataagctgttgtcattcgctgagaatggacattttcacaacctcgctgctgtgcaagatacagtcccaaccatgcaggaaaatagctctgccgatacagcctgcaaggctgatgactctgtggtgagtcaggacacactcctcgctactacaattagcgagcttagcgagttaacccctcagacagattcaatgcctactcagcttcactcgctgagcaacatggagtag

SEQ ID NO: 118235 - DNA, 708 bp, Artificial Sequence
  Description of Artificial Sequence: Synthetic coding sequence
atgctgatttatcacaaaaggtgccataccggggagagaccattcatgtgcgagacctgtggaaaatcttttgccagcaaagagtatttaaagcaccacaatcgtatccataccggcagcaagccatttaaatgcgaggtatgcttccggactttcgcgcaacggaatagcctgtaccagcacattaaagtccatactggcgagagaccctattgttgcgatcagtgtggcaaacaattcacacagctgaatgcactgcaacgtcatagacgcatacatacgggagagcgcccctttatgtgcaatgcatgcgggcgtaccttcactgacaaatcaacgttacgtaggcacactagcattcatgataaaaacactccgtggaaatcattcctcgtcatcgtggatggcagtcccaagaatgacgatggccacaagactgagcaacctgacgaggaatacgtgtcttccaagctgtcagataagctgctctctttcgctgaaaacggtcatttccacaatctggctgctgtacaggatacagtgccgacaatgcaggagaatagtagtgccgatacagcgtgcaaggcggatgattctgttgtgagtcaggacactttacttgccactacgataagcgagctgagtgaattaacaccacagaccgactccatgcctactcaactccattccctgagcaatatggagtag

SEQ ID NO: 118236 - DNA, 1254 bp, Artificial Sequence
  Description of Artificial Sequence: Synthetic coding sequence
atggatgaggaatatgatgtgattgttcttggaactggcctaaccgaatgtatactgtccggcatcatgtcagtgaatggaaagaaggttttgcatatggaccggaatccctattacggtggcgaatcatccagcatcacaccattggaagaactgtataagcgtttccagcttcttgaaggcccacccgaaagcatgggccgggggagagattggaatgtggacctgatccccaagtttctgatggccaacgggcaactcgtgaaaatgctcctgtatactgaggttaccagatacctggatttcaaagtcgtggaggggtctttcgtgtacaaaggcggtaaaatttacaaagtccccagcaccgagacagaggcattagcctcaaatctgatgggcatgttcgaaaacgatccgaaaacatttgaaggtgtggatccacaaaccacatctatgagagacgtttacaggaagtttgacttaggccaggatgtgatcgatttcacaggtcacgctcttgctctctaccggacagacgactacctagaccagccatgccttgaaactgtgaatagaatcaaactttattccgagtcactggcgcggtatggaaagtctccatatctttatccactgtacggcctcggtgaacttccccagggctttgctcgattgtcggctatctatggtggcacctatatgttgaataagcccgttgacgacatcattatggagaacggcaaggttgtcggagtaaagagcgagggagaggtcgctagatgcaagcagctaatttgtgacccgtcctacattcctgatagggtgcgcaaagccggccaggtcattaggatcatttgtatcttgtcccatccgatcaaaaacaccaacgatgctaactcttgccagattatcataccccaaaatcaagtcaaccgcaagtctgacatatacgtctgtatgatatcatatgcccacaacgttgctgcacaaggaaagtatattgccattgcaagcactacagtggaaaccacagaccctgagaaagaggtggagcccgctttggaactgttggagccaatcgacgatggctgtgaatctcaggtcttctgttcatgttcatacgatgctactacccactttgagactacttgcaatgatattaaagacatctataagcggatggccgggactgcatttgactttgaaaatatgaagcgtaagcagaatgacgtgtttggcgaagcagagcagtag

SEQ ID NO: 118237 - DNA, 1344 bp, Artificial Sequence
  Description of Artificial Sequence: Synthetic coding sequence
atggacgaagaatacgacgtgatcgtgctgggtaccggcctgacggagtgcatcttgtctggaattatgagcgtgaatggcaagaaggttcttcacatggataggaatccatattatggcggggagtcttcttcaatcacaccactggaggaactctataagaggttccaattgttggaagggccccccgaatccatgggcagaggacgcgattggaacgtggatctgattcctaagttcttaatggctaatggacagctggtgaagatgcttctgtacacggaggtgactagatacctggactttaaggtcgtcgaagggagtttcgtgtacaagggcgggaagatttacaaagtcccaagcaccgagacggaagcactggcctctaatctgatggggatgtttgaaaagagaaggtttcgcaagtttttggtgtttgtagctaactttgatgaaaacgatcctaagaccttcgaaggtgtggacccccagacgacatccatgcgggacgtctaccgtaaattcgaccttggacaggatgtgatcgatttcaccgggcatgctctggccctgtataggactgacgactatttagatcagccctgcctagagaccgtaaaccgcatcaaactgtactcggagtccttggcccgatacggcaagagcccttacctttatcctctgtacggattgggagagcttccccagggattcgcaaggctatccgccatttacggcggaacttatatgttgaataagccagtcgacgatatcattatggaaaatggcaaggtggtgggcgtgaagagtgaaggcgaggtggcccgctgcaagcagctgatctgtgacccttcttatataccagatagggtgagaaaggcaggacaagtcatccgcatcatctgcatcctatcacatcctattaagaatactaatgatgcaaacagctgccagattattattccccaaaaccaggtgaatagaaaatctgacatatatgtttgcatgatttcctacgcccacaatgtcgcggcccagggtaaatatattgctattgccagcaccaccgtggagactacagatcccgagaaagaagtcgagcctgctctggagctcctggagcccatcgatcaaaagttcgttgctatttccgatctgtacgagcctatcgacgacggctgtgagtctcaggtgttctgtagctgtagctacgacgccaccacccactttgagacaacttgtaatgacatcaaggatatctataagagaatggctggcaccgcctttgacttcgaaaatatgaaacgcaagcagaacgacgtctttggggaggccgagcagtag

SEQ ID NO: 118238 - DNA, 447 bp, Artificial Sequence
  Description of Artificial Sequence: Synthetic coding sequence
atgtcccttggcaagaggaaacccagcaatttctaccttgcaaacttcctggggaaggagtgcattctttctggtataatgagcgttaatggcaaaaaagtgcttcatatggatcgcaatccttattacggcggcgagagcgcatcaattaccccattggaggacctgtacaagaggtttaaaatccccggctcaccccccgagtccatgggtcgaggcagggattggaatgtggacctgattccaaagttcttgatggcaaatggccagctggtaaaaatgctgctatatactgaggttactcgatacttagactttaaggtgaccgaggggtcctttgtttataaggggggtaaaatttataaagttccctctactgaggcagaggcgttggcttcttctttaatgggcctgtttgagaaacggaggtttagaaaattcctatag

SEQ ID NO: 118239 - DNA, 1350 bp, Artificial Sequence
  Description of Artificial Sequence: Synthetic coding sequence
atgtccttaggaaagagaaaaccaagcaacttctatctggccaatttcttgggaaaggaatgtattctgagtggcattatgtccgttaatggaaagaaagtgctccatatggatcggaacccttattatggaggggagagcgcatccatcactccactggaagacctctataaaaggtttaagattcccggctcacctcccgaatcaatgggcagaggccgggattggaacgtggatcttatccccaaatttctgatggcgaatggccaactggtcaaaatgctcctctacaccgaggtgacacgctacctggattttaaagttaccgaaggatcgtttgtatataaagggggtaaaatatacaaagtacccagcactgaagctgaagctctggcgtcctccttaatggggcttttcgagaagcgcaggtttcggaagtttcttgtatatgttgccaatttcgatgaaaaagaccctcggacattcgaggggattgaccctaaaaagactaccatgcgggatgtgtacaaaaagtttgacctcggccaggacgttatcgatttcacggggcatgcccttgctctctacagaacagacgattatttagatcagccttgttacgaaaccatcaatcgcatcaaactgtatagcgagtcacttgcgaggtacgggaaaagcccgtatctctatccattatacggcctcggggagctcccccagggcttcgcccgcctcagtgcgatctatgggggcacctatatgctcaataaacccatagaggaaatcatcgtccaaaacggcaaggtcattggcgttaaaagcgagggcgaaattgctagatgcaagcagctgatttgcgacccctcttacgtgaaagatcgggttgaaaaggttggtcaagttattagagtaatatgtattctgagtcaccctatcaagaatactaacgacgccaactcatgccaaattattattccccagaatcaggtgaatcgcaagtcggatatctatgtttgcatgatcagttttgcacataacgtggcagctcagggtaaatacattgctatcgtcagtaccacagttgagacaaaggagccagagaaggaaattcgacctgcactggagctgctcgagcccatcgagcagaaattcgtgagcataagcgatctactggttcctaaggatctaggcacagaatcacagatttttattagccgcacctacgatgccacaacacatttcgaaacaacctgtgacgatatcaagaacatttacaagcgtatgacgggcagcgaattcgatttcgaagagatgaaacgcaaaaagaacgatatttacggagaggattag

SEQ ID NO: 118240 - DNA, 627 bp, Artificial Sequence
  Description of Artificial Sequence: Synthetic coding sequence
atgcgagatgtctacaagaagttcgatctgggccaggacgtgattgactttacaggccacgcgctcgctctgtaccggaccgacgattatctcgaccaaccatgctacgagacaataaatagaatcaaactgtatagcgagagcctcgcccgctatggaaagagtccttatctttaccccctgtacggtttgggggaactgcctcagggatttgcccgacttagcgcaatttatggaggcacttacatgctgaataagccaatcgaagagattattgtccagaacggcaaggtaatcggagttaagtctgagggggagattgccagatgtaagcagctgatctgcgacccctcctatgtgaaggatcgggtggagaaagtgggtcaggtaatccgggtgatttgcatcttgagtcatcctatcaaaaacacaaacgacgctaactcttgtcagatcataataccccagaaccaagtgaaccgcaagtccgacctccttgcaagcgtcacctcctggtaccagaagacctgggagcagaaggccaggagcctgtttcctgcccatatgatgccccctttgatccttaggcaacgtgtgatgactctcaaaacatctatacgggggtag

SEQ ID NO: 118241 - DNA, 1203 bp, Artificial Sequence
  Description of Artificial Sequence: Synthetic coding sequence
atgaacgaggaatatgacgttatagtgcttgggacagggctcaccgagtgtattcttagcgggatcatgagcgtcaacggcaaaaaagtactgcatatggatcgaaacccttactacggcggagaatcagcaagcatcacaccacttgaggatctttacaagcgttttaaaattcctggctctccacccgaatctatggggcgcggaagggattggaacgtcgacctcatccctaaattcttgatggctaatggattgatgggcctcttcgagaaaagaaggttccgcaaatttctggtgtatgtcgccaatttcgatgaaaaagacccacgtaccttcgagggcattgacccaaagaagaccactatgcgcgacgtctacaagaagttcgacctggggcaggacgtaattgatttcacaggccacgcattggctctgtatcgcaccgacgactacctcgaccaaccctgttatgagactattaaccgaattaagctgtacagtgagtccctggcaagatacggtaaatcgccctacctgtatccactgtatggactcggtgaactaccacaagggttcgccaggctgtcagctatatacggcgggacatatatgttaaacaagccaatagaggaaataatagtgcaaaatgggaaggttataggggtgaaatccgagggcgagattgcccggtgtaaacagctcatctgtgatccctcttacgtgaaagatcgagtcgagaaagtgggacaggttatcagagtgatctgcatcttgtcacaccctatcaaaaacaccaacgatgctaattcctgtcagatcatcattcctcagaaccaagtgaatcgcaaatccgacatctacgtatgtatgataagcttcgcccataacgtcgccgcacagggaaaatacatcgctatcgtgtccactaccgttgagacgaaggagccagaaaaagagatccggccagcgctggagctgctcgaacccatcgaacagaaattcgttagcatctcggatctcctagtgccaaaagacctgggcacagagtcacagatatttatctcaagaacctacgatgcaaccacccattttgagacaacatgcgatgacattaagaacatatacaagcggatgactggttcagagtttgacttcgaggaaatgaagagaaaaaagaacgatatctatggggaagactag

SEQ ID NO: 118242 - DNA, 1338 bp, Artificial Sequence
  Description of Artificial Sequence: Synthetic coding sequence
atgaacgaggagtatgatgtgatcgtgttaggcaccggactgacagagtgtatcctctcaggtatcatgtccgtgaacggcaagaaggtactccacatggatcgcaatccatactacgggggcgagtctgccagtattacccctctggaggacctgtataagcgatttaaaatcccaggctcaccccccgagagcatggggaggggacgggattggaacgtggatcttatccccaaattcctcatggccaatggccagcttgtgaaaatgctgctctataccgaggtgactaggtacctcgattttaaagtgacggagggatcgtttgtctataagggtggcaagatctataaggtccccagtacagaagccgaagcgctcgccagttcccttatgggactctttgagaagcggcgcttccggaagttccttgtgtacgtggctaatttcgatgaaaaggacccccgcacttttgaagggatcgaccctaagaagaccaccatgagggatgtgtacaagaaatttgatctaggccaggacgtcatcgatttcacaggacacgcgttggccctttaccgaactgacgattacttagaccagccatgttacgaaacaatcaatcggattaaactgtactccgagagtctggccaggtacggcaaatctccgtacctgtatccactgtatggactgggtgaactgccacagggatttgccaggctttccgcgatttacggcggtacatacatgctcaataaaccaatagaagagatcattgtacagaatggaaaggttatcggagttaagtccgagggcgaaatagcccgctgcaaacagttaatttgcgacccctcatatgttaaagaccgggtggaaaaggtagggcaggtcatccgcgttatctgcatcctcagccaccccatcaagaacacaaacgatgccaactcttgtcagattataatcccacagaaccaagtgaatcgtaagagtgatatatacgtctgcatgatctcttttgcgcataacgttgccgcccagggtaaatacattgccatcgtgagtacgacagtggaaactaaagaacccgagaaggagatacgcccagcactggaactgctcgaacctatcgagcagaagttcgtctcaattagtgatctcctcgttccaaaggacttaggtaccgaaagccagatttttatatcaaggacctatgatgccacgactcacttcgagacaacgtgcgacgatataaagaatatatataaaagaatgactgggtctgagttcgacttcgaggagatgaagaggaagaaaaacgacatttatggtgaagactag

SEQ ID NO: 118243 - DNA, 468 bp, Artificial Sequence
  Description of Artificial Sequence: Synthetic coding sequence
atgaacgaagaatacgacgtcatcgtcttgggcaccggcttgaccctctacaagcgctttaaaatccccggcagtccacccgaatctatgggaagggggcgggactggaatgtcgatttgattcctaagtttcttatggcaaatgggcagctggtcaaaatgcttctgtacacggaagtgactcgctacttggacttcaaggtaacagaaggctcctttgtatacaaaggggggaagatttataaagtaccctccaccgaggccgaagccctcgccagctccttgatggggctgttcgaaaaaaggaggttcaggaagtttctagtgtatgtagctaactttgacgagaaagacccaaggacatttgaaggcatcgacccaaagaaaaccactatgagagatgtgtataaaaaatttgatctcggacaggacgtgatagactttaccggccatgctttggccctgtag

SEQ ID NO: 118244 - DNA, 612 bp, Artificial Sequence
  Description of Artificial Sequence: Synthetic coding sequence
aaaaaattcgatctgggccaggacgtcatagatttcacaggacacgctctggccctgtacaggacagacgattacttggatcagccttgctatgagactatcaatagaattaaactgtattccgaaagcctcgcacggtacgggaagtctccttacctgtacccattgtacgggctgggcgagctaccccaggggtttgcccggctgtcagcgatctacggaggcacttacatgttaaataagcccattgaggagatcattgtgcagaatggtaaagtgatcggcgtcaagtctgagggcgagatcgcacggtgtaagcaactgatctgtgatccaagttacgtgaaggatcgagtggaaaaagttggccaggtgatccgggtgatatgtatcttgtcacacccgatcaagaatactaatgatgccaattcttgtcagatcattataccgcagaaccaggtcaatcgtaaaagcgatctgctggcgtccgttaccagctggtaccagaagacctgggagcagaaagccaggagcctctttcccgcacatatgatgccccccctgattctgcgccagagagtcatgacgctgaaaacttccattcgaggctag

SEQ ID NO: 118245 - DNA, 792 bp, Artificial Sequence
  Description of Artificial Sequence: Synthetic coding sequence
atgaatgaggagtacgacgtgattgtgctgggcactggactcacagagtgcattctgtcaggcattatgagtgtcaacgggaaaaaagtactgcacatggacaggaatccatactacggtggggaaagtgctagcattacacctttggaggacctgtacaaaagattcaaaatccccgggtctccacccgaaagcatgggaaggggccgtgattggaacgttgacctcatcccaaaatttctgatggccaatgaggtcaccaggtacctcgactttaaagtcaccgaggggtcttttgtgtacaagggtggaaagatctataaggtgccatctaccgaagccgaagcactcgcgagttcgttaatggggctgttcgagaagaggagatttagaaagttcctggtgtatgttgcaaacttcgacgaaaaagacccccggacatttgaaggcattgatccgaagaaaacaactatgcgggatgtgtacaagaagtttgacctcggccaggatgtgattgactttacaggccacgcacttgcactttatcggacggatgattacctcgatcaaccttgctatgagacgattaatagaatcaaactatactcagagtctctggcacgctatggaaagtccccatacctgtatcctctgtacggtctcggcgagcttccgcaaggatttgcgaggctgagcgcaatttatggtggaacgtacatgttaaataaaccgatcgaggagattatcgtccagaacggaaaagtcatcggagttaaatcggagggtgagtag

SEQ ID NO: 118246 - DNA, 1119 bp, Artificial Sequence
  Description of Artificial Sequence: Synthetic coding sequence
atggcgcatgccccagctcggtgtccatccgcgcggggctccggtgatggcgagatgggaaagcccaggaatgtcgcattgattacaggaataaccggtcaggacggctcctacctcgctgagttcctccttgaaaagggctacgaggtccacggtatagtacggcgatccagtagtttcaacacagggaggatcgagcatctctataagaatccccaagcgcatatcgagggtaacatgaagctgcattacggagatctgacagattcaacttgcttggtgaagatcatcaacgaagttaagccaacagagatttacaatctgggggcgcagagccacgttaagatctcattcgatttggccgagtataccgctgacgtggatggggtcggcactttgagacttttggacgccgttaagacttgtggactgatcaacagcgtgaagttttaccaggcgtccacaagcgaactttatggaaaagtccaggagatcccacagaaagagaccaccccattctaccctcggtcaccatatggcgcagcaaagttgtatgcctattggatcgtggtcaatttccgtgaagcgtataacctttttgctgtgaacggcatcctatttaatcacgagtctccgaggcggggcgccaatttcgtgactcggaaaataagtcggtccgtggccaagatctacctggggcagctagagtgtttctctctggggaatttggatgccaagcgcgattgggggcacgccaaggattacgtcgaagcaatgtggctgatgctacaaaacgacgagccagaggacttcgtcattgccacaggtgaagtccacagcgtcagggagttcgtggagaagagctttctgcacatagggaagaccatcgtgtgggagggtaaaaatgaaaacgaggttgggagatgcaaagagacggggaaggtccatgtcaccgtggatttgaagtactatcggccaacagaagtggatttcctgcagggagactgtaccaaagctaagcagaagcttaactggaaacccagagtagcttttgatgaactcgtgagggagatggtgcatgctgatgtggaactaatgcgaaccaaccccaacgcttag

SEQ ID NO: 118247 - DNA, 1029 bp, Artificial Sequence
  Description of Artificial Sequence: Synthetic coding sequence
atgtgtaaaatggatggaagctacctagctgagtttttgctcgagaagggatatgaggtgcatggaattgtgaggagatctagcagttttaacaccggaagaatcgagcatctttataaaaatccacaggctcatatagaaggtaatatgaagctgcattacggtgacctcacagactcaacctgcctggtgaagatcattaatgaggtgaaacccaccgagatttataaccttggcgcgcagtcccacgtgaagatttcatttgatttggctgaatatacagcggacgtggacggcgtgggcaccttacgcctgctggacgctgtgaagacctgcggcctcattaatagtgtaaagttttaccaggcaagtactagtgaactgtacggaaaagtccaagagatccctcagaaggaaaccacacccttctatccccgctccccctatggagccgctaaactgtatgcatattggatagttgtgaacttccgtgaagcttataatctcttcgccgttaatggaatcctgtttaaccatgagagcccacgtagaggtgcaaacttcgtaacgagaaagatttcccgaagcgtcgcaaagatatacttaggccaattagaatgtttcagtctaggtaatctggacgcaaagcgcgattggggccatgctaaagactatgttgaggccatgtggctgatgctgcaaaacgatgagcccgaggattttgtcattgccacgggtgaagtgcattctgtcagggaatttgtggagaagtcattcttacatatcggcaagaccattgtatgggagggcaaaaatgaaaatgaagttgggcgatgcaaggagacaggcaaagtgcatgtcaccgttgaccttaaatattaccggcccacggaagtagacttcctccagggggattgtacgaaagccaagcagaaactgaactggaagcctcgggttgcctttgacgagcttgtcagggagatggtgcacgcagatgtggagttgatgcggactaaccctaatgcttag

SEQ ID NO: 118248 - DNA, 2196 bp, Artificial Sequence
  Description of Artificial Sequence: Synthetic coding sequence
atggtggtcgagcatccagagttcctcaaagcgggcaaggagccggggctgcaaatttggcgggtcgagaaattcgacttggtgcccgtgcccaccaacctgtatggagatttttttaccggcgatgcatatgttattttgaagacagtgcaactgcgcaatggcaatctgcagtacgatttacactactggttggggaacgaatgtagccaggatgaaagcggcgccgcagctatctttactgtccagctggacgactatctgaacggcagggcggtgcaacatcgtgaagtgcagggattcgagtctgcaacttttctgggctacttcaagtccggacttaaatacaagaaaggcggggtggcctccgggtttaaacatgtggtgcccaacgaagtggtggtacagcggctgttccaggtcaagggaaggcgcgtggttagagccacagaagtgcccgtttcttgggagtccttcaacaatggggactgcttcattcttgacctaggaaacaacatccaccagtggtgcggctctaatagcaacaggtacgagaggcttaaggcaactcaggtatcgaagggaattcgagataatgagcgctctggaagagccagggtgcatgtgagcgaagagggaaccgagcccgaggccatgcttcaggtcctgggacccaagcccgcactacccgccggcaccgaggatacagccaaagaagacgcagccaaccgcaaactcgctaagctgtacaaggtgtctaacggcgcaggcactatgagtgtctcactggttgctgacgaaaatccttttgcccagggagccctgaagagcgaagattgcttcatattagatcatggcaaagacggtaaaatctttgtctggaagggaaaacaggctaacaccgaagaacggaaagcagccttaaagactgccagcgacttcattacaaaaatggattatcccaagcagacccaggtgagtgtccttcccgagggtggcgagactcccctgttcaaacagtttttcaaaaactggcgcgatcctgaccagactgacggcctgggactgtcctacttaagttctcacatagctaacgtcgaaagagtaccattcgacgcagcaaccttgcatacaagtaccgccatggctgcccagcacggtatggacgatgacggcacagggcaaaagcagatatggaggatagaaggctctaataaggtgccggtcgaccctgctacctatgggcagttttacggcggggatagctatattatactgtataactaccgccacggcggtcgacagggccaaatcatctacaattggcagggcgctcagtcaacgcaggacgaagtcgctgccagtgcgatcttgacagcccagttggacgaggaactgggcggaacccctgtccaatccagggttgtgcaagggaaagaaccagctcacctcatgtctctattcggtggaaaacctatgattatctacaagggaggaacatcgcgggaaggcggtcagacggccccagcctccacaagactgtttcaggtcagggctaattctgccggcgccaccagagccgttgaggttctgccaaaggccggagccttgaacagtaacgacgcctttgtgctgaaaaccccctctgctgcctacctgtgggtgggaactggggcctctgaggcagaaaaaacaggagcacaagaactgctccgggtgcttcgagcccaaccagtgcaggtggccgagggctctgagcctgatggcttctgggaggccctcggaggaaaggccgcctataggacctcccctaggctgaaagataaaaagatggacgcccatcccccccgccttttcgcctgcagcaacaagatcggcagatttgtcattgaggaagtgccaggcgaactcatgcaggaagacctggcaacagacgacgttatgctccttgacacgtgggatcaggtatttgtttgggtaggcaaggattcccaggaggaagaaaagaccgaagctctcacatcagctaagcggtatattgagactgatcccgccaatcgcgatagacggacccccatcactgtcgtcaagcaaggattcgaaccccccagctttgttgggtggtttctcggctgggacgatgactattggtcagtggatcctctggaccgagcgatggccgagttagccgcttag

SEQ ID NO: 118249 - DNA, 2196 bp, Artificial Sequence
  Description of Artificial Sequence: Synthetic coding sequence
atggtggtggagcaccccgaattcctcaaggctggcaaggagcccggcctgcaaatctggcgggttgagaaatttgacctagtacccgtgcccactaatttgtatggggatttctttaccggggacgcgtatgttatcctgaagactgtccagctccggaacggcaacctccagtatgaccttcattattggcttggaaatgaatgcagtcaggacgaatccggcgcagctgctatcttcacagtccagctggatgattacctgaatggacgggcagtacagcatagggaggtccagggcttcgagagcgctacgtttctggggtattttaagagcgggcttaagtataagaagggtggagtggcctctggtttcaagcacgtggttcctaacgaggtggtagtccagcgactgttccaagtgaagggcagaagagtagttcgagcaaccgaggtgccagtgtcttgggagagttttaacaacggggactgtttcattctggacctggggaacaacatccaccaatggtgcggttctaattcaaaccgttatgagaggctgaaggcaactcaggttagtaaaggcattcgggacaatgaaaggtctggaagggcccgagttcatgtgtctgaggaaggaacagagcccgaagccatgctgcaggtcttaggacctaagcctgcactccccgctggaactgaggacactgcaaaagaagacgctgccaacaggaaacttgctaagctgtacaaagtgtccaatggggcagggaccatgtccgtaagtcttgtagccgatgaaaatccgttcgcacagggcgccctgaaaagtgaggattgttttatcctcgatcacggcaaagacggaaagatcttcgtgtggaagggaaagcaggcaaataccgaggagaggaaggccgcactgaagacagccagtgacttcatcacaaagatggactaccctaagcaaacacaggtgagtgtactgcccgagggaggggaaactccgttatttaagcagttcttcaagaactggagggatcccgatcagaccgacgggcttggcctatcctatcttagcagtcacatcgccaacgtagaacgagtcccatttgacgcagccactctgcatacctctacagccatggcagctcaacacggcatggatgatgacgggaccggccagaagcagatatggcgcattgaaggctctaataaagtacctgtggatcccgccacctacgggcagttttacggcggagattcgtatataattctttacaactacaggcatggagggagacagggacaaataatctataattggcagggggcccaaagcacccaggatgaagttgcagcctccgccatcctgactgcccagcttgacgaggaactggggggcactcccgtgcagagtagggtagtccaaggaaaggagcccgcccatttaatgagcttattcgggggcaagcccatgataatctataaaggaggcactagccgtgagggaggacaaacggctcctgcatccactcggctcttccaggtgagagcaaactctgctggagcaacaagggcagtcgaagtactccccaaggccggggctctcaacagtaacgacgcattcgtcctgaagacccccagcgctgcatatctgtgggtggggaccggagcgtctgaagctgagaagactggtgcccaggagctactccgcgtactaagggctcagcccgtgcaggtcgcagagggcagcgagcccgacggattctgggaggctcttggaggtaaggccgcctaccgcacatcaccgaggctgaaagacaagaaaatggatgctcatccccccaggctgttcgcctgtagcaacaagattggacggtttgtgattgaagaggtgcctggcgagctgatgcaggaagatctcgccacagacgacgtgatgttactggatacctgggatcaggtgtttgtgtgggtgggtaaggactcgcaagaggaggagaagacagaggccctcacgtctgccaaacgatacatcgaaacggaccccgctaatcgtgacaggcgcacaccaattaccgtggtgaagcagggtttcgaaccccctagcttcgtgggctggttcctaggctgggatgacgattactggtccgtggatcctttagacagggctatggccgagcttgcagcctag

SEQ ID NO: 118250 - DNA, 2349 bp, Artificial Sequence
  Description of Artificial Sequence: Synthetic coding sequence
atggctccccataggccagctcctgcgctcctctgcgccctttccctggctctgtgcgccttaagtctgccagtgagagctgccactgcttcacggggggctagccaggccggtgcaccccaaggaagagtgccagaggcccggcccaattctatggtggttgagcatccggagttcctgaaagcggggaaagaacccggcctgcagatttggcgcgtggagaaattcgacctggtccccgttcctacgaatctatacggggacttctttaccggcgacgcatatgtgatcctgaagaccgtccaactgagaaacggtaacctgcaatatgacctgcattactggctgggaaacgaatgctcgcaagacgagagtggcgcggccgcgatatttactgtgcagctggacgactatctgaacggcagagccgtccagcacagagaggtccaaggcttcgagtccgccacctttctcggctacttcaaatccggactgaagtacaaaaaaggcggggttgcaagtggcttcaaacacgtggttcctaatgaagtggttgtgcagagactttttcaagttaaaggacggagggtggtacgcgccactgaggtacccgtgtcctgggaatcttttaacaacggggattgcttcatcctcgatctgggaaacaacattcaccaatggtgtggatccaatagcaatagatatgagcgacttaaggcaacgcaggtttccaaagggattagagataatgagcgcagtgggagagcgcgggtacacgtttccgaagagggcaccgagcctgaagctatgcttcaagttcttggcccaaagcccgcgctgcccgctggcacagaagataccgccaaggaggatgccgccaaccgcaaactggcaaaactgtacaaggtttccaatggagcagggacaatgtcagtgtccctcgtagcagatgaaaatccatttgcccaaggcgcccttaaaagcgaggactgcttcattctggatcacggcaaggatggcaaaatcttcgtgtggaaggggaaacaagctaacactgaggagaggaaagcagccttaaagactgccagtgacttcatcaccaagatggattaccctaaacaaacacaggtctctgtcttgccggagggtggggagacgcccctgttcaagcaattctttaagaattggcgggaccccgaccagaccgatgggctggggttgtcttacttgtccagccacatagctaatgtggaacgtgttccattcgatgctgctacactacacacaagtactgccatggccgcgcagcatgggatggacgacgatggcaccggacagaaacagatctggagaatcgaaggcagtaataaggttcctgtcgaccccgccacgtatgggcagttctatggcggggactcatacataatcctgtataactacaggcacggcggtcggcagggccagataatttacaattggcagggggcccagagcacccaggacgaggttgcagcctcggctattttaactgctcagctcgacgaagagcttggcgggacccccgtacaatctcgagtagttcagggcaaggagccagctcacctgatgagcctttttggcggcaagccgatgatcatttacaagggagggacatctagagagggtgggcagacagctcccgctagcacccgcctgtttcaggttcgcgccaacagcgccggtgcgaccagagcagtagaggtcctgccaaaagcaggggctcttaactccaatgacgctttcgtccttaaaactcccagcgccgcgtatctttgggttggcaccggagcctctgaagccgaaaagaccggagcccaagagctattgcgcgtactgagagctcagccagtgcaagtcgccgaaggcagtgaaccagatggattctgggaggcactaggaggtaaggctgcttatcgtacttctcctcggctgaaagataagaagatggatgcccatcctccccggctattcgcttgtagtaataagattggacggttcgtgattgaggaagtgccaggcgagttaatgcaggaagaccttgccactgatgacgtgatgttgctggacacatgggatcaggtctttgtgtgggtgggcaaagactcccaggaggaggaaaagacagaagcgcttacaagtgctaaaaggtacattgaaacggatcctgccaacagggataggagaacccctatcaccgtggtaaagcaaggtttcgaaccgccttcctttgtgggatggtttctgggctgggacgacgactattggtctgtcgatccgcttgaccgcgccatggctgagttggctgcatag

SEQ ID NO: 118251 - DNA, 2196 bp, Artificial Sequence
  Description of Artificial Sequence: Synthetic coding sequence
atggtggtcgaacatccagagtttctgaaggcggggaaagaacccggtttacagatctggagagtggaaaagtttgacctggtcccagtgccaaccaatctttacggggacttttttactggtgacgcttatgtcatcctgaagacagttcagctccggaacgggaatcttcagtacgacctgcattactggctaggcaacgagtgctcacaggacgagagcggggctgccgcaattttcactgtgcaactggacgattatttgaatggccgcgcagtgcaacacagggaggtgcagggctttgagtctgcaacattcctaggatactttaagtctggactgaagtacaaaaagggaggggtcgcgagcggcttcaaacacgtggtaccaaacgaggtcgtggtacaacgtctgttccaggtaaagggccgtcgcgtggttcgggctaccgaggtcccagtaagctgggaatctttcaacaatggtgactgctttattctcgatctcggaaacaatatccaccagtggtgtggcagcaatagcaaccgatacgaaaggctgaaagcgacccaggtttctaaggggatcagagataacgaacggtctgggagagctcgggttcatgtatctgaagagggaactgagcctgaggccatgctgcaagtgttggggccaaaacccgcactacctgccggaacagaggacacagcgaaggaggatgccgcaaatcgaaagctagccaagctgtacaaagtgtccaatggggcaggaacgatgtctgtatcccttgtggctgatgagaatccttttgcacagggggcgcttaagtcagaagattgcttcatcctcgaccacggaaaggatggtaagatcttcgtttggaaaggtaagcaagctaacaccgaggaacggaaagcagcattgaaaacagcaagtgacttcatcacgaaaatggactaccccaagcagacccaagtttccgtactcccagagggtggcgagactcctctattcaagcagttctttaaaaactggagggatccagaccaaacagacggtcttggccttagctatctctcgagccacatcgcaaacgtggagagagtgcctttcgacgcggcaactttgcatacaagcacggctatggcagcacagcacgggatggacgacgatggcaccggacagaaacaaatatggaggatcgagggttctaacaaggtgcccgtggaccccgctacatacggccagttctatgggggggactcgtatatcatcctttataattatagacacgggggcaggcaaggtcagattatctacaattggcaaggtgcacaatccacacaggatgaggtggccgcctctgctatactgactgcacagctcgatgaagagctgggaggaaccccagtgcaatctcgtgtcgtgcaaggaaaggaacccgctcacctcatgagcctgttcggcgggaagcctatgattatatacaagggcgggactagcagagagggcgggcagacagcaccagcatctactcgcttgttccaggtgagagccaactctgccggggcaaccagggctgtggaggtgctgccaaaagctggcgccctgaactctaatgacgccttcgtgttaaagacaccttcagctgcttacctgtgggtcgggactggggcctcagaagcagaaaaaactggagcccaagagctgttgagggttctgagagcacagcctgttcaggttgcggaaggatcagagccagacggattctgggaggccctgggcggcaaggccgcctacaggacttctcctcgtttgaaggataagaaaatggatgcgcaccccccgaggctttttgcttgtagcaacaaaatcggccgctttgtgatagaagaggtgccgggagagttaatgcaagaggatctcgcaactgacgacgtgatgctccttgacacatgggatcaggtgttcgtgtgggtcggcaaggactctcaggaggaagagaagactgaagcactcacctctgccaagcgctatatagaaactgatccagcaaaccgcgatcggagaactcccatcactgttgtgaaacaaggcttcgagcccccatctttcgtcggatggttcttaggctgggatgacgattattggagcgttgacccccttgatcgagccatggcggagctggcggcttag

SEQ ID NO: 118252 - DNA, 2148 bp, Artificial Sequence
  Description of Artificial Sequence: Synthetic coding sequence
atggttgtcgagcacccggagttccttaaggcaggcaaagagccagggctccaaatatggcgggttgagaagttcgacgcctatgtgatcctcaagaccgtgcagctacgcaatgggaacctgcagtatgatctgcactattggcttggcaacgagtgcagccaggatgagtccggagctgcagctatatttacagtacaacttgacgactacctaaacggtagagcagtgcagcacagggaggtgcagggtttcgagtctgcaacatttctaggctacttcaagtcgggactcaagtataagaagggcggagtggcctctggttttaagcatgtggtccctaacgaggtagtcgtgcaaagattgtttcaggttaaaggcaggcgcgtcgttcgagccactgaggtgcctgtgtcctgggaaagctttaataacggggactgcttcatcctggacctgggaaacaacattcaccagtggtgcggctcgaatagtaataggtatgagaggctgaaagccacacaggtaagtaaggggatccgcgacaatgagaggagcggtagagcccgagtacacgtgagtgaggaaggaacggaaccggaagccatgctgcaagtgttgggtcccaaacctgccctgccagcaggcaccgaagatactgctaaggaagatgccgccaatcgaaaactagcaaagctgtataaagtctccaatggcgccgggacgatgtctgtgtcactggtggctgacgagaatcctttcgctcagggcgcactgaagtcggaagattgttttatcctggaccatggtaaagatggcaaaatttttgtctggaaaggcaagcaagcaaataccgaggaaagaaaagcggctctcaaaactgccagtgacttcatcacgaagatggattatccaaagcagacccaggtctctgtgctgccagagggcggagagacccctctgttcaagcagtttttcaaaaattggagggaccccgatcagacggatggcctgggcctcagctaccttagcagccacattgccaatgtggagcgggttcccttcgacgccgcaacacttcacaccagcacggcaatggcggcccagcatggtatggacgatgatggtaccggacagaaacagatctggaggattgaaggctccaacaaggtcccagtagatccagcaacatacggccagttttatggtggagattcctacattattctgtataactatcgccatggcggccggcaggggcagataatctacaattggcagggagctcaatctacccaagacgaagtggccgcgtccgccattcttacagcacagctggacgaagagctgggtggtactccggttcagtcccgagtggtccagggcaaagagccagcccatcttatgagtctattcgggggaaagcccatgatcatatacaaaggtggcacaagccgcgagggcgggcaaacggccccagcctcaacccgcctctttcaggtgagagccaactccgccggggctacgagagcagttgaggtgctgccaaaagcaggggctctgaactctaacgacgcattcgtcctgaaaacaccgtctgcagcttatctgtgggttggaaccggagcgtctgaggcagagaaaacaggcgcacaggagttgttgcgcgtgttgagagcacagccagtgcaggtggctgaagggagtgaaccggatggcttttgggaggcacttggcggcaaggctgcctaccggactagccctagactcaaagataaaaagatggacgcccatcctcctagactattcgcctgttccaacaaaattggaaggttcgtcattgaagaggttccaggtgagctaatgcaggaagacctggcaactgatgacgtgatgctgttagacacttgggaccaggttttcgtttgggttgggaaggacagccaggaagaggagaaaacagaggccctcaccagcgccaagagatacatagagaccgatcccgccaatcgcgacagaagaactcctataaccgttgtgaagcagggctttgaaccgccatctttcgtgggctggtttctgggctgggatgacgattattggtctgtcgaccccctggatagagccatggcagaactggctgcatag

SEQ ID NO: 118253 - DNA, 2229 bp, Artificial Sequence
  Description of Artificial Sequence: Synthetic coding sequence
atggagaagctgttctgctgttttcctaacagcatggttgtcgagcatcctgaattcctaaaagctggcaaagagccggggctgcaaatttggcgcgtcgaaaagttcgaccttgtgccagtgcctactaacctctatggcgatttttttaccggcgacgcgtatgtcatcctgaagacagtgcaactgaggaacgggaacctgcagtacgatttgcattattggctcggtaacgaatgctctcaggacgagtcaggtgcggccgcaattttcactgtccaactggacgactatctcaatggcagggcagtgcaacatcgcgaggttcaaggctttgaaagtgccacctttcttggttactttaaatcgggactcaaatacaaaaaagggggtgtagcttccggatttaagcacgttgtccccaatgaagtggtcgtgcagagactatttcaggttaaggggcgcagggtggtgagggctaccgaagtgcctgtgtcttgggaatctttcaacaacggagactgttttatcctcgatctgggcaataacatccaccagtggtgcggatcaaattccaatcgctacgagcgactcaaagccacccaggtctccaagggcataagagacaatgaaagatcagggcgagcacgcgtccatgtttcggaggaggggacagaaccagaggctatgctccaagtgttgggaccaaaacctgctctgccagccggtaccgaggatacagccaaggaggacgcagcaaaccgaaagctggccaagctgtataaagtgagcaatggagcaggaaccatgtctgtgagtctggtggcggacgagaacccctttgcacagggggcactcaaatcagaggactgttttatattagatcacggaaaagacggcaaaatctttgtttggaagggcaaacaggccaatacagaggagcggaaagccgctctgaaaactgcaagtgatttcatcactaagatggattaccccaaacagacacaggtgagcgtgctgcccgagggtggcgaaacgcctctgttcaagcagttcttcaaaaactggagagacccggatcagacagatggccttggattatcttacctgtcttctcatatcgctaatgtggagcgtgtaccatttgacgccgccactctgcatacctcaaccgcgatggctgcccagcatgggatggatgatgatggaacaggccaaaagcagatctggagaattgagggcagcaataaggtcccggtcgacccagcaacatacggacagttttatggaggagacagttacattatcttgtataactacaggcatggcggccgtcagggtcagatcatctacaactggcagggagcacagagcactcaggacgaagtcgccgcaagcgcaatcctcactgcccagcttgatgaggaactgggtgggactcccgtgcagagtcgggtggttcagggcaaagaacctgctcacttaatgtctctgtttgggggtaagccaatgatcatctacaagggtggtacaagtcgcgaaggcgggcagacggcccccgcatctactaggctctttcaggtgagagctaatagcgcgggggctaccagggccgtggaagtgttgccaaaggccggagcactcaacagcaatgacgctttcgtacttaaaacacccagcgccgcctatctctgggtcgggactggcgcgtccgaagcggagaaaaccggggcgcaagagttgctgcgggtgttaagggcccaacctgtgcaggtggccgaggggtccgagcccgatggtttttgggaggcactgggggggaaggcagcctaccggacttccccaaggctcaaggataaaaaaatggatgcacaccctccccgcctttttgcatgttccaataagattggaaggttcgtaatagaggaggtgcctggggaattaatgcaagaggatttagccactgatgacgtgatgctgctcgacacttgggatcaggtttttgtctgggtggggaaagactctcaggaagaggaaaagacggaagcccttacatccgccaagaggtacatcgaaaccgatccagctaacagagaccgaaggacacctattacagtcgtcaagcaagggttcgaacctccctcctttgtcggttggtttttaggctgggacgatgactactggtccgtcgatcccttagacagggccatggctgagctcgctgcatag

SEQ ID NO: 118254 - DNA, 2196 bp, Artificial Sequence
  Description of Artificial Sequence: Synthetic coding sequence
atggtggttgaacatcccgagttcctgaaggctgggaaggagcctgggctgcagatctggagagttgaaaagttcgatctggtgcccgtgcccacgaatctctacggcgatttctttaccggagacgcatacgtcatcctcaaaacagtacaactcaggaatggtaacctccagtacgacttacattactggcttgggaacgagtgttcacaggacgagtcaggggcagcagctatatttacagtgcagctggatgattatctgaatggtcgggctgtccagcacagagaagtgcagggctttgaaagtgcaaccttcttgggctattttaagagcgggttgaagtataaaaaaggcggagtggccagtggcttcaagcacgtggtgcccaacgaggtggtagtccaaagactgttccaagtgaaaggaaggcgtgtagtgcgggcgacagaagttccggtgtcctgggagtcatttaacaatggagactgctttatcttggatctcggtaataatattcatcagtggtgtggctctaatagtaatcgatatgaacgtctgaaggctacccaggttagcaaggggataagagacaacgaacgatcggggagggctcgagttcacgtcagtgaggagggaacggaaccagaggcaatgctgcaagtcttgggccctaagcctgccctccctgccgggactgaagacaccgcgaaagaggatgccgccaacagaaagctcgccaagctgtataaggtatctaacggggccgggaccatgtccgtgtctctcgtggccgacgagaatccttttgcacagggggcactgaagtccgaggattgctttatcctcgatcatggcaaagacggaaaaatctttgtttggaaaggaaagcaagccaatacagaggaacgcaaagctgccctgaagacagcatctgattttattaccaagatggattacccgaagcagacgcaggtaagcgttctccctgaaggtggcgaaacgccactgttcaagcagttttttaaaaactggcgagatcccgatcagactgatgggctggggctgtcctacttgtccagccacatcgcgaatgtggagcgtgtgccatttgatgcagccacattgcacacctctaccgccatggccgcccaacatggcatggacgacgacggtactgggcaaaagcagatttggcggatagaaggaagcaacaaggtgcccgtagaccccgccacttatgggcagttttacgggggggactcctatattatcctgtacaattaccgtcacggcgggaggcagggtcaaatcatctacaattggcagggggctcagtctacgcaggatgaggtcgccgccagcgctattctcaccgcccagctcgatgaggaacttggcggaacccccgtacagtcgcgcgtcgtgcaggggaaagagcctgcccacttaatgtcactctttggtggtaagcctatgatcatctataaaggcggcacgtcaagagagggtgggcagaccgctccagcaagcacccggctatttcaggttcgggcaaactccgcaggcgcgacccgagccgtggaggtcctgccaaaggcgggggccctgaactccaatgacgccttcgttctgaaaacaccctccgctgcctatctgtgggtgggcactggtgcaagcgaggcggaaaagacaggagcccaggaactcctacgggtgctcagggcccagcccgtccaggtggctgaaggcagtgaaccagacggcttttgggaggcactcggcggcaaggctgcttaccgcacaagcccccggctgaaagataagaagatggatgctcacccaccacgactctttgcttgctccaacaagataggcaggttcgtgatagaagaagtccccggggagttaatgcaggaggatctggccactgacgacgttatgctgctcgatacttgggaccaggtcttcgtgtgggtggggaaagactctcaagaagaggagaaaacggaagcccttacatcggccaagcgctatatcgaaaccgatccagccaatcgcgaccgaagaacccctattaccgtggtgaagcaggggtttgagccacccagcttcgttggatggttcctgggatgggatgacgactattggtcagtcgaccctttggaccgtgccatggctgagctcgccgcgtag

SEQ ID NO: 118255 - DNA, 783 bp, Artificial Sequence
  Description of Artificial Sequence: Synthetic coding sequence
atggtcgtcgaacatccagaatttctgaaggcgggaaaggagccgggtcttcaaatctggcgcgttgagaagttcgatctagttccagtacccaccaacctgtacggggattttttcactggtgatgcttacgttatattgaagacagtccagctccgcaacgggaaccttcaatatgatcttcactactggttaggaaacgagtgctcccaagatgagagcggagccgctgccatttttaccgttcagctggacgactatctcaacggcagggcggtccagcatcgcgaggttcaggggttcgagtctgccactttccttggatattttaaaagtggattaaagtacaagaaaggcggcgtggcatccggtttcaagcacgtcgtacccaatgaggttgtcgtgcagcgattatttcaagttaaaggaagaagggtggtgagagctactgaagtgccggtgtcatgggaatcctttaataatggggactgcttcatccttgatctgggtaacaatatccatcagtggtgcggcagtaactccaatcggtacgagcggctgaaggcaacacaagtgagtaaaggaatccgagacaacgagaggagcgggcgggcccgtgttcatgtgtccgaggagggcactgaaccagaggctatgctgcaagtgctcggccctaagcctgctctgccagcagggacagaagacacggccaaggaagatgccgccaacagaaagctggccaaactgtataaagtcagcaatggcgcgggcaccatgagctag

SEQ ID NO: 118256 - DNA, 2229 bp, Artificial Sequence
  Description of Artificial Sequence: Synthetic coding sequence
atggagaaactgttctgttgctttccgaattctatggttgttgaacacccggagttcttaaaggcagggaaggagccgggactacagatttggagagtcgaaaaatttgacttggtccccgtcccaaccaatctgtatggagatttttttactggggatgcctatgtcattctgaagaccgtgcagctgcgtaatggcaatctccagtatgaccttcattactggctgggaaatgagtgctcccaggatgaaagtggcgccgccgcgatattcaccgttcaactggacgattatctcaacggcagagccgttcaacaccgggaagtgcagggtttcgaatccgccacttttctgggttactttaaaagcggacttaaatacaaaaaaggtggtgttgcttccgggttcaagcacgtcgtgcctaatgaggtcgtggtgcaacgcctgtttcaggttaagggaagacgcgtggttagggctaccgaagtgccggttagctgggagagttttaacaatggggactgctttattctggaccttggtaataatatccaccagtggtgtggttccaactcaaataggtacgaacgacttaaagctacgcaggtatccaagggaatccgcgataatgagcgctccgggcgcgcacgcgtgcatgtatcagaagaaggaaccgagcccgaggcaatgcttcaagtgctgggcccaaagccagctcttccggccggtactgaggatacagccaaagaagacgcagcaaaccgcaagctggccaagctgtacaaagtctctaatggggccgggaccatgtcagtgtcactggtcgcggatgaaaaccctttcgcccagggagctctgaaaagtgaagactgtttcattcttgaccatggcaaggacggaaagatcttcgtttggaagggcaagcaggccaacacggaggagcgtaaggccgctctgaagactgcctctgatttcataacaaaaatggattatcctaagcagacccaagtgagtgttttacctgaaggcggcgaaacaccacttttcaagcaattcttcaagaactggcgcgacccagaccagacagatggtcttggcctgagctatctgtcttcacacattgcaaacgtggaaagagtgcccttcgacgcagcaacacttcatacaagcacagccatggcggcacaacatggcatggacgacgacgggactgggcaaaagcaaatctggcgaattgaaggatctaataaagtgccggttgacccagcaacctatggccaattctacggcggtgactcttatatcatcctgtacaattatagacatggtggtagacaaggccagattatctacaattggcagggcgcccagtccacgcaggatgaggtggctgcatccgccatccttactgcacagttagacgaagaactgggcgggacacctgtgcaaagcagagtcgtgcagggcaaggagccagctcacctaatgtctctattcgggggtaagcccatgatcatttacaagggcggcacctctagagagggcggtcagaccgcccctgcttccactagactgttccaggttcgcgccaacagtgccggcgctactcgggccgttgaggtgttaccgaaagccggtgcgcttaactctaatgatgcgttcgtactgaaaaccccaagtgctgcatacctttgggtggggaccggagcctccgaggcagaaaagacgggtgcccaggagctcctgagagtgctgcgcgcccagcctgtccaggttgccgaaggaagcgagcctgacggtttctgggaagcgctgggaggcaaggctgcctaccgcacctccccaagactgaaagacaagaaaatggatgctcatcctccgcgcctgttcgcgtgcagcaacaagatcgggcgattcgtgatcgaggaggttcccggcgagctaatgcaggaagatctcgccaccgacgacgtgatgctgttagatacctgggatcaagtgtttgtctgggtcggaaaagactctcaggaggaagagaagacagaagcactcacctcagctaaaagatatattgagacagatccggccaaccgcgaccggcgcacaccaatcacagttgttaagcaggggttcgaaccccccagtttcgtgggatggttccttggatgggatgacgactactggtcagtagatccgctggatagagccatggccgagctcgcggcctag

SEQ ID NO: 118257 - DNA, 2196 bp, Artificial Sequence
  Description of Artificial Sequence: Synthetic coding sequence
atggtggtggaacatccagaatttctgaaggccggcaaggaaccagggctccaaatctggcgggttgaaaagttcgacctggtgccagtccctactaatctttacggcgactttttcactggggatgcctatgtgattctcaaaacagtgcagctcagaaatggcaacctacagtacgatctgcactactggctggggaacgagtgttctcaggatgaaagtggggccgcagccatcttcacagtgcagctggacgactacttgaatgggagggcagtgcagcaccgcgaagtgcaggggttcgagtcggccacctttctggggtactttaagtcgggcctcaagtacaagaaaggtggcgtggcgtccggatttaaacatgtcgttcccaacgaagtggtggtccagaggctgtttcaggttaaggggcgtagagtggtccgagccacagaagttcccgtgagctgggagtcatttaataatggagattgcttcatcctggacctgggaaacaatatccaccagtggtgcggatccaatagcaatcggtacgaaagactcaaggctactcaggtgtccaaaggcatccgtgataacgagaggagtggcagggcaagagttcacgtcagcgaggaaggcactgagcccgaggcaatgctgcaggttcttggccctaaacctgccttgccggcagggacagaggataccgcaaaggaagacgctgccaataggaaactggctaagctgtacaaagtgagcaatggagcaggcactatgtcagtctctttggttgcagacgagaatccatttgctcagggtgctctgaaaagtgaagactgtttcatacttgatcacgggaaggacggcaaaatctttgtctggaaaggaaagcaagccaacactgaggaaagaaaggcggctctgaaaacggcttccgattttataaccaagatggattatccaaaacagacacaggtctccgtgctgcccgaagggggggagactcctctatttaagcagttcttcaaaaattggcgcgaccctgatcagacagacggcctgggactctcttatctgtcaagccacatcgctaacgtcgaaagagtcccattcgacgcagccactttgcacaccagcacggccatggctgctcaacacggaatggatgacgacggaacggggcagaagcagatttggagaattgaagggtctaataaggtgccagtggatccagccacatacggacagttctacggcggggattcatacataattctgtacaactacaggcatggcggtcgccagggccagatcatttataactggcagggtgcccaatcgactcaggacgaggttgctgcatctgccatactgacagcccagctggacgaagagcttggagggacaccggtgcagtccagggttgtgcagggtaaagaacccgctcacctgatgagcctttttggcggcaagcctatgattatttacaaaggcggcacaagccgagagggcggtcagaccgccccggccagtaccagactgttccaggtccgagccaatagcgcgggagccacccgggcagtcgaggtgctgcccaaggccggcgctctgaattctaacgacgcatttgtgctgaaaaccccctcagctgcctatttgtgggtcgggaccggcgcttctgaagctgagaaaaccggggctcaggaactcctgagggttctgcgtgcacaaccggttcaggtggcagagggaagcgagccggatggcttctgggaagctttggggggcaaggcagcctatagaacctcacctaggctcaaggataaaaagatggatgcccatcctcctaggttgttcgcctgcagcaataaaatcggcaggtttgtcattgaggaagtgcccggtgaattaatgcaggaggacctggctaccgacgacgtcatgctattggacacatgggatcaggtctttgtctgggtggggaaggacagccaggaggaggagaaaacagaagcactcacgagcgctaagcggtatatagaaaccgaccctgctaatcgagaccgaagaacccccattacagtggtgaaacagggatttgaacctccgtcctttgtcggatggttcctggggtgggacgacgattattggtcggtcgatccactggaccgcgccatggctgaactggctgcttag

SEQ ID NO: 118258 - DNA, 2118 bp, Artificial Sequence
  Description of Artificial Sequence: Synthetic coding sequence
atggtggtggagcatcctgaattcctgaaagctggtaaggaaccagggctccagatttggcgggttgaaaaattcgacttggtgccagttccaaccaacctgtacggggacttttttaccggtgacgcttacgtcatcctcaagactgtgcagctgagaaacgggaatttgcagtatgacttgcactactggcttggaaacgagtgcagccaggatgaaagtggggccgccgcaatctttaccgtgcagcttgatgactatttaaaatataagaaaggcggagtggcttccggatttaaacacgtcgtgcctaatgaggtggtagtccagagactttttcaggtgaagggtaggcgagtggttagagcaaccgaagttcctgtgagttgggagtctttcaacaacggagactgtttcatacttgacctaggtaacaacatacaccagtggtgcgggagtaactcgaaccggtacgagagactgaaggccacccaggtgtcaaaggggatccgtgacaacgagaggtccgggcgggccagggttcacgtgagcgaggagggtaccgaacctgaggcaatgctgcaggtcttagggccaaagcctgctttacccgcaggcaccgaggatactgcaaaggaggatgctgcaaaccggaaactggccaaactctacaaagtgagcaatggggctggaacgatgtccgtgagtttggtggccgacgagaatccatttgcacagggggccctcaaatctgaagattgttttattctggatcacgggaaagatggcaagatcttcgtgtggaagggaaaacaagcaaacaccgaggagcgcaaagccgcgctcaagacggcgtccgattttatcactaagatggactacccaaaacagacacaggttagtgtgctgccagagggtggggaaaccccactcttcaagcagttttttaagaactggagggatccggatcaaactgacggcctggggttatcatatctctcatctcacatcgccaacgtggaaagagtcccatttgatgcagctaccctacacacttcaaccgcaatggcggcccagcacgggatggatgacgacggaacaggtcagaaacaaatctggaggattgaaggatctaacaaggtgcctgtggatccggccacatacggacagttctatggtggagacagttacatcattctgtacaattatcgccacggtggaagacaaggacaaataatatacaattggcagggtgctcaaagcactcaggacgaggtggcagccagtgctattctgacagcacagctggacgaagaactcggcgggacccctgtgcagtcaagggtcgtccagggtaaagaaccagcccatctgatgagcctgttcgggggaaaacctatgatcatctataaaggcgggacaagccgcgagggggggcagaccgcaccagctagcacccgccttttccaggtcagagccaacagcgctggtgcgacccgggctgtggaagtgctgccaaaagctggcgcccttaacagcaacgacgcttttgtactcaagactccatccgccgcttacctgtgggtggggacgggcgctagcgaggccgaaaagacaggcgcacaggagctgctgcgagtgcttcgcgctcagcctgtgcaggtagcagagggctctgaacccgatggcttttgggaagccctcggcggaaaggctgcctaccgaacctccccccgtctgaaggataaaaagatggacgcacaccctcctagactgttcgcgtgttctaacaagatcggccgattcgtgatcgaggaagttccaggcgagctcatgcaggaagacctcgccactgatgatgttatgctgctggacacgtgggatcaggtctttgtctgggtcgggaaggatagtcaggaggaggagaagaccgaggcgctgacttccgctaagaggtacatcgaaaccgaccctgcaaaccgagatcggcgcacgcccatcacggtggtgaaacaaggtttcgagcctccctcctttgttggatggtttctgggttgggacgacgattactggtctgtcgatcctcttgatcgcgccatggctgaactggctgcctag

SEQ ID NO: 118259 - DNA, 2220 bp, Artificial Sequence
  Description of Artificial Sequence: Synthetic coding sequence
atgccactgtgcactcccaactccatggttgtagaacaccccgagttccttaaagcaggaaaagaacctggcctgcagatctggcgggtcgaaaaattcgatttggtccccgttcccacgaatctgtatggagacttcttcaccggcgacgcttatgtgatcttaaaaacggtccagcttcggaacgggaatcttcagtacgatctccactattggctgggaaatgagtgttctcaggatgaatccggcgccgctgctattttcactgtccagctggacgactacctcaacggtagggcggtgcagcaccgagaagtccaggggttcgaatcagctacatttctggggtactttaaatcaggactgaagtataagaaaggtggcgtcgcctctggttttaaacatgttgtcccaaatgaagttgtcgtccaacggctcttccaagttaagggccgacgcgtcgtgcgtgctactgaagtgccagttagttgggaatctttcaacaacggtgattgttttatccttgatctgggcaataatatccaccagtggtgtggctctaatagcaaccgttacgagcggcttaaggctacccaggttagtaagggaattcgggataacgagcgatctggaagagctcgcgttcacgtgagcgaggagggaacagagccggaagctatgttgcaggttctgggccccaaacctgcactgccggcaggcacagaagacaccgctaaggaagatgcggctaaccgaaagcttgctaaactttataaagtgtccaacggagcgggaacgatgagcgtctcattggtggcagatgaaaatcctttcgcgcagggcgctttgaaaagcgaggactgctttatcctggaccacgggaaggacggaaaaatcttcgtgtggaaaggaaagcaagctaacacagaggaacggaaagctgcgcttaagacagctagcgacttcataaccaaaatggattatcccaaacagacccaggtctccgtgctcccagagggtggggaaactcccttgttcaagcagttcttcaaaaactggcgtgatcctgatcagaccgacgggctgggccttagttatttgtcctctcatattgccaatgtagagagggtcccctttgatgctgccacccttcacacttctaccgctatggcagctcagcacgggatggatgacgacggcacaggccagaagcagatctggaggattgagggcagcaacaaagtcccagtagatcctgccacatacgggcagttctatgggggagactcctacatcatcctgtataattacaggcacggaggccggcagggacagatcatttacaattggcagggcgcgcagagtacccaagatgaagtggctgcttctgcaattctgaccgcacagctcgacgaggagctggggggcacgccagtccagtcccgcgtcgtccagggaaaggagcctgcccaccttatgtccctgttcggcgggaagccgatgatcatctataagggaggtacttcgagagaagggggccagactgcccccgcctccaccagactgttccaggtcagggccaactccgccggcgccactagagccgtcgaggtgctgcctaaggcaggtgctctgaattctaacgacgcctttgtgctgaaaaccccttctgctgcatacctgtgggtcggcaccggggcctcagaggcagaaaaaaccggcgcccaggaattactcagggtgctgagagcccagcctgtgcaggttgctgaagggagcgaaccagacggcttttgggaggcactgggtgggaaggcagcgtataggacatctcctcgactcaaggataagaaaatggatgctcaccctccaagactctttgcctgctcaaataagatcggacgctttgtcatcgaagaagtccctggtgagctcatgcaggaagatctggccaccgacgatgtcatgctcctggatacctgggatcaggtcttcgtgtgggtgggcaaggattctcaggaggaggaaaaaacagaggccctcacttctgcaaaaagatatatcgaaaccgacccagctaatcgagaccgcaggacgcccatcactgtagtgaaacagggattcgaacctcctagttttgtggggtggttcctggggtgggacgacgactattggtcagtggaccctttggaccgtgcaatggctgaattggccgcctag

SEQ ID NO: 118260 - DNA, 4527 bp, Artificial Sequence
  Description of Artificial Sequence: Synthetic coding sequence
atgggtcaggaacccagaacactgcctccttccccaaactggtattgcgctcggtgttcagacgctgtccctggtggtctttttggttttgccgccagaacatctgtctttctggtaagggtaggacccggagccggagagagcccgggaacacccccttttcgggtcataggagagctggtcggccatacggaaagggtcagcgggttcactttctcgcatcatcctggccaatacaacctctgtgcaacctccagtgacgacggaacggtcaaaatctgggacgttgagactaaaacagtcgtcacggaacacgccctgcatcagcacaccatttctacattacattggtctcctcgcgtgaaggatttaattgtttcaggcgatgagaaaggagtggttttttgctactggttcaacagaaatgactcacagcatctgttcatcgaaccccgaactatcttctgtctgacctgtagtccgcatcacgaggacctcgtggccatcggctataaagacggaattgttgtaatcatcgacatttctaagaagggcgaagtaatccacagattgaggggacacgatgacgaaattcattctatagcctggtgcccactgccgggggaagactgcctctccatcaatcaagaggaaacctccgaagaagcagagatcacaaacggtaacgctgtagcccaggcaccagttacaaagggatgttacctggcaacagggtccaaggaccagactatcagaatatggtcttgcagccgggggaggggtgttatgatactcaagctaccatttttaaaacgccgaggcggcggcatagaccccacagtgaaagagagactttggttgacactgcactggccttccaatcagcctacacaactggtgtcttcttgctttggcggagagctcctccagtgggacctcacacaaagctggcggaggaagtatactttattctctgcctcatctgaaggccagaaccactctagaattgttttcaatctgtgtccgttgcagaccgaagacgacaaacaactgctgttaagtacgtctatggatcgggacgtgaaatgctgggatattgccacccttgaatgttcctggacccttccatcccttggtggctttgcgtactccctcgccttcagtagtgtggacatcggttcactcgccatcggagtcggcgacggaatgataagggtctggaacactttatcaataaaaaataactacgatgtcaagaatttctggcaaggagtgaagtctaaagtgacggctctgtgctggcatccaacgaaggagggttgcctggcgttcggcaccgacgatggtaaagtaggtctatacgacacatattctaacaagcccccacagatcagctccacatatcacaagaagacggtgtatactctggcctggggtcctcccgtgccacctatgtcactcgggggggagggtgaccggcctagcctcgcactctatagctgcggcggggagggaatagtgctgcaacacaacccgtggaaactgagcggcgaggccttcgatattaataaattgatcagggatactaattcaataaagtacaagctgcccgtccataccgaaatttcctggaaagctgacggtaagattatggcactcggtaacgaggatgggagcatagagattttccagatccccaatctcaagctcatctgtaccattcagcaacatcataagctggtgaacactatctcctggcaccatgagcatgggtcccagccagagttatcttatttgatggcctccggctcaaataacgcggtgatctatgtgcataatctgaaaactgtgatcgagtcctcaccagaatctcccgtaacgatcacagagccctacagaaccctcagcggtcacactgctaaaataacatctgtagcttggtcgccccaccacgacggcagactggtgtctgcatcctatgatggtacagcacaggtctgggacgcattgagggaagagcccctgtgcaatttcagaggccatagaggaaggttattatgtgttgcttggtcacccttggaccctgattgtatctattcaggcgccgacgacttttgtgtacataaatggctgacctcgatgcaggaccatagccggcccccccaaggtaagaagtccatcgagctggaaaagaaacggctgtctcaacccaaggccaagcctaagaagaagaaaaagccaaccctgcggacgcctgttaagctggagtccattgatgggaacgaagaggagtccatgaaggaaaactctggacccgtggagaacggcgtgagcgaccaggagggagaggagcaggcacgggagccagagctcccttgtggcctggccccagcggtgtctagagaacctgtgatctgcacccccgtatcaagcggatttgagaaaagtaaggttaccatcaataacaaggtgattctcttgaagaaggaaccccccaaggaaaagcccgagactttaataaagaagcgcaaggcaagatcactgctgcctctaagcacctccctggaccataggagcaaagaagagctgcatcaggattgccttgtgctggctactgctaaacattccagagaacttaacgaggacgtttctgcggatgtggaggagcgcttccatctcgggctcttcactgatcgggccacactgtatcgcatgatcgacatcgagggaaagggccatcttgagaatggtcatcccgaactgttccaccagctcatgctgtggaagggcgacctgaaaggtgtcttgcagacggccgcggagagaggcgagttgaccgacaacctggtcgccatggcccctgctgctgggtatcatgtatggttatgggctgttgaagcattcgccaagcaattgtgcttccaggaccaatatgtaaaggcagcatcacacctgctgtcaatccacaaagtgtacgaagccgtagagctattaaaatcaaatcacttctacagggaagctattgcgatcgcaaaggcgagactgcgtccagaggatcctgtgctcaaggatttgtatctgagttggggaactgtgcttgaacgggatggacattacgcagtggcagcaaagtgttatctgggagcaacttgcgcttacgacgccgccaaggtgctggctaaaaaaggtgacgcagcctccctgcgaactgccgccgagctggctgcaattgtcggcgaagatgagctatctgcatcccttgccctgcgctgtgcacaagaattacttctggcaaataattgggtgggcgcccaagaagctctgcagttgcatgaatctttgcagggacaacggctcgtattttgcctccttgaactgctgtctagacacctcgaggagaagcagctgagcgagggcaagtctagctcatcttaccacacatggaatacaggtacagaagggcctttcgtcgagagagtgactgcagtttggaagtctatctttagtcttgacacccctgagcaatatcaagaagcttttcaaaagcttcagaacatcaaatacccaagtgccaccaacaacactccagccaaacagctcctgctccatatttgtcatgacctcacgctggcggtcctcagtcaacagatggcttcctgggacgaggccgtgcaagctctcctgagagctgtcgttcgcagctacgattcaggatcttttactatcatgcaggaagtatactcagcgtttctgcccgacggctgtgaccatctgcgagataagctgggtgatcaccagagccctgctaccccggccttcaagtcattagaggcattttttctgtacggaagattgtatgaattctggtggtccttgtctcgaccttgcccaaatagctctgtctgggtacgggccggacatagaaccctcagcgtggagccatcccagcagctggacaccgccagcacagaggagaccgatcctgaaacatcacaacctgaaccgaatagaccctctgagctggatctacggctcactgaagagggcgagaggatgctctctacattcaaggagctgttctctgaaaaacacgcgtcgttgcaaaactcccagcgcaccgtggccgaagtccaagaaacccttgccgagatgatccggcaacatcagaaatcgcagctgtgcaaaagtaccgctaatggaccggacaagaacgagcctgaggtggaagccgaacagccactgtgtagttctcaaagccagtgcaaagaggagaaaaacgaacctctgagccttccagagttgactaagcgtctaactgaggcaaatcaaagaatggccaagttcccagagagcattaaggcttggccatttcccgatgtcctggagtgctgtcttgtgcttctcctcatccggagccatttccctggttgtctggcccaggaaatgcagcaacaggctcaagagttacttcagaaatacggcaacactaagacgtataggcgacactgccagaccttctgcatgtag

SEQ ID NO: 118261 - DNA, 396 bp, Artificial Sequence
  Description of Artificial Sequence: Synthetic coding sequence
atgcaaacaccagtgaatataccagtcccggtacttagactgcccagagggcccgatgggttttcccgtggttttgccccagacggacggcgggcgcctctgaggcccgaggtgccagagatacaggagtgccctatcgcccaggaatccctcgagtcccaagaacaaagagctagggccgccttgcgcgagcgttacctcaggagcctgctggccatggtagggcaccaggtcagcttcacactccatgagggggtccgtgtagcagcccatttcggagcaacagaccttgacgtggctaacttctatgtgtcccagttgcagacgcccattggagtgcaggcagaagccttgctcaggtgttctgacattatatcctatacattcaaaccatag

SEQ ID NO: 118262 - DNA, 396 bp, Artificial Sequence
  Description of Artificial Sequence: Synthetic coding sequence
atgcaaacccctgtgaatattccggtgcccgtcctgagactgcccagggggcccgacggcttttctcgtggattcgctcccgatggcaggcgggcaccactccggcctgaagtgcctgagatacaagaatgtccaattgcgcaagaatcactcgagtcacaagagcagcgcgctcgcgcggccttgagggaacgctacctgagatccctgttggctatggtcggccatcaggtgtcatttactctacatgaaggtgtcagagtcgccgcacactttggcgcaactgaccttgacgtggctaatttctatgtatctcagttacagacaccgattggcgtgcaggctgaggcgctactgcggtgcagtgacatcatctcctacacattcaagccatag

SEQ ID NO: 118263 - DNA, 2913 bp, Artificial Sequence
  Description of Artificial Sequence: Synthetic coding sequence
atggacgccgcagaaccgggcctccccccaggacccgaaggcaggaaacgatactcggatatcttccgctctctggataacctggaaatttcattgggtaacgtgacccttgagatgctggcaggtgacccgctcctctcggaggacccagagcccgacaagactccaacggccaccgtgacaaatgaagcctcttgctggtctggaccatcccccgaaggccccgtgccattgaccggtgaagaactggacctgcgcctcatccgaaccaaagggggtgtcgacgcggccttagagtacgccaaaacttggtcccgatatgccaaggagctactggcatggacggagaagcgggcctcttacgagctcgaatttgccaaatcaacaatgaaaatcgccgaggcaggtaaagtgagcatacagcagcagtcgcacatgccacttcaatatatctacactctgtttctggagcacgacctcagcctaggcaccctggcgatggaaaccgtggcacagcagaaaagagactactatcagccactggctgcaaagaggaccgagatagaaaaatggcgcaaagaatttaaggagcagtggatgaaagagcagaagcggatgaacgaagcggtacaggccctgaggagggctcagttgcagtacgtccagcgctcagaggatctgagagcgcgcagccagggatcccccgaagatagtgctcctcaagcatcccctggtcccagcaagcagcaggaacgacgcaggcggtccagagaggaggcacaagccaaagctcaggaagcggaagccttgtaccaagcatgtgtaagggaagcaaacgctcgtcaacaggatctagaaattgctaagcagcggatcgtctcccacgtccgaaaactcgtgtttcagggagatgaagtgctgcggcgggttactttatcgctcttcgggctgcgcggcgctcaggccgagcgcggcccgcgggccttcgccgcactggctgaatgttgtgctccctttgaacctgggcaacgttatcaggaattcgtacgagcgctccggcctgaggcacctcctccaccgccccccgccttttcgtttcaggaatttctgccgagtctgaactccagtcctctggacattaggaagaaactctcaggacccctgcctcccagactggacgagaactcagccgagccgggtccttgggaggaccctgggactggctggagatggcaggggacacctggtccaactcctggtagcgacgtggactccgtgggcggaggctctgaatcacggtccttggattcccccacaagcagccccggagcaggcactaggcaattagttaaggctagctctacaggcactgaatctagcgacgacttcgaggaacgtgaccccgatttaggcgatggtctggagaacggattaggatcccctttcgggaagtggactctgtccagcgcagcacagacccaccagcttcgcagactacgaggtccagccaagtgccgcgaatgcgaggcttttatggtgtcaggaaccgagtgtgaggaatgttttctgacctgccacaaacgttgcttagagactcttcttattctgtgcggccatcggcggctgcctgcacgcactccactgtttggggtggacttcctccaactcccacgagactttccagaggaggttccctttgttgtgactaagtgtactgctgagatagagcatagagccctcgatgtacaaggcatttaccgcgtctccggctcacgcgtgcgggtggaacgcctgtgccaagcttttgagaacgggcgtgcgttggtggaactgtctgggaacagccctcatgatgtctcctcagtgctcaagagatttctacaggagctgaccgagcccgtgataccattccacctgtacgatgcattcatctcgttagctaagactttgcatgccgatcccggagatgatccgggcacgccctccccttcacctgaagtaatcaggagcctaaaaactttgcttgtccagttaccagattctaactacaacacactaaggcacctggtagcacatctgtttcgagtggccgcccggtttatggagaacaagatgtccgccaacaaccttggtattgtttttggcccaacgctactgcgtcctcctgatggacctcgcgcagcctcagccatccccgtgacctgcctcttagattcaggacaccaggcgcagctggtggaatttcttatcgtgcattacgaacagatatttggcatggacgaattacctcaagccaccgaacctcctccccaggactccagccctgcccctggccctctcacaaccagttctcagccaccccctccacatctcgacccggattcacaaccacctgtacttgcctctgatccggggccagaccctcaacaccactcgacactagagcagcatcccaccgcgaccccaaccgaaatacctacgccacagtctgatcaacgagaagatgtcgccgaggatactaaagacggagggggtgaggttagctcgcaaggcccagaggactctctcctgggcacacagagccgcggccactttagccgccagccagtgaaatatcctagggggggagtccgccccgtcacacaccagttgagtagcctcgcactcgttgccagcaagttgtgcgaagagacacctataaccagcgtcccaagaggaagtttaagaggccgggggccttcacccgctgcggcttctcccgagggttcacccctgaggcgcacgcccctgcccaagcattttgaaataacacaggaaaccgcccgactcctgtcaaagcttgactcggaggcagttccccgggccacttgttgtccagacgtgcagccagaagaggcggaggaccatctatag

SEQ ID NO: 118264 - DNA, 2826 bp, Artificial Sequence
  Description of Artificial Sequence: Synthetic coding sequence
atggacgccgcggagccgggtttaccccctggccctgaagggaggaagcggtatagtgacatctttcgctcccttgacaacctggagatatctctgggtaacgtgacattggagatgttagcaggcgaccccctgttatccgaggaccctgagccagataaaacccctacagccaccgtcaccaatgaggcttcatgttggtcgggcccgtctcctgaggggccagtaccgttaacaggggaggaactggacctccgcctcatccggacaaaagggggggttgacgcggccctggagtatgccaaaacctggagccgctacgccaaggagctactggcttggactgagaagcgcgcctcctacgagctagaatttgctaagtcaacaatgaaaattgccgaggctggcaaggtaagcatccagcaacaaagtcatatgccattgcaatatatctatactctgttcctggagcatgatctctcactaggcaccctcgctatggagacggttgcgcagcagaaaagagattattaccagccactcgccgcaaaaagaacggagattgaaaaatggcggaaggaatttaaggagcagtggatgaaggagcagaaacgtatgaacgaggccgtccaggcccttcggcgggcccagttgcaatacgtacagcggagtgaggacctgcgggcacgctctcagggcagtcccgaagacagtgcaccacaggcgtcaccgggaccaagcaagcagcaggaaagacgcagacgatcccgagaggaggcacaggctaaggcacaggaggctgaggcgctgtaccaggcttgtgtccgcgaggctaacgcccgccagcaggatttagagatagctaaacagcgcatcgtcagtcatgtgaggaagctggtttttcaaggcgacgaggttctgcgcagggtgactctcagcctattcggcctgcggggagcacaggctgagagaggcccgagagcatttgcggcactagctgagtgctgcgctccttttgagccgggccagcgctaccaggaattcgtccgcgccttgcgcccggaagcaccacctccgccccctcctgcttttagcttccaggagtttctcccatccttaaactcgtctcctcttgacatccggaagaaactgtcgggacctctgccaccaaggttggacgaaaattccgccgagccaggaccttgggaagatccgggcaccggatggaggtggcaaggtccgactccagggtccgatgtggatagcgtcggcggagggagcgagtctagatccctcgactcgccgacctcaagtcccgatctgggggacgggctcgaaaacggacttgggagtccgtttgggaagtggactttaagttccgccgcgcagacacaccagctgcgtcgtctgcgtgggcctgccaagtgtagggagtgtgaggcttttatggtctcggggacagagtgcgaagaatgctttttaacttgtcataaacgttgtcttgaaacacttttgatcctgtgcgggcatcgtcgactgcctgctaggacgccactattcggagtggacttcctgcagttgccaagagactttccagaagaagtaccctttgtagtgacaaagtgcaccgccgagatcgagcatcgtgccctggacgtgcagggtatttaccgggtgagcggttcaagagtgcgggtggagcgcctgtgtcaggcatttgaaaacggccgggctctggtcgaactgtcaggaaatagccctcatgatgtgtctagcgtactcaaaaggttcttgcaggagctcaccgagccagtgatcccatttcacctgtacgacgccttcatctccttggctaaaactctacacgccgaccctggcgacgaccccgggacgccctcaccctcaccggaagtgattaggtctctgaagactctgctggttcagctgcccgatagcaattacaacacattgagacacctggtggcccacttgttccgggtggctgcgcgtttcatggaaaacaagatgtcggccaacaatctcggtattgtgtttggccctactctgttgcgtccacctgatggtcctagggctgccagcgctatcccagtcacttgcctgctggacagcggccaccaagcccagctggtggagtttctcatcgtgcattatgagcagatctttggcatggacgaactacctcaggccacagaacctcccccgcaggacagcagtcctgctcccggtccattgactacatcctcacaaccacctcctcctcacctagacccagactcccagccacccgttctggccagtgaccctggccccgatccacagcatcactccacgctggaacagcacccaacggccacccctaccgaaattccaacgccacagagcgaccaacgcgaggacgtggctgaggacacgaaagacggaggcggggaggtaagctcccagggaccggaggacagtctcctggggactcagagccgtggccatttttctcgtcaacctgtgaaataccctcgaggaggtgtgcgacctgtaacgcaccagctttccagtctggccttagtcgcctccaaactgtgcgaagaaactcctatcacgagcgtaccacgggggtccctcagaggccggggcccatccccagccgcagccagccccgaggggtccccattgcggagaacgccactgcccaagcacttcgagattacccaagagactgcccggctcctctccaaactggacagtgaggcagtccctcgagcaacctgctgccctgatgttcagccggaagaagcagaagatcacctgtag

SEQ ID NO: 118265 - DNA, 1005 bp, Artificial Sequence
  Description of Artificial Sequence: Synthetic coding sequence
atgaatactatcctgccatgccaggaccaatacttcgtgggcggacaatcttacaattgtccttactccacgactaccagcgagagctccgttgatgtgtctacagagacttgggtgtcattttgggcagccgggttgctggataatcgtgaactccagcaggcaccgcaggcccaggagtcttttagtgatagcaatttcccactccctgatctgtgcagctgggaagaagcgcagctgtcgtcgcaactctacaggaacaagcaactccaggacaccctcgttcagaaagaggaggaactcgcgcgactgcacgaagagaacaaccacctacgccagtaccttaatagcgctctggtaaagtgcctggaggagaaagccaagaagttgctttcttccgacgaattcagcaaagcttacggcaagtttcgaaagggaaaacgaaagtcgaaagagcagcgctactcccctgccgaaatcccccatcctaaaaacgctaagagaaacctctctagcgaattcgcgaactgtgaggagcaggccggccctcccgtggacccatgggttctccagacactcggcctaaaagacctggacacaatcgacgacactagctccgcaaactatagtgccctcgcgtctcaccctcgccgggtggcaagcacatttagccagttcccagacgatgccgtggactataagaatatccccagagaggatatgcccatcgactacaggggagatcggactacacccctccactcgacagcaacccatggcgaagatttccacattctgtcccaacttagcaatcctcccgtgggcctcaagactttgccctactacacagcccatgtcagccccaataagaccgagatggccttctcgaccagcttgagcccacactgtaacgtgaagactcattctttccaccaggggcaggcattcgttaggagagacgaggaaggtgggtggaaattcacctgggtgcccaagcagagctag

SEQ ID NO: 118266 - DNA, 2727 bp, Artificial Sequence
  Description of Artificial Sequence: Synthetic coding sequence
atgggcgtcaacgacctgtggcagatccttgagcccgtgaaacagcatattcctttgagaaatctgggtggcaagactatcgctgtggatctctctttatgggtatgtgaggcacaaactgtgaaaaagatgatggggtcagtgatgaagccacacctgagaaacctcttctttcgcattagctatttaacacaaatggacgtgaagttagtgttcgtgatggagggtgagcctcccaaattaaaagcagatgtcatcagtaaaaggaaccagtctagatacggaagtagcggaaaatcgtggtctcagaagaccggcagaagccactttaaaagtgtcttgcgtgaatgtcttcacatgctggaatgcctgggcatcccatgggtgcaggcggcgggtgaagccgaagctatgtgtgcttaccttaacgccggaggccacgtagatggctgtttgactaacgatggcgataccttcctctacggagcccagaccgtctatagaaatttcactatgaataccaaagatcctcacgtcgattgctatactatgtcgtcaattaagtccaaattaggactggaccgcgacgctttagtgggattggccattcttcttggatgtgactacctgcctaaaggcgttcctggggtcggcaaagagcaagcactgaagctgattcagattctgaaaggtcaaagcttgctccagagattcaacagatggaacgagactagctgcaactcgtctccccagcttctggtcaccaaaaagctggcgcactgcagcgtgtgctcgcatcctggctcccccaaggatcatgaacgcaatggctgtaggctgtgcaagtctgataaatactgcgagccccatgactacgagtattgttgcccttgtgaatggcaccgaacggagcatgatcgccagctttccgaggtggagaataacatcaagaagaaggcctgttgttgtgagggctttccatttcacgaggtgattcaggaatttcttttaaataaggacaaactcgttaaggtgattagataccagcgtcccgatctgctgctatttcagcggttcacactggagaagatggagtggcccaaccactacgcttgcgaaaagctcttggtgctactgacccactacgacatgattgaacgaaagctgggcagccggaatagcaatcagttgcagcccatccggatcgtcaaaaccaggattagaaatggggtccattgctttgaaatcgaatgggaaaaacctgagcactacgcaatggaggataagcagcatggagagtttgctcttctgacgatcgaagaggagtctcttttcgaagcagcctatcctgagatcgtggctgtgtatcaaaagcagaagttagagattaaggggaaaaaacagaaacggatcaagcctaaggaaaataaccttcccgagcctgacgaagtgatgtcatttcagtcccatatgacattaaaaccaacttgtgaaatttttcacaaacagaactcaaagttgaatagtggcatctccccggatcccactctgcctcaggagtccatctctgcaagcttgaattcgctgttgctgcccaaaaatactccctgcctgaacgcccaggaacagtttatgagcagccttcggccgcttgctatccagcagattaaagccgtgtctaagtccctgatatcagagtctagccagcctaatacctcttcccacaatattagtgtcattgctgacttgcatctttctacaatcgactgggaaggcacgtctttctctaactcccccgcgattcagagaaacacgttttcgcacgatctgaaaagcgaagtagagtccgagctgagtgccattccagacgggttcgagaacattcccgaacagttgtcctgcgaaagtgaacggtacactgctaacataaagaaggtcttggacgaggacagcgatggcatctcccccgaagagcatctgctgagcggcatcacagacctgtgcttgcaagatctgccactgaaggagcggattttcaccaagctgtcatatcctcaggataacctacagcccgatgttaacctgaagactttaagtattctcagtgttaaggaaagctgcatagctaatagcggctctgactgtacctcgcacctgtcaaaagatttgccaggaattcccctccaaaacgagtctcgggactccaaaatcctgaagggtgatcagctgcttcaggaggattataaggtcaacacttcagtgccatactccgtgagcaataccgtggtaaaaacttgcaatgtgcgtccccctaacacagcgctggatcacagccgcaaggtcgatatgcagacgactcgtaaaatccttatgaagaagtccgtgtgcctggaccggcactcatctgatgagcagtctgcccccgtctttggtaaggccaagtacaccacgcagaggatgaagcatagttcacagaaacataacagctcccacttcaaggagtccggccataacaaactatctagtccaaagattcacatcaaggaaactgagcaatgcgttcggtcctacgagactgccgagaacgaggagtcctgcttccccgacagtacaaagagttctctgtcttctctgcaatgccataagaaggaaaataatagcggtacctgcctggacagccccttgcctttacgccagcgcctgaagctgcgcttccagagcacctag

SEQ ID NO: 118267 - DNA, 2727 bp, Artificial Sequence
  Description of Artificial Sequence: Synthetic coding sequence
atgggggtgaacgacctgtggcagattttggagccagtgaagcagcacatcccgttaagaaatttgggaggaaaaacaatcgcagtggacctgtccttgtgggtgtgtgaggctcagaccgtaaagaaaatgatgggctctgtcatgaagccgcacctgagaaatctattcttccggatctcatacttgacacagatggacgttaaactggtatttgtcatggaaggagaacctccgaagctcaaggccgatgtgatttctaaacgcaatcagtctaggtacgggagttcaggtaaaagctggtctcaaaaaacgggacgctctcattttaagtctgtgcttagagaatgcctgcatatgttggagtgtctggggatcccatgggtgcaagccgccggtgaagcagaggccatgtgtgcttatctaaatgctggcggccatgtggatggctgccttaccaacgacggcgatacattcctttatggcgctcagacagtttacaggaactttactatgaatacaaaagatcctcatgttgactgttatactatgtcaagcatcaagtccaaactcggcctagacagggatgcactggtcgggcttgctatcctcctaggctgcgactatcttcctaagggagtgcctggggtgggcaaggagcaagccctgaagttgattcaaatcctgaaagggcagtctctgttacagcgatttaacagatggaacgagactagctgcaacagctcaccgcaactgttggtgactaagaaactcgctcattgttctgtttgctcacacccagggtcccccaaggatcacgagcgcaatggatgtcggctgtgcaagtcagacaagtattgcgagccccatgattatgagtactgttgtccctgtgagtggcatcggactgagcacgaccgccagctgagcgaggtggaaaataatataaaaaaaaaagcctgctgttgtgaaggattcccctttcatgaagtcatacaagagtttcttctaaacaaggataagttggtgaaagttattcgttaccaaagaccagacctgttactgttccagcgatttaccctggagaaaatggagtggcccaaccactacgcctgtgagaagttgttggtcctgttaacccactacgatatgatagaacgaaaactcggtagccgtaactcaaatcaactgcagccaatccggatcgttaagacccgaattcgaaacggagtacattgtttcgagatcgagtgggaaaaacctgagcactatgctatggaggacaaacagcacggggaatttgcgctactgactattgaggaggagtccctgttcgaggccgcctatcccgaaatcgtggcagtctaccaaaaacagaagctggagatcaagggcaagaaacagaagaggatcaagccaaaggaaaacaatctgccagagcctgatgaggtcatgtcgttccagagccatatgaccctgaagccaacttgtgaaatattccataaacagaattcaaagctgaactcgggaatctcccccgacccaaccctaccccaggagtcaatatccgcgtcactcaacagcctgctcctgccgaagaatactccttgcttgaacgcccaggagcaattcatgtcaagtctcaggccccttgctatccagcagatcaaagcagtcagcaagtccctgataagcgaaagttcgcagcccaacacaagcagtcacaatatcagcgttatcgccgatctccatttgtctacaattgactgggaaggcaccagcttctccaatagtcccgccatccaaagaaatacattctctcatgatcttaaatctgaggtcgagtctgagctcagtgcaattcccgacggattcgagaatatccctgagcaactatcttgcgagtccgagaggtacacagctaacattaagaaggttttagacgaagattctgacggcatcagccctgaggagcacctgctctctggcatcacagatctgtgccttcaagacctcccgctgaaggaaagaatctttacgaaactttcctacccacaggataacctccagcccgacgtgaatctcaaaactctgtccatcctctcagtaaaggagtcatgcatcgccaacagtggatcagactgtaccagtcacttgtcaaaagatttaccaggcataccgctgcaaaacgaaagccgcgattccaaaattctcaagggcgatcagctgctgcaagaagactataaggtgaatacatcagtgccatattccgtgtccaacacagtagtcaaaacatgtaatgttcgccccccgaatacagcccttgatcatagtcgtaaggtcgatatgcagactacgagaaaaatccttatgaaaaagtcagtgtgtttagatagacacagctcggacgagcagtccgcacctgtgttcggcaaggcgaagtatactacccaacggatgaagcactctagtcaaaaacataatagctctcatttcaaggaatctggtcataacaaactatcctctcccaaaattcacattaaagaaacggaacagtgtgttcgttcttatgaaaccgctgagaatgaggagagctgtttcccagactcaacgaaatcgagcctgagctcgctacagtgccataaaaaagagaacaacagcggcacgtgcttggattcccctctccccctgagacagagacttaaattacgcttccagtcaacttag

SEQ ID NO: 118268 - DNA, 381 bp, Artificial Sequence
  Description of Artificial Sequence: Synthetic coding sequence
atgggcgtgaacgatttatggcaaatcctggaacccgttaagcaacatatccccctccgcaacctaggcggcaaaaccattgcggtcgatcttagcctgtgggtgtgcgaagcacagactgtaaagaagatgatgggaagcgtaatgaaaccgcatttgaggaatcttttttttcggatttcgtatttgactcaaatggacgttaaactcgtgttcgtaatggagggagagcccccaaaactgaaagctgacgtcatctctaaaaggaatcaatcccgatacggatcaagcggcaaaagttggtcacaaaaaactgggcggtctcattttaaatcggtgttgagggagtgcctccatatgctcgagtgtctgggaatctag

SEQ ID NO: 118269 - DNA, 282 bp, Artificial Sequence
  Description of Artificial Sequence: Synthetic coding sequence
atgggggtcaatgacctttggcagatacttgaacccgtaaagcagcacattccccttcgcaatctcgggggtaaaaccattgccgtcgacctatctttgtgggtgtgcgaggctcagactgtgaagaagatgatgggttccgtgatgaaaccgcatttgaggaacttgttcttccgaatcagttacctgactcagatggatgtaaagctggtctttgtgatggagggagagccacctaagttgaaggccgatgtcatttctaagcgcaaccagtccagatag

SEQ ID NO: 118270 - DNA, 1431 bp, Artificial Sequence
  Description of Artificial Sequence: Synthetic coding sequence
atggagtggcctaatcattacgcatgtgaaaaactccttgtgctgctgacccactacgacatgatcgaacgaaagctcggcagccgtaactccaatcagctgcagccgatcagaattgttaaaactcggatccgaaacggcgtgcactgcttcgagatagaatgggagaaaccagagcactatgccatggaagacaaacagcacggagaatttgccctccttaccatcgaggaggagtctctttttgaggccgcgtaccctgaaatcgtagccgtgtaccagaagcagaagcttgaaattaagggtaaaaaacaaaagagaataaaacccaaggaaaacaacttaccagaaccagacgaggtgatgtcgttccaatcccacatgacactcaaaccaacatgtgaaatctttcacaaacagaacagcaagctcaattccggcatatctccagatcctaccctgccacaggaatccatttctgccagcttgaattcgcttctgcttccaaagaacactccctgcctaaacgcacaggaacagttcatgtcatcacttcgtcctctcgctatacagcaaattaaagccgtgtctaaatccttgatcagcgaaagttcccaaccgaatacatctagccacaatattagcgttatcgccgaccttcatctttcgactatcgattgggaaggcacatcgttcagtaattctccggcaatccagaggaatacattcagtcacgatctaaagagcgaggttgagagtgagctgtccgcgattcctgacggcttcgaaaacatcccagaacagctgtcctgtgaatccgaacgctacaccgcaaacattaagaaagtgttggacgaagattccgatggaatctctcccgaagagcacttattgagtggtatcaccgacttgtgtttgcaggacctgcccttaaaagagcggattttcactaaattatcgtaccctcaagataatctccagccagatgttaacctaaaaacgctgagcattctaagtgtaaaggagtcgtgtatcgccaacagtggaagtgactgcacttcccacctgtcaaaggacctcccaggtatcccgctgcagaatgagtcaagggacagcaaaatccttaagggggatcaattactgcaggaggattacaaggttaatacatcagtcccttactcagtttcaaacaccgtcgtaaagacttgtaacgtcaggcccccaaacacagcccttgatcactctcggaaagtggatatgcagacgaccaggaaaattctaatgaaaaagagtgtgtgtcttgataggcattccagtgatgaacagagcgcacctgtgttcggcaaagcaaaatacacgacacagagaatgaaacactctagccaaaaacacaattcaagccacttcaaagaatcagggcataacgaatag

SEQ ID NO: 118271 - DNA, 1437 bp, Artificial Sequence
  Description of Artificial Sequence: Synthetic coding sequence
atggcatgcttaaatcccgttcccaaattgtacaggagtgttattgaagatgtgatcgaaggggtaagaaacctgttcgccgaggagggaattgaggagcaggtgttaaaggacctgaaacagctatgggaaaccaaggtcctgcagtccaaggccaccgaggacttttttcgcaacagtatacagtcaccattgtttaccctccaacttccccactctctccatcagacccttcagagctccacggcttccctagtgatccccgcggggcgcacactcccaagctttaccactgctgagctcggcaccagcaattccagtgcaaatttcacattcccgggctatccaatccatgtaccagctggcgtcacactccagacagtgagcggccacttatacaaggtaaatgttcctatcatggtaaccgaaacaagcggccgcgccgggatactccaacatccaatccagcaagtcttccagcagctgggtcagccatcagtgattcagaccagcgtgccgcagctgaacccttggagccttcaggccaccaccgaaaagagccagcggatagaaaccgttctccagcagcctgccatccttcctagcggacccgtggatcggaagcatctcgagaatgccacatccgacatcctggtcagtccaggaaatgaacataagattgtccctgaagcgctactctgccaccaagagtcttcccattacattagtctgcctggggtcgtattctccccccaagtgagccaaactaactctaatgtggagtcggtactaagcggctccgcctccatggctcagaacctccacgacgagtctttgagcacctcgccacacggggccctccaccaacacgttacagatattcagctccacattctgaagaataggatgtatggctgtgactctgtgaaacagcctcgcaatattgaagagccttctaatattccagtctcagagaaagactcaaactcccaggtggatcttagtatacgggtaaccgacgatgacattggcgaaattatccaggtcgatggcagcggtgacactagctctaatgaagaaatcgggtccacaagagacgccgatgagaatgaatttttgggaaatatcgacggcggcgatctcaaagtgccagaggaagaagccgatagcattagcaatgaagattctgctaccaactcatccgataacgaagaccctcaagtgaacatcgtggaagaggacccactgaacagcggggacgatgtaagtgaacaggacgtgcctgacctctttgatacggacaatgtgattgtatgccagtatgataagatccacaggtccaagaataagtggaagttctacctcaaggatggagtgatgtgtttcggcgggcgagactacgtctttgccaaggccatcggcgacgccgaatggtag

SEQ ID NO: 118272 - DNA, 1335 bp, Artificial Sequence
  Description of Artificial Sequence: Synthetic coding sequence
atggcttgcctaaatccggttctgtgggaaacgaaagttctccagtctaaagcaacagaagacttttttcggaactccattcagagcccccttttcacgctgcagctccctcactctcttcaccagactctgcagagcagtacggcctcgctcgtgataccggcaggcagaacattgccttcctttactactgcagaactcgggacctcaaatagtagtgccaatttcaccttcccaggctatccaattcatgtgccagccggtgttacactgcagacagtcagcggccatctatataaggtcaatgtgcctataatggtgactgaaacctccggccgggcaggcatacttcagcacccgattcagcaggttttccagcagctggggcagccaagcgtgatccagacgagcgtccctcagctcaatccgtggtcattgcaggcgactactgaaaagtcacaacggatagagaccgtgttgcagcagccggcgatccttccatccggacctgtggaccggaaacacctagaaaacgctaccagtgatatcctggtatcgcctggcaatgagcacaaaatcgtgcccgaggccctgctctgccatcaggagagctcccactatatctccttgccgggagttgtcttctctcctcaggtgagtcaaacaaactctaacgttgaaagcgtgcttagcggatccgcgagcatggcccaaaacttgcatgatgaatctctctcaacctccccacacggcgcccttcatcaacatgtgaccgacattcagcttcatattttgaaaaaccgtatgtatgggtgtgactcagtcaaacagcccagaaacattgaggagcctagtaacatacccgttagtgaaaaggactctaactcacaagtggatctgtcaataagggtaacagacgacgacatcggggaaattattcaggtggacggcagcggagatacctcatccaatgaagaaataggcagcactcgggatgccgatgaaaatgaattcctcggcaatatcgatgggggggatctgaaagtgcctgaggaagaagctgatagtatttcgaatgaagattctgccacaaacagtagcgataacgaggatccccaggtgaacattgtcgaggaagatcccttgaactcaggggacgatgtttctgagcaggatgtccccgatctcttcgacactgataatgttatcgtgtgccagtacgataaaatccacaggagtaagaacaaatggaagttttacctgaaggacggggttatgtgtttcggtggaagagattatgtctttgccaaggcaattggtgacgctgaatggtag

SEQ ID NO: 118273 - DNA, 951 bp, Artificial Sequence
  Description of Artificial Sequence: Synthetic coding sequence
atggcaagtacatcccgcctcgacgcccttcccagggtgacctgtccaaaccatcccgacgctatcctggtggaggactaccgggcaggagatatgatatgtccagagtgcgggctcgtggtgggagacagagtgattgatgttgggtctgaatggaggaccttttccaacgacaaagctacaaaggatccttcaagggtcggggactcacagaatccgctcctttcagatggcgatttgtccacaatgataggcaaaggaacgggtgcggcttctttcgatgagtttggtaattccaagtatcaaaatcgacggaccatgtcttcctctgatagggcaatgatgaatgccttcaaagaaatcacaaccatggctgacaggataaacctccctcgaaatatcgtcgaccgtacaaataacctgttcaagcaagtttacgagcagaagtcccttaagggccgggccaacgatgcaattgcctctgcctgcctgtacatcgcatgtcggcaggagggtgtgcctagaaccttcaaagaaatctgcgccgttagtcggataagtaaaaaggaaatagggcggtgcttcaagctcatacttaaggcactagaaactagcgtggacctgattactaccggggacttcatgtcgagattttgtagcaacctctgtctgccaaagcaagtccaaatggctgccacgcatatcgctcggaaggccgtcgagttggatctggtgcctggacgttcacccatatcagttgctgcggcagctatctatatggcttcccaggccagcgccgagaaaaggacacagaaagagatcggtgacatcgccggggtcgcagatgtgactattcgccagagctaccggctcatttatccacgcgctccggacctctttccaactgacttcaaatttgatacacctgtcgataaattacctcaactgtag

SEQ ID NO: 118274 - DNA, 696 bp, Artificial Sequence
  Description of Artificial Sequence: Synthetic coding sequence
atggccagtacctctcgccttgatgctctgccccgcgtgacctgtcctaaccaccctgacgccatcctcgttgaagactatagagcaggagatatgatctgcccagagtgtgatagggtgatcgacgtggggtccgaatggcggactttttctaatgataaagcaacgaaggacccaagcagggtgggggatagccagaatcccctgctgtccgatggagacctctcgacgatgatagggaagggcacgggcgcagctagtttcgatgagtttggcaactcgaagtatcagaacaggagaactatgtcaagctcagaccgggccatgatgaatgcctttaaggaaattacaaccatggctgatcgaatcaatctaccgaggaacatcgtcgatcggacaaataacctgttcaagcaggtgtacgagcagaaatctttgaaagggagggcaaatgacgctatcgccagcgcctgcctgtacatcgcctgcaggcaggaaggcgtccctcgaactttcaaagagatttgtgccgtgtcccgcatatccaagaaggagatcgggaggtgctttaagctcattctgaaagctttagagacttcagttgacctcatcacaactggggacttcatgagtagattctgttcaaatctgtgcctgcccaagcaggtgcagatggctgcaactcacatcgcctag

SEQ ID NO: 118275 - DNA, 675 bp, Artificial Sequence
  Description of Artificial Sequence: Synthetic coding sequence
gcctccacatccagactcgacgccctgcctagagttacctgtcctaatcatcctgatgctatcctcgtggaagattacagggctggcgatatgatatgccccgagtgtggactagtagttggtgatagggtgatcgacgtgggatcagagtggagaaccttttcaaacgataaggccacaaaggacccatcacgggtgggcgattcccaaaaccctctgctcagcgacggagatcttagtacgatgatcggaaaaggcaccggtgccgcgtctttcgacgagtttggcaatagcaagtatcagaaccggagaactatgtcttcatctgaccgggccatgatgaacgcattcaaagagatcacaaccatggccgacagaatcaatctgccgcgaaacatagtcgataggacaaataacctgttcaaacaggtttatgagcagaagagcttaaaagggagggctaatgacgctattgctagcgcctgcctgtatatagcctgccgccaggaaggggtacctcggacattcaaggagatctgcgctgtcagtcggatttcaaaaaaggagattggaaggtgctttaagctgatcctgaaggccttagagacctcggtcgatttgatcactaccggcgatttcatgtcacggaactggcggtactgctggtgttgctag

SEQ ID NO: 118276 - DNA, 876 bp, Artificial Sequence
  Description of Artificial Sequence: Synthetic coding sequence
atggacccatctcttttgagggagcgagagctgttcaagaaacgggcgctctcaacacctgtcgtggagaagaggtcagcctcctctgagagtagtagttcttccagcaaaaaaaaaaagacaaaggtcgagcatgggggcagtagcggctctaaacagaactcagaccacagtaacgggagtttcaacctgaaggctctcagcggtagctccggatacaaattcggcgttctggcgaaaattgtgaactatatgaaaacacggcatcagcgaggagatacacacccgctgactctagatgagatcctggatgaaacccagcatttggatattggcttgaagcaaaagcagtggctgatgactgaagccctagttaacaatcccaaaatcgaggtgattgatggaaaatacgcgtttaaacctaaatacaatgttagggacaagaaagcactcctgcggctgctggatcaacatgaccaacgtggtttggggggaattctcctggaagatatcgaggaagcactgccgaatagtcagaaggcggtgaaggccctcggagaccagatcttgtttgtcaatcgccccgacaagaaaaaaattctgttctttaacgacaagtcgtgccagttcagcgtcgatgaggagttccagaaactgtggcgctctgttaccgtggattccatggacgaggaaaaaatcgaggagtatttgaaacgccagggcatctcctctatgcaggagtctggaccaaagaaggtagcacccatacagcgccggaaaaagcccgcatctcagaagaagcggagattcaagacacacaatgagcacttggctggcgtgttgaaggattactcggatatcacatcctccaagtag

SEQ ID NO: 118277 - DNA, 381 bp, Artificial Sequence
  Description of Artificial Sequence: Synthetic coding sequence
atggacccttccctgctgcgggagcgggaattatttaagaagcgtgcactgtcaacccccgtggtagaaaaaagaagcgcttccagcgagtcctcctcctcgtcttccaagaaaaaaaagactaaagtcgaacatggcggctccagcggatcaaaacagaattctgaccattcaaatggcagtttcaacctcaaagctttatccggctcatctggctacaagtttggtgttctggcaaagatcgttaattatatgaaaacacggcatcagcgcggtgatacccaccccctgactttggatgaaatcctcgacgagacacaacatctggacatcggtttgaaacagaaacagtggttgatgacagaggcactcgtgaactag

SEQ ID NO: 118278 - DNA, 597 bp, Artificial Sequence
  Description of Artificial Sequence: Synthetic coding sequence
atggaccctagcctgctgcgggaaagggaactcttcaaaaaaagggccctgtccacaccggtcgttgagaagcggagtgcaagttctgagtccagttcttcatccagcaagaaaaaaaagaccaaagtcgagcacggggggtcttccggaagtaaacagaatagcgaccactcaaatgggtcctttaacctgaaagccctgagcgggtccagcggctataagttcggcgtgctggccaagatagtcaactacatgaagaccaggcaccagagaggagacacccaccctttaacactcgacgaaatcctagacgagactcagcatctagacatcggcctaaagcaaaagcagtggctaatgacggaggccctcgtgaacaaccctaagatcgaggtgattgacggcaagtacgccttcaaacctaagtacaacgtgcgcgataaaaaggctctgcttaggcttttagaccagcacgatcagagaggactgggaggaatactgttggaggatatcgaggaagccctgcccaattctcagaaagccgtgaaggccctaggtgatcagatactgttcgtcaatcggcccgataagaaatag

SEQ ID NO: 118279 - DNA, 1554 bp, Artificial Sequence
  Description of Artificial Sequence: Synthetic coding sequence
atggccgccctggggccttccagccaaaacgtgacagagtacgtggtacgagtgcctaagaatacaaccaagaagtacaatatcatggccttcaacgcggctgacaaggtgaatttcgccacatggaatcaagcgaggcttgaaagggatctgagcaacaagaaaatctatcaagaagaagaaatgccggagagcggcgccggatcggagtttaacaggaaactgcgggaagaggccagacgcaaaaagtatggaatagtgctcaaagaatttaggcccgaggatcaaccctggctgctcagggtcaatgggaagtcgggccgaaagtttaagggcattaagaagggcggcgtcaccgaaaacactagctattacatctttactcagtgccctgatggggccttcgaagctttccccgtgcacaactggtacaacttcacgcctttggcgagacatcggaccctgaccgcagaggaagcagaagaggaatgggagagaagaaataaagtcctgaaccatttctccattatgcagcagcggcgcctgaaagatcaagaccaggatgaagacgaggaagaaaaggaaaagcggggacggaggaaagctagtgaactgagaatccatgatctcgaagacgatctggaaatgtcttctgatgctagcgatgcatcaggagaagaaggaggacgggtacctaaagccaaaaagaaggcccctttggccaaaggcggacgaaaaaagaagaagaagaaggggtcagacgacgaggcatttgaagacagcgacgatggcgatttcgaaggtcaagaggtagactacatgtccgatggctcatctagcagccaggaggaacctgaatctaaagccaaggctccgcagcaggaagagggccctaaaggcgtggatgagcagtctgatagtagcgaggagagtgaagaggagaagcctccagaagaagacaaggaagaggaagaagagaagaaagcccccacacctcaagagaaaaaaagacgtaaagattcctcagaagaatccgacagcagtgaagagtcagacatcgactccgaagcaagctcagcactgttcatggccaaaaagaagaccccacctaagcgggagcgtaaaccctccggcgggtcatctcgggggaatagcaggccggggactccctcggcggaaggcggttccaccagtagcaccctgcgggctgccgcctctaagctagagcagggcaaacgggtttcagaaatgccagcagccaagcggctccggctggatactggaccccagtcattatcggggaaatccacacctcagcccccctctggaaaaactaccccaaattctggagatgttcaagtaactgaggacgcggttagaaggtatctgactcgtaaacccatgacgacgaaggacctgctaaagaaattccaaactaagaaaacgggcctgtcaagcgagcagactgtgaatgtactggcacagattttgaagcggttgaatccagaaagaaagatgattaatgacaaaatgcatttcagtctgaaagagtag

SEQ ID NO: 118280 - DNA, 1299 bp, Artificial Sequence
  Description of Artificial Sequence: Synthetic coding sequence
atggccttcaatgccgcagacaaagtaaacttcgctacttggaatcaggccagactcgaaagagacctttcaaataaaaaaatataccaggaggaggagatgccggaatctggcgctggcagtgaatttaatagaaagctgagggaggaggcccggcggaagaaatatggcattgtcctgaaggagtttagacctgaggaccagccatggctgcttcgggtgaatggtaagtctggacgcaagcgaaacaaggtgctgaatcacttctcaattatgcagcagaggagactcaaagaccaggaccaggatgaagatgaagaagaaaaagaaaagcgcggacggagaaaagcgagcgaactacgcatacacgaccttgaagacgacttggaaatgtcctctgacgccagcgatgctagtggggaagagggcggacgggttccaaaggcgaaaaagaaagccccactagctaaagggggacgaaagaaaaaaaagaagaaaggttctgacgatgaagcgttcgaggacagcgacgacggtgatttcgaaggtcaagaggtggattacatgagcgatggctcatctagcagtcaggaggagcccgagagcaaggccaaggcaccacagcaggaggagggaccaaaaggcgtggacgagcagtctgattcttctgaagaaagcgaggaggagaagcccccagaagaggacaaggaggaggaggaagagaaaaaggcccccactccgcaagagaagaagagacggaaggattcttccgaagaaagtgacagttccgaggaatccgacattgatagcgaggcaagctctgcactgtttatggctaagaagaagacaccacctaagagagagcgaaagccgtctggcgggtcctcaaggggaaactcacggcccggaactccaagcgccgagggggggtccaccagctccactctgcgagcagcagcctctaagcttgagcaagggaaaagagtgtcagagatgcccgccgctaaaaggctccgccttgatacggggcctcagtccctatcgggcaaaagcacgcctcagccaccttcaggaaagacaacacctaacagtggggatgtgcaggtcacagaggacgcagtgcgacggtacttgaccaggaaacctatgaccaccaaagaccttctaaagaaattccagaccaaaaagaccgggctcagctcagaacagactgttaacgttctggcccagatactgaagaggctgaacccagagagaaagatgattaatgataagatgcatttttcattgaaggaatag

SEQ ID NO: 118281 - DNA, 384 bp, Artificial Sequence
  Description of Artificial Sequence: Synthetic coding sequence
atggcagccctaggtccttcatctcagaatgtgactgagtacgtggttagagtacccaaaaacactacaaaaaagtacaacatcatggccttcaacgccgccgataaagtcaacttcgcaacatggaatcaggcgcggctcgagcgcgatctaagcaataagaaaatctatcaggaagaagagatgcctgaaagtggagctggctcagagttcaacaggaaactgagagaagaagcaaggcggaagaaatacggaattgtcttgaaggagttccgtcctgaggatcaaccctggctgctacgggtgaatggcaagtcaggcaggaagttcaaagggattaagaaggggggggttactgagaacaccagctactatatcttctag

SEQ ID NO: 118282 - DNA, 1647 bp, Artificial Sequence
  Description of Artificial Sequence: Synthetic coding sequence
atggcaacatcgtctgaggaggtgctgctgatagtcaaaaaagtccgccagaagaagcaggacggggctctgtacttaatggcggagcggatagcgtgggccccagaaggtaaagataggtttactatctcacacatgtatgccgatatcaagtgtcaaaagatctctccagaaggcaaggcaaaaattcaactgcagcttgtgctgcacgctggcgacacaacaaacttccatttttcaaatgaatcaacagcagtgaaggagcgcgatgctgtcaaggacctgctgcagcaacttctgcccaagtttaaaagaaaggctaataaggagctcgaagagaagaatcgaatgttacaagaggatcccgttctattccagctatacaaggacttggtcgtttcccaggtcatctctgccgaggagttctgggcaaaccgactcaatgttaacgctactgactcttcctccactagtaaccataagcaggatgtgggtatctctgccgcgttcttggctgatgtgcgacctcagaccgatggatgtaatggcctcagatataacttgacctctgatattatcgaatccatttttagaacctaccctgctgttaaaatgaaatacgccgagaatgttccccataacatgactgagaaggagttttggactaggttttttcagagtcattattttcacagagaccgcttgaatacaggttccaaggatctcttcgcagaatgtgctaagatcgacgagaaaggccttaagactatggtctcgctgggcgtcaaaaatccgttgctagatctgaccgccttagaggacaagcccctcgatgaaggatatggaatctcctctgtgccgagtgctagcaactctaagtcaatcaaagaaaatagtaacgccgccattatcaagagatttaaccaccactccgccatggtgctggccgcgggcttaagaaagcaggaagctcagaatgagcagacctctgagccaagcaacatggacggtaatagtggcgacgccgactgtttccagccggccgtgaagagagcaaagctgcaggagagtatcgagtatgaggatctgggcaagaacaattctgtcaagaccatcgccctaaatctgaaaaagtcagacagatactatcatgggcctactccgattcagtctctgcaatacgctacatcccaggacatcataaacagctttcagagcatccgacaagaaatggaggcatataccccaaaacttactcaagtgctgagttcatccgctgcttcttccacgattaccgccctttcacccggtggggctctgatgcaagggggaacacaacaggccattaatcaaatggtccccaacgacattcaatccgagctgaaacacttgtatgttgctgttggcgagctgctgagacacttttggtcttgtttcccagtcaacacgccattcctggaggagaaagtggttaaaatgaagtctaacctggagcgtttccaggtaactaagctgtgtcctttccaagaaaaaatcaggagacagtacttaagtactaatctcgtgagtcacattgaagaaatgctccaaacagcctacaataagctccatacgtggcaatctaggaggctcatgaagaagacatag

SEQ ID NO: 118283 - DNA, 1647 bp, Artificial Sequence
  Description of Artificial Sequence: Synthetic coding sequence
atggcaacttcttcagaggaggtgctgttgatagtgaaaaaagtgcgccaaaagaagcaagacggtgcgctttatttgatggccgagcggatcgcttgggctcctgagggaaaagaccgcttcacaatttcacatatgtacgctgatatcaaatgccagaagatctcacctgaagggaaagccaaaatccagttgcaactcgttttgcacgctggtgacacgacaaactttcacttttcgaacgagtcaactgccgttaaggagcgtgatgctgtcaaagacctcctgcaacagctcctaccgaagttcaagcgcaaagccaacaaggagctcgaagaaaagaaccgaatgctgcaggaggatccagtcctttttcagctgtacaaggatctcgttgtaagtcaggtgattagtgcagaagaattttgggccaatcggttgaacgtcaacgccacagactcttcaagtactagcaatcataagcaggacgtggggatcagtgcagccttcctcgcagatgttaggccccaaaccgacggctgcaatggactgcgctataatctgacttcagatatcatcgaaagcattttcaggacttatccagcagtgaagatgaagtatgccgaaaacgtgccgcacaacatgacagaaaaggagttctggaccaggttctttcaatcgcactattttcaccgcgacagactgaacacaggatccaaggacttgtttgcagaatgtgccaagatcgatgagaagggactgaaaaccatggtttcactgggagtgaaaaacccgctccttgatctgaccgcactagaagataaacctctggacgaagggtacggcataagttcagtacccagtgcctccaactcaaaatctataaaagaaaatagtaatgccgcaatcattaaaagattcaaccatcactccgcaatggtactggcggcagggctgcgaaagcaggaggcacaaaacgaacagaccagtgaaccttccaatatggatggtaatagcggcgatgcagattgcttccagcctgctgttaagagagcaaagctgcaggagtctattgaatatgaagacctaggcaaaaacaactccgtgaagacgatcgcccttaatctcaaaaagtccgaccgatattatcatggccctacgcccatccagtcactccagtatgccacctctcaggatatcatcaattctttccaaagcatacgccaggagatggaggcttatacacccaaattgacccaggtcctctcttcttctgccgcctcctctaccatcaccgcactttcaccaggcggtgcactcatgcaagggggcacacagcaggccattaaccagatggtcccaaatgacattcagagcgagttgaagcacctctatgtagccgtgggtgaattactgaggcacttttggtcatgttttcccgttaacaccccattcctagaggaaaaggtcgtcaaaatgaaatctaatctggaacgctttcaggtcaccaaattatgcccttttcaagagaagatcaggcggcagtacctctctactaacctcgtgtcacatatcgaagaaatgctccagacagcctacaataaactgcacacatggcaatccaggaggctgatgaagaaaacatag

SEQ ID NO: 118284 - DNA, 288 bp, Artificial Sequence
  Description of Artificial Sequence: Synthetic coding sequence
atggccactagctccgaggaagtactgcttattgtgaagaaggtgcgccaaaaaaagcaggacggggccttataccttatggcagaacgaatcgcctgggccccagagggcaaagaccgcttcacaattagtcacatgtacgccgacataaagtgccagaaaatctcccccgaaggaaaagcgaaaattcaattgcagctcgtcctgcatgccggcgacacgactaacttccactttagcaacgagtccaccgcagttaaagagcgagatgctgtaaaggatctgtag

SEQ ID NO: 118285 - DNA, 1299 bp, Artificial Sequence
  Description of Artificial Sequence: Synthetic coding sequence
atgctgcaggaggaccctgttctgttccagctgtataaggatctggtagtcagtcaagttatttccgcagaggaattctgggccaatcgcctaaatgtgaatgccacagattcttcttcaacgtctaatcacaagcaagacgtgggcataagcgctgccttcttggccgatgtaagaccccagacagatggctgcaacgggcttagatacaatttgacaagcgatatcatcgagagcatctttcgaacttacccagccgtgaagatgaagtatgccgaaaacgtgccacacaacatgactgaaaaggagttttggacaagattcttccagagtcactattttcacagagacaggctcaatacaggatcgaaagacttgtttgccgagtgcgcgaaaattgatgagaagggccttaaaaccatggttagtctgggcgtgaagaaccctttactcgacctcacggcattggaggataaacccctggacgaaggttacggtatctcctccgttccgtcagcctctaactccaaaagcattaaagagaactcgaatgccgcgatcattaaacgcttcaatcatcacagtgccatggtcctggcagctggtcttcgaaagcaggaggctcagaacgagcaaacttcagagcccagtaacatggatggaaattctggcgatgcagattgcttccaaccagctgtgaagcgtgcaaaactgcaggagtcaatagaatacgaggatctcgggaagaataactcagtaaagactattgccttaaacctcaagaagagtgatcggtactaccacggtccgacccctatacagagcctccagtacgcaacgtcccaggacataattaacagcttccagtcgattcggcaagagatggaagcctacacacctaagcttactcaggtgctgtcatcatccgccgccagtagtaccatcacagccttatctcctggtggcgctctgatgcaagggggtacgcaacaggctatcaaccagatggtgccgaatgacatacagtctgaactgaaacacttgtacgtcgctgtaggcgaactcctgcgccatttctggtcctgtttcccggtaaacactccctttctcgaggagaaggttgtgaagatgaagagcaatctggaacgtttccaggtgaccaagttgtgtccttttcaagaaaagattcgccggcagtatttatcaacaaaccttgtttcccacatcgaagaaatgttacagaccgcttacaacaagctgcatacttggcaaagcagacgcctgatgaaaaagacatag

SEQ ID NO: 118286 - DNA, 1188 bp, Artificial Sequence
  Description of Artificial Sequence: Synthetic coding sequence
atggatgaagaaccagaaagaaccaagcggtgggagggcggctatgaaaggacatgggaaattctgaaggaagacgagagcggatctttaaaagcgaccatagaagatatactgtttaaggccaagagaaaacgcgtcttcgaacatcatggacaagttcgccttgggatgatgagacacctttacgtagtggtggatggatcaagaacaatggaggaccaggatctgaaacctaatcggctgacttgcacgttaaagcttctcgagtactttgttgaggaatacttcgatcaaaacccgattagccagataggcataattgtgacgaaatctaagagagcagagaagctgaccgaactgtcgggcaacccgaggaaacacataacgtcgcttaagaaggccgtagacatgacctgtcacggcgaacccagcttgtataacagtctgtctatcgccatgcagacactgaagcacatgcccggacacactagcagagaggtgctaatcattttttctagcctcacaacgtgcgatccctctaacatctatgacctgatcaaaacccttaaagcggcaaaaattagagtgtcagtgataggactgagtgcagaggtgagggtgtgcacagtgctagctcgggagacaggtggcacgtatcatgttatcttggatgagagtcattataaagaactgctcacccatcatgtgagtcctcctcctgctagtagctcctctgagtgcagcctgataagaatgggattcccacaacatactattgcatccctgagcgaccaggacgcgaagccatcattcagtatggcccacctggacggtaatacggagcctggactgacattggggggttatttttgcccgcagtgccgggccaagtattgcgaactgcctgtggagtgtaagatctgtggattgaccctggtcagcgcccctcacctggctaggagctatcaccatttgtttcccttggacgcgtttcaggaaatcccgctggaagagtataatggggaacggttctgctacggctgccaaggtgagttgaaggatcaacatgtatacgtctgtgctgtttgccaaaatgtcttttgtgtagattgcgacgtattcgtgcacgattctcttcactgctgtcccgggtgtattcacaagataccggcaccttccggagtatag

SEQ ID NO: 118287 - DNA, 1188 bp, Artificial Sequence
  Description of Artificial Sequence: Synthetic coding sequence
atggacgaagaacctgaaaggacaaagcggtgggagggcggttatgaaagaacatgggaaattcttaaagaggacgaatccggtagcctgaaggcaactattgaagatattctgttcaaagcgaaaagaaagcgagtcttcgaacatcacggacaggtgagactcggtatgatgcgccacttgtacgtggttgtggatggatcccgaaccatggaagaccaggatcttaagcctaaccgattgacatgtaccctaaaactgctggagtattttgtcgaagagtacttcgaccagaatcccatctcacagattggaatcatcgtgactaagtcgaagcgggccgagaaactgaccgagctatccggcaatcctcgcaaacacattacttccttaaagaaggccgtggacatgacctgccacggtgagccttcactatacaactccctgtctattgcaatgcagacacttaagcacatgcccggacacactagtagagaagtcctcattatcttctcaagtttgacaacttgtgatccttccaacatttatgacttaattaagaccctgaaggccgccaagattcgggtaagcgtgattggactctcggccgaggtaagagtgtgcacagtgttagcccgggaaacgggaggaacctaccatgtcatcctcgacgagtctcattacaaagagttattgacccaccatgtgagcccgccccccgcttccagctcctcagaatgttccttaatccgcatgggcttcccccaacataccatcgccagtctctcagatcaagacgcaaagcccagcttctccatggcacatctggatggcaataccgaacccggcctgaccctgggcgggtatttctgcccacagtgtagggccaaatattgtgaactcccagtcgaatgtaaaatctgcggcctaacgctggtgtccgcgcctcacttagcccggtcctaccaccacctatttcccctagacgcatttcaagaaattcccctggaggaatacaatggtgaaaggttctgttacgggtgccagggggaactgaaggaccagcatgtttacgtctgcgccgtttgccaaaacgtgttctgcgtggactgcgatgtgttcgtacacgattcactgcattgttgccccggttgtattcataagatccccgcacctagcggggtatag

SEQ ID NO: 118288 - DNA, 1017 bp, Artificial Sequence
  Description of Artificial Sequence: Synthetic coding sequence
atgaggcatctctatgtggtggtggacggatctagaacgatggaggaccaagatctgaagccgaaccgcctgacatgcactttgaaactcctggaatatttcgtagaagagtacttcgaccagaatccgatctcgcagattggcatcattgtgactaagtccaagcgagctgagaaattgactgaactcagcggaaacccacgaaagcacataactagcctcaagaaggcagtcgatatgacttgccacggcgaaccttccctttacaattctctgagcattgccatgcagacgcttaagcatatgccagggcataccagtagagaagttctgataatattctcctcattgaccacttgcgacccgtctaatatctacgatttaatcaagacactgaaagccgccaagatacgcgtgtctgtcataggactttctgccgaagtgagggtatgcactgtcctagcaagggagacaggaggcacctatcatgtgattctggacgaatcgcactacaaagagctcctaacgcaccacgtgagccccccgccagcttcttctagcagcgagtgcagcctgattcgtatggggtttccacagcacacgatcgcttccctctctgaccaggacgctaaaccctcttttagcatggctcatctggacgggaatactgaaccaggcctcaccctgggggggtatttttgccctcaatgtagagcaaagtactgcgagctgcccgttgagtgcaagatatgcggcctaacccttgtctctgccccccacctagctcgcagttaccaccacctgttcccactcgacgcgttccaagagataccactcgaagagtataatggagagcgtttctgttacggctgtcagggggaactcaaggaccagcacgtgtacgtctgcgcagtgtgccaaaatgtcttttgtgtcgactgcgacgtgttcgtgcatgactcactgcactgttgtcctggttgtatccataagatccccgcgccatctggggtgtag

SEQ ID NO: 118289 - DNA, 1188 bp, Artificial Sequence
  Description of Artificial Sequence: Synthetic coding sequence
atggacgaggagcccgagcgaaccaagcgatgggaaggtggttatgaacgcacttgggagatcttaaaggaggacgagtccggcagtctgaaggctaccatcgaggacatcctgtttaaagccaagcggaagcgcgttttcgaacaccatggacaggtgcgtcttgggatgatgcggcacctgtacgtcgtggtggatgggtcacgtaccatggaggaccaagaccttaagccaaaccgactaacatgcacactcaaactcttggaatactttgtggaggagtatttcgatcagaatccaatctcacagattgggattattgttacaaagtcaaagcgggcggagaagctgaccgagctatccggcaatccacggaagcacatcacatcgctgaaaaaggcagtcgatatgacctgccacggtgaacccagtctgtacaactccctttctattgctatgcagacgcttaagcacatgccaggacatacttccagagaggtgctgattatcttttcctcactgaccacttgtgacccatcaaacatctatgatctaatcaagaccttaaaagctgccaaaatccgggtgagtgtgattggcctcagcgctgaagtgcgtgtgtgcaccgtgctggctcgtgaaaccggtggcacatatcacgtcattctcgacgagtcacactacaaggagctgctcacgcatcatgtgtctccaccacctgcatcatcatcatccgagtgttcccttattaggatgggatttccacagcacaccatcgccagtctgtcagatcaagatgctaaaccttcattctcgatggctcatctggacggaaataccgaacctggtttaacactgggtggctatttttgcccacaatgcagggccaagtattgcgaactgcctgtggaatgcaagatctgcggactcacactggtctctgccccacatctggcgagatcctatcaccatttatttccactggacgcattccaggagatccccctggaagagtacaatggagaacgtttctgctatggatgccagggggagctgaaagatcagcatgtttatgtgtgtgcagtctgtcaaaacgttttctgtgtggattgcgatgtcttcgttcacgattccctccactgctgtcccggctgcatccacaagattcctgctccctccggagtatag

SEQ ID NO: 118290 - DNA, 1389 bp, Artificial Sequence
  Description of Artificial Sequence: Synthetic coding sequence
atggagtcgaccccatccagggggctgaatagggtccaccttcaatgcaggaacctgcaggaattcctgggcgggctaagtcctggcgtcttggatagactatacggacatcctgctacttgtctggctgttttccgcgaacttccaagcctggccaagaactgggttatgagaatgctcttcctggagcagccattaccgcaagccgccgtggcactgtgggtgaagaaggaattctctaaggcccaggaggagtctacaggcctgctcagtggtttgaggatctggcacacccagctgctgcccggggggctgcaggggctcattcttaatcctattttccggcaaaatctgaggatagctttgctggggggcggaaaggcgtggagtgacgatacttcccagttgggaccggacaagcacgcccgagacgttccgtcacttgacaagtacgccgaggaaagatgggaggtggtgttgcattttatggttggctctcccagcgccgctgtatcccaggaccttgcacaactactgtcgcaagcggggctcatgaagtctacagagcccggggagcccccttgtattacgagcgctggcttccagttcctgctcttagacacacctgcacagctctggtatttcatgctgcagtacctgcaaaccgctcagagccgtgggatggatctggtggaaatcttgtccttcctttttcagttgtccttcagcactctgggcaaggactatagcgtcgaaggcatgagcgactccctattaaactttctgcaacacctcagagagttcggactcgtttttcagagaaaaagaaaatcccggcgatactatcccactaggctggccattaacctatcttccggcgtctccggggcaggcggcaccgtgcatcagcccgggttcatcgtggttgaaacaaattacagactctatgcttatactgagagcgagctgcagattgctctcatagcattgttcagcgaaatgctataccggttcccgaatatggtggtagcccaagtgacccgtgaatctgtacaacaagccattgcgtcaggaattacagcacagcagattattcactttcttagaacacgtgcccatcccgtcatgctgaaacaaactcccgtcttgccgcctaccatcactgaccagatcaggttatgggagctggaaagggatagacttcgcttcaccgagggagtgctctacaaccagtttttgtcccaggtcgattttgaacttcttctggcgcacgcccgagagctgggcgtactcgtctttgaaaatagtgccaaacgcttgatggtggtgactcctgctgggcatagcgatgtcaagcgcttttggaaacggcaaaagcacagttcatag

SEQ ID NO: 118291 - DNA, 1389 bp, Artificial Sequence
  Description of Artificial Sequence: Synthetic coding sequence
atggagagcactcccagtagaggattgaacagagtgcatctacagtgccgaaatctgcaggagttcctcgggggactttctcccggggtccttgataggctgtatgggcatccagcaacatgccttgcggtgttccgggagctcccaagcctggccaagaattgggtgatgcgcatgctctttcttgaacagccgctaccccaggccgccgtggctctatgggtgaaaaaggaattttctaaagcccaggaagaaagcacagggcttttgtctggcctccggatttggcatacgcagctccttccaggagggctccagggcctaattctgaatcctatcttcagacagaatctccgcatcgctctgttgggaggcggaaaagcttggtccgacgacacatctcaattgggccctgacaagcatgcccgcgatgtgcccagtctggacaagtatgcggaggagaggtgggaagtcgtcctgcatttcatggttgggagccccagtgcagccgtcagccaggatctggcacagctcctgtcccaggcaggccttatgaaatccacagagcccggagaaccaccgtgtataacatccgcaggctttcaattcctcttacttgatactccggcccaattgtggtatttcatgttgcagtatctccagacagctcaaagccggggtatggacctcgtggagatacttagcttcctgtttcagttaagcttctcaactctgggaaaggattactccgtggaagggatgtccgattccctgttaaattttttgcagcaccttagagaattcgggcttgtgttccaaaggaagcgcaagagccggcgatactatcctacacgccttgccattaacctttccagcggagtttccggcgccgggggcaccgtccaccagccagggttcattgtggtagaaacgaattaccggctctacgcttacacagagtccgagttgcagatagccttaattgccttgtttagcgaaatgctgtaccggtttcccaacatggtcgtcgcacaggttactcgtgagtctgtgcagcaggccatcgcttctggtatcaccgcccaacaaattatccattttcttagaacacgggcgcatcccgtcatgcttaagcagactcccgtgctgccgccaaccattactgaccaaatacgtttgtgggaattggagcgagaccggctgcgcttcacagagggtgtgctctataatcagttcctctcccaagttgatttcgagcttctcctcgcccatgcacgggaactcggggtgcttgttttcgagaactctgccaaacgactcatggtagtcacgccagcaggccatagcgacgtgaagcgattctggaagaggcagaagcacagctcgtag

SEQ ID NO: 118292 - DNA, 1389 bp, Artificial Sequence
  Description of Artificial Sequence: Synthetic coding sequence
atggaatcaacccctagccgggggttgaatagagtgcacttacagtgccgcaatttgcaggagtttctaggaggcctgtcccctggcgttctggatagattgtatgggcaccccgcaacatgcctggccgtctttcgggaactgccgagtttggccaaaaattgggtaatgcggatgctgttcctggagcagcccctgccacaggctgctgtcgccctatgggtaaaaaaggaattctctaaggcccaggaggaaagtacagggctgctgtctggattacggatctggcatacacagctgctacctggcgggctgcagggactgatcctgaaccctatttttagacagaacctgcggatcgcactactcggaggaggcaaggcctggtctgatgacacgagccaactggggcctgataagcatgctagggacgtgccctccctggataagtatgctgaagagcgatgggaggtagtcttacactttatggtgggaagcccaagtgccgctgtgtcccaggatttggctcaacttctctcacaggcagggctaatgaagtcgaccgagccaggcgagcctccctgcatcacatcagctgggtttcaattcctgttactggacacccctgcgcaactctggtacttcatgctgcagtacctacagactgctcaatcacggggtatggacttagtggaaattctcagttttctcttccagctttcttttagcacactcggtaaggattactcagtggagggaatgtccgacagcctactgaactttctccagcacctgagagaattcggcctggttttccagcggaagcgaaaatctcggagatactatccaaccaggttagcaattaacctgagctcaggcgtaagtggtgcaggggggaccgtgcatcagccaggtttcatcgttgtggaaacaaattacagactctatgcctacacggagagtgaactccagattgctttaattgcgctgttttcagagatgctttacaggttccctaatatggtcgttgcacaggtgacacgggaaagtgtccaacaggctattgccagcgggattaccgctcagcaaataatccattttttgaggacacgcgcacatcccgtcatgctgaagcaaacccccgtgcttccacccacaatcacagaccagattaggctgtgggagctagagcgcgataggctcaggttcaccgaaggagttctgtacaaccagttcttgtctcaggtcgattttgaactcctgcttgcacatgctagagagctcggtgtactagtgttcgagaacagcgccaagaggctaatggtggtgaccccagccggccactctgatgtcaagaggttctggaagcgtcaaaaacactcctcttag

SEQ ID NO: 118293 - DNA, 1389 bp, Artificial Sequence
  Description of Artificial Sequence: Synthetic coding sequence
atggagagtaccccttcgcgcggccttaatcgcgtgcaccttcagtgccgaaacctgcaagaattcctgggggggctcagcccgggcgtgctggacaggctgtacggccaccccgctacctgcttagcggtgtttcgggagctccccagcctagctaagaactgggtgatgaggatgctcttcttggagcaaccccttccccaggccgctgtggctctgtgggttaagaaagagtttagcaaggcacaggaggaaagcacgggcctcctgagcgggcttcggatttggcacacccaacttctgccagggggattacaaggactgatccttaatcccatatttagacagaacttgaggattgccttactggggggtggaaaggcatggtccgatgatacgtctcagctgggccctgacaaacacgctcgcgacgtgccgtctctggataagtatgccgaggagcgctgggaggtagttcttcacttcatggtgggcagcccatctgccgcagtgagccaagatctggcacagctgctatcccaggccgggctgatgaagagcacggaacccggggagcctccttgcatcactagcgccggctttcagtttctcctgcttgatactccagcccaattgtggtattttatgctgcagtatttacagaccgctcaatcacgcggaatggatctggtggagattcttagcttcctcttccagctgagcttctccacgcttggcaaagactatagcgtcgaaggcatgagcgattctttactcaatttcctgcagcacttgagagagttcggactggtgttccaaagaaagaggaagagtagacggtactatcccaccaggctcgcaataaatttaagtagcggcgtttctggcgcaggaggtacagttcaccagcccggcttcatcgtcgtcgagaccaactatagactgtatgcctatacggagagtgaactccaaatcgccctgattgctctgtttagtgaaatgctgtaccgctttccgaacatggtcgttgctcaagttacccgtgagtccgtccagcaagccatcgcctcaggcattaccgctcagcagatcattcactttctgcgaactcgagcgcacccggtcatgctcaaacagacccccgtgttgcctccaacaatcacagaccagattcgcctttgggagctggagcgcgataggcttagatttactgaaggcgtgctctataaccagttcctgtcacaggtggactttgagctactgctcgcccatgccagggagctgggagtgttggtgttcgaaaatagcgctaaaagactcatggttgtgacaccagccgggcattccgatgtcaaacgcttctggaagaggcagaaacactcttcgtag

SEQ ID NO: 118294 - DNA, 1389 bp, Artificial Sequence
  Description of Artificial Sequence: Synthetic coding sequence
atggagagtacgccatcacggggacttaaccgggtccaccttcagtgtcgaaatctacaagaatttctggggggcctgtcacccggggttctcgatcggctgtatgggcacccagctacttgcctcgctgtatttcgggagttgccctctctggcgaagaattgggtgatgcgcatgctgtttcttgaacagcccctgccgcaagccgccgttgctctgtgggtcaagaaagagttctcaaaagctcaggaagaaagcaccggcctgctgagcggtctaagaatttggcacacacagctcctgccgggcggacttcagggtctgatcctgaatcccatatttaggcagaatctccgcatcgccctgctcggcggcgggaaggcctggtccgacgatacaagccaactgggacccgacaaacatgcccgagatgttccttctttagacaagtacgccgaagaacggtgggaagtcgtgcttcacttcatggtgggttcaccctctgccgccgtttcacaggacctggcccaattgctaagccaggccgggcttatgaaatcaaccgagcctggagaacccccctgcattacgtccgccggtttccagtttctactgttggatactccagcccagctttggtactttatgctccagtacttacagacggcgcaaagccgaggcatggacctggtcgagatcctctccttcctgtttcaactcagcttctcaacactcggcaaagactacagcgtggaagggatgtcggatagccttctgaactttttgcagcacctgagggagttcggcctcgtgttccaacgtaagcgtaaaagtagaagatactacccgacacggcttgcaattaacctctcttcaggcgtgagcggtgctggcggaacagtgcaccagcccggcttcatagtagtggaaaccaattacaggctgtacgcatataccgagagcgagctccagatcgccctgattgctcttttctctgagatgctatatcggtttccaaacatggtcgtcgcccaggtcacacgggaaagcgtccaacaagcaatcgcgagtggcatcaccgcccagcaaatcattcacttcctgcgaacccgggcccatcctgtgatgctgaagcagacccccgttctccccccaactattaccgaccagatcaggctctgggagctggagcgtgatagattacgcttcacggagggagttctgtacaatcagtttttaagccaagttgatttcgagctgctgctggctcatgcccgggaactcggtgtgctggtgtttgaaaacagcgctaaacgactgatggtcgtcacacctgctggacatagtgacgttaagaggttttggaagcgacagaagcacagctcctag

SEQ ID NO: 118295 - DNA, 417 bp, Artificial Sequence
  Description of Artificial Sequence: Synthetic coding sequence
atggagagtactccctcacgcggactgaaccgagtgcatctccagtgccggaatttacaggaatttctcggcgggctctccccaggagtgctggatcggctttatggacatcctgccacttgcttagcagttttccgcgaactaccatctctggctaagaattgggtaatgaggatgttgttccttgaacagcccctcccacaagcggctgtggccctctgggtcaagaaggaattcagcaaagcgcaggaagaaagtacgggcttacttagcggacttagaatatggcacacgcaactgctcccagggggtctccaaggattgatcctgaacccaattttccggcaaaacctgcgaatcgccctgctagggggtacaggaatcactggcgtgagccattgcgcctggccaggctag

SEQ ID NO: 118296 - DNA, 1389 bp, Artificial Sequence
  Description of Artificial Sequence: Synthetic coding sequence
atggaatcaacaccatctagagggttaaatagagtgcacctccagtgtcgtaacttgcaagagttcctcggcggcctgagccctggcgtccttgaccgtctttacggccatccagccacatgccttgctgtgtttagggagttgcctagcctcgcgaaaaattgggtgatgaggatgttgtttctggaacaaccactgccacaggcagccgtggctctgtgggtcaaaaaagagttcagcaaagctcaggaagagtctaccggactcctgagcggtcttagaatttggcacactcagttgttacctgggggcctgcagggcctgatcctgaaccccatatttagacaaaacctgcggattgccctgctggggggcggaaaggcatggtctgacgacaccagtcaactggggccagacaagcatgcccgggacgtgccttccctggacaaatatgctgaggagcgctgggaggttgtgctccatttcatggtggggagtccgtcagccgctgtaagccaggatcttgcccaattactgtcccaagccgggctcatgaaaagcactgagccaggcgagcctccttgtattacctccgctggattccagtttctcctgctggatacacccgcccagctgtggtacttcatgctgcagtacctccagaccgctcagtccaggggtatggacctggtcgagattctgagctttctgttccagctcagctttagcacattaggtaaagattactcagtagaaggaatgtccgattcgctcctcaactttcttcaacacctaagggaattcggacttgtattccagaggaaacggaagagccggcgttactacccaactcggctggcaatcaatctctcaagtggcgtgtcaggggcgggtggaacggttcaccagccaggattcatcgtggtcgaaacaaattacaggctgtacgcctataccgagtccgagcttcagatcgctttgatcgccctttttagcgagatgctgtatagatttccgaatatggtcgttgcccaggtaaccagggaatctgttcagcaggccattgcctccggcattaccgcccagcaaatcattcatttccttcgaacacgcgcacatccagttatgttgaagcagaccccagtgctgcccccgacaattacagaccagatcaggttatgggagctcgagagagatcgcctccgctttaccgaaggggtgctgtataatcaattcttgtcccaggtggatttcgagctgttgctcgcgcatgcgagagagctcggcgtgttggttttcgagaactcagctaaaagactgatggtggtaacccctgcaggtcatagcgatgtgaaacgtttctggaagagacagaagcacagctcctag

SEQ ID NO: 118297 - DNA, 417 bp, Artificial Sequence
  Description of Artificial Sequence: Synthetic coding sequence
atggagagcactccctcaaggggccttaatcgcgtgcacctacagtgtcggaatctgcaggagttcctgggcggccttagccccggggtcttagacagactgtatggtcacccagccacgtgcttggctgtcttccgggagctgccttctttggcaaagaactgggtaatgcgtatgttgtttttggagcaacctctgccgcaggcagcagtggcactgtgggttaagaaggaattttccaaagcccaggaagagagcaccgggctgttatcaggactgagaatttggcacactcagctgcttcccggaggactccagggactcatcctcaaccctatcttccgccaaaacctaaggatagcacttctgggcggtacaggaatcactggcgtcagtcactgcgcttggccagggtag

SEQ ID NO: 118298 - DNA, 1389 bp, Artificial Sequence
  Description of Artificial Sequence: Synthetic coding sequence
atggagtcgaccccttccaggggcctcaatagggtgcatttgcagtgtagaaacctgcaggaatttttggggggcctttccccaggagttctggaccgactgtacggtcacccagcgacttgtctagctgtgtttcgggagctaccgtcattggctaagaattgggtgatgcgtatgctgttcttggagcagccccttccacaggctgccgtcgcactgtgggtgaagaaagaattctctaaagcccaagaggagagtaccgggttactatccgggctgaggatctggcacacgcaactcctgcctggtggcctgcagggacttatacttaaccccattttccgtcagaacctccgcatcgcattgttgggaggggggaaggcgtggtccgatgataccagccagctgggccccgataagcatgctagagacgtccccagtctggacaaatacgctgaagagcgttgggaagtggtgctgcatttcatggtgggcagcccaagcgcagctgtttctcaagacctcgctcagctcctttctcaggccggccttatgaagtccacagagcctggggagcctccttgtatcactagcgctggattccagttcctcctacttgacacccccgctcagctttggtatttcatgctgcaatacttgcagaccgctcagagccgaggaatggacctcgtggagattctctctttcctgttccagctgagtttttccacactgggtaaagattatagtgtggagggcatgagcgacagccttcttaacttcctgcaacacctccgtgaattcggcctggtgtttcagaggaagcgcaaatctcggcggtactatccgacccgcctggccataaacctcagctccggcgtgtcgggggctggagggaccgtgcaccagccaggcttcattgttgtcgaaaccaactataggctgtatgcttacacggagagcgaactgcagatcgcgttaatcgctcttttctccgaaatgctctataggtttccaaatatggtggtagcacaggtgacaagggagtccgtgcagcaagctatcgcaagcggaattactgcccagcagatcatccattttctgagaacccgcgcccaccctgtcatgctgaaacagacacctgtgttaccccctaccataaccgaccagattaggctctgggaattggaaagggaccggcttcgcttcaccgagggagttctgtacaaccagtttctctctcaggttgacttcgaacttttgcttgctcatgctagagagctgggcgtgctagtcttcgagaattcagctaaaagattaatggttgtgacgcctgcgggccacagtgatgtgaaacgattttggaaaaggcaaaaacattcaagttag

SEQ ID NO: 118299 - DNA, 417 bp, Artificial Sequence
  Description of Artificial Sequence: Synthetic coding sequence
atggagtcgacccccagccgtggacttaatagagtccatctgcagtgcaggaatctccaggagttcctcggaggcctcagccctggggttctcgacagactgtacggacacccagccacgtgcctggccgttttcagggaattgccatctctagcaaagaactgggtcatgagaatgctatttctggaacaaccactgccccaggccgccgttgctctgtgggtcaagaaggagttctcaaaagcccaggaggagtccaccgggttgctgtcgggattaaggatctggcatacccaactgttgccaggcggactgcagggactcattctgaaccctatttttcggcaaaatctccgcatcgctttacttggaggcacaggcataacaggcgtgtcccattgtgcgtggcctggatag

SEQ ID NO: 118300 - DNA, 1389 bp, Artificial Sequence
  Description of Artificial Sequence: Synthetic coding sequence
atggaatccacgcccagcagaggtctcaatcgagtccacctgcagtgcaggaatctccaggaattccttggtggtctgtcccctggggtactcgaccggctctatgggcacccagctacctgcttggcagttttccgcgaactaccatcattggccaaaaactgggtgatgcgcatgctcttcctggagcagccactgccacaggccgccgtggcgttgtgggtgaaaaaagaattcagtaaggcccaggaggaatctactggcctcctttcaggcctgaggatttggcatacacaactgctacctgggggtttacaagggctaatcctgaatcctatattccgccagaaccttcgcatagcacttctcggtgggggcaaagcttggtccgacgacacaagtcagctgggtccggacaagcacgctcgggacgtgcccagccttgacaaatacgctgaagagaggtgggaggttgtcctccacttcatggttggcagcccctctgctgccgtctcgcaggatctcgctcagctcctaagccaagcaggtctcatgaagtcaacagagcctggggagcctccttgtatcacctctgccgggttccagttcctgctgcttgacacccctgcgcagctgtggtattttatgcttcagtatttacagactgcacagagccggggcatggatcttgtagaaatcctctctttcctcttccagttgtccttttccacacttggtaaagattattcagtggagggcatgtccgactctctgttgaacttcctgcagcatctgagggagttcggcctcgtcttccaaagaaaacgcaaaagtcgacggtactaccccactcggctggctatcaacctgtcaagtggcgtttctggagctggtgggactgtgcatcagcctggattcattgttgtggagaccaactatagactctacgcctacacagagtccgagttacagatcgcactgatcgctctcttttccgagatgctgtacagattccctaacatggtggtggcccaggtgacacgtgagtccgtacagcaggcaatcgcctccggcatcaccgcccagcagattatccacttcctgaggacccgcgcgcaccctgtaatgctgaagcagacccctgtcttacctccaaccattactgaccagattcggctttgggagctcgaacgcgaccgcttgcgtttcactgagggtgtgctctacaatcagtttctgtcacaggtcgattttgagttgcttctggcgcatgcccgcgagttgggggtgttagtgttcgagaatagcgcaaagagacttatggtggtgaccccggcgggacattccgatgtcaaaaggttctggaaacgtcagaaacactctagctag

SEQ ID NO: 118301 - DNA, 1389 bp, Artificial Sequence
  Description of Artificial Sequence: Synthetic coding sequence
atggaatctacccctagtcgggggctaaatcgggtgcatctgcagtgtcgcaatctccaggaattcctgggcggcctgagcccgggcgtcctggataggctctatgggcaccctgctacctgcttggctgtatttcgcgaacttccttcattagcgaagaactgggtcatgaggatgctgtttctggaacaacctttgccacaggctgctgtggctctctgggtcaagaaggagtttagcaaggcacaggaggaatccaccggcttattatctggcctgcgcatttggcacacgcagttgttgcctgggggcctgcaaggtttgatccttaatcccattttccgacagaatctcaggattgctctgcttgggggtggaaaagcgtggtcagatgatacctctcagctgggcccagataagcatgcgcgtgatgtccctagcctggacaagtatgccgaggagagatgggaggtcgttttacacttcatggtgggttcccccagtgccgccgtgtcccaggatctggctcagctcctctcccaggccggactaatgaaaagcaccgaacctggggagcccccttgcattacatctgccggctttcagtttttgctgctcgatacccccgcccagctgtggtattttatgttgcagtacctacagaccgcacaatcccgtggcatggatctggtagaaattctttcttttctattccagttaagtttttccacgctggggaaggactattccgtggaaggtatgtctgactctctgttgaattttctccagcatctccgggaatttggcctggtcttccagcggaaacgaaaaagtcggcgctattatccaacaaggctggcaatcaacttgtcatctggggtgtcaggggccgggggaactgtgcaccagcccggtttcatagtcgtggagaccaactatcgcctctatgcttacacggagagcgagctacagatcgcactgatcgctctgttctcagagatgctttatcgctttcctaatatggtggttgcgcaggtcaccagggagtccgtacagcaagccattgcgtctggcataacagcacagcagattatccatttcctgagaactagggcgcatccagttatgttgaagcagacccctgttctgccacccacaattactgaccagatcagattatgggagctcgaacgcgaccgccttagatttacagagggggtcctttataaccagtttctgtcacaggtggatttcgagctcctcttagcacatgcccgcgaactaggtgtgttggtgtttgaaaacagcgcgaagaggctgatggttgtgacccctgctggacattccgacgttaaacgcttttggaagcggcagaaacacagctcctag

SEQ ID NO: 118302 - DNA, 1389 bp, Artificial Sequence
  Description of Artificial Sequence: Synthetic coding sequence
atggaaagtaccccttcgagaggtctgaacagagtacacttgcagtgtcgcaatctgcaagagtttctcggtgggctgtcacccggggtgttggataggttatacgggcatccagctacatgcctcgcagtctttcgagagcttccttcccttgcaaaaaattgggtgatgagaatgctgttcctcgagcaacccttgccgcaggccgcagtggccctctgggtgaagaaggagttttcaaaggcccaagaggagtctactggactcctgtccggcctgcgaatctggcacacccaactgctgccgggcggacttcagggcttgatccttaatcccattttccggcaaaacctcaggatcgctctcttagggggaggaaaagcctggtcagatgatacgtcccagctggggccagacaaacacgccagagatgtgcccagcctcgacaagtatgcagaggaaaggtgggaagtggtgctgcacttcatggtggggagcccgagtgcagctgtttcacaggatttggctcagcttctgtctcaggccgggctgatgaagagcaccgagccaggcgaaccaccctgcatcacatcagcaggcttccagtttctgcttttagatacaccagctcagctgtggtatttcatgctccaatacctacaaaccgcccaatcgagaggtatggaccttgtcgagatcttgagcttcttgttccagttgtcattttcgacgttaggcaaagactatagcgtggagggcatgtcggactcactccttaacttcctgcaacatttaagggaatttggccttgtgttccagaggaagcgcaagagccgacgttattacccaactcgtttggccattaacctatctagcggcgtgtccggcgctggagggaccgtgcaccagcctgggtttatagttgtggaaaccaactatagactctatgcttacaccgagtcagagctccagatagcactcattgcacttttcagtgaaatgttgtaccggtttccgaatatggttgtggcgcaggtgacacgcgagtcagtgcagcaggcgattgcatccgggataactgcccagcagataatacacttcctccgcactagggctcatcctgtcatgctgaaacaaacacctgtcttacctcccaccatcaccgatcagatccggctgtgggaactagagagggatcgccttcgatttacagagggagtgctgtacaaccagttcctgagccaagtggacttcgagcttctgctcgcgcacgcaagagagctcggcgtcctcgtgtttgagaacagcgctaaaagactgatggtggttacccccgcgggccacagtgacgtgaaaagattctggaagaggcagaagcactcttcctag

SEQ ID NO: 118303 - DNA, 1389 bp, Artificial Sequence
  Description of Artificial Sequence: Synthetic coding sequence
atggaatctacaccgagccgcggcctcaaccgagtccacctgcaatgcagaaacctgcaagaattcctgggcggactgagtccgggcgtgctggaccgactgtacggtcatcccgctacctgtcttgcggtctttcgggaactcccctcgctggcaaagaactgggtcatgcggatgctgttccttgagcaacccctgccacaggctgcagtggccctctgggtgaagaaagaattctccaaggctcaggaagagagcaccggcctactctccgggcttagaatttggcatacacagttgttgccgggtgggctgcagggcctgatcctgaacccaatctttaggcagaacctcaggatcgccctgctgggcggggggaaagcatggagtgacgatacaagtcaactgggcccagacaagcacgcccgggatgtgcccagcctagataaatatgcagaagaaagatgggaagtcgttctacacttcatggtcggatctccctccgctgccgtttcgcaggatctggctcagctgctgagccaggcagggctcatgaagtccacagaacctggggaaccgccttgcatcacaagcgcaggcttccagttcctcctgctggataccccagctcagctctggtattttatgctccagtatctacagaccgcccagtcaagaggtatggatctcgtggaaatcttgtcttttctgttccaactgtccttctcaactctaggaaaggactacagcgtcgaaggtatgtcagattctttgcttaacttcctacaacacttgagggagtttggcttggtgtttcagcgcaaacggaaaagtcgcagatattatccaactcgccttgcaattaacctcagctccggggtgtccggggctggtggcacggtgcaccagcccggattcatcgtagtggagactaactatcgtttatacgcttatacagaaagtgagcttcagatagctctgattgccctcttcagcgagatgctgtatcggtttcctaatatggtggtggcccaggtgactcgtgagtctgttcaacaagccattgcttccggtattaccgcacagcaaattattcatttcctccgcacgcgggcgcatcccgtcatgctgaaacagacacccgtactaccccccactattactgatcagatcagattgtgggagctcgaaagggataggctcagattcaccgagggtgtcttatacaaccagttcctgtcacaggtggatttcgaactgctgctggctcacgctcgggagttaggagtgttggtgtttgagaatagcgccaagagactgatggttgtgaccccagccgggcatagtgatgtgaagcgcttctggaagaggcagaagcactctagctag

SEQ ID NO: 118304 - DNA, 417 bp, Artificial Sequence
  Description of Artificial Sequence: Synthetic coding sequence
atggagagcacgccctccagaggactgaaccgcgtgcatctgcagtgtaggaacttacaggaatttctcggaggtctgagcccgggcgtgctggataggctgtacggacaccccgccacatgcctcgccgtctttcgagagctgcccagcctagccaaaaactgggtgatgaggatgctgttcctggagcagcctctcccccaagccgccgtggccctgtgggtaaagaaagagttttcaaaagcacaggaagaaagcacaggcttgctgagcgggttgaggatctggcatacccagctgctgcctggggggctccagggcctcatcctgaaccctatctttcgccagaacttgcggatcgcccttctgggtggaaccggcattaccggcgtctcacattgcgcatggccggggtag

SEQ ID NO: 118305 - DNA, 417 bp, Artificial Sequence
  Description of Artificial Sequence: Synthetic coding sequence
atggagagcactccatcgcgcggcctcaatagggtgcacctgcagtgcagaaacctacaggagtttctcggcggactaagtcccggcgtgctggaccgcctctacggacatccagccacttgcctcgcggtgtttcgtgagctcccctctcttgcaaagaactgggtaatgagaatgctcttcctggagcagcccttgccccaggccgctgtcgctctttgggttaagaaagagttttcgaaagcccaggaagagagtaccgggctgcttagtggactgcggatttggcacacccaactgctgcccggtggcctgcaaggacttatcctgaatcccatcttccgacaaaacctccggatcgctctcctggggggaactggtatcacaggggtctcacattgtgcatggccggggtag

SEQ ID NO: 118306 - DNA, 417 bp, Artificial Sequence
  Description of Artificial Sequence: Synthetic coding sequence
atggaatccaccccatcaagaggactgaaccgcgtccacctccagtgcagaaaccttcaggagtttttgggcggtttgtcgccgggtgtgttagataggctgtacggccaccctgccacatgcctcgcagtgttcagggagctcccatcactcgccaaaaattgggttatgcgaatgttatttttggagcagccgctccctcaggccgctgtggccctgtgggtgaaaaaggaattcagcaaggcccaggaggagagcacaggactgctgtcaggcctcaggatctggcacacacaactgctgccaggggggctgcagggcctgattcttaaccccatctttcgccaaaaccttagaatcgccctcttgggggggacgggcattaccggtgtgtcacactgcgcctggcctggctag

SEQ ID NO: 118307 - DNA, 1389 bp, Artificial Sequence
  Description of Artificial Sequence: Synthetic coding sequence
atggagagcactccctcccggggtctgaatcgggtgcacctgcagtgtcgaaatttgcaggaatttctgggtggcctaagccctggggtattggataggctctacggtcacccggccacctgtctggcggtcttcagagaactcccctctctggccaagaactgggtcatgagaatgctctttttagagcaacccctgccccaggcggcggtggcactctgggtaaagaaggaattctccaaggctcaagaggaatcgaccggtttattgagcggccttaggatttggcatacacagctgctgccaggcggcctccaggggctgattctgaatccaattttcaggcagaacctccgaatcgctttattgggcggaggcaaagcgtggtccgatgatacatcccaattagggccagataaacatgcccgagacgtcccttctctagataagtatgccgaggagagatgggaggtagtcctgcacttcatggtgggcagcccgagcgcagcagtctcgcaagacctggcacaactgctgagccaagcgggtctcatgaagagtaccgaacctggcgagccgccatgcatcactagcgctggcttccaatttctcctgctggacacacccgcccaattgtggtactttatgctacagtatctgcagacagcccagtctaggggcatggacttggtggaaattctctcattcctgtttcagctcagctttagcaccttagggaaagattactcagtcgaagggatgtcagactcactgctcaacttccttcagcacttgagggagttcggcttggttttccagcggaaacggaaatctagacggtactacccgactcgcctcgccataaacctcagctctggggtctcaggagcaggaggtaccgtgcaccaacctgggtttatcgtggtggagaccaactaccgcctatacgcatataccgaaagcgaacttcaaatagcactaatagcgctattcagcgaaatgctgtatagattccctaacatggtagtggcccaggtaacaagagagagcgtgcagcaggcgattgcttccggaataaccgcccagcagataatccactttctgcgaactcgtgcccacccagtcatgctgaaacaaaccccagtgctgccaccgaccattaccgatcagattagattatgggaactggagcgcgataggttaaggttcaccgaaggtgttctatacaatcagttcctctctcaggtcgacttcgaactactcctcgcccatgctagagaattgggggtacttgtcttcgagaactccgctaaaaggctaatggtggttactccagccggccactccgacgtgaaaaggttctggaagaggcagaaacattccagttag

SEQ ID NO: 118308 - DNA, 663 bp, Artificial Sequence
  Description of Artificial Sequence: Synthetic coding sequence
atgagaatgctatttttagagcagccactaccacaggcggccgtggctctgtgggtcaaaaaggaattcagcaaggctcaggaggaatctaccggattactttccgggctgcgcatctggcacacccaactgctgccaggagggctccaaggtctgatactgaatcctattttcagacaaaaccttcgcatcgccctattgggaggaggcaaagcttggtcagacgacacgagccagcttggccctgacaaacatgctcgggatgtgcctagcttggacaaatacgcagaggagcgatgggaggtggtacttcacttcatggtagggagcccttcggcggccgtgtctcaagacctagctcagctgctaagccaagctggattgatgaagagcacagagcctggggagccaccatgtataaccagcgcggggttccagttcctgcttctcgatacaccagcccagctttggtatttcatgctacagtacttacagacagcccaaagccgcggcatggacttagtggagatacttagctttttattccagctctcattcagcaccctcggaaaagattattccgtggaaggaatgtctgactctctgcttaattttttacagcacctaagggagttcgggttggttttccaacgcaaggtgtag

SEQ ID NO: 118309 - DNA, 663 bp, Artificial Sequence
  Description of Artificial Sequence: Synthetic coding sequence
atgcgaatgctttttttggaacagccgctaccacaggctgccgtcgcattatgggtgaaaaaggagttcagcaaggcccaagaggagagcaccggtctcctctcgggactgcggatttggcacacccagctcttaccgggagggctgcaggggttaattctgaacccgatattcaggcagaaccttagaatcgctctcctgggcggggggaaggcctggtccgacgatacctcacagctgggaccagacaagcatgctagggacgtgcccagcctggacaagtacgccgaggagagatgggaggtcgtgctccacttcatggtaggatctccttctgccgcggtgtcccaggatctcgctcagctgctgtcccaggccggcctaatgaagtcaaccgagccgggggaaccgccctgtatcacaagcgccgggtttcaatttctgttgctcgacacacccgcacaactgtggtatttcatgctccagtatctgcagacagcccagagtcgcgggatggacttggtcgagattctcagcttcttgttccaactctctttctcaaccctaggtaaggactactcggtagaggggatgtctgactccctactgaactttctccagcatctccgtgagttcggactggtcttccagcgaaaagtgtag

SEQ ID NO: 118310 - DNA, 663 bp, Artificial Sequence
  Description of Artificial Sequence: Synthetic coding sequence
atgcggatgttgttcttagagcagccacttcctcaggcagctgttgctctctgggtgaagaaagaattcagtaaggctcaggaggaaagcactggcctactcagtggtctgcgtatatggcacacgcagctccttcctgggggactccagggactgattctgaatcctatcttcagacaaaatttgcgaatcgccctgctgggtgggggcaaggcctggagtgacgataccagccagttgggtccagacaaacacgctcgagatgtgccatctctcgataagtatgctgaggaacgatgggaagtcgtgctccatttcatggttggttcaccttccgccgctgtatcccaggatctggcccagctgctcagccaggcagggctgatgaagagcacagagcctggagagccaccctgcatcacttccgctggctttcagttcctgctcctggacacaccagcccaactgtggtatttcatgttgcagtacttacagaccgcccagtccaggggcatggatctggtggagattctgtcctttctgttccaactgtcattttccacattggggaaagactactcagtggaaggtatgtccgatagcctactgaacttcctgcaacatcttagggagtttgggcttgtgtttcagagaaaggtgtag

SEQ ID NO: 118311 - DNA, 663 bp, Artificial Sequence
  Description of Artificial Sequence: Synthetic coding sequence
atgaggatgctgtttctcgagcagccactccctcaggccgctgtggctctttgggtaaaaaaggaattcagtaaggcacaagaagaatctaccgggttactgtctgggctgcggatatggcacacacagcttctccccggaggcctccaagggctcattctgaaccccatttttcggcagaatctgagaattgccttgttgggaggcggcaaggcctggagtgacgacacctcacaactcggccctgacaaacacgcacgtgatgtgccctctttggataagtatgcagaggaaagatgggaagtggttttgcactttatggtaggatctccgagtgctgctgtgtcacaggacctggcgcagctgctctcccaagcgggcctgatgaagtcaaccgaacccggcgagccaccctgtataacatccgcgggattccagtttcttttgctagatactccagcccagctttggtattttatgctgcagtacctgcagactgcacagtctcgaggaatggatctggtcgagattctgtcctttctctttcagctctcatttagcactctgggaaaggactattcagtagaggggatgagcgactctctgctcaattttctgcagcacctgagggagtttggcctggtgtttcagagaaaagtctag

SEQ ID NO: 118312 - DNA, 663 bp, Artificial Sequence
  Description of Artificial Sequence: Synthetic coding sequence
atgcggatgctgttcctcgagcagcctctgccccaagccgctgtggcactgtgggtgaagaaggaattctcaaaagcacaagaggaatctacagggttgctgtccgggctgaggatatggcacactcagcttctgccgggcggactgcagggtctcatcctcaatcccatctttaggcagaatcttaggattgcactgctgggaggcggcaaagcttggtcagatgatacctcccaattggggcctgataagcacgccagggacgtgccaagcctggataagtacgcggaggagaggtgggaagtggttctccattttatggtcggctccccgtcagcggccgtatcgcaggacctagctcagctgctgtctcaagctggccttatgaagtcaacagagcccggagagcccccttgcatcacttcggcgggctttcagtttctactgctagacacccccgcacagctgtggtactttatgctccagtatctccaaacagcccagagcaggggcatggacctggtggagatcttgtcgttcctgtttcagctgagcttctcaacactgggcaaggactactccgtggagggaatgagtgattcactgcttaactttctccagcatctgcgcgagttcgggcttgtgttccaacggaaggtttag

SEQ ID NO: 118313 - DNA, 663 bp, Artificial Sequence
  Description of Artificial Sequence: Synthetic coding sequence
atgaggatgctatttctggagcagcctcttcctcaggcagccgtagccctctgggtgaagaaggagttctccaaagcacaggaggagtcaaccggcttgctgagcggccttcggatatggcatacccaacttcttcccggaggactccaaggtctgattctcaacccaatcttccgacaaaatctccgcatcgcacttttgggaggaggcaaggcctggtctgacgatactagtcagttgggacctgacaagcacgctagggacgtccctagtctggacaagtacgcagaggagaggtgggaagtggtgctccatttcatggtcggctcaccttccgctgctgtctctcaggatcttgctcagctgctcagccaggcaggtctgatgaaatcaaccgagcctggagagcccccttgcataacctctgcagggttccagttcctcctactcgatacaccagcacagctctggtactttatgctacaatatctacagaccgctcagagtcgtggaatggatctcgtggagattctgagctttctgttccagctgtccttcagtacattgggaaaggattactctgtcgagggtatgagcgactcactacttaattttctacaacacttgcgggaattcgggcttgttttccagcgcaaggtgtag

SEQ ID NO: 118314 - DNA, 216 bp, Artificial Sequence
  Description of Artificial Sequence: Synthetic coding sequence
atggtgaatgtactcaaaggcgtcctgatcgagtgcgatcccgccatgaagcagtttttactgtatctggatgaatccaacgctctgggtaaaaaatttattatacaggatatagacgatacacatgtcttcgtgatagcagagttggtgaacgtgctgcaggagcgcgtcggggaactcatggaccaaaatgctttcagtcttacccagaagtag

SEQ ID NO: 118315 - DNA, 2997 bp, Artificial Sequence
  Description of Artificial Sequence: Synthetic coding sequence
atggcacaagtggctatgtcaacgctccctgtagaagacgaagaatctagcgagagtaggatggtggtgacctttcttatgtctgcccttgaaagtatgtgtaaagaactggccaagagtaaagccgaagtggcgtgtatagccgtgtatgagacagacgtgttcgtggtggggactgagcggggtcgcgccttcgttaacacacgaaaggatttccagaaggactttgtgaaatactgcgtcgaagaagaggagaaagcggcagagatgcacaagatgaagagcactacacaggccaataggatgtcagttgatgccgtcgaaatagagacattaaggaagacagtcgaagactatttctgcttttgttatggaaaggcactggggaagtctacggtcgtgcctgtaccttacgagaaaatgctgcgggatcaatcagccgttgtggttcagggcctgcctgagggggtggcattcaagcacccagagaactacgatctggctaccttgaagtggatcctggaaaataaagccggcatttcctttattataaagcggccgtttctcgagcctaagaaacacgtgggaggaagagtaatggtgactgatgctgaccggagtattctgagtcccggaggctcatgcggccccatcaaagtcaaaaccgagcctacagaggactcagggattagtctcgagatggccgcagtaactgtcaaggaggagtcggaagacccggattattatcaatataatatccaagcaggcccgagcgagacagacgatgttgatgagaagcagcctctgtccaagccattacagggctcccaccatagttcggaaggaaacgagggaacggagatggaggtccctgccgaggactccacacagcacgtcccgtcggaaacgtctgaagaccctgaggtcgaggtgaccattgaggatgatgactactcccctccatctaagcggcctaaggcgaacgagttacctcagccaccagtaccagagccagctaacgccgggaagagaaaggtgcgtgagttcaatttcgaaaaatggaacgcgaggatcaccgatttgcgtaagcaggttgaggagctgttcgagagaaaatatgcccaggcaatcaaagcaaagggaccagtcaccataccttacccgctctttcagtcacacgtggaagatctgtatgttgagggtctgcccgaaggcataccatttaggagaccctccacctacggaatccctcgactggagcgaattcttctggccaaagaaagaattagattcgtgataaaaaagcacgagctgcttaatagcaccagggaagaccttcagctggacaaaccggcttcaggtgttaaggaggaatggtacgcacggatcactaaactgagaaagatggtggatcagttattctgcaaaaaattcgctgaagcactggggtcaaccgaggcaaaggccgtgccataccaaaagtttgaggctcaccctaatgacctctacgttgagggcctccccgagaatattccctttcgatctccgagctggtacggtattccacgcctggaaaagatcattcaggtgggcaaccgcataaagtttgtgatcaaacgtcctgagctgctgacacactctaccaccgaagtgacgcagccgcgtacaaatacccccgtgaaggaggattggaatgttaggatcacgaagctcagaaaacaagtggaagagatcttcaatctgaaatttgctcaggctctgggattgaccgaggcagttaaagtgccctaccccgtgtttgagtctaatccggaattcctgtatgtagaggggctccctgagggcattcctttcaggagccccacctggtttggcataccccggttggaacgtatcgtgagaggcagcaataagattaaattcgtggtcaaaaaacccgaactggtaatcagctacctacctccagggatggcatctaagatcaacactaaagccttgcagtcgcccaagaggcccagatcacccgggagcaatagcaaagtccctgaaattgaggtaacggtcgaagggcccaataataataatcctcaaaccagcgctgtccgtacccccacgcagaccaacggctccaacgttccctttaagcccagagggcgagagtttagctttgaggcctggaacgcgaagattaccgacctgaaacagaaagtcgaaaatttgttcaatgagaaatgcggggaagcactgggcttgaaacaagctgtgaaagtgccttttgccctgtttgaatcgtttcctgaagacttttacgtcgagggcttgcctgaaggggttccgttccgcaggccttctacgtttgggatcccaaggttggaaaagattctgagaaataaggcaaagattaagtttataatcaagaaaccagagatgttcgaaactgccatcaaggaatctacgtcctccaagagcccgccccggaaaattaattcgtcgcccaatgtgaacacaacagcaagcggcgtagaggacctaaatatcattcaggtcaccatcccagatgatgacaacgaaaggctgagtaaggttgaaaaagctaggcagctacgtgagcaggtcaacgatctcttctctcggaagtttggagaagcaattggcatgggctttcccgtgaaggtaccatataggaagatcactataaatcctggttgtgttgtcgtggatggtatgcccccgggcgtgtctttcaaagctccttcctatttagaaatctcaagcatgagaaggattctcgactccgctgaatttatcaaatttacggtcattagacctttcccaggtctcgtgatcaataatcagctagtcgaccagtctgagagcgagggacccgtgatccaggaaagcgccgaaccaagccagctcgaggtgcctgccacagaagagatcaaggagaccgacggtagtagccagattaagcaggaacccgatcctacatggtag

SEQ ID NO: 118316 - DNA, 2934 bp, Artificial Sequence
  Description of Artificial Sequence: Synthetic coding sequence
atggctcaggtggcaatgtccaccctgccggtggaggacgaggagagtagcgagagccgtatggtggtcactttccttatgtctgccttggagtccatgtgtaaggaactggcaaagtccaaagccgaggtagcttgtatagccgtctacgagacagatgttttcgtggtcggcaccgaacgagggcgggcgtttgtgaatactcggaaggacttccagaaagatttcgtaaagtattgcgtagaagaagaagagaaagcggcagaaatgcacaagatgaaatccaccacccaggcaaacagaatgtccgtggatgctgtggagatcgagacgctgcggaaaaccgtagaggattacttttgtttctgttacggcaaggccttggggaaatcaacagtggtccccgtcccatacgaaaaaatgcttcgggaccagtctgccgtggtagtacagggtttgccggagggggtggcattcaagcatccggagaattacgacctcgccactctaaaatggattctcgagaataaagccgggatttcctttattattaagcgcccttttcttgaaccaaaaaagcacgtcggaggacgcgtgatggtcaccgacgcagatcgctctattttgtccccagggggtagttgtgggcctattaaggtgaaaacggaaccaaccgaagactcggggatttcccttgagatggcagccgtcaccgttaaggaggagtccgaagaccctgattattatcagtacaacatccaggctggcccctctgaaaccgatgacgtggatgagaagcagcctctgagcaagcccctgcaggggtcccaccactcttcggaggggaacgaggggaccgagatggaggtgcccgccgaggatgacgattattcaccgcctagtaaaagacccaaggccaacgagctgccccagcctcctgttccggaacctgcaaatgcgggcaaaaggaaagttcgagagttcaattttgagaaatggaacgctcggattaccgacttaaggaagcaggtggaggagttatttgagaggaaatatgcgcaagcgatcaaagccaagggcccagtgacaataccctatcctttatttcaatcccatgtagaggacctgtatgtcgagggcttgccagaaggtattcccttcagaagacctagcacctacggtattccacgcctcgaaagaattctgcttgccaaagagcgaatccggtttgtgattaagaagcacgaactgctaaacagcactagagaggacctgcagctggacaaaccagcctcaggcgtaaaagaggagtggtacgccagaataacaaaacttagaaagatggttgaccaattattttgtaagaaattcgctgaagcccttggttctaccgaagcaaaggctgtgccttaccagaagttcgaagctcaccctaacgacctgtatgttgaggggctccccgaaaacattccgttccgatcaccaagctggtacggcatcccccgtctggaaaaaataattcaggtcgggaaccgcattaagtttgtgatcaaacggccagagctactgacccattcaaccaccgaagtgactcagccccggactaacacacctgttaaagaggattggaatgttcggatcacaaaactccggaagcaggtggaagagatctttaacctcaaattcgcccaagcactcggcctcacagaggcagtgaaggtcccctatcccgtgttcgagtctaaccccgaatttctctacgtcgaagggttgcccgaagggattcccttccgctctccaacgtggttcggaattccgcggctggagcgcatcgtcagggggtcaaataaaattaagtttgtagtgaaaaaaccagagttggtgatttcttatttgccaccaggcatggcctctaagattaacaccaaggccctgcagagcccaaagcgtcctaggtctcccggaagcaatagtaaggtgcctgagatcgaggtgacagtggaggggcctaataacaacaacccccaaacaagtgcagtgagaactcctacccagactaacggctcaaatgtacctttcaagcccaggggccgggagttcagtttcgaagcctggaatgcgaaaattaccgaccttaagcaaaaggtggaaaacctgttcaatgagaaatgtggcgaggccctagggctcaagcaagcagtcaaggtgccttttgcattattcgagtcgtttccagaagacttctatgtggagggccttccagaaggggtcccctttcgccgaccctctacattcggcatcccccggctggagaagatcctacgtaacaaggcaaagatcaagtttattatcaagaaaccagagatgttcgagaccgccataaaagagagtacaagtagcaagagtccaccccggaagattaattcttcccccaacgtgaacactaccgcttctggcgtggaggacctaaatatcattcaagtgaccatccccgacgacgacaatgaacgcttgtccaaagtcgagaaggctagacagttgcgggagcaagtgaatgacctgttctctagaaagttcggggaagccattggcatggggttccctgttaaggtgccctataggaagattactatcaacccaggctgcgtcgtggtggacggcatgcctcctggggtgagcttcaaggccccctcctatctggagatctcttctatgcgcagaattctggattctgctgagttcattaagtttacagtgatcagacctttcccaggcctggtcatcaacaatcaattagtggatcagagtgaaagtgagggtcccgtcatccaggaatccgcagagcctagccagttggaagtacccgccactgaagagatcaaagagaccgatgggtcaagtcaaatcaagcaagagcccgacccaacttggtag

SEQ ID NO: 118317 - DNA, 2937 bp, Artificial Sequence
  Description of Artificial Sequence: Synthetic coding sequence
atggcacaagtggccatgtccaccttacccgtggaggacgaagagagctctgaatctcggatggtggtgacatttctgatgagcgccctggagtcaatgtgcaaggagttggcaaagtcaaaggctgaagtagcatgcatcgctgtgtacgagaccgatgtgttcgtggtgggaactgaacgcggaagggcctttgttaatactcgcaaggacttccagaaggacttcgttaaatactgtgtggaggaagaagaaaaagcggcagaaatgcataagatgaagtccacaacgcaggctaataggatgtcagtggatgccgtagagatagagacgctgcgaaagacagtggaagactacttctgcttctgctacggaaaggctctcggaaaatcaactgtggttcccgtgccatacgaaaagatgctcagggatcagagcgcagttgtcgtccagggcctgcccgagggagtggcattcaagcaccccgagaactacgatctagccacattgaagtggattctcgaaaacaaggctggtatcagcttcattattaagaggcctttccttgaacccaaaaaacacgtcggtggccgtgttatggtgacagacgcagacagatcaattttgagcccagggggttcctgtggccccataaaagtcaagacagaacccaccgaagatagcggaatcagcttagagatggccgccgttaccgtgaaggaggagtcagaggatcccgactactaccagtacaacattcagggatctcaccatagcagtgaaggaaacgaaggcaccgagatggaggtgcctgcagaggacagcacgcaacacgtgccaagtgagacatccgaggaccccgaggttgaggtgacaatcgaggacgatgactacagccccccatctaagcggcctaaggcaaacgagctgccgcaacctcccgtacctgagccagctaacgctggtaagcgcaaggtgagggaattcaactttgagaaatggaatgcaaggatcaccgacctaagaaagcaggttgaggagcttttcgaaaggaaatatgcccaggctattaaagcgaaaggaccagtaaccatcccttaccccctgtttcaatctcacgtcgaggacctgtacgttgagggactgccggagggcattcccttcaggagaccgtctacatatggcatccctcggctggaaagaatattactggctaaagaaagaattaggttcgttatcaaaaaacacgagctcttaaactccacgcgcgaggacttacagctggataagcccgcttctggcgttaaggaggagtggtatgcacggatcacaaagttgcggaagatggtggaccagctcttctgcaagaaattcgccgaagctcttgggtcaacagaagccaaggccgtcccctatcaaaagtttgaggcccaccccaatgatctatacgtcgaaggactgcccgagaacatccccttccgtagtccatcttggtatgggatacctcggctggagaaaatcatacaggtgggcaaccgtatcaaattcgttatcaagaggccagagctgctcactcattctactactgaagtcacccagccacgtactaatactcctgtgaaagaggattggaacgtgaggattaccaaactacgaaaacaggtagaagaaattttcaacctgaagttcgcacaggcactgggattgaccgaggccgtgaaagtcccttatcctgtttttgaatccaacccagagttcttatatgtagaaggtctccctgagggcattccatttcgttctccgacgtggttcggaatcccccgtctcgaacgtattgtgagaggaagcaacaaaatcaagtttgtggtcaagaaacctgaactcgttatatcatacctgccaccaggaatggcgtcaaaaattaataccaaggctctgcaatctcccaagcgtcctaggtcacccggctccaactctaaggtgcccgaaattgaggttaccgtggagggtcccaacaacaacaacccacagacgtcggccgtgcgtaccccgacacagactaatgggagcaacgtgccgtttaagcccagagggagggaattcagtttcgaggcttggaatgcgaaaataactgatctcaagcagaaggtagagaatctgtttaatgaaaaatgtggggaggctcttggactgaaacaagcggtgaaggtgccgtttgcgctattcgagagttttcctgaggatttctacgtcgaaggcctgcccgagggcgtgcctttccggcggccttctacttttggaatacctcgtctggagaaaatcctgagaaacaaagcaaagataaaatttataatcaaaaaaccggaaatgttcgagacagctattaaggagtccactagcagcaagtctccacccagaaagatcaacagttctccaaacgtcaataccacagcttccggagttgaggatctcaatatcatccaggtgactatccccgatgatgacaatgagagactgtcaaaagtggagaaagctcgacagctgcgggagcaggtgaatgatcttttttctagaaaattcggggaagcaataggtatgggctttcccgtgaaggtgccttatcgtaagattacgataaatccagggtgtgtggtggttgatggtatgccgcccggagtgagcttcaaagctcccagctatttagaaatcagctctatgagacgcattttggatagcgccgaatttatcaagtttacagtgatccgtccattccctgggctggtcatcaataaccaactcgtggatcagtccgagtcagaaggacccgtgatccaagagtctgctgaacccagtcaactagaggtaccagctaccgaagagatcaaggaaactgatgggtcgtcccaaataaagcaggaacccgatccaacctggtag

SEQ ID NO: 118318 - DNA, 2874 bp, Artificial Sequence
  Description of Artificial Sequence: Synthetic coding sequence
atggctcaggttgccatgtccaccctgcccgttgaggatgaggagagcagtgagagccgaatggtggtgacttttctcatgtccgcccttgagtcgatgtgtaaggaactcgccaagtcaaaggccgaggtagcatgcattgcggtatatgaaactgacgtttttgttgtgggcaccgaaaggggacgcgcgttcgtaaatacacggaaggatttccagaaggacttcgttaagtactgcgtggaggaagaggagaaggccgccgaaatgcataaaatgaagagtactacacaggcaaatagaatgtccgttgacgctgtcgagatcgagacccttcggaaaaccgtggaggattacttctgcttctgctacggaaaagccctgggtaaatcgacagtagtgccggtcccctatgagaaaatgctgcgggatcagagtgcagtcgtggtccagggattgcctgaaggcgtggccttcaaacacccagaaaattatgacctcgcgacactgaagtggattctggaaaataaggctggaatctcctttattatcaagcgtccctttcttgaacctaagaagcatgtgggaggtagagttatggtcactgacgctgacaggtccattctatcacccggcggctcatgtggcccaatcaaggtgaaaactgaaccaaccgaggactcagggattagccttgaaatggcggcggtgactgttaaggaggaaagtgaagatcccgactactaccagtataacatacaggggagtcatcatagtagcgagggaaatgaaggcaccgagatggaagtccctgcggaggacgacgactacagtcccccatcaaagcgcccaaaggccaacgagctcccccagcccccggttcctgaacctgctaacgcgggaaaaaggaaggttagggagttcaattttgaaaagtggaacgccaggataactgacttaagaaagcaggtcgaggagttatttgagcgcaagtatgcccaggccatcaaggccaagggccctgtcactatcccttatccactctttcagtcgcatgttgaggacctctacgttgaggggctgccagaaggaattccttttaggagacctagcacgtatgggatccccaggctggagaggattttacttgcaaaggagcgcatcaggtttgtcatcaaaaagcatgaactgctgaattccaccagagaggatctgcagctggataagccagctagtggggtgaaggaagagtggtacgctcggattaccaaattgagaaagatggttgatcagctcttttgcaagaaatttgcagaagctcttgggtcaacggaggccaaggccgtcccatatcagaaattcgaggctcacccaaatgatctatacgtggaaggtctgcctgagaacatccccttcaggtccccatcctggtacgggatccctaggctggaaaaaatcattcaagtggggaaccgtatcaagtttgtgatcaaacgcccagagctgctgacacacagcacaacggaggttacgcaacctcgcactaacacccctgtgaaagaagactggaacgtccggatcacaaagctgaggaaacaggtcgaggaaatcttcaatctgaagttcgcacaagcgctgggcctcacagaggccgtgaaggtgccctacccagttttcgagtccaacccagagttcttatatgtggagggactccccgaagggatcccatttagatcgcccacctggttcgggatcccacggctcgagaggattgtgcgcggatccaataagatcaagttcgtggttaagaaacccgagctggtgataagctaccttccacctgggatggcgtccaagataaataccaaggcgcttcaatccccaaaacgccctcgctctcctgggagcaactccaaggtgcctgaaattgaggtcaccgtggaaggacctaacaacaataatcctcagactagtgccgtgcggaccccaactcaaaccaatgggagtaatgtgccttttaaacctagaggtagagaattctctttcgaagcatggaatgctaagattaccgacctcaaacagaaagttgagaatctgttcaacgaaaagtgtggagaagcactcgggctgaagcaggctgtgaaggtccccttcgcactgtttgaaagttttcccgaggacttctatgtggagggtctgcccgaaggagtgccttttaggaggcccagcactttcggaatcccccggcttgagaaaatcctgcgcaataaagcaaagatcaagttcattatcaaaaaacctgaaatgttcgaaactgccattaaagagagcacctcgagtaagtcacccccccgtaaaattaacagctcacccaatgtcaataccaccgcgtcgggggtagaggatttgaatattattcaggtaactatcccagatgatgacaacgaaaggctcagtaaggttgagaaagcacgtcaactgcgcgagcaagtgaacgacctgttttctaggaaatttggagaagccatcggaatgggctttccagtgaaagtaccatatagaaaaattacaattaacccgggctgcgtggtcgtggacggaatgcccccaggtgtctccttcaaagcccctagttacctggagatcagcagtatgcgaagaatactggactcagctgagtttataaagttcacagttatacggccatttccaggcctcgttattaacaatcagctcgtcgatcaatccgaatccgaaggcccagtgatccaagagagcgctgaaccctcccagctggaagttcctgctacggaggagataaaagagactgacggttcaagccagattaaacaagaaccagatccaacgtggtag

SEQ ID NO: 118319 - DNA, 321 bp, Artificial Sequence
  Description of Artificial Sequence: Synthetic coding sequence
atggcccaagtcgccatgagtactctccctgtagaggacgaggagtcctctgagagcaggatggtggtcacctttctgatgtccgctttggagtcgatgtgtaaggaactggccaagagtaaggccgaagtggcctgcatcgctgtctatgagacggatgtttttgttgtgggcaccgaacggggaagggcctttgtcaacacacgtaaagatttccagaaagattttgtcaagtattgtgtagaggaagaggaaaaagctgccgagatgcataagatgaaatccactactcaggccaatcggatgagtgtggatgcatag

SEQ ID NO: 118320 - DNA, 825 bp, Artificial Sequence
  Description of Artificial Sequence: Synthetic coding sequence
atggcccaagttgctatgagtacacttcctgtggaggacgaggagtccagtgaatccaggatggtggtgacgttcctgatgagtgccctggaatcaatgtgtaaagagctcgcgaaatcaaaagccgaagtagcttgtattgcggtgtacgagactgatgtgttcgtcgtaggaaccgaacgggggcgcgctttcgttaatacccgcaaagactttcagaaggatttcgttaaatattgcgttgaagaagaagagaaggccgcagaaatgcataaaatgaaatccaccacccaggccaaccggatgtccgtggatgcagtggaaatcgagactctccgcaagaccgtcgaagactacttctgtttctgctacgggaaagctctcggtaagtccactgtggtgccggtgccttacgagaagatgctgcgggaccagagcgcagtggtggtccagggcctgcccgagggcgtagccttcaaacatccagaaaactacgatctggcaaccttgaagtggatccttgagaataaagccggcattagctttattattaaacgcccctttctggagcctaagaagcacgtgggcggccgcgtgatggtcaccgatgcagaccgatctattctgagccctggcggctcctgtggaccgattaaggtaaaaaccgagcccacagaagacagcggcatctcgctcgaaatggctgcggtaactgtcaaagaggaatcggaggatccggactactaccagtacaacatccagggctctcatcatagtagtgagggaaatgaagggacagaaatggaggtgccagctgagggatag

SEQ ID NO: 118321 - DNA, 2982 bp, Artificial Sequence
  Description of Artificial Sequence: Synthetic coding sequence
atgtccaccctccctgtggaggacgaggagagctccgaatcgagaatggtggtcaccttccttatgtctgccctcgagagtatgtgtaaggagctcgcgaagtctaaagccgaggtggcgtgtatcgctgtgtatgaaaccgatgttttcgtcgttggcacagagagaggacgcgcctttgtgaacacacgtaaggattttcagaaagattttgtcaagtactgcgtggaggaggaagaaaaagctgccgaaatgcacaagatgaaatctacaacccaggccaaccggatgtcagtggatgccgtggagatagagaccctgaggaagaccgtggaggactacttttgcttttgttatggaaaggctttaggaaaatccacagtggtgcccgtgccttatgagaaaatgctgagagatcagagcgcggtggtggtccaaggactccccgagggggtagccttcaagcatccagagaactacgatctcgctaccctgaaatggattctggagaacaaagcgggcatcagcttcatcatcaaaaggccttttcttgagcctaagaaacacgtaggaggtagagtgatggtaactgacgctgatagatctatcctctcgcctggaggttcctgtgggccaattaaggttaagactgagcccacagaagacagcgggatctccctggagatggcagccgtcacagtcaaggaggagagcgaagatcccgattactatcagtataatattcaagcaggtccttccgagaccgatgacgtggacgaaaagcagcctctgtctaagcccctccagggaagccatcactcctccgaagggaatgaaggcactgagatggaagtgccagccgaggactccacgcagcacgtgccaagcgagacatcagaggaccccgaggtggaagtgacgatcgaggacgacgattattcccctccctctaagaggcctaaggcaaacgagcttcctcagccaccagtccctgagccggcaaatgccgggaagcggaaagttagggagtttaacttcgaaaaatggaatgcgcggattacagatttaagaaaacaggtggaggagctttttgagcgaaagtatgcccaagccattaaggccaaggggccagtgactattccataccccctctttcagtcccacgtggaggacctgtacgtcgaaggtctgccagagggaattccttttaggcggcctagtacctacggaatccctcggcttgagcgcatccttttggccaaggagaggataagattcgttatcaagaaacatgagcttctaaattccaccagagaggacttgcaactggataaacctgcctcgggggtaaaagaggaatggtacgcacggattaccaagctccgtaagatggttgaccagctgttctgcaagaagtttgccgaggcattgggttccaccgaggcgaaagctgtgccctatcaaaagtttgaagctcaccccaacgatttgtacgtcgaaggactcccagagaacattccttttagatctcccagctggtatgggatcccccgactcgagaaaattatccaggtgggcaaccgcataaaatttgttatcaaacggcccgaattgctcacccacagcacaaccgaggtcactcagccccggacaaacactccggttaaagaggattggaatgtgcgaattactaagcttcgaaagcaggtggaagaaatttttaaccttaagttcgctcaggccttaggattaacagaagctgttaaggtcccttatcctgttttcgagtccaatcccgaatttctatatgtggaggggttgccagaggggatcccgtttagaagtcccacttggttcgggataccacggttggaacggattgtccggggctcgaacaaaattaagttcgtcgtgaaaaagcccgagttagttattagctatctgccccccgggatggcaagtaagatcaacacgaaagctctccagagccctaagcggccccggagcccaggaagcaactcaaaggtgcccgaaattgaagtgactgttgaggggccaaataacaacaaccctcaaactagtgcagtgcggacacccacgcagaccaatgggagcaatgttccgttcaaaccccgggggcgtgaatttagctttgaggcatggaacgccaaaataacggacttaaagcagaaagtcgaaaacttgttcaacgagaaatgtggtgaggcgttgggcttaaaacaggctgttaaagttccatttgctctgtttgaaagctttccggaggatttctacgtggaagggctgccagagggtgtccccttcagacggccctccacatttggcatccctcgccttgaaaagattctaaggaataaggccaagatcaagtttattattaagaaaccagaaatgtttgagaccgctattaaagagagtacaagctcaaagtcacctcctcggaagattaacagttccccgaatgtcaacacgaccgcttccggagttgaggacctgaatataatccaggtgacaattcctgatgacgacaacgaacggttgagcaaggttgagaaggctcgccaactcagggaacaggtaaacgaccttttctccaggaaattcggagaagccataggaatgggattcccggtaaaggtgccatatcgcaagattacaattaacccaggctgcgttgtggtggatggtatgcctccaggagtatccttcaaggctcctagctatttggagatctctagcatgcgtaggatattggacagcgcagagttcataaagtttaccgtgatacgcccttttccagggctggtcattaataaccagctggttgaccagagtgagtcagagggacccgtcatacaggaatccgccgagccttcccagttggaagtccccgctacagaggagataaaggagaccgatggctcctctcagatcaagcaggagccggaccccacctggtag

SEQ ID NO: 118322 - DNA, 642 bp, Artificial Sequence
  Description of Artificial Sequence: Synthetic coding sequence
atggcagctgcagctgacgaaaggtccccagaggacggagaagatgaagaagaagaggaacagctcgtactggtcgaactctcagggattatcgactcagatttcctcagcaagtgtgagaacaagtgtaaagtgttggggatcgatacagaacggcctatactgcaggtggactcctgtgtgtttgctggggaatacgaggataccttgggcacatgcgtgatctttgaggagaatgtagagcatgcagacacagaagggaacaacaaaactgtgctcaaatataagtgtcacacaatgaagaaactctctatgactcggactctcctgacagagaaaaaagaaggggaggagaacatcgggggggtggagtggctccagatcaaggataacgacttctcctaccggcccaatatgatctgtaatttcctgcatgagaacgaggatgaagaggtagtagcatccgctccagacaaatccctggagttggaagaagaggagatccaaatgaatgattccagtaatctgtcatgtgaacaggagaagcccatgcatctagagatcgaggactcaggccctctaatcgatatcccttctgagacagaagggtccgtattcatggaaacacaaatgttgccatag

SEQ ID NO: 118323 - DNA, 2118 bp, Artificial Sequence
  Description of Artificial Sequence: Synthetic coding sequence
atggccactgaggggatgattctcacaaatcacgaccaccaaatccgggttggagtgctgaccgtttctgactcctgcttcaggaatctggcagaggaccgcagcggcatcaatttaaaggacttggtgcaggacccctccctgctaggcggaaccatatctgcctataagattgttcccgacgagatcgaagagataaaagctaccaaggaagtgattgaacgcgaggcccccgggatggccttggcgatgctcatggggtccttaaacgttacacctctgggcatgctttcacggcccgtttgcggcattcgtgggaaaaccctcattattaatctccccgggtctaaaaagggcagccaggagtgcttccaatttatccttcctgccttgccacacgctatagatctattgagggatgccatcgttaaagtcaaagaagtgcatgatgagcttgaagaccttccttcaccaccacctcctctgagtcctccacctacaaccagtcctcataaacagaccgaggataagggtgtgcagtgtgaggaggaagaggaagaaaaaaaggattccggagtggcatctactgaagactcctcttccagccacatcactgcagccgctatagccgccaagatccctgattccatcatctcccgcggtgtccaggtccttccccgggacaccgccagcctttccactacaccttcagaaagtcctcgcgctcaggcaacttcgcggctgagtacagcctcctgccccacccctaaagtgcagtctaggtgcagttctaaggaaaacatcctgcgtgcttcccatagtgccgtggacattactaaggtggctagacggcacaggatgtccccttttcccctcacctccatggataaagccttcataaccgtcttggagatgacccccgtgttgggcactgagattatcaattaccgagacgggatgggccgcgtgctagctcaggatgtgtacgctaaagacaatctccctcccttcccggcatctgtcaaagacggctacgccgtgcgggccgccgatggacccggagaccggtttataatcggggaaagccaggccggggagcagccgactcagaccgtgatgcccggacaggtcatgcgggtgacaactggcgctcccatcccatgtggtgctgacgccgttgtgcaggtggaagacactgaactgatcagagaaagtgacgacggaaccgaagagttggaagtgcgaattctggtccaggcccgtcccggacaggatatcaggcctattggccacgatattaagcgcggtgaatgcgtgctggctaagggcacccacatgggtccatcagagatcgggttattggcaactgtgggcgtgaccgaggttgaagtgaacaagttccctgtggtggcggtgatgagtacgggaaacgagttactcaatcccgaggacgatcttctgcccgggaaaattcgggatagcaaccggtcaactttacttgccaccatccaggagcacggatatcctactattaatttagggatagtgggcgacaaccctgacgatcttttgaatgcgctgaacgagggcatcagtcgtgccgatgttatcatcacaagcggtggagtgtcaatgggtgagaaagattatctaaagcaggtgctggacatcgatctacatgcacagatccactttggtagggttttcatgaaacctggccttccgacaacctttgctactttagacattgatggagtgcggaagattatttttgctctcccagggaatccagtgtctgccgtggttacttgcaatctgtttgtcgtgcctgccctacgcaaaatgcaaggcattttggaccctcgaccaactatcattaaggcccgcctaagctgtgacgtgaagctcgacccgcggcccgagtatcatagatgtatattaacatggcatcaccaggagccattaccctgggcacagagtaccggtaatcagatgtcgtccaggctgatgtcaatgcggagcgccaacggcctgttgatgttacccccaaaaactgaacagtacgtcgagcttcataagggcgaagtcgttgatgtcatggtaattggtcggctgtag

SEQ ID NO: 118324 - DNA, 2211 bp, Artificial Sequence
  Description of Artificial Sequence: Synthetic coding sequence
atggcaacggaggggatgatacttactaatcacgaccaccagattcgcgttggtgttctcactgtctcagactcgtgtttccggaatctggccgaagacagatctggcattaacctcaaagacctcgtgcaggacccatcccttttgggcgggacaatctcagcctacaaaatcgtccccgacgaaattgaggaaatcaaagaaaccttaatcgactggtgcgatgagaaggagctgaacctcatactgacaactggcggcaccgggtttgcaccaagagatgtaactccggaggccactaaggaggtgatcgagcgcgaggcacccggtatggccctcgccatgctaatgggctctctaaatgtaacacctctgggcatgttaagtcgacccgtatgcggcatcagaggaaagacactcattatcaacctcccaggaagcaagaagggaagtcaagaatgctttcagtttatcttgccagccctgccacacgccattgatctgctcagagacgccattgtgaaagtgaaggaggttcacgatgagctcgaggacttgccctcacccccgcctccattatcacctccccctacaacatccccccataagcagaccgaggacaagggtgtccagtgtgaagaggaagaggaggaaaagaaggactccggtgttgcatccactgaggacagttcgtcctcccatatcactgccgcggcgattgccgcgaaaatccccgattccataatttcgagaggagttcaggtgctacctcgggatactgcttctctgtccaccactccttcagagagcccgcgggcgcaggcaacctcacgactttccaccgcttcctgtcctacacccaaggtgcagtctaggtgttcatctaaagaaaacatactgagggctagccactccgctgtagacattacgaaggtggctcgaagacaccgcatgtcccccttcccgttgaccagtatggataaggccttcattacagttctggagatgacaccagtgctgggcactgaaataatcaattacagggacgggatgggcagagtgctggctcaagacgtgtacgccaaggacaacctccctccgttccctgcatcagtgaaagatggatatgctgttcgcgcggccgatggacccggggatcgattcatcattggcgagagtcaggctggggaacaacctacccagaccgttatgccaggacaggttatgcgagttacaacaggcgctccgatcccttgtggcgccgacgcagtggttcaggtggaagatactgagctgatccgggagtcagatgacggaacagaggaactggaggtaagaattttagtgcaggctcgcccaggtcaagacattagacctattggccacgacattaaacggggggagtgtgtcctggccaaaggcacacatatgggtcccagcgaaattgggttactagcaacggtgggcgtgactgaggtcgaagttaacaagtttcctgttgtcgcagttatgtccacaggtaacgagcttctgaacccggaggacgacttgctcccagggaaaatccgcgattctaataggagcactttgttagcgaccattcaggagcatggctatcccaccattaatctggggattgtgggagataatccggatgatctcttaaacgcactgaacgagggcatttcaagggccgacgtcataattacgtccggcggtgtatccatgggggaaaaggactaccttaaacaggtgttagacattgatctgcacgcacagatccactttgggagggtctttatgaaaccagggctgcctacgacattcgcaactttggatatagacggcgtgagaaaaataatatttgcacttcctgggaaccccgtttctgctgtggtcacatgcaatctcttcgtggtgccagctcttcgtaaaatgcaggggatcctggacccccggcctaccatcattaaggcccgacttagctgtgacgtcaagctggaccccaggccagagtaccaccgatgtatactcacttggcatcaccaagagccgttgccctgggcccagagcacaggaaaccaaatgtcatccagactcatgtccatgaggtctgcgaacggcctacttatgctcccccccaagaccgaacagtacgttgagcttcataagggtgaggtcgtggatgtcatggtcattggcagactgtag

SEQ ID NO: 118325 - DNA, 2310 bp, Artificial Sequence
  Description of Artificial Sequence: Synthetic coding sequence
atggctaccgaaggaatgatattgaccaaccacgatcatcagatccgagtaggtgttttgaccgtcagtgactcctgctttagaaacctggccgaggataggtcaggtatcaacctgaaggatttagtgcaagatcccagcctgttgggcggtacgatctccgcctataagattgtgccagacgagattgaagagataaaagagactttgattgattggtgcgacgagaaagagctgaatctgatcttgaccaccggcggcacaggattcgcccctagggatgtcaccccagaggccactaaggaggttatcgagagagaggcacctggaatggctctcgcaatgctaatgggctccctcaatgttacccctctaggaatgttgagcaggcccgtttgtggtatccgcggtaagaccctgattatcaatctccctgggagcaagaaggggtctcaagaatgtttccagtttattcttccggccttgcctcacgcaattgacctgctccgggacgctatagtgaaagtgaaagaagtccatgatgagttggaggaccttccctccccccctccacccttaagccccccaccaactaccagcccccacaagcagactgaggataagggtgtccagtgcgaggaggaggaagaggagaaaaaggatagtggcgtggcctccactgaggactccagctccagccatattaccgccgctgcaatcgcagcgaagaaacaccccttctatacgagccccgctgttgtgatggcacacggcgaacagcccatcccaggcctgattaattacagccaccactccaccgatgaaagaatccctgactccattatctctaggggtgtgcaggtcctccccagggataccgccagtttatccacgactccttccgagagcccacgcgcacaggcaacatcacgcctgtcgaccgcatcctgtcctacgcccaaagtccagtcccggtgctcttctaaggaaaatatcctcagggctagtcatagtgcggtcgacatcaccaaggtggccaggaggcacaggatgagcccatttcccttaacatctatggataaggcgttcatcacggttttagaaatgaccccagtactcggcacagagattattaactatcgcgatggcatgggcagagtgctggctcaggatgtttacgccaaggataatcttccacccttccccgcttctgtgaaagatggctacgccgtacgggccgctgacgggcccggcgaccggtttattataggggaatcacaagcgggggagcagccgacacagacggtcatgccagggcaggtgatgcgggtcacaacaggtgcaccgatcccatgcggggcagacgccgtggtgcaggtggaggatacagaattaattcgcgagtcggatgacggcacagaagagctcgaggtacggattctggtacaggctagacccggtcaggatatacgccctatcggacacgacatcaagcggggggagtgtgttctggccaaggggacacacatgggcccctctgaaatcggccttttagccactgttggggtgacagaggttgaagtgaacaaatttccggtggttgccgtgatgagcaccggtaatgaactgctcaaccctgaggatgatctgctgccagggaagatccgcgattctaaccgtagtaccctcttagccaccattcaggaacacggataccctacaattaatcttggcattgtcggcgataatcccgacgacctgctgaacgccttgaacgaggggatcagccgggctgacgtcattataaccagcggcggtgtgagtatgggggagaaagattatctgaaacaggtgctggacatcgacctgcatgctcagatccactttggcagagtctttatgaaaccaggcctccctacgaccttcgctacattagacatcgacggcgtcagaaagattatttttgctttgcccgggaatccagtctccgcagttgtgacttgtaacctgtttgtagtgcctgcactccgaaagatgcagggcatcctggacccccggcccactatcatcaaagcccggctgtcatgtgacgtgaaactggacccgagacccgagtatcacagatgcatcctcacatggcaccaccaggaaccactaccatgggcacaatctaccggtaaccagatgtcgagcagactcatgagcatgcggagcgctaatgggctcctgatgcttccccctaaaacagaacagtacgtcgaactgcacaaaggagaggtagtcgatgttatggtcatcgggaggctgtag

SEQ ID NO: 118326 - DNA, 903 bp, Artificial Sequence
  Description of Artificial Sequence: Synthetic coding sequence
atggagaaaacgcaggagactgtgcagcgcattctgctcgagccatataaatacttgctgcagctgcccgggaagcaggttcggaccaagctgagtcaggccttcaaccactggttaaaagtgccagaggataagcttcagatcattatcgaggtgaccgaaatgctgcacaacgcctcactgctgatagacgatatcgaggacaacagcaagctaaggcggggtttcccggtcgcacactcgatctacgggatacctagcgtcataaattccgcgaattacgtgtatttcctggggcttgaaaaagtactgacacttgaccatcccgatgcggtcaagctgttcacacggcagttgctcgagctccatcagggccagggcctggacatatattggcgggacaattacacatgtcctactgaagaggagtataaggcaatggtgttgcagaagacgggtggactctttggcctggcagttggcctgatgcagctgttctccgactataaagaggacctcaaacctctcctgaataccctgggtttgttctttcagattagggatgattacgccaacttgcactccaaagagtacagtgaaaataagtccttctgcgaggacttgacagaaggtaaattctcattcccgaccatccacgctatctggtccaggccagagagcacacaagttcagaacatcctgagacagaggacagagaacattgacatcaagaagtactgcgttcattatctggaagatgtcggcagttttgaatatacccggaacactcttaaggaacttgaagctaaggcttacaaacagatcgacgctaggggcgggaaccctgagctggtagctctggtgaagcaccttagcaaaatgttcaaggaggagaatgaatag

SEQ ID NO: 118327 - DNA, 903 bp, Artificial Sequence
  Description of Artificial Sequence: Synthetic coding sequence
atggaaaagacacaagagacggtgcaaagaatcctgctagaaccatacaagtatctgcttcagctgcctgggaagcaggttaggacaaaattaagccaggctttcaaccattggttaaaggtccctgaagacaaattgcagattatcattgaagtgactgagatgcttcacaacgcaagtctgcttatcgacgacatcgaggataacagtaagctccgaagaggcttcccagtggcccactcaatttatgggattccctcggttatcaattctgccaactatgtatattttctcggtctggaaaaagttctcaccctagatcacccggatgctgtcaagttgtttacacgtcagttactggagctacaccagggacagggtctggacatatattggagagataactatacatgtccaacagaagaagagtataaggcaatggtgctgcaaaagaccggggggctgtttgggctcgcggttggccttatgcagctgttcagcgattataaagaggatctcaagccacttctcaacacgcttggactgttttttcagatccgggacgattatgctaatctgcactccaaggagtactcggagaacaaatcattttgtgaggaccttaccgaaggcaaattttcctttcctactatccacgccatctggtcgagacccgaatcaacacaagtgcagaatatcctgcgtcagcggacagaaaacattgatattaagaagtattgtgtgcactacctcgaggacgttggctctttcgagtacacccggaacactttaaaagagctggaagctaaggcttacaagcagatagatgctaggggcggaaatcctgagctagtcgctctagtcaagcatttatcaaaaatgtttaaggaagaaaacgagtag

SEQ ID NO: 118328 - DNA, 729 bp, Artificial Sequence
  Description of Artificial Sequence: Synthetic coding sequence
atggagaagacccaggagaccgtacaacgcatccttttagagccttacaagtatttactgcaacttccaggaaagcaggtccgtacaaagttaagccaggcgttcaatcactggcttaaagttccagaggacaaactgcagattataatcgaggttacagaaatgttgcacaacgcttctctgctgatcgacgacatcgaggacaatagcaagctgagacgcggcttccccgtggcccacagcatctatggtataccttccgtaattaacagtgcaaattacgtatatttcctagggttggaaaaagtcctgacgctagaccatccagacgcagtgaaactgttcactagacagctgttagagctgcaccaggggcagggcctggatatctattggcgggacaactacacctgtccaacagaggaggagtacaaagctatggtgctgcagaaaacaggcggcctctttgggctcgctgttggcctgatgcagctgttcagcgattacaaagaggacctgaagcccctcttaaacactctggggttgttcttccaaatcagggatgattatgcgaatctccacagcaaagagtactccgagaacaaatccttctgcgaagacctgaccgagggcaagttcagtttcccaaccatccatgctatatggagccgtccagaatccactcaagtgcaaaatattctcaggcaaaggacagaaaacatcgactag

SEQ ID NO: 118329 - DNA, 903 bp, Artificial Sequence
  Description of Artificial Sequence: Synthetic coding sequence
atggagaagacgcaggaaacagttcagcgtattctgctggagccctacaagtatctactccaactgcctgggaagcaggtgcggacaaagctcagtcaggcatttaatcattggcttaaggtgcctgaagacaaattgcagatcattattgaagtcactgagatgctacataacgcctctctgcttatcgatgatattgaggataacagtaaactccgaagaggtttcccggtggcccactccatctatgggattccatctgtgataaactcggctaactacgtgtattttctggggctcgagaaggttttgacattagatcatccggatgctgtaaagctttttacacggcagcttctcgaactacatcagggacagggcctcgatatctactggcgagacaattatacgtgccctaccgaggaagagtataaggccatggttttgcaaaaaactggtgggttgtttggcctggccgtaggactgatgcagctgttttccgattacaaggaagaccttaagcccctgctcaacaccctggggctatttttccagatccgcgacgactatgcaaacttacatagcaaggagtattccgaaaataagtccttttgcgaagacctcaccgaggggaaattctccttccccacaatacacgcaatatggagccggccagagtccacgcaggtgcaaaatatccttcgtcagagaaccgagaatatcgatatcaaaaaatactgtgtccactacttggaagatgtgggcagctttgaatacacaaggaacaccctcaaagaactagaggccaaggcctataaacaaatcgatgcccgcgggggaaaccccgagctggtagcattggtgaaacacctctctaaaatgtttaaagaagagaacgaatag

SEQ ID NO: 118330 - DNA, 903 bp, Artificial Sequence
  Description of Artificial Sequence: Synthetic coding sequence
atggagaagacgcaggagaccgtccagcgtatcttgctggagccgtataaatatcttcttcagttgccagggaaacaggtccggaccaaattaagccaggcttttaaccattggctgaaagtgcctgaagacaagttacagatcattattgaagtaaccgagatgctccataacgcctctctgcttatcgacgatattgaagacaactcaaagttgagacgcggatttcccgtcgcacacagcatctatggcattccgtccgttataaactccgccaactatgtgtacttcctgggtcttgagaaagtccttactcttgaccacccagacgccgtgaagctgttcaccaggcaactcctggagctgcatcagggccagggcctggacatctactggagagataattatacttgtcctactgaagaggagtacaaagcgatggttttgcagaagaccggagggctatttggcctggccgtcggtcttatgcaactgttctccgattataaagaagatctcaaacccctactgaataccctcggcctattctttcaaattcgggacgattacgctaacttgcactccaaagaatatagtgagaataagtccttttgcgaagacttgaccgaagggaaattctctttccccactatccacgccatttggtcacgacccgaatccacacaggtgcagaatatcctgcgccagaggacagaaaatatcgacatcaaaaaatattgcgtccattacttggaggacgtggggagttttgagtacactagaaatactttaaaggagctcgaggcgaaggcctataaacagattgacgcccgcggaggcaatccagaattggtcgccttggtgaagcacttgagcaagatgtttaaggaagagaatgagtag

SEQ ID NO: 118331 - DNA, 693 bp, Artificial Sequence
  Description of Artificial Sequence: Synthetic coding sequence
atggagaaaacccaagagaccgttcagcgcatcctcctggaaccttataagtatttgcttcagctaccaggtaagcaggtgcgtacaaagctctcacaggccttcaaccactggttgaaggtaccggaagacaagcttcaaattatcatagaggtgaccgagatgctacacaatgcctccttgttaattgacgacatcgaggacaatagcaaactgcggagaggctttcctgtggcacactccatctacgggatcccatccgtcattaactctgcaaattacgtgtactttctgggactggagaaagtcctaacactggaccacccggatgcagtgaagctctttacccgccagttgctcgaacttcaccagggacaggggcttgatatctactggcgtgataactacacttgtcccaccgaggaagaatacaaagccatggttttgcagaagaccggcggactttttgggttggctgtgggcctgatgcagctgtttagcgactataaagaagacctaaagcctctcctgaataccctgggtctgttctttcagattcgagacgactatgcgaatctgcactccaaggaatattctgaaaataagtctttttgtgaagatcttactgaaggaaaattctctttccctaccatccacgccatttggagtaggcccgagagtacccaggtctag

SEQ ID NO: 118332 - DNA, 537 bp, Artificial Sequence
  Description of Artificial Sequence: Synthetic coding sequence
atggggaattcattactgcgagaaaaccgaaggcagcagaacacccaggaaatgccgtggaacgtgcgcatgcaaagcccaaaacagcgtacatctagatgctgggaccaccacatcgcagaagggtgtttctgtctgccctggaagaaaattctgatcttcgagaagcggcaggattcccagaatgaaaacgagaggatgagctccacgcccattcaggacaatgtggaccagacctacagcgaggagctgtgttacacgctcataaatcatagagtgctgtgtaccaggcccagtggaaatagtgccgaagaatactacgaaaatgtgccgtgcaaagctgagcggcctagggagtccctgggaggcactgagaccgagtattctctgctgcacatgccaagcacagaccctcgtcatgctcggagtccagaagacgagtacgaactgttgatgccccacagaatcagcagccacttcctgcagcagccacgacctttgatggccccgagcgaaacgcaattctctcatctgtag

SEQ ID NO: 118333 - DNA, 492 bp, Artificial Sequence
  Description of Artificial Sequence: Synthetic coding sequence
atgggtaacagcctgcttagggagaatagacggcagcagaacacccaagaaatgccatggaatgtgcgtatgcagagtccaaagcagcgcacgtcacggaaaaagatccttatttttgagaaacgccaggacagtcagaacgagaacgagaggatgagctcaacacctatacaggataacgtggaccagacctactccgaggagctctgttataccctcataaaccatcgtgtgctctgtaccagacccagtggcaacagcgccgaggagtattatgagaacgtcccatgcaaggcagaacggccacgagaatccctaggaggtacagagaccgagtattctctgcttcacatgccatcaaccgatccacgtcatgcgagaagcccagaagatgaatacgagttgctgatgcctcatcggataagcagccacttcctacagcagccgaggccattgatggctccatccgagacacagttttcacacctgtag

SEQ ID NO: 118334 - DNA, 543 bp, Artificial Sequence
  Description of Artificial Sequence: Synthetic coding sequence
atgggtaacagtctgctgagggagaatagctttagaaggcaacagaacacacaggagatgccttggaatgtgcggatgcagtctcccaaacagagaacttccagatgctgggatcatcatattgccgaagggtgcttttgtttaccctggaagaagattttgatatttgagaagcgccaagactctcagaacgagaatgaaaggatgagtagcaccccaatccaggataatgttgaccagacatattcagaggaattgtgttacactttaatcaaccacagggtgctgtgtactcgccctagtggaaatagcgctgaagaatattacgaaaacgtcccctgcaaggccgagcgcccgcgggagagccttggtgggaccgaaactgagtattcactgcttcacatgccttccacagatccaaggcacgcgcggtccccagaggacgagtatgagctcttgatgcctcaccggatctcttcccactttctgcaacagcccaggccactaatggcaccatccgaaacgcagttttcccacctttag

SEQ ID NO: 118335 - DNA, 351 bp, Artificial Sequence
  Description of Artificial Sequence: Synthetic coding sequence
atgccttctcccggtacagtgtgttccctcctgttgctggggatgctgtggctggacctcgccatggccgggagttccttcctcagcccagaacatcagagagtacagaggaaagaatccaaaaagcctcccgccaaacttcaaccacgcgccttagccggctggctgcgtcccgaagacggcgggcaggctgaaggcgccgaagatgagttggaagtgcgttttaatgctccctttgacgtgggaattaagctaagtggcgttcagtatcaacaacattcacaagccctcgggaaattcctgcaagacattctttgggaggaggccaaggaagcccccgccgacaagtag

SEQ ID NO: 118336 - DNA, 354 bp, Artificial Sequence
  Description of Artificial Sequence: Synthetic coding sequence
atgccttctccagggacggtgtgttcgctactgttgcttggaatgctatggctagaccttgctatggcgggctcatctttcctgtccccagagcaccagagggtacagcagcgcaaggaatccaagaaaccgcccgccaaactgcaaccacgcgccttggctgggtggctccggcccgaagacggcggccaggctgagggcgccgaagatgagctagaggtgaggtttaatgcacccttcgatgtgggcatcaagctgtcgggggtccagtatcagcagcactctcaggcattggggaaattccttcaggatattctctgggaggaggctaaggaggctccggccgacaaatag

SEQ ID NO: 118337 - DNA, 276 bp, Artificial Sequence
  Description of Artificial Sequence: Synthetic coding sequence
atgcccagcccgggcactgtttgctcccttctgctcctcggcatgctgtggcttgaccttgcaatggccggctcatcatttttgtcgccggaacatcagcgggttcagcaacgaaaagaaagtaaaaagcccccagctaagttgcagcctcgagctctggctgggtggttacgccccgaggacggcggacaggccgagggagcagaagacgagttggaagtccgccgaccccagcccacaagtgatagaccccaggctctcctgacaagcctatag

SEQ ID NO: 118338 - DNA, 102 bp, Artificial Sequence
  Description of Artificial Sequence: Synthetic coding sequence
atgccctcacctgggaccgtgtgctccctgctgctgctgggtatgctgtggttagatctggctatggctgggagctcctttctcagccctgaacaccagtag

SEQ ID NO: 118339 - DNA, 354 bp, Artificial Sequence
  Description of Artificial Sequence: Synthetic coding sequence
atgccgagtccaggaacggtctgtagtttgcttctcctgggcatgctttggctggacctggcaatggccggctcttcttttttgtctcctgaacaccagcgagttcagcagagaaaagagtctaaaaagcctcccgccaaattgcaaccgagggccctagctggctggctgcgccccgaggatgggggacaggcggaaggcgctgaggatgaactggaagtcaggtttaacgccccgtttgatgtgggcattaaactgtccggcgtgcagtatcagcagcactctcaggccctgggaaagttcttgcaagacatcttgtgggaggaagccaaagaggccccagccgacaaatag

SEQ ID NO: 118340 - DNA, 351 bp, Artificial Sequence
  Description of Artificial Sequence: Synthetic coding sequence
atgcccagccctggaactgtgtgtagtctgctcctattgggaatgctctggttggatctggcaatggcgggctccagctttctgtcacctgagcaccagcgtgtccagcggaaggagtctaagaagcccccagccaaattgcagccccgcgccctggcgggctggctgagacctgaagacggcggtcaagctgagggcgccgaagatgagttggaggtgagattcaatgcacccttcgacgtagggatcaaattgtctggcgtgcagtatcagcaacactcccaagcgttaggaaaatttctccaggacatactgtgggaagaggctaaggaagccccagctgataagtag

SEQ ID NO: 118341 - DNA, 318 bp, Artificial Sequence
  Description of Artificial Sequence: Synthetic coding sequence
atgttcacctgttggtggtcctatcttcgtagcactctcgccgccgtgccgggcgaagcatcccgcgttcagcaacgcaaagaaagcaagaaaccccccgcaaaattgcagccccgcgccctggcaggatggctccgcccagaagatggtggacaggcagagggggctgaagacgagctggaagtgcgcttcaatgcaccttttgatgttggcatcaagctcagcggggtccagtaccaacagcatagccaagccctgggcaagtttctgcaagatattctgtgggaggaagccaaagaagcacccgctgacaaatag

SEQ ID NO: 118342 - DNA, 201 bp, Artificial Sequence
  Description of Artificial Sequence: Synthetic coding sequence
atgtttacttgctggtggtcataccttagatctaccctcgctgccgttcccggagaggccagccgggtgcaatttaacgccccatttgacgtaggtatcaagctttcaggggtgcagtaccagcagcactctcaggcgctgggaaagtttctgcaggacatcctgtgggaggaagctaaggaagcacctgccgacaagtag

SEQ ID NO: 118343 - DNA, 315 bp, Artificial Sequence
  Description of Artificial Sequence: Synthetic coding sequence
atgttcacgtgctggtggagctaccttaggtcaaccctggccgccgtgcccggggaagcaagccgtgttcaacggaaggagagcaaaaaacctccggcaaaattgcaaccaagggcccttgctggctggctgagaccggaggatggagggcaggcagagggagccgaagacgagctggaggtccgctttaacgctcctttcgatgttggtatcaaattgtcgggcgttcaatatcagcagcactctcaggcactcgggaaatttctgcaggatatcctgtgggaggaggccaaagaggccccagcggacaagtag

SEQ ID NO: 118344 - DNA, 351 bp, Artificial Sequence
  Description of Artificial Sequence: Synthetic coding sequence
atgccgagccctggcaccgtctgtagcctcctgttgctcgggatgttatggcttgatctggccatggccggatcatcattcctctcaccagaacatcaacgcgtccagcgtaaggagtccaagaaaccacctgctaaactccagccgcgggccttggccggctggttgcggcccgaagatggcggtcaggcggaaggggcggaagacgaactggaggttaggtttaacgctccctttgacgtgggcatcaagctgtccggggtgcagtaccagcagcactcacaggcgctgggcaagttcctgcaggatatattgtgggaagaggcaaaggaggctcccgctgacaagtag

SEQ ID NO: 118345 - DNA, 354 bp, Artificial Sequence
  Description of Artificial Sequence: Synthetic coding sequence
atgccctctcccggcactgtctgctcccttttactactgggaatgctgtggctcgacctggctatggccggcagcagttttctgagtcctgagcatcaacgtgtgcagcagcggaaagaatctaaaaaaccacctgcaaaattgcagccccgggcgctggcaggctggttgcgccccgaggacggtgggcaggcagagggcgcagaggatgaactggaggttaggtttaatgcgcctttcgacgtggggatcaagttatctggcgtacagtaccaacaacactcccaggctcttgggaagttcttacaggacatcctgtgggaggaggctaaggaggccccagctgataaatag

SEQ ID NO: 118346 - DNA, 354 bp, Artificial Sequence
  Description of Artificial Sequence: Synthetic coding sequence
atgcccagtcccgggacagtgtgctccctcctgctattagggatgctatggctggacctggctatggctgggtcatccttcctgagtcctgaacaccaacgggtgcaacaaagaaaggaatctaagaagccaccagctaagttgcagcctcgggctctggctgggtggctgcgccctgaggacggcggtcaagctgaaggcgcagaggacgaacttgaggtgcggtttaacgcccccttcgacgtgggcattaaactgagcggagttcagtatcagcaacattcccaagcgctcggcaaatttctacaggacattctctgggaggaggccaaagaggctccagccgacaaatag

SEQ ID NO: 118347 - DNA, 1794 bp, Artificial Sequence
  Description of Artificial Sequence: Synthetic coding sequence
atggcagagggttctgcagtctctgacccccagcacgccgccaggttactccgcgctttgtccagcttccgggaagaatcacggttctgtgatgcacatcttgtgctggatggagaagaaataccagtgcagaaaaacatcctggcagctgcttcaccatacattagaactaaactcaactataatccccccaaggacgacgggagcacatacaagatcgaactcgaaggaatctccgtgatggtgatgagggaaattttagactacatctttagtggacaaattaggctcaacgaggacaccatccaggacgtcgtgcaggcagccgatctcctgctgttaaccgatttgaaaactctgtgttgtgagtttttggaaggctgtattgccgctgagaattgtattggaatccgggattttgccctacactactgtctgcaccacgttcactacctcgcgacggagtacttagagacgcacttccgtgacgtaagctctaccgaagaattcctcgaactcagtccccagaaattgaaagaagtgatctccctcgagaaacttaatgtcgggaacgaacgctacgtgtttgaggcggtgattaggtggattgcccacgacactgaaatcaggaaggtccatatgaaggacgtgatgagcgccctgtgggtctcaggcctggatagttcctatctgcgtgagcaaatgttaaatgaaccactggttagagagattgtgaaagaatgctccaatatccctctcagccagcctcaacagggggaggcaatgctggccaattttaaaccccgaggttacagcgaatgtatagttactgttgggggcgaggaacgcgtgagccggaaacccaccgctgccatgcgctgtatgtgcccgctgtacgaccctaacaggcagctgtggatagaactggccccactgtcaatgccgagaataaatcacggcgttctgagcgccgaggggttcttgttcgtgtttggaggccaggatgaaaacaagcaaacattgtcaagcggagaaaaatatgacccagacgctaatacttggactgccttgccccctatgaacgaagccaggcataatttcgggattgtggaaatcgacggaatgctgtacattctgggaggcgaagatggtgagaaagaattaatttctatggagtgttatgacatctatagcaaaacatggactaaacagccagatttgacgatggtacgtaaaatcggatgttatgcagccatgaagaaaaagatctatgccatgggaggtgggtcctatgggaagttgtttgaatcggtggaatgctacgatccaagaacacagcagtggacagcgatctgccctttgaaagagagacggtttggcgctgtggcttgcggagtggcaatggagctgtatgtgtttgggggcgtgaggtccagagaggacgcccagggtagtgagatggtgacttgcaagagcgaattctaccatgatgaattcaaaagatggatttatttaaacgatcagaatctgtgtatcccagcttcgagcagctttgtttatggggccgtcccaattggcgcctcaatttacgtgatcggcgatctagataccggcactaactacgattatgtcagagagtttaaaagatctaccggcacttggcaccacacaaagccgttgctgccttccgatctgaggaggactggctgcgctgctctccggatagcgaactgcaagctattcaggctccaactgcagcaggggctttttcggatccgcgttcactccccttag

SEQ ID NO: 118348 - DNA, 591 bp, Artificial Sequence
  Description of Artificial Sequence: Synthetic coding sequence
atgttctgcgaaaaggctatggaactaattcgtgaactgcaccgtgcacccgagggccagctcccagcgttcaacgaggatggcttgcggcaagtgcttgaagaaatgaaggctctctatgaacagaaccagtctgatgtgaatgaggcaaaaagcgggggtcggtctgacctaattcccacaatcaagttccgtcactgttccctgctcaggaaccgacgatgtactgtggcatacctttacgacagactcttaagaatacgcgccctgcgttgggagtatggctctgtgctgccaaacgctctgcggttccatatggccgccgaggaaatggaatggtttaataactataagcggagcctggccacatacatgagatccctaggcggggatgaaggtctggacatcactcaagatatgaaacctcctaagtctctgtacatagaggttcggtgcttgaaagactatggggagtttgaagttgatgatggaacctctgtgcttttgaagaagaacagccagcacttcctgccgcgatggaagtgtgagcagctgataagacaaggcgttctggaacatatactttcctag

SEQ ID NO: 118349 - DNA, 498 bp, Artificial Sequence
  Description of Artificial Sequence: Synthetic coding sequence
atgttttgtgagaaagcaatggagctcatcagagaactgcatagggcccccgagggccagctgccagcttttaacgaagacgggctgaggcaggtgctggaagagatgaaggccctgtatgagcagaatcagagtgatgtaaacgaggctaagtctggaggtcgatccgacctgattcccacaatcaagttcagacattgttccctgctgcgcaaccggaggtgtaccgtggcatatctgtacgaccgtctgctgcgaattagggctctgcggtgggaatatggcagtgtgctgccgaatgcgttgagattccacatggcagccgaagagatggagtctagatctgttgcacaggcgggcgttcagtggtgtattttatgttccctccaacttcctcctcctggattcaagcagttttcctgtctgagcctcccatccagctgcgattatagatggagcgggttgattatcattaaggacttgctgctgctgatttag

SEQ ID NO: 118350 - DNA, 558 bp, Artificial Sequence
  Description of Artificial Sequence: Synthetic coding sequence
atggatgccgctgaggtcgaattcctggcagagaaagagctcgttaccatcattcctaacttctcactggataaaatctatcttatcgggggcgacctaggaccgttcaatccagggctaccggtggaggtgcccctttggttagccatcaatctgaagcaaagacagaagtgccgcctgctccccccagagtggatggacgtcgaaaagctggagaaaatgcgagaccatgagcggaaagaggagacctttaccccaatgccaagtccatactacatggagcttactaaactgctgttgaatcacgcaagcgacaatattcccaaggccgatgagatccggaccctcgttaaggacatgtgggacacgcgtattgccaagcttcgggtctccgcagattcatttgtaaggcaacaagaggcccatgccaagttggataacttgactttaatggagatcaacacatctggcaccttcttgacgcaggcgctgaaccatatgtacaagctcagaaccaacttacagccgttggagtccactcagagtcaggatttctag

SEQ ID NO: 118351 - DNA, 651 bp, Artificial Sequence
  Description of Artificial Sequence: Synthetic coding sequence
atgtcggaggcgtacttccgcgtggagagcggcgcacttggtcccgaggaaaattttctgtctctggacgacattctaatgtcccacgaaaagttaccagtgaggacagaaaccgctatgccccgcctgggagcattctttcttgaaagaagcgcaggtgccgaaactgacaacgccgtgccacaaggctctaagctggaacttccactctggctcgcaaagggtcttttcgacaacaagcggagaatcctctcagtcgagctcccgaaaatctatcaggaagggtggagaacggtcttctccgccgacccaaacgtggtggacctgcataagatgggaccccacttctatggtttcgggtctcaactgctgcacttcgatagccccgaaaatgctgatatttcacagagcctgttgcagacctttatcgggcggttcagaaggatcatggattcttcacaaaacgcttacaacgaagacaccagcgcgcttgtggcgcgcctcgacgagatggagcgaggactatttcagactgggcagaaaggtctgaacgattttcaatgttgggagaaaggccaggcctctcaaataactgcgtcgaatcttgtccagaattacaagaaacgcaaatttactgatatggaggactag

SEQ ID NO: 118352 - DNA, 417 bp, Artificial Sequence
  Description of Artificial Sequence: Synthetic coding sequence
atgagcgaagcatacttcagagtggaatccggtgccctggggcctgaagagaactttctttctctcgacgacatcctgatgtctcatgaaaaactcccagtgcgaacagagactgcaatgccacgcctcggagcatttttcttggaacgctctgccggtgccgagactgacaacgccgtaccacaaaccttcatcggccggtttagacgcatcatggactcaagccagaacgcgtacaacgaagacacttcagccctggtggctaggctggatgaaatggagcggggattgtttcagactggccagaaagggctgaacgatttccaatgttgggagaagggccaagcctctcagattaccgcttcaaatttagtccagaactacaaaaaacgcaagttcactgacatggaggattag

SEQ ID NO: 118353 - DNA, 768 bp, Artificial Sequence
  Description of Artificial Sequence: Synthetic coding sequence
atgagtgaagcatattttcgtgtggagtccggtgctttgggcccagaagaaaattttctcagcctcgatgatattctcatgagccatgaaaagctcccggtgagaaccgagacggctatgccaagactgggtgccttttttctggaaaggtctgctggagccgagaccgataacgccgttccgcagggttttgccctgctgccacgcctagagtgctctggggtcatttggctgaccgccgcattgacgtctcaggcacctgagatcctgcccccgcagccaccgatgtggcttgtgcttcagggatctaagctcgaattgccgctgtggctggctaagggactgtttgacaacaaaaggcgtatcttgtcggttgaactgcctaagatctatcaagaaggatggcggacggtatttagtgcagacccaaacgtcgtagacctgcataagatgggcccacacttctacggctttggatcgcaactcctacacttcgattctcctgagaacgccgacatctcccagtccttgctccaaacattcataggcaggttcaggcgcatcatggattcgagccaaaacgcatataatgaagacacatccgctctggtggccagattagatgaaatggagaggggactctttcagactggacagaaaggtctgaacgactttcaatgctgggaaaagggacaagcttcccagattacggctagcaaccttgttcaaaattacaaaaagagaaaatttacagatatggaagactag

SEQ ID NO: 118354 - DNA, 672 bp, Artificial Sequence
  Description of Artificial Sequence: Synthetic coding sequence
atgacagaagaggttgacttcttaggccaagactctgacggcggaagcgaggaggtggtgctaacccctgcggaactgatcgagcggctggagcaggcctggatgaatgagaagttcgctcctgaattgcttgagagcaagccagaaattgtagagtgcgttatggaacagctcgaacacatggaggaaaatttgcgcagagcaaaacgggaagacctcaaggtgtcaattcaccagatggagatggagcggattagatatgtgctgtcaagctatcttcgatgcagactcatgaagattgaaaagttcttcccccacgtgcttgagaaggaaaagacacggccagaaggcgagccgtcctccctctcgcctgaagagcttgcattcgcccgtgagttcatggctaacactgagtcatacctgaaaaatgtggccctgaagcacatgccacctaacctgcagaaagtggatctctttcgagcggtgccaaaaccagatctcgactcctatgtttttttacgagtcagagagaggcaggaaaacatcctggttgaacctgacacagatgagcagagggactacgtgatcgatctcgaaaaggggtcacaacatctgatccggtataaaacgatagcccccctcgtggcctcaggagcagtgcaattgatttag

SEQ ID NO: 118355 - DNA, 672 bp, Artificial Sequence
  Description of Artificial Sequence: Synthetic coding sequence
atgactgaagaggtcgatttcctgggccaggattcagacggaggttcagaggaggttgtgctgacccccgcagaattaattgaacgcctcgaacaggcctggatgaatgagaaattcgctccggagctgcttgaatcaaagccagagattgtggaatgcgtgatggagcagctggaacatatggaggagaaccttaggagagccaagcgagaggacctgaaagtttccattcatcagatggagatggaacgcattagatacgttctttcgtcatatttgagatgcagactgatgaagatagaaaagttcttccctcacgtgcttgaaaaggaaaagacccgcccagaaggcgaaccgagtagccttagtccagaagagcttgctttcgcccgcgagtttatggctaatacagagtcataccttaagaacgtggcactgaaacatatgcctcctaacttacagaaagtggacctgttccgggcagtgcccaagcctgatctggacagctacgtgtttctcagagtccgggaaagacaagagaatattttagtcgagcctgatacagacgagcagagagactacgttatagacctggagaaaggaagtcagcacctcattcgctacaagactattgcaccactggtcgccagtggggccgttcagcttatctag

SEQ ID NO: 118356 - DNA, 303 bp, Artificial Sequence
  Description of Artificial Sequence: Synthetic coding sequence
atgaccgaagaggtggattttctgggtcaggattcagatggtgggagcgaggaggtggtcctgacgcccgcagagctcattgagagactggagcaagcatggatgaacgaaaagttcgcccctgagctcctggaaagtaaacccgagatcgtggagtgcgtgatggagcagctcgagcacatggaggagaatctgagaagagctaagcgcgaggatcttaaggtctctatacaccagatggagatggagaggattaggtatgtgttgagttcttatctgcgatgtcgactgatgaaagtgtag

SEQ ID NO: 118357 - DNA, 939 bp, Artificial Sequence
  Description of Artificial Sequence: Synthetic coding sequence
atggagggtgccgccgctcgtgaagccaggggaacagaaaccccacgagcttctgctccccccccagccccaagcgagccccccgctgccccacgagcacgacctcggctggtgtttagaacacagctcgcccatggctctcccacagggaagattgagggattcactaatgtgagagagttgtatgctaagatcgccgaagccttcggcatcgctccgaccgagattctcttttgcaccttaaactctcacaaagtggacatgcagaaattacttggggggcaaattggcctcgaggacttcatatttgcccatgtgcgaggcgagactaaagaggtggaggtcacaaagactgaagacgctctggggctcactataaccgacaatggggcgggatatgcttttatcaagcggatcaaagaggggtccatcattaacaggatcgaagcagtgtgtgtcggggactccattgaggccattaatgaccatagtatcgtcggttgcaggcactacgaggtcgctaaaatgctaagagagctgccaaaaagccaaccgtttaccctgcggctggtacaacccaaaagagcttttgacatgattggacagagatcccggtccagcaaatgccctgtggaagctaaagtgacctctggccgggagacgctgagactgcgttctggcggagccgcaaccgtcgaagaggcaccatccgagttcgaggaagaagctagccgcaaggtggacgacttactagaatcatacatgggaatcagagacccggagcttgctagtacaatggtcgaaacatctaagaagaccgccagcgcccaggagttcgctcgctgccttgattccgtccttggagaatttgccttccctgacgagtttgttgtagaagtctgggcggctatcggcgaggctcgagaagcttgcggctag

SEQ ID NO: 118358 - DNA, 2097 bp, Artificial Sequence
  Description of Artificial Sequence: Synthetic coding sequence
atgccctccgaaggtcgctgttgggagaccctaaaagctctgcgatctagcgacaagggccgcctgtgttattatagggactggctcctccgcagagaggacgtcttagaagagtgtatgtctctcccgaaactgtcaagctatagcggttgggtagtggagcatgtgcttccccatatgcaggagaaccagccactaagcgagactagtccatcctccacttctgccagcgctctagatcagccgtctttcgtccccaaaagtcctgatgcttccagtgcattcagtcccgctagccctgccacaccaaatgggaccaaaggcaaggacgaatcacagcatactgaatcaatggtgttacagagcagccgaggtattaaggtcgagggttgcgtgcgtatgtacgaactcgtccatagaatgaaagggacggaaggcctgcgactgtggcaggaggaacaggaacgcaaggtgcaggccctgtccgagatggccagtgaacagctaaaaaggtttgacgaatggaaggaactgaaacagcataaggagtttcaggacttgagagaggtgatggaaaagagttctagggaagctctgggtcatcaagaaaaactaaaagccgagcacagacaccgcgctaaaatactcaacctgaagctacgcgaggcggagcagcaacgggtcaaacaggccgagcaagagcgtttgagaaaagaagaaggccagattaggctcagagccctgtacgccctacaggaagaaatgttgcagctaagtcagcagctcgacgcgtctgaacagcataaggcattactgaaagtcgatcttgcggcctttcagactaggggaaaccagttgtgttcacttatatccgggattattagggcgtcgtcggaaagcagttaccctacagctgaaagccaagcagaagcagaaagagccctgagggaaatgagggacctcttaatgaatctcggacaagaaattactagagcctgcgaagacaagcgacgccaagatgaggaagaggctcaggtcaagctgcaggaggcccaaatgcaacagggacccgaggcacataaggaaccgcctgccccttcccagggacccggtgggaagcagaatgaagatttacaagtcaaggtacaagacatcacaatgcagtggtatcagcagcttcaggacgcatcaatgcagtgcgtcctcactttcgagggtctgacgaacagtaaagactctcaggccaagaagatcaagatggacctccagaaagccgccaccattccagtcagccagatcagcacgatcgccggttcaaaacttaaagaaatttttgataagatccattcgctcctctctggcaagcctgtgcagagcggcggccgttccgttagcgtgaccctcaatccccaggggttggactttgttcagtataaacttgctgaaaaatttgtgaagcaaggggaagaagaggtggcttctcatcatgaggcagcatttccaatagcagttgttgcaagtgggatctgggagctccatcctcgggtcggagatcttatattggcccatttacacaaaaaatgtccttactccgtgcccttttacccaacattcaaggagggaatggctctggaggactaccagcggatgctcgggtatcaagtgaaagactccaaggtggaacaacaggacaatttcttgaagagaatgagtggaatgatccgactgtacgccgcgatcatccagttgcgatggccatacgggaaccgccaagagattcatccacacggtctaaaccacggctggcggtggctggcccagattctgaacatggagcccctgagcgacgtcacagccacgctgctcttcgactttttggaggtctgtggcaacgcccttatgaaacagtatcaagtgcaattctggaaaatgctgatcttaattaaggaagactactttcctaggatagaggccattacaagctccgggcagatgggctcattcatcaggctgaagcagtttctggagaagtgtctccagcacaaggacatccccgtgcctaaggggtttctcacatctagcttttggagatcatag

SEQ ID NO: 118359 - DNA, 1980 bp, Artificial Sequence
  Description of Artificial Sequence: Synthetic coding sequence
atgccatctgaagggcgctgctgggaaacattaaaggcattgcgcagttcagacaaaggcagattatgctactatcgggattggttacttcgccgtgaggacgtcttggaggaatgtatgagtctccccaaactgtcttcctactcaggctgggtggtcgagcacgtacttcctcatatgcaagagaaccagcctctcagcgagacctctccctcatccacttcagcaagtgcgttagaccaaccgtcatttgtccctaaatctcctgacgccagctccgcgttctccccagcaagccctgcgactcctaatggtactaaagggaaagatgaaagtcagcacaccgaatctatggtccttcagtcgtcccggggcataaaagtggagggatgcgttcgcatgtacgaactggttcacaggatgaagggcaccgaaggactaagactttggcaggaggaacaagaaagaaaggttcaggccctttccgagatggcctccgagcagctgaaacgattcgatgagtggaaggagctgaaacagcataaggaattccaggatctgcgggaggtgatggagaagagcagccgggaagctctcggtcatcaggagaagcttaaagctgagcatcgccatcgagcgaagatactgaatttaaaactgagggaagcagaacagcagcgagtcaaacaggccgagcaggaacggttacgtaaggaagaaggccagatccggctgcgggccctctacgccctgcaggaagagatgctgcagttgtctcaacagctggatgccagcgagcagcataaggcattgctgaaagttgaccttgcggccttccaaacccgcggcaaccagctttgcagccttatcagcggaatcataagggctagctctgagtcctcttaccctactgcagagagccaggctgaagctgagcgtgcacttcgtgaaatgagagaccttttgatgaatctcggccaggagatcactcgggcttgcgaagataagaggcggcaggatgaggaagaggctcaagtcaagctgcaggaggctcagatgcagcagggccccgaagctcacaaggagccccccgcaccatcccagggcccaggtggtaagcagaacgaggatctgcaggtcaaggtccaggatatcacaatgcagtggtaccaacagctgcaagacgcatctatgcagtgcgtgcttaccttcgaaggactgaccaacagtaaggactctcaagccaagaaaatcaagatggatctgcaaaaagccgctacgatccctgtgagccagatatccacaattgcaggatcaaagctgaaagagatttttgataaaatccactccctgctctccggtaagcccgtccagtcaggtggtaggtcggtttccgtcactttgaatcctcaaggtctggatttcgtacaatacaaactggcggagaagttcgttaagcaaggagaagaggaagtagcttcccatcacgaggcagcgttcccgatcgcagtggtagcttcggggatctgggagctgcacccccgcgtgggtgatctaattctcgctcatcttcacaagaagtgcccttacagcgtccccttctatccaacttttaaggagggcatggcgttagaagactaccagagaatgcttgggtaccaggtcaaagattctaaggttgagcagcaggacaattttctcaaacgtatgtccggcatgattagactctacgcagctatcatccagttaaggtggccctacggcaatcggcaggagatccatcctcatggcctgaatcatggctggagatggctcgcccagattctaaacatggaacctctgagcgacgtcactgcaaccttactgtttgatttcctggaggtgtgcggcaacgccctaatgaagcagtaccaggtccaattttggaagatgttgatcctgattaaagaagattatttccccagataccaggcctgttag

SEQ ID NO: 118360 - DNA, 1335 bp, Artificial Sequence
  Description of Artificial Sequence: Synthetic coding sequence
atgctccagttgtcccagcaactcgacgctagtgagcagcacaaggcgttgcttaaggtggacctagccgcgttccagacacgggggaaccagctgtgtagcctgatatcggggataataagagcttcgagtgaaagttcataccctacggctgaaagtcaggctgaggccgagcgcgcactgagggagatgcgggatctcctgatgaatcttggccaggaaatcactcgcgcttgtgaggataaaagacgccaagatgaggaagaagcccaggtgaagcttcaggaggctcagatgcagcaaggtcctgaagcccataaggaacctccagctccctcacagggtcctggtggcaaacaaaatgaagatctgcaagtgaaggtgcaagacattacgatgcaatggtaccagcagctccaggacgcgtcaatgcagtgtgtcctgaccttcgagggattgacaaattctaaagatagccaggcaaaaaagataaagatggacctccaaaaggctgccaccattcctgtgagccagatatcgacaattgctggaagcaagctgaaggagatctttgacaagatccatagcctgctcagtggtaagcctgttcaatcaggcggtaggagcgtgtcagtgaccctgaatccccaggggcttgacttcgttcagtataaacttgctgagaagtttgtgaagcagggcgaagaggaggtggcgagccaccatgaggcagccttccccatcgcggtggtggcgtctggcatctgggagctgcaccccagggttggtgatctgattttggctcacctacacaagaagtgcccttactcagtccctttttatcctacattcaaggaaggcatggctctggaggattatcagagaatgctgggctaccaggtgaaagactccaaagtggagcagcaggataacttcctgaaacgcatgtccgggatgatcaggctttatgcagcaattatccagctgagatggccttatggcaacagacaggagatccaccctcacggcctgaatcacggctggcgctggctcgcccagatccttaatatggagccgctttccgacgtgactgccactctgttgttcgacttccttgaagtgtgtggtaatgctctgatgaaacagtatcaagtacagttctggaaaatgctgattctgattaaggaagattacttccctcgaatcgaagcaatcactagctccggccagatgggatcgtttattcgcctaaagcagttcttagaaaagtgtcttcaacacaaggacatccccgtgcccaaaggattcttgacctcttcattttggaggagctag

SEQ ID NO: 118361 - DNA, 2490 bp, Artificial Sequence
  Description of Artificial Sequence: Synthetic coding sequence
atggctctaacctctatcaatgcaacgccaacacagctgtcatcgtcttcaaattgtctatccgacactaaccagaataaacagagttcggaaagcgccgtttcaagtactgtaaatccagtagcaatacacaaacgatcgaaagtcaaaactgaaccggagggcttgcgtccagctagccccctggcgctgacacagggtcaggtatcaggccatggctcttgcggctgcgcacttccactttctcaagagcaacttgctgacctcaaagaagaccttgaccgcgacgactgtaagcaggaagctgaggtagtaatatatgaaactaactgtcactgggaagattgcaccaaggaatacgatacccaggagcaactggttcatcacataaacaatgagcatatccacggcgagaagaaagaattcgtgtgcagatggcaggcctgcaccagggaacagaaaccgtttaaagcacagtacatgttggtggttcatatgagaaggcacaccggtgaaaagccccataaatgcacattcgaaggctgcagcaaggcttatagcagactcgagaatttgaagactcacttgaggagccatacaggcgagaaaccatacgtgtgcgagcatgagggttgtaacaaggccttcagcaacgcctctgaccgtgccaagcaccagaatcgcacacattccaacgaaaaaccttatatatgcaagatccccgggtgtacgaagaggtacactgatccatccagtttacggaaacacgttaagactgttcatggtcccgacgctcatgttactaagaagcagcgcaatgatgtgcacctccgaacccctctgctcaaggaaaatggcgactctgaagctgggaccgaaccaggtggccctgagagcaccgaggcctccagtacctctcaggcagtcgaagattgtctgcatgtccgggcaatcaaaactgaaagctccggcttatgtcagagttctcccggtgcccagagttcctgttctagtgagccatcacctctggggtctgctccgaacaatgatagcggcgtggaaatgcctgggaccggacccggctccttaggcgatctcactgcactggatgacacaccccccggtgccgatacttccgctctcgccgcaccatcagccggaggtctgcaactgagaaaacacatgacaacaatgcacaggttcgaacaactaaagaaagaaaagctgaagagtctgaaggactcctgcagttgggccgggccaacgcctcacacccgcaatactaagcttcccccactgcctggctctggctcaattttggaaaacttcagtggctctggaggcgggggccccgctggcctcctgccaaatccccgcctatcagaactctctgcatcagaggtcactatgttgagccaactccaggagcgccgcgattcgagtacttcaaccgtcagcagcgcatatactgtctctcgccgcagttcggggatctctccttacttttcctcacgaagatcttcagaagcctctccacttggggccggtcgtccccataacgcaagctctgccgactcgtatgacccaatctccactgatgcgtctaggaggagctcagaggccagccagtgcagtggaggcagcggcttactcaacctcacccccgcacagcagtactcgcttcgagccaagtacgccgctgctaccggtggtcccccccccacgccacttcccggcctagaaagaatgtcccttcgaacacgcctggctctgctggacgcccccgagcggacactgcccgccggctgtccccgcccactgggcccgagacggggtagcgacgggcctacatacggccacggacatgcaggggcagcaccagcgtttccccacgaggcccccggtggtggcgcaagacgtgcatccgatcctgtgaggcgaccagatgcgctgtcactgccgagggtccagaggttccactctacacataatgttaatccgggccccctacctccttgcgcggaccgccgagggctaaggcttcaaagccacccaagcactgatggcggtttggcgcggggggcttatagccctagaccgcctagcatctctgaaaacgtcgcaatggaggctgtggccgcaggtgtagacggcgccgggcccgaagctgatctgggattgccagaggatgaccttgtgctgccagatgacgtcgtgcagtacatcaaggctcacgccagtggggctttggacgaggggaccggccaggtgtatccaactgaatccacaggtttcagcgacaatccacggctcccatcccctggactccacggtcagcgacgtatggtggccgccgactccaacgtgggaccttcggcacccatgttaggagggtgtcagctaggattcggtgccccttcctcccttaataagaataatatgcccgtacaatggaatgaggcttctgcaacctggctctctgggacatag

SEQ ID NO: 118362 - DNA, 4761 bp, Artificial Sequence
  Description of Artificial Sequence: Synthetic coding sequence
atggaaactagtgcgagtgcaacggcatccgaaaaacaggaggctaaatccggtattctggaagccgcaggatttccagaccccggaaagaaggcctctccacttgtggtggccgccgcagcagccgccgctgtagccgcccagggcgtgccacagcatttgttgccaccttttcacgcacctctgccgatcgacatgcgacaccaggaaggtaggtaccactatgagcctcactctgtgcacggcgtgcacggaccacccgccctgtccggctcgcctgtaatatcagacatctccctgatcagactttccccacaccccgccggccccggggaaagcccatttaatgcaccgcatccctatgtcaacccccacatggagcattacctgaggagtgtgcattcatcgccgacactcagtatgattagtgccgcgcgcgggttgtcgcctgccgacgtggctcaggaacacttaaaggaaaggggactctttggattgccagccccgggtaccacaccctctgactactatcaccagatgaccctggtagctggacatccagctccttatggcgacttgttaatgcagtccggaggcgcggctagtgcccctcatctgcatgactatctgaaccccgtggatgtatcaagattctcttcgccgagagtgacaccccgattaagccgtaagcgagcgctgtcaattagcccgctgagcgacgctagcctggacctccagcgcatgatccgtacttccccaaactctctagttgcctatatcaataacagcaggagctcctcagctgcaagtggatcctatgggcacctcagtgctggcgctctgtccccggcgttcaccttcccgcatccaataaaccccgtggcctatcaacaaattctcagtcaacagaggggtctagggtcggcctttgggcataccccccccttgatccaaccatcccctacgttcctggcacagcaacctatggctttaacatctatcaatgctacacctactcagctctcgtcatcatctaattgtctctctgacacaaatcagaacaagcagtcctccgagagcgccgtttcaagcacagtcaatccggtggcaatacataagagaagcaaggtgaaaacggaacccgagggtctgaggcccgctagtccattagctcttactcaaggccaagtgtccggccacggcagttgtggctgcgctctcccactgtctcaggagcagctggcggacttgaaggaagacctagaccgcgacgattgcaaacaagaagcggaggtagtcatctacgaaactaattgccactgggaggattgcacgaaggaatatgatacacaagaacagctggtccaccacatcaacaatgagcatatccacggagaaaaaaaagaattcgtgtgtaggtggcaggcatgtacccgagagcagaaaccctttaaagctcaatacatgcttgtagtacacatgcggcgccacactggagaaaaaccccataagtgtacgttcgaggggtgttctaaggcctactccaggttggagaacctgaagacacatctcagatcccacactggagagaaaccctatgtatgtgagcacgaggggtgcaataaggcattttccaatgcatcggatcgtgctaagcatcagaatcggacacactccaatgagaagccttacatttgcaaaataccgggctgtacaaagcgttataccgacccgtcctcactaaggaaacacgtgaaaacagtgcacggtccagacgcccacgtgacaaaaaaacagagaaacgacgtgcacttacgcacgcccctgctgaaagaaaatggcgattctgaagcaggcactgaacccggggggccggaatccactgaagcgagctcgactagccaagccgtcgaagactgcctgcacgtgcgggcaatcaaaacagagagcagcgggctttgccagtcatctcctggggcccagtcaagctgttcgtcggagccttcccccttgggatccgcacctaataatgacagtggcgtggaaatgccaggaaccgggcctggatcattgggcgatctgactgctctggatgacacgcccccaggtgctgatacctccgcactcgccgcaccttcagccggggggttacaactccggaagcacatgacgactatgcaccgctttgagcagcttaaaaaggagaagctgaaatccttaaaagactcctgtagttgggcaggtcctaccccacacactcggaacaccaagctgccacccctgcctggaagtggtagcatcctcgagaactttagtgggagcgggggcggtggacccgcggggctgctcccaaaccctcgactgtccgagctctcagcgtctgaagtcaccatgctttcccaactgcaagaaagaagagacagttctactagtacagtttcaagtgcctatacagtgtccaggcgttcctcaggcattagcccctattttagtagccgacgaagcagtgaagctagccccttgggggccggcagaccacacaacgccagctccgccgactcatacgatcctatctccacggatgcgtctcggcgatcttcagaggcttcacagtgcagtggcggcagcggcctgctaaacctaacacctgcccagcagtactctctccgggctaagtacgctgctgccacaggcgggcccccccccacaccactgccagggctggagcggatgtctctgagaacacggttagctctgttagacgcacccgagaggaccctgccagcgggctgccctcgccctctaggacccagacgcgggtctgatggaccaacttatggccacgggcacgcaggagccgcgcctgcatttcctcacgaggccccaggggggggagcaagaagggcgagcgatccagtaagacggcctgatgccttatccttaccacgcgtccagaggtttcacagcacacataacgtgaaccccggacctttgcctccttgtgcagaccgccggggactccgcctgcagagccatccctccacggacggcggactggcgcgaggcgcatactcaccacggccgccctcgataagtgagaatgtcgctatggaggccgttgcagccggcgtggatggcgccggccccgaggccgacttgggccttcccgaagacgacctggtgctgcctgatgatgttgtgcagtatataaaagcacatgcatctggcgctctggatgaagggaccggacaggtgtaccccacagaaagcaccggcttctctgacaatccccgactcccatctcccggcctccacggccagcggcgcatggtcgccgcagactcgaatgtggggccttccgcacccatgctgggcggctgtcagctcggctttggtgccccatccagtttaaataagaacaatatgccagtgcagtggaatgaagtgtcatcaggaacagtggatgcactcgcaagccaggtcaagcccccacctttccctcaggggaatctggccgttgtgcagcagaagccggcctttggccagtatcctggttatagcccgcagggtctgcaagcttctcccggtggcctggatagcacccagccacacctacaaccccggtccggggccccctcacagggtattccaagggtgaattatatgcaacagctgagacagcccgtcgctggctctcaatgtccaggcatgaccaccacaatgagtcctcacgcatgttatggacaagtacatccacagctttcccccagcaccatctcgggggctcttaatcagtttcctcaatcgtgtagcaatatgcccgccaagcctggacacctcggacacccccagcagaccgaggtggctcccgatccaaccacaatgggcaatcgccacagagagctcggcgtaccagactccgccctggcgggggtgccccctccacacccagtccagtcttatccccagcaaagtcaccatctcgctgcctcaatgagtcaggaggggtatcatcaggtccctagcctcctgccagctcgacagccagggtttatggaaccccaaaccggtccgatgggcgtcgccaccgccggtttcggcctagttcaaccccgcccccccctggagccatcgccgaccggtcggcacagaggagttagggccgtacagcaacagctggcttacgcgcgggcaacagggcacgctatggctgccatgccttcatcacaggagaccgccgaggccgttcctaagggggcaatgggaaacatgggttccgtcccaccccagcccccccctcaggacgctggtggcgctcctgaccacagtatgctgtactactacggccagatacacatgtacgagcaagatggcgggctggaaaacttgggaagttgtcaggtcatgcgtagccagcccccgcaaccccaggcctgccaagattcgatccagccccagccgctgcccagccccggcgtcaaccaggtcagctcgaccgttgatagccagctgctggaggccccccagatagactttgatgccatcatggatgacggagaccattcctccttatttagcggcgccttgtcacctagtttactgcatagtctttctcagaattcatcgagactcactactcccaggaatagcctgactctgccgtctattccagccggaatctcaaatatggctgtaggcgacatgtcttctatgctgacttctctggctgaggagagcaaattcctgaatatgatgacatag

SEQ ID NO: 118363 - DNA, 249 bp, Artificial Sequence
  Description of Artificial Sequence: Synthetic coding sequence
atggaaacaagcgcatcagcaactgccagcgagaaacaggaggctaaaagcgggattttggaagccgcaggcttccctgatccggggaagaaggcatctcctctggtggtggctgctgccgcagcagccgccgtggccgcccagggggtacctcagcatcttctccctccatttcatgcccccttgcctatcgatatgagacaccaagaaggaaggtaccactacgaacctcactcagttcatggatag

SEQ ID NO: 118364 - DNA, 660 bp, Artificial Sequence
  Description of Artificial Sequence: Synthetic coding sequence
atggaaacctccgctagcgcaaccgccagtgagaagcaggaggccaaaagtggtatcttggaggctgctgggtttcctgacccgggtaagaaggccagccccttggtggtggctgccgctgcagcggccgcagtcgctgcccaaggtgtcccccagcatttgttgcctcccttccacgcaccacttcctattgatatgcgccaccaggagggtcggtaccactacgagcctcactccgtgcatggcgtccatggggttccattcttacaacctgctggagacgccccacctgaaccacaagccggcgccgtccatttgcccacactaaggagacagcctggtccggctgctgacgaccctcatctgacccagctggccagcgggctacaccagcagctgccaaagcagctggggggtcagcgctttttgcgggcctctgtgtccggatgtccacagccatctttgcacctgcctcccccacaccagcctcggggactacctgccgattcggagccggctgaaggatcgggagtgtccttgtggactcacaccacaccagaccccgctctcactcatctgcctgggcctgcagctcacgggccccatctgcaccagtgccacgctcatccagcccagcagcagcagcagttgtctgaatag

SEQ ID NO: 118365 - DNA, 4761 bp, Artificial Sequence
  Description of Artificial Sequence: Synthetic coding sequence
atggaaacctctgcaagtgctacggcctcagaaaagcaggaggctaaatctggaatattagaggccgccgggttccctgatcccggaaagaaggcctcaccattggtggtggccgccgccgccgctgccgcagtcgcggcccagggagttccacagcacctgctccctccctttcacgccccactccctatcgacatgcggcaccaagagggaagataccattacgagccccactctgtgcatggtgtacatggcccccctgcactttccggatctcccgttatctctgacataagccttattcgcctctcgccgcatccggcgggtccgggagaatcccctttcaatgcaccacacccttacgtgaatcctcacatggagcactatctgagaagtgtgcactcgtctcctacccttagcatgatctctgccgccagagggttgtctcccgccgacgtggcacaggagcatctcaaggaaaggggattgttcggtctgcctgctcccgggaccactccttctgattattaccaccaaatgacgctagtcgcagggcatcccgcaccttacggggaccttttgatgcagtctggcggagctgcaagtgctccccatctccacgattatctgaatccggtggatgtgtcacgctttagctccccacgagtgactccgaggttgagtcgcaaacgggcactctccatcagccccctgagtgacgcttccttggatctacaacggatgatacggacaagtccgaattcactcgtggcttatataaacaacagcagatcatccagtgcagcaagcggcagctatggccacttgtccgctggggccctgagcccggcctttacgttccctcatcccattaaccccgtggcatatcagcagatcctcagccagcagaggggactaggaagtgccttcggccatactcccccgctgatccagccatcacccacgtttctggcccagcaacccatggccctgaccagcattaatgcaactcctacccagctcagtagctcctccaactgtttgagcgatacgaaccagaataaacagtcctcagaatcagcagtgtcaagcactgtgaatccagtcgcaatccataaaaggtcgaaagtgaagacagagcctgagggcttgcgcccagcatctcccctggccctgacccaagggcaagtgtccgggcatggatcctgcggctgtgcccttcccctctcacaggaacagcttgcagacctgaaagaggatttggacagagatgactgcaaacaggaggcagaggtagtgatttacgagaccaattgccattgggaggattgcaccaaggaatacgacactcaggaacagttggttcaccacatcaacaacgaacatattcacggagaaaagaaggagttcgtatgccggtggcaagcttgcaccagagagcagaagcctttcaaagcacagtatatgctcgtggtccacatgcgacgccacactggagaaaaaccgcataagtgcacatttgaaggctgctctaaagcctactcccggctggagaatctcaaaactcacctgcgaagccataccggcgaaaaaccgtacgtgtgcgaacacgaagggtgtaacaaagctttcagtaatgcttcagatagggccaagcaccaaaatcggacccactcaaacgagaagccttacatttgcaagattcccgggtgtaccaagcggtataccgatccgagcagtttaaggaaacacgtaaagacagtgcacggaccggacgcccacgttacgaaaaaacaacgtaacgacgtacaccttaggactccattgctgaaagagaacggcgacagcgaagctgggacagagccaggaggccccgaaagtacagaagcgtcttccacctcccaggctgtagaagactgcctgcatgtacgggctattaagaccgaaagcagcggactgtgccaatcttcgccaggcgctcagtcgagctgcagctcagagccttcacccctgggatcagctccaaataacgacagtggtgtggagatgccaggcactgggcctggctccctgggggatcttactgccttggatgatactccacctggagccgacacttccgccttagcggcaccgtctgccggaggtttgcagctgagaaaacacatgaccacgatgcaccgcttcgagcaactgaagaaggagaagctgaagtccctgaaggacagctgctcctgggctgggcccacgcctcatacaagaaacaccaagctgcctcccctgcccggctctggctcaatcctcgagaactttagcggcagtggcggtggaggacccgcaggcctattgcctaatccacggctgagtgaactctccgcaagcgaagttactatgctctctcagttgcaggagaggagagacagctctacaagcacagtgtcaagcgcttatactgtatctcggcgctcctctggtatcagtccttatttttcctctcggcgtagctctgaggctagtcccctgggcgctggacgaccgcataacgcttcaagcgcggactcttatgacccaatcagcacagatgcctccagacgctcatctgaagcttctcagtgtagcggtggaagtggcctccttaatctgacccctgcgcagcaatacagcctgagggccaagtacgccgcagccactgggggcccaccacccacccctcttccaggcctcgagaggatgtctctgcggacacgtctcgcgctacttgacgcgccagaaagaacgctgccagccggctgcccccgtccactgggtcctcgcagggggtctgacgggcccacttatggacacggccacgctggggcggctccagctttcccacacgaggcgcctggaggcggggcgagacgggcatctgacccagtcaggcggccagacgccctcagtctaccacgggtgcagaggtttcatagcacgcataatgtgaaccccggtccgctgcctccctgcgccgaccgaagaggcctgcggctccagtcgcatcccagcactgacggtggactggcgaggggtgcctactctcctcgcccacctagcatctctgagaatgtggcaatggaagccgtcgctgccggcgtggatggcgccggtcctgaagccgacctgggattgccggaggatgacttagttctgccagatgatgtggtgcagtatattaaggcacacgcctccggggcactggacgaaggaaccggccaggtctaccccaccgaatctacggggttttcggataacccaaggctgccctcgcctggactccacggacagcgacgaatggtcgcagccgacagcaatgtgggaccatctgctcccatgttgggtgggtgtcagctgggctttggagccccctcttcactgaacaaaaataatatgccagtacaatggaacgaagtctctagtggcaccgtggacgccttagcctcccaggtaaaacccccaccattccctcagggtaacctcgcggtcgtgcagcagaagcctgcctttggccagtatcccggttatagcccacaaggattgcaggcgtcccccggtgggctcgactcgacccagccgcatcttcaaccacggtccggcgcgccttcacagggaatcccccgggtgaattacatgcagcagctgagacaacctgtcgccggatctcagtgtcccggaatgaccacaacaatgagcccccacgcctgctatggccaggttcatccccagttgtctcccagtaccatctcaggagccctcaatcagttcccccaatcctgttcaaatatgcctgccaagccgggccacctgggccacccacaacaaactgaagtggcaccagatcccactacaatgggaaatcgtcaccgggagctgggcgtgccggactcggctttggctggagtgccaccgccccatccggtccaaagctatccacagcagtcccaccatttagctgcttcgatgtctcaggagggataccaccaggtgccatcccttctgcctgccagacagcctggctttatggagcctcaaacgggcccaatgggggttgctacagccggattcggcttggtccagcctcggccacctttagaacccagtccgaccggcagacacagaggcgtcagggccgtccagcagcagctggcatatgcgagggctaccgggcatgcaatggcggcaatgccatcttcacaggaaacggccgaggctgtgcccaagggtgccatgggaaacatgggttcagtccccccccagcctccacctcaggacgccggaggggcacccgatcattcaatgttgtattactatgggcaaatccacatgtacgaacaagacggcggtctcgagaatctgggcagttgccaggttatgcggagccagccaccccagccacaagcctgccaagactccattcagcctcagcccttaccttcccctggcgtgaatcaggtgagcagcaccgtggactcccagctgctggaggcaccccagatcgatttcgatgctataatggacgatggcgaccatagcagcttatttagcggcgctctctccccctccctcttacactctctaagtcaaaacagctctagactcactacacccagaaactctcttacattaccctcgattcccgccgggatcagcaacatggccgtaggcgatatgtcatccatgctgaccagcctggcggaagaaagtaagtttttgaacatgatgacttag

SEQ ID NO: 118366 - DNA, 4743 bp, Artificial Sequence
  Description of Artificial Sequence: Synthetic coding sequence
atggaagcccaaagccatagttctaccaccacggagaagaagaaggtggaaaattccatcgttaagtgcagtacgcggactgatgtctctgagaaggctgtcgcttcgtctaccacctctaatgaggatgagagtcccggccagacataccatagagaaaggagaaacgctattaccatgcaaccccagaatgtgcaggggttatcgaaggtcagtgaggagccctcaacaagtagcgacgaacgggccagtttaataaagaaagaaattcatggttccctaccgcacgtggctgaaccctctgtcccctataggggaacagtgttcgctatggatcctagaaacggatacatggagccccattaccaccccccccacctgtttccagccttccacccaccagtacccattgacgctagacaccacgaggggcgctatcactacgatccatcgccaataccaccgctgcatatgaccagcgccttaagttctagcccaacataccccgatctccccttcatacgtattagtcctcacaggaatcctacagccgcttcagaatccccgttttcacctccacatccgtacatcaacccctacatggattatatccggtccctgcattcatccccaagcttgtctatgatctccgccactagaggcttgagccccacagatgccccacacgctggggtgagcccagccgagtattatcatcagatggcactgctgacggggcaaaggtctccctacgccgacatcatcccctcggccgcaactgccggtacaggagccattcatatggagtatttacacgctatggactccacacggtttagcagccccagattgagtgctcggccaagccgaaaacgcacactatctatctcccccctgtcagatcacagcttcgacctccagaccatgatcagaacctcccctaattcactggtgaccattcttaacaactctcgaagctcctcatcagccagtggtagctacgggcatctaagcgcttctgccatcagccccgctctgtcgtttacatattcatcagctccggtctctttgcacatgcatcagcaaatcttgtcccgccagcaatccctggggtctgcattcggccacagcccacccctcattcacccagcccctacctttcccacacagagaccgatcccaggaatccctactgttttgaatcccgtgcaggttagctctggcccatctgagagttctcagaacaagccgacatccgaatccgccgtgtcctctacaggcgacccgatgcacaataaaagaagtaagatcaagccagacgaggatctgccatctccgggggctcgaggccagcaagagcagcctgaaggaacgactctcgtgaaagaagaaggagacaaggacgaatccaagcaggagcctgaagttatttacgaaactaactgccactgggaaggttgcgcaagggaattcgatacacaggagcagctggtccatcatattaataatgaccacatccacggggaaaaaaaggaatttgtctgcagatggctggactgctcacgggaacagaagccattcaaagcccaatacatgctagtagtgcacatgagaagacacaccggggagaaacctcacaaatgtaccttcgaaggctgcacaaaggcctatagtaggcttgagaacctgaagacccacctgcgtagtcacactggcgagaaaccctacgtgtgtgagcacgaaggctgtaacaaagcgttctctaatgcttccgacagggcaaaacaccagaaccgcacccactctaatgagaaaccctatgtgtgcaagattcccggttgtacgaaacggtataccgacccttccagcttaaggaagcacgttaagacagtgcacggccccgaggcccacgtgacgaaaaagcagagaggcgacatccatccacgaccaccgccaccgcgggacagcggtagccattcacaatcaaggagtccaggcagaccaactcagggtgccttgggggagcagcaggacctgtctaacaccactagcaagcgagaagagtgtcttcaggtcaagacagtgaaggccgaaaagcctatgacaagtcagccttctcctgggggtcagtcttcctgttctagtcagcaatctccaatctctaactattccaactccgggctcgagctgcctttgaccgatggaggatcgatcggtgacctgtcagccatcgatgagacgccaatcatggactcgacaatttcgacggcaactacagcgctggctttgcaagcaaggaggaatcctgccggaacaaagtggatggaacacgtgaaattggagcggctgaaacaggtgaatggaatgtttcccaggctaaatccaatccttcctcctaaagcccccgccgtgtcaccacttatcggcaatggaacccaatccaataacacttgcagtctgggagggcccatgacgctgctgcctggtcgctctgacttaagtggggtggatgttactatgctgaatatgctgaaccgacgggatagctccgcctctaccatctcaagtgcatatctgtccagcaggaggagttccggcatcagcccatgctttagctctcgtaggtcttcggaggcatctcaagctgaagggcggccccagaacgtgagcgtagcggatagctatgatccaatctcaacagacgcttctaggcgaagcagtgaggcaagtcagagcgacgggcttccctcgttgctttctctgacacccgcccagcagtacagactcaaggccaaatatgccgcagccaccggggggccgcctcccactcccctgccaaacatggagcgcatgtctctgaagacccgcctggccctcctgggggatgctctggagcccggagtagcactcccacctgtgcatgccccccgcagatgcagcgacgggggggcgcatgggtacggcaggcgccatctgcagccacacgacgcacctggccacggtgtccggagagcaagtgaccccgttcggacggggagtgaggggttagcactgccgcgagttcccaggttcagctcactgagcagttgcaacccaccagcgatggccacctctgcagagaaacgctccctggttcttcagaactacacgcgaccagagggtggccagtctcgaaactttcatagctccccttgcccccctagtataactgaaaatgtaacacttgagtccctcaccatggacgccgatgctaatctgaatgacgaagatttcttgcctgacgacgtggttcagtatctcaattcacaaaaccaggcaggttatgaacaacacttcccttcagccctacccgatgactctaaagtgccgcacggtccaggcgacttcgacgccccagggctgcccgatagtcacgcaggacagcagttccacgcgctggaacagccttgcccagaggggtccaagactgacctaccaatacaatggaacgaggtctcatcaggtagcgcggatttgtcttcctccaagttgaaatgcggtccgcgccctgcagtccctcagacaagagcctttggtttctgtaacgggatggtggttcatccccaaaatcccctccggtcaggaccagccgggggctatcaaacactgggcgaaaactcgaatccgtacggcggaccggagcacctcatgctgcataacagtcctggaagcggaaccagcggcaatgcatttcacgaacagccctgtaaggccccacaatacgggaattgtttaaatcgacaacctgtagctcctggcgccctggacggcgcttgcggagccggtattcaagcatccaagctgaaatccacccctatgcaaggttccggcgggcagttaaacttcggactccccgtggcccctaatgagtccgcgggatcaatggttaacggcatgcagaaccaggatcccgtggggcagggctacttagcccatcagttgttaggcgactctatgcaacaccctggggcagggcgacccggacagcagatgcttggacagatctctgccactagccatattaatatttatcagggacctgagagctgtctccccggagcccatgggatggggtcacaaccaagttccctggctgtggttcgggggtatcagccatgcgcttcatttggcgggagtcggcgacaggctatgccacgggactctctggcactgcagtccgggcaactctctgatacatcacagacatgcagagtaaacggtatcaaaatggagatgaagggccaaccccatcccctctgttctaatctgcaaaactattccgggcagttttatgatcagacagttggcttcagccagcaggatactaaggccggatctttctcgatctcagatgctagctgcctgcttcaaggaacctctgcaaagaatagtgagcttctctctcctggggcaaaccaagtgacttcgaccgtggactccttggattcacatgacctagagggtgtccagatcgatttcgatgcaattatagacgacggagaccactcatccctcatgagtggcgcactttctccttccatcatccagaatttaagccattcttcttcaagactaacgacccctagagcctccttgccttttccagcactgtcgatgtcaaccaccaacatggccatcggagacatgtcaagcttgctgacatccctcgcagaagagtcgaaatttttagcagttatgcagtag

SEQ ID NO: 118367 - DNA, 543 bp, Artificial Sequence
  Description of Artificial Sequence: Synthetic coding sequence
atggaggcccagtcccacagttctaccactaccgaaaaaaaaaaggtggaaaattctatagttaagtgttcgaccaggactgacgtgagtgaaaaagccgtggcttccagcaccaccagtaacgaggatgaatcacccggtcaaacatatcacagggagaggcgtaacgctattacaatgcaaccacagaatgttcagggcctaagcaaggtgtccgaagagccgtctacatcttccgacgagagggcctctctgatcaagaaggagatacatggaagtttgcctcatgtcgccgagccgtcagtgccatacaggggtaccgtttttgctatggacccaagaaatggttacatggaaccacactaccatccaccacacctgtttcccgcgtttcatccacccgttcctattgatgcccgacaccacgaaggcaggtatcactatgatccctcacccatccctccacttcacatgacttcggccctctcatccagcccaacctacccggacttaccatttatacggattagtccacacagatag

SEQ ID NO: 118368 - DNA, 1131 bp, Artificial Sequence
  Description of Artificial Sequence: Synthetic coding sequence
atggctgccttgggcgatatccaggagtcaccctcggtgccgtctccagtgtcactgagtagtccagggacgcccgggacacagcaccacgaacctcagctgcacttacatggacaccagcatggatcccctggctcttccccgaaggttttatcccagccttccgatttggaccttcaggacgtagaggaggtcgagatagggagagatactttctggcctgacagcgaaccaaaacctgagcaggccccacgctcgccagggtctcaggcccccgacgaaggggcagggggcgcactcaggtctttactcaggagtctgccaaggcgggcacggtgctctgccggtttcggccctgagtcctccgcggagaggccggccgggcagcctcctggcgctgtcccttgtgcgcagccccgaggcgcatggcgggtgaccttagtgcagcaggcagctgccggccccgagggggctccagagcgtgctgccgaactgggggtaaactttggcagatcaagacagggctctgcacgaggcgctaaaccacacagatgtgaggcatgcgggaagagctttaagtacaacagtctcctactgaaacatcagcgcattcatacaggggaaaagccctacgcctgccacgaatgcgggaagcggttccgcggatggagcggatttatccagcaccaccggattcacacgggcgaaaagccatacgagtgcggacagtgtggacgggctttcagccattcctcccacttcacccagcacctaagaattcataacggagagaaaccctacaaatgtggcgaatgcggacaagccttctcacagtcctctaacctcgtccggcatcagcgcctgcatacaggcgaaaaaccctacgcgtgcagccagtgcggcaaggccttcatatggagttcggtgttaattgagcaccagcggattcatacaggcgaaaaaccttatgaatgttcagactgcgggaaggcgtttaggggaagaagtcatttttttcgacacctgcgcacccatacgggggaaaaaccattcgcgtgcggcgcttgcggcaaagctttcggccagtcatcccaactcatacaacaccaaagggtacactaccgtgagtag

SEQ ID NO: 118369 - DNA, 1131 bp, Artificial Sequence
  Description of Artificial Sequence: Synthetic coding sequence
atggctgccctgggggacattcaggagtcccccagcgtgccaagcccagtgagcttgtcctcgcccggtactcccggaacacaacaccatgagccacaactgcacctgcacggccaccagcatgggtctcccgggtcttcacccaaggtgctgtcacagccgtctgatctggacctgcaagatgtggaggaggttgaaatcggtcgggatactttctggccagattcagagcctaagcccgaacaggcaccacgatctccgggatctcaggcacccgatgagggtgctggaggggccctccgctctctgctgaggagtctcccccgtagggctcgctgctcagccggcttcggccccgaaagttcagccgagcgccccgctgggcagcctccaggagcagtgccttgtgcacagccccggggggcctggcgcgtgacactcgtccaacaggcggcagctggaccagagggtgctcccgagcgggcggccgagcttggagtcaactttggtcggtcacggcaaggcagcgcaagaggagcaaagccccataggtgtgaagcatgtggaaagagcttcaagtataatagtcttcttctgaaacaccaaaggatccacacaggggagaagccatacgcctgccacgagtgcggcaagcgatttagagggtggagcgggttcatacaacaccaccgcatccataccggtgagaagccatacgagtgtgggcaatgcggccgggcttttagccacagcagccattttactcagcacctgaggatacacaacggcgagaaaccctataaatgcggcgaatgtggccaggccttctctcagtcttcaaatctggttcggcaccagcggcttcacacaggagaaaagccgtatgcctgttctcagtgtggaaaggctttcatttggtccagcgtcctgatcgaacatcagaggattcataccggtgagaaaccctatgaatgtagtgattgcggcaaagcctttcggggccgctctcatttttttaggcacctcaggactcatacgggggagaagccattcgcatgcggagcatgcgggaaggcctttggccagtcttctcagcttatccagcaccaaagggtgcactaccgagagtag

SEQ ID NO: 118370 - DNA, 801 bp, Artificial Sequence
  Description of Artificial Sequence: Synthetic coding sequence
atgagagtgaccctggccaccatcgcgtggatggtaagcttcgtctcaaactattcgcatacagccaacattctacccgacatcgaaaacgaggactttatcaaggactgcgtcagaatccacaacaagtttcggtccgaggtcaaacctaccgctagcgacatgttatatatgacatgggatcctgctctcgcccagattgcaaaggcctgggctagtaactgtcaattcagccacaacacacgtcttaagccaccccataagttgcaccctaattttacatcacttggggaaaacatatggaccggtagcgtgcccatcttttccgtgtcatccgctatcaccaattggtatgatgaaattcaagactatgactttaagaccaggatttgcaagaaggtctgcggacattacactcaggttgtctgggctgattcttacaaggtcggctgcgccgtccagttctgtcccaaagtcagcgggtttgacgcactatcaaacggcgctcacttcatctgcaactatgggcccggcggtaactacccgacctggccctacaaaagaggcgccacttgtagtgcttgccccaataacgacaagtgcctcgacaatctgtgtgtgaatagacagagggatcaggttaagagatattattctgtggtgtaccccggatggccaatttatccccgtaacagatatacatcactctttctaatcgtaaactccgtgattctgattttaagcgtgatcattactatcttggtgcagcataagtatccaaatctggtgctactggattag

SEQ ID NO: 118371 - DNA, 429 bp, Artificial Sequence
  Description of Artificial Sequence: Synthetic coding sequence
atgagcgacagcctggtggtctgcgaagttgatcctgagttgaccgaaaaactgagaaaatttagatttcggaaggaaacggacaacgccgccattataatgaaagttgacaaagaccgacagatggtcgtcttggaagaggaatttcagaatattagcccagaggaactgaaaatggaattgcccgaacggcaaccaaggttcgtggtgtattcctacaagtatgttcacgacgatggcagggtttcttatcccctgtgctttatcttcagtagtccagtcggatgtaagcccgaacagcaaatgatgtatgccggctccaagaaccgtctggtgcagaccgcagagcttactaaggtcttcgagattcggaccaccgacgacttaacagaggcatggctccaggagaagctctcatttttcagatag

SEQ ID NO: 118372 - DNA, 429 bp, Artificial Sequence
  Description of Artificial Sequence: Synthetic coding sequence
atgtctgacagcctggtcgtctgcgaagtagacccagagctgaccgagaagcttcggaaatttcggtttcgaaaggaaacagataacgctgctattataatgaaagttgataaggaccgtcagatggtggtgctggaggaggaatttcagaatatcagcccagaggaactcaagatggagttgccggaaagacagccacgattcgtggtgtactcctacaaatacgtgcacgatgacgggagggtaagttatcccctctgctttattttttcttctccagttggctgcaaacctgaacagcaaatgatgtatgcgggttcaaagaatcgcctcgttcaaactgccgagctaaccaaagtctttgagatccgtacaacagatgacctaactgaggcatggctgcaagagaaacttagtttcttccgctag

SEQ ID NO: 118373 - DNA, 1299 bp, Artificial Sequence
  Description of Artificial Sequence: Synthetic coding sequence
atggaaaggcgcagaatcacgtccgccgcccgcagatcctacgtctcgagtggcgaaatgatggtgggtggcctagcaccaggaagacgactcggcccagggaccaggctcagcctggctcgaatgccacccccattgccaacccgggtggacttcagcctagccggcgctctgaatgctggattcaaagagacgagagcaagcgaaagggctgaaatgatggaacttaacgatcgcttcgcctcctacatagaaaaagtgcgctttctggaacagcagaacaaggcccttgcagccgagctgaaccagctgcgtgccaaagaacccacgaaactcgccgatgtgtaccaagcagagttgcgggaattgcgtctgaggctcgatcagcttaccgccaacagtgccaggctggaggtggaacgggataacctcgcacaagacctcgcaactgtgagacagaaactacaggatgaaactaacttgcgactggaagccgaaaacaacctggcagcctataggcaggaagccgacgaggcaactctggctaggttggacctcgaacgcaaaatcgagtcacttgaagaggaaattcgcttcttacgaaagattcacgaggaagaagtgagagagcttcaggaacagcttgcacggcagcaagtgcatgtagagctggacgttgctaaacccgacctgactgctgctttgaaagagattcgtacacaatatgaggccatggcctcttctaacatgcatgaagccgaagagtggtacaggtctaagttcgccgacttgacagatgctgctgcaagaaatgccgaactcctgcggcaggccaagcatgaggcaaacgattacagacgtcagctacagagtctgacgtgtgaccttgaatcccttcgtggtaccaatgaaagcctcgaacgccaaatgcgtgagcaggaggagaggcacgtcagggaagcagcctcttaccaagaggcgctagcacggctggaagaagaagggcagagtctaaaggacgaaatggcccgccaccttcaggaataccaagatctgctgaatgtgaagctcgccctggacatcgaaattgccacatatcgtaaattgcttgaaggagaggagaaccgaatcactattcccgtccagactttttccaatctccagatccgggagactagtttggacactaaatccgtgagcgagggccaccttaaacggaatatcgtagtaaagaccgtggagatgagggacggtgaggtgatcaaggagtccaagcaggagcataaagacgtcatgtag

SEQ ID NO: 118374 - DNA, 540 bp, Artificial Sequence
  Description of Artificial Sequence: Synthetic coding sequence
atggaacggaggcgaattacttcagctgcccgtagatcctacgtgagctcaggagaaatgatggtggggggtctagcccccggaaggcggttggggcccggtactcgcttaagcttagccagaatgccgcctccactcccaacgcgtgtggatttcagcctggccggggccctgaatgccggatttaaggaaacccgagcctccgaacgcgccgagatgatggagctgaatgatcgcttcgccagttacatcgaaaaggtgcggttcctagagcaacagaacaaggcattggcagcggaactgaaccagttgagggcgaaagaacccacgaagctcgctgatgtttaccaggccgagttgcgagaactccgactgcggctggatcagctgaccgcaaatagcgcacggctggaagtcgagagggataacttggcccaagatctggcgacagtgagacaaaagaagcaaatgaaacccccttggccagtttggatctggcggggccgcctgagccgttggcggcggagaagcggctcctag

SEQ ID NO: 118375 - DNA, 1224 bp, Artificial Sequence
  Description of Artificial Sequence: Synthetic coding sequence
atggaaaggcgccggattacttcggccacccgcctgagcctcgcccgcatgcccccaccgctgcccacacgcgtagatttttcactcgccggcgcccttaacgccggattcaaagaaacacgggcgagtgagcgagccgaaatgatggagctgaatgaccggttcgcgtcttacatcgaaaaagttaggttcctcgagcagcagaacaaggcactggccgcagaactcaaccagttgcgggcaaaagagcctacaaagcttgcggacgtgtaccaagcagagctgagagagctcaggctccggctagatcagctcacagcgaacagtgcaaggctggaggttgaacgcgacaacttagcccaagatttagctacagtgagacagaagctgcaggatgaaactaacctcagactggaagcggaaaataacctcgccgcttaccgacaggaagcagacgaagccactctagcccgtctcgatctggagaggaaaatcgaaagtttggaggaggaaattcgttttctgcgcaagattcacgaggaagaggtccgcgagttgcaggagcagctcgctcgccagcaggtgcatgtagagttggacgtggcaaagccagatctcaccgccgctctgaaagagatccgtacacagtacgaggcaatggcgagttccaatatgcacgaggctgaggaatggtaccggtccaaattcgccgacctcaccgatgctgccgcaaggaatgccgagctgctaagacaggcgaaacatgaagccaacgattatagacggcagctccagtctctcacctgtgacctggagtctttgagaggaacaaacgaaagcctggagcggcaaatgagggaacaggaggaaaggcacgtgcgggaagcggccagttaccaggaggcgcttgctcggctcgaggaggaagggcaaagtctgaaggatgagatggcccggcatctccaggagtatcaagacctgctgaatgttaagctggcactggacatcgagatagctacataccggaaacttctggagggtgaagaaaatagaatcactataccagttcaaactttctctaatttacagattcgcgaaaccagtctggatacgaagtccgttagtgaaggtcatttaaaacgcaatattgtggtaaagacagtagagatgagagatggcgaggtaattaaagagtcaaagcaggagcacaaggacgtcatgtag

SEQ ID NO: 118376 - DNA, 1296 bp, Artificial Sequence
  Description of Artificial Sequence: Synthetic coding sequence
atggagcgtaggcggatcacctccgcagctcgacggtcttacgtgtcttcaggcgagatgatggtcggcggcctcgctcccgggcggagattggggccaggaacccgcttatctctcgcccgtatgccaccgcccctgcccactagggtggatttcagcctggcaggagcactcaacgcgggttttaaggaaacacgcgcaagcgaacgcgcagagatgatggagctgaacgacaggttcgcatcctacattgaaaaggttagattcctggagcaacagaataaggcccttgctgcggagctgaaccagctccgcgccaaggagcctactaaacttgctgatgtctatcaagccgagttgcgtgagctgagactgagactggatcagctgactgccaatagcgcacgactagaagtagaaagggataatctggctcaggatctggctacggttcggcagaagttgcaggacgaaacaaacctccgactcgaagcagaaaacaaccttgcagcttaccgacaagaggccgatgaggccactttggctaggttagatctggaaaggaagattgaatctttagaagaagagatcaggttcctacggaagatccacgaggaggaggtgcgcgagctccaggagcaattggcccgccagcaggtccatgtggaactcgatgtcgcaaaacccgacctgacagccgccctcaaggagatcagaacgcagtatgaggcaatggctagcagcaatatgcacgaggcagaggagtggtaccgatctaaatttgccgacctgacagacgcagccgcacggaatgctgaacttctgcggcaggcaaagcatgaggctaatgactacagacggcagctccaaagtttaacttgcgacctcgaatcactgaggggtacaaatgagtcattggaacgacaaatgagagagcaggaggagcgccacgtccgggaggccgcatcctaccaggaggccctggcccggttggaggaagagggacagagcctgaaggacgaaatggcccggcatttgcaggagtatcaggatctcttgaatgtaaaactcgctctggacatcgagatcgccacttatcgcaagctcctggagggcgaagagaataggataactatcccggttcagacattttctaacctgcagattcgggggggcaagagcacaaaagatggtgagaaccataaggtcactcggtacctgaagtcactcaccatacgcgtgatccccatccaagcccaccagattgttaacggcacgcccccagcccgaggctag

SEQ ID NO: 118377 - DNA, 1317 bp, Artificial Sequence
  Description of Artificial Sequence: Synthetic coding sequence
atggaacggaggcgtattacgagcgctgcacgccgttcctatgtttcttctggagagatgatggtgggtggtctcgcgccaggaagacggctgggccctggcacccgattgagtctggcaaggatgccccctccactgcctactcgggtcgatttctccttggctggggccctaaatgccggctttaaagagacaagggccagcgaaagagcagagatgatggagctcaatgaccgttttgccagctatatcgaaaaggtgcggtttctggagcaacaaaacaaagctcttgccgcagagctcaaccagttgagagccaaagaacctacgaagttggccgatgtgtaccaggcggaactccgagagctgaggctgcgtcttgaccagctcactgccaattccgccaggctggaagtggagcgtgataacttggcccaggacctggctacagtgcgccaaaaattacaggacgaaactaacttgcgtcttgaggccgaaaacaatctggctgcataccggcaagaggccgatgaggctacactggcacggctcgatctcgaaaggaagattgagtccctcgaggaagaaattagatttctgagaaagatacacgaggaagaggttcgggagctccaggaacagttggcccggcaacaggtgcacgtggaactggatgtcgctaagccagatctgacagctgcattgaaagaaatccgaacgcagtacgaggccatggcttccagcaacatgcatgaggccgaggaatggtatcgctcaaagtttgctgatctcactgacgccgctgcccgcaacgccgaactgttgcgacaggccaagcacgaagcaaatgattacaggcgccagttacagagcctcacatgtgacttggaatcccttagggggactaatgagagcctcgagaggcaaatgcgcgaacaggaggagcggcatgtacgagaagcggctagctaccaagaggccttggctcggcttgaggaagaagggcagagcctaaaggacgagatggccagacacttgcaggagtaccaggatctcctgaacgtaaagctggcactggacattgagatcgctacttacaggaagctgctagaaggagaggagaaccgcatcaccatccctgtgcaaacctttagtaatcttcagattcgagggcagtactccagagcctcatgggaagggcactggagtcccgccccaagctctagagcctgtcgtctacttcagacggggactgaagatcaaggcaagggaattcagttgagcctgggggccttcgtgaccctgcagagaagctag

SEQ ID NO: 118378 - DNA, 861 bp, Artificial Sequence
  Description of Artificial Sequence: Synthetic coding sequence
atggccgcgcgggtattaagagcccgcggcgccgcatgggccggcggactgttgcagagggccgccccgtgttccctgctgcctcggctgaggacatggacttctagttcaaaccgaagccgagaagattcctggttgaagtctctgttcgtccgcaaggtcgatccccgaaaggacgcacacagtaatctactcgcaaagaaagagacatccaatctgtacaagctgcagttccacaacgtgaagcccgagtgtctggaggcctacaataaaatttgtcaggaggtgctgccaaagatccatgaggataagcattatccctgtaccctcgtgggcacatggaatacatggtatggggagcaggatcaggcagttcatctctggagatacgagggggggtatcccgcgctcaccgaggttatgaacaagttaagagaaaataaggaattcctcgagttccgaaaggctagaagtgatatgttgctgtctaggaaaaaccagctactgctcgagttctccttctggaacgaacctgtaccgagaagcggaccgaatatttatgagctgcgcagctatcagttgaggccaggaacgatgattgaatggggcaattattgggccagggccattcgctttagacaagatggcaacgaagcagtggggggctttttcagccaaataggccagctttatatggtgcaccatctatgggcttacagagatctacaaaccagggaggacatacgtaatgcagcctggcacaagcatggctgggaggagctggtgtactacacagtccctctgatccaggagatggagtcacggatcatgatacccttgaagacgtctcctcttcaatag

SEQ ID NO: 118379 - DNA, 744 bp, Artificial Sequence
  Description of Artificial Sequence: Synthetic coding sequence
atggccgccagggtgctgagagcccggggggctgcatgggcgggggggttgctgcagagggccgctccttgcagcctcctgcctcgtctcaggacctggacctctagttccaacaggagtcgcgaggattcctggctgaaaagccttttcgttagaaaggtggatcctaggaaagatgcgcatagcaacctcttggccaaaaaagagacctccaatttgtacaagcttcagttcaaaagatgctgtcagcgatttactaaaataaacacaacattggtcctgtggtggggactgggaacccgtgggatggctagcagaactaaactcgagtttctggagtttcggaaggcccgtagcgatatgctgttgtccaggaagaaccagttactcctggaattcagtttttggaatgagccagtgcctcggtcgggccccaatatctatgaacttagatcctatcagctacggcccggaactatgatcgaatggggcaattactgggcccgggctatcaggtttagacaggacggtaatgaggccgtcggcgggtttttttctcagattgggcaactgtatatggtgcatcatttgtgggcctaccgagacctgcaaacgagggaggatatcaggaacgccgcctggcacaagcacggatgggaagaactcgtgtactacaccgtgccactgatacaggagatggagagtcgcataatgattcctctgaagacatcacctctgcagtag

SEQ ID NO: 118380 - DNA, 4683 bp, Artificial Sequence
  Description of Artificial Sequence: Synthetic coding sequence
atggacgatgaagatggacggtgtctcttagacgtgatctgtgacccacaggctctcaacgattttctgcacggctctgagaagttggacagtgatgatttgctagacaatcccggggaagcccagtccgccttctatgaagggcctggccttcacgtgcaagaggcctctggcaaccacctgaaccccgagcctaaccagcccgcccccagcgtcgatctcgatttcctggaggatgatatcctcggtagcccagcaacggggggtggggggggcgggagtggaggcgctgaccagccatgcgatatcctacagcagtcactgcaggaagccaatattacggagcagacactggaggctgaggccgagttagacctgggcccatttcagctgcccacactccaaccggcggacgggggggcagggcctactggcgcagggggtgccgccgcagtcgcagccggcccacaggcattgtttcctgggagcactgacttgttgggcctacaggggccccctactgttcttacacatcaagcccttgtgcccccacaggatgtagttaataaagctcttagcgtccagccttttctccagcccgtcggattgggaaatgttacccttcagcccatcccaggcttgcagggccttcccaatggttctccgggcggagccacagcggcaacgctcgggctcgctcccattcaggtcgtgggtcagccagtgatggccctcaataccccaacctcccagctgttggcgaaacaggttcccgtttcagggtacttggcaagcgctgccggtccatctgagcccgtgaccctggcatctgctggggtttcccctcaaggtgccggcttggttatccagaagaacctctcagccgctgttgcaaccaccctgaatggtaactctgtcttcggtggcgccggcgcggcaagtgcgccaaccgggacgccttccgggcagcctctggccgtggcacccggtctcggctcatcaccactggttcccgcgccgaatgttatcctccatcgtacccctaccccaattcagcccaagcctgccggagtcctgccccctaagttatatcagcttactcctaaaccattcgctccagcaggggctactctgacaatccagggcgagccgggtgcattgcctcagcagcccaaggctcctcagaatctgaccttcatggccgcgggaaaggcaggacagaatgtggtgttatctggatttccagccccggccctccaagcaaacgtgtttaaacagcctcctgccacaacgaccggcgcagcgcccccacagccccccggggctttgtccaagcccatgagcgttcacctgctgaaccaggggagctccatcgtgattcccgcccaacatatgctccctggccagaaccagttcctgctgcccggagcaccagcagtgcagcttccccagcaactgagtgctcttcctgccaatgtaggtggccagatattggccgccgccgcaccccacaccggaggacaactgatcgccaacccaatcctaaccaatcagaaccttgcaggtcccctgtccttgggcccggtgctggctccccattccggagctcatagtgcgcacatcctgtctgctgcccctatccaagtcggtcaaccggccctgtttcagatgcccgtgtctcttgccgcaggatccctacccacccagtctcagcccgccccagctggtccggctgctacaacagttctgcagggcgtgacgctcccaccgtcggctgttgctatgctgaacaccccagacgggttagttcaacctgccacacccgccgccgccacaggcgaagccgctcccgtcctcacagtgcagccagcgcctcaggctcctcctgccgtatctacgccgcttcccctggggctccaacagcctcaggcgcaacagccaccgcaggctccgaccccgcaggctgccgctcccccacaggccaccacaccacagccgagcccggggttggcatccagccccgagaagatcgtgctggggcagccaccatctgcaacacccacagcaattctcacgcaggacagcctgcagatgttcttgccgcaggagcgaagccagcaaccactgtccgcggaaggtccacacctaagcgtgcccgctagcgttattgtgtcagcgcctccgccagcccaagacccagctccagccacacccgtagctaaaggtgctggactcggaccccaagcccccgactcccaagcctcaccagccccagcccctcagatcccagccgcagctccattgaagggccctggaccttccagctcgccttccctgccacatcaagcaccactgggagatagcccacacctgccctccccccatcccacaagacctcccagtagaccccccagcaggccccaaagtgtaagccggccaccctctgaaccccccctacatccttgtccccctccacaagcacccccaaccctgcctggaattttcgttatccagaatcagctaggcgtgcctcctcctgcctctaaccccgctccaacagctccaggcccacctcagcctcctcttcggccacagagtcagccccctgaaggccctttgccaccagctccacatctgcctccctcaagcacgtcttctgcagtggcctcctctagcgagactagtagcagactgccagcccctactccttctgactttcagctgcagttccctccgagccagggccctcataaatctcctaccccacctccaactctgcacctggttccagaacccgcggctcctccgcccccgccaccacgcactttccagatggttaccactcctttcccagctttgccacagcccaaagcgcttttagagagattccatcaagtccccagtggcatcatacttcagaacaaggccggcggcgcccccgctgcgcctcagacatcaacttctttgggccccttaacatctcccgcagcaagcgttctggtttctggacaggcaccatctgggacccctacagcaccctcccatgctcccgcacctgctcccatggccgcaacgggcttgccacccctactcccagctgagaacaaagctttcgccagcaacctgccaactctgaacgtggctaaggctgcaagtagcggccccggaaaacctagcgggctgcagtacgaatctaaattgagcggcttgaagaagcccccgacccttcagccctctaaggaggcatgtttcttggaacaccttcataagcatcagggcagcgtgctccatcccgactataagaccgctttcccatccttcgaggacgcactccacaggttgctaccctaccacgtatatcagggggctcttccctccccctctgactaccacaaggtcgacgaggaattcgagacagtgagcacacagctgctaaagcggactcaggcgatgttgaataagtaccgccttcttctgttggaggagagccgacgtgtgagcccaagtgctgagatggttatgatcgatcgaatgtttatacaggaggaaaagacaacacttgcactggataagcaattagctaaggaaaaaccagatgaatacgtgtcaagctccagaagcctggggcttccaattgcggcatcgtcagagggtcaccgactgccgggacacggccctctgagctcttcagctcccggggcaagcacccagcctccaccccatctgccaacaaagctggtcatccgacacgggggcgccggagggtccccttcagtgacctgggctagagcgtcatcttccctgagttccagctcaagttcctcctctgctgccagctccctcgatgccgacgaagatggtcccatgccatcaagaaatcgcccgccaattaaaacttatgaagcaaggtcccgtatcggtctgaaactgaagatcaaacaagaagcgggtctgagcaaggttgtgcacaacacagcactggatccggtgcaccagccaccaccgcctcctgccacccttaaagtggccgagcctcctccaaggccaccgcctcctcctccgccaaccggccagatgaacggaacagtggaccaccccccgccggccgcacccgagaggaaaccactaggcacagcaccccattgtccacgactgccgttgaggaaaacatatcgagagaacgtcggtggtcccggggcgcccgaaggcacacctgctggacgcgctcgcggtgggtcacctgctccgctaccagctaaagttgatgaggctacttccgggttgatcagagagcttgcggcagtggaagatgagctgtatcagagaatgctgaagggcccccctcccgagcccgctgcatccgccgcgcagggcactggcgacccagactgggaggcaccggggttacctcctgcgaagcgcagaaagagcgaaagcccagacgtggaccaggcctcattctcaagcgatagtcctcaggatgacactctaaccgaacatctccagagcgcaattgatagcattctgaacttgcaacaagctcctgggcggacaccggccccctcgtacccccacgccgcctccgcaggaactccagcttccccccctccattgcatcgtcctgaagcctatccaccgtcttcacacaacggtggcttgggcgcccgtactctaacccggtag

SEQ ID NO: 118381 - DNA, 1437 bp, Artificial Sequence
  Description of Artificial Sequence: Synthetic coding sequence
atggcagccggggggtccggggtgggaggcaaaaggagttccaaatccgacgcagactccggctttctagggcttagaccgacctcagtggaccctgcactccggcggcggcggagaggacctagaaataagaaacggggatggagaaggctagctcaagaacctctgggactcgaggtggatcaattcttagaggatgtccgtctgcaggagaggaccagtggaggccttctaagcgaagctcctaacgagaaacttttcttcgtggataccgggtccaaagaaaaaggactaaccaagaagagaaccaaagtgcagaagaagagcctccttctaaagaagcccctgcgggtcgatctcattctggagaacaccagcaaggtgcctgcacctaaggatgtactggctcaccaagtccccaacgccaagaagctgcggcgcaaggagcagctgtgggagaagctagcaaagcagggcgagctccctagagaggtaaggcgagcacaggccaggttactgaacccgagcgccacaagagcaaagccgggcccccaagataccgtggagagacccttctatgacctgtgggccagcgacaatcccctggatcgtcctttggttggacaggacgagtttttcctagagcaaaccaaaaagaagggggtcaaacgtcccgctcggctccatacaaagccctctcaggcccccgccgtcgaggttgcccccgccggcgctagctacaacccctcctttgaagaccatcagacactgctcagcgctgcccatgaggtggagctccaaagacagaaggaggccgaaaagttagaacggcagcttgcgcttccggcaacggagcaggctgcaacccaggagagcacatttcaggaactgtgcgaaggcttactggaggagtcggacggcgagggtgaacctggccagggtgagggaccggaagctggcgacgccgaggtttgtccaacccctgccagactcgccaccaccgaaaaaaagacggaacagcagcgacgaagggaaaaggcagtgcatagactgcgggtgcagcaagctgcattgagagccgctcgcctcagacatcaggaattgttccggctgcgcgggatcaaagcacaagtggctctgagattagccgagttggctcgcaggcagcgccggaggcaggccaggcgggaggccgaagctgacaagcctcgtaggctcggaagactcaaatatcaagctcctgacatcgatgtccagctgagctcagagttgacagactcgctcaggaccttaaaacccgaaggaaacatcctgcgcgatagattcaagagctttcagagacgcaacatgatcgaaccgcgagagcgggctaaatttaagcgcaagtacaaggtcaagctggttgagaaaagggcttttagggaaatccagctgtag

SEQ ID NO: 118382 - DNA, 1419 bp, Artificial Sequence
  Description of Artificial Sequence: Synthetic coding sequence
atggcagccggcggcagcggcgtaggcggaaagcgaagtagcaagtccgacgccgactctggattcttgggcctgagaccaacatccgtggatccagctctgcgacggaggaggcgtggcccaagaaataagaagcggggctggagaagactggcacaggagccactggggttagaggtggaccagttcttagaggacgtgagactacaggagagaacttcaggcgggttgctgagcgaggcccctaacgagaaactgttcttcgtcgatactggctcaaaagaaaaggggctgacaaaaaagcggactaaagtccagaagaaaagtttgcttcttaagaaacctctcagggtcgacctgatcctggagaacacctcaaaggtgcctgctccgaaggacgtcttagcacatcaagtcccgaatgcgaaaaaactgagacggaaggagcagttatgggagaagctggccaagcagggtgagctgcctcgggaggtgcgcagagctcaggcacgcttgctaaacccctcagcaacccgagcaaagcccggaccccaggacaccgtcgaacgacctttctacgatctgtgggcctccgataacccgttggaccgaccactcgtcggccaagatgaattctttctggagcagacaaagaaaaagggtgtcaaacggccggcaaggctccataccaagccttctcaagcgccagctgttgaagtggcacctgccggcgcttcctacaaccccagttttgaagatcatcagacactgctgtctgccgcgcatgaagttgagttacagaggcagaaggaagccgagaagcttgaacgacagctggcccttcccgcaaccgaacaggccgctactcaggaatccacattccaagagttatgcgaaggactgctcgaggagagcgacggcgagggagaaccaggccagggagagggaccagaggctggcgacgctgaggtctgtccaacaccagcccgccatcacagagaagaggacggagctgccgcggccaggaggctgtgcaccggatgcgggtactctaggcctagatgcggcccaccgggctcgggtactaggtcctgctctgggtgtgctggttcaccaggcggcccggaggcgggcggggcccgacgacagaggcggcgacaggcacgccgagaggcagaggccgacaaaccacggcgtctcggcaggcttaagtaccaagccccagatatagatgtgcagctatcatccgagctgacagactcattacgcacactcaagcccgaagggaacatcctccgagatcgtttcaagtcctttcagcgccgcaatatgattgaacctagggagcgggcaaagttcaaaagaaaatataaggtgaagcttgtcgagaagcgggccttccgcgaaatccagctgtag

SEQ ID NO: 118383 - DNA, 792 bp, Artificial Sequence
  Description of Artificial Sequence: Synthetic coding sequence
atggccgccggggggagtggggtgggcggtaagaggtcctctaaatctgatgctgactccggcttcctaggcttgagacctacgtccgtggacccggcattgaggcggcgacgcagggggcccaggaacaagaagcgcgggtggcgcaggttggctcaggaaccgcttggccttgaggtggatcagtttctcgaggatgtcagactccaggaacgcacatccgggggattgttatccgaggcccctaacgagaagctgttcttcgttgacaccggatccaaggagaaaggactcaccaagaaaagaaccaaagtccagaagaaatctcttctgctgaagaagcctttgagggttgacctgatacttgaaaacacaagcaaggtcccagcacccaaggacgttctggcccatcaagtccccaatgcaaagaaactccggcggaaggagcagctttgggcaagtgataacccccttgatagaccattggtaggccaggatgagtttttccttgaacagaccaagaagaagggggtgaagaggcgggaggccgaggccgataaacctcgtagactgggtcgcctgaagtatcaggcccccgatatcgacgtgcagctcagttctgagttgactgatagtctgaggacactgaagcctgagggtaatatcctgagagaccggttcaagtcatttcagcgacgcaacatgattgagccaagggagagagcaaaattcaaaagaaaatataaggtgaagttggtcgagaaacgcgccttcagggagattcaattatag

SEQ ID NO: 118384 - DNA, 1656 bp, Artificial Sequence
  Description of Artificial Sequence: Synthetic coding sequence
atggcaagaggcgctgaagggggcagaggggacgccggctgggggctgagaggtgccctggccgctgtcgctttgctttctgccctgaacgctgccggaacagtattcgccctttgccagtggagaggactgagctcagccctacgggctcttgaagcgcagcggggccgtgaacagcgggaggactccgccctgcggtcctttcttgcggaactctcaagggctccacggggagcctccgcaccgcctcaagaccctgcgagttcagcccgcaataaacggtcacatagcggggagcctgcacctcatatcagagccgaaagtcacgacatgctcatgatgatgacatattcaatggtgccaatcagggttatggtcgacctttgcaactccacgaagggcatatgtctcacgggtccttcaggccctcctgggcctcccggagctggggggctgcccggacacaatgggctggatggtcagccaggacctcaaggcccgaaaggggagaaaggcgctaacgggaagaggggcaagatgggtattcctggggcagccgggaatcctggcgagcgtggggaaaagggcgatcacggcgaattgggcctacagggtaatgaggggccaccaggacagaagggggagaagggtgataagggcgacgtttcgaacgatgtacttctggccggtgcaaaaggggaccagggccccccgggtcctcccggtccccccggtcctcctggtccccctggacctcccggcagccggagggccaaaggcccacgccagccatccatgttcaacggacaatgcccaggggagacctgtgctattccaaatgatgacacactggtcgggaaagcagacgagaaggcatctgaacatcattccccacaggcagagagcatgatcacgtcaatcggcaacccggttcaggtgctgaaagtcaccgagacttttggaacatggatcagggaatcggcgaacaaaagcgacgacaggatttgggtgactgagcatttcagtggcatcatggtcaaggagttcaaggatcagccgagtctactgaacggcagttacacatttattcacttgccctactactttcatggatgtgggcacgtagtctataataatagtttatattatcacaagggaggctcaaacacactggtcaggtttgagttcgggcaggagacaagtcagacacttaagctggaaaatgcgctatattttgatcgaaagtacttgttcgcaaattcaaaaacctatttcaacctcgccgtggatgagaagggcttatggatcatctacgcttccagcgttgatggatccagtatcctggttgcacagctcgatgaaagaactttcagtgtagtccagcatgtgaatactacttaccccaagagcaaagcaggaaacgccttcatcgcccgcggaattctctacgttacggatactaaagacatgagagtcaccttcgcatttgatctactcggagggaagcagattaacgctaactttgacctgaggactagccagtcagtcctggctatgctggcgtataatatgagggaccagcatctctacagctgggaggatgggcatttaatgctttatcccgtgcagttcttgtccactactctcaatcagtag

SEQ ID NO: 118385 - DNA, 1284 bp, Artificial Sequence
  Description of Artificial Sequence: Synthetic coding sequence
atggtggacctgtgcaattcaaccaagggtatctgccttacaggcccgtcgggaccgcctgggcctcccggtgccggtggacttccaggccataacggtctggatgggcagccaggtccacaaggtcccaaaggggagaagggagctaatggcaagcgcgggaaaatggggattccgggagccgctggaaaccccggggagagaggagaaaagggggaccacggtgagctgggactacaggggaatgaaggcccccctggacagaagggagagaaaggggacaagggcgacgtgtcaaatgacgtcctgctcgctggagctaaaggcgaccagggaccacccggacctcccggacctcccgggcctcccgggccccctggcccccccggatctcgaagggctaaggggccacgacagccctctatgttcaacgggcagtgcccaggcgaaacctgcgccatcccaaacgacgatacactggtgggcaaggcagatgaaaaagcttcagaacatcatagccctcaggctgagtccatgattactagcattggcaaccctgttcaggtcctgaaggttacggaaactttcggaacctggatccgggaaagcgcgaataagagtgacgatcggatctgggtgacggaacacttcagcggaataatggttaaggagttcaaggatcagccctcactgctgaatgggtcctacacctttatccacctaccctactatttccacggctgcggccatgtggtatacaacaattctctttattatcacaaagggggaagcaatactttagtgcggttcgaatttggacaggagacatcacaaacgctgaagcttgagaatgcactctattttgacagaaaatatttgttcgccaactccaagacatactttaacctcgcggtggatgaaaaaggcctgtggattatttacgccagttccgtggatggatccagtattctggtcgctcagctggatgagcgaacgttctccgtggttcaacatgtcaacactacgtaccccaagtcaaaagctgggaatgctttcatcgcacgggggattctctacgtgacagatacaaaagacatgagggtaacgttcgcgtttgacctcctcggtggcaagcagatcaacgccaactttgaccttagaacctctcagagcgtacttgctatgctggcttacaatatgagagatcaacatctgtattcttgggaggatggccacttaatgctttaccccgtgcagtttctaagcactacccttaaccagtag

SEQ ID NO: 118386 - DNA, 1284 bp, Artificial Sequence
  Description of Artificial Sequence: Synthetic coding sequence
atggtggacctctgtaattcaaccaaagggatttgcttaacagggccaagtggtccccccggccctcctggcgccggaggcctaccgggccataacggcctggatggtcaaccgggccctcagggtcccaagggcgaaaaaggcgccaatggaaaacggggcaagatgggaatacccggcgccgccggcaaccccggggaacgaggcgagaagggtgaccatggggagttgggtttgcaggggaatgagggacctcccgggcagaaaggcgagaaaggagacaagggagacgtgagtaatgatgtactactcgctggagcaaagggcgatcagggcccccctgggccacccggcccccccgggcctcccggtccccctggacctcccggaagcagacgggcaaagggtccccggcagccatctatgttcaatggccagtgtccgggggaaacctgtgcgatccccaatgatgatacccttgtggggaaggctgatgagaaggcatctgaacaccactcacctcaggcagagtccatgattacaagcattgggaaccctgtacaggtgctcaaagttaccgagacctttgggacatggatacgggagtcagccaacaagtcagacgacagaatttgggtgacggaacatttctcaggtatcatggtaaaggaattcaaggaccagccctctttacttaacggttcatacacattcatccatctcccatactatttccatgggtgcggccatgtggtctataacaattccttatattatcacaagggaggaagtaatactctcgtgaggttcgaattcggtcaggagacgtcccaaactcttaaactggagaatgctttgtactttgataggaagtatttgtttgccaactcaaagacctattttaatctcgctgtagacgaaaaaggtttgtggataatttatgcctcctcagtggacggcagttccatcctggtcgcacagctcgacgagcgcaccttttctgttgttcagcacgtgaataccacatatcctaagagtaaggccggcaacgctttcatcgctagaggaatcctatacgtcacagatacaaaggatatgcgagtcaccttcgcttttgacctgctgggaggaaagcagatcaatgccaactttgacctgcggacctctcagtctgtcttagcaatgttagcatacaacatgagggaccagcatctgtacagctgggaagatgggcacctaatgctgtacccggtacaatttctgagcactacgctgaatcagtag

SEQ ID NO: 118387 - DNA, 1575 bp, Artificial Sequence
  Description of Artificial Sequence: Synthetic coding sequence
atgcattctttagacgagcccctggacctaaagttaagcattacaaagcttcgtgccgccagggagaaaagggaacgcacattgggggtagtgcgcccgagggcactgcaccgggaactcggcctggttgacgacagccctaccccaggaagccccggttcccccccaagtggttttctgctaaattcaaaattccccgagaaggtcgagggaagattctcagctgcccctctggtggatctttctcttagcccaccctcaggcctcgattccccaaatggtagcagctcactcagccctgagcgccagggaaatggggacctacccccggtgccctccgcctcggacttccagccactgcgatatctggacggagtgccttcctccttccagttctttctcccactgggctctggcggtgctttacatctccccgcatctagcttccttacaccacctaaggacaagtgcctaagccccgatctgcctcttcctaagcagctcgtgtgccgttgggctaaatgcaaccagctcttcgaattgctgcaagatctcgtggatcacgtgaatgattatcacgtgaagcctgaaaaagatgccgggtattgctgccactgggaaggctgcgcacgccacggccgcggctttaatgctagatataaaatgctcattcatatcagaacacacacaaacgaaaaaccacatcggtgccccacgtgttccaaatccttcagccgcctcgaaaatctaaagattcacaaccggagccacactggcgaaaagccctacgtatgcccgtacgaaggttgcaacaagagatatagtaattcgtcggaccggttcaagcataccaggacacactatgttgataagccatattactgcaagatgccggggtgccacaagcggtataccgatccgagctccctgcgcaaacatattaaggcccatggccacttcgtatcccacgaacagcaagagctgttgcagctacgccctccacctaagcccccactccccgcaccagatgggggcccctatgtgtcaggagcgcagatcataatacctaatccagccgcgttgtttgggggccctggcctgcccggactacccctgcctctagctcccggaccgctggatctcagcgccttagcatgtggcaatggcgggggctcaggtggaggcggagggatgggaccgggactgcctgggcctgtattacctttaaatctggccaaaaatccccttctgccttctccattcggcgccgggggtctaggtctcccggtcgtcagcttgttagcgggtgccgctggcggcaaagcagagggagagaagggcagaggcagcgtgcccacacgcgctctcggaatggaaggccacaaaacacccctggagcgcacggaatccagttgctctagacccagtcccgacggactgcctttgcttcccgggactgtgctggacttgtctacaggagtcaactccgcagcctcatctcctgaggcactggctcctggatgggtggtgattccccccggatccgtgttgctgaagcctgcagtggtgaattag

SEQ ID NO: 118388 - DNA, 1575 bp, Artificial Sequence
  Description of Artificial Sequence: Synthetic coding sequence
atgcacagccttgacgagccgttggaccttaagctgtccatcacaaaactacgggccgccagggagaagagggagcgcactctgggagtcgtacggccaagggccctccatcgggagctcggcctggtcgacgattctccgacacctggttcccccggttctcctccttcaggtttccttttaaatagtaagtttcctgagaaggtcgaaggaaggttcagcgctgcacctctggtcgatctctctctatccccccccagcgggttggattcacctaatggctcgtcctccttgtccccagagagacagggcaacggagatctcccccctgttccttctgcgtctgacttccaacccttgagatacctcgacggggttccgtcgtcatttcagttttttttgccattgggctcaggcggcgcacttcatctgcctgcgtcctcatttctgacccctcctaaggataagtgtctcagtcctgatctgccgttgcccaagcagttagtatgtaggtgggctaaatgcaatcagctgttcgaactcctacaagatctggtagatcatgtgaacgactaccatgtgaaacctgaaaaggatgcagggtactgctgccattgggaaggatgtgcaaggcacggacggggctttaatgcccgatacaagatgctgatacacattcgcacccatacaaatgagaagccacaccggtgtcctacttgctccaaaagcttcagcagactggaaaatctcaagatccacaatcggtcccacactggagagaagccctatgtgtgtccatatgagggttgcaacaagcggtatagcaatagctcggacaggtttaagcatactcgaacccactacgtcgataaaccatactattgcaaaatgcctgggtgccataaacggtatactgacccctcttccctgcgaaagcatataaaagctcacggacacttcgtttctcacgagcagcaggagctccttcagctccggccgccccctaaaccacctctgcctgcccctgatggagggccttatgtgagcggagctcagataatcatccctaacccagcggctctgttcgggggccccggcctgccaggtctgcctctccccttggcaccaggtcccctggacttgagcgcattagcttgcggcaatggaggaggatcgggtggaggaggcggcatgggtcccggtctaccagggccagttttgcccctgaatctggctaagaacccactgttgccaagtccgttcggtgcaggcggtctggggcttcccgtcgtaagtctgctggcgggtgccgcaggtggcaaggccgagggtgaaaagggacgagggtccgtgcctaccagagctctgggaatggaggggcacaagacacctctggaacgtactgaaagtagctgctcccgacccagccccgacggcctgccactgctgccggggaccgtactggacctatcaacaggagtgaactcagcggcgagctcacctgaggccttagcacccgggtgggttgtgatcccccccggatctgtcttgctgaagcccgccgtggtgaattag

SEQ ID NO: 118389 - DNA, 2328 bp, Artificial Sequence
  Description of Artificial Sequence: Synthetic coding sequence
atgatggttcaacgattgggtctgattagtccgcccgcatctcaggtttctaccgcctgcaatcagatcagcccgtccctccagcgtgccatgaatgccgctaacctgaacattccaccttcggacacacgcagccttatctctagggaatcattagcatccactaccttatctttgactgagtcccaatctgccagtagtatgaaacaggagtggtcccaaggataccgagcacttcccagtctgtcaaatcatggctctcagaatggcctcgacctgggcgacctgttgtcccttccaccaggcacctcaatgtccagcaattccgtgagcaattccttaccttcttatctgttcggcacagaatcctctcacagtccatatcccagtccaagacatagtagtacgcgctcacactccgcacgaagcaagaagcgtgccctgagcctgtcccctctgtccgatgggattggcattgatttcaatacgattattaggacttcacctacctcccttgttgcttacattaacgggtcgcgggccagtccagccaacctgtctcctcagcctgaggtatacggccactttctgggcgtacggggatcttgcattccacagccccgacccgtccctggatcacagaaaggggttctcgtcgcaccaggagggctggccctcccagcctatggggaggacggggccttggaacatgaacggatgcaacagttggaacacgggggtttgcagccgggattggtaaaccacatggtagtacagcatggtctccccggccctgattcacaatcagccgggctcttcaaaacagagagactcgaggagttcccaggaagtacagtggatctccctcctgccccacctctcccaccactccccccccctcctggaccaccacctccctatcatgcacatgcccatctccaccaccctgagctgggtcctcacgcgcagcaactggctctgcctcaagctacactggatgacgatggggaaatggacggcatagggggaaagcactgctgcaggtggatagactgcagcgccctttacgaccagcaggaggaactggtgcgacacatcgagaaggttcatatcgaccagaggaagggcgaggacttcacttgcttctgggctggctgcccaagacggtacaaaccttttaacgctagatataagcttctgatccacatgcgggttcacagtggggagaaacccaataagtgtacttttgaagggtgcgagaaggcattctccagactggagaatcttaagattcacctgcgcagccacactggtgagaagccctatctgtgccagcatccaggctgtcagaaggcattttcaaactccagtgatcgcgcgaagcaccagagaacccacttagacacaaaaccctacgcctgtcagattccagggtgtactaagcgctacaccgatccctcctcactgcgaaagcatgtaaaggcccacagctctaaagagcagcaagcgcgcaaaaaacttagaagtagcacagaactgcatcctgatctcctgacagactgtctcaccgtgcagtccctccaaccagcgacctcaccaagagatgctgctgctgaaggtacagtaggtcgatctcccggcccggggccagatctgtatagtgccccaatttttagctccaattacagttctagatcaggcacagccgcgggcgcagtaccgccccctcacccagtgtctcaccctagccccgggcacaacgtccagggctctccacacaacccctccagccagctgcccccactcactgccgtagatgccggcgcagagagatttgccccatctgctccctctcctcatcatattagtcctagacgggttccagccccgtccagcatactgcaaaggacgcagcctccatacacacaacaaccatcaggaagccatctcaaatcctatcagcccgagacaaattctagtttccaacctaatggaatacatgtccacggtttttacggccagctccagaagttttgtcctcctcactatcccgacagccagcggatcgttccccccgtgtcctcctgctcggtggttccctccttcgaggattgtttggtccctaccagcatgggccaggccagcttcgacgtgtttcatagagcattctctacacacagcggaattactgtctacgatttgccttcatcatctagttccctttttggagaatccctcaggtcgggtgcagaggacgccacattcttacagatctccaccgtcgatcgatgcccaagtcagcttagttcagtgtatacggagggatag

SEQ ID NO: 118390 - DNA, 2793 bp, Artificial Sequence
  Description of Artificial Sequence: Synthetic coding sequence
atgaacggacggtcttgcagcatgagccttcaccgtacatccggcaccccccaggggccccgtatggtgtccggccaccatattcctgcgattcgggcgcacagtggcactccaggaccctcgccatgcgggtccacctcatcacctaccatggctagcctagcgaataacctgcacctgaagatgccgagtggtggggggatggccccccagaataacgtcgcagagagtaggattcacctccctgccttatctcccaggcggcagatgttaaccaatggtaagccccggtttcaggtgactcaggccgggggtatgagcgggagccacactctcaagccgaaacaacaagaattcggcagcccattccctccaaacccggggaagggcgcattgggattcggtccacagtgtaagtcaatagggaagggatcatgcaacaacctggtggttacttcatcaccaatgatggttcagcggttgggcctcataagccccccagcatcacaagtgagcacagcatgcaatcagatctcaccctctctacaacgagccatgaacgctgccaatctcaacatccctccatctgacactcgttcattgatttcgcgagaatctttggctagcacaacgcttagtttaaccgaatctcagagcgcaagcagtatgaaacaggaatggtcgcaggggtatcgagcactgccttccctgtcaaatcacggtagtcagaatggtctggacctgggggacctgctgtctctgccccccggcacaagtatgtccagtaattcagtgtccaattcattaccctcttaccttttcggtacggaatcttcccattccccttatccgtcccccaggcactcaagcacacgcagccattcagcacgcagtaagaaacgggccctctctctgagtccgttgtctgatggcattggcatagactttaacaccatcataaggacttcacctacatcgctcgtcgcctatattaacggaagtagagccagccccgcgaaccttagccctcagcccgaagtgtacggacactttctgggggttcgagggtcatgtatcccacagcctcgccccgtacccggatctcaaaagggtgtgttagtggcccccggtgggctggctctgccggcctacggcgaggatggcgccctggagcatgaaaggatgcaacagctggaacacggaggcctacagcctgggctcgtgaaccacatggtggtgcagcacggtttgcctgggccggatagccagtctgccggcctgtttaaaacggaaagattggaagagtttcctggctctaccgtcgacctacccccagctcctccccttccgccactgccccctccccccggacctcccccaccctatcacgcccatgctcacctgcaccaccctgagttgggtccccatgctcagcaactggccctgccacaagcgacattagatgacgacggagaaatggacgggattgggggcaagcactgttgtcgctggatcgactgcagcgccctgtacgaccagcaggaggagctggtgcgacacatcgagaaggttcacattgatcaacgtaaaggcgaagattttacctgtttttgggccgggtgcccacgccgctataagcccttcaacgcgcgatacaaacttctcattcatatgcgcgtccactctggtgaaaaaccaaacaagtgcactttcgagggatgtgagaaagccttctcccgacttgagaacctgaaaatacatctgcgctcccacacaggcgaaaagccatatctttgccagcaccctggctgccagaaggcttttagcaactcatctgatagagctaagcaccagcgaacacatctggacaccaaaccttacgcctgtcagatcccaggatgcaccaagcgctacacagacccttcgtctttgcggaaacacgtcaaggctcactcaagtaaggaacagcaggcaagaaagaaactccgctcctccaccgagctgcaccccgacctgttaactgactgccttacggtccagtccttgcagcctgcaactagccctagagatgctgctgccgaagggactgtcgggcgctccccaggtcctggaccggatctctattctgctcctattttttcctcgaactactcttccagatcagggaccgccgctggagcagtccccccccctcacccagtctctcacccttctccaggccataatgtgcagggcagcccccataatccctcaagccagcttccacctttgactgccgtggatgccggagccgagagatttgccccctctgcaccgtccccccatcatatcagtcctagacgggtgccggcaccaagcagcattttacagcgaacccagcccccctatacacagcaacctagtggttctcacttaaagtcataccagccggaaaccaactctagtttccagccaaacgggatccacgtgcacggattctatggccagctgcagaagttttgccctccccattatcccgacagtcagagaatcgttccaccggtcagcagctgttcggtggtgccgtctttcgaggactgtctggtccccactagtatgggacaggcatcctttgacgtgtttcatcgcgctttcagcacccattctgggatcactgtgtatgatctgccttcatcatcctctagtctctttggggagtccctccggtccggcgccgaagacgcaacctttctgcagatttcgaccgtggatcgctgtccatcccagctgtcctccgtctacacagagggctag

SEQ ID NO: 118391 - DNA, 270 bp, Artificial Sequence
  Description of Artificial Sequence: Synthetic coding sequence
atgatggttcagagactagggttaatttcgccacccgcctcccaggtaagtactgcatgtaatcagatctcacccagtctgcaacgggccatgaacgctgcaaatctaaacatacccccctctgacacccgctctttaatatcccgtgaatctcttgcctcgactactctgtctctgaccgagtcccagagcgcatcaagtatgaagcaggaatggtcacaaggatacagagccctgccttctctgtcgaatcacgggtcgcagaattag

SEQ ID NO: 118392 - DNA, 735 bp, Artificial Sequence
  Description of Artificial Sequence: Synthetic coding sequence
atgaacgggagaagttgttctatgtcattgcataggacaagtgggaccccccagggaccaaggatggtttctggacatcacattcctgccatccgggcccatagcggaacccctggccctagcccctgcggtagcacctcgagtcccactatggcgagcttagccaacaaccttcacctgaagatgcctagtgggggcggaatggctccgcaaaataatgtcgctgagtctagaattcatttgccggccctttctccccgacgccagatgctgactaatggcaaaccacgatttcaagtcactcaagcagggggcatgagtggtagccacacgctgaagcccaaacaacaggagttcggaagccctttcccccctaacccaggcaagggagcactgggcttcgggcctcagtgcaaatccattgggaaaggctcttgtaataacctggtggtgacctcttctcccatgatggtccagcggttgggattgatcagtcctcctgcttcgcaggtttctactgcctgcaatcagatttcgccaagccttcagagagccatgaatgccgccaatctcaatattcccccgtccgacacgcggtccctaatcagcagagaaagcctcgcgtcaactacactatcactgaccgagtcacagagtgccagtagcatgaaacaggagtggtctcagggttatcgagccttgccttccctgagcaatcacgggagccagaattag

SEQ ID NO: 118393 - DNA, 270 bp, Artificial Sequence
  Description of Artificial Sequence: Synthetic coding sequence
atgatggtccagcggctggggctgataagccctccagcttctcaggttagcaccgcctgtaatcagatttctccgagtctgcagagagccatgaatgccgccaacctaaatatccctccaagtgatactaggtcactcattagcagagagtcactcgcttccactaccctctctcttactgaaagccagtcagcctcttccatgaagcaggagtggtctcaagggtaccgcgcccttccatctctgagtaatcatggttcacagaactag

SEQ ID NO: 118394 - DNA, 270 bp, Artificial Sequence
  Description of Artificial Sequence: Synthetic coding sequence
atgatggtgcaaagactgggactcatctcacccccagcctcacaagtgtcaacagcttgtaaccagataagtccttccctgcagcgtgctatgaatgcagccaacctgaatatccctccatctgacaccaggagtcttatctcaagggagtccctggcatctaccacattgtctctgaccgagtctcagtctgcttctagcatgaagcaggagtggtcacagggatacagagccctgccatctctatccaatcatggctcacagaattag

SEQ ID NO: 118395 - DNA, 735 bp, Artificial Sequence
  Description of Artificial Sequence: Synthetic coding sequence
atgaacgggcgcagctgctccatgagcttgcaccgaaccagtggcaccccccagggaccaagaatggtgtcaggccaccacatccccgcaatacgggcccatagcggcacgcctggaccttcgccgtgtggtagtacaagttcgccaactatggcctcattagccaataatttgcacctcaaaatgccatccggagggggtatggctccacagaacaatgtggcagagagccggatccacctgcctgcgctatccccgaggaggcaaatgctgactaatggcaagccacgcttccaggttactcaggccggggggatgtccgggtcccacacgttgaagcccaagcaacaggagtttggctctcctttccctccaaatcccgggaagggcgcccttgggttcgggcctcaatgcaagagcatcgggaagggatcctgtaacaacttagtcgtgacatccagcccaatgatggtgcaacgactgggcctgatttccccacctgcttcccaggtgtcgacggcctgcaatcagatatcccctagcttgcaaagagccatgaatgccgctaacctaaatattcccccttccgatacaaggagcctgatctccagggagtctcttgcgagtactacgttgagcttgaccgagtctcagagcgcctcctctatgaaacaggaatggtcccagggttatcgggccttaccatccttgtccaaccacggcagccaaaactag

SEQ ID NO: 118396 - DNA, 219 bp, Artificial Sequence
  Description of Artificial Sequence: Synthetic coding sequence
atgcaccgcaggcgtctagcattgggacttggcttctgtttgctcgcaggtaccagcctctccgtgctctgggtgtatttagaaaattggctgccagtatcctacgtgccttactatttgccctgtcctgagattctcctcgagtataggggtgtgatatctgctcactgtaacctgcacctaccaggctctagcaattgtcatgcttcagccacctag

SEQ ID NO: 118397 - DNA, 483 bp, Artificial Sequence
  Description of Artificial Sequence: Synthetic coding sequence
atgcaccggcgcaggctcgcactgggattagggttctgtttgttggcaggcacgtccctgtccgtgctgtgggtatatctcgagaactggctccccgtgagctacgtcccgtactatctcccgtgcccagaaattctgcccatgatgatggctctaagctgtctgtgccaccagcagcatgaagcggccttgcaggaaggcgaggcaacacccgcacgtggtatggtgacagtcccctctgcacaggccgcaggcgctcaggcccatacggccgcggacactcacacactcgtcggggctcacaggctgagaggtaacttacagcctagagcctctgcagcgcacttgccggcaactgaaccagatcactggggccatggggtctgccgaggggaggtgcattcctttcatccagtcctgcccggcgtctcccggggcgtgcttcatgcttgggtgcccggtgcactcctgcatttgcactag

SEQ ID NO: 118398 - DNA, 1044 bp, Artificial Sequence
  Description of Artificial Sequence: Synthetic coding sequence
atgcacagacggagactggccctcggactagggttctgtcttctagccgggacgagtctttcagtattatgggtctatctggaaaactggctgccagtttcatatgtgccatattatctgccatgcccagaaatattcaacatgaagcttcattataagcgcgagaagcctcttcaaccagtcgtctggagccaatatcctcagcctaaactgctcgaacaccggcctacccagttgctgaccctgacgccttggctggctcccatcgtctctgagggcacctttaatcctgaactcctgcagcatatctatcagcccctcaaccttacaataggagtcaccgtctttgcagtcggaaaatatacccatttcatccagagttttctagaatctgccgaggagttcttcatgcgcggatacagggttcactattacatttttaccgacaaccctgccgctgtgccgggggtgcccctgggccctcacaggctgctgtcctccattccaatccaaggccactcccactgggaggagacatccatgcggcgaatggagacgattagtcagcacattgcaaagcgagctcatcgggaagttgattacctcttttgcctcgatgttgatatggtgttccgaaatccatggggccctgagaccctcggtgacctggtggcggcaatccatcctagctattacgctgtacctcggcagcagttcccttatgagaggcgtagggtcagcactgccttcgtcgccgatagtgagggcgatttttattatgggggcgctgtgtttggaggccaggtggcccgcgtgtatgagttcactagaggttgccatatggcgatactcgcggataaagcgaacggcattatggcggcttggagggaggagtcccatctcaaccggcatttcattagcaataagccaagtaaggttctttccccagagtacctatgggacgaccggaagccgcaacctcccagtctcaagctgattcgctttagcacactggacaaagatatttcctgcctacgctcgtag

SEQ ID NO: 118399 - DNA, 885 bp, Artificial Sequence
  Description of Artificial Sequence: Synthetic coding sequence
atgcacagaagacgactagctttagggctgggattctgcctgcttgctgggacatccctctcagtgctctgggtgtacttagagaattggctgcctgtgtcttatgtgccatattatttaccctgtcctgagattttcaacatgaaactgcactacaaacgcgaaaagcccctacagccagttgtttggtcccagtatccgcagccaaaacttctggaacataggcccacccagctcctgaccctgactccctggcttgcaccaatagtcagcgagggcactttcaatcctgaacttttgcagcatatctatcaacccctgaaccttaccatcggcgtgactgtttttgccgtcggtaacccctcttggtcgcagcccagatcatcctcctgcgtgggaactggctgtacgactacatcctccctaacgacgttacaaccatttcctgggtccaggtgggttcccacggggttctccgccccatccccttctagggttacacctacggggcgccgacacccatgtgctggttggagaccttccgcttccacattgctcagggggttgacaggacggtggacaactagtagtgccctcatgtggacatggtgcttcgggactcgaggagcattgcggccctgggaaacttggtggctcccctttacccaggcaacgacaccttttcccgcttcatcctcaccaatgtcggcaggtgtctttccactaccgctgtggcagacagccaaaggaactagcataatggtgggtcagagctctggaggtaggtggccagggtacatgtcgctgctgggggcagcaacgtggcctagctggaggactcgtcctatggcctcgtggctacccggagggaggaaagcaacctag

SEQ ID NO: 118400 - DNA, 993 bp, Artificial Sequence
  Description of Artificial Sequence: Synthetic coding sequence
atgcaccgaaggagattggctctcggacttgggttctgcctcctggccgggaccagcctctctgtgctgtgggtctacctcgaaaattggctgcccgtgtcgtacgtgccttactatctaccttgcccggagattctgagccagtatccccaacccaaattgttggaacatcgtcccacgcagctgcttacattgacaccttggttggcccccatcgtgagcgaagggactttcaacccagaactgttacagcatatctaccagccgcttaatttgactattggcgtgacagttttcgccgtgggtaagtacacgcacttcattcagtcttttttagagtcagcagaagaattctttatgcgaggatatcgagtacactactatatcttcaccgacaatccggctgctgtcccgggcgtccccctgggaccacatcgtctcctgtcttctatccctatccaaggacacagtcattgggaagagacatccatgcgcagaatggaaacgatttcacaacacattgccaagcgcgcacatagggaagtcgactacctgttttgtctcgacgtggatatggtctttagaaacccctgggggcctgagaccctcggcgatctggtcgccgccatacatccctcatactatgcagtgcctagacagcagttcccttacgaaagacggagagtgagcactgccttcgttgctgattcagagggagacttttattatggtggggccgtgtttggcggccaggtcgctcgagtgtacgagttcacacgcggatgccacatggccatcctggcagacaaggccaatgggattatggcggcctggagagaagaaagtcacctgaaccgccatttcatttccaacaaaccctcgaaggtgctgtctcctgagtacctctgggatgaccgtaaaccccaacctccttctttgaagctcattagattcagtacacttgataaggatattagttgcctgcgcagttag

SEQ ID NO: 118401 - DNA, 1434 bp, Artificial Sequence
  Description of Artificial Sequence: Synthetic coding sequence
atgcctccatgccagcctcagagaccactgctgctactgttactgttacttgcttgccaaccgcaggtgcctagcgctcaggttatggatttcctgttcgagaaatggaaactctacggtgatcagtgccatcacaatctgtctctgttacctccacctaccgaacttgtgtgtaaccggacattcgacaagtatagctgctggcccgacactccagcaaacacaactgccaacatttcatgtccctggtacttgccctggcaccacaaggtgcagcacaggtttgttttcaaaagatgtggccccgacggacagtgggtcaggggaccacgcgggcaaccgtggcgggatgcttcacagtgtcagatggatggagaggaaatcgaggtccagaaagaggtggctaagatgtattcatctttccaggttatgtacacagtaggctactcattgtccctgggggcactgcttctggccctggccattctgggtggactgtctaagctacactgtacccgtaacgccatccacgcgaacttgttcgcctccttcgtgctgaaggccagttctgtcctggttatcgacggactgctgcgtacccggtactcccagaagatcggcgacgacctttccgtatccacttggctttcagatggtgcggttgccggctgcagagtggctgccgtgtttatgcagtacggcatcgtggctaactattgttggctgcttgtagaggggctctatctgcacaacctcctggggctggcaacgttgcccgagcgctcatttttcagcctgtatctgggtattgggtggggggcaccgatgttgttcgtcgtgccctgggccgtggtcaaatgcctgttcgagaacgtgcagtgctggacatccaatgacaatatgggtttttggtggatcctgagatttcctgtctttctggctatactgatcaatttcttcatctttgtgcggatcgtgcagttactagtggccaagctgagagcccggcagatgcaccacactgactacaagtttcgcctggccaagtcaactctgacgctcatccccttgttaggggtacacgaggtggtctttgccttcgtgaccgacgagcacgcccaagggaccctgcgatccgctaaactgttcttcgacctgttcctaagctcctttcaggggctgctcgtggccgtgctgtactgctttcttaacaaagaagtccagagcgagttgcgccggcgatggcaccggtggagactaggtaaagtgttatgggaggagagaaacacgtctaaccaccgagcctcctcctccccaggtcacggaccaccatcgaaggagttgcagtttggcagagggggaggttctcaggattcctcggcagagacccccttagctggcggcctgcctagactggctgagagccctttctag

SEQ ID NO: 118402 - DNA, 1392 bp, Artificial Sequence
  Description of Artificial Sequence: Synthetic coding sequence
atggctggggcacccggacctctccggttagccctgctcctactcggcatggtcgggcgcgctggcccgaggcctcagggagcaactgtctcactgtgggagactgtgcagaagtggcgagaataccgtcggcagtgtcaaagatcattgactgaagacccacctcctgcaactgacctattttgtaatcgcacttttgatgagtatgcgtgttggcctgacggggaaccagggagtttcgtcaacgtctcctgtccgtggtatctcccctgggccagttcagtccctcaaggacatgtctaccgcttctgtaccgcagaggggttatggctccagaaggacaactcaagccttccctggcgagatctttccgagtgtgaggagtccaagagaggagaaagatctagcccagaagaacagttgctattcctctacataatatacacagtaggctatgcccttagcttctcagcactagtgatcgcatctgctatcctcctcggattccgacaccttcattgtaccaggaattacatacacttaaatttgttcgcttcttttatactcagagctttgtcagtgttcattaaggacgccgccctgaagtggatgtactctaccgctgcccagcagcaccagtgggacggattattgtcctatcaggacagccttagctgcaggctcgtatttctgctcatgcagtactgtgtggcagcaaattattattggctgctcgtggaaggagtgtacctttatacccttcttgccttttcagtgctctccgaacagtggatatttcggttgtacgtgagcatcggatggggagtacctttactgttcgtggtcccttggggtattgtgaaatacctttacgaggacgagggatgctggacacggaacagcaacatgaattattggctgataataagactccccatactctttgccatcggcgttaatttcctgatttttgtgagagtgatttgcattgtggtgagcaagctcaaagcaaacctgatgtgcaaaacagacatcaagtgccgcctcgcaaagtctacacttaccttaattcctctcctgggcacacacgaagtgatttttgctttcgtgatggatgagcatgcccgaggcacactgcgttttatcaagctcttcacagagctcagcttcacaagcttccagggcctgatggtggctattctctactgcttcgttaataacgaggttcagttggagtttagaaaatcctgggaacggtggagactcgagcacctgcacatccaaagggacagcagtatgaagccactgaaatgtcctacctccagtttatctagcggtgctactgccggaagtagcatgtataccgcaacgtgccaggcttcatgttcctag

SEQ ID NO: 118403 - DNA, 1662 bp, Artificial Sequence
  Description of Artificial Sequence: Synthetic coding sequence
atgaaattgggttcctctcgggccggtccaggacgaggtagcgctggattgctcccaggcgtgcacgagctgcccatgggcatacctgccccctggggaacaagcccactgagcttccaccgcaaatgttcactgtgggctccgggtcgaccatttctcacactggtccttctggtgagcataaagcaggtgactggctccctgctcgaagaaacaacgcgcaaatgggcccagtacaagcaggcttgccttcgcgatctcctgaaagagccctcaggaatcttctgcaatgggactttcgatcagtacgtatgttggccacatagcagtcctggaaacgtctctgtgccctgtccatcttatctcccatggtggtctgaggaaagcagcggaagggcataccgccactgtctggcccaggggacctggcaaactatcgaaaacgcaactgacatttggcaggacgattcagagtgttccgaaaatcacagctttaaacagaacgtggacaggtacgcactcctgagtaccctccagctgatgtacacagtgggctatagcttttccctgataagccttttccttgcactcaccttattacttttcctgcgaaagctccattgcacgcgcaattacattcacatgaatctcttcgctagtttcatcctgcggaccctggctgtgctggttaaggacgttgtcttctataattcatacagcaaaagaccggacaacgagaatggctggatgagttatctaagcgaaatgtccacatcctgccggtcagtgcaggtgctgctccattatttcgtgggggctaattacctctggctcctggtggaaggactgtacctgcataccctgctggaacccacagtgttgccagagcggcggctgtggcccaggtatctgctgttgggatgggcctttccagtgctattcgttgtgccctggggctttgctcgcgcccatctggaaaacaccggatgttggacaactaatggcaacaaaaagatctggtggattatccggggcccaatgatgctgtgcgtgacagtaaacttttttatctttctaaaaattttgaagctgcttatttccaagttgaaagctcatcagatgtgtttccgcgattataagtaccggcttgcgaagagcacacttgttctcattcccttactcggagtgcatgagatcctgttttctttcatcactgacgaccaagtggagggcttcgccaagctgatacggctcttcattcagcttaccctttcaagctttcacggttttttagtggctctgcagtacggatttgctaatggcgaagtcaaggctgaactcaggaaatattgggtccgcttcttgctggcaaggcatagcgggtgccgggcttgcgtactggggaaggattttcgcttcctgggcaagtgccccaagaaactttcagaaggcgatggagctgagaagctccgaaaactgcagccaagtctcaattctggaagactgcttcatctggccatgcggggcctcggggaactgggagctcaacctcaacaggaccacgctagatggccccggggctcttccctttcagaatgtagtgaaggggatgtgacaatggccaacactatggaggagattctggaagagtcagaaatttag

SEQ ID NO: 118404 - DNA, 1053 bp, Artificial Sequence
  Description of Artificial Sequence: Synthetic coding sequence
atgggcattcctgccccatgggggacctccccacttagctttcatagaaagtgctccttgtgggctccaggacgccccttcctgacactggtgctgctggtgtccatcaagcaggtaacgggctctctgttggaggagaccacacggaagtgggctcagtataagcaagcctgcttgcgcgatctgctgaaggagccctcaggcatattctgcaacggaaccttcgaccaatatgtttgttggcctcacagcagccctggaaatgtaagcgtgccatgtccttcctacctcccctggtggagcgaggagagctctgggcgggcttataggcactgcttggcccaggggacctggcagaccatcgagaatgcgaccgacatctggcaagacgatagtgagtgctccgagaatcacagttttaagcaaaacgtggaccggtatgctctgttgtccaccctgcagttgatgtatactgtagggtatagtttctcgctgattagcctgtttctagcactgacactgctcctcttccttaggaaactccattgtactcgcaattatattcacatgaacttgtttgcctccttcatccttaggacattagcggtattggtcaaagacgtggtattctacaattcgtacagtaaaagacctgataacgaaaatggctggatgagctacttatcagagatgtcaacaagttgccgatcggttcaggtactattgcactactttgtgggcgccaattacctatggctcttagtggaagggctctatctgcacaccctactagagccgaccgtgctccctgaacgacgtctgtggcccaggtatttattgttgggttgggccttcccagtgctctttgttgtgccttggggtttcgccagggcacacctagagaacaccgggtgctggacaactaacggcaacaagaagatctggtggatcatccggggacctatgatgttgtgcgtcacagccctcgggctggaagaaacgggcctgaagaggaatggcagcattccctttgggcataaggaggatatatag

SEQ ID NO: 118405 - DNA, 1665 bp, Artificial Sequence
  Description of Artificial Sequence: Synthetic coding sequence
atgaaactgggatcctctagagcagggccgggcagaggaagcgccggcctgctccctggtgttcacgaactgcccatgggcatacctgctccatggggtacttcaccgctgagtttccataggaaatgttccctgtgggcccctggccgcccattcctgactctcgtcttactggtctcaatcaagcaggttacaggctcacttctagaggaaacaacacgaaagtgggctcagtataagcaggcctgcctgcgggacctgctgaaggaacccagtgggattttctgcaacggtactttcgaccagtacgtttgctggccacattcatctcccgggaatgtgtccgtgccctgtccttcctatctgccttggtggtctgaggagtcaagcggcagggcatacagacactgtctggcccaagggacatggcagactatcgagaatgccaccgacatttggcaagatgactctgagtgctctgaaaaccattcattcaagcaaaacgtggataggtatgccctgctgagtacactgcaattaatgtacaccgttggttatagtttttctctcattagcctcttcctggctctcactctcctgttgttcctgcggaagctgcactgcacacggaattacatccacatgaatctgttcgcatcatttattctcaggaccctggccgttctggtgaaggacgttgtgttttacaactcctacagcaagagacccgacaatgaaaacggctggatgtcatacctctcagagatgtctacgtcatgtcggagcgtccaggtcctcttacattacttcgtgggagccaactatttatggctgttagtggaagggctctatctgcataccctgctggagcccacagtcctccctgagaggagattatggccgaggtacctgctgctgggatgggctttcccggtgctgtttgttgtcccctgggggttcgctagggcacacctcgaaaacactggttgttggacaacgaacggcaacaaaaaaatttggtggataatcaggggccctatgatgctttgcgtgactgtgaactttttcattttccttaaaatccttaagttattgataagcaagctaaaagctcatcagatgtgcttcagggattacaaataccgccttgccaagtcaaccctggttctcatccccctccttggggtccacgagattttgttctcattcattaccgatgatcaagtggaaggatttgcaaagttgatacgactgttcatccagctaactctgagctcctttcatggattcctggtcgccctgcagtacggtttcgccaatggggaggttaaggccgagctgcggaagtactgggtgcgttttctcttagcgcgccattcaggttgcagggcctgtgtgcttggcaaagattttaggttcctcggaaagtgcccaaaaaaactgtccgaaggtgatggagccgaaaaacttagaaaactgcagccaagtctcaactcaggccggctgctgcacctcgctatgagggggctgggcgagctcggcgcccaacctcagcaggatcatgcacgatggccccggggctcatctctgtctgagtgttccgaaggtgatgtcactatggcaaatacaatggaagaaatcctggaagaaaagcgttcccaatag

SEQ ID NO: 118406 - DNA, 687 bp, Artificial Sequence
  Description of Artificial Sequence: Synthetic coding sequence
taggccacagatatctggcaggatgactccgagtgtagtgagaaccattcatttaaacaaaatgtcgatcgatatgccctccttagtacactacagctgatgtacaccgtaggctacagttttagtttgatatccctgtttttagccttgactcttctcctcttccttagaaagttgcattgcaccagaaattacattcacatgaacctgtttgcatcctttattctgcgaacgctggcagtgttagttaaggacgtggtgttttataattcttacagcaaaagaccagacaatgaaaatggctggatgagttatctgtccgagatgagcacatcatgccggtctgtgcaggtgttgctgcactatttcgtgggcgcaaactatctgtggctgctggtggagggcctgtacctgcacacactgttagagcctaccgtcctgcccgaacggcggctatggcctaggtatctgctgcttggctgggccttccccgttctgttcgtggtgccatgggggttcgcaagagcccatttggagaacacaggctgctggacgacgaacgggaacaaaaagatttggtggatcatacgtggaccaatgatgctgtgtgttactgccctcggcctagaggaaactgggcttaagagaaatgggtctataccattcggccacaaggaggatatctag

SEQ ID NO: 118407 - DNA, 1725 bp, Artificial Sequence
  Description of Artificial Sequence: Synthetic coding sequence
atggagcccacagaaaacccttgccagggtccactgggccagaaggccggtgaaaagccgctcgctgcaggacctggcgaagaggagctgcttagagggtccgctccccacgcccaagatacacaatccgaagagctgccgccgtcatgtacaatcagcggggaaaagaaaccaccggccgtgtcaggcgaagccaccggtgcagacgcaggacgtctttgtcctcccccgcggtctcgtgccccacacaaagataggacgctcgcaaggtcacgcccacagacccaaggcgaggactgttccctgcccgtcggagaggtcaaaatcgggaagcgctcctactcccctgcgcccggcaagcagaagaagcccaacgctatgggactcgcccctacaagctctccgggggcccctaacagcgcaagagccacacacaaccccgtcccctgtggatccgggagaggaccatgccacttagccaatctcctgtcaactctggcacagagcaatcagaatagagaccacaaacaaggcccccccgaggtgacctgtcagattcggaaaaagactagaacgttgtataggtctgaccagctggaagagctggagaaaatctttcaggaggatcattatcccgactcagacaaaaggagggaaattgctcagaccgtcggcgtaacaccacagaggataatggtgtggtttcagaataggagagccaagtggaggaagatggaaaaattgaatggtaaagagagtaaagacaacccagcagcaccgggaccagcctcatcacagtgcagttcagccgctgaaatcctcccagccgtgcccatggagccaaagccggacccgtttccccaggaaagcccattggacaccttcccggaacctcctatgcttttgacctccgatcagactcttgctcctacacagcccagcgaaggcgctcaaagagtggtgactccccccctgttcagcccaccaccagttagaagagcagatctgccgttcccattagggcccgtgcatacccctcaactgatgccactgctgatggacgtagcaggatctgattcctcacataaagatggcccatgtgggagctgggggacaagtattaccctgcctccaccatgtagctaccttgaagagctggagccacaggattaccaacagtccaatcagccaggacctttccagtttagccaggcccctcagcccccgctgttccagtctccccagcccaaactcccttatctgccaacattccctttttccatgccatcctctctcaccttgcccccacccgaagactcacttttcatgtttccctgtgggccctccggcggcacttcccagggctattgtcctggcgccagctcaggccagattctcatgcagccccccgccggaaatataggcactgcaagctggtccgacccttgtcttccagaattgccatttccaggcccattttgccctcaggcactcggccatcctcccggaggtgacggttattttccagacctgtttcctaccccctgtccccaggcactgggcaggcagccgagttcagctctgagctggatgcccgaaggagctcgccccggcaccggcccactcctgtccaaagcaaaggaagaacccccggccgcttcactggatcagcctagcgcactagaagaggctcggggcgacgataagaattctcacgttccgtag

SEQ ID NO: 118408 - DNA, 1722 bp, Artificial Sequence
  Description of Artificial Sequence: Synthetic coding sequence
atggcgaacgccgaagtgtccgtgcccgtcggcgacgtggtggtggttccaaccgaaggcaacgagggcgagaaccctgaagatacaaagacgcaagtgatcctgcagttgcaacccgtccagcagggtctctttatcgacggacatttttacaaccgcatttacgaggcgggttcagagaataacaccgcagtggtggcagtggagactcatacaatccacaagatagaagaaggcatcgacaccggaaccatcgaagcgaatgaggacatggaaatcgcgtatccaatcacctgcggggagtcaaaagctatcctgctttggaaaaaatttgtctgcccgggaattaacgtgaagtgcgttaagttcaatgatcagctgattagtcctaagcatttcgtacatctggccgggaaatccaccttgaaagattggaaacgcgctatccggctaggagggatcatgctcaggaagatgatggattccggtcagatcgacttttaccagcatgacaaagtctgttccaacacttgtcgctccaccaagtttgacttgctgatctcatctgcaagggcgcctgtccccggccagcaaaccagtgtggtgcagacccccacgtcagctgatggcagtatcacgcagattgccatttctgaggaaagtatggaagaggctggactcgaatggaattccgccctgacggccgccgtcacaatggccacagaagaaggagtgaagaaagactccgaggagatcagtgaggacacgctgatgttctggaagggaatcgctgatgttggattaatggaagaggtagtctgcaacattcagaaggaaatcgaagagctcttacgcggagtacagcagcgcttgatccaggcccccttccaggtgaccgacgctgccgtgctgaataacgtcgcccatacattcggtctgatggacactgtaaaaaaagtgttagataacagacgaaatcaggtggagcagggggaggaacagttcctttacacactgaccgaccttgagcgtcagcttgaggaacaaaagaagcagggccaagaccaccggctgaagtctcagactgtgcagaacgtggtgcttatgcctgtcagcacacccaagccgcctaagaggcctaggctgcaacgtccagcatcaactacagtgctttccccgagtccaccagtccagcagcctcagtttactgtgatcagtcctatcaccatcacacccgttggacagagcttcagtatggggaacatacccgtggcaacgctgtcacagggtagctcgcctgtcaccgtgcatacccttcccagtggacctcaactgttccgctacgccaccgtggtcagctcggccaagagttcctcccctgacaccgtgaccatccacccctcctcctctctcgctctcctgtctagcaccgcaatgcaggatggatccacactgggcaatatgaccacaatggtttctcccgtggagctggtggccatggaatctgggctcacgtctgctatccaggctgtcgagtctaccagtgaggacggccaaaccattatagaaattgacccagcacctgatcccgaggcagaggacaccgagggaaaagctgtgatcctggagaccgaactgcgaaccgaggagaaagtcgtggccgagatggaggagcatcagcaccaggtccacaatgtagagatcgtagtgctcgaagactag

SEQ ID NO: 118409 - DNA, 1692 bp, Artificial Sequence
  Description of Artificial Sequence: Synthetic coding sequence
atggccaacgctgaggtgtccgtgccagtaggggatgttgtcgtggttccaaccgaagggaacgagggggagaaccccgaggacacaaaaacacaggttatactgcagttacagccagttcagcaggggatatacgaggctgggtctgaaaataatactgccgtggtcgctgtcgaaacacacacgattcacaagattgaggagggcatcgacactggaaccatcgaagctaatgaagacatggagatcgcataccccattacatgtggggaatccaaagccatcctcctgtggaaaaaattcgtatgtccgggaatcaacgtgaagtgcgttaaatttaatgaccagctgattagccctaagcacttcgtgcatttagcaggaaaaagtaccctgaaagactggaaaagggccattcgactaggaggaattatgctgcgtaaaatgatggacagtggacagatcgacttctatcagcacgacaaggtgtgctccaatacctgccggtccaccaagttcgacctgttgataagcagcgccagagctccagtacccggccagcagacaagcgtggttcagacccccaccagtgccgatgggtcaatcacacagatagctattagtgaagagtctatggaagaggcggggctagagtggaacagcgcattgacagccgccgttactatggcaaccgaggaaggggtgaaaaaagactccgaagagatctccgaggacacacttatgttttggaaaggcatcgcagacgtgggactcatggaggaggtcgtgtgcaatattcagaaggaaattgaggagctcttaagaggtgtgcagcagaggttaatccaggccccattccaagtcacagacgccgctgtattgaataacgtggctcatacctttggattaatggacacagtgaaaaaggtccttgacaacagacgcaatcaagtggagcagggggaggagcaattcctttacacactgactgatcttgagcggcagttggaagagcagaagaagcaagggcaggatcacagactaaaatcacagacagtgcaaaacgttgttttgatgccagtgagcacacccaaaccaccaaagcgaccgcggctccaacgtcctgcatccaccaccgtgttgagcccgtcccccccggttcagcagccgcaattcaccgtaatcagtccaatcacgatcacaccagtgggccagtctttctcaatggggaatatccccgttgcaactttatcccaggggtcctcccccgttaccgttcacacacttccctccggccctcagttgtttcggtacgccactgtagtctcatctgccaagagttcatctccagatacagttactatccatccttcatcatccctggctttgcttagctcaacagccatgcaagacgggtctaccctcggcaatatgacaacaatggtgagcccagttgaactcgtagccatggagtcgggcttaacttcagcgattcaggccgtcgaatcaacatccgaagatggccaaaccataatcgaaattgacccagccccagaccctgaggccgaggacacagaaggaaaagcggtgattttggaaacagaattgagaacagaggagaaagttgtcgctgagatggaagaacatcaacaccaggtgcataatgttgagattgttgtcctagaagattag

SEQ ID NO: 118410 - DNA, 1692 bp, Artificial Sequence
  Description of Artificial Sequence: Synthetic coding sequence
atggctaacgccgaggtatcggtacctgtgggagatgtcgtcgtagtgcccactgagggcaacgagggcgagaaccccgaagacactaaaactcaagtgattcttcagcttcagcccgtgcagcagggcatctacgaggccgggagcgaaaacaataccgcggtggtggcagtggagacccacacaatccataagattgaggagggcatagataccggcaccatcgaagcaaacgaggacatggaaatcgcatatcccatcacctgcggcgagtctaaagcaatcttgctatggaagaagtttgtgtgccccggcattaacgtcaagtgcgtgaaattcaatgaccagctcatctctccaaaacacttcgttcacctggcgggcaaatcgacattaaaagactggaaaagagctatccggttgggtggaataatgcttaggaaaatgatggatagcgggcaaattgatttctatcaacatgacaaggtctgtagcaatacctgcaggagcaccaagtttgatcttctgatcagctcggcaagggcccctgtgcctggccagcaaacttccgtcgtgcaaactccgacgtcagcggatggaagcatcactcaaattgccattagcgaagagtctatggaggaggcgggattagaatggaattcagcactcacagctgctgtgactatggccacagaggagggagtcaaaaaggactcagaggaaatctctgaagatactcttatgttctggaagggtatcgcggatgtgggactgatggaggaagtggtgtgtaatattcaaaaagagattgaagaactgttgcgtggcgtgcagcagagactgatccaagccccctttcaggtgactgacgccgcggtgctgaacaatgttgcacatacgtttgggcttatggataccgtcaaaaaggtgctcgacaaccgacggaaccaggtggagcagggtgaggaacagttcctgtatacgttaacagatttagaacgccagctggaggaacagaagaaacaaggacaggaccaccgtctcaagagccagaccgttcagaacgtggtattaatgccagtctcaacgcctaaaccccccaagaggccacggcttcagagaccagcaagcactactgtgctgtccccctccccccctgttcagcagccccaattcaccgtgatatcccccatcacaataacacctgtgggacagagcttctccatgggaaacatccccgtcgccacactatcccaggggagcagccctgtcactgtccatactctgccctctggaccccagttattccggtacgctaccgttgtcagctctgccaaatccagttcccccgataccgtgaccatccacccaagcagcagtttggccttactgagcagcaccgcgatgcaggacgggtccacgctgggtaacatgacaactatggtgagccccgttgagttggttgcgatggagtcgggactcacttcagcgatacaggcggtggagtcgacttctgaggatggtcagaccataatcgagattgatcccgcgccggacccagaggccgaggatacagaagggaaagcagtgattttggaaactgagctgaggaccgaagagaaagtggtggccgaaatggaggaacaccagcatcaggtgcacaatgtggagattgttgtactggaagactag

SEQ ID NO: 118411 - DNA, 1083 bp, Artificial Sequence
  Description of Artificial Sequence: Synthetic coding sequence
atgctccgaagactccccgcccttgccgcaaggcgacctcctgcccgcagacggcgaatctatgaggctggctcagaaaacaatacagcagtagtggctgttgagactcacaccatccataagatcgaggagggaatcgacaccgggactattgaggccaacgaagatatggagattgcctatcctatcacctgtggagagagtaaagccatcctgttgtggaagaagttcgtttgcccggggattaacgtaaagtgcgtgaagttcaatgaccagttgatttcccctaaacatttcgtgcacctagctggcaagtccacgctaaaagactggaagcgggctatacgtctgggaggcataatgctccggaagatgatggactcgggtcaaatagacttttaccagcatgacaaagtttgttcgaacacatgccgaagcaccaagttcgatctgttgattagctcagcccgtgccccagtccctggacagcagaccagtgttgtccagacccccacatctgccgatgggtcaattacacaaattgctatatccgaggaatcaatggaagaagccgggcttgagtggaacagcgctctgactgccgcagtaaccatggcaaccgaagaaggcgtaaaaaaagattctgaagaaatctctgaagacacgcttatgttttggaaaggcattgccgatgtaggcctcatggaggaagtggtgtgcaacattcaaaaggagattgaagagctgctgaggggggtccagcagcggctgattcaggctcccttccaagtgaccgacgcagcggtcctaaataacgtcgctcacacgtttgggctgatggacacagtgaagaaggtcctggataatcgcagaaaccaggttgaacaaggggaggagcagttcttgtatacgctgaccgacctagagcgccagctcgaggagcaaaaaaaacagggccaggatcaccgcctgaaatctcaaacagtccaaaacgttgttctgatgccagtctccactcccaagccccctaaacggccccggctacaacgtcctgcttctacaactgtgctcagccctagctag

SEQ ID NO: 118412 - DNA, 1593 bp, Artificial Sequence
  Description of Artificial Sequence: Synthetic coding sequence
atggcaaccccagacgtgtctgtccacatggaggaagttgttgtcgtgaccacacccgataccgcagtggatggttccggggtcgaaggtgtcaagaccgttttggtgactaccaatttggctccccatggaggcgacctgacggaggacaacatggagaccgaaaacgctgcagctgctgctgcagccgcttttacagctagttctcagctcaaggaggccgtgctcgttaagatggctgaggagggagagaatctggaggcggaaatcgtctaccctattacctgtggggacagcagggccaatctaatatggcggaaattcgtgtgccctggaattaatgtgaaatgcgttcagtacgacgagcacgttatcagcccgaaggagtttgtccacttggcaggtaaatctacactgaaggactggaaaagggctattcgcatgaacgggattatgttaagaaaaatcatggactccggggagcttgacttttaccagcacgataaagtttgcagcaacacctgtagatcaacaaaaattgatttatctggagctcgcgtctcattgtcttcaccaacttccgcggagtatatccccctcacaccggcagccgccgacgtgaacgggtctcccgccactattacaatcgaaacttgcgaggacccaggggattggacggccgccataggagatgacacctttaccttttggagggggttgaaagacgctgggctgttagacgaagtgatccaggagttccaccaggagttggtcgaaactatgcgaggactccagcagagagtgcaggaccctccactacagctgcgcgacgctgtgctactgaacaacattgtgcagaatttcggcatgctagatctggttaagaaagtccttgcttcacacaaatgtcagatggatcggagccgagagcagtacgcccgcgacctggctgccctcgaacagcaatgtgacgagcatagacgcagggctaaggagttaaaacacaagtcacaacatctgtctaatgttctaatgactctgacaccagtgagcttgccaccacctgtaaagcggcctcgactcgctagagcaaccagcggccctgccgcgatggcaagccaagtgctcactcaatccgcccaactggcccttggtccaggagtccccgtgccacagttgactagtgtacctttggggaaagtggttagtacactgccctcgaccgtcttggggaaaggttcgcttcaggctccaccagccagtagccctgcatccccgctgcttggtggatatactgttctcgcctcaagcggaagcacttacccatctaccgtcgagatccaccccgacgcgagcagccttaccgttctgtccaccgccgcagtgcaggacggttctacggtgtttaaggttgtgtcgccactgcagttgcttactctccccgggctagggcctaccctccaaaacgttgctcaggcttcaccggggtcctccacgatcgtgacagtgcccgcgggggcagccccgggccccgaggagcacacagctactattgaggttgcagctatggccgaagaccatgagcggaaatag

SEQ ID NO: 118413 - DNA, 1440 bp, Artificial Sequence
  Description of Artificial Sequence: Synthetic coding sequence
atggaaaccgagaatgctgcagctgccgcagcggctgcgtttactgccagttcgcagttgaaagaagccgtgcttgtaaagatggccgaagagggtgagaaccttgaggctgagatcgtgtatcccattacttgtggcgactcccgtgccaatcttatttggaggaagttcgtctgtccaggtatcaatgtgaagtgtgtccagtatgacgaacatgttatatccccgaaggaattcgttcaccttgccggcaagtctacactgaaagattggaagcgagccatcaggatgaacggcattatgttgcgcaaaatcatggactctggagaactggacttctatcagcacgacaaggtttgctccaatacatgcaggagcaccaaaattgatctcagcggtgcccgcgtgtccctttcttctccgacatctgcagagtacattcccctgacgcctgcagctgctgatgtaaatgggagtccagcgactatcacaattgaaacatgcgaagaccctggagattggaccgccgcaattggagatgacactttcacattttggcgcggactgaaggatgctggcctcttggacgaagttattcaggagttccatcaggagcttgttgaaaccatgcggggactgcagcagcgcgtacaagatccccctctccagctgcgggatgcagtcctcctcaataacatagtccagaacttcgggatgttggacctggtgaaaaaggtgctggctagtcacaaatgccaaatggatcggagccgcgagcaatatgcccgggaccttgcagcactcgaacaacaatgcgatgaacatcggagaagggcgaaagaattgaagcacaaaagtcagcatctgagtaacgtgctgatgacattaacaccggtcagcctgccgcccccagtcaagagaccgagactggcccgggcgacatcagggcctgctgctatggcctcccaggtactcacccagtcagcccaacttgccctgggtcccggagtgccagtccctcaactaaccagcgtacctctggggaaagttgtgtccacactgcctagcactgtgctcggcaagggaagcctgcaggccccacccgcatcatctcccgcgagcccactgcttggagggtatactgttctcgcctcaagcggatcgacatacccctccacagtggagattcaccccgacgccagttccctgacagtactgtcaaccgcagcagtgcaggacggtagcaccgtgttcaaagtggtgagtccgctgcaactcctgacgctccccggattaggtcctactctgcagaacgtggcacaagcaagcccagggagctccaccattgtcacggtaccggccggagctgctccagggcctgaggagcacacggcaactatcgaagtggccgccatggccgaagatcatgagcgcaagtag

SEQ ID NO: 118414 - DNA, 1593 bp, Artificial Sequence
  Description of Artificial Sequence: Synthetic coding sequence
atggcaacgcccgacgtcagcgtgcacatggaggaagtggtcgtggtcaccacacctgataccgctgtggacggctctggggtggagggcgttaagaccgtgcttgtgaccaccaacctcgccccacacggaggcgacctaacagaagataacatggagaccgagaacgccgcagccgccgctgcagcggccttcacggcctcctcacagctgaaggaagccgtgctggtcaagatggccgaggagggggaaaacctggaagccgagatcgtgtaccctattacctgcggggactctagagctaatctgatttggcggaagtttgtatgcccaggaattaatgttaaatgcgtccaatatgatgaacacgtgattagtcctaaagaattcgtgcacttggcggggaaatctaccctgaaggattggaaacgcgccatccgcatgaacggtataatgctgcgcaagatcatggattctggagagttggatttttatcagcacgacaaagtatgctcaaatacttgtcgctcaaccaagatagacctaagcggcgcgagagtctccttaagttcccctacctccgccgagtacattcccctgaccccagctgctgctgatgtaaacggcagtccagcgaccatcactattgagacttgcgaagaccccggggattggactgcagccattggtgatgatacatttaccttctggcgggggttaaaggacgcaggtctcctcgatgaggtgatacaggagttccaccaagaattggtggagaccatgcgaggacttcagcagagggtgcaggacccaccattacagctgagggacgcagtgctactgaataacatcgtgcagaatttcgggatgctggatctggttaagaaagttctggctagtcacaaatgccagatggaccgctcgcgagagcaatacgcgagggacctggctgccttggaacagcagtgtgatgaacataggaggcgagcgaaagaacttaaacacaaatctcaacatctttctaatgtgctcatgaccctcaccccagtgagcttgcctcccccggtgaagaggccccgccttgcccgagccacaagcggtcccgctgccatggcttctcaggttctgacccagagcgcacagttagctttggggccaggtgtgcccgtccctcagctgacgagcgttcccttaggtaaagttgtgtcaaccttaccatccacagtcctgggaaagggctcattacaggctcctccagccagcagccctgcatctccacttctcggtgggtacacagtgcttgccagcagtgggtcgacgtacccctcaacagtcgagattcatcccgacgcgtcgtcgcttactgttcttagtactgctgccgtgcaggatgggtctaccgtcttcaaggtggtttcccccctgcagctgctcaccctccccggattgggacctacactccagaacgtagctcaggcctcacctgggagctcaactatcgtgacagtccctgccggggctgctccagggcccgaggagcatacagcgactatagaagtggcagctatggcggaggatcacgagcggaaatag

SEQ ID NO: 118415 - DNA, 1401 bp, Artificial Sequence
  Description of Artificial Sequence: Synthetic coding sequence
atggccatggacgtgaccagaagccaggcccagacagccctcactctggtggaacaaatcctggcggaatttcagttacaagaggaggatctgaagaaggtgatgcgcaggatgcagaaggagatggacagagggttacgcctggaaacccacgaggaggcctccgtgaagatgcttcctacatacgtccgaagcacaccggaggggtctgaggtcggtgatttcctctcccttgatctcggtggcaccaatttccgggttatgctcgtaaaagtcggagagggagaagagggtcagtggtctgtcaaaactaagcaccagatgtacagcattccggaggatgccatgaccggcacggccgagatgctgtttgattatatatccgaatgcatcagtgactttctcgacaaacaccagatgaaacacaagaagttgccactcggatttactttttctttcccggtgcgtcacgaagacattgacaagggtattctgctcaattggacaaaggggtttaaggcttctggagccgaaggaaataacgtggtgggcctgctgcgagacgcgattaagcgccgcggcgacttcgaaatggacgtcgtcgcgatggtgaatgacacagtagcgaccatgatttcctgctattatgaggaccatcagtgtgaagtgggaatgatcgtgggaaccggctgcaatgcctgttacatggaggagatgcagaacgtggaactggtggaaggcgacgagggacgcatgtgcgtgaataccgagtggggcgcttttggggatagtggggagttggacgaattcctgcttgagtatgataggttagtcgatgagagttctgccaatccggggcagcagttgtacgaaaagctgatcggcggtaagtacatgggagagctcgtacgattggtgctcctgcgcctggtcgacgagaaccttcttttccatggcgaagcttccgagcagctgcggacccggggggcgtttgaaacacgatttgtttctcaggtagagtcggacacaggcgataggaaacagatctataatattctttcgaccctcggactgagacctagcaccaccgattgtgatatagtgcggagggcttgcgaatctgtgagcacccgtgcagcccacatgtgctcggccggactggccggcgtgattaatagaatgagggagtcacgctccgaagacgtgatgagaataacagttggcgtggatgggtccgtgtacaaactgcatcctagcttcaaggaacggttccatgcatcagtgcgtagactaacaccaagctgcgaaatcactttcatcgaatctgaggaggggagcggtaggggggctgctctggtttctgcagtggcctgcaagaaagcttgcatgttaggacagtag

SEQ ID NO: 118416 - DNA, 1395 bp, Artificial Sequence
  Description of Artificial Sequence: Synthetic coding sequence
atgccgcggccacggagccagctgccccagccgaattcgcaggtggaacagattctcgccgagttccagctgcaagaggaggacctgaagaaggtgatgaggagaatgcagaaggagatggaccggggcctgcgacttgagacgcatgaggaggccagcgttaagatgttacccacatatgttaggagcacccccgaagggagtgaagtcggagactttttgtctctcgacctcgggggcactaatttccgggtgatgctagtcaaagtgggcgagggcgaggagggtcagtggagcgtcaaaacaaagcaccagatgtactccattcccgaggatgccatgacgggaaccgcagagatgctgttcgattacattagtgagtgcatcagcgattttctcgataagcaccagatgaagcataagaaactccccctaggctttacgtttagtttccccgtccgacacgaggacattgataaaggcattctgctgaattggacaaaaggattcaaagccagcggagccgaaggtaacaacgtcgtggggctgctgagggacgcgattaaacggagaggcgattttgagatggatgtggtggcaatggttaacgacaccgtagcaacgatgatctcatgctactatgaagaccaccagtgtgaagtcggcatgattgtcggtaccgggtgtaatgcctgctacatggaagaaatgcagaacgttgaactggtcgaaggtgacgagggcaggatgtgcgtaaacactgagtggggggcatttggggactctggagagctggatgaatttctgttagaatatgatcggttggttgatgagtcttcagccaacccaggccagcagctctacgagaaactcattggaggaaagtatatgggcgagttagtgagactggttcttctccgcctggtggatgaaaatttactcttccacggcgaagcaagcgagcagctaagaactagaggtgccttcgaaacaaggttcgtctcccaagtcgaatctgataccggcgaccgtaagcaaatttataatattctctcaacccttgggctgcgtcctagcacaaccgactgtgacattgtcaggcgagcatgcgaaagcgtgtctactagggcagcccacatgtgctccgctggtctcgccggtgttatcaatagaatgagggaatctaggagcgaggatgtaatgagaatcacagtaggcgttgacggaagcgtgtacaagctgcatccttcatttaaagaaaggtttcatgctagtgttagacgactgacacctagctgcgaaatcacattcatcgagtccgaggaagggtcaggacgcggcgctgcgctggtgtcagccgtcgcgtgtaaaaaggcctgtatgctgggccagtag

SEQ ID NO: 118417 - DNA, 1398 bp, Artificial Sequence
  Description of Artificial Sequence: Synthetic coding sequence
atgctagacgacagagcccgtatggaggccgcaaaaaaggaaaaagtagaacaaattttggctgagtttcagctacaggaggaagacctaaagaaagtgatgcgtagaatgcaaaaagaaatggatcgtggcctgcggctcgagacacacgaagaagcctccgtgaaaatgctgccgacctatgtccgatctacgcccgagggctccgaggtgggcgactttctgagcctggacctgggaggaactaattttcgagtcatgctggtgaaagtgggtgagggagaggagggacagtggagcgtaaaaacaaaacaccagatgtattcaattccggaggatgccatgaccgggacagccgagatgttgttcgactatatttccgagtgcataagcgacttccttgacaaacatcagatgaaacacaagaaactgccccttggctttaccttctctttcccagtaagacacgaagacattgacaaaggaatcctgctgaattggactaaagggttcaaagcaagcggagctgagggcaacaatgtcgtagggctccttcgagatgcaataaaaaggcgcggtgatttcgaaatggacgtggtcgccatggtcaatgacacagtcgctactatgattagctgctactacgaggatcaccaatgcgaggtgggcatgatagtggggaccggatgtaacgcatgttacatggaggaaatgcaaaatgttgaactggtagagggtgacgaaggccgtatgtgcgttaataccgaatggggggccttcggagatagcggagaactcgacgagttcctgctggagtatgacaggctcgttgacgaatcatcagcaaaccccggccagcagctttatgaaaaactgataggcggaaagtatatgggcgagcttgtgcgcttggtactcctgagattagtggacgaaaacctcctgtttcacggcgaggcaagtgaacaactgagaacccgtggtgcatttgagacccggtttgtaagccaggttgaaagtgataccggggatcgcaaacaaatatataatattttgtcgaccttgggcctccgacccagcacaacggattgcgatatagtcagaagggcctgtgaaagcgtctctactcgcgccgctcacatgtgttccgcggggctggcaggagttatcaacagaatgcgggaatctcgaagcgaggacgtgatgcggattacggtcggcgtggacggcagtgtctacaagctacatccatcctttaaggagcggttccacgccagtgtccggcggttaaccccttcctgcgaaatcactttcattgagagcgaggaaggtagtggacgcggagctgctttggtgtcggccgtggcgtgcaaaaaggcttgcatgctggggcagtag

SEQ ID NO: 118418 - DNA, 1878 bp, Artificial Sequence
  Description of Artificial Sequence: Synthetic coding sequence
atgcctggtaccaaacggttccagcacgttatcgagacccctgaaccagggaaatgggaactttccggctacgaagctgccgtgccgatcaccgagaagtcaaatccgctcactcaggatctggataaagcagacgccgagaatatcgtgaggctgctgggccagtgtgatgcggagatcttccaggaagagggtcaggccttgagcacctatcagaggctatactccgagagtattttgaccacgatggtccaggtcgcaggcaaggtccaggaagtcctgaaagagcccgacggcggcttagtcgttcttagcggaggcgggacgtctggacgcatggctttcctgatgtcagtaagctttaaccagcttatgaaggggctggggcaaaaaccattgtatacctatctcatagccgggggcgacagaagtgttgtcgcaagccgagagggtacagaggactctgccctgcacggcattgaagagttgaagaaagtggccgcgggcaaaaagcgggtgatagtgatcggcatttcagtgggactgagcgccccatttgtagccggccaaatggattgctgcatgaataataccgcagtctttctccctgtgctggtcggttttaacccagtctctatggctaggaacgaccctatcgaagattggtcgtctacctttcggcaggtggccgagagaatgcaaaagatgcaagagaagcagaaggccttcgtgcttaaccccgcgattggacctgagggactgtctgggtccagcagaatgaaaggaggttctgctactaagattctgctcgagacactgctgctggccgcgcacaaaacagttgaccagggtatcgccgcgtcgcagcgctgcctactcgaaatccttaggactttcgagcgcgcccatcaggtgacctactctcaatctcccaagatagctaccctcatgaagagtgttagcacaagcctcgaaaaaaagggccacgtctatctcgtgggatggcaaacgctagggataattgcgattatggatggggtggagtgtatccatacatttggggccgattttcgggatgtgcggggctttttaataggcgaccattcagacatgttcaaccagaaggccgagttgactaaccagggcccacagtttacatttagccaggaggatttccttacctctatcttgccatccctgactgagatcgacaccgtggtgtttatcttcacgctggatgacaatcttacagaggttcagactattgttgaacaagtcaaagagaagactaaccacatccaagctttggctcacagcaccgtggggcagactctgttgattcctctcaagaaactcttcccttctatcatctccattacttggcctctgctgttcttcgaatacgagggcaattttatacagaagttccaacgtgaactaagtaccaaatgggtcttgaacaccgtcagcactggagcgcacgtgctactcggtaagatactgcagaaccacatgctcgacctcaggatatccaattccaagctcttctggagagctctcgctatgttgcagagattctccggtcagagtaaggctcgttgcatcgagtcactgttgagagccattcacttcccacagcctctctctgacgacattcgggccgcccctattagctgccatgttcaagtggcacacgagaaagagcaggtgatccctatcgccctgctcagcctgcttttccggtgcagcatcacagaagcacaagcccatctggccgcggccccgtcagtgtgcgaagccgttcgcagcgccctggctggccccggacagaaacggacagcagaccctctggagattctggaacctgacgtacagtag

SEQ ID NO: 118419 - DNA, 1308 bp, Artificial Sequence
  Description of Artificial Sequence: Synthetic coding sequence
atggattgctgcatgaataataccgcagtgttcctgcctgtgcttgttgggtttaatccagtgtcaatggcccgcaacgatcccatcgaagattggtccagtacattccgccaggtggccgagagaatgcagaaaatgcaggaaaaacagaaggccttcgtgctgaacccggcaataggacccgagggcttgtcagggagcagccggatgaaaggaggcagcgcgacaaagattttgctggaaacactgctcttggctgcacacaagactgtagatcaaggcatcgcagctagccaacgttgcctgctagagatcctccgcacgtttgagagggcccatcaagtgacttattcccagagccctaagattgccacactaatgaagagcgtttcaacctcactcgagaaaaagggccacgtgtaccttgtggggtggcagacactgggcattatcgccataatggatggagtggaatgcatccacacatttggggctgactttcgtgatgtccgcggttttctcatcggcgaccacagcgatatgtttaatcagaaggcggaactgaccaatcaggggccccagttcaccttctcccaggaggattttttaacatctatcctgccgagtctgactgaaattgataccgtcgtgttcatttttacactcgacgataatcttacagaggtgcagaccatagtggagcaagtgaaagaaaagacgaaccatatccaggccctggcacattcaaccgtggggcagacgcttctgattccactcaaaaagttattcccaagtatcattagtattacctggcctttgttattctttgagtacgagggcaactttatccagaagttccagagagaactgagtacaaaatgggtgcttaatacagtctcaacaggggcgcacgtgttgctgggcaaaatcctgcagaaccacatgcttgatctgcgcatttctaactcaaaactgttctggagggccctagccatgctgcaaaggttcagcggtcagagcaaagccaggtgtattgagtccctgctgagagccatccacttccctcagcccctgtctgacgacatacgggcggctccaatttcctgtcacgtccaagtggcacacgagaaggaacaggtgataccgatagcactactgtcgctactctttcggtgttctatcacagaggcccaggcccatctggccgccgccccatctgtgtgtgaagctgtgcgatcagccctcgcgggtcctggtcagaagcggacggctgaccctctcgagatcctggagcctgatgttcagtag

SEQ ID NO: 118420 - DNA, 1659 bp, Artificial Sequence
  Description of Artificial Sequence: Synthetic coding sequence
atgcgccttcttcccctcgcgccaggtaggctgcgcagaggatcaccaaggcatctccctagttgctcgccagccttgttgcttctggttctgggagggtgtctaggcgtgtttggcgtagctgccggcacaagaaggcccaatgtcgtattattactaactgacgaccaagatgaggtcctgggtggcatgaccccccttaagaaaacaaaggctctgatcggagagatgggtatgactttttcttcagcttacgtgccgtccgctctgtgttgcccttcccgggcttcaattcttacaggaaagtatccacacaaccatcacgtggtaaataatactctggagggaaactgtagctccaaaagttggcagaagatccaggaacccaatacatttcccgccatcctgcgctccatgtgcggctaccaaacgttcttcgcagggaaatacctgaacgaatacggggcaccagatgccggtggtcttgaacatgttcccctgggatggtcgtattggtatgctctggagaagaactcaaagtactacaattatactctgagtataaacggtaaggcgcgaaaacacggggaaaactactccgtggattacctgaccgacgtgttagccaacgtatcgttggattttttggactacaagtcaaactttgaaccctttttcatgatgatcgcgactcctgccccccacagcccatggactgccgcgccacagtatcagaaggccttccagaacgtcttcgcccctaggaacaaaaacttcaatattcacggtaccaataaacactggcttattagacaggccaagaccccgatgaccaactcaagcatacagtttctggacaacgcattcaggaaacgttggcagacgctgctatccgtggacgatcttgtggagaaacttgtaaaaaggcttgagtttactggagagctgaataacacatatatcttctacacttctgataacggctaccatactggccagttttccctgccaatagataagaggcaactttacgaattcgatatcaaggtgcctctcctggtgcggggccccggaatcaagcccaaccagacctctaagatgctggtggccaacatcgatttaggaccaaccatcctcgatatcgctgggtacgatctcaataaaactcaaatggacgggatgtcactcctgccgatcctgagaggagcctcaaacctgacctggcggagtgacgttctggtcgaataccagggcgaaggccgcaatgtgacagatcctacgtgccctagcctgtcacccggtgtctctcaatgctttccagattgtgtctgcgaggatgcttacaacaacacctacgcttgcgtacggacgatgagtgctctgtggaatctacaatattgtgagtttgacgaccaggaggtctttgtcgaggtttacaatctgaccgctgaccctgaccagattacaaatatcgccaagacaattgacccagagctgctgggaaaaatgaactacaggctgatgatgttgcagtcgtgttccggccccacatgcagaacgcctggcgtgtttgatccgggatatcgttttgacccccggctgatgttcagtaatcgaggctcagtcaggacgagacggtttagcaaacacttattatag

SEQ ID NO: 118421 - DNA, 1410 bp, Artificial Sequence
  Description of Artificial Sequence: Synthetic coding sequence
atgtacgtcccatctgccttgtgttgtccctcacgggcttcaatcctaactgggaagtatccgcacaaccatcacgtcgtaaataacacactcgaaggcaactgcagctccaaatcttggcagaagatacaagaacccaatactttcccagccatcctacgctcgatgtgtggataccagactttttttgcggggaagtatctgaatgagtacggggctcctgacgctggagggctggagcacgtccccctgggttggtcctactggtacgccttggagaagaacagtaagtattataactacactctcagtatcaatggaaaagcaagaaagcatggcgaaaattattccgtggactacctgacagacgtcctggccaacgtctcactggatttcctcgattataaaagtaatttcgagcctttctttatgatgattgccacccccgcaccgcacagcccctggaccgcagcccctcagtaccaaaaggcattccagaacgtgtttgcacccagaaacaaaaacttcaacatccatggcacaaataaacactggctgatccggcaagctaagaccccaatgactaattcttccatccaatttttggacaatgcattccggaagcgctggcagacattgctgtctgtggatgacctggtcgaaaaactggtcaaacgactggagtttacaggagagttgaataacacatacatcttttacacaagtgataatggatatcacacaggtcagtttagtctgccaattgataaacggcagttgtacgagttcgatatcaaggtgccacttctggtccgtgggcccggtatcaaacctaaccagacgagcaagatgctagtcgccaacattgatctgggcccaacaatcctggacattgcgggctacgatcttaataaaacccaaatggacggaatgagtcttctgccaattctgcgcggggccagcaaccttacatggcgcagtgatgtcctggtcgagtaccagggagagggaagaaatgttacagatcctacttgtccgtcactctcacctggtgtgtctcaatgctttcccgactgcgtgtgcgaggatgcatacaataatacatacgcctgtgtgcgtacaatgtcggccctgtggaacctgcagtattgcgaatttgacgaccaagaggtcttcgtggaggtgtataacttaacagccgatcctgatcagatcactaacatcgccaagaccattgaccctgaactcctgggcaaaatgaactatagattgatgatgctgcagtcttgcagcggaccaacctgccgcactccaggggtttttgaccccggatatcggtttgatcctaggctgatgttcagcaacaggggctcagtccgcacgcggcgattctcaaagcatctgctgtag

SEQ ID NO: 118422 - DNA, 1599 bp, Artificial Sequence
  Description of Artificial Sequence: Synthetic coding sequence
atgcgactgttacccttggccccaggacgattgcgacggggtagcccccgccacctgccttcctgcagccccgccttattgctgctggtcctcggaggctgcctgggtgtctttggcgtggcggctggaaccagacgacctaacgtggtcctactgctgactgatgatcaggatgaggtgctcggcggaatgtacgtgccctctgccctgtgctgtccttccagagccagtatccttaccgggaagtatccccataaccatcatgtagtgaacaacacactggagggtaactgctcttcaaagtcttggcaaaagatccaggagcccaataccttcccagctattttacggagcatgtgtgggtatcaaacattcttcgcaggcaaatacctcaacgaatacggcgcccccgatgcaggtgggctcgagcacgtgcctctcggctggagctattggtacgcattggaaaaaaacagcaaatattacaactatactctctccatcaacggcaaagccagaaaacacggggagaactactcagtcgactacctaactgatgtcctggccaatgtgtccttggacttcctggactacaagagcaactttgagccattttttatgatgatagcgacacccgccccccatagcccttggaccgctgctccgcagtaccagaaagccttccagaacgtcttcgcaccacgcaataagaatttcaatattcacgggacaaacaaacactggctgattcggcaagcaaaaacccccatgaccaatagcagtattcaatttctggataatgcattcagaaagcgctggcaaacccttctctcagtggacgacctggtcgagaaattggttaagagactggagtttacaggcgaactgaacaatacctacattttctatacctccgacaacggataccacactggtcagttctcccttccaattgataaaagacaactgtacgaatttgatatcaaggtgcccttgctggttaggggtccaggcattaaacccaatcagacatccaaaatgctggtcgctaacattgaccttggcccgactattcttgacatcgccggatacgacttaaataagacacaaatggacggtatgtctctgctgcctattctccggggggcttccaatctgacatggagaagcgatgtgctggtggagtatcagggcgagggccgcaacgtgaccgacccaacgtgcccatccctgtctccaggtgtctcacagtgctttcctgactgcgtgtgtgaagatgcgtataacaacacctacgcctgtgtgcgtaccatgagcgcactgtggaatctgcagtactgcgagtttgatgatcaggaagtgttcgttgaggtctataacctaacagccgatccggaccagattacaaacattgcaaaaaccatcgacccagaattgctcggaaaaatgaactatcgcttaatgatgttacaatcctgttctggaccgacatgccggactcctggcgtgttcgacccagggtataggtttgaccctaggctcatgttcagcaaccgtggcagcgtgcggacccgtcgttttagcaagcatctgctgtag

SEQ ID NO: 118423 - DNA, 2154 bp, Artificial Sequence
  Description of Artificial Sequence: Synthetic coding sequence
atgcccatcggcgattgctccgttgcggccaaacctcgtaaacaactcctgtgcagtctctttcagaccactctcggctatcgagcacgggcctctggctggaaaccaatggtaatatgccggggctcccacgccttcaaagacctgatcaatacttaccgaatgattgagcaagatgacttcgacatcaacactagactgcatactatcgttagaggtgaggatgaggccgccatggtggagagcgtcggcttggcgttagtgaaactacccgatgtgctcaacaggctaaagccggatataatgatagtgcacggcgataggttcgatgctttggcgctggccaccagcgcggcactgatgaatatcagaatcctgcatatagaggggggggaagtgtctggcacaattgacgactccatccggcatgcgatcaccaaactggcacattatcacgtctgctgtacaaggagtgcggagcagcacctgatctccatgtgcgaagatcacgatcgcatattactcgcgggctgtccaagctacgacaagctgctgtcggccaaaaataaagattacatgagcattattcgcatgtggttgggtgacgacgtgaagtctaaggactacatcgttgccctgcagcaccccgtgacaaccgatatcaagcactccatcaaaatgttcgaactgacactcgacgcgctgatatctttcaacaagcgaactctagtgctattcccaaacattgatgctgggtccaaagaaatggtgcgggtcatgagaaagaaaggaatagaacaccaccccaattttcgggctgtgaagcacgtgcccttcgatcaattcattcagctggttgcccacgcaggctgtatgattggcaatagttcatgtggcgtgcgagaggtgggcgcttttggcacacccgtcatcaatcttggaacaaggcagatcgggagggaaacaggcgagaatgtgttgcatgtgagagacgccgacactcaggacaagattctgcaggccctgcatctgcaatttggcaaacagtacccctgctcaaagatctacggcgacgggaacgccgtcccgaggatcctgaaatttcttaaaagtattgacctgcaagaaccgctgcagaaaaagttttgcttcccaccagtgaaagagaatattagccaggatattgaccacattctcgagactctaagtgccctggccgtggatttaggcgggacaaaccttagagttgctatcgtctctatgaagggtgagatcgtcaaaaagtacactcagttcaaccccaagacatacgaggaaaggatcaacctcattcttcagatgtgcgtggaggccgcagccgaggcagtcaagctgaactgtcgaatacttggagttggcatttctaccggcggacgggtgaatcctagggagggcatcgtgctacactctaccaagctcattcaggaatggaattctgtggatctaaggacccccttgagcgacactctccacctaccagtgtgggtggataacgatggcaactgtgccgcactggccgaacgcaaatttggccagggtaaagggctggagaattttgtgacccttatcacaggaaccggcattgggggagggatcatccatcagcacgagctgatccatggcagcagcttctgcgccgctgagctcggccatttggttgtctctctggacggtcccgactgttcttgcggatctcatggatgtatagaagcttacgcttcgggaatggcgctgcaaagggaggcaaagaagctccatgatgaggatctcctactcgtggagggtatgtctgtgcctaaggacgaagcagtgggggccttgcacctgatccaggccgctaagttaggaaacgccaaggcacaaagtattttaaggaccgccggaacggccctcggactgggcgtcgtgaatattttgcatactatgaatccaagcctcgtgattctgtctggcgtcctggcgagccactatatccacatcgttaaagacgtgatcagacagcaagccttatcgtccgttcaggatgttgacgttgtcgtgagcgacttggttgacccagccttactaggcgccgcctccatggtgctcgactatacaaccaggcgcatatactag

SEQ ID NO: 118424 - DNA, 2169 bp, Artificial Sequence
  Description of Artificial Sequence: Synthetic coding sequence
atggagaaaaatgggaacaatcggaagctgagagtgtgtgtggctacatgcaaccgagctgattactcaaaactggcccccataatgttcggcatcaagaccgagcccgagttcttcgaactggacgtcgttgtactgggctcacatctgatcgatgactacgggaatacttaccgcatgattgaacaggacgattttgacattaacacgaggctgcataccattgtgaggggcgaggatgaagcagcaatggtggaaagcgttggccttgctctcgtgaagctgcctgacgttcttaaccgtctgaaacctgatataatgatcgtgcatggcgaccgttttgacgccttggctctcgccacaagtgcagcgctgatgaatatcagaatcctgcacattgagggaggtgaagtgagtgggaccattgatgatagcatacggcacgccattacaaagctggctcactaccacgtgtgttgtacacgcagcgctgaacagcatctgatcagtatgtgcgaagaccatgaccgcatcctgcttgcaggatgtccatcctatgataagttgctgagtgcaaagaacaaggactacatgtccatcatcagaatgtggctaggcgatgacgtgaagtccaaggattatattgtcgctctgcaacaccctgtgaccacagatatcaaacacagcattaaaatgttcgagcttaccctggatgctctgatctcttttaacaagcgtacgctagtcctgtttcccaacattgacgcaggatcaaaagaaatggtgagagtgatgagaaaaaaagggatcgagcatcacccgaatttccgagcagtgaaacatgtgccattcgaccagttcatccagctcgtcgcacatgctggttgtatgattgggaattcgagttgtggcgtgagggaagtgggtgcatttggaaccccggtgatcaatctgggaaccagacaaatcggcagggaaaccggagaaaatgtgctgcacgtgcgggatgccgacacacaggacaagatcctacaggctctgcacctgcagttcggaaaacagtacccttgcagcaagatctatggggacgggaacgccgtaccacgaattctcaagttcctgaaatcaatcgatctgcaggaaccactgcagaaaaaattctgtttcccacctgtcaaggagaacatcagccaggatatcgaccacatcctggagactttaagtgccctggcagtagatttgggcggaaccaacctgcgggtggccatcgtgtctatgaaaggggaaatcgtcaagaagtacacacagttcaatcccaaaacctatgaggaaaggattaacctgatcctacagatgtgcgtggaagcggccgccgaggcagtcaaactcaattgcaggatcctgggtgtgggaatctcaacagggggtcgcgtcaatccaagagaaggtatagtgctgcattcgactaagctgatccaggagtggaattccgtcgatctacgcaccccactcagcgacaccctacacctgcccgtgtgggtggacaatgatgggaactgtgctgctctcgccgaaagaaaattcggtcagggaaagggtttggaaaactttgtcacactgatcaccggtaccgggattggaggcgggattatccatcagcacgagctgattcacggcagctctttctgtgcagcggagctgggacacctcgtggtctctctcgacgggcctgattgcagctgtggaagtcacgggtgcatagaagcttatgccagtggaatggcattgcagcgggaggcaaaaaaacttcatgatgaggacctcctgctggtggagggaatgagtgttccgaaagacgaggctgtgggtgccctacacctgatccaggctgctaagcttgggaacgcaaaagcgcagagtatcctcagaactgctgggacagcgctggggctgggtgtggtcaatatcttgcatactatgaatccaagtctggttatcctatccggggttctcgcatcacattatatccatatagtaaaagatgtcatccgccagcaagctctgagttcggttcaggatgtggacgttgtggttagcgacctggtggaccctgctttactgggagctgcttccatggtgttggattacacaacacggaggatctactag

SEQ ID NO: 118425 - DNA, 2262 bp, Artificial Sequence
  Description of Artificial Sequence: Synthetic coding sequence
atggagacctatgggtatcttcaacgtgaatcctgtttccaggggccacacgagctctatttcaaaaacctgagcaagcgtaacaaacagataatggagaagaacggcaacaatagaaaattaagagtgtgcgtcgcgacttgcaacagagcagattacagtaaactcgcgccgatcatgtttggcatcaagactgagcctgaattctttgagctcgacgtggtcgttctaggttcacatctaatcgatgactacgggaatacttatcggatgatcgagcaggacgacttcgacatcaatacaagactccacactatcgtgaggggtgaagatgaagccgccatggtcgagtcagttggccttgcactggtgaagctgcccgatgttctgaatcggctcaagcccgacatcatgatcgttcatggcgaccgctttgatgcgctggcgctggcaacctccgccgcgcttatgaacattcggatcctgcacatagaaggcggtgaggtttccggcacgatcgacgactccatccgccacgctatcacaaaactcgcgcactaccacgtctgctgcacaagaagtgccgagcagcacctgatcagtatgtgcgaggatcatgatcgtatcctgctcgccggctgcccatcttatgataaactcctgagcgcgaaaaataaggactatatgagcataatcagaatgtggttgggagacgatgtgaagagtaaagattatatcgtcgccctgcaacatcccgtgacaacggacataaagcactccatcaaaatgtttgagttgaccctcgatgccctgatcagcttcaataagaggacgttggtgctctttcccaatatcgacgccggcagcaaagagatggtcagggtgatgcgtaagaagggcatagaacatcatcccaatttcagggctgtgaaacatgtccccttcgatcagtttatacaattagtggctcacgcagggtgcatgatcggcaatagttcctgtggagtccgggaggtgggggcattcggcacacccgtgattaaccttggaacgcgccagatcggacgagagaccggagagaatgtacttcacgttagagacgccgacacgcaagataagattttacaggccctccacctccaattcggcaagcagtacccatgttcaaaaatctatggggacgggaatgccgtgcctagaatactgaagttcctcaagtccatcgacctgcaagaaccgctgcagaagaaattctgttttccacctgttaaagagaacatctcccaggatattgatcacatcctcgaaacattgagcgcactggctgtggatttgggggggacgaacttacgagtggcaatcgtctctatgaagggggagatagtaaagaaatatacccaattcaatcctaagacctatgaggaaaggataaatctgatcctgcagatgtgtgttgaggcagctgccgaagctgtcaaactgaattgccggatactgggagtcggaatcagcactgggggtagagtgaacccccgtgagggcattgttttgcacagtactaaattgatccaggagtggaactccgtggatcttagaactcctctttctgacacacttcatctccctgtttgggtagacaacgatggcaactgtgctgctctggccgagcgaaaattcgggcaaggcaaagggctcgagaactttgtgacacttattactggcacaggcataggtggagggatcattcaccaacatgaattaatccacgggagctcattctgcgcggccgagctaggccatctggtagtaagcctcgatgggcctgattgcagttgtggctcgcatgggtgtatcgaggcgtacgcctcaggcatggctctgcagagggaagcgaagaaactgcacgacgaagatctgctgttggtggaaggaatgtccgttcccaaagacgaggctgtgggagcattacacctgatccaggcggccaagctgggcaatgctaaagcacaatcgatcttgcggacggcgggtaccgccctgggccttggggtggtaaatatcctgcacacaatgaatcctagcctagtgatcctgtccggcgtccttgccagtcactacatccatatcgtcaaggatgtaatccggcaacaggccctaagctctgtgcaggatgtagatgttgtggtctccgatctggtggaccctgctttgctgggagcagctagcatggtgctagattatacgaccagacgtatctactag

SEQ ID NO: 118426 - DNA, 399 bp, Artificial Sequence
  Description of Artificial Sequence: Synthetic coding sequence
atgttcgagctcaccctcgatgcacttattagtttcaataaaagaaccctggtcctgttccctaacatcgacgcgggatcgaaggagatggtgagagtgatgcggaaaaaaggcatcgagcaccatcccaacttccgtgccgtgaagcacgttcctttcgaccagtttatccagctagtcgcacacgccggttgtatgattggaaattcatcctgcggcgtacgcgaagttggtgctctgactaggttatacacgtacgtctcttgttataaacacacacacacccacacacatacgcacccctccagttctaatcccaaactgagatctcagaaagtgatccagtcagagaataggggcaaatcctaccaggaaggacttaagtacacctttttttag

SEQ ID NO: 118427 - DNA, 2169 bp, Artificial Sequence
  Description of Artificial Sequence: Synthetic coding sequence
atggaaaaaaatggcaacaatcgtaaactgagagtctgtgtagcaacttgtaatagagccgactactctaaactggcaccaatcatgtttggcataaagaccgagccagagttctttgaactggacgtggtcgtgctgggaagccatctgatagacgattatggcaacacgtatcgcatgatcgagcaagacgactttgatattaacaccagactccacacaatcgtcaggggggaggacgaagcagcgatggtcgagtccgtcggactcgcactggtgaaactgcctgatgttctcaacagactgaaacccgatatcatgatagtgcatggagatcgattcgacgctctggcgctggcaacttccgcagccttgatgaatattagaatcttgcatattgagggaggcgaggtatccgggaccatcgatgattccattcgccacgccattacgaagctggctcactaccacgtgtgctgcaccaggtccgctgagcaacacctgatttctatgtgcgaggatcacgacaggatccttttggcgggatgcccgtcttacgataaattgctaagcgctaaaaacaaggactacatgagcattatacggatgtggctgggggacgacgtcaagtccaaggactacattgtggccctgcaacacccagttacaactgatatcaaacacagcataaagatgtttgaattgacactggacgcattaatatccttcaataagaggaccctggtcttgttcccgaatatcgatgcaggatccaaggaaatggtaagggttatgcgcaagaaaggaatcgagcatcatccaaattttcgggccgtgaaacatgttccctttgaccagttcatccaactggtagcgcatgccggatgcatgatcggaaatagtagctgcggtgtgagggaagtgggcgcttttggaaccccagtgataaatttgggaactcggcaaatcgggagagagacaggggagaatgtgctccatgtgcgcgacgccgacacacaggacaagattctacaggcgttgcatctacagttcgggaaacagtatccctgctctaaaatctacggcgatgggaatgccgtgccccggatattgaaattcctcaagtctatcgatctacaggagccactccagaagaaattctgtttcccgccggtcaaggagaatatttcacaggatatcgaccatattctggagaccctcagcgctctagccgtggatttaggcggcacaaacctgagagtagccatcgtatctatgaagggtgagattgtgaagaaatatacacaatttaatcctaagacttacgaggagagaattaatctcattttgcaaatgtgcgttgaagcggccgccgaggccgtgaagctcaactgtcgtatattgggtgttggaatttccaccggggggcgagttaaccctcgggagggcatagtgctccatagtacgaagctgatccaggaatggaattccgtggatttgcggacaccactgtccgatacactccacctgccggtatgggtcgacaatgatggcaattgtgcagccctggcagaaaggaaatttggccagggaaaagggttggagaacttcgtcaccctcataactggtaccgggatcggcgggggcatcattcaccagcatgagctgattcatggctccagcttctgcgcagccgagttgggacaccttgtggtttcgcttgatggccctgattgcagctgcggctcccatggatgcattgaagcctacgcgtctggcatggccctacagagggaagcaaagaagcttcacgatgaagatctcttgctcgtcgaagggatgagcgtgcctaaagacgaggcagtgggtgcgctgcatctgatccaggctgcgaagctcggcaacgctaaggctcaaagtattctgaggacagctgggactgctctgggtctgggagtagtcaatatcctgcacacaatgaaccccagtctggttattctctctggggttctcgcatctcattacatccacatcgtgaaagatgttattcgccaacaagctctcagctcagtccaagatgtagacgtcgtcgtgtctgaccttgttgaccccgcactactgggcgccgctagtatggtcctggattatactacaaggcgcatctattag

SEQ ID NO: 118428 - DNA, 1947 bp, Artificial Sequence
  Description of Artificial Sequence: Synthetic coding sequence
atggagaagaatgggaacaaccggaagctgcgcgtatgcgtggcgacctgtaatcgggcagattactccaagctggctcctatcatgttcgggattaaaacggagccagaatttttcgaactagacgtggttgtgctaggctcccacctgattgacgactatgggaatacgtatagaatgatcgaacaagatgactttgacatcaatactcggcttcacacaatagtgcgcggcgaagacgaggccgcaatggtggagtcagttgggttagctttggtgaaattgccagacgtgctaaatcggctcaagcccgacataatgattgttcacggcgataggttcgatgccttggccctggctacatcagctgcgctgatgaacattagaatactgcacatcgagggcggcgaagtaagcggcactatcgatgattctatcagacacgccataaccaaactggcccattatcacgtgtgctgcacacgatccgccgagcaacacttaatttctatgtgtgaggatcacgacagaatactgctggcaggttgcccaagttacgataagctcctgagcgcgaagaataaggactatatgtcgataattagaatgtggctcggggatgacgtgaagagcaaggattacatcgtggcactccaacatccggtgacaacggatataaaacattcaattaagatgtttgagttaaccctggacgcgctgatatcattcaacaagcgcacacttgttctgtttccgaatatcgacgcagggagcaaggagatggtgcgagtcatgagaaaaaaggggatagaacatcaccccaatttccgggccgttaaacacgtgcctttcgaccagttcatacagctggtcgcccatgccggctgcatgatcggcaactcttcttgcggggtgcgcgaggttggagcctttggcacacccgtgattaatctgggaactcgacagattgggagggaaaccggcgagaatgtcctccacgtccgcgatgcggacacacaggacaagatattacaggcactgcatctccaatttgggaagcagtacccctgttctaaaatctatggtgacgggaatgccgtgccgagaatcctgaagtttctcaagtccatcgatttgcaggagcctctgcaaaagaaattttgctttccccctgtgaaggaaaatatttctcaagacatagaccacattctggagactttgtcggccctcgctgtagacctaggaggcaccaaccttcgggtcgcgatagtttccatgaagggggagattgtcaagaaatacacccagttcaaccctaaaacctacgaagagcggatcaatttaattctgcagatgtgtgtggaagccgcagctgaggctgtgaagcttaactgtagaattctgggtgtgggcattggcggcggaattattcatcagcacgagctgatacatggttcgagtttttgtgcagccgagctcggtcacctggtagtgtccctggatgggcctgactgttcttgtggtagccatggatgcatcgaggcctatgctagtggcatggcactgcagcgcgaggctaaaaagctgcacgacgaagacctcttacttgtggagggtatgagcgttcccaaagacgaggcagtgggggccctgcacttgatacaggcagccaaactgggcaacgcaaaagcccaaagcatcctgaggacagccggtaccgcgttaggtctcggagtggtgaacatactccacaccatgaacccttctctggtgatactgtcaggcgtgctagcaagccactatattcatatcgtaaaggacgtgataagacaacaagccttatcttcggtgcaggatgttgacgttgtagttagcgatctcgtggaccctgccctccttggggccgcatctatggtgctagactacactaccaggagaatatactag

SEQ ID NO: 118429 - DNA, 1839 bp, Artificial Sequence
  Description of Artificial Sequence: Synthetic coding sequence
atgatcgagcaagacgatttcgatattaacacaagactgcacaccattgtaaggggtgaagacgaggctgcaatggtggagtccgtgggtttggccctggtgaagctccccgatgttctgaacaggctgaagccagacatcatgatagtccatggggatcgttttgatgcacttgccttggccacgtctgccgctcttatgaatattaggatcctccacatagaaggcggcgaggtcagcggaaccatcgacgatagtatacggcatgcaattactaagctcgctcactaccatgtttgttgcacacgttctgcggagcagcacctcatttccatgtgtgaggaccacgaccgtatccttctcgcaggatgtccgagctacgataaattactgtctgccaagaacaaagattatatgtcaatcattcggatgtggctgggctccaaggagatggtcagggtgatgagaaaaaaagggattgaacatcaccccaattttagagctgtgaagcatgttccttttgaccagtttatacagttggtggctcacgccgggtgcatgattggaaactccagctgcggcgtccgagaggtaggagcctttggaacacctgtcataaacctgggaacacgccagatcgggcgagagaccggcgaaaatgtgctccatgtgcgagatgcagatacacaagataagatattgcaggccctacacctccagtttgggaagcaatatccatgttcaaagatttatggcgacgggaacgccgttccacgcattctgaaatttcttaagtccatagacttgcaagagccactgcagaagaagttttgcttccctcccgttaaagaaaacatttcccaggatatcgaccatatactggagactctgtccgctctcgccgtggatttgggaggaactaatttgagagttgcaatcgtgtccatgaagggtgagatcgtcaaaaaatatacccagttcaatccgaagacatacgaagaacgcatcaatctaatacttcagatgtgcgttgaggccgctgctgaggcggtgaagttaaattgtaggattctgggtgttgggattagcacgggagggagagtcaatccaagggagggcatcgtgttacattcgacaaagcttatacaggaatggaattctgtcgacctgcgcacaccattgtcggataccctccatctgccagtgtgggtggacaacgacggcaactgcgcagctctcgcagaacgaaagttcgggcagggaaagggcctcgaaaactttgtgacattgatcactggcacaggaatcggtggaggcatcatccatcaacacgaacttatccatggtagcagcttctgcgccgccgagctgggtcacctggtggtatctctggacggccctgactgttcctgcggcagtcacggctgtatcgaggcctatgcttctggcatggccctgcagagagaggccaaaaagttgcacgatgaggacttgctgctagttgaggggatgtccgttccgaaagatgaggccgtgggtgccctgcacctcatccaggccgctaaactgggcaacgccaaggctcagtccatcctgagaacagctgggaccgctctggggttgggcgtggtgaacatattgcatactatgaaccctagtttggttattctttccggggtcctcgcgagccactacatacacatcgtgaaagacgtgattaggcagcaagctctgagtagtgtacaagatgtagacgtggtggtgagcgatcttgtggacccagctcttctgggggcggcatcaatggttctggattataccacccgtaggatatattag

SEQ ID NO: 118430 - DNA, 870 bp, Artificial Sequence
  Description of Artificial Sequence: Synthetic coding sequence
atgaaactaatcatactcgaacattatagccaggcttcggaatgggctgcgaagtatatcaggaacaggatcattcagtttaaccctggccccgaaaagtactttaccctgggcctacctaccggctccacccctctggggtgctacaagaagctcatcgaatattacaaaaacggcgatctctcctttaagtacgttaagaccttcaatatggatgagtacgtcggacttccgcgtgaccatcctgagagctatcacagttttatgtggaacaatttctttaagcacattgatatccaccccgagaacacccatatattggacgggaatgccgtagaccttcaggccgagtgcgacgcattcgaggaaaaaatcaaagccgccggtggcattgaactgttcgtaggaggtataggaccagacggccacatagcattcaatgaacctgggtctagtctggtgtctcggactagagtgaagacactggccatggatacaattctggccaacgcgcgcttcttcgatggtgaactgacaaaggtgccgacgatggctctgacagttggagtgggtactgtcatggatgctcgggaggtcatgattctgatcaccggagctcacaaggctttcgctctgtacaaggcgatcgaggaaggcgtgaaccacatgtggacggtcagcgcctttcagcagcaccctcgaacagtgttcgtatgcgatgaagacgccacattggagctgaaagtaaagaccgtgaagtactttaagggcctcatgctcgtgcataacaaactggtggacccgctctactcaatcaaggagaaggagacagaaaagagccagtccagtaaaaaaccatacagcgattag

SEQ ID NO: 118431 - DNA, 768 bp, Artificial Sequence
  Description of Artificial Sequence: Synthetic coding sequence
atgaagcttattatcctggaacactattctcaggccagcgaatgggccgctaaatacatcaggaatagaatcattcagttcaaccctggtccagaaaagtatttcaccctgggcctgcctaccggtctgccacgagaccacccagagtcttaccactccttcatgtggaataacttcttcaaacacatagatattcatcctgagaacacacacattttggacggtaatgcagtagatctgcaagcagagtgcgatgcttttgaagagaaaataaaggccgctggaggcatagagctgttcgtcggcgggatcggtcccgacggtcacattgcatttaatgagcccggatcgtctttggtgtctcggacgagggtgaagacccttgcgatggacaccattttagccaatgcccggttttttgatggggagttaacaaaagtcccaaccatggctttgaccgtcggagttggcacagtcatggatgctagggaagttatgatactgattaccggagcgcacaaggccttcgcgttatataaggcaattgaggaaggtgttaaccatatgtggacagtctctgcattccaacagcacccccggactgtcttcgtgtgtgacgaggacgcgacgctggagctcaaagtaaagacggttaagtactttaagggtctcatgttagtgcataacaagctggttgacccactctattcgattaaggagaaggaaaccgaaaaatcccaaagtagcaagaaaccatactcagactag

SEQ ID NO: 118432 - DNA, 870 bp, Artificial Sequence
  Description of Artificial Sequence: Synthetic coding sequence
atgaaactgataatccttgaacattattcccaggcctctgagtgggcagccaagtacatacggaatcgaattattcagttcaatcctggaccggagaagtactttactctaggactgcctacaggaagcacacctctcgggtgctataagaaactgatcgaatattacaagaacggcgacctctcattcaagtatgtaaaaacgttcaacatggacgaatacgtcggcctgccgcgcgatcatcccgagtcgtaccattcctttatgtggaataactttttcaaacatatcgacatccaccctgagaatacacacattctcgacggcaacgcagtcgaccttcaagcagagtgcgacgctttcgaggagaaaatcaaggctgccggaggtattgaactgttcgtagggggtatcggacctgacggtcacattgccttcaatgagccaggatcctccctggtgtccaggaccagggtaaagacccttgccatggacacaattctggctaacgcccgcttttttgatggtgagttgacgaaagtgcctactatggctctgaccgtgggagtggggacagtcatggacgcccgcgaggtaatgatattgatcactggagcccacaaggcttttgccttatacaaagcgatcgaagaaggggtaaaccatatgtggaccgtttctgccttccaacagcatccccgcacagtgtttgtctgcgatgaagacgccacgttagagcttaaggtgaaaacagtgaagtacttcaaaggtctaatgctggtgcacaataaactcgtggaccctttatactcaatcaaagagaaagagaccgaaaaaagtcaatctagcaaaaagccctattccgactag

SEQ ID NO: 118433 - DNA, 417 bp, Artificial Sequence
  Description of Artificial Sequence: Synthetic coding sequence
atgaaactgataatcttggagcactacagccaagcatcagaatgggccgccaaatatattcgcaaccgtatcatccagtttaatcctggccccgagaagtacttcaccctgggtctgccaaccggatctacccctctggggtgctacaaaaagctgatcgagtattataaaaatggagacttgtcgtttaagtacgtaaaaacattcaacatggatgaatacgtcggattaccccgagatcatcccgaaagttaccatagcttcatgtggaataatttttttaagcatatcgacatccaccccgaaaatactcacatactagacgggaacgctgtcgacttgcaggccgagtgtgacgctttcgaggaaaagattaaagccgctggaggaattgagttgtttgtgggagggatatag

SEQ ID NO: 118434 - DNA, 870 bp, Artificial Sequence
  Description of Artificial Sequence: Synthetic coding sequence
atgaaattgattattttggaacattactcccaggcgtccgagtgggcagccaaatacatccgcaatcggattatccaatttaacccaggccctgagaaatattttactttgggactgcccactgggagcactcctcttggctgttacaaaaaactcatagagtactacaagaacggagatctttcattcaaatatgtcaaaactttcaatatggacgaatacgtgggcctgcctagagaccacccggagagttatcactctttcatgtggaataacttctttaagcacatcgacattcacccagagaacacacacatccttgatggcaatgctgtggatttacaggctgaatgcgatgcgtttgaggagaaaattaaagctgcaggtggcatcgaattgttcgtgggagggattggccctgacggtcacattgcctttaatgagccgggtagttcactggtgagcagaacccgagtaaaaaccctggcaatggacactatcctggccaacgccaggttctttgatggcgagctgactaaagtgcccactatggccctcaccgtcggagtgggcacagtgatggatgccagagaagtgatgatcttgatcactggagcccacaaagcgttcgccctctacaaggcaattgaggagggggtgaaccatatgtggacagtatctgcctttcaacagcatccccggacggtattcgtttgtgacgaggacgcaacattagagctgaaggtgaagactgtaaaatactttaagggcctcatgctggtgcataataagcttgtagatcccttgtacagcatcaaagagaaggagacagagaaatcccagtcttcgaagaagccttacagcgactag

SEQ ID NO: 118435 - DNA, 90 bp, Artificial Sequence
  Description of Artificial Sequence: Synthetic coding sequence
atgaagctgataattttagagcactactcccaagccagtgagtgggccgctaaatacattcgcaatcgaattatccagttcaatccctag

SEQ ID NO: 118436 - DNA, 870 bp, Artificial Sequence
  Description of Artificial Sequence: Synthetic coding sequence
atgaaactgataattctagaacattacagccaggcgagcgagtgggccgcgaaatacatccgaaaccggatcattcaattcaacccaggccctgagaagtacttcactctcgggctcccaacaggttcgactccattaggatgctataagaagctcattgaatattataaaaacggggacttaagcttcaagtatgtgaaaacctttaatatggatgagtacgtgggcttaccccgagaccaccccgaatcgtatcactccttcatgtggaataacttctttaagcacatcgatattcaccccgagaatacacacatactggacgggaacgctgttgacctgcaggctgaatgtgatgctttcgaggaaaaaatcaaagctgccgggggaatcgagttgttcgtcggcggcatcgggcccgatggtcacatcgcttttaatgagccgggttcatccctcgtgagcagaactagagttaagacgttggcaatggatacgatcctggctaatgcaagattttttgatggcgaactgaccaaggtccccactatggccctaaccgtcggggtgggtacagtgatggacgctagagaggttatgattttgattaccggagcacataaagcctttgctctatacaaagctatcgaggagggcgttaaccacatgtggaccgtgagcgccttccagcagcacccccggacagttttcgtgtgtgacgaggacgcgaccctggagctgaaggtaaagacggttaagtattttaagggcttaatgttggtgcataataagcttgtggatcctctttattctatcaaggagaaggagacagaaaagtcccagagtagcaaaaagccttacagcgactag

SEQ ID NO: 118437 - DNA, 486 bp, Artificial Sequence
  Description of Artificial Sequence: Synthetic coding sequence
atgaaactgatcatccttgaacactatagccaggccagtgaatgggcagctaagtatatccggaatagaatcattcaatttaaccctggcccagagaaatattttacgttaggcctgccaacaggcagcacccctctaggctgctataaaaagctgatcgaatactacaagaacggcgatctctcctttaaatacgtcaaaacatttaatatggacgaatacgtcgggctgccccgcgaccatccagagagttatcactcttttatgtggaataatttttttaagcacattgacattcatcccgagaatacccacattctggatggaaacgccgtggacctccaggccgagtgtgatgccttcgaagaaaaaattaaagccgctggcggcattgaattatttgtgggcggtattggcccggatggccacattgcgtttaacgagcctgggagctctttagtttcacgtacgcgagtgaaaacatag

SEQ ID NO: 118438 - DNA, 639 bp, Artificial Sequence
  Description of Artificial Sequence: Synthetic coding sequence
atgaagttaattatactggaacattacagccaggcttctgaatgggctgcgaagtatatccggaaccggatcatccagtttaatccaggaccagagaagtattttactctgggtcttccaaccgggtccacgccactcggctgctacaagaagttgatcgaatactacaagaacggagacctctcattcaagtatgtgaagactttcaatgaacctgggagttccttggtgtctagaactagggtcaaaacattggctatggataccatcctagccaacgcgagattctttgatggggagttgacaaaggtgccaaccatggctctcacagttggggttggtacagttatggatgcgagagaagtgatgatcctcatcaccggggcccacaaagccttcgccctatataaagccatcgaggagggagtgaaccacatgtggacagtgtctgcctttcaacagcatccccggactgttttcgtctgcgatgaagacgcgacactcgagctgaaagtcaaaaccgtgaaatattttaagggactcatgctggtccacaacaagctggtggacccactgtactccatcaaggagaaggagaccgaaaagagccaatcttctaaaaagccttacagcgattag

SEQ ID NO: 118439 - DNA, 831 bp, Artificial Sequence
  Description of Artificial Sequence: Synthetic coding sequence
atgcgcctcgtgatcttggataactacgatctcgccagcgaatgggccgccaaatatatatgtaatcgcattatccagttcaagcccggccaagacagatacttcacgctggggctgcccacaggaagcacgcccctcggatgttacaaaaaattaattgagtaccataagaatggccacctcagtttcaaatatgttaagaccttcaacatggacgagtacgttggactccccagaaaccatcctgagtcctaccattcctacatgtggaacaatttcttcaagcacattgacatcgacccgaataacgcgcatattctcgacggcaacgccgccgatctgcaagcagaatgtgatgcattcgaaaacaaaatcaaagaagcaggcggcatcgatctgttcgtaggtggaataggccctgatggacatattgcattcaacgaacctgggtctagcctcgtttctcgaacccgattgaagaccctggcgatggacacaatcctggccaatgcgaagtattttgacggcgacctgtctaaagtacccactatggccttgaccgttggcgtggggaccgtgatggacgcccgggaggtgatgatcctgatcactggtgcacataaagcctttgcgttgtataaagccatcgaggagggggttaaccatatgtggaccgttagcgcatttcagcaacacccgcggaccatcttcgtgtgcgacgaggacgccacactggaactcagggtaaagaccgtgaagtactttaaaggcctgatgcacgttcacaacaagctggtcgatcctctgttcagtatgaaagatggaaattag

SEQ ID NO: 118440 - DNA, 780 bp, Artificial Sequence
  Description of Artificial Sequence: Synthetic coding sequence
atgcgtctagttattttagataattatgacctcgcctccgagtgggcggccaagtacatttgtaacagaataattcagttcaaacctggacaagaccggtattttaccttgggcctgccaacaggctctactccccttgggtgttacaaaaagctgatagaataccacaaaaatgggcacttgtcctttaaatacgtaaagaccttcaacatggacgagtatgttgggctgccccgtaaccatccagaatcataccatagttacatgtggaataatttcttcaaacacattgatatcgatcctaacaacgcacatattcttgatggcaacgctgcagatctgcaggccgagtgcgatgcatttgagaataagatcaaggaggctggaggtattgacctcttcgtggggggaataggtcctgatgggcatattgcctttaatgagccaggcagcagcctggtgtcacggacgcggttgaaaactctggctatggacacaattctcgcaaacgccaaatacttcgatggtgatctgagtaaggtgcccaccatggcccttacagtaggggttggaacagtgatggacgcacgtgaggtgatgattctgattaccggtgcacacaaggcttttgcattgtataaggcaatcgaagagggagtcaatcacatgtggacagtaagcgcgtttcagcagcaccctagaacaatcttcgtgtgtgacgaggatgctactcttgagttgcgggttaagactgtgaaatattttaagggggaacactag

SEQ ID NO: 118441 - DNA, 729 bp, Artificial Sequence
  Description of Artificial Sequence: Synthetic coding sequence
atgcgtcttgtgattcttgataactatgaccttgcaagtgagtgggcagcaaagtatatctgcaatcggatcatccaatttaagccgggccaggacagatatttcacactgggattgcctaccggccttcctagaaaccaccctgagagttaccattcctatatgtggaataacttttttaaacacatcgacatagatcccaacaatgcccacatcctggatggtaatgctgccgacctgcaagcagagtgtgacgcctttgagaacaagatcaaggaggccgggggcatcgaccttttcgttggcgggatagggcctgatggtcacatcgccttcaatgaacctgggtccagccttgtatcacgcaccaggctgaagacgttagcaatggacactatcctggcaaacgcgaagtattttgacggagatctgagcaaagtgccaactatggccctgaccgttggtgtgggcacagttatggatgcacgcgaggtaatgatactgattacaggagcccacaaagcatttgcactgtacaaggccattgaggagggcgtgaaccacatgtggactgtgtcggcctttcagcagcacccacgcactatctttgtgtgtgatgaggacgcaactctggagctgagggtgaaaactgtgaagtactttaaagggctgatgcatgtgcataacaagctagtggatccactgtttagtatgaaagatggtaactag

SEQ ID NO: 118442 - DNA, 1287 bp, Artificial Sequence
  Description of Artificial Sequence: Synthetic coding sequence
atgctgaggaccctcctgagacggcgcttattttcttatcccaccaaatactactttatggtacttgtgctctccttgataacattctctgtgctgaggattcaccagaagccagagttcgtctccgtgcgccatctcgagctggctggcgagaatccttcttccgacatcaactgtactaaggtcctgcagggggacgtaaacgaaatccaaaaagtgaaactagaaattctgaccgtaaagttcaaaaagcgtcctcgctggacaccagatgattatatcaacatgacatccgactgctcgagttttataaagaggagaaagtacattgtcgagccactctccaaggaagaggctgaatttccaatcgcctattctattgtggtgcaccataagatcgagatgctggatcgtctcctcagagcaatttatatgcctcaaaatttctactgtattcacgtggatactaaatcagaggattcctatctcgcagctgttatgggaatagcaagctgtttttctaatgtgttcgtggcttctcgccttgagtctgtggtctatgcgtcttggtctcgggtccaggcagatcttaactgtatgaaagacctgtatgcaatgtctgcgaattggaagtatctgattaatctatgtggtatggacttccctattaagactaatctcgaaattgtccgaaagctgaagctgctaatgggcgaaaacaacttggaaaccgagcgtatgccttcacacaaggaagagagatggaagaaaaggtatgaggttgtcaacggcaaactcactaacaccggcaccgttaagatgctgcccccgctggaaacgcctctgtttagcggctccgcatatttcgttgtaagcagggagtatgttggctatgttttgcagaatgagaagatccagaaactgatggaatgggcacaggacacatactccccagatgaatacctgtgggcaacaattcagaggatcccagaagtacccggttcacttccagcatcccacaagtacgaccttagcgacatgcaagcagtagctaggttcgttaaatggcagtactttgagggggatgtgtccaaaggtgctccttaccccccctgtgatggcgtccatgtgcggagcgtatgtatcttcggcgccggggatctgaattggatgctaagaaagcatcacttatttgctaataaatttgacgtggatgtagacctgtttgctatacaatgcctggacgaacacctcaggcacaaagccctggagacactaaaacactag

SEQ ID NO: 118443 - DNA, 1287 bp, Artificial Sequence
  Description of Artificial Sequence: Synthetic coding sequence
atgttgaggacactgctgagacgccgcctcttcagttatcctacaaagtattacttcatggtgctggtgctgtctcttatcacattttccgtcctcaggatccatcagaagcccgagttcgtttctgtgagacatctggagctcgctggcgagaaccctagctctgacattaattgtaccaaagttctgcagggagatgtaaacgagattcagaaggtcaagctggaaattctcaccgtgaagttcaaaaaaaggcccagatggacaccagacgactatatcaacatgacttcggactgtagctcatttatcaaaagaaggaaatacatcgtggagccgctaagcaaggaagaggcagagttcccaatcgcctactccattgtagtgcaccataagatcgagatgttggaccgcctgttaagggccatctacatgccacagaacttctactgtattcatgtggacaccaaatccgaggactcttacttagctgcagttatgggtatcgcctcttgttttagcaacgtgtttgtagcgtcccggctcgagagcgttgtctatgcatcttggagccgcgtccaggcagatcttaactgtatgaaagatctctatgcgatgagcgctaattggaagtatttaattaacctttgtggtatggattttccaatcaaaacaaatctggaaattgtgagaaagctcaaactgctgatgggcgagaacaacttggaaacagaacgaatgccatctcacaaggaagaacgttggaagaagcgctacgaagtagttaacggaaaacttaccaatacgggcacagtgaaaatgctgcctcctctggagacgccactgtttagcggatctgcgtacttcgtggtttcacgcgagtacgtgggttacgtccttcaaaatgagaagatacagaaactgatggaatgggctcaggatacgtatagtccggatgaatacctgtgggcaaccatccagcggattccagaagtgcccggcagtctccccgcctcacacaagtacgacctgagtgacatgcaagctgtggcaaggtttgttaagtggcagtatttcgaaggggatgtgtcaaagggggcgccatatccaccctgcgacggagtgcatgtacggtctgtctgcatattcggtgccggtgatcttaactggatgctgcgcaaacatcacctcttcgccaataagttcgacgtggatgtggacctgtttgcaattcagtgcctggatgagcacttgcgacacaaagcccttgaaaccctgaagcattag

SEQ ID NO: 118444 - DNA, 1287 bp, Artificial Sequence
  Description of Artificial Sequence: Synthetic coding sequence
atgttgcgcacgctcctgcgacgccgcctgttctcctacccaaccaagtactacttcatggtgcttgtgctcagtttgattacctttagcgttctgcgcatacaccagaagcctgagttcgtctccgttcgccatctcgagctcgccggagaaaatccgtcttctgacatcaactgtactaaagtcttacagggggacgtcaatgaaattcagaaagtaaagcttgagatcctcacagtgaaattcaagaagcggcctaggtggacgcccgacgactatatcaatatgacctcggactgttcttcatttattaaacgccgcaagtatatagttgaaccgctcagcaaagaggaagccgagtttccaattgcgtactccatagtagtccatcataaaatcgaaatgctggatcgtctgttgcgggctatttatatgccgcagaacttttattgtatccacgtcgacacaaaatctgaagattcctatctcgctgctgttatgggaatagcttcttgtttctcaaatgtgttcgttgcctccaggctcgaaagtgttgtgtatgcatcatggtcacgcgtgcaggccgacctgaactgtatgaaggacttatatgctatgtccgctaattggaaataccttataaatctctgcggcatggacttccctattaagactaatctggaaatcgtgcgcaagctcaagctgctcatgggggagaataatctggagacagagcgcatgccttctcacaaagaagagaggtggaagaaaagatatgaggtggttaatggtaaacttacaaataccggtactgtcaagatgctgcctcccctggagacacctcttttctccggctctgcctatttcgtggtgtcacgggaatacgttggctatgtactgcagaacgagaagattcagaaactgatggagtgggcccaagacacttactcacccgacgagtatctgtgggctacaatacagcggatcccggaagtccctgggtccctgccggcatcacacaaatatgatttatccgatatgcaagctgtcgctcggttcgtgaagtggcagtatttcgaaggtgatgtttctaaaggagccccatatcctccgtgtgacggggtgcatgttaggagtgtgtgtatatttggcgccggagacctgaactggatgttacgcaaacatcatctttttgcaaataagttcgacgtcgacgtggatctgttcgccattcaatgcttggatgagcacctcaggcacaaagcactcgagaccctgaagcattag

SEQ ID NO: 118445 - DNA, 1287 bp, Artificial Sequence
  Description of Artificial Sequence: Synthetic coding sequence
atgttgaggacccttttgcgccggaggctatttagctaccctacaaagtattactttatggtcctagttctaagccttatcaccttcagtgtacttagaatccatcagaagcccgaattcgttagtgtcaggcatctagaactggctggggagaatccctcatccgatattaattgcactaaggtgttgcagggagatgtaaacgagattcaaaaggtgaagttggagatcctgaccgtgaagtttaaaaaaagacccaggtggacacctgacgactatatcaatatgacttcagactgcagctcttttatcaagcggcgcaaatatatcgtggaacccctgtccaaggaggaagcagagttccccattgcttatagcattgtggttcaccataaaatcgagatgcttgacagattgctgcgcgccatctacatgccccagaatttttactgtattcatgttgatacaaaaagcgaggatagctacttggcagctgtgatggggatcgccagctgtttcagcaacgtgtttgtggcaagtcgtttagagtctgtcgtttatgcttcttggtcgagggtgcaggcggacctgaattgcatgaaggacttgtacgctatgagtgctaactggaagtatttaataaacttgtgcgggatggatttccccataaagacaaacctggagatagttcggaagctaaaacttctgatgggagagaacaacttggagactgagcggatgccttcccataaagaggagcgatggaagaaaaggtacgaggtggtgaacggcaagctcaccaacacaggcaccgtaaagatgcttcccccactagagacacccctgttctccggtagtgcatattttgtggtctctcgggaatatgtcgggtacgtgctccagaatgaaaaaatacagaaactaatggagtgggcacaggacacttattcccccgacgagtacctttgggccacgatacagcggatccctgaggtacctggctcgttgcccgcctcccataagtacgatttgtctgacatgcaggcagttgcacgattcgtaaaatggcaatatttcgagggagatgtgtccaagggcgccccttacccaccttgtgatggagtgcatgtgcgctcggtgtgcatctttggtgccggcgacctgaactggatgcttaggaagcaccatttattcgcaaataagtttgatgtggacgtggacctgtttgccatacagtgcctggacgaacatctgcgccataaggccctcgaaactctcaaacattag

SEQ ID NO: 118446 - DNA, 1209 bp, Artificial Sequence
  Description of Artificial Sequence: Synthetic coding sequence
atgaacttttggcggtactgctttttcgcctttaccctgctgagcgtggttattttcgtgaggttttactcctctcaattgagtccccccaaatcatatgaaaagctgaactcgagtagtgaacgatactttcggaagaccgcttgtaatcatgcactggagaaaatgcctgtctttctctgggagaacatattaccttctcctctgcgaagtgtgccttgtaaggactacctgactcaaaatcactatattacctcgcctttgagtgaagaggaagcagctttcccgcttgcttatgtcatggtgatccataaagacttcgatacctttgagcgcttatttagagccatctacatgcctcagaatgtatactgtgtgcacgtggatgaaaaggcgcccgccgagtacaaagagtcagtcagacaacttttgtcttgctttcagaacgcttttatcgcttctaaaacagagtcggtggtatacgcgggcatcagcaggctacaggctgatctgaactgtctgaaagatctcgtggcctccgaagtgccgtggaaatatgtgattaatacgtgcggtcaagactttccactgaaaacaaatagggaaattgttcagcatctgaagggattcaagggcaagaatataaccccgggggttctccctcccgaccatgcaattaaaagaaccaaatatgtacaccaggaacacaccgacaaaggcgggttctttgtgaaaaacactaatatcctgaaaacatcacccccccatcagcttaccatctatttcgggacagcttacgtcgcccttaccagagacttcgtcgactttgtgctccgggatcagcgcgccatcgatttgctgcagtggtccaaagacacctactcaccagacgaacacttttgggttacactcaatcgggtgtcaggcgtgccgggttcaatgcctaacgcatcttggacgggcaatctgagagccatcaaatggtccgatatggaagacaggcatggtggttgccatggtcattacgtgcatggaatctgtatttacggtaatggcgatctcaagtggctggttaattcgccatctctcttcgccaacaaattcgaactgaacacttatccactgactgttgaatgcctggagctgaggcatcgagaaaggactttaaaccagtccgaaaccgcgattcagccctcatggtatttttag

SEQ ID NO: 118447 - DNA, 1203 bp, Artificial Sequence
  Description of Artificial Sequence: Synthetic coding sequence
atgcctctctccatgcgttacttattcatcattagtgtctcgagcgtgattatctttatcgtattctcagtgtttaactttggcggggacccttccttccagcggctaaatatatcggacccactgcggctgacgcaggtgtgtacgtcctttatcaacgggaagacacgatttctttggaagaacaagctgatgattcacgaaaagtcaagttgtaaagagtaccttactcaaagccattatatcactgctcccctgtctaaggaggaggccgacttcccactggcctatattatggtcatccaccaccacttcgacaccttcgcccgcctatttagagcaatctacatgccacagaacatttattgcgttcacgtggatgagaaggcgaccaccgaatttaaggatgctgtggagcagcttcttagttgcttcccgaatgcctttttagctagcaagatggaaccggttgtctatggaggaatttctcgtctgcaggcggaccttaactgtatcagggacctcagcgccttcgaggtgagctggaaatacgtgattaatacatgcggacaggatttccccttgaagactaataaggaaatcgttcagtatctaaagggattcaaagggaaaaacataacacccggggtgcttccaccagcgcatgccattggacgaacgaagtatgtgcaccaggagcatcttggcaaagaactcagctatgtgatccgaacgaccgcactcaagccccctcctccccataatctaacgatttatttcggcagcgcttacgtcgcccttagccgagagtttgctaattttgtgcttcatgaccctcgggccgtggacctgctgcagtggagtaaggataccttttccccggacgagcatttttgggtcactctgaataggatcccaggagtgccaggtagcatgccgaatgccagctggactggtaatcttagagcaattaagtggagcgatatggaggatagacatggggggtgtcatggccactatgtacacggaatatgcatttatggtaacggcgacttaaaatggctggtgaacagcccctcgctgttcgccaacaagttcgagctgaatacctacccgctgacagttgagtgtctggagttgagacatcgggagcgaactctgaatcagagtgagaccgccatccaaccctcatggtacttctag

SEQ ID NO: 118448 - DNA, 1209 bp, Artificial Sequence
  Description of Artificial Sequence: Synthetic coding sequence
atgatgggatcatggaaacattgtctcttctcagcgtccctgatctctgctctgatattcgtgttcgtgtacaatactgagctttgggagaacaaaaggtttttgcgggcagccctgtcaaatgctagtcttctggccgaggcctgccatcagatcttcgaagggaaggtgttctaccctaccgagaacgcattgaaaaccaccctggatgaagctacttgttacgagtatatggttcggtctcattacgtgaccgagactctgtcagaggaggaggctggatttccactggcgtatactgtgacaattcacaaagacttcggtacattcgaacgtctgttccgcgccatttatatgccacaaaatgtgtactgtgtgcacctcgaccagaaagccacggatgccttcaagggggccgtgaaacagctgttatcgtgttttccaaatgcattcttggcatctaaaaaagagtcagtggtgtacggaggcatctccaggctccaagccgacctcaattgtttggaggatcttgttgcttcggaggtgccatggaaatatgtgattaatacatgtggacaggacttccccctgaaaactaacagggagatcgtgcaatacctcaagggcttcaagggtaagaacatcactccaggggtactgcccccagatcacgcggtgggaaggactaaatatgttcatcaggaactcctgaatcacaagaatagctacgtcatcaagactacaaaactgaagactccccctccccatgacatggtcatttacttcggtaccgcctatgtggcacttacccgagattttgccaacttcgtgctgcaggaccagctggcacttgacctgctgtcatggagcaaagacacatacagcccagatgagcatttctgggtgaccttgaaccgtattccaggcgtccctggatccatgcctaatgcatcctggaccggcaacctccgggctatcaagtggagtgatatggaggacaggcacggcggttgtcacggccactatgtccatggcatttgtatctacggaaatggcgatctgaaatggctggtcaactcaccatccctttttgcgaataaatttgagctaaacacataccccctgaccgtagaatgtctggaactccgccatcgggaacggacgctcaatcagtccgaaacagccattcagccatcctggtacttctag

SEQ ID NO: 118449 - DNA, 1209 bp, Artificial Sequence
  Description of Artificial Sequence: Synthetic coding sequence
atgatggggagctggaagcactgtctgttttctgcatccctcatctccgcgctgatattcgtgtttgtctacaacaccgaactatgggagaacaaaagattccttagagccgccctgtccaatgcctcactgctggctgaggcctgtcaccagatcttcgaggggaaagttttttacccgacagagaacgcattaaaaaccacactcgatgaagctacctgttatgaatacatggtccggagccattatgtcactgaaacactgtcagaggaggaagcaggttttcccctggcgtataccgtcaccatccacaaggactttggaacctttgaaaggttgttcagggccatctacatgccgcaaaacgtttattgtgtccacctcgatcagaaagccactgacgcctttaaaggggccgtgaagcagctgctgtcatgctttcccaacgcatttctcgcatcaaaaaaagagtcagtggtttacggcgggatttcccgattgcaggctgaccttaattgcctggaggacctagttgcctccgaggtgccctggaagtatgtgattaacacttgcggccaggacttccctctcaagacaaacagggagattgtacagtatctcaaggggtttaaagggaaaaacattacccccggcgtgctccctcctgatcacgctgtcggccgcacaaaatatgtgcaccaagaactactcaaccacaagaactcctatgtcatcaaaactaccaagttgaaaacacctccaccacacgacatggtaatttatttcggaacagcttacgtagccttgacaagggatttcgccaatttcgttctccaagaccagctagccctggacttactgtcttggtccaaggatacctactcaccagacgagcatttctgggtgaccctcaacagaatcccgggagttcccggctcaatgcccaacgcctcatggacaggtaatttacgggcgattaagtggagtgatatggaggacagacacggggggtgccatggccattatgttcacggaatttgcatttatggcaacggagacctgaagtggctcgtaaatagcccaagcctgttcgccaataagttcgagcttaacacatatccccttaccgtggagtgcctggaactcaggcatcgggagcgcactctaaatcagagcgagactgccatccagccatcttggtatttttag

SEQ ID NO: 118450 - DNA, 1317 bp, Artificial Sequence
  Description of Artificial Sequence: Synthetic coding sequence
atggttcagtggaagcgcttatgtcagcttcactacttgtgggcactcgggtgctatatgctgttggcgacagtcgcgctgaaactctctttcagactgaagtgcgactctgaccatctcggcttagagagtcgagagtcccagtcccaatactgccgcaacattctgtacaacttccttaagttacccgcgaagaggtcaataaactgctccggggtgacacgtggcgaccaggaagctgtcctgcaagccatcctgaataatctagaggtgaagaagaagagagagccatttactgatactcactacttatctctcaccagagactgtgagcacttcaaggccgagcggaagtttatccaattcccactttctaaggaggaggtggagttcccgatcgcctactcgatggtgattcatgagaaaattgaaaactttgaaaggctcttgcgagctgtgtatgcgccgcagaacatctactgtgtccacgttgatgagaagtctccagagacctttaaagaggccgtgaaggccatcattagctgtttcccaaatgtattcattgcttccaaactcgtgcgagtggtgtatgcctcctggagcagggtccaggccgacttgaactgtatggaggacctgctgcagtcatccgttccatggaaatattttctgaatacctgcggcactgatttccctattaaatctaatgcagagatggttcaggcgttgaaaatgctgaatggaagaaacagcatggagagtgaggtcccaccgaagcataaggaaacccgttggaagtaccattttgaagtcgtacgggacacactgcatctgacaaataagaaaaaggacccacctccgtacaacctcactatgtttactggcaacgcttatatcgtggcttcaagagactttgtgcaacacgtgctgaaaaacccgaaaagccagcaattgatcgagtgggtgaaggacacatattcacctgatgagcacctctgggccacgctccagcgagccagatggatgcccgggtcagtacccaaccatccaaagtacgacattagcgacatgacttctatcgcacggctagtcaagtggcaggggcatgaaggggatattgacaaaggagcaccctatgcgccttgctctggtatccaccagcgggctatctgcgtgtatggcgcaggggacctcaactggatgttacagaatcatcatttgctggctaacaagttcgatccgaaggtagatgataatgccctccagtgcctggaggaatacctgagatataaagcaatctacggaaccgagctatag

SEQ ID NO: 118451 - DNA, 264 bp, Artificial Sequence
  Description of Artificial Sequence: Synthetic coding sequence
atggtgcaatggaaacggttatgccagctacattatttgtgggcactgggttgttacatgctcttagcaacagtggctctcaagctctcgtttcggttgaagtgtgactccgatcacctgggcctagaatcacgcgagtcacaatcccagtactgcagaaacatcctttataacttcctgaaactccctgcaaagcgcagtatcaattgcagcggagtgacacggggtgatcaggaagccgttctgcaagcaatcctgaattag

SEQ ID NO: 118452 - DNA, 462 bp, Artificial Sequence
  Description of Artificial Sequence: Synthetic coding sequence
atggtacagtggaaacggttatgccaactgcactatctgtgggccctgggttgctacatgttgctggccacagtcgcacttaagctgtccttccgcctcaagtgcgatagtgaccacttgggtctggagagcagagagagccaatcacagtattgtcgtaacatactttataatttcttgaaactcccagctaagcggtcaatcaattgctccggagtcactcgcggggatcaggaagcagtgctgcaggctattctgaataatttggaggtaaaaaagaaaagagagccttttaccgacactcactatctcagcctgacacgggattgtgagcacttcaaagcagaaaggaagtttattcagttcccactctcaaaagaggaggtagaattccccatagcctattcaatggtaatacatgaaaagattgagaacttcgagcgcctactgcgggcagtttag

SEQ ID NO: 118453 - DNA, 162 bp, Artificial Sequence
  Description of Artificial Sequence: Synthetic coding sequence
atggtgcaatggaaacgcctgtgtcagctgcattatctctgggccctaggttgctacatgctcttggctaccgtggcccttaaactgtccttcagactgaagtgtgattccgatcacctgggactggaatcccgggaatctcaatcccagtattgtcggtag

SEQ ID NO: 118454 - DNA, 1317 bp, Artificial Sequence
  Description of Artificial Sequence: Synthetic coding sequence
atggtgcagtggaagcggctctgccagctacattatctgtgggccctgggctgctacatgctccttgctacagtcgcactgaaattgtcattcagattaaagtgcgattcagaccacttgggtctcgagagcagggagtctcagtctcagtattgtcggaatatcttatacaactttctaaaactgcctgcgaagagatctatcaattgctctggtgtaactagaggcgaccaagaagctgtgctgcaggctattcttaacaacctggaagtgaagaagaagcgcgaaccattcaccgacactcattacctcagcctgactcgcgactgcgagcacttcaaggccgagaggaagttcatccagttccctctcagtaaggaggaagtggagttccccatcgcatactccatggttatccacgaaaaaattgaaaacttcgagcggcttctcagggcagtgtatgctcctcagaatatttattgcgtacatgtggacgaaaagtcacccgagaccttcaaagaagcagtgaaggcaattatcagttgttttcctaatgtgtttatcgcatccaaattagttcgcgtagtttacgccagttggtctcgcgtgcaagccgacctcaactgcatggaagaccttctgcagtccagcgtaccatggaagtatttcttaaatacttgtgggaccgatttcccaatcaagtcaaacgccgagatggtgcaggcactcaagatgctcaatgggaggaactccatggagtccgaggtgccgccaaagcataaggagaccagatggaaatatcactttgaagttgtcagagatacacttcacctgactaacaaaaagaaggaccctccaccctataacctgactatgttcacaggcaacgcctatattgtggcctcgcgggacttcgtccagcacgtcttaaagaatcctaagtcccagcagctaattgagtgggtaaaggatacttactctccggacgagcacctctgggctaccctgcagagggcaaggtggatgccgggctccgtgcctaaccatcccaagtacgacatttcagacatgacgagtattgctagactagtgaaatggcaggggcacgaaggagatattgataagggagctccctatgccccttgttctggcattcaccagcgcgccatttgcgtttatggggccggagacttgaactggatgctccagaaccatcatctgctggcaaacaagtttgatcctaaggtggacgataacgcattacagtgcctagaggaatacctacgctataaggccatttatggcaccgagttgtag

SEQ ID NO: 118455 - DNA, 1041 bp, Artificial Sequence
  Description of Artificial Sequence: Synthetic coding sequence
atggagagtactctgggcgccggtatcgtgattgccgaggccctgcagaaccagctggcgtggctggaaaatgtctggctttggatcaccttcctgggcgatccaaagatcctgttcctgttctattttcctgccgcctactacgcaagcagacgcgttgggatcgctgtgctctggatcagtcttatcactgagtggttaaacctgatcttcaaatggtttctgttcggagataggcccttttggtgggtacacgaatccggatactattctcaagccccggcgcaggttcaccagttccccagttcctgtgaaacagggcctggctcaccatctggacattgtatgattacaggggccgctctttggcccatcatgacggctttatcaagccaggtagccaccagggccagatctaggtgggtgcgggtgatgccttctctggcctactgcacgttcctcctcgctgtgggcttaagtcggatcttcatccttgcccactttcctcatcaggtgttggcaggcctgattactggggctgtgctaggctggctcatgaccccccgagtccccatggaaagagagctctcgttttacggattgaccgcactggcgttaatgctgggtacctccctgatctactggacattattcaccctcggccttgatctgtcctggagcatcagcttggcctttaagtggtgcgaacggcctgaatggatacacgtggactcaaggccattcgcaagccttagccgagatagcggcgcagctcttgggttggggatagctcttcacagcccctgctatgcgcaggtgcggcgggctcagctgggcaatggccagaaaattgcttgcctagtgctcgccatgggactgctcggccctctggactggctggggcaccctccacaaatttcactgttttacatcttcaacttcctgaagtacacattatggccatgtttggtgctcgccctggtgccatgggcggtacacatgttcagtgctcaggaggcaccgcctattcacagtagctag

SEQ ID NO: 118456 - DNA, 465 bp, Artificial Sequence
  Description of Artificial Sequence: Synthetic coding sequence
atggactttctccacaggaatggcgttctgattatccaacacctgcagaaagactacagagcatattacaccttcctcaatttcatgagcaatgtgggagatcccaggaacatcttctttatctacttcccgctctgttttcagtttaatcagaccgttgggacaaaaatgatctgggtggcagttatcggggattggctgaatttaatttttaaatggatcctcttcgggcataggccttactggtgggtgcaagaaacacagatttatcccaatcacagcagcccatgtctggaacagttcccgaccacctgcgagactgggcccggctctccatctgggcatgccatgggcgcatcctgcgtttggtacgttatggtcacagctgcgctgtcccataccgtttgcggcatggacaaattctccataaccttgcaccgtcacgcaggcggtcgggggctttag

SEQ ID NO: 118457 - DNA, 1068 bp, Artificial Sequence
  Description of Artificial Sequence: Synthetic coding sequence
atggatttccttcaccgcaatggagtgctaatcatccagcacttgcaaaaagattaccgggcttactacacgttccttaactttatgtccaatgtgggtgaccctcgcaacatctttttcatctacttccccctgtgctttcaattcaatcagacagttggaacaaagatgatttgggtcgcggtgatcggagactggttaaatctcatctttaagtggatcctctttgggcatcgtccatactggtgggttcaggagacccagatctaccccaatcatagttctccctgtctcgagcaatttccgacgacgtgcgagactgggcctggatccccatccggccatgctatgggggcgagctgcgtctggtacgtgatggttaccgccgccttatctcatactgtatgtggaatggacaagtttagtatcacactgcacaggctgacttggtcgtttttgtggagtgtgttttggcttattcaaatctcggtctgcatatctcgggtatttatcgctacacactttcctcaccaggtcatcctgggtgtcatcggcggcatgctggttgcggaggcctttgaacacacaccaggaattcagactgcatccttaggaacctacttaaagacaaacctctttctgttcttgttcgctgtcggcttctaccttctactgcgcgtcctaaatatcgatctgctgtggtccgtcccgatcgccaaaaagtggtgtgccaaccctgattggatacatattgacacaactccattcgctggactggttagaaacttgggagtcctgtttgggctcggattcgcaatcaattccgaaatgttcctgctatcctgtcgcggagggaacaactataccctcagcttcaggctgctttgtgccctgacgtctttgaccatcctgcagctttatcatttcctccagatccccacccacgaggagcatctcttctacgtgctgtctttttgtaaaagtgctagcatccccctgacagttgtcgccttcatcccttattccgttcacatgctgatgaaacagagcggcaaaaagagccaatag

SEQ ID NO: 118458 - DNA, 1677 bp, Artificial Sequence
  Description of Artificial Sequence: Synthetic coding sequence
atggcagctctcacaagggatcctcaatttcagaaactgcagcagtggtaccgcgagcaccggagtgagcttaacttgagacgactgttcgacgcaaataaggatcgtttcaaccatttctcgctgaccctgaatactaaccatggccacatcctggtggactatagcaaaaacctagttactgaagatgtgatgagaatgctcgtggacctggcaaaaagccgcggggtggaggctgcccgggagcggatgtttaatggcgagaagatcaactacactgaaggaagggctgttcttcatgtcgccttgaggaatcggagcaacacccccattttagttgatggcaaagacgtcatgccagaagtgaataaagttctggataagatgaaaagtttctgtcagcgggtgcgatctggcgactggaaggggtacactggcaaaaccataacagatgtaatcaatatcggaattggcggctcagacctcggacctcttatggtaacagaagctttgaagccttattccagtggtggaccaagggtgtggtatgtatcaaatatcgatgggacccatattgctaagactctcgctcagttgaacccagagagctccctgttcatcatcgcgtctaaaacgtttaccactcaggagaccatcacgaatgcagagacagctaaagagtggttcctccaggctgcgaaggacccatctgccgtagccaagcatttcgtggccttgagtaccaacacaacaaaagtcaaggagtttggaatcgatccgcagaatatgtttgagttctgggattgggtaggcggaaggtattccctctggtctgcgataggcctttcaatagcactgcacgtgggcttcgacaatttcgaacagctgctgagtggcgcccactggatggatcagcactttcgaaccactccccttgaaaagaatgccccggtcctgctcgccctcctagggatctggtacataaactgttttggctgcgagactcacgcgatgctcccatatgatcaatacctgcatagatttgctgcttattttcagcaaggagacatggagtccaacggaaagtacattaccaagagtgggactagggtggaccaccaaaccggcccaattgtatggggagagcccggaacaaacggacaacacgctttctatcagctgatccatcagggaaccaaaatgatcccctgtgactttttgattcccgtgcagacacaacatccgattcgaaagggcctgcatcataaaatactcttggcaaacttcctggcccagactgaagccctcatgcggggcaagtccactgaggaggcacgtaaagaactgcaggcagcagggaaatcccccgaggatctcgaaaggttgctgccccacaaagtttttgaagggaacaggcccaccaatagcatcgtgtttactaagttaactccttttatgctgggcgccttggtcgcaatgtacgaacataagatttttgtacaggggatcatttgggatattaacagtttcgaccaatggggagtggagctgggtaagcaacttgccaaaaagattgaaccagagctcgacggttccgcccaggttaccagtcatgacgcaagcactaatggcctgattaatttcattaagcagcagcgcgaggcccgggtgcagtag

SEQ ID NO: 118459 - DNA, 1563 bp, Artificial Sequence
  Description of Artificial Sequence: Synthetic coding sequence
tctcgacacggtagatcccaccccggaccccctgtgccggaagcggccgctatggtgccacgggcccccctgcgggctgaacctgcgccgcccttgcgctgtcagcagggcccactgcagcccctgcaggttcgtgccggcagacggcgaggacttcccagggcagcccccggaaccgggcacgctggcctcggctctggaggagggggtagtggagcaagggggcctcagtctcctacttccagaccgagaacgggagcccaggcagaaagcgctctcaggccatggtcattgcttggtgtccggtcctggggtctggctgctagcccaggcgtatccgccccgggtctgctgcgatacgaggagaagagggctccgccatggggccattttcccagcagcagcccttgctcctcaggtcacctcagccgcggaagtttccgctcgtgtgaggagcgtccttggctcactcagcaggccgggaagggttgcccattcccctctgcccctggccatatgtccctcggcgcttccgctggccgagcggcaagagccggcgtttttgagggggcagggtggaaagacggtgatgtgggccgagattcttgcaggcggcacctctgtacaaccggcaagtgggagggagtgttcgagcagataatgggtggctcagctgctaagggagcattgattaccgacactggcggaggtggtggcggggagcgcctatggttgcgcgcacgcagacctgatgggcacccatgccatctcgacgggtgcctttctaacttgcggcaaaaagtcgaggctctcgggagaggaggcccaccactccagtcgggactcctcatacagggtctccccgcatccacggtatgcgaggatggctttttcctgtgggctgccgttgcagaccatccaggtggcccggccggcgatagacaccatcactgcgccggttggccgagacctctgtggggcgttggccagggggggtgctttttctgggagcagctccttctaagggcttggcttccagcccgggagacgagagtgtggagtgctgcatctccgtctttttgcagtttgaccttgaatacaaaccacgggcacatccttgtggattatagcaagaacttggttactgaggacgtgatgagaatgctggtagatctggccaagtcccggggggtggaggccgcacgcgaacgcatgttcaacggcgaaaagatcaattatactgaggttagtcggcctcatataccttccggtgcctcgttcctgccattcggtgtttacttgaccgtaagcaggattactctttgcttgcaccccttcagctgggcaatgctgttgcttaacgagggacctgagggactgttccctccagcttgttcacgagccctgggatgcgcctttcacaagatcggtctagtaagttccctcgagtggtttcccgtgagtgcctgggaggaacacatctcatacccgcagggtgaatttttgaaggccgacatcttcctcgaaaagctcactctgatatacccccagtgtaagttttag

SEQ ID NO: 118460 - DNA, 1710 bp, Artificial Sequence
  Description of Artificial Sequence: Synthetic coding sequence
atggtggccttatgttctttgcaacaccttggatcatcagatcctagggccctacccacattacctactgccaccagtggccagcgacccgctaaaagaaggagaaagagcccggccatggccgctcttacccgcgatccacagttccaaaagcttcagcagtggtatcgtgagcacagatcagagctgaacctgagacgcttatttgatgcgaataaggacagattcaatcacttctccttaacacttaacaccaaccatggccacatcctagtggattatagcaagaacctcgtaaccgaggatgttatgaggatgcttgtcgacctcgctaagagtagaggtgtggaggctgctcgcgaacggatgttcaacggcgaaaagattaactatacggaagggagggctgtactgcacgtcgcacttaggaacagaagtaatactccgatcctggtggatggtaaggatgttatgcctgaggtcaataaggtgctggataagatgaaatctttctgtcagggacccctgatggttacagaggccctaaagccttattcctctggcggcccgagggtgtggtacgtgagcaatatcgacgggacgcacatcgctaaaacgctggcacaactcaacccggagagttctctgttcataatagcatctaagacatttacaacacaagagacaataaccaacgccgaaactgcaaaggaatggttcttgcaggcagcaaaagaccccagcgcggtggccaaacatttcgtggccttaagcaccaacacaacgaaggtcaaggaattcggcatcgaccctcagaatatgtttgaattctgggattgggtgggtggtcgctatagcctttggtctgccatcggcctgtccattgccctgcacgtcggcttcgacaacttcgaacagctcctgtcaggcgctcattggatggaccagcactttcggacaacccctctggagaagaatgccccagttcttctcgctctgctcggaatttggtacattaactgtttcggatgcgaaacccacgccatgctcccctatgatcagtacctacatcggtttgccgcctatttccagcagggtgacatggagagtaacgggaagtacatcaccaaatccggcacccgcgttgaccatcaaaccggccctattgtgtggggggaaccagggacaaacggacagcatgccttttatcagctaatccatcaggggacaaaaatgatcccttgcgattttctcatccccgttcagactcagcaccccatccggaaaggcctgcaccacaagattctcctcgcgaattttctggcccaaaccgaggccttaatgagggggaaatctacagaggaggctaggaaggaactgcaagctgccggaaaatctccagaggatcttgagcgactacttccccataaggtcttcgaaggaaatagacctaccaactccattgtgttcacgaagctgacgccgttcatgctgggcgcactagtcgctatgtatgaacacaaaatcttcgtgcagggtataatttgggacataaatagtttcgatcagtggggcgtggaattgggaaaacagcttgccaagaaaattgaaccggaattggacggatctgcccaggtcacatcacacgacgcatcgacaaatggccttattaacttcatcaagcagcagagggaagctcgagtccagtag

SEQ ID NO: 118461 - DNA, 2901 bp, Artificial Sequence
  Description of Artificial Sequence: Synthetic coding sequence
atggccgcggtggccgctgtcgccgcccgcagacgcagaagctgggcctccctggtcctggcctttctgggcgtgtgtcttgggattactctggctgtcgacagatcgaacttcaaaacatgcgaggaatcttctttttgcaagaggcagcgctcaatccgccccggactgtctccttatcgcgccctgttggactcactccagctgggtcccgactcactcactgtgcatcttattcacgaggttacaaaagtgctgctggtgctggagctgcaaggcttgcagaagaatatgacacgcttccgcatcgatgaattggagccacgacgacctcgatatagggtgccggacgttttggtcgccgaccctccaatcgctaggctatccgtctctggacgagatgaaaactccgtggaactgacaatggctgagggaccatataaaatcattctcacagcccgacccttcagactcgacctactcgaggataggtccctgctcctgtcagttaatgcccgcggcttgctcgaattcgagcaccaaagagcaccgagagtgtctttcagtgataaggtaaatctgaccttggggtcaatctgggacaaaatcaagaatctgtttagcagacaggggagtaaagaccccgcagagggggacggggcccagcctgaggaaacacctcgggatggagataaaccagaggagactcagggaaaagccgagaaggacgagcccggcgcatgggaggaaacattcaaaacacactccgacagcaaaccatacggcccgatgtcggtgggactcgatttctctctcccgggaatggaacacgtgtatgggatcccagaacacgccgataacctgagattaaaagtgacagaaggcggggaaccctaccgtctttataatctagacgtgttccagtacgaactctataaccctatggcactgtacggatctgtgccggttctgctcgctcacaacccccaccgggatctcggtattttttggctcaatgccgcagagacttgggtggacatctcttccaatactgccgggaagaccctgtttgggaagatgatggactatctgcaaggatccggagagactccccagacagacgtccggtggatgagcgagactgggattatagacgtctttctgctgctggggccgtcaattagcgatgtcttcagacagtacgctagcctgaccgggacccaggccctgcctcccctttttagccttggctaccatcagtcaaggtggaattatcgggacgaggcagatgtgctggaggtggatcagggatttgatgatcataatctcccatgcgatgtcatatggctcgacattgaacacgccgacgggaagagatacttcacatgggatccaagccggttcccacagccaaggacaatgttggagagacttgccagcaaaagaagaaagctggtcgctatcgttgacccacatattaaggtggactccgggtaccgcgttcatgaagaacttaggaatctcggtttgtacgttaagaccagagatgggagcgattatgaaggctggtgttggcctggatcagcgggctacccagatttcaccaaccctacaatgagagcctggtgggccaatatgtttagctatgacaattatgagggttcagctcccaatttgtttgtatggaatgatatgaacgagcccagcgtgttcaatggaccggaggttaccatgctgaaggatgcgcagcattacggcggctgggagcatcgagatgtgcataatatctacggcctctatgtgcatatggccacagcagatggattgcggcagcgcagcggagggatggaaaggccttttgttctggctcgggcgttttttgcaggctcccagcgctttggcgcagtttggacaggggataatactgcagagtgggaccatttgaagatctccatccccatgtgcctaagtctgggccttgtcggactgtccttttgtggcgcggacgtggggggattttttaaaaatccggaaccagagctcctcgtgcggtggtaccagatgggagcttaccagccatttttcagagcacacgcgcatctcgacactggccgacgagagccctggctgctaccgagccagcacaatgacattatcagagacgccctagggcagcggtatagcctcctgcctttttggtataccttgctctatcaggcccatagggaaggcatccccgtcatgcgccctctgtgggtgcagtaccctcaagacgtgacgacgttcaacattgatgaccagtatctgttgggcgacgcccttctggtgcaccccgtctcagactcaggagcccacggggtacaggtctatctgcctggacagggcgaagtgtggtatgacatccaatcatatcaaaagcaccacgggccacagacactctatctccccgtgactctaagtagtatcccagtctttcagcgaggaggaaccattgtcccaagatggatgagagtgcggaggagcagcgaatgtatgaaggatgatcccatcacgttattcgtagcactctcccctcaaggaactgctcagggggaactgttcttggacgacggtcataccttcaactatcaaactcgccaggagtttctcttacggaggttttcattctccgggaataccctcgttagtagctccgccgatccagaaggccatttcgaaacccctatctggattgaacgtgttgtgattatcggggccggtaaacctgctgccgtggtgctccagactaaaggcagcccggaatcacgcctgagcttccagcatgatccagaaactagcgtgctcgtgcttcggaaacccggaatcaatgtcgctagtgattggagtattcacctgcgttag

SEQ ID NO: 118462 - DNA, 2835 bp, Artificial Sequence
  Description of Artificial Sequence: Synthetic coding sequence
atggccgccgtagccgctgtggccgctcgtcggagaaggagctgggcctccctagtgttggccttcctgggcgtgtgtctgggtatcaccctggcggtcgaccggtccaatttcaagacctgtgaggagtcctcattttgtaaacgacaacgatccattcgtccaggtctgtccccgtacagggcccttctcgatagcctgcagttgggtccggattctcttaccgtgcaccttatccacgaggtgactaaagtgctcctcgtgctcgagcttcagggcctacagaagaacatgacacgcttccgcatcgatgagctggaaccccggagacctcgctatcgagttccggacgtgctagtcgccgaccctcccatcgcccgactctcagtgagtggccgggatgagaatagtgtcgagctcactatggctgagggaccttacaagatcattcttactgcacgaccctttagactggacctcttagaagatagaagcctgctgcttagtgtgaatgcgcgcggattgctggagtttgagcaccagcgggcgcccagggttagccagggctcaaaagaccccgctgagggagacggcgcgcagccggaggaaacacctcgcgacggtgacaaaccagaggagacacaggggaaagccgaaaaagacgaaccaggagcttgggaagaaacattcaagacccattccgactcaaaaccatacggccccatgtcagtcggactggactttagcttgcctggcatggagcacgtgtatgggattccggaacacgcagacaacctcagactcaaggtgaccgaaggaggggagccgtaccgcctctacaatttagacgtatttcaatacgaactgtacaacccgatggctttatacgggagcgttcctgttctgctcgcccacaatcctcaccgtgacctggggatcttctggttgaacgcggccgagacatgggtggatatcagctccaacacggcgggaaaaaccctctttggcaagatgatggactacctgcaaggctctggagagactccacagaccgatgtgcgttggatgagcgagacgggaatcatcgacgtgttcttgttgttaggcccttcaatatcagacgtgtttaggcagtacgcgtctcttacaggaacacaggctctccccccattgttttccctcgggtaccaccagagccggtggaactatagagatgaggcagatgtgctcgaagtcgaccaggggttcgatgaccacaacctgccatgcgatgtaatatggctggatatcgaacacgctgacggcaagcgctacttcacttgggacccttccaggtttccccaaccgaggaccatgcttgaaaggctggcctcaaaaagacgcaagttagtggccatcgttgatccccatattaaagtcgatagtgggtacagggtgcacgaggaattgaggaacctgggactgtacgttaaaacgagggacggaagtgattacgaggggtggtgctggccaggatccgccggatatcctgatttcacaaaccccactatgcgggcctggtgggctaacatgtttagctacgacaactatgaaggctctgctcccaatttgttcgtctggaatgatatgaatgaaccgtcggtgtttaacgggccagaagtcactatgctaaaagacgctcaacactacggagggtgggagcaccgggacgtacataacatatatggcctctatgtccacatggcgacagccgacggtttaagacagagatctggggggatggaacgacctttcgttctggccagagccttcttcgccggatcacaacggtttggagctgtctggacaggagataacaccgcagagtgggatcacctgaagatcagtatcccaatgtgtctttcactcggcctggttgggttgtcattctgcggtgccgatgtagggggcttcttcaagaatcccgagcccgagctgcttgtccgatggtatcaaatgggcgcgtaccaaccctttttcagagctcatgcgcatctggataccggccggcgcgagccttggctgctccctagtcaacacaacgatataattcgggacgctttgggacagaggtacagcctgctccccttttggtataccttgctctaccaggcacaccgcgagggcatccctgtgatgcggccactctgggtgcaatacccccaggatgtgacaacctttaacatcgatgaccagtatctccttggggacgccctgctggttcaccccgtcagcgacagcggggcacatggggtgcaggtttatctgcccgggcagggagaggtttggtacgatatacaaagctatcagaagcatcacggtccacagaccctatacctgcccgtcacattgtcgagtattcccgtctttcagcgcggaggaactatcgttccgcggtggatgagggtgagacgcagcagcgaatgtatgaaagatgaccccataactctgttcgtggctttatctccccaagggactgcacagggagagctatttctggacgatggacacacattcaactaccagaccaggcaggagttcttgttgcggcggtttagcttctccggaaataccttggttagctcgtccgcagatcctgagggacattttgagactccaatctggatcgagcgcgttgtgatcattggcgcgggaaagcccgccgctgtggtgttacagacaaagggctccccagaatcaagactcagcttccaacatgaccccgaaacatcggtgcttgtgctgagaaaacctgggataaacgtcgcttcagactggtctatccatcttcggtag

SEQ ID NO: 118463 - DNA, 2544 bp, Artificial Sequence
  Description of Artificial Sequence: Synthetic coding sequence
atgacccgctttaggatcgatgaactcgaaccacgccggccccgctatcgcgttccggacgttctcgttgcagacccacctattgccagactgagtgtgtcaggccgagacgagaacagcgtggaacttacaatggcggagggaccctacaaaatcatactgactgccaggccattccggctggatcttttggaagaccggagtctgttactctcagtgaacgcaagagggctgctggagtttgaacatcaaagagccccgcgtgtaagccagggttccaaggacccagccgagggggatggcgctcaacctgaggagactccacgggatggggacaagccagaggagacccagggaaaggcagaaaaagatgaacccggagcctgggaggagaccttcaagacgcactctgactccaaaccttacggtcccatgagcgtgggcctcgattttagcttgccgggcatggagcatgtgtatggcattccagaacatgccgacaatctcagactcaaagtcacagaaggcggcgagccctatagactgtacaatttggatgtcttccaatacgagctatataatcctatggctctgtacggctccgtgcctgtactgctggctcacaatccacaccgggatctcggcatcttctggcttaatgccgccgaaacctgggtggacatctccagcaacacagccggcaaaactctctttgggaaaatgatggactatctccaggggagtggcgagacacctcagaccgatgtacggtggatgtctgagaccggcatcattgacgttttcctcctccttggcccatctatcagtgacgtgttccgacagtatgcatcgctgactggcacacaggccctccctcccctgtttagtctggggtaccaccagagccgatggaactacagagacgaagcagacgttctggaagtcgaccaggggtttgacgaccacaacctcccttgcgatgttatttggcttgatattgagcatgcggacggaaagcggtacttcacctgggatccttcccgatttccacagccacggacaatgttagagagactggcctcaaaacgccgaaagttggtggctattgttgatccccatatcaaggtggatagcggatatcgagtccacgaagaactcaggaacctgggcctctacgttaaaacacgagatggcagtgactacgagggctggtgctggccgggtagcgctggctacccagattttacaaatcccactatgcgtgcttggtgggcgaatatgttctcttatgataactatgagggatctgcccctaatctatttgtgtggaacgatatgaacgagccttctgtcttcaacggccccgaggtgacgatgttaaaggacgctcaacactatggcggatgggaacaccgtgacgtgcataacatctacggattgtacgtgcacatggccactgccgacggcctgcggcaacggagcggcggaatggagcgcccattcgtcctggcacgtgccttttttgcaggcagccagagatttggcgctgtgtggaccggcgacaataccgcagagtgggatcacctgaagatatcaataccaatgtgtctatccttgggcctggtcggtctttccttttgcggtgctgacgttggggggtttttcaagaatcctgaaccagagctactggtcagatggtaccagatgggtgcttaccagcctttctttagggcccatgcccacttagacacggggcggcgggagccatggcttctcccgagccagcataacgacatcattcgtgacgccctaggacaaagatattccctgcttccattttggtataccctgttgtatcaagctcatcgcgaaggaatcccagttatgaggccactttgggtgcagtaccctcaagatgtgacaactttcaacatcgatgatcaatacctgctgggggacgctttactggtgcaccccgtgtccgattccggggcacacggcgtccaggtgtacttaccaggtcagggcgaggtctggtatgacatccagtcctaccaaaaacaccatgggccgcagactctgtacctacccgtaactctgtcctccatccctgtgttccagagaggcggcacaatcgtaccaagatggatgagggtcaggcgtagctctgagtgtatgaaggatgacccgatcaccctgtttgttgcactgtccccacagggtaccgctcaaggggagttgttcctggatgacggccacaccttcaactaccagactcgccaggaattcctgctgcgtagatttagcttctccggaaacacattggtgtcgtcctctgccgaccccgaggggcatttcgaaacccctatttggattgaacgcgtggtgatcatcggcgccggtaaaccagccgctgtggtcctgcagactaagggttcaccggaatctcggctgtcctttcagcacgaccctgaaactagtgtgttggtcctacgaaagcctggtattaatgtggcgtctgactggtcgatacacctgcgctag

SEQ ID NO: 118464 - DNA, 2745 bp, Artificial Sequence
  Description of Artificial Sequence: Synthetic coding sequence
atggaggctgccgtgaaggaggagatctccctggaagatgaggcagtggataaaaacatctttcgggattgcaataagattgctttctaccgtcggcagaagcagtggctgtctaagaagagcacctatcaagcactgctcgattcagtaacaacagatgaggacagtactagatttcagatcatcaatgaggcctcaaaggtgcccctgctcgcagaaatttacgggatcgagggaaatatattcaggctcaagatcaatgaggagactcctcttaagcctcgtttcgaggtacccgatgtgctcacttccaaaccatctactgtgcgacttatctcttgttccggagacaccggctccctaatcctcgccgatgggaagggggacttgaagtgccatataacagcaaaccccttcaaagtggacctcgtgtccgaggaagaggttgtgatatctattaattccctgggccagctgtactttgagcatttacagatcttacacaagcaaagagcggcaaaagagaacgaggaggagaccagcgttgacacatcgcaggagaaccaggaagatctcggattgtgggaagaaaaattcggtaagttcgttgatatcaaagccaacggcccgagttccatcgggctcgatttctcattacatggctttgagcacttgtatgggataccacagcatgctgaaagccaccagttaaagaataccggcgatggcgacgcatataggctgtacaatttggacgtttacggctatcagatttacgataaaatggggatctacggaagtgtaccttacctgttagcacacaagctgggcaggacaatcggaattttctggctgaacgcatctgagacattggtagagattaatactgaacccgctgtagaatacacacttacgcagatgggtcccgttgccgcaaagcagaaggtgaggagtcggacgcatgtgcactggatgtctgaaagcgggatcattgatgtatttcttctgaccggacccaccccatccgatgttttcaagcagtatagccacctgaccggcacccaggccatgccacctctgttcagcctgggataccaccagtgccggtggaactacgaagatgaacaagacgtgaaggccgtagacgcaggattcgatgaacacgacataccctacgatgccatgtggctggacatcgagcacactgagggcaagcgctacttcacctgggataagaacagatttcctaatccgaaacgcatgcaggaattgctgcggtctaagaaacggaagcttgtggtgatatctgatccccatataaaaattgatccagactatagcgtatatgtaaaggcgaaggaccaggggtttttcgttaagaaccaagaaggcgaggatttcgagggcgtttgttggccgggactatcctcatatctggattttaccaatcctaaggtacgcgaatggtattcttctcttttcgcattccctgtgtatcagggatctaccgacattctgttcctgtggaatgacatgaatgagcccagcgtcttcaggggccccgaacaaaccatgcaaaaaaatgctattcaccacgggaactgggagcacagagagctgcataatatctatggcttttaccatcagatggctaccgctgaggggctgatcaagcgaagcaaaggaaaagaacgcccatttgtactcacgcggagcttcttcgccggctcccagaaatatggggcagtatggaccggcgataacactgccgagtggagtaacttgaagatctctatacccatgcttctcacactgtctatcacaggaatcagtttctgtggggccgatatcggcgggtttattggcaatcccgagaccgaactgctcgtaaggtggtatcaggcaggagcatatcagccattctttcggggacatgccacaatgaacactaagcggagagagccgtggctgtttggcgaagagcacactaggcttatacgggaagccattcgcgagaggtatggtctgctgccttattggtacagcttgttttaccacgctcatgttgcttctcaacccgtaatgagacccctttgggtggaatttcccgacgagctgaaaactttcgacatggaggatgaatacatgctggggtccgcattgttagtccaccccgtgactgaaccaaaggccaccacagtagacgtctttctgccaggctctaacgaagtgtggtacgattataaaaccttcgctcactgggaaggagggtgcacggtcaagattcctgtcgccctggacactatcccagtgttccagagaggaggcagcgtcatacctatcaagacgaccgtcgggaaatcaacaggctggatgaccgagtcttcttatggacttagagtcgcactgagcacgaagggttcttcagtcggagaactttatctggacgatggccactctttccagtatctgcatcagaaacagttccttcaccgcaaattttcattctgctccagcgtgttaataaacagctttgccgaccagcggggacactatccttccaagtgcgtggtggagaagattctggtactggggtttagaaaagaaccttcctctgtgactactcactcgagcgacggaaaagaccagccagtggcatttacgtattgcgctaaaacctccattctatctctcgagaaattgagcctgaatatcgccaccgattgggaagtgcgtattatttag

SEQ ID NO: 118465 - DNA, 849 bp, Artificial Sequence
  Description of Artificial Sequence: Synthetic coding sequence
atggaggctgcggttaaggaggagattagtctggaagacgaagcagtggacaagaacatcttccgagactgcaacaaaattgcattctacaggcggcaaaagcagtggctctcaaaaaagtccacctaccaggcactgctggatagcgtcacgaccgatgaggactcgactagatttcagattattaacgaagctagtaaggtgaggtgtcaggatcaatccccgaccacattagatgccttcaaaggcaaagagaccacagtccaggaagaaacacaggatctgagcactcgtcaacacctagcgcaaaaggaagcggaagagcctgataagcagggccagataacctgggacatcagcaacgttgcgcctaagactgaaaacttcgaagacctacttgaacagaccccctgctccgcctgcttacaaggatttactagggacaatacgtcaagctcgttttctgaggatgcaggaatttcattaagcacctccgtcaagctgcccttagcctcatctagcaagccaaatgagaacgaagctcttcctaatcagcctccaagccagcaaatcagacacaactatcggcttctcgctagcacggtttccgccgaaatggcaagaaataggcagcttatatgggagctggcccgccagtccgaggcccatctggaccggcccgttgtgctgggagagcaggccagtgctcaaagagaggttgcttctatattatgccgcaagagtgtcctggccattaaccagctcgccgcaaccgtagagggcacaatcagcgttctgcaacagttcaatgaactgttggaccatcctttagatcctgggcgtagctag

SEQ ID NO: 118466 - DNA, 1230 bp, Artificial Sequence
  Description of Artificial Sequence: Synthetic coding sequence
atgcggcgatacctgcgcgttgttgttctgtgtgtcgcatgcgggttctgttccctcctctacgccttcagtcagctcgcagtcagcctggaggagggaaccggaggggggggagggaaaccgcaggccgccgtggccagctggctcgctggaggaggtcgcggtgctgtgcgcggcgccggtgtagcgggtcctgccgcccatccaggggtgagtgaccgttacagtctcaagattcaacctgtcgagaaaatgcatttggccgtggtggcctgtggggaacgcctcgaggaaacaatgacaatgctgaaatctgcaattatattctctatcaagccccttcaatttcacatcttcgccgaggatcagctgcaccactcctttaaaggcaggctcgacaattggagcttcctgcagacatttaactatactctttatcctattaccttcccatccgagaacgctgccgagtggaagaagctgtttaaaccttgcgcaagccagaggttattcctccctctcatcctgaaagaagtcgactcactcttatacgtggataccgatatcctattcttgaggcccgttgatgacatctggagcctgttaaagaagttcaatagtactcagattgcagcaatggctcctgaacacgaggaaccacgcatcggttggtacaatagattcgcaagacatccttattatgggaaaacaggagtgaattcaggtgtgatgctgatgaatatgaccagaatgcgccggaagtacttcaagaatgacatgaccaccgttcgtctgcagtggggtgacattctgatgcccttactgaagaagtacaagttaaatattacgtggggcgaccaagacctgctgaacattgtgttttttcataatcccgaatccctgtttgtgtttccatgccagtggaattacaggccagaccattgtatctacgggtcgaattgccaagaagcggaggaaggcggcatatttatcctacacggcaatcgtggggtctaccatgacgataaacagcccgcgttcagggctgtctatgaggctctgaggaactgcagttttgaagacgacaacatacggagtctcctgaagccactggagcttgagctccaaaagacggtgcatacttattgcggaaaaatctacaagatatttattaaacagctggcgaagtctgtgagagataggtacgcccgtagtcccaaagagaaatag

SEQ ID NO: 118467 - DNA, 1323 bp, Artificial Sequence
  Description of Artificial Sequence: Synthetic coding sequence
atgagaagatacttacgagtcgtcgttctgtgcgttgcatgcggcttctgttccctgctttatgcattctcccaactggctgtgtccctcgaagaaggaactggaggcggcggtgggaagccccaggctgctgtggccagctggcttgcgggtggcggaaggggcgcagtgcgaggcgccggcgtggccggacccgccgcccaccctggtgtctctgatcggtgcaaagacttcagtctttgttactggaacccttattggatgctcccatccgatgtctgcggcatgaattgtttttgggaggctgcatttcgctacagcctgaagattcaaccggtagagaagatgcatcttgccgtcgtggcctgcggtgaacgacttgaggaaaccatgacaatgctgaaaagcgccatcattttctccatcaagcccctgcagtttcacatctttgccgaagaccaattgcaccattccttcaagggaagattggataattggtcattcttacagacctttaattacactctttaccccataactttcccctctgaaaatgcagctgaatggaagaagttattcaagccctgcgcctcccagcgcctctttctgccgctgattctgaaagaagtggatagcttgctgtacgtggataccgacatcctcttccttcgcccagtagatgacatctggtcactcctcaagaaatttaactcaacccaaattgccgctatggccccagagcatgaagaacccagaatcggctggtacaaccgttttgctcgtcacccttactatggcaaaacaggtgtgaattccggggttatgcttatgaacatgacacgaatgcggaggaaatatttcaaaaatgatatgacaaccgtcaggctgcagtggggagacattctgatgcctctccttaaaaaatacaaattaaacattacctggggggatcaggatttgctcaacatagtgttttttcacaacccggagtctttgtttgttttcccctgccagtggaattatcgtccagaccactgcatttacgggtcgaattgtcaagaagcagaagagggcggcatctttatcctacacgggaatcggggagtctaccatgacgacaagcaacccgcctttagagccgtgtatgaagctcttcgcaattgtagcttcgaggatgataacatccgttccttattaaaaccattagaactggagcttcagaaaaccgtgcacacgtattgcggcaagatatacaagatctttatcaaacagctcgccaagtccgtacgggataggtacgccagaagtccaaaggagaagtag

SEQ ID NO: 118468 - DNA, 1332 bp, Artificial Sequence
  Description of Artificial Sequence: Synthetic coding sequence
atgaaattacgatccaaggctgctgccctgctgctgctcgctcttgcagcccttttgttggcactgctgagtctgcgggcaggcagggccgaaccgcccgccctgccagctcgccccgctagcgctccccagcggcacccagcaccggttcccgcccgatggcccgggccaggggccctcccaggtgcctcaccaggggtccgcaggagacgaccaccgaggccaagacccagagcaggccgacgtggcgccgcccggctggaaaagctggcccggaggcccggcgaaccccggtcatttcaggcagtactccctcctgaactctggattcatctcgcagtagtagcttgtggcaacaggctcgaggagacgctggtcatgctaaagtccgcagttctgttttctcatcgcaaaatacaatttcatattttcactgaggactctttgaagcccgagttcgataagcagttacggcagtggccagatagttatacaaagaaattcgagcacaggatctaccctattacattctctgttggcaacccacaagagtggaagaaactgttcaagccctgcgcggcacagcgacttttcctccctgttattctcaaagacgtggacagcttactgtacgtggatactgatgttctgtttcttcgacctgtggatgatatttggaaactgctgcgcctgtttaacagcacccagttggccgcaatggcccctgaacatgaaattccaaaaataggatggtactcccgctttgcccgccatccattctatggctccgctggggtgaattcaggggtgatgctcatgaacttaacaagaatcagatcaacccagtttaagaacagcatgatccccacgggactggcctgggaagatatgttataccccctgtaccagaagtacaaaaacgcgataacgtggggcgatcaggacctgcttaatattattttctatttcaatcctgagtgcctgtatgtcttcccatgtcagtggaattacagacccgatcattgcatgtacggatcgaactgtcgggaggccgagcatgagggtgtctccgtgctgcacggcaaccgtggcgtttaccatgatgacaagcagccaaccttccgcgccctgtatgaggcaatccgggactttccatttcaggacaatcttttccagagcatgtactaccccctccagctcaagttcctggagactgtgcacacactatgcggccgaataccccaagtttttctgaaacagatcgaaaaaactatgaagcgtgcctacgagaaacacgtgatcattcatgtgggtcccaaccagatgcactag

SEQ ID NO: 118469 - DNA, 1854 bp, Artificial Sequence
  Description of Artificial Sequence: Synthetic coding sequence
atgcggtgtctggctgcccgagtgaattataaaaccctcattataatttgcgcgctatttacgctagtcacagtcctgctgtggaataaatgcagctcggacaaggcaatccaattcccccgaaggagtagcagtggctttcgtgtggatggctttgaaaagagagccgccgctagcgaatctaataattatatgaaccacgtggcgaagcagcagtctgaagaggctttcccgcaagagcagcagaaagccccccctgttgttgggggcttcaatagcaacgtcgggagtaaagttctcgggctcaagtatgaagagatcgattgcttgattaacgatgagcacactatcaaagggcgcagggagggtaacgaagtattcttgccctttacatgggttgagaagtactttgatgtgtatggaaaggtggtgcagtacgatggatacgatagatttgagttttcacactcttactcgaaagtatacgcgcaacgcgcaccctaccaccctgacggagtgtttatgtccttcgagggctacaacgtcgaggtcagggacagggtgaagtgcattagcggtgtggaaggcgtgccgctttctacacaatgggggcctcagggatatttctaccccattcaaatcgcccaatacggactgagccattactccaagaacctgaccgagaaacccccacatatagaggtatacgagaccgcagaagaccgtgataaaaataagcccaatgattggacggttccaaagggctgctttatggctaatgtcgccgacaagtctcgattcacaaatgtaaagcagttcatagctcccgaaacatcagaaggggtgtcattgcagttggggaacaccaaagatttcattatatctttcgaccttaagttcttaactaacggttctgtgtctgtggtactggagacaaccgaaaagaaccagctgttcaccatccattacgtcagcaatgcacagcttattgctttcaaggagcgtgacatttattacggaatcggccctcgtaccagttggtcaaccgtaacacgtgatctggtcaccgacctgcgcaagggcgtcggactgtccaataccaaggccgtcaaacctaccaaaatcatgcccaagaaagtagtcagacttatcgctaaaggcaaaggattcctcgacaacatcaccatctccacaaccgcacacatggcggctttctttgcggccagcgactggttggttagaaatcaagatgagaaggggggatggccaattatggtaactcgcaaactgggggaaggattcaaatccctggagcccgggtggtactccgccatggcacaagggcaggcaattagcacactagtgcgagcttacctgctaaccaaggaccatatatttcttaacagtgctctccgagcaacagccccttacaaatttttatccgagcagcatggcgttaaagccgtctttatgaacaagcacgattggtatgaggaataccctacaaccccttcttcattcgtgttgaacggctttatgtattccctgattggtctctatgacctcaaagagacagctggcgaaaaactcggcaaggaagcgagaagtctttatgaaaggggcatggaatctctcaaagccatgctgccactgtacgatacaggttcagggaccatctacgatctgcgccacttcatgttagggatcgcccccaacctagcacggtgggactaccacaccacacacattaatcagctgcaactgttgagcactatcgacgagtcacctgttttcaaagaatttgtgaagaggtggaagagctatctcaaaggatccagagccaagcacaactag

SEQ ID NO: 118470 - DNA, 1662 bp, Artificial Sequence
  Description of Artificial Sequence: Synthetic coding sequence
atgaaccatgttgccaaacagcagtcagaggaagctttccctcaggagcagcagaaagcacctcctgtggtgggtggattcaactccaatgttggtagcaaggtgcttggccttaagtacgaggaaatcgattgcttgatcaatgatgagcatactattaaggggagacgtgaggggaatgaggtgttccttccctttacctgggtcgagaaatacttcgacgtgtacgggaaggtggtccagtacgatggatatgatcgtttcgagttctcgcactcctacagtaaggtttacgctcagagggcaccgtatcaccccgatggcgttttcatgagctttgagggctacaatgtcgaggtgagggacagggtgaagtgtataagcggggtggaaggcgtgccattatccacacagtgggggccccaagggtacttttatccaatccaaattgctcagtatggactcagtcactattcaaagaacctgaccgaaaagcccccccacattgaggtatatgaaacagctgaggacagagacaaaaataaacctaatgattggaccgtgccaaaaggctgttttatggctaacgtggccgacaagagccgctttaccaatgtgaagcagtttattgcacccgaaacgagcgaaggagtaagtctccaactcggcaacactaaggacttcatcatttcttttgatttaaaattcctcacgaatggatccgtgagtgtggtgctcgagactaccgagaagaatcagctgttcaccattcattacgtgagcaatgcacagctgatcgcgtttaaagagcgcgacatctattatgggataggcccacgcacatcatggtcaacggtcaccagggacctcgtaactgatttaaggaagggagtaggtctctctaacaccaaggccgttaagcccaccaagattatgcccaagaaggtggttaggctcatagctaagggaaaaggcttcctagacaatatcacaatcagcacaacagcgcacatggcggcattctttgctgcctctgattggctggtgcgcaaccaggacgagaaaggcggctggcccattatggttacacggaaattaggagaggggttcaaaagtcttgagccgggctggtactccgctatggcccaggggcaggcgatcagcaccttggtgcgcgcttatctgctcactaaggatcacatattcctcaacagtgcgctgagggctaccgccccctacaagtttctgagtgagcagcacggggtgaaagccgtgtttatgaacaaacacgattggtacgaagagtatccaactaccccgagctctttcgtgctaaacggatttatgtactctctaatcggcctctacgacctcaaagagacggctggggagaagcttggaaaggaagcgcggagcttgtatgagcggggaatggaaagtctgaaggcaatgctccctctgtatgacactggatctggcactatatacgacctgagacattttatgctgggcatcgccccaaacttggctagatgggactatcatacaacccatatcaatcagctccagctcttgagcacaattgacgagagcccagtgttcaaagagtttgttaagcgatggaaatcttatctgaagggaagtagagccaaacataattag

SEQ ID NO: 118471 - DNA, 1956 bp, Artificial Sequence
  Description of Artificial Sequence: Synthetic coding sequence
atggcccggggtagtgcagtggcatgggctgccctgggcccactcctctgggggtgtgcgttaggactgcagggtggtatgctgtatcctcaagagtcaccatctcgagagtgcaaggaactagatggtttatggtctttccgagccgatttctccgataaccgtagacggggcttcgaggaacaatggtatcggagaccactgtgggaaagcggccctactgttgatatgcccgtgccatcgagctttaacgatattagtcaagattggcgtctccgtcatttcgttggctgggtatggtacgagcgtgaagtgatcttgcccgagagatggactcaagatctgcgaacacgggtagtgctgcgcattggcagcgcccacagctacgcaatcgtatgggtgaatggagtggacacacttgaacatgaaggcggttacttaccttttgaagctgacatctccaacctggtgcaggttggccccttgccatcacgtttgaggatcacaatcgccatcaataatactcttacgccaaccacgctgcctcctggcaccattcagtatctgacggatacaagcaagtatccaaagggctacttcgtgcagaacacctacttcgactttttcaactacgcgggcttgcaacgctccgttctgctgtacaccacaccaaccacgtatattgatgacatcacagtgaccacatctgtggaacaagactcaggcttggtgaactatcaaattagtgtgaaggggagcaatctttttaagctggaagtgcgccttcttgacgccgagaacaaggttgtggcaaacggcaccggcacacaggggcagctgaaagtcccgggtgtcagtttgtggtggccatatttgatgcatgagcgtccagcttacctctacagcctggaagtccaactgaccgcacagactagcctcggacctgttagcgacttttatacactccctgtgggcattcgtaccgtcgctgtcactaagtcccagttccttatcaatggtaagcccttctattttcatggggtaaacaagcatgaagacgctgatatcaggggaaagggcttcgactggcccctcttggtcaaggactttaatctgttacggtggctgggggctaacgcttttaggacatcccattatccttatgccgaagaggtaatgcagatgtgtgacagatacggcatcgtcgttatcgacgaatgccctggagttgggctggccctcccgcagtttttcaataacgtgtccctccatcatcatatgcaggtgatggaggaggtcgtcagacgagataagaaccatcccgcggttgtcatgtggtctgtggccaacgaacccgcgagccatctcgagagcgccgggtactacctgaagatggttattgcacacactaaaagtttagacccctctaggccagtgacattcgtctccaactccaactatgccgcagacaagggcgccccttatgtcgatgtcatctgcctgaattcatattacagctggtatcatgattatggtcacctggagctgatccagctacagcttgcaacacaatttgagaactggtataaaaagtatcagaaaccaataatacagagtgagtatggggctgagaccatagctggtttccaccaggaccctccactgatgttcaccgaggagtatcagaaaagtctactggagcaataccatctgggcctggatcagaagcgccgcaagtatgtcgtgggggaacttatttggaatttcgcagattttatgacagagcaatctccaactagagtcctgggcaataagaagggcatttttacccgacagagacaaccgaagagcgccgcctttctcctgcgagagcgatattggaagattgctaacgaaaccaggtacccacactccgtcgcaaaatcacagtgcctggaaaacagcctgtttacttag

SEQ ID NO: 118472 - DNA, 1803 bp, Artificial Sequence
  Description of Artificial Sequence: Synthetic coding sequence
atggctcgggggagcgccgtggcatgggccgccctcgggcccctcctgtggggctgtgcattgggcttgcaaggcggtatgctttacccacaggagtctccctcccgggaatgtaaagaactcgatggactttggtctttccgagccgatttctccgacaatcggcgcaggggttttgaagaacagtggtacaggcggcctctctgggagtcaggacctaccgtggacatgcccgtcccctccagctttaacgacatatcccaggactggaggctgaggcattttgtggggtgggtgtggtacgagcgtgaggtgatcctgccagagcggtggacccaagaccttcgtaccagggtggtactgcggatagggtcagcccattcatatgccatcgtctgggtaaacggagttgacactctggagcatgagggcgggtacctcccctttgaggctgacatttccaacctggtgcaagtagggccattacctagcaggctgaggatcaccatcgccatcaataacacactgacgcctactaccctgccccccggcactattcagtatttgaccgacactagcaagtatcccaaaggctactttgtgcaaaacacctacttcgactttttcaattatgccggtctgcagaggtccgtacttctttacaccactccgaccacctacatcgatgacattactgtgactacctcggttgagcaggacagcggcctggtgaactaccaaatcagcgttaaaggttccaatttatttaagcttgaggttcggctgctcgatgcagagaacaaagtagtggcgaacgggaccggcacacagggccagctcaaggtgcccggtgtatccctgtggtggccttatctgatgcatgaaaggcccgcttatctgtacagcctcgaaattcgcggaaaggggtttgactggccacttctggtgaaggacttcaatctcctgcggtggttgggcgctaatgctttccggacatcccactacccctatgcagaggaggtgatgcagatgtgcgatcgctatggcattgtggtgatagacgaatgtcctggggtcggactggctttgccccagttcttcaacaacgtctccctgcaccaccatatgcaagtcatggaggaggtggtgcggcgtgataaaaaccatcccgccgtggtcatgtggagcgtggccaacgagcctgctagccatctagaatccgctgggtattatctgaagatggttatcgcccacaccaaatccctggacccttcgaggccggtgacatttgtgtcgaattccaactatgccgctgacaagggtgctccgtacgtggacgtgatttgtctcaacagttactattcttggtaccatgactatgggcacttagagctgatacaactccagcttgctactcagtttgagaactggtataagaagtaccagaaaccaatcattcagtcagagtacggggctgaaacaatcgctggattccaccaggaccctccactcatgttcactgaagaatatcagaagagtcttttggaacagtatcatctcggactggaccagaaaagaaggaagtatgtcgtgggcgaacttatttggaactttgccgactttatgaccgagcagagtcccacccgggtgcttggaaacaaaaaagggatattcacgcggcagaggcaaccaaaatcagccgcattcctgctgcgggagcggtactggaagatcgcaaatgaaacccgctatccgcatagcgtggctaagagccagtgtctggagaatagcctctttacctag

SEQ ID NO: 118473 - DNA, 675 bp, Artificial Sequence
  Description of Artificial Sequence: Synthetic coding sequence
atggcatccagcacacccagcagtagcgccaccagcagcaacgcgggcgcagaccctaataccaccaatctgaggcccactacctacgacacatggtgcggcgtcgcccatgggtgcacccgtaagctggggttgaaaatctgcggcttccttcaacgaacaaatagcttggaagagaagtctcgtctggtctccgcctttaaggagcgacagtctagcaaaaacctactgtcctgcgagaattctgatcgcgatgcacgcttcaggagaactgagacagatttttctaatttgttcgcccgcgatctcctgcccgctaaaaatggcgaggaacaaactgtgcagttcctgctggaggttgtggacattttgctcaactatgtcaggaagacgttcgatagatcaacaaaggtgctggattttcaccatccacaccagctcctggaggggatggaaggatttaacttggaactgtccgatcatccggaatctcttgagcagatccttgtggactgccgggacactctcaaatacggggtgcgaaccggtcatccacggtttttcaaccagttatccaccgggcttgacattataggattggcaggggagtggctgactagcacagcgaatacgaacatgccatcagacatgagggaatgctggctgctgagatag

SEQ ID NO: 118474 - DNA, 1785 bp, Artificial Sequence
  Description of Artificial Sequence: Synthetic coding sequence
atggcgtccagtacccccagtagctcagccacaagctcaaatgcaggtgccgatccaaacaccactaacctccggcctacgacctacgatacttggtgtggagtcgcccacggttgcacgcggaagctcggactcaagatttgcggcttcctgcaacgcactaactctctggaagagaaatcacgtctggtctctgctttcaaagagaggcaaagctctaaaaatctgctcagttgtgagaactctgatagggacgcgagattccgtcgcaccgagacagacttctctaatctgttcgccagagacttactccccgctaaaaacggggaggagcagactgtacagttcctccttgaagtggtggacattctgctgaactacgtgcgaaaaacgtttgaccgcagtaccaaagtgctcgactttcatcatccccatcagcttctggaaggcatggaaggcttcaatctggagctgagcgatcatccggagtcactcgagcagatactcgtcgattgccgggatactctgaagtatggcgtgcgcacagggcaccccaggttcttcaatcagctttcaacggggctggacatcatcgggctcgcaggagagtggctgacctcaaccgccaataccaatatgtttacatatgaaatcgctcccgtgttcgttttgatggaacagatcacattgaagaagatgagggaaatagtcggttggtccagcaaggacggcgatggtatcttttcacccgggggagccatatctaatatgtattccataatggctgcccggtataagtatttccccgaggtcaagactaaagggatggctgccgtgccaaaactggtgctgtttacctctgaacagagccactactccatcaagaaggcgggggctgcactgggattcgggacagacaatgtcatcctaattaagtgcaacgaaaggggaaaaattatcccagcagacttcgaggcaaaaattcttgaggccaagcagaagggatacgtgccgttctacgtgaacgccaccgctggcacaactgtttatggggcttttgaccccatccaggaaattgccgatatctgcgagaagtataatctgtggctccacgttgatgccgcctggggaggcgggctgttaatgagtcggaaacatcggcacaagctaaacggcatcgagcgggccaactcagtgacctggaacccccacaaaatgatgggcgttctgctgcaatgctccgccatcctggtcaaggagaaaggcattcttcaggggtgcaatcagatgtgtgctggctacctgttccagcctgataaacagtacgatgtatcatatgataccggagacaaggccattcagtgcggcagacacgtcgatatatttaagttctggctgatgtggaaagccaagggtacagtgggttttgaaaaccaaatcaacaagtgtctggagctcgccgagtacctgtacgccaagataaagaatagggaagaattcgaaatggtgttcaatggagaacccgaacacactaacgtatgtttttggtatatccctcagtcattaagaggtgtgccggactcacctcaacggagagagaagttacacaaggttgctcctaagatcaaagccctgatgatggaatccggaacaaccatggtcggatatcaacctcagggcgataaggcaaattttttcaggatggtcatctccaacccagctgcaacccagagcgacattgattttctgatcgaggaaattgagcgcctcggacaggacctgtag

SEQ ID NO: 118475 - DNA, 675 bp, Artificial Sequence
  Description of Artificial Sequence: Synthetic coding sequence
atggcgtcttctaccccaagctcctctgcaactagctctaacgcaggggcagaccccaataccactaatctgcgcccgactacttatgatacatggtgcggtgtggcccacggatgtacccgtaagttgggtttgaagatctgtggcttcctgcagcggacaaactcactggaggagaaaagtagacttgtgagcgcgttcaaagaacggcagtctagtaagaatcttctatcctgcgagaactcagatcgcgacgcccggtttcgccgcaccgagacagacttctcaaatttgttcgccagggatctgctccccgcgaagaacggtgaggagcagaccgtgcagttcttgctggaagtggttgacattctgttgaactacgtaagaaagaccttcgatcggagcaccaaggttctagattttcatcacccacatcagctcctggaggggatggaaggctttaaccttgaactttccgatcaccccgagtcactggagcagattctagtcgattgccgcgatacactaaaatacggcgtgcggaccggacaccctcgattcttcaaccagctgtctaccggtctggacattattggcctcgcgggagaatggctgacatctaccgccaatactaatatgccttcagacatgagggagtgttggctgctaaggtag

SEQ ID NO: 118476 - DNA, 114 bp, Artificial Sequence
  Description of Artificial Sequence: Synthetic coding sequence
atggccagctccaccccgagctcatctgcgacatcctccaatgctggggccgacccaaacacaacaaacctaagacccaccacatatgatacttggtgtggtgtggcgcactag

SEQ ID NO: 118477 - DNA, 258 bp, Artificial Sequence
  Description of Artificial Sequence: Synthetic coding sequence
atggcgtcctcaacgccctccagttcagcaacctcaagcaatgccggcgccgaccccaatacaactaaccttagacccacaacctatgacacatggtgtggcgtcgcgcacgggtgcacacggaaacttggtctcaagatttgtggatttctccagcggactaattcactcgaggaaaagtcccgactggtctccgcttttaaggagcggcagtccagtaagaatctgttgtcatgcgaaaattcggaccgcgactag

SEQ ID NO: 118478 - DNA, 348 bp, Artificial Sequence
  Description of Artificial Sequence: Synthetic coding sequence
atggccagcagtactccttcgagttcagcaacctcatcaaacgccggcgctgaccccaacactacgaatctcaggcccaccacctatgacacatggtgcggtgtcgcccatgggtgcactcgtaagctgggtctgaagatatgcgggttcctccaaaggactaatagtctcgaggagaagtctcgcctggtctctgcttttaaagagcggcagtcctcaaagaatctcctaagttgcgaaaattctgaccgtgacgccaggtttaggaggaccgagaccgacttttctaacctgttcgcccgtgacctcttaccagccaaaaacggtgaagagcagacggtgcagtag

SEQ ID NO: 118479 - DNA, 366 bp, Artificial Sequence
  Description of Artificial Sequence: Synthetic coding sequence
atggcgagcagtacaccgtcctcttcggccacaagtagtaacgcaggggcagatccaaacacaacaaatttgaggccaacaacctatgatacctggtgcggcgtggcacatggctgtaccagaaagctgggtctgaagatttgcggcttcttgcagagaacgaactcactagaagagaagtctcgccttgtgtcagccttcaaggaacgccagtctagcaagaatttgttaagttgtgaaaacagtgacagggatgcgaggttccgacggaccgagactgactttagcaacctgttcgcccgggatttgctgccagcgaaaaacggcgaggaacaaacagtccagtttctgctcgaggtagtgtag

SEQ ID NO: 118480 - DNA, 1758 bp, Artificial Sequence
  Description of Artificial Sequence: Synthetic coding sequence
atggcgtcgccgggttcgggcttctggtcgttcggtagcgaagacgggagtggagacagcgagaacccaggtaccgctcgagcgtggtgtcaggtcgcacagaaatttacgggggggatcgggaataagctatgtgccctgctatacggcgacgcagaaaagcctgccgaatctggcgggagccaacctccaagagccgccgcgcggaaggctgcttgtgcttgcgatcagaaaccctgcagctgtagcaaggtcgacgtcaactacgctttcctccatgccaccgacttactgccggcctgcgatggcgagcgcccaacacttgcctttctccaggatgttatgaacatcctgctccaatatgttgtaaagtcattcgaccgatccacaaaagtcatagactttcattaccctaatgagctgctacaggagtataattgggaactggctgaccaaccccaaaatctcgaagaaatactgatgcactgtcagactactctaaagtatgcgattaagacggggcacccaaggtactttaaccagctgtccaccggtttagatatggtgggtctggcggcagattggttgacttccaccgcaaacaccaatatgtttacatatgagattgcccctgttttcgtgctgcttgagtatgttacactaaaaaaaatgcgggagattatcggatggcccgggggcagcggtgatgggatcttctcacctggcggggccattagtaacatgtacgctatgatgatagctcggtttaaaatgtttcccgaagtgaaggaaaaaggaatggcggcactgccaagactgatcgctttcactagcgaacattcacacttctctctgaagaagggtgctgccgccctgggcatcggaaccgactctgtaatcctcattaaatgtgacgagcgagggaagatgatcccatctgatctcgagcgaagaattcttgaggctaaacagaaaggcttcgtgcctttcctagtgagtgccaccgctggaaccacagtgtatggcgctttcgatccactgttggccgttgcagatatctgtaagaaatataaaatatggatgcatgtcgatgccgcctggggcggaggactgctgatgagcagaaagcacaaatggaaattgagtggagtcgaaagagccaattccgtgacctggaaccctcataaaatgatgggggttccactccaatgtagcgcgctcttagttagggaagaggggctcatgcagaattgtaatcagatgcatgccagttacctgtttcagcaagataagcactatgacctcagctacgataccggggataaggcgcttcaatgtgggcggcacgtagatgtcttcaaactgtggctgatgtggagagctaaaggcaccactggatttgaggcccatgtggacaagtgtctggagcttgccgagtacctgtacaatattatcaaaaacagagagggctacgagatggtgttcgatgggaagccccagcatactaacgtgtgcttctggtatatacccccctccctgagaacgctagaagacaacgaagaacggatgtctagactgagcaaagtcgcaccagtgatcaaggccagaatgatggaatacgggactactatggtctcttatcaacctctgggggataaggtgaactttttccggatggtcatctcaaaccctgctgccacacatcaggacattgacttcctaatcgaagaaattgagaggctcggtcaggatttatag

SEQ ID NO: 118481 - DNA, 390 bp, Artificial Sequence
  Description of Artificial Sequence: Synthetic coding sequence
atgaacattctcctacagtacgtggtgaagagcttcgatcgaagcacgaaggtgattgacttccactatcctaacgagttactccaggagtataattgggagctggctgatcagccccagaacttggaagagatcctaatgcactgccagaccactcttaagtacgctataaaaacgggccacccacgatacttcaatcagctgagtacaggcctggacatggtgggcctcgcagcggactggctaacaagcaccgctaataccaacatgttcacctacgagatcgccccagtttttgtgttgctggagtatgttaccctcaaaaagatgcgcgagattatcggctggcccggaggcagtggcgacggcatcttctctccaggaacctag

SEQ ID NO: 118482 - DNA, 1758 bp, Artificial Sequence
  Description of Artificial Sequence: Synthetic coding sequence
atggctagtcccgggagcggcttttggtcatttggaagcgaggatggttctggagattctgagaatcccggaaccgctcgtgcatggtgccaagtcgcccagaagttcaccgggggaatagggaataaactctgcgcactgctgtacggcgacgctgaaaagccggctgagtcaggaggcagccagccaccgagggccgccgcccgcaaggccgcatgcgcatgtgatcagaagccatgctcctgctctaaggtggatgtcaattatgccttcctccatgccactgacctgctgcccgcttgcgatggcgagcgcccaactctggctttcttgcaagacgttatgaacatcctgttgcagtacgtggtaaaaagtttcgatcggtctaccaaagtcattgattttcattatcccaacgaactgctgcaggagtacaactgggaattggccgatcaaccccaaaatcttgaggaaattctcatgcactgtcagactactcttaaatacgctataaagacaggccaccccaggtattttaaccagctgtccacaggactcgacatggtgggcctcgccgcagactggctgacttcaactgccaatacaaatatgtttacttacgaaatcgctccagtttttgtcctcctggaatacgtcaccctgaaaaagatgcgagaaatcattgggtggcctggagggtctggcgacgggatatttagccctggaggggcgatctctaatatgtatgccatgatgatcgctaggtttaaaatgtttcccgaagttaaagaaaagggtatggccgccctccctcggctgatcgctttcacatccgagcattcacacttcagcttaaagaagggcgcagccgccttgggcattggcactgacagcgtgattctgatcaagtgcgatgagagaggaaaaatgatccctagtgatctcgaaagacgaatcttggaagcaaaacagaaaggattcgtgcctttcttggtttcagctactgctgggactaccgtgtatggggcttttgaccctttgttggccgtggctgacatttgcaagaaatacaagatttggatgcacgtagatgccgcttggggggggggtctgctaatgtctagaaagcacaaatggaagctttccggagtagagcgagccaatagtgttacttggaaccctcataaaatgatgggcgttcctcttcaatgttccgccctcctggtgagagaagagggtctgatgcaaaattgcaaccagatgcacgcatcctatctgtttcagcaggataagcactatgacttgtcctacgatactggggataaggccctgcagtgcggtcgccatgtggatgtctttaaattgtggttgatgtggcgggctaaaggcactacaggttttgaagcccatgtggataaatgtttggaactggccgagtacttgtacaacattatcaagaatcgggagggatatgagatggtcttcgacggaaagcctcagcatacaaacgtttgtttctggtacatccctcctagccttcgcacactagaagacaatgaggagagaatgtctaggctgtcaaaggtggctcccgtgatcaaggctagaatgatggagtacgggaccactatggtttcctaccagccattgggggataaggtgaattttttcaggatggtcatcagtaacccagctgcgacacatcaagatatcgatttcctaattgaggaaattgaaaggcttggacaggacctatag

SEQ ID NO: 118483 - DNA, 567 bp, Artificial Sequence
  Description of Artificial Sequence: Synthetic coding sequence
atggcaagtccaggcagtggcttctggtctttcggaagcgaagacgggtctggcgactcagaaaaccctggtactgccagggcatggtgccaggtggcccagaaatttactggcggcatcggaaacaagctatgtgcactgctgtacggcgatgcagagaagccagctgaaagcggcgggtctcaacctccacgtgctgccgctcgcaaagctgcctgcgcctgtgatcagaaaccttgtagctgcagcaaggtggacgtgaattatgcctttttgcatgccactgacctgttgcctgcatgcgacggcgagcgacctacattagcgttccttcaggacgtgatgaacattctgctccaatacgttgtgaagagttttgatcgatctacaaaggttatagacttccactacccaaacgaactgcttcaggagtacaactgggagctggccgaccagccacaaaatctggaggaaatcttaatgcattgtcagacgacacttaaatatgccattaaaacgggcatcgtgtcctctaaaatcattaaactgttttttcgtctgcagtag

SEQ ID NO: 118484 - DNA, 1677 bp, Artificial Sequence
  Description of Artificial Sequence: Synthetic coding sequence
atgtaccgctacctgggtgaagcactcctgctcagccgcgccggtcccgccgcactcggctcagctagcgccgatagcgccgcccttctgggatgggctaggggtcaaccagcagcagccccccagcccggtctggcgctggcagctagacggcattactcagaggccgtcgctgaccgcgaagatgatccaaacttctttaaaatggtggaagggtttttcgaccggggtgcatccatcgtggaggacaagctggtggaggatttaaggactagagagagcgaggagcagaagaggaaccgggtccgagggattcttcgaatcattaagccatgcaaccacgtcctttctctaagtttccccataagaagggacgacggcagttgggaagtcattgagggatacagggcccagcactcacaacataggacaccttgcaaaggcggtattcggtatagcactgatgtgagcgtcgacgaggttaaggccttagcctcattgatgacctataaatgcgctgtggtcgacgtgcctttcggaggagctaaggctggcgttaaaatcaaccctaagaactataccgacaacgagctggagaagatcactcgcaggtttacgatggagctcgcgaagaagggatttatcggcccgggcatagacgtgcccgcgcctgacatgtccactggcgaaagggaaatgtcttggatcgccgatacttacgcctctaccataggccattatgatatcaatgcgcacgcttgtgttactggaaaaccaatcagccaaggaggtattcacgggaggatcagtgccacggggcggggcgtgttccacggcatcgagaatttcatcaacgaagctagttacatgtctatcctgggcatgaccccgggattcggagacaagacttttgtcgtccaaggctttggcaatgtgggactgcacagcatgaggtatctacacagattcggcgccaagtgcatagcagttggggagagtgatgggagcatttggaaccccgacggcatcgatcccaaggagctggaagacttcaagctccagcatggatcaatcctcgggttccctaaagcaaagccctacgaagggtccatactggaagcggactgtgatattctcatacccgctgcaagcgaaaagcagctcacaaaatccaacgccccccgcgtgaaagcgaagatcatcgctgaaggagcaaatgggcctacgacacccgaagccgataagatcttcctggagagaaacatcatggtgataccggatctatacttgaacgccggcggagttaccgtgtcctattttgaatggctcaagaacctcaatcatgtgagctacgggagattgacatttaaatacgagcgagactccaattatcatcttttaatgtccgtgcaagaatccttggagcgtaaatttggtaaacacggcggcaccatccctatcgtgcccacagcagaattccaggatcggatatccggggcatctgagaaggacatcgttcactccgggttggcatacacaatggagagatccgctcggcagatcatgcgaactgctatgaaatacaacctggggcttgatttacggactgctgcctacgtgaatgccattgaaaaggtgttcaaggtgtataatgaagccggagtaacctttacatag

SEQ ID NO: 118485 - DNA, 1548 bp, Artificial Sequence
  Description of Artificial Sequence: Synthetic coding sequence
atgtaccgatacctgggacccgggacagccagacgacgcccagccgccggagccggcatcggtaggcctgctccactgcagcgcggggggggtaggcctcgaggccggccacagctactccaggatggcggcggactgctccgctccaggagacagcacaggggaggacaggctggaggaggtcctgaggatcccggagaaagaggggccgaagccgagcccggtgcaagacacccagctgatcatcaggctctccagccctgcgctgagtcattacttccccagcactcacagcatcggaccccgtgcaagggaggcatcagatattccacagatgtgtccgtcgatgaggttaaggctttagcttccctgatgacatacaagtgcgccgtcgtcgacgtgcccttcggcggcgctaaggctggggtaaagattaatccaaaaaattacactgacaatgaacttgaaaagattacacggaggttcaccatggagttggccaagaaaggatttatcgggcccggaatcgatgtacccgcccctgacatgagcacgggggagagagagatgtcctggatcgcagacacttatgcttcaactattggacattatgacatcaatgcgcatgcctgcgtgaccggtaaacccatctcacagggcggaattcacggcaggataagtgccaccggacggggcgtttttcacggcatcgagaactttattaacgaagcatcttacatgtccatccttggaatgacacccgggttcggcgataagacgttcgtggtacagggcttcggaaacgttggcctccactctatgagatatctgcatcgcttcggagccaaatgtatcgccgttggtgagtctgacggtagcatttggaatccagacgggattgaccctaaagaactggaagactttaaattgcaacacgggtccatcttgggttttcccaaggccaagccctatgaaggaagcattctagaggcagactgcgatattttgatacccgccgcctccgaaaagcagctgacaaaatcaaatgctcctcgggtaaaggctaaaattattgccgaaggtgcaaatggccccactacaccggaggccgacaagattttcctggaacggaacattatggttatccccgacctgtatttgaatgctggcggagttacggtgtcctattttgaatggttgaagaacttaaaccacgtcagttatggacgtttaacatttaaatacgaaagagactcaaattaccacctcctaatgtccgttcaagagagccttgagaggaagttcggcaagcacggcggcacgattcctatagttcccacagccgagtttcaagaccgaatttcgggcgcttcagagaaggacatagtgcactctggactggcctacactatggagagatccgcacgccagatcatgcgtacagccatgaaatataatttgggcttggacctgcggactgccgcctacgtgaatgccattgaaaaggtctttaaagtgtataatgaggcaggtgttacttttacttag

SEQ ID NO: 118486 - DNA, 1473 bp, Artificial Sequence
  Description of Artificial Sequence: Synthetic coding sequence
atggtggaaggatttttcgataggggggcgtcaatagtcgaggataaactggtcgaggacctgcgaactagagagtccgaggaacagaaacgaaatcgggtgagaggaatccttcgcatcatcaagccatgtaaccatgtactcagcttgagcttccccatacgccgtgacgatggctcttgggaggtcatagaagggtatagggctcagcattctcagcacaggacaccctgcaagggtggcatcagatactccacagacgtgtctgtggatgaggttaaggctcttgcttcattgatgacatacaagtgcgctgtggtcgatgtcccattcggtggggccaaggcaggcgttaaaatcaatcctaaaaactacactgataatgagttagagaagatcacaaggagattcacgatggagttggccaagaaagggtttatcggccctgggattgatgtacctgcccctgatatgagcaccggcgagagggagatgagttggatcgctgatacctatgcatcaaccataggtcactacgacatcaacgcccacgcttgtgtcacaggcaaacctattagccaaggaggtatacatggccgcattagtgccactgggagaggtgttttccatggcatcgaaaacttcatcaacgaggcatcatacatgtcgatcctcggcatgacacccggttttggcgataaaacgttcgtggtgcagggattcggtaatgtgggactgcacagcatgagatacctgcatcgtttcggggccaaatgcattgctgtgggggagtctgatggatccatctggaacccggacggcattgatccaaaggaactggaggacttcaagctccaacacggcagtattctgggttttccgaaagccaaaccctacgagggatctatcctggaagctgattgcgatatcctcatccctgctgcctcagagaaacagctgactaaaagtaatgctccccgcgtgaaggccaagataattgccgagggagctaacggacctaccactcctgaagccgataaaatattcctggagcgcaacatcatggtgattcctgatctttacttgaatgccggaggcgtcaccgtttcttatttcgaatggctaaagaatctcaatcacgtgtcctacgggcgcctgacttttaagtacgagcgggattctaattaccacctgctcatgagtgtgcaggaatctctggagcggaagtttgggaaacacggcggaactattcccattgtgcctaccgccgaattccaggataggattagcggggctagcgaaaaagacatcgtgcattccggattggcatacaccatggagaggtccgctcgacaaattatgaggaccgctatgaaatataacctcggtttggacctcaggacagctgcttacgtaaatgcaattgagaaagttttcaaggtctataacgaggctggagttacatttacctag

SEQ ID NO: 118487 - DNA, 774 bp, Artificial Sequence
  Description of Artificial Sequence: Synthetic coding sequence
gaaaacttcatcgtggaaggcttcggcaacgtggggctgcacagtatgagatacttgcacaggttcggcgctaaatgcattgctgtcggcgagagtgatggctctatctggaacccagacggtattgacccgaaagagttggaagactttaagctacagcacgggtccattctgggttttcctaaggcaaaaccttatgaagggtctatcctggaagcagattgtgatattctgatcccagcagcctccgaaaagcagctgaccaagtcgaatgccccccgtgtcaaggcgaagattatcgcagaaggagccaatgggccaaccacacccgaagccgacaagattttcctggaaagaaacattatggttatccccgacctatatctgaatgcaggcggggtaaccgtgtcttacttcgagtggctgaagaacctgaaccacgtgagttatggaaggctcactttcaagtatgagcgagattctaactatcatctgctgatgagtgtccaggagtcgctcgagcgcaagttcgggaaacacggcggcacaattccaatcgtccctacagcagaattccaggacaggatatcgggcgctagtgagaaggatatcgtccactcagggctggcgtacactatggagcgttcggccaggcaaatcatgcgcacggcaatgaagtacaatcttgggctggaccttagaacagccgcttacgttaatgctatcgagaaggtcttcaaagtctataacgaagccggcgttacgtttacctag

SEQ ID NO: 118488 - DNA, 1176 bp, Artificial Sequence
  Description of Artificial Sequence: Synthetic coding sequence
atgacgtacaagtgtgccgttgttgatgtccccttcggcggagcaaaggcaggagtgaagatcaatccgaaaaactacacagacaacgagctggaaaagatcacccgccggttcacgatggagctggcaaaaaagggattcatcgggcccgggatcgatgtacccgcaccagacatgagtacaggggaacgcgaaatgtcctggatcgccgacacatacgcttctacaatcggacactatgatattaatgcgcacgcgtgtgttacagggaagcccatctctcagggcgggatccacggacgtatctctgcgacaggaaggggcgttttccacggtattgagaactttatcaatgaagcctcctatatgagcatacttgggatgactcccgggtttggcgacaagacctttgtcgtgcaagggttcggcaacgtcggactgcattctatgcggtatctgcaccggttcggggcgaaatgtattgctgttggcgagagtgacgggagcatctggaatcccgatggcatcgatcctaaagaactggaagatttcaaactgcagcatggatccatactcggcttccctaaggcgaagccttacgaaggttcaatcctggaggctgattgtgatatactcataccagctgcgtctgagaaacagctcacgaaatccaatgcgccgcgcgtgaaggctaaaatcatagcagagggagctaacggccctactactcccgaagcagataaaattttcttggagaggaacataatggtcattcccgacctgtatctgaatgctggcggcgttaccgtttcatatttcgagtggctgaagaacctgaatcacgtgagttatgggagactaacgtttaaatatgagcgcgactcaaactatcatctgctgatgagcgtacaggagagtttggaacgcaagtttggcaaacacggtggtactattcctatagtgccaacagcggaatttcaggatcgcatttctggggccagtgagaaagacattgtgcactctggcctggcatataccatggaacgatctgctcgccagatcatgcggactgctatgaagtacaacttggggctggatctaagaacagctgcatatgtgaatgcgatcgagaaagtattcaaggtctataatgaagcgggtgtgacgtttacttag

SEQ ID NO: 118489 - DNA, 1278 bp, Artificial Sequence
  Description of Artificial Sequence: Synthetic coding sequence
atgacatgtccctgtgataatgccagttccgttttcctcggattttgcatcagatactcgacggacgtatctgtggacgaagtaaaagcactcgcttcgctgatgacatataaatgcgccgtagttgatgtgcctttcggcggggccaaggcgggtgtgaagatcaaccccaagaattatacggacaacgaactggaaaaaatcactaggaggttcacaatggaactcgccaaaaagggtttcatcggacctggaatagatgtgcccgctcccgatatgagcactggtgaacgcgagatgtcctggatcgcagacacgtacgcctcaaccatcggtcactatgatattaatgctcacgcctgcgtcactgggaaacccatctcacaggggggcattcatgggcgtatttccgctaccgggaggggggtgttccacggcattgagaacttcattaacgaagcttcttatatgagcatcctaggaatgaccccaggctttggcgacaaaacatttgtggtccagggatttggcaatgtgggtctccattccatgcgctacttacaccgatttggagctaaatgtattgcggtgggcgaatcggatggctctatttggaacccagacggcatagaccccaaggagttggaggatttcaaactgcagcacgggtcaatattaggcttccccaaagcaaagccatacgaaggtagtatcttagaggctgattgcgatattctcattcccgccgcctctgaaaaacagttgactaaatcaaacgcaccgagagtgaaagccaaaattatcgctgagggagccaatggacccaccaccccagaagcagacaaaatcttcctagagcgcaacataatggttattccagacttatatttaaacgccgggggggtaactgtgtcatatttcgagtggctgaaaaatctgaaccacgtgtcatacggcagactcacatttaagtatgaaagggattctaattatcacctgttgatgagcgtgcaggagtccttggaacgcaagttcggtaaacacggaggcaccatccctatcgtgccgactgccgaattccaagatagaatcagcggtgccagtgaaaaggacatcgtacattcaggcttagcctacaccatggagcgttcggccaggcagatcatgaggacggctatgaagtacaacttaggattggacctgcgaactgcagcatatgtgaatgcaatcgaaaaggtgttcaaagtttacaacgaggccggtgtgactttcacatag

SEQ ID NO: 118490 - DNA, 1677 bp, Artificial Sequence
  Description of Artificial Sequence: Synthetic coding sequence
atgtacaggtacctggcgaaagccttattacctagccgggccggaccagcagctctgggctcagctgcaaatcacagtgcggctttgttagggcggggccgcggtcaacctgccgctgcatctcaacccgggctcgcgctggcggcgaggagacactattccgagctcgttgctgatcgtgaggacgatcctaatttttttaaaatggtggaaggcttctttgacagaggcgctagcatcgtagaggataagcttgttaaggaccttcgcacgcaggaatccgaggaacagaaacgaaacagagttcgtggcatcctgcgcattattaaaccctgtaatcacgtcctgtcgctttctttccctattaggagagacgacggtagctgggaagttatcgagggctaccgggctcagcattcacaacacagaacaccgtgcaaaggcgggatacgttacagcaccgacgtgtctgtcgacgaggtgaaggcactagcctccctgatgacctataaatgcgctgttgtcgatgtaccattcgggggagccaaagcgggggttaagattaacccaaaaaactacacagagaatgagcttgagaaaattacccggcggttcactatggagctggcaaaaaaaggcttcatcggaccaggcgtcgatgtgccggcgccagatatgaataccggtgaacgcgaaatgagctggattgcagatacctacgcctcaaccatcggccactatgacatcaatgcccatgcatgcgtaacaggaaagcccattagtcaggggggcatccatggccgaattagtgcgactggccggggggttttccacgggatcgagaacttcatcaatgaggcaagttacatgagcatcctgggaatgactcccggcttcagagacaaaaccttcgtggtgcagggctttggaaatgtgggattacactccatgcgttatctacaccgctttggggccaagtgtatcgcagtgggtgagtcagatgggtccatctggaatcccgatggtattgacccaaaggagctagaagactttaagctgcagcatggtagcattttgggctttccgaaagcgaagccttacgagggcagtatcctggaggttgactgtgatattttgatccccgccgccactgaaaagcaactgaccaaatctaacgccccccgtgtcaaggccaagataattgctgagggcgctaacggtcccacaacccctgaggctgataaaatctttctggagaggaatatcttagtcatccccgatctgtacctgaatgctggaggagtcacagtgagttattttgaatggctaaaaaatctaaaccatgtgagttacggcagactgacttttaagtatgaaagagactctaactaccatctgttgctgtccgtgcaagagagtctggaaaggaaattcggtaagcacggagggaccattcccattgtcccaactgcagaattccaggatagtatttcaggtgcttctgagaaggacattgtccacagcgcgctagcatacaccatggagagaagtgctcggcagatcatgcatactgccatgaaatacaatcttggattagacctgaggaccgcagcgtacgtaaacgctattgagaaagtgttcaaagtctatagcgaagctggcgtcacatttacctag

SEQ ID NO: 118491 - DNA, 3342 bp, Artificial Sequence
  Description of Artificial Sequence: Synthetic coding sequence
atgatcgcggtgtccttcaagtgcaggtgtcagattctgcgacgactgacaaaagatgagtctccttatacaaagagcgcgtcacagactaaacctcccgatggagccctggcagtgcgcagacagtctataccagaggagttcaagggctccactgtcgtggaactgatgaaaaaggaagggaccaccctcggcctcaccgtgagcggtggcatcgacaaggatggcaaacctcgtgtatcaaacctgcgtcagggagggattgccgctcggtccgaccagctggacgttggggactatatcaaagccgtaaacggaatcaaccttgcaaagtttagacacgacgaaatcatctccttgctgaaaaatgtgggcgagcgggtcgttctcgaggtggagtacgaactaccccccgtgagtgtccaggggtcttctgtgatcttcaggacagtagaagtcacgttacacaaggagggcaatacattcggctttgttatcagggggggcgcacatgacgataggaacaagagccggccggtcgttatcacttgtgttagaccaggaggtccagctgatcgggagggtacaattaagccgggcgatagacttctgagtgtggacggcattagattgctgggaaccacacacgctgaagcaatgagcatactgaaacagtgcggtcaagaggcggccttgctcatcgagtatgacgttagtgttatggacagcgtcgccacagctagcgggccgctcctcgtggaagtagccaaaaccccaggcgcatccctcggtgtggccttgaccacctccatgtgttgtaataagcaggttattgtcatcgacaagattaagagtgcgtctattgccgatcggtgcggtgcactgcacgtaggggatcatatcctatccattgatgggacttcaatggagtattgtaccttggccgaggctactcagtttcttgctaacacgacggatcaggttaaattggaaatcctgcctcaccatcaaacccggctggcactaaaagggcctgatcacgtcaaaatccaacggagcgatagacaactgacctgggactcttgggcttcaaaccacagctcattgcacactaaccaccattacaacacataccaccctgatcactgccgagtccctgcccttacatttccaaaagcccctccgcccaattccccaccagcactcgtgtctagttccttttcccccacatctatgagcgcatactctctatcgtccctgaacatgggaacactgcctagaagtctgtactcgacaagcccgcggggcacgatgatgcgccgccggctgaaaaagaaagattttaagagctcattaagcctggcttcatctactgtgggcctggccggccaggtcgtccacaccgaaaccacagaggttgtgctcacagccgacccagtgactggcttcggtatacaactgcagggcagtgtgttcgctacagagactctatcttcaccacctctcatcagttacatcgaggccgactctcccgccgagcggtgcggcgtcctacagatcggggatagagtcatggctattaatgggattcccacagaggattcgacctttgaagaggccagccagctgctccgcgacagttcgatcacctcaaaagtaaccctcgagattgagttcgatgtcgctgagtccgtaattccatcctctggtacctttcacgttaaactgcccaagaagcacaacgtagaattgggcatcactatttcctctcccagctctcgcaaaccaggggatccactcgtcattagcgacattaaaaaaggttccgtcgctcaccgaacagggaccctggaactgggcgataaactccttgcaattgacaatattcgactcgataactgcagtatggaggacgctgttcaaattctgcaacagtgcgaagatttggtgaagctgaagattagaaaagatgaagataacagcgatgaacaagagtcctcgggagccatcatctataccgttgaacttaagaggtatggaggcccactcggcataaccatctccgggaccgaggagcccttcgatccaatcataatctctagccttactaaaggaggactggccgaaagaactggcgccatccatataggcgatcggatccttgccatcaattctagctccctgaaagggaaacccttatccgaggctatccaccttttgcagatggctggcgagactgttaccctgaagattaaaaagcagaccgacgcccaaagcgcttcatctccaaagaagttcccaatctcttctcatttatcagacttgggcgatgtggaagaagacagctctcctgcgcagaagcccgggaaactctccgacatgtaccctagcacagttccatcagtagacagcgctgtcgactcctgggacggctctgcgattgacacaagctatgggacccaggggactagttttcaagcatccgggtataatttcaacacctacgattggagatcaccgaagcagcgaggatcgctctcaccggtgaccaagccgcgctcgcagacttaccccgacgtaggattgtcctacgaagactgggacagaagcaccgcgagcggatttgcaggagccgctgattccgctgagacagagcaagaagagaacttctggtcacaagcactcgaagaccttgaaacatgcggccaaagtggtattctgagggaactggaggctactattatgtcagggtcgacaatgagcttgaaccacgaagcgccaacgccaagaagccagctgggaaggcaggcctccttccaagaacgcagcagctcgcgcccccactacagccaaactacccgtagcaacacattacccagtgatgtggggcggaaatctgtgacgttgcgaaagatgaagcaagagatcaaggagatcatgtcaccaactccagtggagctgcataaggtgactctttataaagactcagacatggaagatttcggattttccgtcgccgacgggctgctcgaaaaaggggtctacgtgaaaaatattcgtcccgccggaccaggtgatctggggggccttaagccgtacgatcgccttctacaggtaaaccacgtacggactagggattttgattgctgtctggtagtgcccctgatagccgaatctgggaacaagctcgatttggttatctcacgcaaccctttggctagccagaaatcaattgaccagcagagccttccgggggattggtccgagcaaaactctgcattcttccagcaacccagtcatggggggaacctggaaacccgggaacccactaatacactgtag

SEQ ID NO: 118492 - DNA, 3387 bp, Artificial Sequence
  Description of Artificial Sequence: Synthetic coding sequence
atgatcgccgtgagcttcaaatgtcgttgtcaaatactgaggcgcctgacaaaagatgagagcccctacactaagagcgcctcccaaactaagccccccgatggagccctcgcagtgcggaggcagtctataccggaggaattcaaagggagtactgtggtggagttaatgaagaaggaaggcaccacactgggcctcacggtgtctggcgggatcgacaaagacggcaagccccgcgtgagcaacctcaggcaggggggaatcgctgcacggtctgatcaacttgacgttggtgactacattaaagccgtcaatgggatcaacctggctaaatttcggcacgacgaaattatttccctgctgaagaacgtgggcgagagagtagtgctggaagtggagtatgaactgccaccagttagcgtgcaggggagtagcgttatcttccgcactgtggaggtcacacttcacaaggaaggtaatacttttggctttgtgattcgcggcggagctcacgacgaccgtaataagtcccggcctgtggtgattacctgcgtaagacctggtggtccagcggaccgcgaggggacaattaaaccgggcgataggttgctgtcagtggacggaattagactactggggacaacccatgctgaggccatgagtattctcaaacagtgtggacaggaggccgcactgctgatcgaatatgatgtgtccgtaatggactccgtagctaccgctagcggaccgctgctagtggaggtggcgaagacccccggcgcgtctttgggggtggcgttgactacctcaatgtgttgcaataagcaggtcattgtgattgataaaataaagagtgcctcgattgccgaccgatgtggcgccctacatgtcggggatcacatcctgtccatcgacggcacttctatggaatactgcactttggctgaggcaacgcagtttctagcaaatacgactgatcaggttaagctggagattctgccccatcaccagactagacttgctctcaagggtcctgatcatgttaaaatacaacgaagcgacagacaactgacatgggacagctgggcttctaaccactcatctcttcatactaatcaccattataatacgtaccatccggatcattgcagggtgcccgccttgacgttcccgaaggctccaccacctaattccccaccagctcttgtaagtagctccttttcaccgacatctatgtccgcctactctctgagttccctgaacatgggaaccctgccacgctcactttattcaaccagcccccgcggaacaatgatgcggagacgcctgaaaaaaaaggactttaaaagcagcttgtcacttgcctctagcactgtgggcctcgccgggcaagtcgtgcataccgaaactaccgaggtggttctcactgctgaccccgtcaccggatttggaattcagctccaaggaagcgtcttcgccaccgaaaccctcagcagcccccccctcatctcctacatcgaggcagacagtccagccgaacggtgtggagtcttgcagattggagaccgcgtgatggcaatcaacggtataccaacagaggacagcacatttgaggaggccagccagttgcttagagattccagcattacaagcaaagttaccctcgagatcgagtttgacgtcgcggagtcagtgatcccttcatctggcacctttcatgtaaagctgccaaaaaagcacaatgttgaactgggaattacaataagttccccgtcaagccgcaaacccggcgacccactggttatctctgacattaagaaggggtccgtagctcatagaaccggcacactggagctgggagacaagctgcttgccatcgacaatattcggcttgacaactgctctatggaagatgctgtccagatcctccaacagtgcgaggacctagttaagctcaaaattagaaaagatgaggacaactcagatgagcaggaaagtagcggagctatcatttataccgttgaactcaagagatacggtggaccactaggaatcaccatatcaggtaccgaggagccattcgacccaataattatttcttccctgacaaagggtggcctagcggaacggaccggcgccatccatattggtgatagaattctagctataaactcgtcgtcactgaaaggtaagcccctgtccgaagcgatccatctgctccagatggccggtgagaccgttaccttaaaaatcaagaagcagaccgacgcccagagtgcctcgagcccaaaaaagttccctataagttctcacctgtccgatctcggcgatgttgaagaagactcctcaccagctcagaagccaggcaagctgagcgacatgtatccatcaacagtcccctccgtggactcagctgtggacagttgggacggaagtgcaattgataccagctatggcacacagggcaccagtttccaggcttcaggatataattttaatacttacgactggcgtagtcctaagcagagaggctcactgtccccggtgacaaagccccgcagccagacttacccggatgttgggttaagttacgaggattgggaccgctcaactgcgtctggcttcgccggtgctgctgatagtgctgaaactgagcaagaggagaacttctggagccaggcactagaggaccttgaaacatgtggtcagtcggggatcctgagagagctagaagagaaggcagatagacgcgtgagcctgcgaaatatgactctgcttgctaccattatgagtggatctaccatgagcctcaatcacgaggccccgacccctagatcgcagctagggcggcaggcatcctttcaagagcgcagtagctccaggcctcactattcgcaaacgacgagatcgaacacactgcctagcgatgtcggacgtaagtccgtaaccctgaggaaaatgaaacaggagattaaggaaattatgtcccccacccctgtagaactgcacaaagtgacactttacaaggacagcgatatggaagactttggcttctccgtagcagacggactgctcgaaaaaggagtgtacgtgaaaaatattcgccctgctggccccggggacttgggagggctgaaaccctatgatcgcctgctgcaggtgaaccacgtgagaacccgagatttcgattgctgcctggttgttcccctgatcgcagagagcggaaataagttggacctggtcatcagtcgcaaccctttggcctcacagaaatcaatcgaccagcaaagtctgccaggcgactggagcgagcagaatagcgccttctttcaacagccctctcatggagggaacctggaaacacgggagcctacaaatacactttag

SEQ ID NO: 118493 - DNA, 3231 bp, Artificial Sequence
  Description of Artificial Sequence: Synthetic coding sequence
atgatcgccgttagtttcaagtgtaggtgtcagatactcaggagactgacaaaggacgaatctccctatacgaagtccgcatctcagacgaagcctcctgatggcgccctagcagtcagacgacaatcaatacccgaagagttcaaggggtcaaccgtggtggaactaatgaaaaaagagggcaccacactcggtcttacggtgtccggaggaattgacaaagatggtaagcctcgtgtctcaaatctgagacagggcggcatcgcagcgaggtccgaccagttagacgtgggagactatatcaaagcggtcaatggtataaacttggctaagttccgtcacgacgaaatcatctctcttctgaagaacgtcggtgagagggtggtgcttgaggtcgaatatgagctgccaccagtgtctgtgcaaggaagcagcgtgatctttagaacagtggaggtgacgctgcataaagagggcaacacttttgggttcgtgattagagggggggctcatgacgaccggaataaaagtcggccagtcgtaattacatgtgtaagacccgggggcccagccgaccgggagggcactattaagcctggcgatcgcctgctatcagtggacggcatacggctgctgggaacgactcatgctgaggcaatgtctatattgaagcagtgtgggcaggaggctgccctgctgatagagtatgacgtgtcagtgatggactcagttgctaccgcctcgggacccctgctcgtagaagtggcaaagacccctggcgcctcgctcggcgtcgctttgaccacatccatgtgttgcaataaacaagtaatcgtcattgataaaatcaaatcagcatctatcgcggacagatgcggggctctgcatgtgggtgatcatatccttagtattgatggcacctcaatggagtactgtacattggccgaggcgacacagttccttgctaacacaacagatcaagtaaaacttgaaattctgcctcaccatcaaacaagacttgcactcaaaggtcctgaccatgccgcgttggtttccagcagtttttccccaacgagtatgagcgcatattcactgagctctcttaacatggggacgttgcctcgcagcctttattccacatccccaagagggaccatgatgagaagacgcctgaaaaaaaaggacttcaagtcatctctgtccctggcttccagcaccgttggcctggccggacaagtcgtccacactgaaaccaccgaagtggtactcacggctgaccccgtgaccgggttcggcatccagttgcaggggagcgtgtttgccaccgagacactgtccagccctccgctaattagttatattgaagcagactcacctgcagagagatgtggagtgttgcagattggagatcgcgtgatggcaattaacggaatccctacagaagatagtacttttgaagaagccagccagctgttgcgcgattcttccatcacttcaaaagtcactttggaaattgaatttgatgtggcggaatctgtcatcccctccagcggtacctttcatgttaagctgccaaaaaagcataatgtagagttgggtattacaatttccagtcccagtagtcggaagcccggcgatccccttgtgatctcagatattaaaaaggggagcgtggcacatcggaccgggactctcgagctgggagacaagctgcttgctatcgataacatccgtttagacaactgtagcatggaagacgcagtgcagatactgcaacagtgcgaggatctcgtcaagctcaaaatacgcaaggacgaggataactcagatgagcaggaatcttccggcgccattatctacacagtggaactgaaacgatatggcggacctttgggaataaccatttctggaacagaggaaccttttgaccccattatcatttcctcccttacgaagggaggtctggccgagcgaactggcgctatccatataggggatagaatcctcgcaattaactctagttcattgaagggtaaaccactgtccgaggccattcatctccttcagatggcgggggaaaccgtgacccttaagataaaaaagcaaacagacgcccaatccgcctcatcacccaagaagttcccaataagctctcatctgtctgatttgggagacgtggaggaggactcttcccctgcacagaagcctggtaaactgagtgacatgtatccatccactgtgccatccgtggatagcgctgtggatagctgggacggctctgccattgatacatcctatggcacgcagggaacaagtttccaagccagcgggtacaatttcaacacttacgactggcgctctccaaagcagcggggctctttaagtcctgtgacgaagccccgcagccagacttatcccgatgttgggctcagttatgaggattgggatcggagtaccgcctctgggttcgcaggggccgctgacagcgccgagaccgaacaggaagaaaacttttggagccaagccctggaagacctggagacttgtggccagagtggcattctacgagaacttgaagagaaggccgatcgtcgggttagcctgcgcaatatgaccctgctggcaaccattatgagtgggtctacgatgtctctgaaccacgaggcaccaacaccccgatctcagctgggcagacaggcgtcctttcaggagcggagcagctcaaggccacactacagccagactacacggtccaacaccctgccctcagacgtgggcaggaaaagcgtgactctgagaaaaatgaaacaggagattaaagaaatcatgagtcccaccccagtggagctccacaaagttactttgtacaaagacagcgatatggaagattttggttttagtgtagccgacggcctcctggagaagggagtgtatgtgaaaaacatccgcccagctggtcccggagatttgggcggcctgaagccctatgaccgattactgcaggtgaaccatgtgcggacccgtgattttgattgttgcttggtagttcccctgattgccgagagtggaaataaattagacctggtaatttcacgcaatcctcttgcctcgcagaaatccattgaccagcagtccctccccggggattggagcgaacagaacagcgcttttttccaacaaccctctcacggcggcaatctggaaacacgagaacccacaaatacactgtag

SEQ ID NO: 118494 - DNA, 2511 bp, Artificial Sequence
  Description of Artificial Sequence: Synthetic coding sequence
atggtccagttctctactagtgaatttcgcctgacaccccatattgacaaccttgaggtggccaactcgtttgccgtgactaatgcattttgcagccagttcagccgaggagtttatgcgatcttcggcttctacgacaaaaagtcagtgaatactatcaccagcttttgcgggacacttcatgtatcttttatcacaccctcttttccaaccgacgggacacacccattcgtaattcagatgcgccctgacctgaaaggtgccttgctttctcttattgaatattatcagtgggataagtttgcctatctgtatgactccgatcgaggattgtctactttgcaagctgtgctagactctgcagctgagaaaaagtggcaggtaactgccatcaatgtcggtaacattaacaatgataaaaaggatgaaatgtatcgctccttatttcaggatctggaattgaagaaggagaggagggtgatactagactgtgagagggataaggtcaacgacatagtggaccaggtaattactattggaaaacacgtcaaaggctatcactatattattgcaaacctggggttcactgacggggatttgttgaagattcagttcggcggggctaacgtgtctgggttccagatagtcgactacgacgacagcctggtgtcaaaattcattgaacgctggtctacactcgaggagaaagagtacccgggagctcatacaaccacgatcaaatatactagcgctttgacatacgacgcggttcaagtcatgaccgaggcctttcgcaatctcaggaagcaaagaattgagataagccggaggggtaatgcgggcgattgtctggccaaccccgcagtcccttggggtcagggcgtggagattgaaagggccttaaagcaggttcaggttgaagggctctcagggaatatcaaattcgaccagaacggaaagcgcattaattataccatcaatatcatggagctgaagactaacggaccccggaaaattgggtactggagtgaagtcgacaagatggtggtgactctgacagaactaccctctggcaacgacacatccgggcttgagaataaaaccgtcgtcgttaccaccatactcgagagtccttatgtgatgatgaagaagaaccatgagatgctggaagggaatgagcgctacgaggggtactgcgtcgacttggctgctgagatagccaagcattgcggctttaaatacaagctcaccatcgttggagatgggaaatatggcgctagggatgccgacaccaagatctggaacggaatggtgggtgaactcgtatatggtaaggccgatatcgccatagcacccctcaccattactctggtgagagaagaagtaattgatttctccaaacctttcatgtccctgggcatttctatcatgatcaagaagccacagaaatccaaaccgggcgtgttttcgtttctggaccccctcgcgtacgagatatggatgtgcatagtgttcgcttacatcggagtgtctgtagtcttattccttgtctctcgcttcagtccctatgaatggcataccgaggagttcgaagacggccgtgaaacccagagcagtgagagcaccaatgagttcggaatctttaattccttatggttttctttaggggcattcatgcagcagggatgtgatatttcccctagatccctgtccgggaggatcgtcgggggtgtctggtggttttttactttgattattatcagctcgtacacagcgaatctggctgccttcctgaccgtggagcggatggtcagcccgatagagagcgccgaagatttatcaaagcaaacagaaattgcatatgggacccttgatagcggctcaacaaaggaattttttcgcaggagcaagatcgcggtgtttgataagatgtggacatacatgcgctccgcagagccatccgtgtttgtacgcacgaccgcagagggtgtggcacgtgtaagaaagtccaagggaaagtacgcttacctgctggagtctacaatgaacgagtatattgagcaacggaaaccgtgtgacacaatgaaagtcgggggcaatctagactctaagggctacgggattgccacacccaaaggtagctccctgcggaccccagtgaacctggccgtgctcaaattgtctgagcagggcgtgctggataagctgaaaaataaatggtggtatgacaagggtgagtgcggggccaaagattcgggcagtaaggaaaagaccagtgctctcagcctgtctaatgtcgcaggagtgttttacatattggtcggaggcctcgggctcgcgatgttagtcgctctgatagagttctgttataagagccgagctgaggccaaaagaatgaaggtagccaaaaacgctcagaacattaacccttcatcgtcacagaattcccaaaacttcgccacttataaggaagggtataacgtatacggcatcgaatcggtgaagatctag

SEQ ID NO: 118495 - DNA, 2706 bp, Artificial Sequence
  Description of Artificial Sequence: Synthetic coding sequence
atgtcgactatgcggcttcttaccctggctctccttttctcgtgtagcgtggcccgagccgcttgcgaccccaaaatcgtgaacattggagcagttttgtccactcggaaacacgagcaaatgttcagggaggccgttaatcaagctaataagagacacgggagctggaagatccaacttaatgcaacaagcgtcactcataaacccaacgcgattcaaatggccctgagtgtctgtgaggacctgatctccagccaggtttacgccattcttgtgtctcatccccctacccccaacgatcacttcactccaacacctgtcagttatacagccgggttctatcgaatccccgtcctcggcctcacaacgagaatgagcatatacagcgataaaagcattcacctgagcttcctgcggacagttcccccttacagccaccagtcttccgtttggtttgaaatgatgagagtgtattcctggaatcatatcatactgttggttagcgacgaccacgaagggcgggcagcgcagaagagactcgagactcttctggaagagagggagtctaaagcggagaaagtgctacagtttgatcccggcacaaaaaacgtgaccgcccttttgatggaagcaaaggaactggaggctagagtgatcattctgtcggccagtgaggatgacgcagccacagtgtacagggcagcagctatgctgaatatgactggaagtggctacgtctggcttgtgggcgagcgggagatttcaggcaacgctctccgctatgcccctgatggtatcttgggtctccaactgattaatggaaagaatgagtccgctcacatatcagacgcagtgggtgtggtcgctcaggcggtgcatgaattgctagagaaagaaaacataactgatcctcctcgtggatgcgtggggaatactaatatttggaaaactggccctctgttcaagcgagtcctgatgtcatccaaatacgccgatggagtaaccggtcgggtggagttcaatgaggacggagataggaaatttgccaattacagtattatgaacttgcagaataggaaactcgtgcaggtgggcatttacaatggtacccacgtgattcccaatgacagaaagataatttggcctggaggcgagaccgaaaagccgagaggttatcagatgtcaacccgcctcaaaatcgtgaccattcatcaagaaccgttcgtgtatgtaaaaccaacgctgtccgatggcacatgtaaggaggaatttactgtgaatggggaccccgtcaagaaggtcatatgcacaggccctaatgacacctcccccgggtcaccaagacacaccgttcctcagtgctgttacggattttgtattgacctgcttattaagctggcccggactatgaactttacgtacgaagttcatttggtagcagacggtaagttcggaacccaggagcgagtgaacaattcaaataagaaggaatggaatggcatgatgggggaactgttgtccgggcaagcagacatgattgtagcgcccctcaccataaacaatgagagagcacaatatatcgaattttcaaaaccatttaagtaccaggggcttactattttggtgaaaaaagagattccgagaagcaccctggactctttcatgcagccgttccagtcgactctgtggctgctcgtcggactcagcgtccacgtggtggccgttatgctctacttgttagaccgcttctctcctttcggtcgctttaaggtgaacagtgaggaggaggaggaagacgctctaaccctgagcagtgcgatgtggttctcttggggtgtccttctgaattccgggattggtgaaggagcccctcggtctttctccgctcggatcctgggtatggtgtgggccgggtttgccatgattatagtagcatcctataccgccaatctcgccgcctttttagtcttagatcgaccggaagaaagaatcacaggaattaacgacccacgcctgagaaatcccagtgacaagtttatttacgctacagtgaagcagagctcagtggacatttactttagacgccaggtggagctttcaacaatgtaccgacatatggagaagcacaattatgaatcagccgcggaagccatccaggctgttagggataataagctgcatgcctttatctgggactccgccgtgctggaattcgaggcatcccagaaatgtgatttggtcaccacaggcgaattattcttcaggagtggattcggtatcgggatgagaaaagactccccatggaagcagaatgtgtcactaagcatcctaaaaagccatgagaatgggttcatggaagacctggacaaaacttgggtaagataccaagaatgcgattcacggtcaaatgcccctgcaacactgactttcgaaaatatggcaggcgtgtttatgctagttgctggcggaattgtggccgggatcttcctgatcttcatcgaaattgcatacaagcgccacaaggatgccagacgtaagcagatgcagctggctttcgcagctgtgaacgtctggagaaagaatttgcagagcaccggaggtggccgaggagctctgcagaatcagaaggacacagtattgccaaggcgtgcaatcgagcgcgaggagggtcagcttcagctgtgcagtcgccaccgcgaatcatag

SEQ ID NO: 118496 - DNA, 2658 bp, Artificial Sequence
  Description of Artificial Sequence: Synthetic coding sequence
atgagcacaatgagacttctgacactggcgctcctgtttagttgtagtgtggccagagccgcttgtgatccaaagatcgttaacattggtgcggtcttgagcacacgaaagcatgaacagatgttccgggaggctgtgaaccaggccaataaacgccacggcagttggaagattcagctcaatgctacctctgtaacccataagcccaatgcaattcagatggctttatccgtctgcgaagatctcattagttcacaagtgtatgcgattctagtgagccatcctcccactccgaatgaccattttacccctactcccgtgagttacacagccggattctaccgcatcccagtactcggactgacaacccggatgtctatctattccgacaagtccattcacttatccttcctgcgaacggtccccccgtacagtcaccagtcttctgtatggtttgagatgatgagagtgtattcttggaatcacattattttgcttgtgagcgacgatcatgaaggtagagcagcccaaaaacgcctcgagactctgctcgaggaacgtgagtcgaaggccgaaaaggttcttcagttcgaccctgggacgaagaacgtgacagcgctcctgatggaagccaaagaacttgaggcacgcgtgatcatcctgtcggcctccgaggacgatgccgccactgtctacagagctgctgcaatgctcaacatgaccggcagcggctacgtgtggttggtcggcgagagggaaatttcagggaatgcattacgttacgcacccgatggtatccttggattgcaacttatcaacggcaaaaatgaaagtgcacatatttctgacgcagtgggcgtggtcgcccaggctgtccatgagctgttggaaaaagagaatattaccgacccaccccgggggtgcgtcgggaataccaatatttggaagactggaccgctgtttaaaagagtgctgatgagctcaaaatatgctgacggcgtgaccgggcgcgtggaattcaatgaagacggcgaccgcaagtttgctaactattccattatgaacctacagaaccgcaagcttgtccaagtcgggatctataacggcacccacgttatcccgaacgaccgcaagatcatttggcccggaggagagaccgagaagcccaggggttatcagatgtccaccagactcaagatagtgactatccatcaggaacccttcgtgtacgtgaaaccgacactttccgacggtacctgcaaggaggaatttactgtgaacggcgatccggttaagaaggtcatctgcactgggccgaatgatacaagccccggatccccacgtcatactgtccctcagtgttgttacggcttttgcattgatttgcttatcaagttggcaagaacaatgaattttacatatgaagtacatctggtcgccgatggaaagtttggcacacaggaacgggtgaataattccaacaagaaggaatggaacggaatgatgggagagttactttccggacaggcagatatgatcgtagctccattgaccataaacaatgagagggcccaatatatcgaattttccaaacctttcaagtaccaagggctgaccatattggtgaagaaggagatcccccgctccactttagacagctttatgcagcccttccagtccactctctggcttctcgtgggcctgagcgtgcatgtggttgcagtgatgctgtatctgttggaccgatttagtcccttcggaagattcaaggtgaattccgaagaggaggaggaagatgcactaactctaagcagcgcaatgtggttttcgtggggcgtactccttaacagtggtatcggggagggtgccccaagatctttcagcgcaaggattctgggaatggtgtgggcaggatttgctatgattatcgtggcctcttacacagcaaacctggcggcgtttctggtgctggatcggccagaggagagaatcacgggaatcaacgacccacgattaaggaacccctccgataagttcatctacgctactgttaagcagtcttcagttgatatttatttccgccgacaggtcgagctatcaacgatgtaccgtcatatggagaaacataactacgagtcagccgccgaagctatacaagctgtgagagataacaagctccatgctttcatctgggactccgcagtgctggagttcgaagcgagtcagaaatgtgacctggtgaccacaggtgagctgttctttagaagtggatttggcataggcatgcgtaaggatagcccatggaaacagaatgttagcctctccatcctcaagtctcacgagaacggctttatggaagacctcgacaagacctgggttaggtaccaggagtgcgacagtcggtccaacgctccagctacattgacatttgaaaacatggctggggtcttcatgttggtggctgggggaatcgtggccggaatcttcttgatatttattgaaatcgcatataaacggcacaaagatgctcggcggaaacagatgcagcttgctttcgccgccgttaatgtgtggaggaaaaacttacagcagtaccacccgaccgatatcaccgggcccctgaacttaagtgatccctccgtttccacagtggtgtag

SEQ ID NO: 118497 - DNA, 2769 bp, Artificial Sequence
  Description of Artificial Sequence: Synthetic coding sequence
atggtccagctgcgaaagttactgagggtcctgaccctgatgaaatttccttgctgcgttttggaagtgctgttgtgtgctctagccgccgccgcaagaggccaagaaatgtacgctcctcactccatcagaatcgagggagatgtgacactcggcggactgtttccagtccatgcaaagggcccttcgggggttccttgtggtgacattaaacgtgagaacgggattcaccgtctggaggctatgctgtacgctctcgaccagataaactccgaccctaatctgttacccaatgtcacactcggcgcccgaattctggacacatgcagcagggatacctatgcattggaacagtcactgacctttgtccaggccctgattcagaaggacacgagcgatgtgcggtgtacaaatggtgaacctccggttttcgtcaagccagagaaagtcgtgggagtgatcggcgcctcgggttctagtgtgagcatcatggtcgcaaatattctgagactgtttcaaatcccgcaaatttcgtacgccagtactgcccccgagctcagcgacgatagacgttacgattttttttcaagagtggttccaccggattcctttcaggctcaagccatggtcgatatcgttaaagccctgggctggaactacgttagtacccttgcttcggagggcagctacggcgagaaaggggtggagagctttacacaaatttcaaaggaggcagggggactctgcattgctcagagtgtccggattccgcaggagcgcaaggaccgaacaatcgatttcgatagaatcattaagcagctcttggatacccccaactcgcgggccgtagtcatcttcgctaacgacgaggacataaaacagattctcgcagctgccaaacgagcagatcaggtgggacacttcctgtgggtgggctccgactcatgggggtcaaagattaaccccttgcaccaacacgaggacatcgcggagggcgctatcacaattcagccaaaacgggcaacagttgagggctttgatgcatattttacctcaagaacattagagaacaatagacggaatgtgtggtttgctgagtactgggaagaaaactttaattgtaaactcacaatctcaggcagcaagaaggaagacaccgataggaaatgcaccgggcaagaaagaataggcaaggatagcaactacgagcaggaggggaaggtacagttcgtgatcgatgctgtctacgccatggcccatgcccttcatcatatgaataaagatctgtgtgcagactatcgcggggtctgcccggagatggaacaggccggcgggaagaagcttttaaaatacatccgtaatgtgaatttcaacggatcggccgggacccctgtgatgttcaacaagaatggcgacgctccggggaggtacgacatatttcaatatcagaccactaatacttcaaaccctggctaccgtctcatcgggcagtggactgacgaactgcagttaaatattgaagacatgcagtgggggaaaggggtacgcgaaattccagcctccgtgtgcacactaccatgtaaacccggacagaggaaaaagacccaaaagggaacaccatgttgctggacctgtgagccttgtgacgggtaccagtaccagttcgatgaaatgacgtgtcaacactgcccatacgatcagcgccctaatgagaatcgcacaggctgtcaggatattccgattatcaagctggaatggcatagcccgtgggccgtgatccccgtcttcctggctatgctaggaattatcgcaaccatcttcgtcatggcaactttcattcgatacaatgacacacccatcgtgagagcctcaggtcgtgaattatcatatgtgcttctgaccggtatctttctttgttacattatcacttttctgatgatcgcgaagcctgatgtggccgtatgctcttttcgccgggtctttttgggcctgggcatgtgtatttcatatgcagccctgcttaccaaaaccaaccgcatttacaggattttcgagcaaggtaagaaatccgtcacggctcccagattgattagtccgacaagccagctggccatcacatcctcccttatctccgtacaattgctgggcgtgtttatatggtttggggtggatccccctaacatcatcattgattacgacgagcataagactatgaatcccgagcaagcaaggggtgtgctgaagtgcgatatcacagacctccagattatctgctcccttgggtattccatactcctcatggttacatgtaccgtttacgctataaagaccaggggtgttccagagaatttcaatgaagcgaaaccaattggattcaccatgtacaccacttgtatcgtttggctggctttcatccccatctttttcggtactgcccagagtgccgagaaattgtatatccaaacaactactctgaccataagtatgaatctttctgcttccgttgccttaggtatgctctacatgccaaaagtctacatcattatctttcatccagaattgaacgtgcaaaagcgtaaacgctcctttaaggcagtggttaccgccgcgacgatgagctctcgcctcagccacaagccttcggacagacccaacggcgaggcgaagaccgagctctgtgagaatgtagatcccaataactgcattcctcccgtgaggaagtcagtgcaaaaatcagtcacctggtatactattcctccaactgtttag

SEQ ID NO: 118498 - DNA, 2685 bp, Artificial Sequence
  Description of Artificial Sequence: Synthetic coding sequence
atggccaggcaaaaaaagatgggtcaatctgtgctgcgggctgtattctttctcgtgttgggtctgctgggccattcccatggggggtttccgaacactattagcattgggggcctgtttatgagaaatacagtccaggagcattctgccttcaggtttgcagtacagctgtacaatacaaatcagaacactaccgagaaacccttccacctgaactaccacgttgaccacctggacagctctaactcctttagtgtcactaacgccttctgttcccagttctcaagaggagtctacgccatcttcggtttctatgaccagatgagcatgaatacgcttacaagcttctgcggggcactccatacgagttttgttactcctagcttcccaaccgacgccgacgtgcagtttgtgatccaaatgcgtcccgccctaaaaggagccatcctatcacttctcgggcattacaagtgggaaaagtttgtatatttatacgatacggagagagggttcagcattctgcaggcgatcatggaggccgccgtccagaacaactggcaggttaccgccagatccgtgggcaatataaaggacgtgcaggagtttagacgaattatcgaggaaatggaccgcaggcaggagaagagatacctgatcgactgtgaggtggagcgcatcaacaccatcctggagcaggtcgtgattctgggcaagcattcccggggataccactatatgctggcgaatctcggatttacagatattctgctcgagagggtgatgcatggcggcgctaacatcacgggatttcagattgtaaacaacgaaaatcccatggtgcagcagttcattcagcggtgggtacgtctggatgagcgagagtttccagaagccaagaatgctcccctgaaatacacctcagctctcacgcatgacgctatcctggtgatagctgaggcattcaggtacctacgacgacaacgagtagacgtctcccggcgagggagcgctggagactgccttgcaaaccctgcagtgccctggtcacagggaattgacatcgagcgcgccctcaagatggtgcaggtgcagggaatgaccggcaatattcagtttgacacctacggtcggcgcactaattacactattgatgtctacgagatgaaggtgagcggaagccgcaaagctggttattggaatgagtatgaacggtttgtgcctttctcagaccagcagatctctaacgactccgcctcatctgaaaaccggactatcgtggtaaccacgattctggaaagcccgtacgtgatgtacaagaagaaccatgagcaacttgaggggaatgaacgctacgagggatattgtgtagacttggcctacgaaattgctaagcatgttcgtataaagtataaattgtctattgttggagacggtaaatatggggccagggaccctgaaaccaagatctggaacggaatggtgggcgaactcgtgtacgggcgcgcagacatcgccgtcgcacctctgacgatcaccttagtgcgggaagaggttatcgacttctcaaagccttttatgtctctcggaatcagcattatgatcaagaagccacagaaatccaaaccaggtgtcttcagttttctggaccccctcgcctacgagatctggatgtgtatagttttcgcttatatcggggtctcagtagtgctgttcttagtgagccggtttagtccctatgagtggcacctggaggacaataacgaggaaccccgggatccacaatcacctcctgaccctcccaatgagtttggaatttttaacagtttgtggttctctcttggtgccttcatgcagcagggatgtgacatcagccctaggtcactgagcggacggatcgtgggaggcgtttggtggtttttcacattaataataattagcagctacacagccaatttggccgcattcttgaccgtcgagcgaatggtgtctcccatcgagagtgctgaggacttagctaagcagacagaaatcgcatacgggacactagactccgggagtactaaagagttttttcggcgctcaaagattgctgtctacgagaaaatgtggtcctacatgaagagcgcggagccatcggtgtttaccaaaaccacggccgacggggtcgccagggtacggaagagtaaggggaaattcgcgtttctgctcgagagtactatgaacgagtacatcgagcaaaggaagccctgtgacaccatgaaggtgggaggcaacctcgactccaaagggtacggtgtggctaccccgaagggctctgctctccggaacgccgttaacctggctgtcctgaagctgaacgaacagggactgttagacaaacttaagaacaaatggtggtacgataaaggagaatgtgggtcggggggcggagacagtaaagacaagacatccgcacttagcctgagtaatgttgctggggtgttttatatcctcgtcggcggcctcggtctagccatgatggtcgctctgattgagttttgttacaaatcaagagcagaatccaaacgaatgaaattgacaaaaaacacccagaatttcaagccagccccagcaaccaatacacagaattacgctacctaccgggaggggtacaatgtgtacggaaccgagtctgttaaaatttag

SEQ ID NO: 118499 - DNA, 432 bp, Artificial Sequence
  Description of Artificial Sequence: Synthetic coding sequence
atggcccgacagaagaaaatgggccagagcgtgctgcgagctgtcttttttctagtcttggggttactaggacacagccatggagggttccctaacacaatttccattggcgggctatttatgaggaatacggtccaggaacactcagccttcagattcgccgtgcaactgtacaataccaaccagaatacaacagagaaaccatttcacctcaattaccatgtggatcatctggacagcagtaatagcttcagcgtgaccaacgcctgccctgccgagcgcgactacctaccatggcctgggtccattagagaaaacaattggactgcgctgccctgctgcaaggaccatggattactccaccttaaatgcagtcccggcggcaggcagaattgggcctattgcatctggggagtcaccggcgagctttag

SEQ ID NO: 118500 - DNA, 2685 bp, Artificial Sequence
  Description of Artificial Sequence: Synthetic coding sequence
atggcaagacagaaaaagatggggcagagcgttctccgcgcagtcttctttttagtgcttggtcttctcggacactcgcatggcggctttccaaatacaatcagcatcgggggtctgtttatgagaaatactgtccaggagcacagtgcatttagattcgcagtacagttgtataataccaaccagaatacgacggaaaaaccattccaccttaactatcatgtcgaccacctggacagctcaaattctttctctgtcacaaacgctttttgctctcagttcagcaggggggtatacgcgatttttggattctacgaccagatgtccatgaacacacttacgtcattttgtggagcgctccacacgtcattcgttactccctccttccctacagacgccgatgtgcagtttgttatccaaatgcgacctgcactcaagggggcaatcctgtccctgcttggccattacaagtgggaaaagtttgtgtatctgtatgatacagaaagaggctttagcattctccaggcaataatggaagccgctgtacagaacaattggcaggtgaccgcccggtccgtgggcaacatcaaagacgtccaggaattccgcagaattattgaggagatggaccgaagacaggagaagaggtatcttatagattgcgaagtcgaaagaataaatacaatactggagcaggttgttatactaggcaaacactctagggggtatcactacatgcttgccaacctcggatttacagacatcttactggaacgggtgatgcatggaggcgcaaatataactggtttccagatcgtcaataatgaaaaccccatggttcaacaatttattcaacggtgggtgaggctggatgagcgcgaatttcccgaagcaaaaaatgctcccctgaagtatactagcgctcttacgcacgacgccatactggttattgccgaggcctttagatatctgcggaggcagagggtcgatgtatccaggcgcggcagcgccggggactgcctggctaaccccgctgtaccctggtcccagggcattgacatcgaaagggccttaaagatggtacaggtccaggggatgacagggaatatccagttcgatacttacggccgcaggaccaactacactatagatgtttacgagatgaaagtcagcggatcccggaaggctggctattggaatgaatacgaaagatttgtcccctttagcgaccagcagatctccaatgatagcgcaagtagcgagaatagaacgatcgttgtaacgactatactggagtcaccatacgtaatgtacaagaagaaccacgaacaattggaagggaacgagcgttatgagggatactgtgtcgatttggcatacgagatcgccaagcacgtcagaatcaagtacaaactgtcgattgtcggcgatgggaagtacggggcccgtgaccctgaaaccaagatctggaacgggatggtcggggagctcgtgtacggtcgcgccgacatcgctgttgcgccccttaccatcaccctcgtgagggaagaggtaattgacttctctaaacctttcatgtctttagggatctccattatgattaaaaaacctcagaaatcaaagcctggcgtgttctccttcttggatcctctagcctatgagatctggatgtgcattgtgttcgcctatattggcgttagtgttgttttgttcctggtgagtcgattctctccctacgagtggcacctggaggataataatgaggagccgagagacccccagtcgccacccgatcctccaaacgaatttggcatttttaactctttatggttcagtctcggcgctttcatgcagcagggctgcgacatctcccctcggagcctctctggacgcatagttggaggcgtttggtggttcttcacattgatcattatttcctcttacacagccaatttggctgccttcctgaccgtggagcggatggtgtcccctatcgagtcagcggaagaccttgccaagcagactgagatcgcatatggcactctcgattccgggagcaccaaagagttcttccggcggagtaaaatagccgtttatgagaaaatgtggagttatatgaaatccgccgagccatctgttttcacaaagaccaccgcggatggagtggcaagagtgaggaagtccaaaggaaagtttgcttttttactggagtctacgatgaatgagtacatagagcagcggaaaccctgcgataccatgaaggtgggaggtaacctggattctaagggctatggtgtggctacacctaaaggtagtgcactgagaaatgccgtgaatcttgccgtattgaaactcaatgagcaggggttgctggataagttaaaaaacaagtggtggtacgacaaaggcgagtgcgggtccggcggaggcgactcaaaggacaaaacatccgccttgtctctgtccaacgtggccggcgtgttttacatcttggtagggggcctcggcttggcaatgatggtggcattgatcgaattctgctataagtctcgagccgaatccaagcgcatgaagctgactaagaacacacagaattttaaaccagcgcccgctacaaacactcaaaactacgctacttaccgcgaagggtacaacgtatacggaactgagtctgtgaaaatatag

SEQ ID NO: 118501 - DNA, 2685 bp, Artificial Sequence
  Description of Artificial Sequence: Synthetic coding sequence
atggccagacagaagaagatgggtcagtccgttttgagggcagtattttttttagtattaggcctcttgggccacagtcacggaggctttccaaacactatatctattggaggcctgttcatgaggaacactgtacaggagcactctgcttttcgattcgccgtacagctctacaataccaaccagaatactaccgagaaaccattccacctgaactaccacgtcgatcatcttgattcatccaattctttttcagtgaccaacgctttttgtagccagttcagcaggggcgtttacgcaatcttcgggttttatgatcagatgtccatgaataccctgacaagcttctgcggcgctctgcacacgtccttcgtcactccttccttccctactgatgcggatgttcagtttgttatacaaatgagacctgccctcaaaggcgccattctctctcttctgggacattacaagtgggaaaagttcgtgtacctgtacgatacggagagaggattcagcattctgcaggcgattatggaggccgccgtgcagaataactggcaagtcacggcccgaagtgttgggaatatcaaggacgtgcaggaatttcgacggatcattgaggaaatggacagaagacaggagaaaaggtaccttatcgattgtgaggtggaacgcataaacacgatcctggaacaagtggtgatcctgggaaagcattccagaggataccattatatgttagctaatctgggcttcaccgatatccttttggagcgggtaatgcatgggggcgctaatatcacgggatttcaaatagtgaacaacgaaaaccctatggtgcagcagtttattcagagatgggttaggttagatgaacgggagtttcccgaagccaagaatgctccactgaaatatacttcagccctgacgcatgatgctatcctagtgattgccgaagcttttcggtacctacgccgtcagagagtggacgtaagcaggcgcggaagcgccggtgattgcctggccaaccccgctgtgccttggtcccaggggattgacatcgaacgggctctgaaaatggtacaggtgcagggtatgaccgggaatatccaattcgacacatacggtcgtaggactaattacacaattgacgtgtatgaaatgaaagtgtcgggctccagaaaggcaggttattggaacgagtatgagcggttcgtgccattttcagatcagcagatcagtaatgactcagcttcctccgagaataggaccatcgtggttactactatcttggagagtccctacgtaatgtacaaaaagaatcacgaacagctggagggcaacgagagatacgaaggctattgtgtagaccttgcatacgaaattgctaaacatgttcgtattaaatacaagttgtctatagtcggtgacggcaagtatggagccagggatccggagacaaaaatctggaacgggatggtgggagaactggtatacggaagagccgacattgctgtggccccactgacaatcactctcgtgagggaagaagtgatcgatttctcaaagcctttcatgtcgttgggaatatccatcatgattaaaaagccacaaaagagcaagcccggagtattcagtttccttgaccctctcgcatacgagatttggatgtgcatcgtgtttgcatacatcggcgtgtccgtggtcctgtttctggtgtcaagatttagcccctacgagtggcatttggaagacaataacgaagaaccacgcgaccctcagtctccaccagaccccccgaatgagtttgggatctttaactccttgtggttttccttaggagcattcatgcagcaggggtgtgatatctccccacgctctctctccggccgcatcgtggggggcgtttggtggttcttcaccctgattatcattagctcctacactgctaacctagctgccttcttaactgtcgagcgaatggtttctccaattgaatctgccgaagatcttgccaaacagaccgagatcgcctatggaaccttggacagcggatcaaccaaagaattttttcgcagaagtaaaattgccgtttatgaaaagatgtggagctacatgaagtcggctgagcccagtgtgtttacaaaaaccacagcagatggcgtcgcacgggtgaggaaatccaaagggaagtttgcttttctgctcgaatcaaccatgaatgaatatattgagcagaggaaaccctgcgatactatgaaggtgggagggaatctcgatagcaagggctatggcgtagctactccaaagggatccgcactcaggacacccgtgaaccttgctgtgctgaaactgtctgagcagggaattcttgacaagcttaaaaacaagtggtggtatgacaaaggggagtgcggagctaaggattcaggttccaaggataagacgtccgctctttcactatccaatgttgcgggggtattttatattctcgttggcggcttggggctggccatgatggtagcgctgattgagttttgttacaaaagtagggccgagagcaaaagaatgaaattgacaaagaacacccaaaattttaaaccagcccccgccactaatacacagaactatgcaacttatagggaggggtataatgtgtacggaacagaatccgtgaagatctag

SEQ ID NO: 118502 - DNA, 495 bp, Artificial Sequence
  Description of Artificial Sequence: Synthetic coding sequence
atggcccgacagaagaaaatggggcagtctgtgctccgcgccgttttttttctggtattggggctcttggggcactcccatggaggattccccaacactataagtatcggcgggctatttatgagaaataccgttcaggagcattctgcctttaggtttgccgttcagctctataacactaatcaaaacaccacagagaagcctttccacctgaattaccatgtcgaccacctggacagctccaactccttctcagttaccaacgcgtgccctgccgagagagattacctgccctggcctggcagcattagggaaaacaattggacagccctcccttgttgcaaggaccacggtttactgcacctaaagtgttctccgggagggccggctaagaccggacccatagtctccggggcactgcaagtgaattgtaagatgagaacacggtcccaagtttctacaacttcctcgttactggagtttagtacggagtag

SEQ ID NO: 118503 - DNA, 495 bp, Artificial Sequence
  Description of Artificial Sequence: Synthetic coding sequence
atggctaggcaaaaaaagatgggccagagcgtgctgagggcagtcttcttcctggtcctgggcctcttgggccactcacacggagggtttccgaataccattagtatcggcggcctgtttatgaggaatacagtccaggagcatagcgcttttagattcgctgttcagttgtataatacaaaccagaacacgacagagaagcccttccacttgaattatcacgtagatcatcttgatagttctaattcctttagcgtgactaatgcctgtccagccgagcgcgattacctgccatggcccggatctattcgcgagaataactggacggcccttccctgttgtaaggaccatggactgctccacttgaaatgtagcccgggcggtccagccaaaaccggtccgattgtgtcaggagctctgcaggtgaattgtaaaatgagaacacgttcacaggtgagtaccacctcatccttactggaattctctactgagtag

SEQ ID NO: 118504 - DNA, 1989 bp, Artificial Sequence
  Description of Artificial Sequence: Synthetic coding sequence
atgctgcagggaggcgaggaatccagacttttcgggtctctgctttggactctgccatggcgagggcttttcatgcgaaacaccgtacaggaacacagtgctttccgcttcgccgtgcagctgtacaatacaaaccagaacactaccgagaaacctttccacttgaactatcacgtggatcatttagactctagcaactcgttcagtgtgacaaacgcgttctgcagccagttctcccggggagtgtacgccatttttggcttttacgatcaaatgtctatgaatacgttaacaagcttttgcggtgctctccatacctcattcgtcacgcctagctttccaactgatgctgacgtgcagttcgtcatacagatgaggcccgcgctgaagggcgctattctcagcctcctgggtcactacaagtgggagaagtttgtatacctctatgataccgagagaggtttcagcattctccaagccattatggaggccgccgtgcagaataactggcaagtgactgctagaagcgttggtaacatcaaagacgttcaggagttccgccgcatcattgaggagatggataggagacaagaaaaaaggtacctcattgattgcgaagtggaacggattaatactatcctggagcaggtggtgatactgggcaaacactcacgaggatatcactatatgttggcaaatctgggatttactgatatattacttgagcgcgtgatgcacggcggcgcaaatattacaggattccagatagtgaataacgaaaacccgatggtacaacagtttattcagcgctgggtccgactcgatgaacgagaattccccgaggcaaagaacgcgcccctgaaatatacgagtgccctgacacatgacgcaattcttgtgattgccgaagcttttagatacttgagacgccagcgcgttgacgtatcccgacggggctccgccggtgactgtctggccaacccggccgtcccttggagccagggcattgatattgaacgggccttgaagatggttcaggttcagggcatgactggtaatatccagtttgacacatacggtcgccgcactaattacacaatcgacgtgtatgagatgaaggtgtccggttcacggaaagctggatattggaacgaatacgagcgatttgtgccattttccgaccagcagatctccaatgattctgcctcctctgaaaaccggactatcgtggtgacgactattttggagtctccttatgtgatgtataaaaaaaaccacgaacagctcgaagggaatgaaaggtatgagggctactgtgtggacctggcatatgagatcgcgaagcacgtgcgcataaaatacaagttgtccattgtgggtgatggaaaatacggcgctagagacccagagaccaaaatttggaatggaatggtcggcgaattggtgtacggtcgagctgatatagccgtcgcccccttgacaattacactcgtgcgagaggaggttatcgatttctctaagccattcatgtcattgggcatttcaattatgataaagaaaccccagaagtccaagcctggtgttttttcatttcttgatcccctcgcctatgaaatctggatgtgtatcgtctttgcatacatcggagtatccgtcgtgcttttcctggtctctaggttcagcccttatgaatggcatttggaagataacaatgaggagcccagggaccctcagagcccaccagacccccctaacgagttcgggatcttcaactccctttggttctcccttggcgccttcatgcaacaaggatgcgacatctcgccaaggtttgtttttgtcgcatattcaatgccccattgcatactttggtcgtactccatacacgtacatatggtgtttatccatcttaactctagattcttctcctttaacatcccttccaacgatcgtcttagctctagccattgcgtgtgtttgtgcccatag

SEQ ID NO: 118505 - DNA, 2475 bp, Artificial Sequence
  Description of Artificial Sequence: Synthetic coding sequence
atggcccggcagaagaaaatggggcaaagcgtgctgcgtgccgttttttttctagttctaggactgcttggccatagccatggcggatttcctaatacgattagtatcggtgggctattcatgaggaatactgtgcaggaacatagcgctttccggttcgctgttcagctgtataacacaaaccagaataccactgaaaaaccttttcatctcaactaccatgtcgaccacctggactcaagcaattcattctccgtgaccaacgccttctgttctcaatttagcagaggcgtctatgctatttttgggttctatgatcaaatgtccatgaacacactgaccagcttctgtggagctctccacacaagttttgtaacaccatctttccctacagacgccgatgtccagttcgtgattcaaatgagacccgcgctcaagggggctatcctatcgctcttaggacactataagtgggagaagttcgtttacctatatgacaccgagcgcggattttcaattctgcaggccatcatggaggccgccgtccagaacaactggcaggtgactgcgcggtccgttgggaatataaaagacgtgcaggaattccgacgcattattgaagagatggaccgccgtcaggagaagcgttacctgatcgactgtgaagttgaaagaattaatactatactggagcaggttgtcatcctcggcaagcattcacggggataccattatatgctcgctaaccttggattcacagatatcttactggagagagtgatgcatggtggcgcaaatattaccggcttccagattgtcaataatgaaaatcctatggtgcagcagttcatccaacggtgggtgcgactcgatgagcgcgagttccccgaagccaaaaacgctcccctgaaatacactagcgccttgacacatgatgcgatattggtgattgctgaggcatttcgatatctgagacgacagcgggtcgacgtgtcacgtcggggctctgcaggagactgtctggctaatccggctgtcccctggtcccagggaatcgacatcgagagagccctgaaaatggtgcaggtgcaagggatgaccggcaacatacagttcgacacatacgggcgccgaactaactacacaatcgatgtatatgaaatgaaagtaagcggctcacggaaagctggatactggaatgaatatgaaaggtttgtaccgtttagtgaccagcaaatctcaaatgatagcgcttcaagcgaaaatcggactattgtggtcacaactatcttggagtccccttacgtgatgtacaagaagaaccatgagcagctcgaggggaatgaacggtacgaagggtactgtgtcgacctggcttatgagatcgctaaacatgtgagaataaagtataagctgtccatcgtcggagatggcaagtatggcgcccgggacccagagaccaagatttggaacggcatggtaggcgagcttgtatatggaagagcagacatcgccgtcgcaccacttacaatcacactggtccgggaagaggtgattgacttttcgaagccttttatgtccttgggaatcagtattatgatcaaaaagccccagaagagcaagcctggagtcttctcctttcttgacccactggcgtacgagatctggatgtgcatagtcttcgcctacattggcgttagcgtggtactgtttttggtaagcaggttcagtccttatgagtggcacctggaggacaataatgaggaacctagagacccacagtcaccacccgaccctcccaacgagtttggaatctttaattccctttggttctccttaggcgcgttcatgcaacaaggttgcgatatatcgcctcgctcacttagtgggcggatcgttggcggcgtttggtggttcttcacactcatcattatttcgtcctacaccgcaaacctggccgcttttttgacagtggagcggatggtctcccccattgaaagcgctgaagatttggctaagcagacagagattgcctatgggactcttgattctgggtccactaaggagttcttccgacgatctaaaatcgccgtgtatgagaagatgtggtcctacatgaaatctgcagagcccagtgtgttcacaaagactactgccgacggcgtggcccgagttcgtaagagtaagggaaagttcgcatttcttctggaatctaccatgaatgaatacatcgagcaacggaaaccatgtgatacgatgaaggtgggcggcaatctggacagtaagggctatggcgttgccactcctaagggctccgccttgcggaacgctgttaacctagcggtgttaaaactgaacgagcaggggttgctcgacaaactcaagaacaagtggtggtatgacaaaggagagtgtggaagtgggggcggtgatagcaagaacgcctgcaagccttgctcgattgaaactcagtag

SEQ ID NO: 118506 - DNA, 2709 bp, Artificial Sequence
  Description of Artificial Sequence: Synthetic coding sequence
atgcgcatcattagtcggcaaatcgtgttgctcttctcaggattttgggggctcgctatgggcgctttcccatccagtgttcaaatcggcggcctgttcatacggaatacagatcaggaatatactgcgtttaggttggccatatttctgcacaacacatctcccaacgcctctgaggcgcctttcaatctggtgccacacgtggataacatcgaaactgcgaattccttcgctgtaactaacgccttttgtagtcagtattctcgaggggtgtttgccatctttggactgtatgacaaacggtccgtccacactctgacgtcattttgtagcgccctgcatattagcctgataacgccctccttccctacagaaggggaatcgcagttcgtgctgcaactaagacccagcctcaggggtgctctgctcagcctgttagatcactacgagtggaactgtttcgtcttcctttacgacacagatcgagggtattctatccttcaggccatcatggaaaaagccggccagaatgggtggcacgtgtctgcaatctgtgtagaaaattttaacgacgtatcctatcggcagctcttagaagagctcgacagaagacaggaaaaaaagtttgtgattgactgcgagattgagaggcttcagaacattctcgagcagattgtgtccgtcggcaagcacgtgaagggttatcactatataatcgcaaacctcggtttcaaggacatctctttagaacggttcatccatggcggcgctaacgttactggatttcagcttgttgacttcaatacacccatggttattaaactgatggacagatggaaaaaacttgatcagagagagtacccagggtcagaaacacccccgaagtacacgtccgccctcacatacgatggggtgttggtcatggcggaaacattcagaagccttcggagacagaaaattgacatttctcgtaggggcaatgccggtgattgcttggcgaatcccgcagctccttggggtcaaggaattgacatggagagaactttaaaacaggtcagaattcaagggttaaccggcaacgtgcagttcgatcactacggtcgccgggttaactataccatggacgtgttcgaactgaagtctacaggcccccgaaaagtgggctactggaatgacatggacaaacttgttttgatccaggacgtccccaccctgggtaacgacactgcagctatcgagaacagaaccgtcgtggtcaccacaattatggaatccccgtacgtcatgtataagaagaatcacgaaatgtttgagggcaatgacaagtacgaaggctactgtgtggacctggcttcagaaattgccaagcacataggtattaaatacaaaatagccatcgtccctgacggtaaatacggcgcaagggatgccgataccaaaatttggaatggcatggttggggagctggtctatgggaaagctgaaattgctattgcgcctctgaccattacattggtgagggaagaagtcatcgacttttctaaaccatttatgagcctggggatctctattatgattaaaaagccacaaaagagcaagcctggtgtgttcagcttcctcgacccactggcctatgaaatttggatgtgtattgtctttgcgtacatcggagtctcggtcgttttattcctggtgtctcggttctccccgtacgagtggcacacagaagagcccgaggacggtaaggaggggccatccgatcaacctcccaacgagttcggtatctttaactctctgtggttctcactaggtgcattcatgcaacagggttgcgatatttcacccaggagtttgagtgggcggatcgtaggtggcgtctggtggtttttcactcttatcatcattagcagttacacggcaaatctggctgcgtttttgaccgtcgagaggatggtgtcacccatcgagtccgcagaggatctggcaaagcagaccgagatcgcttatggaactcttgatagtgggtctactaaggagttcttccggagatctaaaattgcagtgtacgagaaaatgtggacgtacatgagaagcgcggagccctctgtttttacaaggactacagcagaaggagtagctcgcgtgcggaagtctaaggggaagttcgctttcctgctggaaagcacaatgaatgagtacattgaacagaggaaaccctgtgataccatgaaggttggggggaatctcgactctaagggatatggagtggcgacgcccaaggggagcagtctccgcactccggttaatctggccgtcctgaagctgtccgaggcaggcgtgctagacaagctcaaaaacaaatggtggtacgataagggcgagtgcggacctaaagatagcggctcaaaggacaagacatccgcactgtcactgtcaaatgtggcgggagtcttttacattttagttgggggtttaggcttggccatgctggtggcactcattgagttctgttacaaatcaagagcggaggcaaaacgcatgaaactgacattctctgaggctattaggaataaggcaagactctcgatcactggctcggtgggcgaaaatggccgcgttttgacacccgactgtcccaaggccgtgcataccgggacggccattcgtcagtcctccggacttgctgtgatcgctagcgaccttccatag

SEQ ID NO: 118507 - DNA, 1302 bp, Artificial Sequence
  Description of Artificial Sequence: Synthetic coding sequence
atgagaattatttctagacagattgtgctgctgttctcaggtttttggggccttgcgatgggggctttcccatcctctgttcaaataggtggcctgttcatcagaaacacagaccaggagtacaccgcctttcgactagcaatctttttgcataatacatcacctaatgcttcagaggcacccttcaacctggttccacacgtcgataatatcgagaccgcaaacagcttcgccgtcaccaacgccttttgtagccaatattcacgcggcgtattcgccatctttggtctttatgataagcgctcagtgcatacactcacaagcttttgcagcgcgctgcatattagcctgataactcccagtttcccgactgagggggagagccaattcgtactgcagctccggccatctctcagaggcgcgctgctgtcactcctggaccactacgaatggaattgttttgtgtttctctatgacactgaccgaggctatagtatcctgcaggctattatggagaaggcaggtcagaatgggtggcacgtgtcggcaatctgcgtggagaatttcaatgacgtatcgtaccggcagttactggaggagttggacaggaggcaggaaaagaagtttgtcatcgactgtgaaatagaacgactccagaacatcttggagcaaatagtttccgtgggtaagcacgtgaaagggtatcactacatcatcgcaaatctagggttcaaagacattagtctagagcgttttatccacggcggggccaatgtgaccggatttcagctggtggacttcaacactccaatggttatcaagctgatggacagatggaagaagcttgaccagcgggagtatcccggatccgaaaccccacctaaatatacatcggcgttgacttacgatggggtgctggtcatggctgaaactttcaggagcctccggaggcagaaaatcgatatcagccggaggggcaatgcgggtgattgtctggccaaccctgcagcgccgtggggtcaaggtatagatatggagaggaccctgaagcaggtgcgaatccaggggctgactggaaatgtgcaattcgaccactacggtaggcgggttaattatacgatggatgtgttcgagctcaagagcaccggccccagaaaggtgggatactggaacgatatggataaactggtgctgatccaggacgtcccaaccctggggaacgacactgccgctatcgaaaaccgtacagttgtcgtgaccacgataatgccattaatgaagaatcccattctgaggaattag

SEQ ID NO: 118508 - DNA, 2655 bp, Artificial Sequence
  Description of Artificial Sequence: Synthetic coding sequence
atgaggatcatctcccgacagattgtgctactgttttcgggcttctgggggttggccatgggtgccttcccctcttccgtgcaaatcggaggactgttcattaggaatacagatcaggagtacactgcattccggctagcgatcttcctacacaacaccagtcccaatgcatccgaggccccctttaacctggtgcctcacgttgataacatagaaaccgcaaactcttttgcagtcacaaacgcattttgctcacagtactcacgcggcgtgttcgccatcttcggactgtatgacaaaaggtccgttcacaccctgacatctttttgtagtgcattacacatcagcttgattaccccctccttcccaaccgaaggagagagtcaatttgtcctccagttgcggccgtcccttcggggggctctgctctctcttttagaccattacgagtggaattgcttcgtctttttgtacgataccgacagaggctattctatcctgcaagccatcatggagaaggccggtcagaacggctggcacgtgtccgcaatttgtgtggagaactttaatgatgtttcttaccgtcagctcttagaggaactcgataggcggcaggagaaaaagttcgtgatcgactgtgaaattgagcgtcttcagaacatcctggagcagatcgtctccgttggcaaacatgtgaaaggataccattacatcatcgcgaatctgggcttcaaagacatctctctggaacgtttcatccacggcggtgccaacgtgactggctttcaactggtggacttcaacactcccatggtcataaagttgatggacaggtggaagaagctggaccagcgcgaataccctggatctgaaacaccaccaaaatatacaagtgcactgacctacgacggcgtcctggttatggctgagactttccggtccctaagaaggcagaagattgacatctcaagacggggcaacgcaggcgattgcctggcgaacccagccgcaccttggggccaaggtatcgacatggaacgtactctgaagcaggtgagaatccagggcttgaccggcaatgtgcaattcgatcattacggtcgacgggtcaactatacaatggacgtgttcgagctgaagtcaacgggcccccggaaggtcggatattggaatgacatggacaaacttgtactgatacaggacgtgcctactctgggaaatgatacggcagcgattgaaaacagaacggtagtagtgacaaccatcatggagagcccttatgtcatgtataagaagaatcatgagatgtttgagggtaacgataaatacgagggatactgcgtggacttggcatcagagatagcaaaacacatcggcatcaagtacaagatcgcaattgtgccagatggcaagtacggtgcacgggacgccgacacaaagatctggaatggcatggtgggggagttggtgtatgggaaggccgaaattgccatcgcccccctgaccattacgttggtcagggaggaggtgatcgacttcagcaaacccttcatgtctctgggaatcagtattatgatcaaaaagccccagaagtctaaacccggggttttctccttccttgacccgttggcctacgaaatctggatgtgtatcgttttcgcatacatcggggtgtcggttgtactgttcttagtcagtaggttttcaccgtatgagtggcatactgaagaaccggaagatggaaaagagggccccagcgaccagcctcctaatgaatttgggatattcaattccctttggtttagtctcggagctttcatgcagcagggctgtgatatctccccccggtcactttcagggcgaatcgtcgggggcgtttggtggtttttcacgctcataatcatttcaagctatactgctaaccttgccgcctttctcacggtggaaaggatggtgtccccaatagaatcggccgaggacttggctaagcagactgagatagcatatggtacactggatagcggttccacaaaggaattttttcggcggagtaaaatcgccgtctacgaaaagatgtggacatacatgcgtagcgcggaacctagtgtgtttacacgaaccaccgcagagggagtggcgagagtgagaaagtcaaaagggaaattcgcctttctgctcgaatctaccatgaatgagtacatcgagcaacggaagccgtgcgatactatgaaggtcgggggcaacctcgacagcaagggttacggcgtcgcaactcctaaaggtagttctctgcggaacgccgtgaacctggctgtgctgaaattaaacgaacaaggactgttggacaagctgaaaaacaaatggtggtacgataagggcgagtgtgggtcaggcgggggtgattcaaaggataaaacatccgctttatcgctgagtaacgtggctggagtattttatattctggtgggggggctgggcttagccatgctggtggctttgatcgagttctgttacaaatcccgggcagaagctaagagaatgaaagttgctaaatctgcacagacatttaaccctacgtctagccaaaatacccaaaacctggcaacttaccgcgaaggttataatgtgtatggaactgaatctatcaaaatatag

SEQ ID NO: 118509 - DNA, 1302 bp, Artificial Sequence
  Description of Artificial Sequence: Synthetic coding sequence
atgaggattatctcacggcagatcgtgcttctgttttcaggcttttggggcctcgccatgggagcttttccttcgagcgtccaaatcggcggattatttatccgtaatactgatcaggagtatacagcttttcgacttgctatttttcttcacaacacgtccccgaatgcctcagaggctccattcaatctggtcccacatgtagacaacatagagaccgccaacagcttcgcagtgaccaatgcgttttgctcccagtactctaggggggtttttgcaatctttggcctctacgacaagagaagtgtgcacacactgacctccttttgcagcgcgcttcatatatccttaatcactccgtctttccccacagagggcgagagccagtttgtgcttcagctacggccaagcctgcgtggcgcactgttaagccttctggaccattatgaatggaactgctttgtcttcctatacgacactgatagaggatacagtattctgcaggctataatggagaaagccggacagaacggatggcacgtatctgctatctgcgtcgaaaacttcaatgacgtttcttacagacaactgctggaggagttggataggagacaggagaagaaattcgtaatcgattgtgagatcgagcgcttacagaacatcctggaacagatagtgagtgtggggaaacacgtgaaggggtatcactacataattgccaatctcgggtttaaggatatatcccttgaaagattcatccatgggggcgccaacgtaacaggattccaactggtggattttaacacacctatggtgatcaaactaatggatagatggaagaagctcgaccaaagggagtaccctgggtctgagacccccccgaagtataccagtgccctcacctacgacggcgtattagtaatggccgagacctttcgatctcttcggcgccagaagattgatatcagcaggcgcgggaacgctggggattgcctcgctaatcccgccgccccttggggccagggcatcgacatggaaaggactctaaaacaagtcagaatccaggggttaactggcaacgtgcagtttgatcattatggtcggagagttaattataccatggacgtgtttgaattaaaatctacaggtccacggaaggtgggctattggaacgacatggataaattggttctaattcaggatgtacctactctgggcaacgacacagctgccatagagaatagaacagtcgtagttacaactattatgcctctgatgaaaaacccaatactgcggaactag

SEQ ID NO: 118510 - DNA, 2655 bp, Artificial Sequence
  Description of Artificial Sequence: Synthetic coding sequence
atgcgcatcatatcgaggcagatcgtcctcttattctccgggttttggggcttggccatgggagcttttccatcttcagtgcagatcggcggactgtttatacgaaatactgaccaggagtacacagccttcaggcttgctatctttttgcacaacacatcccccaacgctagtgaggccccgttcaatctcgtgcctcatgttgataacatcgagacggccaactctttcgcagtgactaatgccttttgctctcagtactcccgtggggttttcgccatctttggcttgtacgacaagaggtccgtccatacactgactagtttttgtagtgctctgcacatctccctcataacgcctagttttcctaccgagggtgaatctcagtttgtcctccagttgaggcccagcctgagaggcgctttattgtcccttctggatcactacgagtggaactgcttcgtgttcctctatgatactgataggggctattcaatcctgcaggcaattatggagaaggccggccagaacgggtggcacgtgagtgctatctgcgtcgaaaacttcaacgatgtgtcctacagacagctgctggaagagctggatcggaggcaggagaaaaagtttgttattgactgcgagatcgagagactgcaaaacattctggagcagattgtctctgtagggaagcacgttaagggctaccattatattatcgctaaccttggcttcaaagacatctccctggaacgattcattcacggcggtgctaatgtcacggggtttcaactggtcgacttcaatacgcccatggtcattaagcttatggataggtggaaaaaattggaccagagggagtacccaggcagcgaaacgccacccaagtacacttcagcccttacctacgatggagtgttagtgatggcagagacctttagatcactacgacgtcagaagattgatatcagccgtcgcgggaacgctggggattgcctggcaaatccagccgcgccctggggtcagggtattgacatggagcgcactctgaagcaagtgcgcattcagggactgaccggtaacgtgcagttcgaccactatggacggcgtgttaactacaccatggatgtgttcgagctaaaaagcacaggtcccaggaaggtaggatactggaacgatatggacaagctagtgttaatccaggatgtccccaccctgggtaatgatactgccgctatagagaatcgcaccgtcgtcgtgacaacaattatggaatctccatacgtgatgtacaagaaaaaccacgaaatgtttgagggcaacgacaagtatgagggctactgtgtcgacctagcatctgagattgctaagcacattggtatcaagtacaagatcgctattgtgcccgatggcaaatacggcgctagggacgcggacaccaagatctggaacggcatggtgggtgagctagtgtatggcaaggcagagatcgccatagccccgctcacaattaccctggtcagggaggaggtgatcgatttttcaaagccgttcatgagtctcgggatctccattatgatcaagaagccccagaaatctaaacccggcgtcttctctttcctggaccccctcgcttacgagatatggatgtgcattgttttcgcatatattggtgtttccgtcgtgttgtttctagtgtcaaggttcagcccatatgagtggcacacagaggagcctgaagacgggaaagaaggcccctctgatcagccccccaatgagtttggaatattcaactctctgtggttctctctcggagccttcatgcagcagggctgtgatattagccctcggtccctgagtgggcgtatagttgggggcgtgtggtggttctttaccctgatcatcatttcaagttacactgcaaacctggctgccttcctgacggtggaaaggatggtctccccaatcgagtccgctgaggacctcgctaagcagactgagattgcctacggcaccctggactccggaagcaccaaggagtttttcaggcgcagcaagatcgccgtctacgaaaagatgtggacctacatgcggagcgccgagccatccgtgtttacccgcaccactgcagagggggtggcccgagtcagaaagtccaagggaaagtttgccttcctgttagaaagcaccatgaacgagtacattgagcagcggaaaccttgcgacactatgaaggtcggcggcaacctcgatagtaagggttacggcgtggctactccaaagggctctagcctgaggaacgctgtcaacctagctgtcctgaaactcaacgaacaaggcttgctggacaaactgaagaacaaatggtggtacgacaaaggcgagtgcgggagtgggggaggtgacagcaaggataaaacaagtgctctttcgctgagcaatgtggccggggtcttctatatcctcgtcggagggttaggactggccatgctggttgccctcatcgaattctgctacaagagtcgcgccgaagctaagcggatgaaagtggccaaaagtgcccaaacatttaatccgaccagctctcagaacacccagaacctagccacgtatcgagaagggtacaacgtatacggtaccgagtccatcaagatatag

SEQ ID NO: 118511 - DNA, 249 bp, Artificial Sequence
  Description of Artificial Sequence: Synthetic coding sequence
atgcggatcatctcacggcagattgtcctattgttttccggtttttggggactggccatgggagctttcccttcttcggtccaaataggtggactttttatcagaaacaccgaccaggagtacactgccttcagactggccatctttctccataacacctcgcccaacgcctctgaagccccatttaatttggtgccccacgttgacaatattgaaacagctaattctttcgctgtcaccaatgcttag

SEQ ID NO: 118512 - DNA, 249 bp, Artificial Sequence
  Description of Artificial Sequence: Synthetic coding sequence
atgcgcatcatttctaggcagattgtactgctgttttccgggttctggggattggccatgggcgcttttcctagcagcgtccagataggcggtctgttcattagaaacacagatcaggaatacactgccttccggctagccattttcctgcacaatacgtctccaaacgccagcgaagccccatttaatttagtgcctcatgttgacaacatcgagactgccaactcatttgccgtcactaatgcgtag

SEQ ID NO: 118513 - DNA, 2709 bp, Artificial Sequence
  Description of Artificial Sequence: Synthetic coding sequence
atgagaattatctcacggcagatcgtgctcctcttttccggcttctgggggctggcaatgggggcctttccttcatcagttcagataggaggactctttattaggaatacagatcaggagtataccgccttccgactcgctatcttcttgcacaacacgtcgccgaacgcctctgaagcccctttcaatctggtcccccacgtggacaacatcgagactgcaaatagctttgctgtgacaaacgcgttttgcagccagtactcacggggagtgttcgcgatttttggcctgtatgataaaaggtctgtgcatactctgacatcgttttgtagcgctcttcacatctctctgattacaccatccttcccgacagaaggggaaagtcagttcgttctccaactcaggccaagcctaagaggggctctcttgagcctgttagatcactacgagtggaattgctttgtatttctctatgataccgacaggggctacagtattctacaagcgataatggagaaggctggccagaacggttggcacgtgagcgctatttgcgtagagaacttcaacgacgtgtcttacaggcaactgctcgaagaactcgatcggcgccaggagaaaaaattcgtgatcgactgtgagatagagaggctgcagaacattctcgaacagatcgtttcagtgggcaagcacgttaaaggttatcactacataattgcaaatttgggattcaaggacatttctcttgaacggtttattcatggcggcgccaatgtgacaggctttcaactggtggattttaacacccctatggttatcaagctcatggaccggtggaaaaagctcgaccagcgtgagtaccctggatccgagacacccccaaagtatacatctgcattgacctacgatggggtgttagtcatggccgagacttttcgatccctgaggagacagaagatagacatctccagacggggaaacgcaggcgactgtctggctaacccagcagccccctgggggcaggggatcgacatggaacgcaccctcaagcaagtgaggattcaggggttgaccggaaacgtccagtttgaccattacggccggcgagtaaattacaccatggacgtgttcgagctgaaatcgacgggccccagaaaggttgggtactggaacgacatggataagctcgttttaattcaggatgtccctaccctgggtaatgacacagccgcgatcgagaataggacagttgtggtgactaccatcatggaatccccatacgttatgtataaaaagaaccacgagatgttcgagggcaatgataagtacgaaggttactgtgtagacctggcttcggagatagccaaacatattggcataaagtataagattgccattgtgcctgatggcaagtatggtgcccgcgatgcagatacgaagatctggaacgggatggtgggcgaactggtctacggtaaggcagaaattgcaatcgctcccctgaccataaccctggttcgggaggaagtgatcgactttagcaagccattcatgtccctgggaatcagtattatgataaagaagcctcaaaagtccaagcccggagtattttcctttctggaccccctggcttatgagatctggatgtgtatagtctttgcctacattggcgtgtcagtggtgttgttcctggtgagccggttttcgccgtatgagtggcacactgaggaacctgaggacggtaaggagggtcccagtgaccagccacccaatgagttcggaatattcaattccctgtggttcagcttaggggcatttatgcagcaaggatgtgacatctctccccggtctctctccgggagaatcgtaggcggcgtgtggtggttctttaccctgatcatcatcagttcctacacagcgaacttagccgcctttctgaccgtagaaagaatggtatcaccaattgagtcagcagaggatctggccaagcagactgagatcgcctacggcactctggattctggtagcactaaagaattcttccggcgaagtaagatcgcagtgtacgagaagatgtggacttacatgcggtcagctgagccatccgtgtttacgcggactacagccgaaggggtcgccagagtaagaaagtccaaaggcaagtttgcttttctgcttgagtccaccatgaatgagtacattgagcaacggaagccctgcgacacaatgaaagtgggcggaaatctggactcgaagggatacggagtggctactcctaagggcagtagtctgcggacacctgtcaatttggccgtactcaagctgtcagaagccggtgtcctcgacaaactgaaaaataagtggtggtacgacaaaggcgaatgcggccctaaggactccgggtcaaaagacaagacatccgctttgtcactcagtaatgtggcaggtgtgttctatatccttgtgggcgggctgggactggcaatgctcgttgccctcatagagttctgctataagtccagagccgaagccaagaggatgaagctaacattctcggaggcaatcaggaataaggcccgacttagtataactggatccgtgggagagaacggaagagtcctcacgccggattgtcctaaggcagttcacacagggacggcaatacgccaaagctctgggctggcagttattgcatcagatctgccatag

SEQ ID NO: 118514 - DNA, 360 bp, Artificial Sequence
  Description of Artificial Sequence: Synthetic coding sequence
atgcgttcagcagagccatccgtcttcacacgaaccaccgcggagggcgtggccagagttaggaaatcgaagggaaaattcgcctttctcttggagtctactatgaacgaatatattgaacagcggaagccctgtgatacaatgaaggtgggtggtaacctggatagtaaaggttatggggtggcaacccccaaggggagcagcctgcggaatgcagtaaacctggctgttctgaagcttaacgagcagggccttctggacaaactgaagaacaagtggtggtacgataagggtgagtgtggctctggaggcggggacagtaagaatagctgcaaaccttgtcggtttgaaacacaatag

SEQ ID NO: 118515 - DNA, 2721 bp, Artificial Sequence
  Description of Artificial Sequence: Synthetic coding sequence
atgcagcatatctttgcctttttttgtaccggctttctgggagccgtggttggtgccaatttccccaacaacattcagatcggcggactttttcctaatcagcagtcacaggaacatgctgcttttagatttgcattgtcccagcttacagagccaccgaagcttctgccccagatcgacatcgtaaatatttcagactcatttgaaatgacataccgcttttgttctcagttttcgaaaggtgtatatgccatctttggcttctatgaaagacgaactgtgaacatgttgacctccttctgcggtgccctgcacgtctgctttatcacaccctccttccccgtagacacatccaatcagtttgttttgcagttgcgacccgaactgcaggatgcactgatctcaattatcgatcattacaaatggcagaaatttgtgtatatctacgatgccgatcggggtctgtcggtcctgcagaaagtgctagatacagcagcggagaaaaattggcaagtgacggccgtaaacattttaacaaccaccgaggagggttacagaatgttgtttcaagacctcgagaagaaaaaagaaagactggttgtggtggactgtgagtcagagcgccttaacgccatactagggcaaataatcaaactggagaaaaacggaattggctatcattacatcctggctaacctgggctttatggacattgatctaaataaatttaaggagtctggcgccaacgtcaccgggttccagcttgtaaactatactgataccatccctgcgaagattatgcagcagtggaagaacagtgatgcccgcgaccacacgcgcgtggactggaagcgcccaaagtatacctcagccctgacctatgatggtgtgaaagtcatggcagaggcctttcagtcactgcgaaggcaaagaatagatatctctcgacgagggaacgcaggagactgcttggcaaaccccgccgtgccttgggggcagggcatcgatatccagagggccttacaacaggtgcgatttgagggcttgacaggaaatgtccagttcaacgaaaagggtcgcagaaccaattacacactacacgtgatagaaatgaaacatgacgggataaggaagatcggctattggaacgaagatgataaattcgtgccagcggcaaccgatgcccaggctggcggggacaacagttcggtacagaataggacatacattgtcacaacaatactagaagacccatacgttatgctgaaaaagaatgccaatcagttcgaggggaatgaccggtatgagggatattgtgtcgaactggctgccgaaatagctaaacatgtcggatactcgtataggctggagatcgtctcagacgggaaatatggtgcaagggacccagacacaaaagcctggaacggtatggtgggtgagcttgtttatggtagggcggacgtggcagtggccccactgaccatcaccctcgtgagggaggaggtcatcgactttagtaagccatttatgtctctcggtatctctattatgatcaaaaaaccacagaaatccaaacctggagttttttcctttcttgatcccctcgcgtacgagatatggatgtgcattgtttttgcatacatcggcgtttcagtggtactcttcttagtcagccgcttctcaccctatgagtggcactcggaagagtttgaagagggacgggaccagactacttccgaccagagcaatgaattcggaatattcaattctctgtggttttctctgggagcttttatgcagcagggatgtgatatctctccacggtctctttctggtcgtatcgtgggcggagtctggtggttctttaccctcattatcatctcttcttataccgctaatctcgccgccttcctgaccgtcgagaggatggtctctccaatcgagtccgcagaggacttagctaagcagacggagatcgcttatgggaccctcgaagccggcagcactaaggagttttttcgcaggtctaaaatcgcagtgtttgagaagatgtggacctatatgaagtctgccgaacccagtgtattcgtgcgcacgacagaggagggtatgatccgtgtgcggaagagtaaaggtaagtatgcctacctcctggagtctaccatgaacgagtacattgaacagcgcaagccatgcgataccatgaaggtcggcgggaacttagactcgaaaggctatggcattgcaactccaaaaggctcagccctccggaaccccgtcaacctcgccgttctgaaactgaacgagcagggcctacttgacaagctgaaaaacaagtggtggtatgacaagggcgaatgtgggagtggggggggcgacagcaaagataagacctccgccctcagtctttctaacgtggccggcgtattctacatcctgatcggggggctgggactcgccatgctggtggcactcattgaattttgctacaagtccagatccgagagcaaacgcatgaaaggattctgtttgatcccacaacagagcatcaacgaggcgatccgcacgtccactttgccacggaattccggagctggggcatccagtgggggatccggggagaacggtcgcgtggtgtcccatgactttccgaaatccatgcagagtattccttgcatgtcccactccagcgggatgccactcggagcgacgggactctag

SEQ ID NO: 118516 - DNA, 2721 bp, Artificial Sequence
  Description of Artificial Sequence: Synthetic coding sequence
atgcaacacatttttgcgttcttctgtacgggatttctgggtgctgtagttggggcaaacttcccaaacaacatccagattggcggactctttcctaaccagcagagccaggagcacgctgctttcaggtttgcactgtctcaacttaccgaacccccgaagctgctgccacagattgacattgtcaatattagtgatagcttcgagatgacctatcggttctgcagtcagtttagcaagggcgtttatgccattttcgggttttatgagcggagaacagtgaacatgctgaccagcttctgcggcgccctccacgtctgcttcattacaccctcctttcccgtcgatacgtcaaatcagttcgtgctccagctgcgccccgagctgcaggacgccctaatcagtatcattgaccactacaaatggcagaaatttgtgtacatatacgatgctgaccgggggctgtccgtgctccagaaagtcctggacaccgctgccgagaagaactggcaggtcacagcagtgaacatattgacaaccacagaggagggttaccggatgctcttccaggacctggaaaagaaaaaggagagactggtggtcgtcgactgcgagagtgagaggctgaacgccatcctgggtcaaatcattaagctagagaaaaacggaatcgggtatcactatattctggcaaaccttggattcatggacatcgacctaaacaaattcaaagagagtggagcaaatgtcactggatttcagctcgtgaactataccgacacaatccctgcgaaaatcatgcagcagtggaaaaatagcgacgccagggaccacacgagggtggattggaagagaccaaagtatacttctgccctgacctatgacggggtgaaggtcatggcagaggccttccagtcgctgcgtagacagagaatcgatatcagccgtagagggaatgccggcgactgcttggccaatcccgctgttccatggggtcaaggcatcgatattcagagggcgctacagcaggtaagatttgagggtcttactggtaatgtgcaatttaatgaaaaaggccggcgcactaactacaccctgcatgtgattgaaatgaagcatgacgggattcgcaagatcgggtactggaacgaggacgacaagttcgttccagcagcgacagatgcccaggcaggtggcgacaacagctctgtccagaaccgaacatacatcgtgactactattctggaggatccatatgttatgttgaagaagaatgcaaaccaatttgagggtaacgaccgctacgaaggctactgcgtcgagcttgccgccgaaattgccaaacacgtgggctatagttaccgtctggagatagtgagcgacgggaagtatggcgcaagagaccccgacaccaaagcctggaacgggatggttggagagttagtctacgggagagccgatgtggctgtcgctcccctcaccataactctcgtgcgtgaggaagtcatcgatttctcgaaaccattcatgtcactcggtatctccataatgattaaaaagccacagaaatcaaagcctggtgtgttcagctttttagaccccctcgcctatgagatttggatgtgtattgtcttcgcttacatcggcgtgtccgtagtcctgttcctggtatccaggttttccccctatgagtggcactctgaagagttcgaggagggtcgcgatcaaactacatctgaccagtcaaatgagtttggcattttcaactccctatggtttagtctaggcgccttcatgcagcaggggtgcgatatatccccgcggtccctgtccggacgcattgtaggcggtgtctggtggttttttacccttattataatcagttcttacaccgcgaacctggctgcttttctgacagttgagaggatggtgagccccatagagagcgccgaagaccttgccaagcagactgaaatcgcatatggcaccttagaagctgggagcaccaaggagttctttaggcgatccaagatcgcagtgttcgagaagatgtggacgtacatgaaatccgccgagccgagcgtctttgtgagaacaacagaagagggcatgatacgggtgcggaaatccaaaggcaaatatgcttacctgctcgagtccaccatgaatgagtatattgagcagcggaagccctgtgacaccatgaaggtgggagggaacctggacagcaaggggtacggcatagctacaccgaagggaagcgctctaagaggacccgtcaacctggctgtactgaaactgtccgagcagggagtgctggacaagcttaagtccaagtggtggtacgataagggcgagtgcggaagcaaagatagtggtagtaaagacaaaacatctgccctcagtctttctaatgtcgcgggggttttctacatcctgatcgggggcttagggttagccatgctggttgcactgatcgagttctgctataaaagtcgctctgagtcaaagagaatgaaggggttctgtttgattccacagcagtctattaacgaagctatcagaacaagcactctaccccgtaatagtggcgcaggcgcttcctccggtggtagtggggaaaacggcagggttgtatcacatgatttcccaaaatctatgcagtcaatcccatgcatgagccatagcagtggcatgccactaggtgccacaggactctag

SEQ ID NO: 118517 - DNA, 2751 bp, Artificial Sequence
  Description of Artificial Sequence: Synthetic coding sequence
atgtgttgctctacccacctcttccaacctctacagctggccgggggattagagtggccctggagtaatttgctgtgtttcctcacaccagtcaagttgcaccccgaagtttggggattgttcccgaaccagcagtcccaggaacatgctgccttccgttttgccctcagtcagctgacggaaccccccaaactcctgccacagattgacatcgttaatatatctgactcattcgagatgacctaccgcttttgttcccagtttagtaaaggggtgtacgccatattcggtttctatgagcggagaaccgtgaatatgctcacctcattctgtggggcactgcatgtctgtttcattactccctcgttcccagtcgatacctctaatcagtttgttttgcagctgaggcccgagctgcaggatgcattgatttccattattgaccactataagtggcagaagttcgtatatatctatgatgctgaccgggggttgagcgtattacaaaaagtgctggatacagccgccgaaaagaattggcaggtgacggctgttaacattcttaccacgaccgaagaaggctaccggatgctgttccaggatttggagaaaaaaaaggagcgattggtggtggtggactgcgagtctgagaggctgaatgccattttgggtcagattatcaaactcgagaagaatggcatcggataccattacatactggctaatctcgggtttatggacatagacttgaacaaattcaaggagagcggcgcaaacgttacaggattccaactggtgaactatactgacaccattccagcgaagattatgcagcaatggaaaaattctgatgcccgggaccatacaagggtggattggaagcgcccaaagtacacctccgcactcacttacgatggtgtgaaggtgatggccgaagcattccagtctttacggagacagagaatcgatatctcccgcagaggtaacgccggcgactgtttggccaaccccgctgttccctggggtcaaggcatagatattcagcgagccctccaacaggtcaggtttgagggcttgacaggaaacgtccaatttaacgagaagggcaggcggactaattacacactgcacgtgatcgagatgaaacacgatgggatccggaaaatcgggtactggaacgaggatgacaaatttgtgccagctgcaaccgatgctcaggcagggggtgacaattcctctgtacagaaccgcacctatatcgttactactatcctggaagacccttatgtaatgttaaaaaagaacgccaatcaatttgagggcaacgataggtacgaaggatattgcgtcgagcttgccgccgaaattgcgaaacatgtagggtacagttacaggctggaaatcgtgtccgacggaaagtatggcgcccgggatccagatacaaaagcatggaacgggatggttggtgaactggtctatgggcgggctgacgtggcagtggctcccttgacaatcacgctagtgagagaggaggtgatagacttttctaagccgttcatgagcctcggcatttccattatgataaagaaacctcaaaagtctaagcccggggtcttcagtttcctggatccactcgcttatgaaatctggatgtgtatcgtgtttgcttacatcggggtgagtgtggtgctgtttctggtaagcaggttttctccttatgaatggcactctgaagaatttgaagaggggagggaccagacaacgtcagaccagtccaacgagttcggcattttcaatagcctctggttcagtttgggcgcatttatgcagcaggggtgtgatatttctccacggtccctctctggaaggattgtcgggggagtctggtggttttttacattaatcatcatctctagttataccgctaatctggccgctttccttacagtggaacgaatggtgtccccgatcgagagcgccgaagatcttgcgaagcagaccgagattgcttatgggactcttgaggcaggcagcactaaagaatttttcaggaggtcaaagattgcagtttttgagaaaatgtggacttacatgaagtccgctgagccctccgtcttcgtacgaactactgaagagggaatgatccgagtcagaaagtcaaagggcaagtacgcctatttactggagagtaccatgaatgaatatattgagcaaagaaaaccttgtgacaccatgaaagtgggtggaaaccttgactccaaggggtacggcattgctactcccaaggggtccgccctgagggggccggtcaacctggcggtgctgaagctgtctgaacagggagtgctcgataagctgaaaagtaagtggtggtacgataaaggtgagtgtggatcaaaggactccggctcaaaggataagacctccgcacttagtctgagtaacgtcgccggggtgttttacatacttattggaggactcggactagccatgttagtagcccttattgagttttgctataaatcccgctctgaaagcaaacggatgaaaggattttgtctgattccccagcagtccattaacgaagccatacgcacgtctactcttccacgaaacagcggcgctggagccagctctggtggctccggagaaaacggcagggtggtgagccacgacttccctaagagcatgcagagcatcccctgcatgagccactcgtctggcatgccactcggcgccacgggcctgtag

SEQ ID NO: 118518 - DNA, 2481 bp, Artificial Sequence
  Description of Artificial Sequence: Synthetic coding sequence
atgcagcacatttttgccttcttctgtacaggatttctgggcgccgtcgttggtgcaaattttccgaataatatccaaataggcggattatttcccaatcaacagtcacaagaacacgctgcttttcgatttgccctgtcccagctgaccgaaccaccaaaattgctgcctcagatagacattgtgaacatatcagacagctttgagatgacctataggtgtctatccgtgctgcaaaaagtactggataccgccgctgagaaaaactggcaagtgacagcggtaaacatacttaccacaacggaggagggatacaggatgcttttccaagatcttgagaagaagaaggagagactagttgttgtggactgtgaaagcgagcggctcaatgctattctgggccagataatcaagcttgaaaaaaacggaatcgggtatcactatatcctggcaaacctgggctttatggacattgaccttaataaatttaaagaatctggtgctaacgtgactgggtttcaattagtaaattacacggacaccataccggcaaagatcatgcagcagtggaagaattccgatgcaagagatcacacacgcgtagactggaagaggccaaagtacaccagcgcgctgacctatgatggtgtcaaggtgatggcagaagcatttcagtcactgagacggcagcgcatagatatttcccgtagggggaacgctggagactgtctcgccaaccccgccgttccatgggggcagggaatcgatattcagagagcactacagcaggtcaggttcgaagggctgactgggaacgtccagttcaatgagaagggaaggcggaccaattacaccctgcatgtcatcgagatgaaacacgacgggattagaaagattggatactggaacgaagacgataaattcgttcccgctgcaaccgatgcccaggcaggaggcgataactcttccgtgcagaacagaacctatatcgtgaccacgatccttgaggacccatacgtgatgcttaaaaaaaacgctaatcagttcgaagggaacgataggtatgagggttactgtgttgagctggccgccgagatcgcgaagcatgtggggtatagttaccgcttggagattgtctctgacgggaagtacggggccagggatccggatacaaaggcctggaatggcatggttggagagctggtgtacgggcgagcagacgtagctgtggcccctctgactatcaccctggttagagaagaggtgatcgacttctcgaagccctttatgtcgttggggatctccataatgatcaaaaaaccacagaagtcaaagccgggtgtcttcagctttcttgatcccctggcctacgaaatctggatgtgtatcgtgttcgcctacattggcgtcagtgtggtcctcttcctcgttagcagatttagcccatacgaatggcattctgaagagttcgaggagggcagagaccagaccaccagtgaccagtctaacgaattcgggatcttcaacagcctctggttctcgcttggggctttcatgcaacagggttgtgacatatcaccaaggtccctaagtggtaggatcgtcgggggcgtctggtggttcttcacccttataataatttctagttataccgctaatctggccgcttttcttaccgtggaaagaatggtgtccccgattgaaagcgctgaagaccttgccaagcagactgagattgcctacggcaccctggaagcaggatcgacaaaggagtttttccgcaggagtaagattgctgtgtttgaaaagatgtggacctacatgaagagtgccgagcctagcgtttttgtccgaaccaccgaagagggcatgatccgcgttcggaagagtaagggaaagtacgcttacctattggaatcaaccatgaacgagtacatcgaacagcggaagccctgtgataccatgaaagtgggaggaaacctggatagtaaaggctatggcattgctacccccaagggctctgcactgcgaaatcccgtgaacctggctgtcctgaaactcaatgagcagggactactcgacaagctgaagaacaagtggtggtacgacaagggagagtgtggctcaggcgggggcgattcaaaggataagacaagcgccctgagtctatccaacgtcgcaggtgtcttctatatcctgatcggcggtctcggactagcaatgctagtcgcgctaatcgaattctgttacaaaagtcgatcagaaagcaaacggatgaagggattctgccttatccctcagcaatcaattaatgaggctatccgcaccagcaccctgccacggaacagtggagcaggtgccagttcaggcggctcgggggagaatggtcgggtcgtctcacacgactttccaaagtccatgcaaagcattccgtgtatgagtcacagctccggcatgccactgggtgccacagggctttag

SEQ ID NO: 118519 - DNA, 2751 bp, Artificial Sequence
  Description of Artificial Sequence: Synthetic coding sequence
atgtgctgcagcacccacctttttcagccactgcaactcgctggcggtctggagtggccttggtcgaatctcttatgttttctcaccccagtcaagctgcaccctgaggtatggggccttttcccaaaccaacagtcgcaggagcacgcggccttccgtttcgccctgagtcagcttacggagcccccaaaacttctcccccagatagatattgtcaatatttcggattcgttcgagatgacataccgcttctgcagtcaattctccaagggcgtgtatgccatctttggattctacgaacggcgaacagtgaatatgctgacatctttttgcggtgcccttcatgtgtgttttatcacaccgagctttccggtggatacgtctaatcaattcgttctgcaactccgcccagagctacaggacgcgctcattagcattattgatcattataagtggcaaaaatttgtgtatatctacgatgctgaccgcggactgtctgtgcttcagaaggtgctggatactgctgctgagaagaactggcaggttacggctgtgaacatactgacaactaccgaggagggttatagaatgttgttccaagatctcgaaaagaagaaggagcggctcgtggttgtcgattgtgagtccgaaagactgaacgccattctcgggcagatcatcaaacttgaaaagaatggcatcggataccactacatcctggccaatcttgggttcatggacatcgatctgaacaagtttaaagagtccggggctaatgttacgggattccaactagtgaattacacggacacgattcctgctaaaatcatgcagcagtggaagaattcggatgccagggatcatacccgagtggactggaaaaggcccaagtacacaagcgccttgacttacgatggagtcaaagtgatggcggaagcgttccagtccctgcgcagacaaaggattgacatctccagaagggggaacgcgggggattgtctagcaaacccagctgtgccatgggggcagggcattgacattcagcgggcattgcaacaggtgcgctttgaggggctcacgggcaacgtgcaattcaatgagaagggaaggaggaccaattacacactgcatgtgatcgagatgaagcatgacggaatcaggaagattggttattggaatgaagacgacaagtttgtccctgctgccactgatgcccaggccgggggcgataactcaagcgtgcagaaccggacatatatagtcactacaatattagaggacccttatgttatgctgaaaaaaaacgctaaccagtttgaggggaacgatcgatatgagggctactgtgtggagctggctgctgagatagccaaacacgtaggctatagctaccggctggagatcgtctctgacggcaaatacggcgccagggacccagataccaaggcatggaatggaatggttggggaattggtgtacggaagagcagatgttgcagtcgctcccttgactataaccctagtccgggaggaagtcatcgacttctccaagccatttatgtctttaggaatctctattatgattaagaaacctcaaaagtcaaagcctggagtattcagcttcttggatcccctcgcatacgaaatctggatgtgtatcgttttcgcctatataggcgtgtccgtcgtgctgttcctggtctctcgattctctccctatgagtggcactcagaggagttcgaagagggaagagaccagaccacctctgaccagtcaaacgaatttggcatctttaacagcctctggtttagcctaggggcttttatgcagcaaggctgcgacatcagtccccgtagcctctctgggaggatcgtcgggggtgtctggtggtttttcactcttatcattatttccagttacaccgctaatcttgcagccttcctgaccgttgagagaatggtatcacccatcgagagtgccgaggacttagcgaagcagacagaaatcgcctatggcacgttggaggccgggagcaccaaagagtttttccggcgaagcaagatcgccgttttcgaaaagatgtggacgtacatgaagagtgccgaaccctccgtatttgttaggaccacagaggagggaatgatccgagtgcgaaagtccaagggcaagtacgcatacctcctcgagtccacaatgaatgagtatatcgagcaaagaaagccgtgtgacacaatgaaagtcggcggtaatttggactcgaagggctatggtatagctaccccaaaagggagtgccctcagaaatcccgttaacttggcggtgctcaagctgaacgaacagggcctgctggacaagcttaaaaataaatggtggtatgacaaaggggaatgcggaagcggcgggggggattctaaggacaaaacgagtgccttgtccctcagcaatgtggcgggggtcttttatatcctcatcggcggcctgggcctagcgatgttagtggctctcatcgagttttgctataagagtaggtcagagtcaaagcggatgaagggtttttgcttaataccacagcagagcatcaatgaagctattcggacctcaaccctgcccagaaattccggagccggcgcctcttcaggtgggagtggcgagaatgggagagtggtaagccacgatttcccgaagtccatgcagtccattccatgcatgagccactcaagtgggatgcccctgggagctacggggttgtag

SEQ ID NO: 118520 - DNA, 2151 bp, Artificial Sequence
  Description of Artificial Sequence: Synthetic coding sequence
atgcagcacattttcgcctttttctgcaccgggttcctgggcgccgtggtaggcgcaaatttcccaaacaacatacaaatagtttgcagccagttttcaaagggtgtgtatgccattttcggattttacgagagacggacagtaaacatgcttacctctttttgtggcgccctgcacgtgtgtttcatcacaccaagcttccccgtggacacaagcaatcagttcgtgctgcagctgaggccggagctccaagatgctctcatctccatcatagaccattataagtggcagaagttcgtatacatatacgacgctgaccgcgggctaagtgttttgcagaaagttttggacactgcggccgagaaaaactggcaggtgactgccgtcaacatcctcacgacgaccgaggagggctatcggatgcttttccaggacctggagaagaaaaaggagcggctggtagtggtcgactgcgaatctgagcgtctgaacgctatcctcggacagattataaagctggagaagaacggtattggataccattacattctagccaacctaggtttcatggatattgatctgaataagtttaaagaaagcggagccaatgttacaggttttcagttagtgaactatacagataccatcccagcgaagatcatgcagcagtggaagaacagtgacgcaagagaccatacgagggtagactggaagagaccgaagtatacctcggctctcacctacgacggtgtgaaggtgatggccgaagcattccaatctttacgccgccagaggatcgatatttctcgccggggtaatgccggcgattgcctagcaaaccctgcagtcccttggggtcaagggattgatattcagagggcactgcaacaggtgcgatttgaagggttaacaggaaatgttcagtttaacgaaaaggggagaaggaccaattacaccttgcatgttatagaaatgaagcatgacggcattcggaagattggttattggaacgaggatgataagttcgtgcccgcagcaacagacgcccaagcgggaggggataattcaagcgtgcagaatagaacctacatagttaccaccattttagaagacccctatgtgatgttaaaaaagaacgctaaccagttcgaagggaacgaccgttatgaaggctactgtgtagagctggccgctgagattgcaaagcatgtgggatatagctaccgtctggaaatagtctccgatggaaaatatggggctagagatccagacacaaaggcgtggaatgggatggttggggagctcgtgtatggtcgcgcggacgtggccgtcgcccccctaaccattactctggtgagggaggaagtgatcgatttctccaagccatttatgtcccttggaataagtatcatgataaaaaaaccacagaaatcaaagcctggagtcttctcttttcttgaccctctggcatacgagatctggatgtgcatcgttttcgcctatatcggtgtgtccgtagtccttttcctggtgagcagattctccccgtacgagtggcacagcgaggagttcgaggaaggcagagaccaaaccaccagcgaccagtccaacgagtttggcatttttaattctctgtggttctccttaggcgccttcatgcagcagggctgtgatatcagtcctcgctcactgagtggtaggatcgttggaggcgtgtggtggttctttaccctgatcatcatctccagctacaccgcaaacctggctgctttcttgacagtggagcgaatggtatcaccgattgagagtgccgaggacttggccaaacagaccgagattgcctacggcacgctcgaggcaggttccactaaggagttcttcagaagatccaagatcgccgtgtttgaaaaaatgtggacatatatgaagagcgctgagccttccgtgttcgtccgcactactgaggaaggtatgatccgtgtgaggaagtctaagggcaaatatgcatatctcttggagagtactatgaacgaatatatcgagcagcgtaaaccctgcgatacaatgaaggtcggcggaaatctggattctaaaggatatggtatcgccacacccaagggaagtgccctgaggacccgccaggccctgtag

SEQ ID NO: 118521 - DNA, 2721 bp, Artificial Sequence
  Description of Artificial Sequence: Synthetic coding sequence
atgcaacacattttcgcctttttttgcacgggcttcctgggcgcagtggtcggcgccaactttcccaataacattcaaatcggaggtttgttcccaaatcagcagtcccaggagcatgccgcattcagattcgctctgtctcagctgaccgagccacctaagctcctcccacaaatcgatatcgttaatatctcagattcctttgaaatgacgtataggttctgttctcaattttcaaaaggcgtgtatgctattttcggtttttacgagaggcgtacagtgaatatgctgacttccttctgcggcgccctgcacgtatgtttcataactccaagtttcccggtggacacctctaaccagtttgtgctgcagctcagaccagagctacaggacgctctaatatctataatcgatcattataaatggcagaagttcgtgtacatttacgacgccgacagaggtctatctgtcctgcaaaaagtgctcgatactgccgccgaaaagaattggcaggtgaccgctgtgaatatccttacaactacagaagaggggtatcggatgttgttccaggatttagagaagaaaaaagagagactggttgtagttgattgtgagtcggagcggctaaacgcgattctgggacaaatcattaaactcgaaaaaaatggcatcggctaccattacattctggcaaatctgggatttatggatatcgacctcaataagttcaaagaaagtggggccaacgttactggtttccaacttgtaaactatactgataccatccccgctaaaatcatgcagcagtggaagaacagtgatgccagggaccacaccagggtggactggaaaaggccgaaatatacctccgcactcacctacgatggcgtgaaagtgatggccgaagcctttcagagcctccgccgccagcggattgacatcagccgacgaggcaacgctggcgactgtctcgccaatccggccgtgccttggggacagggtatcgacattcagagagcactgcagcaggtccgcttcgaaggtcttacgggaaatgtgcagttcaatgaaaagggaagacggacaaattatactctgcatgtaatagagatgaagcatgacggaatcagaaagattggctattggaacgaagatgacaagttcgtccccgcggctactgatgcccaggccggtggcgataatagtagtgtacagaacagaacttacatagtgaccaccatcttggaggatccctatgtgatgctcaaaaagaacgctaatcagtttgaggggaacgaccgctacgaggggtactgcgtggagttggctgctgaaattgccaaacatgtaggatactcatatcgactggaaatcgtctctgatggaaagtacggtgccagagacccagatactaaggcttggaacggaatggtcggagagctagtttacggcagggccgacgtggccgtcgctcctctgacgataacactggtgagagaggaggtgatcgacttcagcaagccattcatgtccctaggtatcagcataatgatcaagaaacctcagaaaagtaagcccggagtcttctcatttctagatcccttagcctatgagatctggatgtgcatagtctttgcatacataggtgtctctgtcgtactgttcttagtgtcccgcttttccccctatgaatggcacagcgaggagttcgaggaagggcgggaccagaccacatctgaccagtcaaacgaatttggaatatttaactctctctggttttccttaggcgcctttatgcagcagggctgcgatatttctcccagaagtcttagcggaaggattgtgggcggcgtgtggtggtttttcaccctgataatcatctcatcgtacactgcaaatcttgccgcctttcttaccgtggagcgcatggtatctccaatcgagagtgcagaagacctggccaaacaaaccgagatcgcatacgggacactagaagctggctccacaaaggaattttttcgccgatctaaaattgcggtgttcgagaaaatgtggacgtacatgaagtctgcagaacccagcgtatttgtccggacaaccgaggagggcatgatccgcgtgcgaaaaagtaagggaaaatacgcttacttactggagtccactatgaacgagtacatcgagcagcgcaagccgtgtgacactatgaaggtcggcgggaatcttgattccaaaggatacggaatcgcaacacccaagggcagcgctctcaggggacctgtgaatctagccgttctgaagttgtcagaacaaggagtgctagataaactaaagtcaaagtggtggtacgacaagggggagtgcggatctaaagatagcggatcaaaggataagacttctgccctgagcttaagcaacgtcgccggcgtgttctatatcctaattggcggtttgggcttggcaatgctcgtggctctcatcgaattttgctataagtcacgctccgaatctaagcgcatgaagggcttttgtttaattccccaacagtctatcaatgaagcaattcggacaagcaccctgcccagaaactcaggtgccggagcatctagtggtggcagtggcgaaaatggccgcgttgtgtctcacgattttccaaaaagcatgcagtctattccctgtatgagccatagctccggaatgcctctgggagctaccggtctctag

SEQ ID NO: 118522 - DNA, 2514 bp, Artificial Sequence
  Description of Artificial Sequence: Synthetic coding sequence
atgacctatcggttttgcagtcaattctcgaaaggtgtgtatgcgatttttggcttttacgagcgcaggactgtcaacatgctcacatcattttgcggagcactgcatgtgtgctttatcactcccagttttcccgtagacacatccaatcagttcgttctccagttgagacccgaattgcaggacgccctgattagtataatcgaccactacaaatggcagaaattcgtatacatctacgacgcagatagaggtctctctgtgctgcaaaaggttcttgacactgccgccgaaaagaactggcaggtgaccgccgtaaacatcctgactaccaccgaggagggctacaggatgttgtttcaggacctggagaagaagaaggagaggttggtggtcgtggactgcgagtccgagaggttaaacgccattcttggacagataataaagctcgaaaagaacggaatcggctaccactatatcttggctaacctgggctttatggacattgacctgaataagttcaaggagtccggagcaaacgtgactggattccaactggtgaattataccgatactattcccgctaaaattatgcaacagtggaagaactcagatgccagagaccacacaagagtggattggaagaggcccaagtatacctcagccctaacatatgatggggtgaaggttatggccgaagcctttcagagccttaggaggcagcgcatcgacatctcccgcagaggcaacgctggggactgcttggcaaaccccgccgtaccatggggccaaggaattgatatccagagagcactccaacaagtgagattcgagggacttacagggaatgtgcagttcaacgagaagggacggcgcactaactatactcttcacgtcatcgaaatgaagcatgatggcatccgtaagatcgggtattggaacgaggacgacaagttcgtgccagctgccaccgatgcgcaggccggcggtgacaatagcagtgtgcagaacaggacatatatagttacaacgatattggaagacccttatgtgatgttgaagaaaaacgccaatcaatttgaagggaacgaccggtacgagggctattgcgttgagttggcggccgagattgctaagcatgtgggctactcataccggctagaaatagtctccgacggaaagtacggcgcacgcgatccggatacaaaggcatggaatggtatggtaggggagcttgtgtacggccgagctgacgtggcagtcgcacccctaactatcaccttggtcagggaggaagtgattgatttctccaaaccttttatgagcctggggataagcatcatgattaaaaagccacaaaagtctaaacccggcgtgttcagctttctcgaccccctggcgtacgaaatttggatgtgtattgttttcgcgtatatcggggtgagcgttgtgctgttcttggtctctcgattctctccatacgaatggcactcagaggagttcgaagaagggagagaccagactacctctgatcagtctaacgaattcggtatatttaactctctgtggtttagcctgggagcatttatgcagcagggatgcgatattagcccaaggtcactttccggccgcattgtcggaggggtatggtggttcttcaccctgattattattagcagctataccgccaatctggctgcatttctgaccgttgagcggatggtttcgccgatcgagtcggcagaagaccttgcaaagcagaccgagattgcatatgggaccctggaggctggatcaaccaaggaattcttcaggcggagcaagattgcagtatttgagaagatgtggacttacatgaaatccgctgagccatctgttttcgtaagaaccactgaagagggcatgataagggtgcgaaagtcaaaggggaagtatgcgtacctgttagaatcaactatgaacgagtatatcgaacagaggaagccctgcgacacaatgaaagttgggggcaaccttgactcaaagggctacggaattgccactccaaaagggtcggctctgcgcaatcccgttaaccttgcagtgttgaagctgaatgaacagggccttctcgataagttgaagaataaatggtggtacgataaaggtgagtgcggctcaggtggcggggacagcaaagataagaccagtgcactgtctttgtcaaatgtcgccggtgtcttctacattctgataggcggcctcggccttgctatgctggtcgctctgatcgagttctgctacaagtcccggtccgagtctaaaagaatgaagggattttgcttaattccccaacagtctatcaacgaggcaattcgaacctcaaccctcccaagaaacagtggggccggcgccagctctggggggtcaggggagaatggacgagtggtctctcacgatttccccaaaagcatgcagagcataccgtgtatgagccattctagtggcatgccacttggagctactgggctgtag

SEQ ID NO: 118523 - DNA, 2652 bp, Artificial Sequence
  Description of Artificial Sequence: Synthetic coding sequence
atgcagaaaatcatgcacataagcgtccttttgagtccagtgttgtggggattgatcttcggcgtatcttccaactctatccagattggcggactgtttccgagaggtgccgaccaggagtactccgccttccgcgtaggcatggttcaattttccacttcagaattccgcctaactcctcacatagacaatttagaagtggccaacagctttgccgtgacaaacgcattctgctcccagttcagcagaggagtttacgccatttttggcttctacgataagaaaagcgtgaacaccattacttctttctgtgggaccctgcacgtttccttcattaccccctcctttcctacagatggtacgcatccctttgtgattcagatgcggcccgaccttaaaggcgccctgctgagtctgattgaatattatcagtgggataaattcgcttacctttatgattccgacagagggctgagcactcttcaggcggtgctggattccgccgccgagaagaagtggcaggtgactgccatcaacgtgggcaacataaataatgacaagaaagacgagatgtatcgatccctgttccaggacctcgaactgaagaaagagaggagggtgatcctggattgtgaacgcgataaggtaaacgacatagtcgaccaggtgattacgattggcaagcacgtgaaaggataccactacataatcgcgaatcttggattcactgacggagatctgctgaagattcagtttggcggggccaatgtgtcaggctttcagatcgtcgactacgatgacagcctggtatctaaatttatcgagaggtggagcacactggaagaaaaagagtaccctggcgcacacaccactactatcaagtatacatccgcactgacctatgacgccgtgcaggtgatgaccgaggctttcagaaatctgcgcaagcagcgcattgagattagccgaagaggcaatgctggggactgtttggctaaccctgccgttccctggggccaaggcgtagaaatcgaacgggccctgaaacaggtgcaggtagaaggcctttccgggaatattaagtttgatcaaaacggcaaaaggattaattataccatcaacattatggagctgaagacaaatgggccccggaagattggctactggagcgaggtcgacaagatggtggtgaccctcacggagctgccctctggtaatgatacgagcggcctcgagaacaaaacagtggtagtgacgaccattttggagtctccctatgtgatgatgaagaaaaaccacgaaatgctggaaggtaacgaacggtatgaaggatattgtgtcgacctggccgccgaaatcgcaaagcactgtggatttaaatataagctgactattgtcggcgatggcaagtacggcgccagggatgccgatacaaagatttggaacgggatggttggcgagctggtgtatgggaaggccgatattgctatcgctccgttgactattaccttggtgcgggaagaggttattgacttcagcaagccatttatgtctctaggaattagcattatgatcaaaaagcctcagaagtctaagccaggggtgttcagcttcctggaccccctagcttatgaaatatggatgtgtatcgtatttgcctatattggagttagcgtggttttatttttagtgtccagattcagcccctatgagtggcacactgaggagtttgaggacgggcgagagacccagtcttcagagagcacaaacgagttcgggatattcaatagcctctggttttctttgggggctttcatgcaacaggggtgcgacatctctccccggagcctgtcagggaggatagtcgggggggtctggtggttcttcacattgatcatcatttcatcatacaccgcaaacctcgccgctttcttgaccgtggagaggatggtgtctcctatcgagagcgctgaggatctctcgaagcaaacggagattgcctatggtacccttgattccggctcgacaaaggaattttttagaagatccaaaatcgctgtctttgataagatgtggacgtatatgagatcggcagagccttcagtgttcgttcggaccacagccgagggagtggcaagagtgaggaagagcaaaggcaaatacgcatatctactcgaaagtaccatgaatgaatacattgagcagaggaaaccctgcgacacaatgaaggtcgggggcaacctggatagcaaaggttatggcatagccacccctaaaggttctagcctacgtaatgctgttaacctggccgtgctcaagctcaatgagcagggtttgctggacaaattaaagaacaaatggtggtatgacaaaggggaatgtggcagcggaggaggcgacagcaaggagaagacctccgcgctgagtctatcaaacgtggccggggtcttttatatactcgtaggtggattaggtctcgccatgctcgtagctcttatagaattctgctacaagtcccgggctgaggctaagcggatgaaagtggccaaaaatgcccagaacataaatcctagtagctctcagaattcccagaacttcgccacgtataaggaaggatacaacgtgtacggcattgagtcagtcaaaatatag

SEQ ID NO: 118524 - DNA, 2652 bp, Artificial Sequence
  Description of Artificial Sequence: Synthetic coding sequence
atgcaaaagattatgcacatttccgtgctactgtcccctgtgctttggggcctcatctttggcgtgtctagcaacagcatccagattggaggtcttttcccaagaggagctgaccaggagtacagtgcattcagagtcgggatggtgcaattttctacaagcgagtttcgacttacaccacatatagataatctggaagttgcgaactcatttgctgtcacaaatgcattctgttcacagttttcccggggagtctacgccatttttgggttttacgacaaaaaatctgtgaacactatcacctccttttgcggaacactgcacgtttccttcattaccccttccttccctaccgatggaacccacccttttgtcatccagatgaggccagacctgaagggcgccttgttgtctctcatagagtattatcaatgggacaagttcgcctacttatacgatagtgaccggggtctgtcaaccctccaggcagtgttagactctgccgcagagaagaagtggcaggtcaccgctatcaatgtcgggaatattaacaacgataagaaagacgaaatgtaccggtctctgttccaggacctcgagctgaagaaggagcgccgagtcattctcgattgtgaacgcgacaaagttaacgacatcgtggaccaagtaatcaccatcgggaagcatgtgaagggctatcactatatcattgccaaccttggctttaccgatggcgacttgctgaagattcaattcggcggggccaacgttagtggattccaaatcgtcgactacgacgactctttggtaagcaagttcattgaaagatggagtacccttgaagagaaggaatatcctggtgcccatactacgacaatcaaatacaccagtgctcttacctacgacgcagttcaggtgatgaccgaggccttccggaaccttaggaagcagaggatcgagatatctcgtagaggcaacgccggggactgtcttgccaaccccgcggtgccttgggggcagggagtggaaattgaacgagctcttaagcaggtacaggtggaaggccttagtggcaacattaaatttgatcagaacggcaagcggataaactatactattaatatcatggaactgaagaccaacggtcctcgaaaaatcggttactggagtgaggtcgacaagatggttgtcactctcaccgagctgccctcaggaaatgacacttccggtcttgagaacaaaaccgtagtggtcactacaatcttggaaagcccttacgtgatgatgaagaaaaatcacgagatgcttgagggaaatgagcgttatgagggctactgcgtcgaccttgctgccgagattgccaaacactgcggattcaagtacaaactgaccatcgtgggggatgggaagtatggagcccgcgacgccgacaccaagatctggaacggaatggttggcgaattggtctatggaaaggctgatattgccatcgccccattaacaatcacgcttgtacgtgaagaggtcatagatttttcaaagccctttatgagtctgggaatctctataatgatcaagaagccacagaaatccaaacctggtgtcttcagcttcctggatccacttgcgtacgagatctggatgtgtatcgtgttcgcttacataggcgtgtccgttgtgctattccttgtgtctagatttagcccttatgagtggcataccgaggaattcgaggatggtcgcgagacacagagcagtgagtcaaccaatgagtttgggatctttaatagcttgtggttttccctgggcgccttcatgcagcagggctgcgacatatcccccaggagcctctcaggcagaattgtcgggggagtgtggtggttctttaccctcatcataatttccagctacacagccaacctggcagcctttctcacggtcgaacgcatggtcagtccaatcgaatcagccgaagatttatcgaagcagactgagatcgcatacgggacgctcgattccggtagcaccaaggagttcttcagacgctcaaaaattgctgttttcgacaaaatgtggacatacatgagatccgcggagcccagcgtgttcgtccggacaacggcagaaggagtggcacgggtgcgcaagtccaagggtaagtacgcgtatctcctggagagtactatgaacgagtatatcgagcagaggaagccatgcgataccatgaaggtgggggggaacctggatagcaaggggtatggaatagccactcccaagggctcttccctgcgaacacctgtgaatctcgcggtgctgaaacttagcgagcagggggtcttagacaaactgaagaataaatggtggtacgataaaggtgagtgcggggctaaagactcaggaagtaaagagaagacgtcagcactatctctttccaatgtcgctggcgtcttttatattctggttggcggactgggcttggccatgctggttgcacttatcgaattctgctataagtctagggctgaggccaagcgaatgaaggtggctaagaacgcacaaaatataaatccctcttcttcccagaactctcaaaacttcgctacatacaaagagggctataatgtctacggaatagaatccgtaaagatctag

SEQ ID NO: 118525 - DNA, 2193 bp, Artificial Sequence
  Description of Artificial Sequence: Synthetic coding sequence
atggtgcagttttccacctccgagttccggttgaccccgcacatcgataatttagaagtcgccaactcattcgcagtcaccaacgccttctgtagtcaattcagtaggggggtctacgcaattttcggcttttacgataagaagtctgtcaacactattaccagcttttgcgggactctccacgtgtcattcataacccccagctttcccacagatgggacacatccatttgttatccagatgaggcccgatctcaagggtgctctcttaagcctgatcgagtactaccagtgggacaagtttgcatatctgtatgacagtgacagagggctctcgacgctgcaggccgtgttagattccgcagcagaaaagaagtggcaagtaaccgccatcaacgtgggtaatatcaacaatgacaaaaaggacgagatgtataggagcctcttccaggatctggaactgaaaaaagaacggagagtgatcctggattgcgagcgcgacaaagtcaatgatatcgttgatcaagttatcaccattggcaagcatgtgaaaggctaccattatattattgccaacttgggcttcaccgacggagatctgttgaaaatccaattcggcggcgctaatgtctccggattccagatagtcgattatgatgattcactggtgtccaagttcatcgagcgttggtccaccctggaagagaaagagtaccccggagctcacaccaccactatcaagtacacttccgcactaacctatgatgcagtccaagtgatgaccgaggctttcagaaatcttagaaaacagagaatcgagataagccgccgcgggaacgcaggagactgcttagccaatccagctgtgccctggggacaaggcgtcgagatcgaacgcgctttaaagcaggttcaggtggagggcctttcagggaacatcaaattcgaccagaatgggaaaaggatcaactataccatcaacattatggaactcaagaccaacggccctagaaaaatcggctactggagcgaagtcgacaagatggttgtgaccctgaccgaattgcccagcggcaacgacactagtggcttagagaacaagaccgtagtggtcactactatcttggaatctccttatgtaatgatgaaaaaaaaccacgagatgctggaggggaacgagaggtacgagggctattgcgtagacctcgcagctgaaatagcgaagcattgcggattcaagtacaaactgacgattgttggtgacggcaaatacggggccagggatgcagataccaagatttggaatggcatggtgggcgagcttgtgtacgggaaagccgacatcgccattgctcctctgacgattacactggtcagagaggaagtgatcgatttctctaagccttttatgtcactcggcatctctataatgatcaagaagcctcagaagtctaagcctggagtgttcagtttcctagacccgttagcatatgagatctggatgtgcatcgtattcgcttacatcggagtctccgtagtgctgtttctggtctctcgattctctccttatgagtggcataccgaagaatttgaggacggtagagaaacacagtcttcagagagcactaatgaatttgggatttttaatagcctgtggttctctttaggtgccttcatgcagcaggggtgcgatataagtccaaggtcattgtcaggacgaatagtgggcggagtgtggtggttcttcaccctaatcattattagctcatacactgcaaacctcgcagcattccttactgtggaacggatggtgtcacctattgaatccgcggaagacctgtctaaacagactgagatcgcctacggcacactggacagcggcagtactaaggagttttttcgcaggagcaagatcgccgtgttcgataaaatgtggacctatatgcgaagcgcagaaccctcagtattcgtgcgcaccaccgcagagggagtcgctcgggtgaggaaaagcaaagggaaatacgcctacctactcgagtccaccatgaatgagtacatagagcaaagaaaaccctgcgataccatgaaggttggaggaaatttggatagcaaagggtacggcattgccactccaaagggtagtagcttgtctggtgtgaccttcaagaccctcctattcgtctgttgtgggtag

SEQ ID NO: 118526 - DNA, 297 bp, Artificial Sequence
  Description of Artificial Sequence: Synthetic coding sequence
atgaacgaatatattgagcagcggaaaccttgtgatacaatgaaggttggaggtaacctggacagtaaaggatacggaattgcaactcctaagggcagttcgctttctggagtaaccttcaagacactgatttgcctcttgtggattaacgcagttaatcttgcagtactgaaacttaacgagcaaggactgctcgataagctcaaaaataagtggtggtacgacaagggtgaatgcggctctggaggaggagattctaaaaacccgagcaaatcttgcagcatcgaaacccagtag

SEQ ID NO: 118527 - DNA, 2511 bp, Artificial Sequence
  Description of Artificial Sequence: Synthetic coding sequence
atggtgcagtttagtaccagcgaattccgcctcacacctcacatcgataatctagaggttgccaacagttttgctgtgactaatgccttctgctcccaattttccaggggcgtgtacgccatcttcggcttttatgataagaaatcagtcaacaccatcacctctttctgtggcaccctgcatgtcagcttcataacccccagcttcccgactgacggaacccatccattcgtgatccagatgcgacccgacctcaaaggtgctttattaagcctgatcgagtattaccagtgggataaatttgcctacttgtacgattctgataggggattgtccaccttacaagcagtgctggactccgccgccgaaaagaaatggcaagttacggccattaacgtggggaatatcaataacgataagaaagacgagatgtataggtctcttttccaagatcttgaactgaagaaagagagacgcgtcatcttggattgcgaaagagacaaggttaatgatatagtggaccaagttatcaccattggcaagcatgtgaagggataccactatatcattgctaatctaggattcaccgatggcgatttgctgaagatccagttcggtggtgcaaacgtgtccggatttcaaatcgtggactacgatgattccctggtcagtaaatttatcgagcggtggtctactctggaagagaaggaatatcccggagctcacactaccacaatcaagtacacctctgccctgacctatgacgccgtgcaagtaatgaccgaggcatttaggaacctgagaaagcagcgcatcgaaatttctcgtcggggaaatgctggagattgtcttgcaaatcccgcggtgccatgggggcaaggagtggaaatagagcgggcccttaagcaggtgcaggtggaaggactttcggggaatattaagtttgatcagaacggcaagcggattaattataccataaacataatggagctcaagacaaacgggccacgcaagattggctactggtcggaagtggacaagatggtggtgaccctgacagagctgccaagcggtaacgacacgtcaggcttggaaaataagacagttgtggtgactacaatcctggaatccccatatgtgatgatgaaaaaaaatcatgaaatgttggagggaaatgaacgatatgaagggtattgcgtggatctggccgctgagattgccaagcactgtggcttcaagtacaaactgacaatagtcggagacgggaagtatggagcgagggacgccgacaccaaaatctggaatggtatggttggcgaactggtttacgggaaggcagatatcgcgatcgcgccactcaccattacactggttcgagaagaggtaatcgatttcagtaaaccgttcatgagtctcggcatctccataatgataaagaagcctcagaaatctaaacctggcgtcttctccttcctggatcctctggcttacgaaatttggatgtgtattgtgttcgcctatatcggagtatctgtcgttctattcctggtctccagattcagcccctatgagtggcacacagaagagttcgaggacggtagagagacacagtcctccgaatccactaacgagtttgggattttcaatagcctctggttcagtctcggcgcatttatgcaacaaggctgcgacatctctccaagatctctgagcggacgtatagttggcggcgtctggtggtttttcacgctgattataatttcctcctacacggccaatctggcagcatttctgaccgtggaacgtatggtgtcgcctatagaaagtgctgaggacctctcaaaacaaacagaaattgcgtacggtacgttggactcgggctccactaaggaattcttccgccggtcaaaaattgccgtgtttgataaaatgtggacctacatgagatcagctgagccatcggtgtttgtccggacgacagctgagggagtagctagagtgcgcaagtcaaaagggaagtatgcatacctcttggagtcgaccatgaatgaatacatcgaacagagaaagccctgcgatactatgaaggttggaggcaatctcgatagcaagggatatgggatcgcaacacccaagggatcatcacttcgaacccccgtcaacctagccgtcttgaagctttctgagcagggtgtcctcgataaactgaagaataagtggtggtacgataagggcgaatgtggcgctaaagattcgggatcaaaagaaaaaaccagcgccctctcattgtcaaacgtggctggcgtgttctacattctggtggggggccttggtcttgccatgctggtagcgctcatagagttttgctacaaaagtagagctgaagcaaagagaatgaaggttgcaaagaacgcacagaatattaacccaagcagcagccaaaattcacagaacttcgccacttataaggagggttataatgtttacggcatcgaatccgtgaaaatctag

SEQ ID NO: 118528 - DNA, 438 bp, Artificial Sequence
  Description of Artificial Sequence: Synthetic coding sequence
atggtacaatttagcacctcagagttccgactcactcctcacattgataacctcgaagttgcaaatagtttcgcagtaacgaacgctttttgcagccaattcagtagaggcgtgtacgccatttttggtttctacgacaaaaaaagtgtgaacactattacatccttttgcggcacacttcacgttagctttataacgcctagctttcctacagatggaacccacccgtttgtcatccagatgagaccagacctaaagggtgccctcctcagtcttatcgagtattaccagtgggacaaattcgcttatctgtacgactccgaccggggcctaagcacactgcaggcagtgctcgatagcgccgctgagaagaagtggcaagtaaccgcgattaatgtgggaaatatcaacaacgataaaaaggacgagatgtactag

SEQ ID NO: 118529 - DNA, 174 bp, Artificial Sequence
  Description of Artificial Sequence: Synthetic coding sequence
atggttcaattttcaacctcagagtttaggttaacgccccacatcgacaatcttgaagtggcaaatagcttcgctgtcaccaatgctttctgctcccagttttcacggggagtgtacgccatctttggattttacgataaaaaaagcgtgaatacaataacatccttctgttag

SEQ ID NO: 118530 - DNA, 2511 bp, Artificial Sequence
  Description of Artificial Sequence: Synthetic coding sequence
atggttcagttttccacctccgagtttaggttaaccccacatatcgacaatttggaagtggcaaattcctttgccgtcacaaatgccttttgttcgcagttttcccgcggggtgtacgctatcttcgggttttatgacaagaagtccgtgaacacaatcactagcttttgcggtactttgcacgtcagttttattactcctagctttccgaccgacggtacacatccttttgttatccaaatgagaccggatctcaaaggcgcactgttgagcttaatcgaatactaccaatgggacaaattcgcatatctgtacgatagtgatcggggcctcagcacactgcaagccgtattggactctgctgccgaaaagaaatggcaggtcaccgccataaatgtcgggaatattaataatgacaagaaagacgagatgtacaggtccttgttccaggaccttgagctcaaaaaagagcgccgtgttatattggactgtgagcgggacaaggtgaatgacattgtggatcaggtgatcactattggcaaacacgtaaagggctatcactacatcatcgccaacttaggatttactgacggggacctgttgaaaatccagttcggaggggctaacgtgagtggcttccaaatcgtggactacgatgactctctagtctcgaagtttatcgagcgatggtccacattggaagagaaagaatatccgggggcccatacaacaaccatcaagtacaccagcgccctgacatacgacgccgtgcaggtgatgacagaagctttccggaaccttcggaagcaaaggatcgagatatctcgccgcggcaacgctggcgattgcttagcaaatcctgctgtcccttggggccagggcgttgagattgagagggcactgaaacaagttcaggtggaaggcctgagcggcaatattaagttcgatcagaacggcaagagaatcaattatacgattaatattatggaactgaagactaatggacctaggaagattggatattggtctgaagttgataagatggttgtaacccttaccgaacttccttcaggcaatgatacaagtggtctggagaataagacggtcgtggtaactaccattctggagtctccctatgtcatgatgaagaagaatcacgagatgctcgaagggaacgagaggtacgagggatactgtgtggatctggccgccgagatcgcgaaacactgcggctttaagtataaactgaccatcgtaggagatggtaaatacggagctagagacgctgacaccaagatctggaacgggatggtcggcgaattggtgtatggaaaggccgacatcgccatagctcctctaactattacacttgttcgcgaggaagtgattgacttctccaagccctttatgtctctgggtatttcaataatgatcaagaagcctcaaaagtccaagcctggcgtgttttcttttctggatcctctggcgtacgagatctggatgtgcatcgtgtttgcttacattggcgtgagtgttgtgctgttcttggtgagcagattttccccttatgaatggcacacagaggaattcgaggatggccgagagacgcagagtagcgaatctactaacgagtttgggatttttaactccttgtggttctccctcggggctttcatgcagcagggctgtgatataagtcccagaagtctgtcaggccggatcgtgggtggagtgtggtggtttttcaccctaattataataagctcgtacactgctaacctggcggcatttttaaccgtggaacgaatggtttctcccatcgagagtgcagaggatctgtccaagcagacagaaattgcttatggcacgctcgactcaggttcaaccaaggaattctttcggcgctccaaaattgccgtatttgataaaatgtggacatatatgcggagcgctgaaccttcggttttcgtaagaacgactgccgaaggagtagctagagttcggaagagtaaaggcaaatacgcctatcttctagagtccacgatgaacgagtacatcgagcaaagaaagccctgtgacacaatgaaggtaggaggaaatcttgactctaagggttatggcatcgcaactccaaaggggagctctctgaggacgcccgtaaatctggctgtactgaaactctctgaacagggcgtcttagacaaactcaagaataaatggtggtatgataagggtgagtgcggtgctaaggattccggatctaaagaaaagacaagcgctctctccctgagtaatgtcgccggagtgttttacatattagtcggcggcctcgggttagccatgctggtcgctctaatagaattttgctacaagtcacgggcggaagccaagcgaatgaaagtcgcgaaaaatgcccaaaacatcaatccgagctcctcacagaactcccagaacttcgccacctacaaggagggctacaatgtgtacggcattgaatctgttaagatctag

SEQ ID NO: 118531 - DNA, 378 bp, Artificial Sequence
  Description of Artificial Sequence: Synthetic coding sequence
atgcagaagattatgcacatctctgttttactcagtcccgtgctctggggactcattttcggggtttctagcaactcgattcagatcggaggactgtttccccggggcgccgatcaagagtattccgcatttcgggtgggcatggtgcaattttctacgagtgagttcaggctgacgcctcatatcgacaaccttgaagtggcgaactcctttgccgttaccaacgctttttgctcccaattctcaaggggcgtttacgccatcttcggattttatgataaaaaaagtgtgaatactatcactagcttttgtggtacactccatgtgagcttcatcaccccttcattccctacggacgggacgcacccttttgtttag

SEQ ID NO: 118532 - DNA, 147 bp, Artificial Sequence
  Description of Artificial Sequence: Synthetic coding sequence
atgcagaagataatgcatataagcgtgctactcagtccagtgctgtgggggctcatttttggagtgtcaagcaattctatacaaataggaggcctgttccctagaggcgctgaccaggaatactcagccttccgcgttggtatgtag

SEQ ID NO: 118533 - DNA, 3030 bp, Artificial Sequence
  Description of Artificial Sequence: Synthetic coding sequence
atggaagctctgacgttgtggctgctgccgtggatttgccagtgcgtgtctgtgagggccgattccattatccacatcggagctatctttgaggagaatgctgcaaaggacgaccgggtgtttcaattggccgtgagtgatctttcgctgaacgatgatatactgcaaagtgagaaaatcacctactctatcaaggtcatcgaagctaataatccttttcaggcggtgcaggaggcatgtgatttaatgacccagggaatcctcgcattggtaacttctacaggctgtgcctcagcgaatgctctccagagccttactgatgcaatgcacattcctcacctgtttgtccagagaaacccaggaggaagtcctagaaccgcctgccacctgaacccctccccggatggtgaagcctacaccctggccagcagacctcctgtccggctgaatgacgtgatgcttagactggtgactgagctgaggtggcagaagtttgtcatgttctacgacagtgaatatgacatccgcggtctccagtccttcctggatcaggcaagcaggctggggttggatgtgtccttgcagaaggtggataaaaatatatcccacgtcttcacctcccttttcactacgatgaaaacagaggaacttaaccgctaccgagacacgcttcgccgtgcaatactgttgttgagcccccagggcgcccactcctttattaacgaagcagtggagactaatttggccagtaaagattcccattgggtctttgtgaatgaggagattagcgaccctgaaatactagacctcgtgcattctgcacttggtcggatgacggttgtcaggcagattttcccttcggccaaggacaaccaaaaatgcacacgtaacaatcatcgaatcagtagcctcttgtgcgatccccaagagggctacctacaaatgctgcagatctccaacctttacctgtacgacagtgtcctgatgctggcaaacgcattccacagaaaactggaggatcggaagtggcactcaatggcaagcctgaattgcattcgaaagtctaccaaaccgtggaatggaggaagaagcatgcttgacaccataaagaaagggcacatcacagggctgaccggggtgatggagtttcgagaagattccagtaacccttatgtgcaatttgagatcctgggaactacatactcagagaccttcgggaaggacatgcgcaagctggctacatgggattctgaaaaagggctgaatggctcactccaggagagaccgatgggtagccgccttcaggggttgactctaaaggtcgtgacagtcctagaagaacctttcgtgatggtggccgaaaacatcctgggccagcctaaacggtacaagggattttcaatagacgtgctggacgcactggcaaaagcgctgggttttaagtatgaaatttaccaagcacctgacggacgctatgggcatcagcttcataatacgtcttggaacgggatgattggtgagctgatctccaaacgggcagatctcgcgatttctgccattacaatcacacccgagagggaaagtgtcgtcgacttttcgaaacggtatatggactactcggtgggaatcctgattaaaaagcctgaagaaaagatcagcatcttctcgctctttgcacccttcgactttgctgtgtgggcctgcatcgcagctgctattcccgtggttggagtgctgatttttgtgcttaaccgtattcaggccgtgagagcacagtccgctgcacagccgaggccaagtgcttctgccacactgcacagcgcgatctggatcgtgtatggggcttttgtccaacaagggggcgaaagctctgtgaactcaatggccatgagaattgttatgggttcatggtggctttttacactcatcgtgtgctcctcgtacactgcgaacctggccgcgttcttgactgtctctaggatggacaaccctattagaacatttcaggacctgagcaaacaggtggagatgtcatatggtactgtgcgggacagtgccgtttatgagtacttccgggcgaaaggaacaaacccactggaacaagatagtaccttcgccgagctctggcgcacaatatcaaaaaatggcggcgcggacaattgcgtctcctctccatcagaaggtattcggaaggctaaaaaaggaaattatgcttttctctgggatgtcgcggtggtcgagtacgctgccctcaccgatgacgactgtagcgtcaccgtaatcggtaatagtatctctagtaagggctatggtatcgccctgcagcatgggagcccatacagggatctgtttagtcagcgaattttggaactgcaagatacaggggatcttgacgtgctcaaacagaaatggtggccgcacatgggaaggtgtgacttaacaagccacgcctccgcgcaggccgacggcaagtcattgaagctgcatagttttgcgggcgtgttttgcatcttggccataggcctactcttggcctgcctggttgccgcccttgagctctggtggaacagtaatcggtgccaccaggagaccccaaaagaagacaaggaggtgaaccttgaacaagttcaccgccgaatgaacagtctgatggatgaggatattgctcacaagcagatttcccccgcctcaattgagctgagcgcactcgaaatgggcgggttggcaccaacacaaaccctcgagcccacccgggagtaccaaaatacacagctatcagtcagcacttttctccccgaacagtcctcgcacgggacgtctcggacactctccagtggaccatctagcaacctgccactcccactttctagcagcgctacaatgccctccatgcagtgcaagcatcggagcccaaatgggggtctgttccgccagagcccggtgaagacccccataccgatgtcttttcagcccgtgccagggggagtcctcccagaggccctcgatacgtctcatggcactagcatttag

SEQ ID NO: 118534 - DNA, 1743 bp, Artificial Sequence
  Description of Artificial Sequence: Synthetic coding sequence
atgggttcccggctgcaaggcctgaccttgaaagtagtgactgtcctcgaagagccatttgtaatggtggccgagaatatactaggacagccaaagaggtacaaggggttctctatcgatgtgctagatgcactggctaaagctctaggctttaagtacgaaatttatcaggctcccgacgggcgttacggacaccagttgcacaatacatcctggaacggaatgataggcgagttgatctccaaaagagcggaccttgccatctctgcaattactatcactccagaaagggaatccgtggtggacttttccaagcgctacatggactatagtgtgggtatcctcatcaagaagcctgaggaaaaaataagtatcttcagcctcttcgcccccttcgattttgcagtgtgggcttgcatcgcagctgctatccctgtcgttggtgtgttaattttcgtcctaaataggattcaggccgtccgcgcccagtccgccgcgcagcctcgtcccagtgctagcgccacactgcatagtgccatttggatagtgtatggtgcctttgtgcaacagggcggcgaatcatccgtaaactctatggcaatgcgaattgtgatgggcagctggtggctcttcaccttaatcgtatgtagcagctatactgccaacttggccgcttttcttactgtgtccagaatggacaaccctatccggacattccaggacctgtcgaagcaagtggagatgtcatacggtaccgtgagagactcggcagtgtatgagtattttcgcgctaagggtaccaaccctcttgagcaggattctacatttgccgagttatggcgcaccatatcgaagaacggcggggccgacaactgtgtctcatctccttctgaaggtatccgcaaagccaagaaaggcaactacgcctttttgtgggacgtggctgttgtggagtatgctgccctgacagacgatgattgttctgtgaccgtgatcggcaactcaatctctagtaaagggtacgggatcgctctgcaacacggatctccgtaccgtgatcttttttcccaaagaatccttgaactgcaggacaccggtgacttagatgtgcttaagcagaaatggtggccgcacatgggtcgatgtgacctcactagccatgcttctgcccaggctgatggaaaatcgctcaagttgcacagcttcgccggagtcttctgcatcctggccataggattattgctcgcctgtctggtggccgcattggagctgtggtggaattcgaacagatgccaccaggagactcctaaggaagataaggaggttaatctggagcaggttcatagaagaatgaatagcttaatggatgaggacatcgcccacaaacagatcagccctgccagtattgagctatctgcgctagaaatgggtggtctggccccaactcagaccctagagccaacccgcgagtaccagaacacccagttatctgtctccactttcctgccagagcagagtagccacggaacttcaagaaccctgtcttcagggcccagcagcaacctgccacttccattatcatcttccgccacaatgccaagcatgcagtgtaagcatcggtcacctaatggcggtctgtttagacagtcccccgtaaagacaccgattcccatgagctttcagcccgtgcccggcggtgttctcccagaggcgctggacacgtcacacggaacatcaatttag

SEQ ID NO: 118535 - DNA, 3024 bp, Artificial Sequence
  Description of Artificial Sequence: Synthetic coding sequence
atggaggttttcccttttcttctcgtcttatcagtctggtggtcacggacctgggactctgccaacgccgactcaataatccacattggagccatcttcgacgagagtgcaaagaaggacgacgaagtatttcgcacagccgtgggcgaccttaaccagaacgaggaaatattgcaaaccgagaagattacattctcagtgactttcgtggacggcaacaatccattccaagctgtacaagaggcatgtgagttgatgaaccaagggatactggcgctcgtgagtagcataggatgtactagtgcggggagcctgcaaagcctggcagatgccatgcatataccccacctgtttattcagaggagcaccgccgggacccccagatctggatgcggattgacgaggagtaacagaaatgatgactatactttgtctgttaggccgcctgtttacctgcacgatgtaatactgcgtgtggtgacagaatatgcgtggcagaaatttatcatcttttacgatagcgagtatgatattcggggtatccaggagtttctggataaagtgagccagcagggaatggacgttgcgctgcagaaggtggaaaacaacattaataaaatgattactactttgtttgataccatgcgaatcgaggagcttaacaggtatcgggacacacttcggcgagcgatcctcgttatgaaccccgcaaccgccaaatcatttataactgaggtagtcgagacaaacttagtcgcctttgactgccattggatcataattaacgaggaaatcaacgatgttgacgtacaggagttggtccggcgctccattgggaggctcacgatcatcaggcagacatttccagttccgcagaacatttcccagcgatgctttcgcggtaatcacagaatttcttcaactctttgtgatccaaaggatccatttgctcagaatatggagatttctaacctctacatctacgataccgttctcctgttggctaatgcttttcacaagaaactcgaggacagaaagtggcactcaatggcttctctgtcatgtataagaaaaaatagtaaaccatggcaaggaggacggtccatgctggagactatcaaaaaaggaggtgtttcaggtctgacgggagaattagaattcggagagaacggcggcaaccctaatgtgcatttcgaaatcctcggcacaaattacggcgaggagctcgggagaggcgtgcgcaaactggggtgctggaacccggtaactggcttgaacggatctttgacagataagaagcttgagaacaacatgcggggggtagtgctgagagttgtgaccgtgctcgaggaaccttttgtgatggtcagcgaaaatgtgctgggtaagccaaaaaagtatcagggatttagcatcgacgtgctggacgcactgtcgaattacctcggctttaactacgagatttatgtggcccctgatcacaaatacggtagtcctcaagaagacgggacctggaacgggctagtcggagagttggtctttaagagagctgatattggcattagcgctttaacaattacacctgatagagaaaacgtggtggacttcaccactcgttacatggattactcagttggggtcttgctgcgacgggctgagaaaacagtggatatgtttgcctgtttggcaccgtttgatctgtcactctgggcatgtatcgccggaacggtcctcctggtaggactcctggtgtacctcttaaactggctcaatcctcctcggctccagatgggttccatgacttctaccacgctatacaattccatgtggtttgtctacggaagtttcgtgcagcagggtggcgaggtaccctacaccacactggcgaccagaatgatgatgggagcctggtggttgttcgctctcatagtcatctcttcatatacggctaatcttgctgccttcttgacaatcacgcggatcgagtccagcattcaatcgcttcaggacctgtctaaacagaccgagattccctatggtacagtgctggactccgccgtctacgaacatgtgcggatgaagggcctgaacccctttgagcgggacagcatgtatagccagatgtggagaatgattaatagatccaatgggtctgaaaataacgtgcttgagtcccaggctggaatccagaaagtcaaatacggcaattacgcatttgtttgggacgcagctgtcctcgaatacgtggctatcaacgaccctgattgctccttctacaccatcggcaataccgtggcagaccgaggctatgggatcgccctgcagcacggatccccctatcgggacgtgttttctcagaggattctggagttgcagcagaatggcgatatggacatcctgaagcacaagtggtggccaaaaaatggccagtgtgatctgtattcctcagtggacactaagcagaagggtggggctcttgacatcaagtcttttgctggtgtcttctgtatcctggccgctggaatagtcctgtcttgttttatcgctatgctcgaaacttggtggaacaagcgaaagggatccagggtgccaagcaaagaagatgataaggagatcgaccttgagcacttgcatcgccgcgtgaattccctgtgcactgacgacgattcaccccataagcagttttctactagtagcattgacttgacacctctggacattgataccctgcctacccggcaagctctggagcagatctcggattttcgcaacacccatatcaccaccaccaccttcattccggagcaaatccagacattgtcccggacgttgagcgcaaaggccgcaagtgggtttacttttggcaatgtaccggagcaccggaccggaccctttagacaccgggccccgaacggaggattcttccggtctccaatcaaaactatgtcatcaatcccataccagccaacacccacactcgggctcaacctcggaaacgatcctgatcgcggcacatccatctag

SEQ ID NO: 118536 - DNA, 2739 bp, Artificial Sequence
  Description of Artificial Sequence: Synthetic coding sequence
atggaggtgtttccgttcctcctggtgctgtcggtgtggtggagccggacatgggattcagcaaacgcagattcaatcatccacatcggcgccattttcgacgagagcgctaagaaggacgacgaggtgtttaggacggcagttggagatctgaaccagaatgaggaaatcctccagaccgagaagatcactttctcagtaacctttgtggatggaaataaccctttccaggcagtccaagaagacattagagggatccaggagtttctggataaagtctcgcagcaggggatggacgtcgctctgcagaaggtcgagaacaatattaacaagatgatcaccacactgtttgatacaatgaggatcgaagagctgaaccggtacagagacactcttagaagagccatccttgttatgaacccagcaacagccaaatcgttcatcacagaggttgtagaaactaatctggtggcattcgactgccactggatcatcataaacgaggagatcaacgatgtggatgtgcaagaactggtgagacggtcgataggccgcctgaccatcatcagacagacgtttcccgtgcctcagaacataagccagaggtgttttaggggaaatcacaggatttcttcaactctgtgcgaccctaaagatccatttgcacaaaatatggagattagtaatctctatatatacgatactgtcctgctgctcgcaaacgctttccataaaaagctcgaggaccgaaaatggcattctatggcctcccttagctgtattaggaagaatagcaagccatggcagggcggaaggtccatgttggagactatcaagaaggggggcgtctccggcctgaccggcgagttagagttcggcgagaacgggggaaatcctaatgtgcactttgagatcctgggaacgaactacggggaggaactgggcaggggcgtacgaaagcttggttgctggaacccggtcacaggactcaatggctctctcactgacaaaaagctggagaataacatgcggggtgtagtcctgcgtgttgtgacagtcctcgaggagccctttgtcatggttagcgagaacgtgctgggcaagcccaagaaatatcaggggttctcgatagacgtgctggatgctctgtctaattatctgggctttaactacgagatctatgtggccccagaccacaagtacggaagcccccaggaggacggaacatggaacggcctggttggagaactggtctttaaaagggccgatataggaattagcgctcttaccattactcctgatagagaaaatgtagtcgatttcaccacccgctacatggactattcagtgggtgttctgctgagaagggccgagaaaactgtcgatatgttcgcgtgcctggccccctttgatctctctctctgggcatgtatcgctgggacagtgctcctggtgggcctcctggtctatctgctgaactggctgaatccacctaggttgcagatgggaagcatgacctcaaccactctctataattctatgtggtttgtgtacgggtcattcgtgcagcagggcggagaggtcccttacacgaccctcgccacccgaatgatgatgggcgcctggtggctgttcgccctcattgttatatctagctatacagcaaatctggctgcctttctgacaattactcgtattgagtcctccatccagagtcttcaagatctgagcaaacaaacagagatcccatatggcacagtgctggactcggcagtctacgaacacgtccggatgaagggcctgaacccttttgagcgggactcaatgtacagccaaatgtggagaatgataaaccgcagtaatggaagcgaaaataacgtactggagagccaggccggcattcaaaaggtgaagtatgggaactatgcttttgtgtgggacgcagccgtgctggagtacgtagccatcaatgatcctgactgcagcttttacactatcgggaacaccgtcgcagatcgaggttatggcattgccctccagcacggatcaccttaccgcgacgtgttctctcaacggatactagaactgcagcagaatggagacatggatatccttaagcacaagtggtggcccaagaacggccagtgcgacctctattcttcagtagacacaaagcagaaaggcggagcgctcgacatcaagagctttgccggcgttttctgtattctggccgccggcatagtgttgtcttgctttattgctatgcttgagacatggtggaataagcggaaagggtctagggtgccaagcaaggaggatgataaagaaattgatctggagcacctccacaggagagtgaactccctctgcactgacgatgactcgcctcataagcagttcagtacttcttccatcgatttaacccctctggatatcgatacattgcccactcgccaggcgttggaacagatatctgacttccggaatactcacatcaccaccaccacatttatacctgagcagatacagaccttatcacgcacgctgagtgccaaggctgctagcggctttacattcggaaacgttccagagcataggaccggcccctttaggcacagagctcctaatggagggttcttcaggtccccgattaagacaatgtcctctattccgtaccagccgacccccactctgggccttaatttgggaaatgatccggacaggggtacctctatttag

SEQ ID NO: 118537 - DNA, 2763 bp, Artificial Sequence
  Description of Artificial Sequence: Synthetic coding sequence
atggagcacggtacgcttttggcccagcctgggctctggacgagggacacctcttgggctttgctgtacttcctgtgctacatcttacctcaaacggcccctcaagttctaagaatcggagggatctttgagacagtagaaaatgagcctgtaaacgtggaggaactagcattcaagttcgctgttacttctattaaccgaaaccgtacccttatgcctaatacaactcttacctacgatatccagcggatcaacctgttcgacagcttcgaggcgtccaggcgtgcttgcgaccagctcgcgctcggagtggcagccttattcggaccaagccatagctcctcggtgagcgccgtgcaatcaatttgtaatgcgcttgaagtaccccacatccagacccggtggaaacatcctagtgtagataataaggatctgttttatatcaatctgtatccggactacgctgcaatctcaagggccattttagatttggtgttatactataattggaagactgtgactgttgtgtacgaggactccaccggtttgattaggctgcaggaattgattaaagccccatcaagatacaatatcaaaataaagattaggcaacttccaagcggcaataaagacgcaaagccactcctaaaggaaatgaagaagggcaaagaattttacgtaattttcgactgcagccatgaaaccgccgctgaaatcttaaaacagattttgttcatgggaatgatgacagagtattaccactactttttcacaacactcgatctcttcgctctcgacctggagctgtatcggtactcaggagtgaatatgaccggctttcggttgttgaatatcgacaacccacacgtttcatcaattattgaaaaatggtcaatggaacgactgcaggccccaccacggcccgagaccgggctcctggacggaatgatgactacagaagcagcattaatgtatgatgctgtgtacatggtggctatcgctagccacagggcttctcagttgaccgtgtcatcactgcagtgtcatcggcataagccatggcgactgggccccagattcatgaacttaattaaggaagcgactgcacgctgggacggcctgactggtcatattacgttcaacaaaacgaatggacttagaaaggactttgacctggacataatttcgttgaaggaggaggggactgagaaggcagccggcgaggttagtaaacatctgtacaaagtgtggaagaaaatcggtatttggaacagtaattcgggactcaacatgaccgattccaataaggataagtcgtccaacatcactgattctttggcaaacagaacccttatcgttaccacaattctcgaggagccttatgtgatgtatagaaagagtgacaaacccttatatggcaatgacagattcgaaggttactgtttggatctgttgaaagaactttctaatatcctcgggtttatttacgacgtgaagctcgtgcccgacggaaagtacggcgcccagaacgataagggcgagtggaacgggatggtgaaggaactgatagatcacagagcggaccttgcagtagcccctctgaccatcacctacgtgcgggagaaggtgatcgatttttctaagcccttcatgacactcggcatttccatactgtaccgcaaaccaaatggcaccaatccgggagtgttctcattcctgaacccattgtctccagatatttggatgtatgtcctgctcgcctgtctgggggtgagctgcgtgctattcgtgatcgcccgctttaccccctacgagtggtacaatcctcatccctgtaacccagactctgacgttgtcgagaacaacttcaccctcctgaatagtttctggtttggcgtcggggcgttgatgcagcagggaagcgaactgatgcctaaggctctttcaacccggattgtgggtgggatttggtggtttttcactttgataatcatcagttcctatactgccaatctcgccgcgttcctcaccgttgaaaggatggagtcaccgatagactccgccgacgaccttgcgaaacaaacaaaaatcgaatacggggccgtgagggacggaagcacaatgacattttttaagaagtccaagattagtacctatgagaagatgtgggcatttatgagctccaggcagcagaccgctcttgtcaggaactccgacgagggtattcagcgagtgctcacgaccgactacgccctattgatggaatcaactagtatcgagtatgtgacccagcgaaactgcaatctaacccaaattggcgggcttattgacagcaaaggttacggcgtgggcacccctattgggagtccttaccgcgacaagattacaatcgcgattctccaactgcaggaggagggcaaactccatatgatgaaagaaaaatggtggcgggggaatggttgtcctgaggaggacaataaagaagcctcagcattaggcgtcgagaatattggcggcatcttcatcgttctcgctgctggcctggtgttgagcgtgtttgtcgccataggcgaattcatttataaaagtcgaaaaaataacgatattgagcaggcattctgcttcttctacggcttgcagtgtaagcagactcacccgactaattctacaagcggtaccacattgtccaccgacctggagtgcgggaagttgatacgtgaggaaagaggtattcgcaagcagtcctctgtgcacaccgtctag

SEQ ID NO: 118538 - DNA, 2850 bp, Artificial Sequence
  Description of Artificial Sequence: Synthetic coding sequence
atggagcatgggacacttttggcacagcctggactctggacccgagatactagctgggccctcctgtacttcttgtgctatatactacctcaaaccgctccgcaggtgcttcggattgggggcatttttgaaaccgtggaaaacgaacctgtgaacgtagaggaactcgcctttaagtttgcagtaaccagcatcaataggaataggaccctgatgccaaacaccacactgacatacgatatccagcggattaacctatttgacagctttgaagcatccagaagagcatgcgatcaactcgccctgggggtggcagccctgtttgggccttcccactcttcctccgtctcagccgtgcagagcatttgcaatgctctagaggttccacacatccagaccaggtggaagcatccttcagttgataataaggatctgttctatattaatctctatccagattacgccgcgatttcacgagccatccttgacctcgtcctttactacaactggaaaaccgtcaccgtggtatacgaggattctacaggtctcatccgactccaggagcttatcaaggcgccttccagatacaacattaagattaagatacggcaattaccttcaggtaacaaggatgccaagcccctgttaaaggagatgaagaaggggaaagagttctacgtaatcttcgattgttcacatgaaacagctgcggaaatactgaagcagattctgttcatgggcatgatgactgagtactaccactacttttttactacgctggatctcttcgcacttgacttggagttgtaccgctactcaggagtgaacatgacaggtttcagacttctgaacattgataatcctcacgtctcttctattattgagaaatggtccatggaacgcctacaggctcctccgaggcccgagaccggactcttggacggtatgatgaccaccgaagcagctctcatgtatgatgccgtgtatatggtggctatcgcttctcacagagctagccaactcacggtttcaagcctgcagtgccataggcacaagccctggagattaggaccccgcttcatgaatctgattaaggaggcaagatgggatgggctgaccggacatattacattcaacaagaccaacgggctgcgcaaggactttgacctggacatcatcagcctaaaagaggaaggcaccgagaaggccgcgggcgaagtctcgaaacacctgtacaaagtctggaagaagatcggcatctggaacagtaactctggactgaacatgacagactctaataaagacaaaagctctaacatcacagacagcctagcaaatagaacactgatcgtaaccaccatcctggaagagccatacgtgatgtaccgcaaaagcgacaaacccctctacggaaacgaccgcttcgaaggatactgtctagatctgctgaaggagctgagcaatatcctgggcttcatttacgacgtgaagctggttcccgatgggaaatatggagcccagaatgataaaggggaatggaatggtatggtgaaggagctgattgatcaccgagctgatttggcagtggctcctctgactataacctacgtccgcgaaaaggtaattgacttttctaaaccatttatgactctggggatcagtatcttatatcgcaaacccaatggaacgaatccgggggtcttctcttttctgaaccccttatctccggacatctggatgtacgtcttgctagcctgcttgggagtttcctgtgtgctttttgttatcgcacgtttcacgccctacgaatggtacaatccacatccctgtaatcccgactctgatgtggtggaaaacaatttcacactgctgaattcattttggtttggggtgggagctctcatgcagcagggatcggaacttatgcccaaggccttgagcacccgaatagtgggaggaatatggtggttctttaccctgatcattatctcctcctatacagcgaacttggctgcgtttctcacagtcgaacgaatggagtctccaattgactcagcagacgatctagcaaagcaaacgaagattgaatacggcgcagtccgggacggcagtaccatgacctttttcaaaaaatcaaaaatttctacctatgaaaaaatgtgggcttttatgtcatcaagacagcagacagctcttgtgcgcaatagtgacgaaggtatccaaagagtcctcacaactgactacgctctcttaatggagtctacttccatcgagtacgttacgcaaagaaattgcaacctgacacagatcgggggcttgattgacagcaaggggtacggcgtcggcacccccatcgggtctccttaccgagataagattaccatcgccattctccaacttcaggaggagggaaaattgcacatgatgaaggaaaagtggtggcggggcaacggctgtccggaggaggacaataaggaggcttccgcgctaggagtcgagaacataggcggaattttcatcgtgttagcagcgggtctcgtcttatctgtctttgttgctattggcgagtttatctataagagcagaaagaataacgatatcgaacaaaaggggaagtcaagcagaattcggttttattttcgcaacaaagtaaggtttcacgggcgcaagaaacagagccttggtgtcgaaaaatgtctgagttttaacgccatcatggaggaacttggaatcagtctcaaaaatcaaaagaagatcaaaaagaaatccagaaccaagggaaagagcagcttcacctctatcctgacctgccaccagcggcggacacagagaaaggaaacggtggcttag

SEQ ID NO: 118539 - DNA, 2616 bp, Artificial Sequence
  Description of Artificial Sequence: Synthetic coding sequence
atggagcacggcactttgctggcgcagcccggattatggactcgcgacacgtcttgggcgctcctgtacttcctttgctacatcctaccacaaaccgcaccacaggtactgaggatcggtggcatattcgagactgtcgaaaatgagccagtgaatgtcgaggaacttgccttcaagttcgctgtgacttctataaacagaaaccgaacactcatgccgaacactaccctcacctacgacatccagaggatcaacctgttcgatagttttgaagcgtcccgaagagcatgcgaccaactggccctcggcgtcgccgctttgttcggcccaagccatagctctagcgtatctgccgttcagtccatttgcaacgctttagaagtgccgcacattcagactcggtggaaacacccatcggtggataataaagatcttttctatataaatctgtaccccgattatgctgccatatcaagggcgatactggaccttgtgttgtactacaattggaagaccgtgactgtggtctacgaggattccactggcctgattagactccaggagctgattaaggctccttcacgctataacatcaaaatcaagatccgacagctgcctagtggtaacaaagacgctaagcctctcctcaaagagatgaaaaagggcaaggaattctatgtgatcttcgattgttctcatgaaacagcagccgaaatcctgaagcagatccttttcatgggtatgatgacagagtattaccattacttcttcaccacactggatctcttcgctctcgatctagagttataccggtattctggagtcaacatgaccgggttccgattgttgaacattgataaccctcacgtaagcagtatcatcgaaaagtggtccatggagcgcctccaggccccacctaggcccgaaactgggctgctggatggcatgatgactacagaagctgcacttatgtatgacgccgtgtacatggtcgccatcgcctcacatagagcaagccagctaactgtgtctagccttcagtgtcatcgacacaaaccatggaggctcggcccccggttcatgaacctcatcaaagaagcacgttgggatggactcacagggcatatcactttcaataagacaaatggcctccgtaaggattttgatttagacatcataagcctgaaggaggaaggtacagaaaaagccgctggcgaagtgtctaagcacttgtacaaggtctggaagaaaatcggaatttggaactctaactctggcctaaacatgacggacagtaataaggacaaatcctccaatattacagattccttagctaatcgaaccttaatcgtcacaactattttggaggagccttacgtcatgtatagaaaatccgacaagccgctgtacgggaacgataggttcgagggctattgcctggacttgcttaaggagctgagcaacatccttggcttcatctacgacgttaagctggtgccggacggcaagtatggagcacagaatgacaaaggtgaatggaatggaatggtgaaggaactcatcgatcatagagctgatctggccgtggcacccctaaccattacatacgtgcgagagaaagtcatcgattttagtaagccattcatgacactgggcatctccatcctgtatcgaaaacccaatggaactaaccctggcgttttctcgtttttgaatcccctcagcccagacatatggatgtatgtgctcctggcttgcctaggtgtctcttgtgtcctttttgttatcgcgcgcttcacaccctatgaatggtacaatccacacccttgtaaccctgacagtgatgtggtggaaaacaattttactcttctgaactccttttggttcggagtgggcgccctcatgcagcagggctccgaactgatgccaaaggctctgtccaccagaattgtcggaggaatttggtggttctttactctaataattatcagttcctacacagctaaccttgctgcatttctcactgtggaaagaatggaatctcctatcgactcagcagatgacttggcaaagcagacgaagatagagtacggggctgtgagggacggctcgaccatgaccttctttaaaaaaagcaagatctccacctacgagaagatgtgggcatttatgtcttcacgacagcagacagcactggttcgcaatagcgacgagggcattcaacgagtgctcaccacagattacgctctcctaatggaatcaacctccatcgagtatgtcacacagaggaactgtaatctaactcagatcggtggactgatcgatagtaaagggtatggtgttgggactcccatcggctctccttatcgtgataaaatcaccattgccatactgcagctgcaagaagaaggtaagttgcacatgatgaaggagaaatggtggcgaggcaacgggtgtcctgaggaagataacaaagaggcgtctgcattgggcgtggaaaatattggtggtattttcattgtgcttgctgccggtctggttctgtctgttttcgtggccatcggcgagttcatctacaagtctaggaagaataacgatattgagcagcactactag

SEQ ID NO: 118540 - DNA, 2718 bp, Artificial Sequence
  Description of Artificial Sequence: Synthetic coding sequence
atggaacacggcactcttctggcacagcccggtctgtggacacgggacacaagctgggccctgctctattttctgtgttatatactaccccagaccgctcctcaggtgctacgaattggtggaattttcgagactgtggagaatgaaccagtcaacgtagaagagttggccttcaaattcgccgtgactagcatcaacaggaatcgcactctcatgccaaacacaacactgacctatgacattcaacgaattaatttatttgattcgttcgaagccagccgacgagcctgtgatcagcttgcattgggcgtggccgctctctttggaccaagtcatagctcgtcagtttcagcagtgcagtcgatttgtaacgctctcgaggtcccccatatccagactcgatggaaacacccaagtgtggacaacaaggacctgttctacattaacttgtacccagactacgccgcgatatcacgtgctattcttgacctggtgctctactataattggaaaaccgtcaccgttgtgtatgaggacagcaccggactcataagacttcaagagctcatcaaagctcccagtcgctacaacatcaaaatcaaaatccgacagctgccttccggtaacaaggatgccaaaccactcctgaaggagatgaagaaaggcaaagagttctatgtgattttcgattgttcccacgaaactgctgcagaaattctcaagcagatcctgtttatggggatgatgactgagtactatcattactttttcacaactttggatctttttgccctggatctggagctgtataggtatagcggcgtaaacatgacaggctttcgcctgctgaatatcgataaccctcatgtcagttcaataatcgagaaatggtccatggagcgactacaggcccccccaaggcccgaaaccggactgctggacggaatgatgaccactgaggctgcactaatgtatgacgccgtgtatatggtcgctattgcgtcccaccgcgcctctcagcttacagtgagttcattgcagtgtcaccgtcataagccttggagactcgggccacggttcatgaatctgataaaagaagcgaggtgggacggccttacgggccatatcacctttaacaaaacgaatggcctgcggaaagactttgacctggatattataagcctaaaagaagaaggaactgaaaagattggcatttggaattccaactcaggcctcaacatgactgatagcaacaaggacaagagctcgaacatcaccgactctctggctaataggacactcatcgtcacaacaattctagaggagccgtacgtgatgtaccggaagagcgacaagcctctgtacggcaacgaccgttttgagggatattgcttagacctgctgaaggaattgtccaacatcctggggttcatctacgatgttaaactcgtgccagacgggaaatacggcgcacagaatgacaagggcgaatggaatgggatggtgaaggaacttatcgatcaccgcgctgatttagccgtggctcctctgactatcacttacgtgagggagaaggtcatagacttttccaagcccttcatgacactgggcatttccatcctgtatcgtaagcctaacgggacgaaccctggcgttttcagctttctcaatccactttcaccagacatctggatgtacgtcctcctggcctgcctgggagtcagttgtgtgctgttcgtcatcgcacgatttaccccctacgaatggtacaatcctcatccatgtaatcccgatagcgatgtggtggaaaacaactttaccctgttgaacagtttctggtttggggtgggagcactgatgcagcaagggtctgagctcatgccaaaggccttgagcacacgcatcgtgggtgggatctggtggttctttacgttaattatcataagcagctacactgccaatcttgcagcgttcctcaccgtggagcggatggaatctcccatcgactctgcagatgatttggctaagcagactaagatagagtacggtgccgtgcgcgacggttctacgatgacttttttcaaaaagagtaagatttccacttatgagaagatgtgggcgtttatgtcttcccgccaacagactgccctggtgcgaaactcagacgaaggtattcagcgagtactgactaccgattatgcccttcttatggaatcgacctcgatagagtacgtcacgcagagaaactgcaatctcacccagattggcggactcatcgacagcaagggatacggggtcggaacccctattggctcgccgtaccgtgacaagattactatcgcaatcctgcaactgcaggaggagggtaagcttcacatgatgaaggagaagtggtggcgggggaatggatgccctgaagaggataataaagaagccagtgccctcggcgtggagaacattgggggaatctttatagtgctggccgccgggcttgtcttgtctgtgtttgtggccatcggcgagttcatctacaaatcaagaaaaaataacgatattgaacaatgcttatcttttaatgcaattatggaggaactgggaatctctctaaaaaatcaaaagaagatcaagaagaaatcgcgcaccaaaggcaaatcatcctttacttctattctcacatgtcaccagaggcggacacagaggaaggaaacagttgcctag

SEQ ID NO: 118541 - DNA, 2757 bp, Artificial Sequence
  Description of Artificial Sequence: Synthetic coding sequence
atggaacatggcacactgctggcacagcctggactgtggaccagagatacgtcatgggctctgttatacttcttgtgttatatccttcctcagactgcccctcaggtattacggatcggcggaatcttcgaaacggtggaaaatgaaccagtcaatgtggaagagttagctttcaaattcgccgtgacaagcataaatcgtaatcgtactctgatgccgaatactacgctgacgtatgacatccaacggataaatctgttcgattccttcgaggcctcaagacgtgcctgcgatcagctggccctcggtgtagctgcgctcttcggccccagtcattcatcttccgtatcagctgtccagtctatctgcaacgccctggaggtgccacacatccaaacacgctggaagcatccctcagtcgataataaggaccttttctacattaatctctaccccgattacgccgcaataagccgggctatccttgatctggtcctttattataactggaagaccgtaacagtcgtgtacgaggattctaccggcctcatccgacttcaggaactgatcaaggccccttcccgctacaacatcaaaatcaagatcagacaactgccaagtggcaataaggatgctaaacctctgctgaaagagatgaagaagggaaaagagttttacgtgatctttgattgtagtcatgagaccgcagccgagatcttgaagcagatactgttcatgggcatgatgaccgaatattaccattactttttcacaaccctggacctattcgcactggatttggaattataccggtactctggagtaaacatgaccggctttcgactccttaatatcgataatccccatgtgtcatccattattgaaaaatggtccatggagagattgcaggctcccccacggccagagaccggacttctggacggcatgatgaccaccgaagcagcgctgatgtacgatgcggtttatatggttgcaatcgctagtcatagagcctcacagttaacagtgagctctctgcagtgccataggcacaagccatggagattgggaccaagattcatgaacctgataaaagaagcgcgatgggacggacttaccggccatatcacttttaataagactaacggtctgcgcaaagacttcgacctcgatataatctccctgaaagaagaggggacagaaaaagccgctggagaagtgtcaaagcacctctataaggtctggaaaaagatcggaatttggaacagtaactcgggactaaacatgactgattccaacaaggacaagagctccaatatcaccgactccctcgccaataggactctcatcgttactaccattctggaggagccctacgtcatgtataggaaatctgacaagcctctgtatggcaacgaccgctttgaaggatactgcctcgatctgctgaaggaattaagtaatatcctgggtttcatctacgatgtcaagcttgttccagacggaaagtatggtgctcaaaatgacaagggagaatggaacggaatggtgaaagaactgatagatcacagagcagacctcgcagtagccccacttactataacatatgtgagagaaaaagtgattgatttttcaaagccctttatgactcttggaatttcaattctctatcgaaagccaaacgggacaaacccaggcgtcttttcttttctgaatccactgtcccctgacatttggatgtacgtcctcctcgcgtgtttaggagtgtcatgcgttctgtttgtaatcgcccgatttaccccatacgaatggtataacccccacccctgtaatcctgattctgatgtggtggaaaataatttcaccctgctgaattcattctggttcggagtcggtgccctcatgcagcagggaagtgagttaatgcctaaggcactgagcacgcgcatcgtgggcggcatttggtggttcttcacactgattattatttcctcatacactgccaatttggcagcctttctgactgtggagcgtatggaatccccaatcgacagcgcagacgatcttgcaaaacagacaaagattgaatacggagccgtccgtgacggctccacgatgactttcttcaaaaagagcaaaatcagtacttacgaaaagatgtgggcattcatgagtagcagacagcaaactgcccttgtaaggaactccgatgaggggatccaacgggtcctcactaccgactatgccctactgatggagtcaacgtcgattgaatatgtgacccagcgcaattgcaatcttacccagatcgggggactcatagactctaagggctacggtgtgggcactccgataggttcaccctaccgcgacaaaataaccattgctatccttcagctgcaggaagaaggtaagttgcacatgatgaaagagaaatggtggcgaggcaatggatgccccgaagaggacaacaaggaggcaagtgctctcggcgtggaaaatattggcggaatatttattgtgctggctgccggactagtgctctctgtgtttgtggctatcggcgaatttatttataagagtcggaagaataatgacattgagcaggccttctgttttttttatggactgcagtgcaagcagactcacccaactaactctacatctggaacaaccctgtcgacagacctcgagtgcgggaagctgattcgggaagagcgaggcatcaggaaacagtcttccgttcatacagtttag

SEQ ID NO: 118542 - DNA, 2712 bp, Artificial Sequence
  Description of Artificial Sequence: Synthetic coding sequence
atggaacacggtaccctattggcacaaccaggattgtggacccgggacacaagctgggccctgctgtacttcttgtgctacatccttcctcaaacggcgccgcaagtgctccgaattggtgggatctttgaaaccgtcgaaaatgaacccgtcaatgtggaggaactagctttcaagtttgctgtcacttcaatcaaccgaaacaggacactgatgcctaacacaacactcacgtatgatatccaaaggataaacttatttgattctttcgaggcctcgcggcgggcctgtgaccagctcgctctgggcgtcgctgccctgttcggcccttcacacagcagtagcgtcagcgccgtacagtcaatatgtaacgccctggaggtcccccacattcagacccggtggaagcacccatcggtcgataataaggatttattctacattaacctataccccgactatgctgccatatccagggcgattctggacctggtgctgtactataattggaagaccgttactgttgtgtacgaagatagcaccgggctcattcgcctgcaagaactcatcaaggcccccagtaggtacaacataaagattaagattcggcagttgccatccggcaataaagacgcgaagccactccttaaagagatgaagaagggcaaagaattttacgtgattttcgattgctcgcacgaaaccgcagctgagatcctgaaacagattcttttcatgggcatgatgacagaatattaccactattttttcacaaccctggacttgtttgccttggacttggagctataccgatactcaggtgtgaatatgacagggttccgcctgctgaatattgacaatcctcacgtttcctcaattattgagaagtggagtatggaaagactgcaagcacctccacgccctgaaactggccttttagatggcatgatgacaacagaagcagctctgatgtatgacgccgtgtacatggtagccatcgccagtcaccgggcaagccagctgaccgtctccagtctccaatgccaccgccacaagccatggcgtcttggcccccgattcatgaacctaattaaagaagctcgctgggatggcctgacaggacatattacatttaataaaaccaacggcttgaggaaagactttgatctggacatcatttccctgaaagaggaggggaccgaaaagattggtatatggaactccaactctggactaaatatgaccgacagcaacaaggataagagttccaatatcactgatagtctcgcaaataggacactgattgtgaccacaatcttggaagagccttatgttatgtacagaaaatctgataagcctctgtatggcaacgataggtttgaaggctactgtttagatctgctcaaagagttgtcgaacatcctgggtttcatctatgatgtgaagctggtgcctgacggcaaatacggagcacagaacgacaaaggggagtggaacggcatggtcaaggaacttattgatcatcgagctgacctggctgtggcacccctcaccatcacctacgtgcgagagaaagtgatcgacttttcaaaacccttcatgacactcgggatttccatcctctacaggaagccaaacggtacaaatcctggtgtgttctcctttctcaatccactgtcacctgatatttggatgtatgtgcttctcgcatgtctcggtgtttcttgtgtactgttcgtgatagctagattcaccccctacgagtggtacaacccccacccctgtaaccccgatagcgatgtggtggaaaacaattttaccctgctgaatagtttctggtttggcgtgggcgcgctcatgcaacagggtagcgagttaatgcccaaggccctgtcaacgcggattgtgggcggtatctggtggttcttcacgttgatcatcatctctagttataccgcgaatctggcagcgttcctgacagttgaacgaatggagagtcctatcgactccgctgatgatcttgcgaagcagaccaagatcgagtatggggctgtccgtgatgggtccacaatgaccttctttaaaaagagcaaaatcagtacgtacgagaagatgtgggcatttatgtccagcagacagcagaccgccctggttcgcaactcagacgaaggcatccagagggtactgaccaccgactacgctctgctaatggaaagcacatcgattgagtacgtgacacagagaaactgcaatttgactcaaattggcggactaattgactccaagggatacggtgttggaacgcctatcggttctccttacagagataaaattactatcgcaattcttcagctacaggaggagggaaagttgcacatgatgaaggagaagtggtggcgcgggaatggatgcccagaggaggacaataaggaagcgagcgccctcggagttgagaatattgggggcatctttattgtgttggcagcgggattagttctgtccgtattcgtggcgattggagaattcatctataagagtcgaaagaacaacgatattgaacaggcgttttgtttcttctatggtctgcagtgtaagcaaactcacccaacaaacagtacatctggcacaacactgagcacagatctcgagtgtgggaaactgatccgggaagaacgagggatccggaagcagtcctctgttcacacggtgtag

SEQ ID NO: 118543 - DNA, 2763 bp, Artificial Sequence
  Description of Artificial Sequence: Synthetic coding sequence
atggagcatggtaccctcctggcccaaccaggtctgtggacaagagacacttcctgggccctactttattttctgtgttacattctcccgcagaccgctccacaggtgctcagaataggtggcatcttcgagaccgtggaaaacgagcccgtgaatgtagaagagctcgcttttaaattcgctgtgacaagtattaacaggaaccgcaccctgatgcccaatacgaccctcacctatgatatccaaagaatcaacctcttcgattcctttgaagcgagccggcgcgcctgcgaccagctggcccttggggtcgcagcactctttgggcccagtcactcgtcatccgtgtcagcagttcagagtatatgcaatgccctggaggtgcctcatattcagactcgctggaaacaccctagtgttgacaataaagacctgttctacatcaacctgtaccctgactacgccgcaatttcacgcgcgatccttgacctggtgctatattataattggaaaacagtaaccgtcgtgtacgaggattccacaggtctaatcaggcttcaggagttgattaaggcgccttctagatataacattaaaataaaaatccgacagttacccagcggcaacaaagatgcaaagccattattaaaagagatgaaaaaggggaaggagttttatgttattttcgactgtagccacgagactgccgctgaaatactgaagcaaatcctttttatgggcatgatgaccgaatactaccactatttctttaccacattagacctgttcgcactggacttggagctgtacagatacagtggcgttaatatgacggggttcagactcttgaatatagacaatccgcatgtgagctcaatcatcgagaagtggagtatggagagacttcaggctcccccaaggcccgaaaccggtctgctggatggaatgatgacgaccgaggccgcacttatgtacgacgccgtgtacatggtggcaatcgcgagtcaccgtgctagtcaacttactgtctccagtttacagtgtcaccggcataaaccttggagacttgggcccaggttcatgaatctcattaaagaggctcgctgggacgggctgactggccacatcacctttaacaaaactaatggtctccggaaggactttgaccttgacataatatctctgaaggaggagggaaccgaaaaagcagcaggggaagtgagcaagcacctgtacaaagtgtggaagaaaattgggatttggaacagcaattccggactgaacatgaccgacagtaacaaggacaaaagctcgaacatcaccgatagtcttgccaaccgtactctgattgtcaccaccattctcgaagaaccgtacgtgatgtatagaaaatccgacaagccactatatggcaacgaccgcttcgagggatactgtcttgacctgctcaaggagctgtctaacatcctcggttttatctatgatgtaaagctggtccctgatggcaagtatggagcccagaacgacaagggcgagtggaacggcatggtcaaagagctgatagatcatagggccgaccttgccgtggcccctctcacaatcacctatgtccgtgagaaagtgatcgacttttcaaagcctttcatgacgctcggcataagcatcctttaccggaagcctaatggaacaaaccccggggtcttctccttcctgaaccccctcagtcccgacatctggatgtacgtgctgctggcttgtcttggtgtgagctgtgtcctgtttgtgatagcgcgatttaccccatatgaatggtacaacccccacccttgcaatccagatagcgatgtggtggagaataacttcacactcctgaatagtttttggttcggcgtgggcgctcttatgcagcagggtagtgagctgatgccaaaggctctgagcacccggatcgtgggcgggatctggtggtttttcacattaatcatcatatccagttataccgcaaatttggcagcattcctaaccgttgaaaggatggagtccccaattgattctgcagatgacttggctaaacaaacgaaaatcgagtacggcgccgttcgcgacgggagcactatgactttctttaagaaaagcaagattagcacatatgagaaaatgtgggccttcatgagtagccggcagcagaccgcactggttcgcaattcagatgaaggcatccagagggtgctgactacagactatgctctacttatggaatctacaagcattgagtatgtaacccaaaggaactgcaacctcacccagattggcggccttattgactctaaagggtatggagtgggaacgcccattgggagcccataccgtgataagatcacaatcgcgatcttgcagcttcaggaggaggggaagctccacatgatgaaagagaagtggtggcgcggaaatggttgtcccgaagaggacaacaaggaagcctccgcattgggcgtggagaacattggcggcattttcatcgtgctcgcagcaggactggtgctttcagtgttcgtggcaattggtgaattcatctataagtcgcgtaagaataatgacatagagcaatgtctttcttttaacgctataatggaggaattaggcatttctctcaagaatcaaaaaaagatcaaaaagaaatcacggacaaagggcaagtctagttttacctcgatcctcacctgtcatcagcgcaggactcagcgcaaggaaactgtagcttag

SEQ ID NO: 118544 - DNA, 2805 bp, Artificial Sequence
  Description of Artificial Sequence: Synthetic coding sequence
atggaacatggcaccttgttagcacagcccggactgtggacacgtgacacctcttgggcattgctctatttcttatgctacattctccctcagacggcaccccaggtgctgaggatcggcggtattttcgagactgtggagaacgagcctgtgaatgtagaagagttggccttcaagttcgccgtgacttcaatcaaccggaacagaacacttatgccgaatactacactcacttacgacatccagcgcattaatctgtttgattcttttgaggcttccaggcgcgcctgcgatcaactggccctgggggtcgccgctctcttcgggccatctcactctagtagcgtttcagctgtgcaaagcatttgtaacgcgctcgaggtgccacacattcagactcgttggaagcaccccagcgtggataacaaagatttgttttacatcaacttataccccgactatgctgcaatttccagggcgatcctggatctggtcctgtattacaactggaaaacagtcaccgtggtgtacgaggactccacaggcctgattagactgcaggagcttatcaaggcaccaagcaggtacaatattaagatcaaaatccgccagctcccatctggcaacaaagacgccaaacctctgttaaaggaaatgaagaaaggcaaggagttctacgtgatctttgactgcagccacgaaacagccgcggagattttaaaacagatcctgttcatgggcatgatgaccgagtattaccattacttctttactaccctggatctctttgctctggatctggagctctacagatattccggcgtgaacatgactgggttcaggctgctcaacatcgataatcctcacgtgtcaagcattatcgagaagtggagcatggaaaggctccaggcacccccgaggccggaaaccggtctgctggacggcatgatgacgaccgaggccgctctcatgtacgacgcggtctacatggtggccatcgcatcccatagagcttctcagctgactgtttcctctctgcaatgtcaccgccataaaccctggcggttgggcccccgatttatgaatctgattaaggaggctcgatgggatgggctgacgggccatatcacattcaataagaccaatgggctaagaaaggacttcgacctcgatattatttccctgaaagaggaaggcacggagaagataggcatatggaactctaattccggcttaaacatgaccgattcaaataaggataaatcgtcaaatataacagactccctagctaaccgaaccttaatcgtgactaccattcttgaagaaccatacgtgatgtataggaagtcagataagcccctatacggcaatgataggtttgagggatactgtttggacctgctgaaagagctgtccaatatacttggatttatttatgacgtcaagctcgtgccggacggaaagtatggggctcaaaacgataaaggagagtggaacggcatggtaaaggaactgattgaccatcgggccgatctggccgtggccccactcacaatcacatacgtacgggaaaaagtgattgacttttctaaaccgttcatgactttgggcatctccattctctatagaaaaccaaatggcacaaatccgggtgtcttctcttttctgaatcccctttcccctgacatttggatgtacgtactgctcgcatgcttaggcgtctcatgcgtcctgtttgtgatcgccagatttacgccttacgagtggtataatccccatccttgcaatcctgactccgatgtagtcgaaaacaacttcacacttctgaatagcttctggtttggagtgggcgctctcatgcagcagggaagtgagttgatgcctaaagctctgagcaccagaatcgtggggggaatatggtggttttttactctaatcatcatctcgtcttacaccgcgaatctagccgccttcttgaccgtggaacgcatggagagtccaattgactccgctgatgatctggccaagcaaactaagattgagtacggcgccgtacgggatggtagcacaatgactttttttaagaagagcaaaatcagcacctacgaaaagatgtgggccttcatgtcgtcacgccagcaaaccgccctggtccggaattcagacgaaggaattcaacgtgtgttaaccacggactacgcattgttgatggagtccaccagtatcgaatatgtgactcagcggaactgtaacctcacacagattggcggattgatagattccaaaggttacggggtggggacccctatcggctctccttatagggataagatcaccattgccatcttacaactgcaggaggaaggcaaattgcacatgatgaaggaaaagtggtggcgcgggaacggatgccctgaagaagataacaaggaagcaagcgcgctcggcgtagagaacatcggaggaatctttatagtgctggctgccggtttggttctttcggtttttgtggcgatcggagagtttatctacaagagccgcaagaacaatgatatcgaacaaaagggaaagagttcaagaattagattttattttaggaataaggttagatttcatgggcggaagaagcagtctttaggcgtggagaagtgcctcagtttcaatgccatcatggaggagctaggtataagtctcaaaaaccagaaaaaaatcaaaaagaagtcaagaacgaaaggcaagagctcattcacatccatcctaacatgccaccagaggagaacccaaaggaaggaaaccgtggcttag

SEQ ID NO: 118545 - DNA, 2769 bp, Artificial Sequence
  Description of Artificial Sequence: Synthetic coding sequence
atggaacacggtacgttacttgcccagccggggctgtggacacgagacacttcttgggcgctgctgtattttctctgctatatcttaccccagacggccccacaagtactgcgaatcggcggtatcttcgaaaccgtggagaatgagccggtaaacgtggaagaactggcattcaaattcgccgttacctccattaacaggaatagaaccttgatgcccaacacaactctgacctacgatatacagagaatcaatctgtttgacagcttcgaggcctcccggcgagcgtgcgatcaactggctttgggagtggctgccctattcgggcctagtcatagttcatctgtgtctgccgttcaaagtatttgtaacgctttggaggtgccccatatccaaacccggtggaagcacccctctgtggataataaagacttgttttatataaatctgtaccccgattacgcagccatctccagggcgattctcgatctggtgctgtactacaattggaagaccgtcacagtggtgtatgaggattccactggcctgatacggttacaggaactgatcaaggcaccctcacggtacaacataaagatcaagataagacagctgccatccggcaacaaggacgccaagcccctgctgaaagaaatgaaaaaagggaaagagttttacgtgatttttgactgctcacacgagactgccgctgagattctcaagcagattctgttcatgggcatgatgactgagtattaccattatttcttcaccaccctcgatctttttgccctggacctggaactttatcgttattcaggcgtgaatatgactgggttcagactactcaatatcgataacccgcatgtgagttccatcatcgaaaaatggtctatggagcgactccaagcgccacccaggcccgaaaccggcttgctggacggcatgatgactacagaagcggcgctaatgtacgatgcggtgtacatggtggccatcgcaagccaccgcgcttcccagttaactgtaagctcactgcagtgtcaccgacataagccttggcgtttaggtcccaggtttatgaatctgattaaggaagccacggcacggtgggatgggctgaccgggcatatcacatttaacaagactaacgggctcaggaaagattttgaccttgacataataagcttgaaagaggaaggcacggagaaagcggctggagaagtgtctaaacacctgtacaaggtgtggaaaaaaattgggatttggaatagcaactcgggcttaaacatgactgacagcaacaaggacaaatcttctaacatcacggatagcttagccaatagaacactgattgtcacaaccatcctcgaagagccatatgttatgtaccggaaatcagataaacctctgtatggaaatgaccgcttcgaggggtattgccttgacctattaaaggagctctctaacattcttggctttatatacgacgtgaagctggtccctgatggaaagtacggcgcccagaatgacaagggggagtggaatggcatggtgaaagagctcatagatcatcgggctgacctcgctgtcgctccactgaccatcacttacgtccgagagaaggtgatcgatttcagtaagccttttatgacacttgggatttctattctgtaccgcaagcctaacgggaccaaccctggagtcttctcttttctgaaccctctgtcacccgatatttggatgtacgtgctgctggcctgcctaggggtatcttgcgtgctctttgtgatcgcgagatttaccccatacgaatggtataatcctcacccttgcaatccagattccgacgtggtggaaaataactttacactgctcaatagcttttggttcggagtgggagcattgatgcagcagggaagcgaactaatgcctaaggccctgtccaccaggattgttggcgggatctggtggttcttcacactcatcattatatccagctacacggctaatcttgccgcatttctgactgtggagcggatggaatcacccattgactctgccgacgatctagctaagcagacgaaaatcgaatatggcgcagtcagggatggtagcaccatgacgtttttcaaaaaaagcaaaatctctacttatgaaaagatgtgggcctttatgtcttcgcggcagcaaaccgctctcgtgagaaactcagatgaaggcatccaacgggtgctgaccacagattacgccctgcttatggagtccacctctatcgaatacgtgactcagcgcaattgcaacctgacacagatcggcggtctaatcgactcgaagggctacggcgtaggaacacccatagggtcaccttaccgagacaagattacaatagctattctgcaacttcaagaagagggaaaacttcatatgatgaaggaaaagtggtggagggggaatggatgccccgaagaagataataaggaagcctctgccctgggagtggagaacataggcgggatctttatcgtcctagcagctggattggtgttatccgtttttgtcgccatcggcgagtttatttacaaaagtaggaagaataacgacatcgagcaatgcctgtccttcaacgccatcatggaggagcttgggataagcctcaagaaccagaagaaaattaagaagaaaagccgtaccaaaggcaagtcgagcttcacttcgatactgacctgccatcagcggagaacccagcgaaaggagacagtggcttag

SEQ ID NO: 118546 - DNA, 2247 bp, Artificial Sequence
  Description of Artificial Sequence: Synthetic coding sequence
atggaacatggaacgttgctggcgcagccagggctgtggacgcgcgacacttcctgggccctgctgtacttcctgtgttatattctcccacagacggccccacaggttctccggatcgcctgcgaccaactggctctaggagtggcggccctgttcggcccatcgcacagcagctctgtcagcgccgtgcagtctatttgtaacgccttggaagtgcctcacatacagacccgctggaagcaccccagtgtggacaataaagacttgttttacatcaatctgtaccccgactatgccgcaatatcaagagctatcctggacctggtactttactataactggaagacggtgactgtggtttatgaagactctactggcctgatcaggctccaggagctcataaaggctcctagccgctacaatatcaaaattaagattagacagctgccctcaggtaacaaagacgcaaagccacttttgaaagaaatgaaaaaaggaaaagagttctacgtcatcttcgactgctcacatgaaacagccgccgagattctaaaacagatcctgtttatgggcatgatgaccgaatattatcactacttcttcactaccctggatctgttcgcactggacctagaactctatagatattctggcgtcaatatgactgggtttagattgctaaacatcgacaacccccatgtcagcagcatcatcgagaaatggagcatggaaagacttcaggcccccccacgcccagagactggactgctcgacggaatgatgacaaccgaggccgctctgatgtacgatgctgtctacatggtggccatcgcgtcacatcgagcctcacagttgacagtgtcctctctacagtgtcatcggcacaagccttggcgacttggcccacggttcatgaacctcataaaggaggcgcggtgggacgggctgaccggccacatcacattcaataagaccaatggcctgcggaaagattttgatctggatattattagcttgaaggaagagggcacagagaagattggcatatggaatagcaactctggcctgaatatgacagactcaaacaaggacaaatcatctaacattaccgactcgctggccaaccgcacgctgattgtgacaactatcctgcgggccgatctcgcggtcgcgccacttaccattacctacgtcagagagaaagtgatagacttctctaagcctttcatgaccctggggataagtattctgtatcgcaaacctaatggaaccaacccaggggtcttttctttcttaaatcccctgagtccggatatttggatgtacgtgctactggcatgtctaggcgtctcctgtgtgttgttcgtgatagcccggttcaccccatacgagtggtacaacccccatccctgtaaccctgattctgatgtcgtcgagaacaattttacactcctcaactccttttggtttggcgtgggagccctcatgcagcagggttcagagctcatgccaaaagcactgtcaacccggatagttggggggatctggtggttttttacactcatcatcatttcctcttacacagctaacctggcagctttcttgaccgtcgagcgaatggagtctcctatcgacagtgctgatgacctcgctaaacaaaccaagattgagtatggcgcagtgcgggacggttctacgatgaccttcttcaagaagtccaaaatcagcacatacgagaagatgtgggcttttatgtcaagccgccagcagaccgctctggtgaggaacagtgacgaaggcattcaacgcgttctgaccaccgactacgccttgttgatggaaagcacctccattgaatacgtgacacagcgaaattgcaatctcacacagataggcggcctgatagactcaaaggggtacggagtggggactccaatcggtagtccctaccgagacaaaattaccatcgcaatcttgcagttacaagaggaaggaaagctccacatgatgaaggaaaaatggtggagaggcaatggatgtcccgaggaagacaacaaggaagcttcagcattaggcgtggaaaacatcgggggcatctttatagtgttagccgctggattagtattgtccgttttcgtcgctatcggggaattcatctataagagcagaaagaataacgatattgagcagtgtctcagtttcaacgctatcatggaagaactcgggatatccctgaagaaccaatag

SEQ ID NO: 118547 - DNA, 2610 bp, Artificial Sequence
  Description of Artificial Sequence: Synthetic coding sequence
atgaagattatattccctatcctgtctaacccagtcttccgccgtacagttaaactactcctttgtttgctgtggattggctactcgcaaggcacaacccacgtcctgcgcttcggaggaatcttcgagtatgtcgagagtggacctatgggcgcagaggaactggcctttcggttcgccgtgaataccatcaaccgtaaccggactctattaccaaatacaaccctcacctacgacacccaaaagatcaatttgtatgattccttcgaggcttctaaaaaggcatgtgatcagctgtctctaggtgttgcggctatcttcgggcctagtcatagttcttcagctaatgcagtacagtcaatttgtaatgctctgggcgtgcctcatattcagaccaggtggaagcaccaggtatcagacaacaaggacagcttctacgtgagcctgtacccagatttctcgtccctgtcgagagcaatactggatctcgtccagttcttcaagtggaagaccgtaacagttgtctacgatgactccactgggctgattcgactgcaagaacttattaaggccccctcccgctataacctgcgcttgaagattcggcaactgcctgccgacactaaagacgcgaagccactcctcaaagagatgaaacggggcaaggagtttcacgtgatcttcgactgcagccacgagatggccgcaggcatactgaaacaagctttggcgatgggcatgatgaccgaatattaccattacattttcaccacactggacctcttcgccctggatgtcgagccttacagatacagcggcgtgaacatgacaggttttagaattctgaacactgaaaatacacaggtgagtagcatcatagagaaatggtcaatggaaaggctgcaagcccctcctaaaccagatagcggactgctcgacgggtttatgacaactgatgcagctctgatgtatgatgcagtccatgtagtgtcagtcgccgtgcagcaatttcctcagatgacagtgtcctctctacagtgtaacagacataaaccctggcgatttggcacccggttcatgtccctcattaaagaggcacactgggagggcctaactggacgcattactttcaataaaaccaacggtctgcgcacagatttcgatcttgacgtgatctcgctgaaagaagaaggactcgaaaagatagggacctgggatcccgcttccggtctgaacatgactgaaagtcagaagggcaaacctgctaacatcactgactccctatcgaatcgaagcctgatcgttaccaccattttggaagaaccttatgtgctgtttaaaaagagtgataaacctctctacggcaacgatcgatttgaggggtattgtatcgacttgttaagggagctcagtactatattaggtttcacctacgagatccgcctggtggaggatggaaaatacggcgcgcaggacgacgccaatgggcagtggaatggcatggtcagggaacttattgaccataaggctgacctggcagtggccccgctggcgatcacttacgttagggaaaaggtcatcgacttctccaagccctttatgaccctgggcatcagcatcctgtaccggaaacctaacggcactaaccctggggtgttctctttcctaaatcccctgagtcccgatatttggatgtacatcctcttggcgtatcttggagtgagctgcgtgttgttcgtcatcgcccgcttcagcccttatgagtggtataatccgcacccgtgcaaccccgacagtgatgtggtggaaaacaatttcaccctactgaattctttctggttcggcgtgggagccctgatgcagcagggttctgaattgatgcccaaagcgctttctacccgcatagttggaggtatctggtggttcttcaccctcatcatcatttccagctacaccgcaaatcttgctgcgtttcttacagtggagcgcatggagtctcccatagactccgccgatgatctggccaagcagacgaagatcgaatacggagctgttgaggacggtgccaccatgaccttttttaagaaaagcaagattagcacctacgacaaaatgtgggccttcatgtcttcgcgccggcaatctgtgctagtgaagagcaatgaggagggcatacagcgcgtgctaacaagtgattacgcctttctcatggagtccactacaatcgaatttgtgactcaacggaactgtaacctcacccaaattggagggctaatagattcaaagggatatggtgtcggtacccctatgggcagtccttacagggacaagattacaatcgccattctgcaactgcaggaggagggcaaattgcatatgatgaaagaaaagtggtggcggggtaacgggtgccccgaagaagaatctaaagaggccagcgcactcggcgttcagaacatcggcggcattttcattgtacttgcagcaggactggtcctgtcagtgtttgttgctgtcggtgagttcttatacaaatcaaagaaaaacgcacagctcgagaaagaaagcagtatttggctagtccctccttaccaccctgatactgtgtag

SEQ ID NO: 118548 - DNA, 2580 bp, Artificial Sequence
  Description of Artificial Sequence: Synthetic coding sequence
atgggggccgaagaattggccttcagattcgccgtgaatacaattaaccgcaatcgaacccttctgcccaatacgacactgacatacgacactcaaaagataaatctttatgacagctttgaagctagcaaaaaggcctgtgatcaactttctcttggcgtagcggccattttcggtccaagccactcttcctcagcgaacgcagtccagagcatctgcaatgcactcggcgtgccacatattcagaccagatggaagcaccaggtgtccgataataaagacagcttttacgtctcattatacccggactttagtagcctgagccgggcaattctcgatctagtacaattctttaagtggaaaactgtgaccgttgtttacgacgattcaactggactcatccggttgcaggaacttataaaagccccctcaagatataatctccggctaaaaatcagacagttgcccgccgacactaaagatgccaaacctcttctgaaggaaatgaagcgcggtaaagagttccacgtgatcttcgattgtagccatgaaatggcagctggtatcctgaagcaggcactggccatgggcatgatgaccgagtactatcactacatcttcaccactcttgacttgttcgcactggacgtggagccttatagatattccggagtgaacatgactggctttaggatccttaatacagagaacacgcaagtgagctcgatcatagagaaatggtccatggaaaggctgcaagcgcctcctaagcctgactctggcctgctagacggcttcatgacaacggacgctgcccttatgtacgacgccgtgcacgtggtgtcagtggctgtgcaacagttccctcagatgaccgtaagttctctgcagtgcaacaggcataagccttggagattcggcacccggtttatgagcctgattaaggaggcccactgggagggacttactggcaggatcacatttaacaagacgaacggacttcgtaccgattttgacttagacgtcatttccttgaaggaggagggcctggagaaaattggaacttgggacccagccagcggactgaacatgactgaaagccagaaggggaagccagcaaatatcacagatagcctctccaatagatcactgattgtgacgactatcctggaagaaccttacgtgctgtttaagaagagcgacaaacctctgtacggaaacgaccgttttgagggatattgcatcgatctcctgagagaactgtcaactattctgggtttcacctatgagatacgtctcgtggaagatgggaaatacggggcgcaggatgatgccaatggtcagtggaacggaatggtccgagagttgattgatcacaaggccgacctggcagtagcccccttggctattacttatgtacgcgagaaagttatcgacttctctaaaccctttatgaccttaggcattagtatactataccgcaagcccaatggtacgaatccgggcgttttttccttccttaacccactgtccccggacatctggatgtatatcctgctggcatatctcggcgtcagctgtgtgctgttcgtgatagctagattcagcccttacgagtggtacaacccccatccttgtaatccagattccgatgtggtggaaaacaattttactctgttaaattccttctggttcggagtgggagccctgatgcagcaaggttcagaactgatgcccaaggctttgagcaccaggatcgtcggggggatctggtggtttttcacactgatcatcatatcctcttataccgccaacctggccgcgttcctaacagtggagagaatggagtctcccatcgacagcgccgacgatttagccaaacaaaccaagattgagtacggcgcagtggaagacggcgccactatgacgttttttaaaaagtctaaaatcagtacctatgataagatgtgggcatttatgagcagtcgaaggcagtcggtccttgtgaaatctaatgaggagggcatacagcgggttttaacaagcgactatgccttcttaatggagtccactacgatcgaatttgtgacccagcgaaactgcaatctcacccagatcgggggccttatcgattccaagggctacggggttggcacgccaatgggcagcccttatagagacaaaattaccattgccatcctccagctccaggaggagggaaagctccatatgatgaaagagaagtggtggcgtggcaatggctgtccagaagaagaatcaaaggaggctagcgccctgggggtccagaatattggagggatcttcatcgtgctggcagccgggctcgtcctgtctgtgtttgtggcggtcggcgaattcctctacaaatcgaaaaaaaacgctcaactggaaaaacggagtttctgtagcgccatggtcgaggagctcagaatgtctctcaagtgtcagcgccgactcaagcacaagccgcaggcaccggtgattgtcaagacggaggaggtcatcaacatgcacaccttcaatgaccggcgcctacccggcaaggaaactatggcatag

SEQ ID NO: 118549 - DNA, 2499 bp, Artificial Sequence
  Description of Artificial Sequence: Synthetic coding sequence
atgaaaataatattccccatcctgagtaatcccgtatttaggcggacagtgaaattgttactgtgcttactctggattggctactctcagggaaccacccatgttctcagattcggcggcatttttgaatatgtggagagtgggccaatgggcgcagaggagctcgctttcaggtttgctgtgaatacgatcaacaggaatagaaccctactgcctaacacaacgttaacttacgacacacagaagattaatttatatgattctttcgaggcttcaaaaaaggcctgcgaccagttgtccttgggagtggccgctatctttgggccttcgcattcgtccagcgccaacgctgtccagtccatttgtaatgcacttggcgttccacacatccagactcgctggaaacatcaggtttctgataataaagactccttctacgtatccctatacccggactttagctcgctgtcccgcgcaatccttgatctggtccagttctttaagtggaaaactgtgactgtggtgtacgatgatagcacaggcctgatccgcctgcaggagctgatcaaggcccctagccggtacaatctgcggctgaaaatccgtcagttgcccgccgatacgaaggatgcaaagcctctgctaaaagagatgaagcgcggtaaggagtttcacgttatttttgactgctcgcatgagatggcagccgggattctgaagcaggctctggccatgggtatgatgaccgaatactatcactatattttcactaccttagacttatttgcactcgatgtcgaaccatatcgttacagcggcgtgaacatgaccggctttcgcatccttaatactgaaaacacacaggtcagctctattatcgaaaaatggagcatggaaagattgcaggctccacctaaaccggactctgggcttttggatggcttcatgacaactgacgctgctttaatgtatgacgcagtacacgtggtttctgtggccgtccagcagtttccacagatgacagtgagtagtcttcaatgtaaccgacacaagccgtggcgatttgggacccggttcatgtctctaattaaggaagcccactgggagggactcacgggccgtatcacttttaacaaaacaaatggtctccggacagacttcgatctcgatgtgatctctctgaaggaggagggactcgagaaaataggcacatgggatcctgcgagtggcctgaacatgaccgagagccagaagggtaagcccgcaaacatcactgactctctcagtaatcggtcgttaatcgtaacaacaattttggaggaaccatatgttctgttcaagaagtccgataagcccctttatggaaacgatcgcttcgagggctattgtatagacctgttaagggagctctcgaccattctcggttttacatatgaaatcagactcgtcgaggatggaaagtacggagcacaggatgacgccaatggccaatggaatggaatggtcagggaacttatcgatcacaaggctgatttggctgtagcccccctggctatcacttacgtacgagaaaaagtcatagattttagcaagccttttatgacgctggggataagtatcctttatagaaagcccaacggtagtgagctaatgcctaaggccctgagtacacgcattgtgggtggcatctggtggttctttaccttaataattatttcgtcctacaccgccaatctggcagcctttttgaccgtagaaagaatggagtccccaattgatagcgccgatgacctggcaaaacagaccaagatcgagtacggcgcagtggaagacggtgcaacgatgactttttttaaaaaatcaaagatctccacctatgacaagatgtgggccttcatgtccagcaggcgacagagtgtcctagttaaatccaatgaggagggaattcagagggtacttacctcggactatgcctttttgatggaatccaccactatagagtttgtcactcagcgcaattgtaatttaactcagataggtggcctaattgatagcaagggatacggagttggcacacctatgggaagtccttaccgcgacaagataaccattgctatcctccagctacaggaggagggcaagctacatatgatgaaagaaaaatggtggcggggcaatgggtgtcccgaagaggaatcaaaggaggcttcagctctcggcgtgcaaaatatcgggggaatttttatagtgttggccgctggattagttctcagtgtcttcgttgccgtgggagaattcctgtacaaatctaagaagaatgcccagctcgaaaaacggagtttttgctcagccatggtggaagagctgagaatgtctttaaagtgtcagcgcaggctaaagcacaaaccgcaggcccccgtgattgtgaagaccgaagaggttattaatatgcacaccttcaacgacaggaggcttcccggcaaagagactatggcctag

SEQ ID NO: 118550 - DNA, 2679 bp, Artificial Sequence
  Description of Artificial Sequence: Synthetic coding sequence
atgaaaattatcttccccattctttctaatccagtgttcaggcgcactgtcaagctgttgctgtgccttctctggatcggctactcgcagggaaccacacacgtcctgcgatttggggggatttttgagtacgtggaatcagggccaatgggcgctgaggagctagcattcaggtttgccgtgaataccattaaccgcaaccgcaccctcttgccaaatactaccttaacctacgacactcaaaaaatcaacctctatgactcctttgaagctagtaaaaaggcatgtgaccagctctccctgggggttgccgcaatttttggcccctctcattcttcttcagctaacgcggtgcaatccatctgtaatgccctcggggtgccacacattcaaacacgatggaaacatcaagtttccgacaataaggattccttttacgtatctttataccccgatttctcaagcctgagtagggcgattctggatcttgttcaatttttcaaatggaaaacagttaccgtcgtttacgacgactctactggccttatcagactgcaagagctaatcaaggctccgtcccgctacaatctccggttgaaaatcaggcagctacccgccgataccaaggacgccaaacctctgctgaaggagatgaaaagggggaaagaattccacgtgatcttcgactgctcccacgaaatggcagccgggatcctcaagcaagcacttgctatgggtatgatgactgaatattaccactatattttcactactctagacctctttgcccttgacgtggagccctaccggtactccggcgtcaatatgacaggattcagaatcctgaatacagagaacacacaggtgtcctctattatagaaaaatggagtatggaaagactgcaagcccctcccaagcccgacagtgggcttctggatggcttcatgaccaccgatgccgccctaatgtacgacgccgtacacgtagtaagtgtcgccgtccagcagttccctcagatgacagtcagctcactccagtgtaatcgccacaaaccctggcgctttggaacacgcttcatgagccttattaaggaggcacattgggaggggctgaccggtcgcatcactttcaataagactaacgggctccggaccgattttgatctggatgtgatttccctaaaagaagaaggcctcgaaaagatcggcacgtgggatcctgcctccggcttaaatatgaccgagagccagaaagggaagcccgctaacattaccgactccctcagcaacagatctcttattgtaaccaccatcctcgaagagccttatgttcttttcaaaaagtctgataagccactgtatggaaacgatcgcttcgagggatattgcatagacttattgagagagttgtcaactattctgggctttacatacgaaattcggctggtggaggacggtaaatacggggctcaagacgatgctaacggccaatggaatgggatggtacgggaactgatcgatcacaaagcagatttagccgtcgctcctctggcaatcacctatgtgagagaaaaggtaatcgacttctcgaagccattcatgaccctagggataagtattctttaccgcaaacccaacggaactaaccccggggtctttagtttcctgaaccctctgtctcctgatatctggatgtatattctcctcgcataccttggtgtgtcatgcgttctgtttgtcatcgcccgcttctcaccttacgaatggtataatcctcacccatgcaatccggactctgacgtggtggaaaataacttcacattgctcaattcattttggttcggtgtcggcgcactcatgcagcaaggtagtgagctgatgcctaaggcgctctcaacacgaatcgtcggcgggatatggtggttctttacgctgattattatcagctcatacacagccaacttagcggcttttctcactgtcgagcggatggaaagcccaatcgactctgcagacgacctggctaaacagaccaagatcgagtacggcgctgtcgaggacggagccacgatgaccttcttcaagaaatccaaaatatctacttatgacaaaatgtgggcttttatgtccagcaggagacagagcgtattagtgaagagcaacgaagaaggaattcagcgcgtcttgaccagcgattacgcgtttctgatggagagtacaacaattgagttcgtcacacagcgcaactgtaatttaacacagataggtggcctgatcgactcgaaggggtacggcgtcggcactcctatggggagtccataccgagacaagattactatagcgattctgcagctgcaggaagaaggcaagctgcacatgatgaaagagaagtggtggcgcggcaatgggtgtcccgaggaagaatccaaggaagcttctgccctgggcgtccaaaacatcggcggcatcttcatcgtgcttgctgctggcctcgtgctgtcagtgtttgtcgctgttggcgaattcctatacaagagtaagaagaacgcccagctggaaaaaagagcaaagacaaaactccctcaggactacgtgttcttaccaattcttgagagcgtttccatctccactgtgctctcctccagtccaagctccagttccttatcaagctgttcttag

SEQ ID NO: 118551 - DNA, 1755 bp, Artificial Sequence
  Description of Artificial Sequence: Synthetic coding sequence
atgaagatcatcttccctatccttagcaacccagtttttcggcgtactgtgaagctgctcctctgtctgctctggattggctactcacagggcaccacccacgtcttgcgctttggcggcatattcgagtatgttgagagcggacccatgggggctgaagaactggcatttcggttcgcggtgaacaccattaaccggaatcgcacacttctccctaacaccacattgacatatgacacccagaaaattaacttatatgacagctttgaggcgtccaagaaagcttgtgatcagctgagcttaggtgtcgccgccattttcggacccagccatagttcatctgccaatgcagtgcaatctatctgtaatgctctgggagtcccccacatccaaactcgctggaagcaccaagtgtccgataacaaagacagtttctacgtcagcttgtatccagatttcagcagtctgagtagggctattttggatctagtgcagttctttaagtggaaaactgtgacggtggtctacgacgatagtacgggactgatccgactgcaggaactgataaaagccccatcccgctacaatctcaggcttaaaattaggcagctccccgctgataccaaggacgccaagcccctgctgaaggagatgaagcgtggcaaagagtttcatgtgattttcgactgctctcacgaaatggctgccggcattcttaagcaggctttagccatgggtatgatgacggaatactaccattatatcttcaccacccttgacctgtttgccctagacgttgagccctaccggtactcaggcgtcaatatgactggattccgcatattgaacaccgaaaacacccaggttagttcgatcattgaaaaatggagcatggagaggctgcaagccccccccaagccagatagcggccttttagatggtttcatgactactgatgcagccctgatgtatgacgccgtgcatgtggttagtgttgctgttcagcaattcccccagatgactgtgagcagcttacagtgtaatcgacacaaaccctggcgttttgggaccagatttatgtcactgatcaaggaagcccactgggaaggactgactggacggattacctttaataagaccaacggcctgcgcaccgacttcgatctggatgtcatttctttaaaagaagaaggactcgaaaaaatcgggacgtgggacccagcatccggactgaatatgacagaatcacagaagggcaagcccgcaaatataactgactctctctctaaccgatccttgatcgttacaactattctggaggagccatacgtgctcttcaaaaagagcgacaaacctctgtacggaaatgatcgctttgagggatactgcatcgatctgctgcgcgagcttagcacaatcttaggttttacctatgagatccggctggtggaggacggcaagtacggggcacaggacgatgctaatggacaatggaacgggatggtgcgcgaacttatagatcacaaagcagatcttgctgtggccccccttgctattacgtatgtcagggaaaaagtcattgatttcagcaagccatttatgaccttagggatttcgatactctaccggaagcccaatggaactaaccctggagttttctcattcctgaatcctctgtctcctgatatctggatgtatatcttgcttgcatatttgggagtgagctgcgtgctgttcgtgatcgcccggttttag

SEQ ID NO: 118552 - DNA, 2610 bp, Artificial Sequence
  Description of Artificial Sequence: Synthetic coding sequence
atgaagatcatattcccgatcctttcaaacccagtgtttcgccggaccgtaaagctcctgttgtgcttactgtggattggttacagccagggaaccacacacgttttacgttttggtgggatcttcgagtacgtagagtccggtccaatgggagctgaagagttggctttccgctttgctgtcaatacaatcaacaggaaccggacacttctgcctaacacaactctgacatatgatactcagaaaatcaatttatacgactctttcgaggcttccaaaaaggcatgcgaccaactgtcgttaggggtcgcagcgatttttggcccctctcattctagttcagcgaatgctgtgcagagcatatgcaacgccctaggggtaccacatatccagacccgctggaagcaccaggttagcgataacaaagattctttctacgtgtcactctaccccgatttctcctcgctctcacgggccattttggaccttgttcagttttttaaatggaagactgtgacagtggtgtatgatgattctacaggactcatacggctacaggaactgatcaaggcaccgtctcgatacaacctgaggctcaagatcagacagctcccggccgacacaaaagacgcaaagccactgcttaaggagatgaaacgaggcaaagagttccatgtcatcttcgactgctcacatgaaatggcggccggcattctcaaacaagcactcgctatgggcatgatgacggagtactatcactacatcttcactactctcgatctgttcgcccttgacgtagaaccttatcgctatagtggagttaatatgacaggtttcagaatcctcaatactgaaaacacacaggtgagctccatcattgagaaatggagcatggagaggctacaggcccctcccaagccagatagcgggctgctcgatggatttatgaccacagacgccgcccttatgtatgacgccgttcacgttgtcagcgtcgcggtccagcaatttccgcaaatgacagtgagctccctacagtgtaataggcacaaaccctggcgcttcggaactcgcttcatgtcgctcattaaagaggcacattgggagggcttaacgggacgcataacctttaacaagaccaatggcctacgaactgacttcgacctggatgtaatcagtctgaaagaggaggggctggagaaaataggcacatgggaccctgcttccggcctcaatatgaccgaaagtcagaaagggaagcctgccaacatcactgacagcctgagcaatcggagcctcattgtgacgaccattcttgaagagccgtatgttctgtttaaaaagtcagacaaacctttgtacggcaatgaccgcttcgagggatattgcattgatttgctgcgggagctctcgaccatcttaggctttacatatgaaatccgcctcgtcgaagatggaaagtatggggctcaggacgacgctaatggtcagtggaacggtatggttcgcgagttaatcgatcataaggctgacttggcagttgcgccactggccattacttatgtgagagagaaggttatcgatttcagcaaaccgttcatgacacttggcatctccattctgtaccgtaagccaaatggcactaacccgggggttttctcgtttctaaatccactgtcccctgatatctggatgtacatcctgctggcgtacctgggagtgtcctgtgtgctgttcgtcattgcaagattcagcccttacgagtggtacaacccacatccctgcaaccccgactctgacgtggtggaaaataatttcacactactgaacagtttctggtttggtgtgggggctctgatgcagcagggcagtgagctgatgcctaaggctctgagcaccaggatcgtaggggggatttggtggtttttcacgctaataatcatctcttcatacacagctaacctggccgccttccttaccgttgagcggatggaaagtcctatcgactctgcagacgacctggcaaaacaaacaaagattgaatacggagccgtggaagacggtgctactatgacattcttcaagaagagcaaaatctctacttatgacaagatgtgggcctttatgagctcacgtcgtcagagcgtgttggtgaaatccaatgaagagggcatacagcgcgtactgaccagcgactacgccttcctcatggagtccacgacaatcgaatttgtgactcagcgcaactgtaacctgacacagattggtggcctgattgacagcaaagggtatggagtcggaacacctatgggaagcccataccgcgacaaaatcaccatcgcaatcttgcagcttcaggaagaggggaagttgcacatgatgaaagaaaaatggtggagaggaaacggttgtccagaggaggaatcaaaagaggctagcgctctaggtgtacaaaatataggaggaattttcattgttcttgccgcgggcctggtgctgagtgtgttcgtggccgtgggcgagttcctctataagtccaagaagaatgcccagctggagaaagaaagctccatttggctggtaccgccgtatcatcctgacacagtgtag

SEQ ID NO: 118553 - DNA, 2727 bp, Artificial Sequence
  Description of Artificial Sequence: Synthetic coding sequence
atgaaaattatattcccgatcctcagtaatcccgtcttccggcggactgtcaagttgctgctgtgcttactgtggattggctattctcagggcacaacccacgtgcttagattcggggggatcttcgaatatgtggagtccggtcccatgggcgcagaggaattagcattccgatttgccgtcaacacaattaatagaaatagaacactgctccctaataccacactaacatacgacacccagaaaatcaacctctacgatagcttcgaggccagcaagaaggcctgcgaccagctttccctaggcgtggccgctattttcggaccatcacatagctcctctgcgaacgccgttcagtctatttgcaacgcacttggggtaccacacattcaaactcgatggaagcatcaagtgtccgataacaaggacagcttctatgtgagcctttatcctgatttctctagccttagcagggctatcctggatctggtccaattcttcaaatggaaaacggtcacagtagtatatgatgattctacaggattgatccggctccaagaattgataaaggctccctccagatacaatttgagattaaaaattcgtcagctccctgccgacaccaaagacgcaaagccactgttaaaggaaatgaagaggggaaaagagtttcatgtgatctttgattgctcacatgaaatggccgctgggattctgaagcaagcgctggctatgggtatgatgactgaatattaccattatatcttcactacacttgacttattcgccttagacgtcgagccctatcgctatagcggtgttaatatgacaggcttcaggatcctcaatactgagaatacgcaagtgagtagtattatagagaaatggagcatggagcgtttgcaggccccccctaaacctgattcaggactgctcgacggctttatgacaacggatgccgctctcatgtatgacgctgtgcatgtcgtttccgttgccgtgcagcaatttccccagatgacagtctcatctctgcagtgtaataggcacaaaccttggcggtttggtactagattcatgtccctgattaaagaggcccactgggaaggtttgaccgggcgtatcacttttaacaaaaccaatggcctgcgcactgatttcgacctggacgtcatcagtttgaaggaagaaggcttagagaagatcggcacatgggacccagcatcaggacttaatatgaccgagagtcaaaaaggaaaaccggctaacataaccgacagtctttccaatcgctccttgatagtcacaactatcttggaagaaccttacgtactcttcaaaaaatcggataagccgctttatgggaacgatcgtttcgaaggctattgtattgacttacttcgagaattgtcaacaatcttgggatttacctatgagataaggcttgtggaggatggtaaatacggagcccaggatgacgccaatggtcagtggaatgggatggtgcgcgagcttatcgatcataaggccgatctggcagtggcccctttggccattacgtacgtgagagagaaagtgatcgatttcagcaaaccgttcatgactcttgggattagcatcctgtaccggaaacctaatggaaccaatcccggcgttttctcattcctgaacccgttgagtcctgacatctggatgtatatccttctggcttatctaggggtgtcctgcgtgcttttcgtgattgcccggttttcaccgtacgagtggtacaaccctcatccgtgtaaccccgattcagatgtagttgagaacaattttaccctcctgaactccttttggttcggcgtgggagccctgatgcagcaaggttcggagcttatgccaaaagccttatccacaagaatagtgggcggaatatggtggtttttcactctcattataataagtagctatacagctaatctggccgcatttctcacggtggaaagaatggagtcacctatcgatagtgccgatgatttagcgaaacaaaccaaaattgaatatggagccgtggaggatggagctacgatgacattcttcaagaagtctaaaatctccacatatgataaaatgtgggcctttatgagttcgaggagacagtctgtgttggttaagagcaacgaagaggggattcagcgggtactgaccagcgattatgcctttctcatggagtcgaccaccattgaattcgttacccagagaaattgtaatctgactcagatagggggattgatcgattctaaggggtacggggtgggcacccctatgggctccccataccgggataagataacaatcgccattctgcagctccaggaagagggcaaattgcatatgatgaaggagaaatggtggcgtggcaacggctgtcccgaggaagaatccaaggaagccagcgccctaggagtgcagaacataggggggatctttatcgttctggcggctgggctggtgcttagcgtctttgtggcagttggagagttcctgtataagtccaagaagaatgcccagctggaaaagagatctttttgcagcgccatggtcgaggaactgagaatgtcgctgaagtgccagaggcgccttaagcacaaaccccaggctccagtgattgtgaaaacagaagaagtcatcaacatgcacactttcaatgatcgcaggctcccgggaaaagagaccatggcctag

SEQ ID NO: 118554 - DNA, 1935 bp, Artificial Sequence
  Description of Artificial Sequence: Synthetic coding sequence
ggcggtatcttcgaatatgtggagagcggacctatgggagcagaagagctggctttccggttcgcagtcaacacaataaaccgcaataggaccctgctgcctaataccaccttaacgtacgatactcagaagatcaacctgtacgacagcttcgaggcttccaaaaaagcttgcgatcagctttctctgggcgtggccgctatctttgggccttcacatagctcatccgctaatgcagtccaatccatctgcaacgcccttggtgttccacacattcagacacggtggaaacatcaggtgtccgataacaaggactctttctacgtgagtctctatcctgacttcagctccctctcccgtgcaatccttgatctggtgcagttttttaagtggaagaccgtgaccgtggtctatgatgacagtaccggtcttattcgcttgcaagagctgattaaggctccctcacggtacaacctgcgattgaaaattcggcaactgccggctgatacaaaagatgccaagcccttgctgaaggaaatgaagagggggaaggagtttcatgtcattttcgactgctcacacgagatggcggcgggcattcttaaacaggcccttgcaatggggatgatgaccgagtactaccattatatctttactactctggatctgtttgccctagacgtggagccgtaccgttacagcggcgtgaatatgacgggcttccggattttaaacaccgaaaacacacaggtgagttccatcatcgaaaagtggtccatggagagactgcaggcaccacctaagcctgactccggtctcctcgatggatttatgactaccgacgccgcgctgatgtacgacgccgtgcacgtcgtgtctgtcgccgtacagcagttcccacagatgactgtatccagcctgcagtgcaacaggcacaaaccatggcgatttggcactcgcttcatgagtctcattaaggaagcgcattgggaaggcctgaccggcaggatcactttcaataaaacaaacggtctgcgtacagacttcgatctggacgtcattagcttgaaggaggagggccttgagaagatcggtacctgggaccctgctagcgggctgaacatgaccgaatcacagaaggggaaaccagccaatattacagactctctgtcaaatcgatctctgatagttaccactatcctggaagagccttacgtgctgttcaagaaatctgacaagccactgtacggaaacgacagatttgagggatactgtattgatctgttgcgggagttatcaacaattctgggcttcacatacgaaatccggctcgtcgaagatggcaaatatggtgcccaggatgacgcaaacggccagtggaacgggatggtacgggaactaatcgatcacaaatcaaagatctcaacctatgacaagatgtgggcttttatgagcagtcggagacagtctgtcttagtgaagagcaatgaggaggggattcaaagggtgcttacctcagactatgccttcttgatggagtccaccaccatcgagttcgttacacagcgtaactgtaatctgacccagatcggtggactgattgacagtaagggttacggagtcggcacaccgatggggagtccctatcgcgacaagattacgatcgcaatcctgcagcttcaagaagagggaaagctgcatatgatgaaagaaaaatggtggcgcggaaacgggtgcccagaggaagaatctaaagaggcgagtgccctgggagttcagaacatcggaggtatcttcattgtgttggccgccggactcgttctatctgtgttcgtggctgtgggtgagttcctatataagtccaagaaaaacgctcagctggaaaaggagtcctccatttggctagtcccaccctatcacccagatacggtttag

SEQ ID NO: 118555 - DNA, 2760 bp, Artificial Sequence
  Description of Artificial Sequence: Synthetic coding sequence
atgaccgctccctggaggcgcctgcgcagtttggtgtgggagtactgggccggactactggtttgtgctttctggatccctgacagtcgtggcatgccccacgtgatccgaatcggagggatcttcgagtacgcggacgggccgaatgcccaagtcatgaatgcagaagaacacgccttccgcttctcagctaatatcatcaacagaaatcggacactccttcctaataccacactcacatacgacatccagagaattcattttcatgatagtttcgaggcaaccaaaaaggcatgtgatcagttagcattgggggttgtggcaatatttggacccagccaaggatcttgcaccaatgccgtgcaaagcatttgcaatgccctggaagtgcctcatattcaacttaggtggaagcatcacccacttgacaataaagatactttttatgtgaacctgtatccagattatgcctccctatcacacgctattctcgaccttgtgcagtatttaaagtggcggtccgctaccgttgtttacgacgacagtacaggtcttatcaggttgcaagagctgatcatggcgccatcacgttacaacatccggcttaagattagacagctgcccatcgactctgatgatagcaggcctctgctgaaggagatgaaaagaggacgagaattccgtatcatatttgattgcagtcacaccatggccgcgcagatactgaaacaggccatggcaatgggaatgatgaccgagtattatcactttatttttaccaccctggatctatacgccttagatctggagccatatagatattctggcgtaaatctgactggatttaggatcctgaatgttgacaatccccatgtgagtgcgatcgtggagaaatggagtatggaacggcttcaagccgctccgagaagtgagtctggactgcttgatggtgtgatgatgacagacgccgccttgctgtacgacgctgtccatattgtgtccgtctgttaccagagagcgccccagatgacggtgaatagcttgcagtgccatcgacacaaagcgtggcgattcggaggtagatttatgaatttcattaaggaagcccagtgggaaggtttaacgggacggatcgtgttcaataagacttcaggcctccgcaccgactttgatcttgatatcatctctcttaaggaagacggtctggaaaaagtaggcgtgtggtcccccgctgatgggctcaacattacagaagtcgcaaaggggcggggccccaacgttaccgactctcttaccaaccgcagtctgatcgtgactaccgtgctggaagagcccttcgtgatgttccgaaaaagcgaccgcacgttgtacggcaacgatcgctttgaggggtactgcatcgatctgctgaaagagcttgcccatatcctgggcttctcctacgaaataagactcgtagaggatggaaaatatggagcccaggatgataaaggacagtggaatggtatggttaaagaattgatcgatcacaaagctgatcttgccgtggctcctttgacgataacccatgttcgtgagaaggccatagatttttctaagccctttatgacactgggagtctcaatcctttaccgtaaacctaacggaacaaacccgtccgtgttttcattccttaaccccctcagtccagacatatggatgtacgtgctactggcctacttgggtgtcagttgtgtgttgttcgttatagcacggtttagtccttacgagtggtatgatgcacacccctgcaacccgggctcagaggtggtggaaaataatttcactcttctgaattccttctggttcggcatggggagtctaatgcagcagggcagcgagctgatgcctaaggcactaagtacaaggataatcggtgggatctggtggttctttactctgattattatcagcagctacaccgctaatctcgctgccttcttgaccgtggagcgaatggagtcgcccatcgattctgctgacgacttagccaaacagaccaaaatcgagtatggggctgtcaaggacggcgcgactatgaccttcttcaagaagtccaaaatttcaactttcgagaaaatgtgggcattcatgtctagcaagcctagcgcactggttaaaaacaacgaggagggcattcagcgcgctctcacagctgattacgccttgcttatggagagtacaactatcgagtacgtgacccagcgcaattgcaatctgacccagatcgggggtctgatcgatagcaaggggtacggaatcggcaccccaatgggttctccttaccgcgacaaaatcacaatcgctattctgcagctccaggaagaggataaactgcacattatgaaagaaaagtggtggagaggctcgggatgccccgaggaagagaataaggaggctagtgctctcgggatacagaagatcggtggtatatttatagtgctggcagccggcctcgttctgtccgtgctggtggcagtgggcgagtttgtgtataagctcagaaagactgctgaaagggaacagcggagcttctgctcaaccgtggctgacgagatacgattctctttaacgtgccagcgcagagtcaaacacaagcctcaaccaccaatgatggtgaagacggatgcggtcattaacatgcacacgtttaatgataggcgcctgcctggtaaggattccatggcttgttctaccagccttgcccccgtctttccttag

SEQ ID NO: 118556 - DNA, 2619 bp, Artificial Sequence
  Description of Artificial Sequence: Synthetic coding sequence
atgaccgccccttggcgtcgccttaggtcactggtctgggagtactgggccggcctgctcgtatgtgcgttctggattcctgattcaagggggatgccccatgtcatccggattggcggcattttcgagtacgctgacggcccaaacgctcaagtgatgaacgcagaggagcatgcatttcggttcagcgcaaatattattaaccgtaatagaactctgctgcctaacacaacattgacatatgatatccagaggattcacttccacgacagtttcgaggccacaaaaaaggcttgcgatcaattggctctgggtgtcgtcgcaatattcggcccatcacaaggttcctgcactaacgcggttcagtctatctgcaatgccttggaagtgccccacattcagctgcgttggaaacaccatcccctggacaataaagatactttttacgtgaacctttaccccgactatgctagcttgagccatgccatcctggatcttgtccagtacctgaaatggcggagcgcaaccgtcgtgtatgacgattcgactggcctgatcaggctgcaggagttgatcatggcgccgagtagatacaacattcggctgaaaatacggcagctaccgatcgactccgatgattcccggcctctgttaaaggagatgaaaagaggacgagagttcagaatcatctttgactgttcacacactatggcagcccagattcttaaacaggcaatggcaatgggcatgatgaccgagtactatcattttatcttcactactctggatctgtacgctcttgatctcgaaccttatcggtactccggagttaacctcaccggcttccggattcttaacgttgacaatccacatgtgtccgctatcgtcgaaaaatggtccatggagcgcttgcaggctgcccccaggtctgaatccggtctgcttgacggggttatgatgaccgatgccgccctgctctacgacgccgtccacatagtgagcgtttgttatcagagggccccccaaatgacagtcaactctttgcagtgccaccggcacaaagcatggcggttcggaggccgattcatgaatttcatcaaggaagctcagtgggaaggattgacaggtagaatcgtgttcaataagaccagcggactcaggacagatttcgatctcgatattatctcgctgaaggaggatggattagaaaaggtgggagtctggtctcccgctgatggacttaacattactgaggtggccaaaggccgaggcccaaacgtaaccgattcacttacaaaccgatcccttatagttaccaccgtgctggaagagccgttcgttatgtttagaaagagcgatagaaccctatatggcaacgaccggttcgagggttactgtatcgacctcttgaaagaactggctcacatactgggattttcctacgagatccgactggtagaagacgggaagtacggcgcccaggatgataagggtcagtggaacgggatggtgaaggaactgatagaccacaaagcggacctggctgtagccccgctcaccatcacacatgtgcgggagaaggctatcgattttagcaaaccgtttatgaccctgggggtgtccattctttaccgcaaaccgaacggaaccaacccatcagtctttagcttcctgaacccactttccccggacatctggatgtatgtgctcctcgcatatctgggggtgtcctgtgtgctgttcgtcatcgcgcgtttctctccatacgagtggtacgacgcacacccatgtaaccctggctcagaagtagtagaaaacaacttcacgcttttgaattccttctggttcggcatgggctcacttatgcaacagggttccgagctgatgcctaaagccctttccaccaggattattggcgggatctggtggttctttaccctcattattatctcaagctacaccgccaatctagccgcctttttaactgtggagcgtatggagagtccgattgattccgcagatgacctggcgaagcagactaagatcgagtatggcgccgtgaaggatggagcaactatgaccttttttaaaaagtctaaaatctcaacgttcgagaagatgtgggcctttatgtcatcaaagccttccgcactggtcaagaacaacgaggagggtatccaaagggctctgacagcagattatgcactcctcatggagtctactactatcgaatacgtgactcagcgtaactgcaatttgacacagatcggaggactgatcgattccaagggctacgggattggcacacccatgggctctccttaccgagacaaaattaccattgcgatcctgcagctccaggaggaagacaagttacacattatgaaagagaagtggtggcggggctccggttgtcctgaggaagaaaacaaggaagccagtgcccttggtatccagaagattggaggaatctttatcgtgttggctgccggcctcgtattgagcgtcctcgtggctgtcggcgagtttgtctacaagctgaggaagacagccgagagggaacaagttagcctgcgggcctggtcattgcatcggatgggcaatggcgactctcggtag

SEQ ID NO: 118557 - DNA, 2871 bp, Artificial Sequence
  Description of Artificial Sequence: Synthetic coding sequence
atgccccgggtgtccgcaccattggtgctgcttcctgcttggctggtcatggtcgcgtgttccccacattctctcaggatcgccgccattttagacgatcctatggaatgtagccgtggggagcgactgtcaatcaccttagcaaagaaccggattaaccgggctcccgagcgcctaggtaaagcgaaggtggaggtcgatatattcgaactgctgagagactccgagtacgagactgccgagaccatgtgtcaaattctgcccaaaggagtggtggctgttttgggcccatccagcagtccggcgtcctcttcaatcattagcaatatttgtggtgagaaggaggtgccccacttcaaggtggcccccgaggagtttgttaagttccaattccagaggtttacaactctaaatctgcacccctctaataccgatatttctgttgccgtggccggaattttgaatttcttcaactgcacaaccgcatgcctgatctgtgccaaggccgaatgtctcctgaatttggagaaactcctgcgtcagtttctgatcagtaaggatacattgtctgttagaatgctcgacgatactcgcgatcccacgccactgctgaaagaaattagggacgacaagactgccaccatcattatccatgcaaatgcgtccatgtcccacaccatcctcttgaaagccgctgagcttggcatggtgtccgcatactacacatatatctttacaaacttggaattctctcttcagcgcatggactccttggtcgatgaccgggtgaacattttggggttttccattttcaaccaaagtcatgccttttttcaggagtttgcccagtcgctcaaccaaagctggcaagaaaattgtgaccacgtgccatttacaggacccgctctgagctctgcattgctgtttgacgcggtgtatgccgtagtgacggcggtccaggagcttaacaggagccaagagattggggtgaaaccactatcatgcggatcagctcagatatggcagcacggcaccagcctcatgaattatttacggatggtagaactggagggcctgactggtcatatcgagttcaattctaagggacaacgttccaattatgctctcaagattcttcaattcactagaaacggctttagacaaatcgggcagtggcacgtggccgaagggctgtctatggactcccacctgtatgcaagcaacatctcagatactctgtttaacacaacccttgtggtgaccacaattctggaaaacccatatctcatgctcaaaggcaaccatcaggaaatggagggtaatgaccggtatgaaggcttctgcgtggatatgctgaaagagttggcggagatccttcgatttaattacaagatcagattggtcggcgatggagtgtatggtgtgcccgaggctaatggcacatggacagggatggtgggggagttgatcgcccggaaggcggatctggctgttgccggtcttaccatcaccgcagagcgggagaaagtgatagacttctctaagcctttcatgacacttggaatctccatcctgtatcgggtccatatgggtcgcaagccagggtactttagtttcctggatccctttagcccaggagtgtggttatttatgctcctcgcctacttggctgttagttgtgtcctattcctcgttgcgaggctgactccctacgaatggtattcccctcatccctgcgcgcagggccgatgcaatctgcttgtgaaccagtattccctgggcaactctttatggttccctgtagggggcttcatgcagcagggaagcactattgcaccacgtgccctgtccacacgatgcgtgtccggagtctggtgggcgtttactctgattattattagctcctacacagctaaccttgcggcgtttctgacagttcaaagaatggatgtacctattgagagcgtagatgatctggccgatcagaccgccattgaatatggaactatccacggtggatccagcatgaccttttttcagaattcacgctatcagacgtaccaaaggatgtggaactatatgtactccaaacagccttctgtgttcgttaagagcactgaagagggcatcgcacgagtgctcaattccaattatgcatttctcctcgagagcaccatgaacgaatactatcggcaaaggaattgtaacttgactcagattgggggcctactcgacactaaagggtatgggatcggcatgcctgttgggtctgttttccgcgacgaatttgacctggcaattttacagctccaggagaacaaccggctggagattttgaaaagaaagtggtgggaaggcgggaaatgtccaaaagaggaggaccatagagcgaaggggctgggtatggaaaacatcggcgggattttcgttgtactaatctgtggactgatagtcgccatttttatggccatgcttgagttcctgtggaccttgaggcactcagaggccacagaagtgtcagtctgtcaggagatggtcacagagctgagaagtattatattatgccaggattccatccatccgagaaggagacgggcggcagttccaccccccaggcctccgataccagaggagcgccggcctcgcggcaccgcaactctctcaaatggaaaactctgtggcgcaggagagccagaccagttggcccagcgtcttgcacaggaggctgcgctggtggccagagggtgcacccatatacgagtttgtcccgagtgtagaaggtttcagggccttcgtgcccggccaagcccagccagatccgaggagagcttggaatgggagaagacaacaaactctagtgagcccgaatag

SEQ ID NO: 118558 - DNA, 2871 bp, Artificial Sequence
  Description of Artificial Sequence: Synthetic coding sequence
atgccgagagtgtctgcaccgctggtactgctcccagcgtggttggtgatggtggcgtgttcgccccactcattgcgcattgccgccattctggatgacccgatggagtgctcaaggggggagcggctgtccataacacttgccaaaaataggatcaatagggcgcctgagagattgggaaaagctaaagtggaggtggatatcttcgaactgctgcgggactcagagtacgaaacagcagagactatgtgtcagattctgccaaagggagtagtggccgtgcttggcccttcatcttcaccagcctccagcagtatcatcagtaatatttgcggggaaaaagaggtcccacattttaaggttgcacccgaggagtttgtgaaattccagtttcagcgcttcacgaccttgaacctgcatcccagtaatacggatattagtgtcgccgtggctggcattctcaactttttcaactgtaccaccgcttgcctgatctgcgctaaggctgagtgtctcctcaaccttgagaaactcctgagacagttcctaattagcaaagacactcttagcgtgcgtatgctggacgacacccgcgaccccactccccttctcaaggagatccgtgatgataagaccgctactatcatcatccatgcaaacgccagtatgagccacaccatcctgttgaaggccgccgagctagggatggtttccgcgtattacacctacatctttaccaacctggaattctctctccagcggatggattcacttgtcgacgaccgagtgaatatccttggcttctccattttcaatcaatcacacgcgtttttccaggagtttgcccagagcctgaatcagagttggcaagaaaattgtgaccacgtcccatttaccggtccagccttgagtagcgcgctgctgtttgacgccgtgtatgcagtggtgaccgctgtacaagagctgaatcgaagccaggagatcggcgtcaaaccactgagctgtgggtccgcccaaatctggcaacacggtacttctttgatgaattatctcagaatggtggagttggagggattgaccggacacatcgagtttaatagtaaggggcagagaagcaattacgccctgaaaatcctacagttcacacggaatgggttccgccagatcgggcaatggcacgtcgcggagggccttagtatggattcccatctgtacgcatccaacatttcagacacattattcaataccactcttgttgttaccacaatcctcgaaaacccttacctcatgttaaaaggtaaccaccaggaaatggaagggaacgacaggtacgagggtttctgcgtcgatatgctgaaagaactcgcagaaatcctccgctttaactataagatcagactggttggcgatggtgtctacggtgtgcccgaagctaacggcacttggaccggtatggttggagaactgattgcgcgaaaagcagatctcgccgtggcagggctgacaataactgcagagcgggagaaagtgattgatttttccaagccttttatgacactgggcatctcaatcctttatcgtgtccatatggggcggaagcccggctatttcagttttctcgaccctttcagtcctggagtctggctatttatgcttttggcttacctggctgtgagctgcgtgctcttcctcgttgctcgcctgactccctacgaatggtattcccctcacccgtgtgcccagggccgatgtaacctgctagttaaccaatacagtcttggaaatagtctgtggttcccggtgggtggttttatgcagcagggctctacaatcgcccctagggcactgagcacacgctgcgtgtccggcgtgtggtgggcctttaccctgataatcatttcctcttataccgccaatctggctgccttcctgaccgtgcaacgtatggacgtgccgatagagtctgttgacgatctggccgaccaaactgccattgagtacggcaccatccacggcgggagcagcatgaccttctttcagaattctcggtaccagacataccagaggatgtggaattacatgtactcaaaacagccctccgtctttgtgaagtccacagaggaaggcatcgccagagttctaaactcaaattatgcgtttttgctagaaagcacaatgaacgaatattataggcagcggaattgcaacctgactcaaatcggtggcttacttgacaccaaaggttacggaatcggcatgcctgtgggcagcgtgttccgcgacgagttcgatttggccattctgcagttacaggagaacaacagattggagattttgaagagaaaatggtgggagggagggaaatgtcctaaggaggaagaccacagggcgaaggggctcgggatggagaatattggtgggatctttgtggtgctgatttgtggcttaatcgtcgccatattcatggctatgctggagtttctttggactttgagacacagcgaagcaaccgaggtgagcgtgtgtcaggaaatggtcaccgaactgcgttcaattattctgtgccaggattctatccatccgagacgccgacgcgctgccgtccctccacctcgcccgccgattcccgaggagcgacgtcctagaggaaccgccaccttgagtaacggcaagctatgcggagcaggggaacccgaccagttagcccagcgactcgctcaggaggctgccctggtggcacggggctgtactcatatcagggtgtgtcccgagtgtagacgctttcaaggactccgtgcacgacccagcccagctcgatctgaagaaagcctggagtgggagaagacaaccaattcctctgaacccgaatag

SEQ ID NO: 118559 - DNA, 2943 bp, Artificial Sequence
  Description of Artificial Sequence: Synthetic coding sequence
atgcccgctgaattgttgctcttgttgatagtggcgttcgctagcccatcttgccaggtgctgtcttctttgcggatggccgcgatcctggacgaccaaacggtctgcggcaggggagagcgtttggccttggccctggccagagagcagatcaatggcatcatagaagtgcctgccaaagctcgggttgaggtcgacatcttcgaattacagcgggacagtcagtacgagaccacagatacaatgtgtcagatcctgcctaaaggagtcgtctctgtgctgggcccctcctcgtcgccggcctccgcctctactgtgtctcatatctgcggcgaaaaggaaattccacatatcaaagtaggtccggaagaaactccccgactccagtacttgcgttttgctagcgtgagtctctatccaagtaatgaggatgtgagtctggctgttagccggatcctcaaaagcttcaactatccgtccgcatctctgatatgtgcaaaggccgagtgcctcctcagactggaggagctcgtacgaggctttctaatttccaaagagaccttatctgtgcggatgttggatgacagcagggatcctacccctttgttaaaggagattagggacgacaaagtgagcacaatcattatcgacgccaacgcctctatttcccacttgatcttgcggaaagccagcgaattgggaatgaccagcgccttctacaaatatatcttgacgacaatggacttccctattctgcatcttgatgggatcgttgaggatagctcaaacatcctgggatttagtatgttcaatacgagccaccctttttaccctgaattcgtgcgctctctgaacatgagttggcgagagaattgcgaagcctcaacatacctgggtccagcccttagcgccgccttgatgttcgacgccgtgcacgttgtcgtgagcgcagtgagggagctcaacagatcccaggagattggggtgaagccactggcctgtacatctgcgaacatatggccccatggaacttcacttatgaactacctacgcatggtggagtatgatggcttgacaggcagagtcgagttcaacagcaagggtcagcggacgaattataccttgcgtattctggaaaagtcgaggcaaggacacagggaaataggcgtgtggtattctaaccggactctggctatgaatgctaccacccttgacattaatctgtcacagaccctcgcaaataaaacattagtggttacaaccatacttgaaaacccatacgtcatgcgacgtcccaacttccaggcgttgagcggcaacgaacgctttgagggcttctgcgtcgacatgctaagggagcttgccgaactcctgaggttccggtacaggttacgactggttgaggatggactttatggcgctcctgagccaaatggcagctggaccgggatggttggcgagctgattaatcgaaaggccgatctggccgtggctgccttcacaattaccgctgagagagagaaggtcatcgacttcagtaaaccattcatgacactggggatctccatcctttaccgggtgcacatgggtagaaagcctggttatttcagctttcttgatcctttctctcctgctgtttggttgttcatgctgctggcctaccttgccgtcagctgtgtcctcttcctcgctgcccgactttccccctatgaatggtacaatccacatccctgcttacgcgcccgtccccacatactcgagaaccaatacacgctcgggaactctctttggttcccggttggaggttttatgcaacagggaagcgagatcatgccacgtgccctgtctacgcgatgcgtctctggcgtgtggtgggcctttacgttgattataatcagttcctacacggctaacctggcggcatttctgaccgtgcagcggatggaggtacccgtagaaagtgccgatgacctcgccgaccagaccaacattgagtacgggacaatccacgcgggcagcacaatgactttctttcagaacagccgctaccagacttaccaaaggatgtggaattacatgcagtcaaagcaaccttctgtgtttgtaaagtcgaccgaagagggcatcgctcgcgtcttaaactcccggtacgcctttcttctcgaaagcactatgaatgagtatcacaggaggctcaattgcaacctcacgcagatcggaggcctgctcgacaccaaggggtacggcatcggtatgccactggggagcccattcagggacgagattacgctagcgatactgcagcttcaggagaacaatagactggaaattctcaagaggaaatggtgggagggaggccgctgtccaaaagaggaagatcacagagccaaaggacttgggatggaaaatatcggaggcatctttatagtgttaatctgcgggctcattatcgctgtctttgtggcagtgatggagttcatatggagtacgagacgctccgctgagtccgaggaggtctcggtatgccaggagatgctgcaggagctaagacacgcagtatcctgcaggaaaacttctcgatcacggaggagaagaagacctggaggcccaagccgggctttactgagcttgcgcgcagtacgcgagatgcgacttagtaatggcaaattgtactctgccggcgccggaggggatgcaggctctgcgcatggcggccctcagcgtctcctcgacgacccaggccctccttcaggtgcaagacccgcagcgcccacgccatgtacacacgttcgcgtctgccaagagtgtagaaggatccaggctcttagagctagtggagctggcgctccacctcggggattgggggtgcccgcagaggctactagtccaccaaggcctcgcccaggtcctgccggaccacgtgaactggccgaacatgaatag

SEQ ID NO: 118560 - DNA, 2946 bp, Artificial Sequence
  Description of Artificial Sequence: Synthetic coding sequence
atgccagcggagctgctgctgcttttgatagtcgcgtttgcaagcccaagctgtcaagtactgagcagcctgcggatggccgccatactcgatgaccaaactgtctgtggcaggggagagagacttgctttagctctagctcgcgaacagataaatggcatcattgaggtgcctgccaaggcccgggtcgaggtcgacatttttgagctccagagagatagtcaatacgaaacaacagataccatgtgccagattctccctaagggagtcgtgagcgtgcttggtccgagcagttcccccgcctccgcctctaccgtgtctcacatctgcggggaaaaggagataccccacattaaggtgggacctgaggagactccaagattgcagtacctcagatttgcatccgtcagcctgtatccttcaaacgaggatgtgtcacttgccgtgtccagaattctgaagagcttcaattatccctccgcctctctgatttgcgccaaagcagaatgcctgcttaggctggaagaactggttagaggtttcctgattagtaaggaaaccctctccgtgaggatgttggacgattcccgggatcctactccccttcttaaggaaattagggatgataaggtgtctactatcatcatagacgccaatgcaagcatctctcacctcattcttagaaaggccagtgagcttgggatgactagcgcattttataagtatattctgacaacgatggactttccaatcctccatctcgatggcatcgtcgaagattcgagtaacatcctaggtttttccatgtttaacacctcccaccctttctaccctgagttcgttcgctccctgaacatgtcctggcgggagaactgtgaagcctccacgtatctcggccctgcactgtctgctgcgctgatgtttgatgcggtgcacgtggtggtatccgctgttcgggagctgaaccggtcacaggagataggcgtgaagcccctagcctgcacctccgccaatatctggcctcacggaaccagtctcatgaattatctgcggatggtggagtacgacggcctaaccggtagggtcgagtttaattcaaagggccagagaacgaattacactcttcgcatacttgaaaagtctcggcagggccatagagagattggggtctggtatagcaacagaacactggctatgaatgccaccacgcttgacatcaatctgagtcagacgctggcaaacaagaccctcgtggtgacaaccatccttgagaacccctacgtaatgcgccgccctaatttccaggcgctgtccggaaatgagcgctttgaaggcttttgtgtcgacatgttgcgagagctcgccgaactcctgaggttccgttaccgattacggcttgtggaggacggcctttacggcgccccagaacctaatgggtcttggaccggcatggtgggcgaattaattaaccggaaggccgatttggccgtggcggctttcacaataacagcagagagggaaaaagtgattgactttagcaagcctttcatgacacttgggataagcatcctgtaccgagttcacatgggaaggaagcccggatacttcagctttcttgacccattttctccagccgtttggctctttatgttgcttgcttacctcgccgtttcctgcgtcttgttccttgctgcgcgtctgtcaccctatgagtggtacaacccacacccctgtcttcgcgcccgcccacatatactggagaatcagtacactttaggaaacagcctctggtttcccgtgggcggcttcatgcagcaaggaagcgagattatgccacgtgccctgtctacacgctgcgtaagcggtgtgtggtgggcatttacgttgatcatcatttcaagctataccgccaacctggcagctttcctcacggttcagcggatggaagtgccggtcgagagcgccgatgatctggccgaccaaactaatattgaatacggcaccattcacgctgggagcactatgacatttttccagaacagccgttatcagacctaccagcgaatgtggaattatatgcagtcaaaacaacctagcgtgttcgtcaagtctaccgaggagggaatcgcccgcgtgcttaatagccggtacgcctttctactggagtcaacaatgaatgaataccatcggaggctcaattgcaaccttactcaaatcggcggcctgctcgatacgaaggggtacggtattggaatgcccctcggcagccctttccgagacgaaatcacgcttgccattctgcagcttcaggagaacaaccggctcgaaatattgaagagaaagtggtgggaaggtggaaggtgcccgaaggaagaagatcacagagctaagggtttggggatggagaacatcggcggcattttcatcgtgctaatatgcgggctgatcatcgctgtcttcgtggccgtcatggagtttatctggagcaccagaagatccgccgaatccgaggaaactccggccctccatcccgccgcctgccagtgctccgctctcggacctcggacccccttgaaggaacctagcatgcttctcgttaaggttccttctacacgggtgcaggtggcgtttagccgtacctcactgcgccaggtgtgccccttcctccttcagcaccaactgtccagtttgtattggatccaggcgacgaatgttcagatttgttgtcacttcagctccctgaaaccatctcctgaccttacatttcccccatcgcatcggcccctgtcctcactgctctttactgcactagcggccgtgggcgggctccctgacgcctcgtcgttcttcttcccacccatcagctcctgtccacctttgcaaagcggtatcggaccatgccatagcactgaagcaacccttgtcaccagcaatttccatgtgtag

SEQ ID NO: 118561 - DNA, 1077 bp, Artificial Sequence
  Description of Artificial Sequence: Synthetic coding sequence
taatgggcatttaccttgataatcatatctagctacacagcgaacctggccgctttccttacggtgcagagaatggaggtgcctgtggagtctgcagacgaccttgctgaccaaaccaacatcgagtatgggacaatccatgcggggtccacgatgacattttttcagaattcccgctatcagacatatcagcgaatgtggaattatatgcaatcaaaacaacccagtgtgtttgtcaaatccaccgaggaaggaattgcaagagttctcaatagtcgatatgcctttctactagagagcaccatgaacgaatatcacaggagactgaactgtaacctgacacagatagggggcctcctggacactaaaggctatggaattggcatgccactcggaagccccttccgagacgaaatcactctggcaatactgcaactgcaagagaataaccgtctggagatacttaagaggaaatggtgggaaggaggaagatgtccgaaggaggaagaccacagggctaaaggactcgggatggaaaatatcggcggcatcttcattgtgctcatttgcggtctgataattgccgtgtttgttgcggtgatggaatttatctggtcaactcgcaggtcggcggaaagcgaggaaaccccagcgctgcaccccgctgcatgccagtgttctgcattagggcctcgcacaccacttaaggagccttccatgttgcttgtcaaggttccatctactcgggtccaagtcgccttttctcgaaccagcctgcggcaggtgtgccctttcttgcttcagcaccaactgagttccctctactggatccaagcgaccaatgtacagatatgctgccacttttcttcgctgaaaccatctccagatctcaccttccctccttcacatcgtccactgtcatcccttcttttcaccgcactggccgccgttggtgggctgcccgacgctagcagcttcttcttccctcccatatcttcttgtccgcctctgcagagtggcatcgggccctgccattctacagaggctacactagtgacgtctaacttccatgtatag

SEQ ID NO: 118562 - DNA, 2769 bp, Artificial Sequence
  Description of Artificial Sequence: Synthetic coding sequence
atgtctaccatgcgcctgctgactctggcccttttgttcagttgctctgtcgcaagggccgcctgtgacccaaagatcgtgaatattggagcagttctttccaccaggaagcacgagcagatgttccgggaggcggtgaatcaggcaaacaaacgacatgggagctggaaaatacagctcaatgctacttcagtgacccacaagccgaatgctattcagatggctttatccgtctgtgaggaccttattagctcccaggtctacgcaatcctggtgagccacccccccacccccaatgaccattttacaccaactccggtctcctacacagccgggttttatagaatcccagtcctaggacttacgactagaatgtccatttatagcgataagagtatccacctgtcttttctgaggactgtgcctccatactctcaccaaagttcagtgtggtttgagatgatgagagtgtacagttggaaccatatcattctgttagtatctgacgatcacgagggaagagccgcccagaagcgcttagagaccctgttggaagaacgggaatcaaaagccgaaaaagttctgcagtttgaccccggcaccaaaaacgtgacagccctgctgatggaggcaaaggagctggaggccagagtgatcatcctaagcgcttcagaagatgatgcagcgactgtgtatagggctgccgctatgctgaacatgacaggctccggatacgtgtggttggtgggagaaagagagattagtggcaatgccctaaggtatgccccggatgggatcctggggctgcaactgatcaacggaaagaatgaaagcgcccacatctctgacgccgtgggcgtggtcgcgcaggccgtccatgagctcttggaaaaagagaatatcactgatccaccccgagggtgcgtgggaaataccaatatttggaaaactggacccctgttcaaacgcgttctgatgtctagtaagtatgccgacggcgtgaccggacgcgtcgagtttaacgaggatggggaccgaaaatttgctaattatagtattatgaacctccagaatcggaagctcgtgcaagttggcatctacaacggtacacacgttatacctaatgataggaaaattatttggccaggcggggagactgaaaaaccccggggctatcaaatgagcaccagactgaaaatcgtgacaatccatcaggagccttttgtctacgtaaagcccaccctgtccgacggcacctgcaaagaggaatttaccgtgaacggagaccccgtgaagaaagtcatatgtactggtccgaatgacaccagccccggtagtcccagacacaccgtacctcagtgctgctatggcttttgcatcgatctgttgattaaacttgcaagaacaatgaacttcacttatgaggtacatctcgttgcagacgggaagttcggcacgcaggaacgtgtgaacaactcaaacaagaaagagtggaacggcatgatgggcgagctcctttcaggtcaggcagacatgatagtggctccccttactatcaacaacgaacgcgcacaatatattgaattcagtaagccgtttaaataccaaggacttacaattcttgttaagaaggaaattccaaggagtactctggattcatttatgcagcccttccagtccacactgtggttgttggtggggttgtcagtgcatgtggtcgctgtgatgttgtacttactcgatcggttctcccccttcggccgtttcaaagtaaactctgaggaagaagaagaagacgctctgactctgtcatccgctatgtggttctcgtggggcgtgcttctgaactccggaattggggagggcgcccccaggagcttctccgctcgcatactcggcatggtttgggcggggttcgccatgataattgtggcctcctataccgccaatcttgccgccttcctggtactggacagaccagaggagcggataaccggcatcaatgacccaagactcaggaatccgtcagacaagttcatctatgcgactgtcaaacagtcaagcgtggatatttatttccgccgtcaggtggagcttagcaccatgtacaggcacatggagaagcacaattatgagtcagctgccgaagcaattcaggcagtccgcgacaacaagctccacgccttcatctgggattcagcagtgttagaatttgaggcctcgcagaagtgcgacctggtaacaactggcgaactgttttttcgcagtggcttcggcataggaatgcgaaaagattcgccttggaaacagaatgtgtctcttagcattctaaagtcgcacgagaatggattcatggaagacctggacaaaacgtgggtgcgctatcaggaatgcgattctcggtctaacgctccagcaaccttaacttttgagaacatggcgggcgtgtttatgcttgtggccggcggaatcgtggccggaatttttctgatttttattgagatcgcttataagaggcacaaggacgctcggcgcaaacagatgcagctggccttcgctgctgtcaacgtctggaggaagaatcttcaggatagaaagtccgggagggccgagcccgaccctaaaaaaaaagcaacattccgagcgattacatccaccttagccagttcattcaaacgcagacggtctagcaaggacacccagtatcacccgacagacattacaggccctctgaacttaagtgacccatctgtaagtacagtcgtatag

SEQ ID NO: 118563 - DNA, 2730 bp, Artificial Sequence
  Description of Artificial Sequence: Synthetic coding sequence
atgtctacaatgcggttactgaccctggctctgctcttttcctgttccgtggcgcgcgccgcgtgcgatcctaagatcgtgaacatcggagccgtcctgtcaactagaaaacacgagcaaatgttcagggaagcagtaaaccaagccaacaaaaggcatggatcttggaagatccaactgaacgcgaccagcgtgacccacaagccgaatgcgatccaaatggccttgtctgtgtgcgaggatttgatttcctcgcaagtgtacgctattctggtgtctcatcctccgacgccaaatgatcacttcacccctacccccgtctcttacacagctggcttctacagaatccctgtgttaggtctgactacccggatgtctatctacagcgataagtcaattcatttgagctttctgagaacagtcccaccctattcacaccagagctccgtctggttcgagatgatgcgtgtatactcatggaatcacatcattctgcttgtctctgacgaccacgaaggtagagccgcacagaagagactggagacacttctggaggagcgcgaatcgaaggcagagaaagtccttcagtttgatcctgggaccaagaatgtgacagccttgttaatggaagccaaagaactcgaggcaagagtcattatcctttccgcgtcagaagatgatgccgccaccgtatacagagctgctgcgatgttgaacatgacaggcagtggctatgtctggcttgtgggagaacgtgagatttccggcaatgctctgcggtatgcaccagacggaattctgggcctgcaactgataaatggtaaaaacgagagtgcgcatatttccgatgcagtgggggttgttgcacaagctgtgcacgagttgctcgagaaagaaaatatcactgacccaccaagaggatgtgtgggcaatacgaacatctggaaaacgggacctttatttaagagggtcttaatgtcttccaagtacgcggatggagtgactggccgagtggaatttaacgaagatggtgataggaaattcgccaattatagcataatgaatctgcagaaccgcaagttggtgcaggtaggcatatataacggtactcatgtgattcccaacgatcggaagatcatttggcccgggggcgagaccgagaagcctagagggtatcagatgtccacccgacttaaaatagttaccatccaccaggaaccattcgtatatgtgaagccaactctaagcgacggcacatgcaaggaggaattcaccgtgaatggcgaccccgttaagaaagttatctgcactggacccaacgacactagccccggttccccacggcatacagtcccccaatgttgttacggcttctgcattgacctgctgattaaattggcgcgcacaatgaactttacatatgaggttcacctcgtggccgatggaaaatttggcacacaggagcgggtcaataatagcaataagaaagaatggaacgggatgatgggtgagttgctgtccggacaagctgatatgatcgtggcaccgctgactattaataatgaacgggcgcagtatatcgagttctcaaaaccatttaagtaccaaggactcaccatattagtaaaaaaggagatccctcgaagcaccctcgactcctttatgcagccctttcagagcacactgtggttactggtcggcttgtcagttcatgtggttgccgtgatgctctatctgctggatcgcttctcacctttcgggagattcaaggtgaatagtgaagaagaggaagaggatgctctgacactgagcagtgctatgtggttctcctggggagtcttgttgaacagcggaatcggggagggagcccctagatccttttcagcccggatcttagggatggtttgggccggcttcgcaatgatcatagtggcaagttacacagccaacttagccgccttcctcgtgcttgatcggcccgaggaacgaatcactgggattaatgaccccagacttcggaatccaagcgataaattcatatatgcaacagtgaagcagagttcagtggatatttacttcaggcgacaggtcgaactcagtacaatgtatcgacacatggagaaacataattacgagagcgctgcagaagctatccaggctgtgagggacaacaaacttcatgcattcatttgggattcagctgtgctggagtttgaagcctcacagaagtgtgatctggtcactactggagagctgttctttagatcgggctttggtattggaatgcgcaaagattcaccttggaagcagaatgtgagtctatcgattctcaaatcccatgagaatggtttcatggaggatttggataaaacctgggtccggtatcaagagtgtgacagtaggtccaatgcccccgcaactctgacatttgagaatatggctggcgtcttcatgttggttgccggtggcattgtcgcggggatttttctcattttcatagagattgcttataaacgccacaaggatgccagacggaaacagatgcaacttgcgttcgctgccgtcaatgtttggagaaagaacctgcaggtcggacaggctaccctgcggggactggtgcccagagccagacccgggcacgggccacctccgagtcctaaggccgtcgcactggcactggcactggtggggcgcactggggcccgatcacatggtcagggtcagtggtag

SEQ ID NO: 118564 - DNA, 2832 bp, Artificial Sequence
  Description of Artificial Sequence: Synthetic coding sequence
atgagcactatgagactgttgactctagccctgcttttcagctgttcggtggcccgcgcagcatgtgatccaaagatagtgaatatcggtgcagttctttccacaagaaagcacgagcagatgtttagggaagccgtgaatcaggctaataagagacatggatcctggaaaatacagttaaatgctactagcgtgacccataagcccaatgccatccagatggccttaagtgtgtgcgaggacctgatttctagccaggtgtatgcgattttagtgtctcatccaccgacccccaacgatcacttcacccccacccctgttagctacacagccggcttttatcggattccagttctggggctaaccacacgaatgagtatctatagcgacaaatcaatacacttgagctttctgcggacagttcctccctatagccaccagagcagcgtatggtttgagatgatgcgcgtatactcctggaatcatattatcctcctcgttagcgatgatcacgagggcagagccgcgcagaaaaggctggagactctcctggaggagcgggagagcaagagtaaaaagagaaactatgaaaacctggaccagctctcctacgacaataaaagaggtccgaaagctgagaaggttctgcagttcgaccctgggactaagaacgtcacagctctgctgatggaggcaaaggagttggaggcacgggtgattatattgtctgcatccgaggatgatgcagccactgtatatagagctgctgcaatgctcaacatgaccggttctggttacgtgtggctcgtgggagaacgagagatcagtggcaacgccctacgctacgcacctgatgggattctggggttgcaactaatcaatggcaagaatgagtcagcacatatctctgatgcagtgggggtagttgcgcaagccgtgcacgaactactcgaaaaagagaacattacggaccctcctcggggctgcgttggcaacacaaacatctggaagactggaccactgtttaaacgtgtgttgatgtccagcaaatacgctgacggggtaactggcagggtcgagttcaatgaagacggcgataggaagttcgccaattattctattatgaacctgcagaatcggaaactggtgcaagtcggaatttacaacggaacacatgtcattccaaacgacagaaaaatcatatggccaggtggtgaaactgagaaacccaggggctaccagatgtccacgcggctgaagatcgtgaccattcaccaggaaccattcgtgtatgtcaagcccacactgtcagatggaacgtgtaaggaagagttcactgttaatggcgacccagtaaaaaaagtgatctgtaccggtccaaatgatacttctccaggttcaccacggcacaccgtaccacaatgttgctatggcttctgtatcgacctgctcatcaaactggccaggacaatgaactttacctatgaggtccatctggtggctgacggcaagtttgggacccaggagcgcgtgaataattcaaataagaaagagtggaacggtatgatgggcgagctcttgagcggacaggctgacatgatagtcgcccctttgactattaacaatgaaagggcccagtacattgagttcagtaaacctttcaagtaccaaggcctgaccatcctggtcaagaaagagattcctagaagtacgttagatagctttatgcagccattccagagtactctttggctacttgtgggtctcagtgtgcatgtggtcgctgtgatgctgtatctgctggataggttttcaccattcggaaggttcaaggttaacagcgaggaggaggaagaagacgctctaacgctttccagcgccatgtggttctcctggggggtcctccttaatagtggaatcggggagggtgcacctaggtcgttcagcgcgcgaattttaggaatggtttgggcgggcttcgctatgataatcgttgcctcctatacggctaacctcgccgcattcctggttttggatcgacctgaggaacgcatcacgggaattaatgatccgaggcttagaaacccctctgataagttcatctatgccactgtgaaacagagctccgtggacatctactttcggcggcaggtggagctgagcacaatgtatcgccacatggaaaaacacaattatgagtctgccgccgaagccatccaggcggtgagagataacaagctacacgcctttatatgggactctgctgtgctggaatttgaggcatcccagaagtgtgatctggttacaacgggcgagttattctttaggagcggctttggtattggcatgcgcaaggactccccctggaagcagaatgtgtccctgtctatcctaaagtcccacgagaacgggtttatggaagaccttgataaaacatgggtgaggtatcaggagtgtgactcgcgctcaaatgcccccgcaacactcacctttgaaaacatggcgggtgtatttatgctggtggccggggggatcgtggccggaatcttcttaatattcattgaaatcgcttacaaaagacacaaagacgctagacgcaaacagatgcagctagcattcgctgcagtaaacgtgtggcgaaagaatttacaggaccgcaagtccggccgcgcggagccagaccctaagaaaaaggctacgtttcgggcgatcacctccactttggcgtcttctttcaaaagaagacggagctctaaagacactcaataccacccaaccgatatcaccgggcctctgaacctctctgacccctcagtttctactgttgtgtag

SEQ ID NO: 118565 - DNA, 2769 bp, Artificial Sequence
  Description of Artificial Sequence: Synthetic coding sequence
atgagcactatgcgcttgttaaccctagccctcttgtttagttgcagtgtcgcccgcgccgcttgcgaccctaagatcgttaacatcggagccgttttgtcaacaagaaaacacgagcagatgttccgcgaggcagtgaatcaggcaaacaaacggcatgggtcctggaaaatacagttgaacgccacatccgtgacgcacaaaccgaacgctatccaaatggcattgtcggtgtgtgaagatctcatttcttcccaggtgtacgcaatcctggtgtcacaccctcccactcccaatgaccactttacgccaactcctgtgtcatatactgccggcttttacaggatccccgtgctcggcctgacaacacgcatgtctatatattccgacaagagcatccacctgagtttccttcgcacagtgccaccctattctcaccagtctagcgtttggttcgagatgatgcgggtctatagttggaatcacatcatactattagtctctgacgaccacgaagggcgcgccgcacagaagcgtttagaaacattactagaggagagggagagtaaaagcaaaaagcgcaattatgaaaatctggatcagctgtcctacgataacaagcgcggccccaaggccgagaaggtgctccaattcgatcccgggaccaagaacgttaccgcccttttgatggaggctaaagagctggaggcccgcgtgattatactttccgcaagtgaagacgatgccgcaacagtgtacagggctgccgccatgctaaatatgactggctcaggctacgtgtggcttgtaggagagcgggagatttcgggaaacgccctgaggtacgccccagacggcatcttgggcctgcaactgataaatggtaagaatgagtcagcccacatatccgacgccgtgggcgttgtagctcaggcagtacacgagctgctggagaaggagaacatcacagacccccccagaggttgcgtgggtaacacaaacatttggaaaacagggcctttatttaagagagtgcttatgagctcaaagtacgcagacggcgtgactggcagggtggaatttaatgaagacggagataggaaattcgcgaattactccatcatgaacctgcaaaatagaaagctggtgcaggtcggaatttacaacggcacccatgtgatccccaatgatcgtaagatcatttggcctggtggggaaacagagaagccccgtgggtaccaaatgagcactagattaaaaattgtgacaattcaccaggagcccttcgtgtacgtgaaaccaactctgagcgacggaacttgcaaagaggagttcacagttaacggagaccctgtgaagaaggtgatctgcacagggcccaacgataccagtccaggtagcccgcggcatacggtcccccagtgctgctacggattctgtatagacctcctgattaagttagcacgcacgatgaactttacgtacgaagttcacttagtagccgatggaaaattcgggacccaggagcgcgtgaacaacagtaataaaaaggagtggaatggtatgatgggtgagcttctgtctgggcaggccgatatgattgtggcgccgctgacaatcaacaatgagagagcacaatatattgagttttctaagcccttcaagtatcagggattaactattctggtgaaaaaggaaatacctaggtcgacgctggattcattcatgcaaccattccaatcaacgctgtggttactcgtcggtctcagcgttcacgtagttgcagtgatgctttatctgttggatcgcttttcccctttcggcagatttaaggtaaactccgaagaggaggaagaggacgccttgactttaagtagcgctatgtggttctcttggggcgtgctgctcaactccggaatcggggaaggcgctcctcgatcattttccgctcggatcctcggaatggtgtgggccggttttgcgatgatcatagtggcatcatacacagctaatctggctgccttcctggtgctggatcggcctgaagagagaatcaccgggatcaatgaccccagactcagaaaccccagcgacaagtttatctatgcaaccgtcaagcaatcttcagtggatatctatttccggcggcaggtagagttatccacaatgtatagacacatggagaaacacaattacgagagcgcagccgaagctattcaagctgtacgggacaataaactgcacgcatttatctgggacagcgctgtcctagagtttgaggcatcacagaagtgtgacctggtcactacaggggagttgttctttcgatctggtttcggcataggcatgcgtaaggactcaccttggaaacaaaacgtttctttatcaattttgaagagtcatgagaatggctttatggaggatttggacaagacttgggtccggtaccaggagtgcgactctaggagcaatgccccagccactctgacgttcgagaacatggctggcgtcttcatgctggtcgccggcggcattgtggccggtatctttctgattttcattgagatcgcatataagcgccataaggatgcccggagaaagcagatgcagctggcctttgccgctgtgaacgtttggcgcaagaatctgcagtcaacaggaggcggcagaggcgctctgcagaatcagaaagacacggtcctcccccggagagctatcgagcgagaggaagggcagctgcagctgtgtagccgccatcgcgaatcttag

SEQ ID NO: 118566 - DNA, 2721 bp, Artificial Sequence
  Description of Artificial Sequence: Synthetic coding sequence
atgagtaccatgcgactgctaacacttgccctcctgttttcatgctccgtggcaagggcagcttgtgatcccaagattgtgaatatcggcgctgtgctctctacccggaagcacgagcagatgtttcgggaagccgtcaatcaggcgaacaaaaggcacggcagctggaagatccagcttaacgctacgagcgtcacacataagcccaacgctatccaaatggccctttccgtctgcgaagacctgatcagcagccaggtgtatgcaatcctcgtctcccatccacctactcctaacgaccacttcacacctacaccggtgagttacactgccgggttttatcgcatacccgtcctgggtcttacaacccgcatgtccatctactccgacaaaagcatacatctctcatttctgagaactgtccccccatatagccatcagtcaagcgtctggttcgaaatgatgagagtatacagttggaatcacattatcctccttgtgtctgacgaccatgaaggtcgcgcggcacagaagcgactagagacactgctcgaggagcgggaatccaaaagcaagaaaaggaactatgaaaacctcgatcagctgtcctatgacaataagaggggacctaaagcagagaaagtgctgcagtttgaccccgggactaagaatgtcacggcattactgatggaggccaaagagctggaagcaagagttataattctaagcgcgtcagaggacgacgctgctaccgtgtatagagcggctgcaatgttgaatatgactggttccgggtacgtttggctggtgggggaacgcgagatctccggaaacgctctgagatatgccccggatggcattctgggattgcagctgatcaacggaaaaaacgagagtgcccatatatcagacgccgtaggcgtggtggcccaggccgtgcatgaattactggaaaaagaaaacattactgatcctccaaggggatgtgtgggcaatacaaatatttggaagactggacctctcttcaaacgtgtcttgatgtcctccaagtacgccgacggcgtgactggccgcgtcgagtttaacgaggatggagatagaaagtttgctaactactccattatgaatctgcagaataggaagttagtccaggtgggtatttacaacggaacccacgttatccccaacgacaggaagattatttggcccgggggtgagaccgagaaaccaaggggatatcagatgagtactcgattgaagatcgtgaccattcaccaagagccctttgtgtatgtcaaacctacactgtctgacggtacttgtaaagaggagtttaccgtgaacggcgatccggtgaagaaggtcatctgtactggtcccaacgatacatctcccggcagcccgcggcatacagttcctcagtgctgctacggattctgcatagacttgctcattaagctggctcggactatgaacttcacctatgaagttcatctcgtggccgatggaaagttcggcacacaggagcgggtgaataacagtaacaagaaggagtggaatggcatgatgggagagctgctgtcaggccaggctgatatgatagtggctcctctgacaattaacaatgagcgggcacagtatattgagttctctaaacctttcaaataccagggcttgaccattctcgtgaaaaaggagattcccagaagtaccttggattcctttatgcagcctttccaatctaccttgtggttgctagtcgggctgtctgtccacgtggtcgctgtgatgctctacttgctcgatcgctttagtccattcggccgctttaaagtcaacagtgaagaagaagaggaagatgcgctgactctcagcagcgccatgtggttcagctggggagtgctgctcaattctggcattggcgagggcgctcctaggagttttagcgcgaggattctgggcatggtctgggccgggtttgccatgataatcgttgcatcttataccgcaaatctggccgcctttctcgttctggaccgccctgaagaaaggattaccggaattaatgacccaagactgagaaacccttccgataaattcatttacgccactgtcaagcagagcagcgtcgatatttatttcagacggcaggtggagctcagcacaatgtatagacacatggaaaaacataattacgagagcgcagcagaggcgattcaggccgtcagagataacaagctccacgctttcatttgggatagtgccgtcttggaatttgaggccagtcagaagtgtgatctcgtgacaaccggagaactcttttttcggtctgggttcgggatcggcatgagaaaggactccccctggaaacagaacgtgtctctctccatcctgaaatcccacgagaatgggttcatggaggacctggacaagacttgggtacgataccaggagtgcgactccaggtcaaacgcccccgcgaccttgacgttcgagaacatggcaggagtgtttatgttggtggcaggcggcatcgttgccgggattttcctcatttttatagagatcgcctacaagcgacacaaagatgccaggagaaagcagatgcagttggcttttgcagctgtgaacgtttggcggaagaatctgcagcagtaccaccccacagatataacaggcccactgaacctgagcgacccgagcgtaagcactgtggtgtag

SEQ ID NO: 118567 - DNA, 2817 bp, Artificial Sequence
  Description of Artificial Sequence: Synthetic coding sequence
atgtctacgatgcggctcctgactctggccctgctcttctcgtgtagcgttgcccgggcagcatgtgacccaaaaatagtgaatatcggggctgtgctttccactagaaagcacgagcagatgtttagagaagccgtgaaccaggcaaacaagcgacacgggagctggaagatccagctcaatgcaacaagtgtgactcacaaacccaatgccatccagatggctctttctgtctgcgaggaccttatttctagccaggtctacgcaattttagtgagtcacccgcccacccccaacgatcactttaccccgacacccgtgtcctataccgcgggtttttatcggatcccagttctcggactgaccactaggatgtccatttattccgacaaatctatccacttatcgtttctgaggacggtgcccccatatagtcaccagtcctctgtgtggttcgaaatgatgcgtgtgtattcctggaaccacattattctgctggtgagtgacgatcatgaaggtagggctgcccagaagcgtctggagaccctccttgaagagagggagagcaaagccgaaaaagtactccagttcgaccccggcaccaagaacgtaaccgctctccttatggaagctaaagagctcgaggccagggttatcatcctaagcgcgtccgaggatgacgctgctactgtgtacagggccgctgctatgttaaacatgactggctctggatacgtgtggcttgtgggagagcgtgaaatcagtggcaatgccctcaggtacgctccagatgggattttaggcttacagcttatcaacggaaagaacgagtccgcacacatctccgatgcagtcggcgttgtagctcaggccgtgcacgagctcctggagaaggaaaatattacagacccccctcggggctgtgtgggtaacaccaatatctggaagacggggcccctttttaagcgggtcctgatgtcaagcaagtatgccgatggtgtcactggcagagtagagttcaacgaggacggagaccgaaaatttgctaactattccatcatgaaccttcagaacagaaaactcgtccaggtcggtatctacaacggtacacatgttattccaaacgacaggaaaatcatttggcccggcggtgaaaccgaaaagcccaggggatatcagatgagcacacgcctgaagattgtgacaatccaccaggagccatttgtgtacgttaagcccacactgtcagacgggacttgcaaagaggagttcactgttaacggggatccagtgaaaaaagttatctgtaccggaccaaatgacacttctcccggatctccaagacacactgttcctcagtgctgctacggattctgcatcgacctgctgattaaattagcacggacgatgaatttcacatatgaagtccatttggtcgctgacggtaaatttggtacccaggagcgcgtgaataactccaataagaaagaatggaatggaatgatgggtgagcttctgagtggccaggcagatatgattgtggccccgctaactatcaataacgaaagagctcagtatattgagttctccaagccttttaagtatcagggactaactatcctcgtgaaaaaggagatcccaaggtctacactggacagttttatgcagcctttccagtccacattgtggcttttggtggggctttcagtgcacgtggtagccgttatgctatacctgctagaccgtttctcaccctttggaagattcaaggttaattccgaggaggaagaagaagacgctttgaccctctcctctgccatgtggttttcctggggcgtcctcctcaattctggtatcggggaaggagcccctagatccttttcagcccgaatcttgggaatggtgtgggcaggatttgccatgatcatagtggcatcctacacagcaaatctcgccgcatttttagtgcttgacagaccggaggagcgaatcacagggattaacgatcccaggttgcggaacccgtctgataagttcatttacgccactgtgaaacaatcgtctgtcgacatttactttcgtagacaggtggagcttagtactatgtaccgccacatggaaaaacacaactacgagtcagccgccgaagccatccaagccgtgcgagataacaagctgcatgcttttatttgggacagcgcggtcctggagttcgaggcatcccagaagtgcgatctggttaccaccggggaactgttttttcgcagcggctttggcattggcatgcgcaaagattctccgtggaagcaaaacgtctctctctccatcctgaaaagtcacgaaaacggctttatggaagatctggataaaacctgggtcaggtatcaggagtgtgatagccgtagcaacgccccagccactcttaccttcgagaatatggcaggtgtgtttatgcttgtggcaggcggaatagtcgcaggcatttttctcattttcatcgaaattgcctataaacggcataaggatgccagaagaaagcagatgcaactggccttcgcggcagtcaatgtgtggcggaagaaccttcaggatagaaagtcaggacgcgcagaacccgaccccaagaaaaaggcaactttccgggctatcacatcaaccttggcatcttcgttcaagaggcgaaggtctagtaaggatactagtaccggggggggacgaggcgcactacagaatcaaaaagataccgttctccccagaagggccattgaaagggaggaagggcagctccagctgtgctctcgccatcgggagtcttag

SEQ ID NO: 118568 - DNA, 4395 bp, Artificial Sequence
  Description of Artificial Sequence: Synthetic coding sequence
atgggtagagtagggtattggaccctgctcgttctgcccgcactgctggtgtggaggggtcccgcacccagtgccgccgcggagaaggggcctcctgctttgaacattgccgtaatgctgggccactcccatgatgtcaccgagagagagctgcgaaccctgtgggggcccgagcaggcagccgggctgcctctcgatgtcaatgtagtcgcgttacttatgaacagaacagatcctaagtctttaatcacccacgtctgcgatttgatgagcggtgcccgaatccacgggctggtatttggtgatgacaccgatcaagaagcggtggcccagatgttggatttcatttcaagccacactttcgtgcctatcttgggaattcatggaggtgcatccatgattatggccgataaggaccccacatcaacattctttcagttcggggcaagcattcagcagcaggctacggttatgttgaagatcatgcaggattacgattggcacgtgttcagccttgtcacaacgatattccccggctacagagaatttatttcatttgtgaaaacaactgtcgacaatagtttcgtaggctgggatatgcaaaatgtgatcacccttgacactagcttcgaggatgccaagacgcaggtgcagctaaagaagatccactcaagcgtgattcttctgtactgcagcaaagatgaagcggttttgatactctcagaagctcgttccctgggcctgaccggctatgactttttttggatagttccaagcctggtgagtggcaatacagagctgatcccaaaggagtttccatcaggactcatttccgtgagctacgacgattgggactacagtctcgaggcccgggtcagagatggtatcgggatcttgaccactgccgcttccagcatgctcgagaaattttcttacatccctgaggccaaagccagttgctacgggcagatggaaaggcccgaggtccctatgcacactttacaccctttcatggtcaacgtgacatgggacggcaaagatctctccttcacggaagagggataccaggtccaccccaggctcgtagtgattgtgctgaacaaagatagagagtgggaaaaggtggggaaatgggagaaccatactctgtctctgcgccatgccgtttggccaagatataaaagcttcagcgactgtgaaccggacgataatcacttgtcgattgtcacactcgaggaagccccgttcgtcatagttgaagacatagatccacttacagagacgtgcgtacgaaataccgtgccttgtcggaaattcgtcaaaatcaataacagtacaaatgaaggtatgaatgtgaagaaatgctgtaagggcttctgtatcgatatcttgaagaagctgagccgcactgttaagtttacatacgacttgtatcttgtgacaaatggcaagcacggcaagaaggtgaataacgtctggaatgggatgatcggagaggtggtgtatcagcgggcagtcatggccgtggggagcctgaccataaacgaagaaaggtctgaggttgtagacttctcggtgccattcgttgagactgggatctctgtaatggtttcacggagtaatggcacagtctcccccagcgcgtttctcgaaccttttagcgcctccgtttgggtcatgatgtttgtgatgctactgatagtgtccgcgattgccgtctttgtcttcgaatacttttctcctgtcggctataaccgaaacctcgctaaaggtaaagcaccacacggacccagtttcactatcggaaaggccatctggctcctgtggggcttagtgttcaacaactccgtacctgtgcagaaccctaaggggactacaagcaaaattatggttagtgtctgggcattctttgccgttattttcctcgcatcatacacagcaaatctggccgcctttatgatacaagaagagtttgtggatcaggtgaccgggctgtctgacaagaaatttcaaagaccacacgattacagtcctcctttccgttttggaactgttcccaacggcagcactgaaagaaacatccgcaataattacccctatatgcaccagtacatgacaaaattcaatcaaaaaggggtagaagatgcattggtcagtctgaagaccggcaaactggatgccttcatatatgacgcagcggtgctaaactataaggcggggcgggacgagggctgtaagctcgtgacaatcggctctggatacatttttgccacgactggctatggaattgcccttcagaaagggagcccttggaagagacagattgacctggcattgctccagttcgttggcgatggcgagatggaggaacttgagacactgtggctaacaggtatctgtcataatgagaagaacgaagtaatgtcgagccaactggacatcgacaacatggccggagttttttatatgttggctgcggctatggcgctgtccctgattaccttcatttgggagcatcttttttactggaaactgagattctgtttcacaggcgtgtgcagtgaccgaccagggttactattcagtatcagtcggggcatctacagctgtatccatggagtgcacatcgaggaaaagaaaaaatcgccagattttaacctaaccgggtcccaaagcaacatgctgaagttgctgcgcagtgcgaaaaatataagtagtatgtcaaacatgaatagtagtaggatggatagccccaagcgagccgccgattttattcagcgtggctccctgataatggatatggtctctgacaaaggcaatttaatgtactccgataaccgcagcttccaggggaaggagagcattttcggcgataatatgaacgagttacagacttttgttgctaataggcagaaggataacttgaacaattatgtcttccagggccagcatccgttgaccctgaacgagagcaatcccaatacggtcgaggtggctgtcagtaccgagtctaaagctaactcaaggcctcgccagctgtggaaaaaatctgtggacagtatcaggcaggacagcctgagtcagaacccagtgtctcagagagatgaggcgaccgctgaaaacaggacccatagcttgaaatcaccccggtacctccccgaagagatggcacactcagatatttcggagacatccaatcgggcaacctgtcatcgggagccagataattccaagaatcacaagaccaaagataacttcaagcgttcagtcgctagcaaatatccaaaagactgctcagaggtcgagcggacatacctgaagaccaagtcatccagtccgcgtgataagatttacaccatcgatggtgaaaaggaaccgggcttccacctcgacccaccacagttcgtggaaaacgtcactctgcccgagaatgttgatttcccagacccgtatcaggatccatccgaaaacttcaggaaaggggattccacactgcccatgaataggaatccgctccataacgaggagggactttcgaataacgatcaatacaagctgtacagtaagcattttaccctcaaagataaaggatccccccactcagaaacatccgagcgatatcgtcaaaattctacccattgtaggagctgcctgtccaacatgcccacatacagcggccattttacaatgagatctcccttcaagtgtgacgcttgccttagaatgggcaacctgtatgacattgatgaggaccagatgctgcaggagacagggaatccggctactggggaacaggtgtaccaacaggactgggcacagaataatgccctccaactacaaaagaacaagttgagaatcagccgccaacattcttacgacaatattgtggacaagcctcgagagttggaccttagtagacccagcaggtcaatctctctgaaggaccgggaacggctgctcgaagggaatttttacggatccttgttctcagttcctagctctaaactgtctggcaaaaaatcatctctgttccctcaaggattggaggacagcaagaggagcaagagtcttcttccagatcacacgtccgacaatccttttctgcacagtcatagggatgaccagcgcctggttattggcaggtgcccctcagatccctacaagcattccctcccctcccaagcggtgaatgacagctatctgcgctctagtctcagaagtaccgcctcatactgctcccgagatagcaggggccataacgacgtttacatttcagagcatgtgatgccttacgcagccaacaagaacaatatgtactcaaccccacgcgtactcaacagctgttctaacagacgagtatacaagaagatgccatctatagaatctgatgtctag

SEQ ID NO: 118569 - DNA, 4395 bp, Artificial Sequence
  Description of Artificial Sequence: Synthetic coding sequence
atggggcgtgtcggatactggaccctgctggtgctgcccgcgctcctggtttggcgaggtccggctccaagcgcggccgctgaaaagggaccaccggcactgaacatcgccgtcatgctgggccactcacacgacgtgacggaacgcgagttgagaacattgtggggccccgagcaggccgctggattacctctggatgtgaatgtggtggccttgttgatgaatcgcacagaccccaaatccctcataacacatgtttgtgacctgatgagcggagctcggattcacgggctggtttttggcgatgataccgaccaggaggctgtcgcccagatgctagattttatttcatcacacactttcgtgccgattctcggcattcacggcggagctagcatgatcatggctgacaaggatcccacttcaactttctttcagttcggagccagcattcagcagcaggcaacagtcatgcttaaaatcatgcaggattacgactggcatgttttcagtctggtcactacaatcttccccggttaccgggaatttatctcttttgtcaagaccaccgtagataacagctttgtgggctgggatatgcagaacgttattactctggacactagcttcgaggacgctaaaacacaagtgcagctgaaaaaaatccattcatccgtcatacttctgtactgtagcaaggacgaggccgtcttgatattaagcgaggctagatccctagggctgacgggttatgatttcttttggatcgtgccatctctggtgtccggtaatactgagttgatccccaaagagtttccttccggacttatctccgtgtcttacgatgactgggattatagtcttgaggcacgagtgcgtgacggaatcgggatactgacaaccgcagcctcctccatgctggaaaaattctcctatatccccgaggctaaggccagttgctacggccaaatggagaggccagaggtgcctatgcatactctccatccttttatggtgaacgtgacctgggatggaaaggatctatctttcacagaagagggataccaagtgcacccaagactcgtggtaattgtgctcaataaggacagggagtgggaaaaagtgggcaagtgggaaaatcatacactcagtctgagacatgccgtgtggccacgctataagtctttctctgattgcgaaccagacgacaaccatttaagtatcgtcaccctggaggaggccccctttgtgatcgttgaggacattgacccgctgaccgagacctgtgttcgaaatactgtgccatgccggaagttcgtgaaaatcaataattcaactaacgagggcatgaacgtaaaaaaatgttgcaaaggattctgcatcgacattctgaaaaagctcagccgaactgtaaaattcacttacgacctttatctcgttactaatggaaagcatggtaaaaaggtaaataacgtgtggaacgggatgatcggagaggtggtgtatcaacgggcggtcatggccgtgggaagcttgactataaacgaagagcggtccgaagttgtggactttagtgtgcccttcgtggagaccggcatctcggtgatggtgtctagatccaacggaacagtttccccctccgcttttctggagcccttttccgccagtgtgtgggtgatgatgtttgtcatgttacttatcgtatccgctattgccgtttttgtgtttgaatatttcagccccgtgggatacaatcggaacctagccaaagggaaggctccacatggaccctcattcaccataggtaaggctatctggctgctgtggggcttagtctttaataattctgtgccggtgcagaaccctaaaggcaccacaagcaagatcatggtgtcagtgtgggcctttttcgctgtcatttttctggccagctatacagcaaaccttgccgctttcatgatccaagaggaattcgtggatcaggtcaccggcctcagcgacaagaaatttcagcggccgcacgattattcccctccattcagattcggcacagtgccgaacggatcaacggagcggaacattaggaataactatccttatatgcaccagtacatgacaaaattcaaccaaaaaggagtggaagatgctctagtcagcttgaaaactgggaaattagacgccttcatctatgatgccgccgttctgaattacaaagccggccgcgatgagggatgcaaactcgtcaccatcgggtctggttacatattcgctactaccggctacgggattgctctacagaaaggcagtccctggaagcggcagatagacttagccctcctgcagttcgtcggtgacggtgagatggaagagcttgaaacactgtggctgactggcatctgtcataacgaaaagaacgaagttatgagttctcagttggatatagataacatggccggcgtgttttacatgctcgccgcggcaatggctttgtcactgatcaccttcatttgggaacatctattctactggaagcttcggttttgtttcacaggcgtctgttctgataggcctggcctgctcttttccattagcaggggaatctactcgtgcatccacggggtacacatcgaggaaaaaaagaagagcccagacttcaacctcacaggatcacagagcaacatgctgaagctgctccgatctgccaagaatatcagctccatgagtaacatgaatagcagtaggatggactcccccaaaagggccgccgattttattcagagaggctcgttgatcatggatatggtaagcgacaaaggcaatctcatgtacagtgacaacagatctttccagggcaaggagtcaatattcggtgacaacatgaatgaactgcagacctttgtggcgaaccggcaaaaagataatttgaacaactacgtgttccaggggcagcatcctctcactcttaacgagtctaatcctaacacagtggaggttgctgtgtctacggagtcaaaagctaatagccggccgcgacaactctggaagaagtcagtggattctatcaggcaagattccctgtcccagaatcctgtgtcccagcgggatgaggccacggccgagaatcggactcactcccttaagtctcctaggtatctcccagaagaaatggctcattctgacatctctgaaactagtaatcgcgcgacgtgtcatagagaacccgataacagcaaaaatcataaaaccaaagacaacttcaagcgatcagtggccagcaagtatcccaaggactgcagcgaggtggagcggacgtacctgaagactaagtcgtcttcaccccgagacaaaatctatacaatcgacggtgaaaaagaaccagggttccacttggatcctccccaattcgtcgaaaacgtgaccctaccggaaaatgtggactttcccgacccgtatcaggaccccagcgagaatttccgcaagggcgactcgaccctacccatgaatagaaaccctctgcacaatgaggaagggctctcaaacaacgatcagtacaagttgtactcaaagcactttaccctcaaagataaggggtctccccactccgaaacatccgagcggtacaggcagaatagcacccactgtcgcagttgtctaagtaacatgccaacatactcaggccatttcacaatgcgctcgcctttcaaatgcgacgcatgtcttagaatgggcaacctctacgacatcgatgaggaccagatgcttcaagagaccggtaaccccgccaccggggagcaggtctaccagcaggactgggctcagaacaatgcattacagctgcagaaaaataagctcaggatctccagacagcacagctatgataatatcgtggataaaccccgggaactggacctgagcagaccttctagaagcatttccctgaaggatcgggaacgcctgcttgaagggaatttctatggctctcttttttctgtgcccagctccaagctgagcggaaaaaagagttcgctctttccccaggggctggaggatagcaagaggagtaagtccctgctcccagatcacactagcgataatccctttcttcactctcaccgggatgatcagcgcttggtcattgggcgctgtccttctgacccctacaagcatagtctgccatctcaagccgtgaatgatagctatctccgctcttcgctcagatcaactgcttcatactgctcacgggacagtcgcggccacaacgatgtgtatatttcggagcatgttatgccatacgctgcgaataaaaataatatgtatagtacccctcgtgtgcttaattcatgttccaatcgaagggtgtacaagaagatgccatcaatcgagtcagatgtttag

SEQ ID NO: 118570 - DNA, 4395 bp, Artificial Sequence
  Description of Artificial Sequence: Synthetic coding sequence
atgggccgggttggatactggaccctacttgtgctccccgctctgttggtttggagaggtcccgcccccagtgctgccgccgagaagggccctccggcattaaacatcgccgtgatgctgggtcactcccacgatgttacagaaagggagcttcgtacactgtgggggcccgaacaagccgcaggattaccattggacgtaaatgtggtcgctctcttaatgaaccgtaccgaccctaagagccttataactcatgtatgcgatctgatgtctggagccaggattcatggactcgtctttggtgacgatactgaccaagaagccgtggctcagatgctggatttcatctccagccatacctttgtgcccattctcggcatccacggcggggcctccatgataatggccgacaaggacccaacgtccacattttttcagtttggcgcttcaattcaacagcaagctacagttatgttgaagataatgcaggactatgactggcacgtctttagcttagtgaccaccatattccctggttaccgggagttcatctctttcgtgaagacgactgtggacaattcttttgtgggatgggacatgcagaatgtcattacgcttgacacaagcttcgaagatgcaaagacccaggtgcaactgaagaaaattcacagcagcgtaattctgttgtactgctccaaagacgaggccgtgttaatactctctgaagcaaggtcactggggctgactggctacgactttttttggatcgtgccaagcttggtgtctggtaatacagagttgattcccaaggaatttcccagcggactaatcagcgtctcttacgacgactgggattacagcctggaagccagagtccgggatggtattggaatacttaccaccgctgccagcagcatgttggagaagttctcgtacattccggaagctaaggccagctgctatggtcagatggagcgacccgaggtcccaatgcatacattgcacccttttatggtaaatgtgacatgggatggaaaagacctttctttcacggaggaaggctatcaggtgcacccacgactggtcgtgattgtgctcaacaaggaccgcgagtgggaaaaggttggtaaatgggaaaaccataccttaagcctaaggcatgctgtgtggcctaggtataagtcgttttccgattgtgaaccagatgacaatcacctgtccatagtcacactggaggaagccccatttgtcattgtcgaggacattgatcccttaactgaaacctgtgtgaggaacactgtgccttgtcgaaaatttgtgaaaattaacaattctaccaacgaaggcatgaacgtcaagaagtgttgtaagggcttttgtattgatatcctaaagaagttgtcccggaccgtgaaatttacctacgacctgtatctcgttacaaacggcaagcacggtaagaaggtgaacaatgtctggaacggcatgattggtgaagtggtgtatcagagagcagtgatggctgtggggtctctgacaatcaacgaagagcggtctgaggttgtggatttttccgtgccttttgtcgagacagggatttctgtgatggtgagccgatccaatggcaccgtgtcacccagcgcttttcttgagccattttcagcttcagtgtgggtgatgatgtttgtaatgcttttaatagtctctgcaatcgccgtgtttgtgttcgaatatttctcaccggtcggttataacaggaacttggctaaagggaaagctccacacggtcccagttttactattggcaaggctatatggctcctctggggattggtcttcaataattctgtaccagtccagaatccaaagggtaccaccagcaagattatggtgtccgtctgggcattttttgcagtcattttcctcgcttcctacactgccaatctggcagctttcatgattcaggaagagtttgtggaccaggtgacgggactgtcggacaagaagttccagaggccccacgactactcacctccgtttcggtttggtactgtgccaaacgggtcaactgagagaaatattcgcaataactatccatacatgcatcagtatatgacaaagttcaaccaaaaaggggtggaggacgctctcgtctccctgaaaactggtaagctcgatgcttttatatatgatgctgccgttctgaattacaaggccgggagggacgaaggctgtaaactcgtgacaatagggagcggatacatctttgctacaaccgggtatggcatcgcccttcaaaaaggcagcccttggaagagacagatcgatctggccctgctgcagttcgtgggagatggtgagatggaagagctggagactctgtggctcacaggcatatgtcacaacgaaaagaatgaggttatgagctctcagctggacatcgataatatggctggcgtattctacatgttggctgcagctatggcactctccttgattacatttatttgggagcacctgttctactggaaactgcgcttttgtttcactggggtgtgctcagataggcctggcctgctgttcagcataagtcgcggaatctatagttgtatccatggagtgcacatcgaggaaaagaaaaaatctccggacttcaacctcaccggctcacagtcaaatatgctcaagctattgaggtccgccaagaacattagctcaatgagtaacatgaatagttccaggatggacagtccaaagcgcgcagcagactttatacaaaggggctcgttaatcatggatatggtttcagacaaaggaaatcttatgtacagcgacaatcggtcctttcagggcaaagagtccatttttggtgacaacatgaatgaattacagacgttcgtggctaacaggcagaaggataacttaaataactacgtgtttcaaggccagcacccgttgaccctgaacgaatcaaatccgaacaccgtggaggtcgcagttagcaccgagagcaaggccaacagcagaccgaggcaattgtggaagaagagcgtagacagtatcaggcaggactctctgtcccagaatccagtttctcagcgggacgaggcgaccgcagaaaatcggacgcactcactgaaaagcccccgatacctgccggaagaaatggcccacagcgacatctccgaaacatcaaatcgagccacctgccatcgtgagcccgacaactctaagaaccataagacgaaagacaactttaaaaggagcgtcgccagcaagtatcccaaggactgttcagaagtggagaggacctatctaaaaaccaagtcatcaagccctagagataagatctatacaatcgatggcgaaaaagagcctggatttcacctcgaccccccgcagttcgtagagaacgtgaccttgcctgagaatgtagacttcccagacccataccaggaccccagcgaaaattttaggaaaggcgactcaacactgccgatgaataggaatcccctgcacaacgaagaggggctctccaataatgatcaatataagctgtactctaaacacttcaccctcaaggacaagggctcccctcattccgaaacatcagaacgttacagacagaactcaacccattgtagatcctgtttatccaacatgcctacttattcagggcactttacgatgcgaagtccttttaagtgcgacgcttgcctgagaatggggaatctttatgatatcgacgaagatcagatgctgcaagagaccggtaacccagcaacaggtgagcaggtctaccaacaggactgggcccagaataacgctctacagctacaaaaaaataaattacggattagccgccaacatagttacgataatatcgtggacaagcctcgagagctggacctttcgcggccctccagatcgatctcactgaaggatagggaaaggctgctggagggcaacttttacggatcccttttctccgttccttcaagcaagctgtcggggaagaaatcgagcctgtttcctcagggtttagaggacagcaagaggagcaagtcactgctcccagatcatacatccgacaacccgttcttacactcccaccgcgacgatcaacgtttggttattggtaggtgcccaagcgatccatacaaacacagcctgccatctcaggctgtgaacgactcatacttgagatcatctctcaggagcactgccagttactgttcccgggattcccgtggccataatgatgtgtatattagcgaacatgtgatgccttatgcagcaaacaagaacaatatgtactcaaccccaagggtcctgaattcatgtagtaacagaagagtttacaaaaaaatgccgtctatcgaaagtgacgtctag

SEQ ID NO: 118571 - DNA, 3846 bp, Artificial Sequence
  Description of Artificial Sequence: Synthetic coding sequence
atgggacgtgtgggttactggactctcttagtgctccccgcactgcttgtctggcgagggcctgccccatctgctgcagccgaaaaaggcccacctgctctcaacattgccgttatgcttggccatagtcacgacgtcaccgagagggagctgcgtactttgtggggtccagagcaggccgccgggctgcccttagacgtcaatgtcgtggccttgctaatgaatcggacagaccctaagagcttgataacccatgtctgcgatctaatgagcggagcccgaatccatggactggtgtttggtgacgatactgatcaggaagcagtagcacagatgctggatttcatttctagccatactttcgtgccgatactcgggatacacggcggcgcttccatgattatggcagataaggacccaacctccacattttttcagtttggggccagtattcagcagcaggctactgtgatgctgaaaatcatgcaagactacgattggcacgtcttctctctggtaactaccatcttcccaggctatcgggaatttatttcctttgtcaagacaaccgtagacaatagttttgttggctgggacatgcagaatgtgataaccctggatactagctttgaggacgcaaaaacccaagtccaactgaaaaagatccatagctctgtgatcctgctgtactgttctaaggacgaagcggtcctaatactcagcgaggctcggagtcttggcctgacaggctatgattttttctggatagtgccctcgctggtctcagggaatacagaacttatccctaaagaattccctagtggattgatttcagtctcctatgacgactgggattactctcttgaagcccgggtcagggatgggatagggattcttaccaccgcagcatctagcatgctggagaagttcagctacatccccgaggccaaggcatcatgttatggccaaatggagcgcccagaggtgcccatgcataccctccatccattcatggtgaacgtcacttgggacgggaaagatttatccttcactgaggaaggctaccaggtccaccctcgtctggtggtgatcgtgctaaataaagatcgagagtgggagaaagtgggaaagtgggagaaccatactttgagccttcggcatgcagtttggccacgatacaaaagtttcagcgactgtgagccagacgacaatcacctgtcgatcgtgacactagaagaagcgccttttgttatcgtcgaggacatcgaccctctgacagaaacctgtgttcggaacacagtaccatgccgtaaatttgttaagattaataactccaccaacgagggcatgaatgtgaagaaatgctgtaagggcttttgcatagacattctgaaaaagctgtcaaggaccgtgaagttcacctatgatctctatctagtgacgaacggcaaacacggtaaaaaggtgaacaacgtgtggaatgggatgattggcgaggtcgtttaccagcgggcggttatggctgtcggctccctgaccatcaacgaagagcggtctgaggtggtggatttctcagttccctttgtcgaaacgggcattagtgtaatggtatcccggagcaacggtaccgtatctcctagcgccttcttggagcctttcagtgctagcgtctgggtcatgatgttcgtgatgctgttaatcgtgagcgcaattgcagtgttcgttttcgaatactttagccctgtcggatacaaccgtaacctggcaaagggaaaggccccccatggaccctctttcacaattggaaaggctatctggttgctctgggggctggttttcaacaactctgtgccagtgcagaaccctaagggcaccaccagtaaaatcatggtgagcgtctgggccttttttgccgtgattttcttagcctcttacacagctaacctcgcagccttcatgatacaggaagaatttgtagatcaggtcaccggcctgagtgataaaaagtttcagcggcctcacgactattccccacccttcaggttcggcactgtgccaaacggctcaactgagcgcaacatccggaacaattacccctacatgcatcagtacatgactaagtttaatcaaaaaggtgtggaagacgccctggtctccctgaagaccggcaagctagatgctttcatttatgacgccgcggtactgaactataaagccggcagagacgaaggttgtaagctggtgacaatcggctccggctacattttcgcaactacgggttatggaatagcccttcagaagggaagcccgtggaagcgacaaatcgacctggcccttctccagttcgtgggagatggcgaaatggaggaactcgagaccctgtggctgaccggaatatgccacaacgagaagaacgaggtcatgagcagtcagctggacatagataatatggcgggcgtgttctatatgctggctgctgctatggctctgagtttgattaccttcatctgggaacatctcttttactggaaactccgtttctgtttcactggcgtgtgtagcgaccggccagggctgctgttctccatttctcgtggaatctattcttgcatccacggagttcatattgaggagaagaagaaaagtccagacttcaatctgacgggaagccaaagcaacatgctaaagttgctgcggtcagccaaaaatatctcttccatgtcgaacatgaattcaagcaggatggatagtcccaaacgagctgcagacttcattcagcggggctcactgataatggacatggtttccgataaggggaatctgatgtacagcgataaccggtcctttcagggtaaggagagcatctttggcgacaatatgaatgagcttcaaacattcgtggctaacagacagaaagacaatcttaataactacgtctttcaagggcagcaccccctcacacttaatgagtctaatccaaataccgtagaggtggctgtctcaactgaatcaaaggcaaacagccgcccaagacagctctggaagaaatccgtcgactccataaggcaggactccctgtctcagaacccagtgtctcagcgtgatgaggcaaccgccgagaaccgcacccactcgttgaagagccccagatacctgcccgaagagatggcccactcggatatatcagaaacctctaatagggctacctgtcacagagaacctgacaattccaagaaccacaagaccaaagataatttcaagcgatctgtggcaagcaagtaccccaaagactgctccgaggtagaaaggacctacttgaagaccaagtcttcgtctccacgggacaagatttacacaatagacggtgaaaaggaacccggctttcacctggatccgccacagtttgtggaaaacgtaacgctgccagaaaacgtggatttcccagacccctaccaggacccctcggagaactttcgcaaaggcgattctaccctgcccatgaacaggaatccgttgcacaacgaagaaggattatctaataatgaccaatacaaactgtactcaaagcactttacgttaaaggataaagggtctccacacagcgaaacgtccgagcgctatcgccagaactccactcactgcaggtcatgcctgtccaacatgccaacttacagcggccactttacaatgcgctccccctttaagtgcgacgcttgtctgagaatgggcaatctgtacgacatcgatgaggatcagatgctacaggaaacggggatgaccaatgcttggctgctgggagacgcccccaggaccctaaccaacaccaggtgccatcccaggcgctag

SEQ ID NO: 118572 - DNA, 3375 bp, Artificial Sequence
  Description of Artificial Sequence: Synthetic coding sequence
atgctgaagatcatgcaggattatgattggcacgtcttcagtctggtgactaccatttttcccggatacagagaattcatttccttcgtgaaaaccacagtcgacaactccttcgttggctgggatatgcagaatgtgatcacgctggatactagctttgaggacgccaagacacaggtgcaactcaaaaaaatccacagttccgtgatccttctgtactgttctaaagatgaggccgttcttatattgtcagaagcgcggagtctcggcctcacaggctatgattttttctggatcgtcccttctctggtgtcaggaaatactgaactgatacccaaagaatttccatctgggttgatctccgtctcatatgatgattgggactacagtctggaggccagagtgagggatggcatcggtattctgaccacggctgcgagctctatgctagagaagttctcctatattcccgaagctaaggccagctgttacggacagatggagcgcccagaagtgccaatgcacacactacacccctttatggtgaatgtgacatgggacggcaaggatctctctttcaccgaagagggttaccaggtgcaccctagacttgtggtaattgtgttgaataaggaccgagagtgggagaaagtcggcaaatgggaaaatcataccctaagtctgaggcacgctgtctggcctagatataaatctttctctgattgcgaacccgacgacaaccatctatccattgtcactcttgaggaagcaccatttgtgatcgttgaagacatcgacccgctgaccgaaacctgcgtgcgcaataccgtcccatgcagaaagtttgtgaagattaataattctaccaacgagggtatgaatgtgaaaaaatgttgtaaggggttttgtatagatattctgaaaaaactgtcccggactgtcaaattcacatatgacctttaccttgtgacaaacggcaagcatggcaagaaggtgaacaatgtgtggaacggcatgataggggaggtcgtgtaccagcgagccgttatggcagtgggctccctcacaattaatgaagaaagatctgaggtcgtggatttctccgttcctttcgtggagactggtatctctgtcatggtatcaaggagtaacggcacagtaagcccgagcgcctttcttgaaccattcagtgcgtctgtgtgggtgatgatgtttgtaatgctgctcatagtgagcgccatagctgtgttcgttttcgagtattttagtcctgtcggctataaccgcaacctggccaaggggaaagccccacacgggccaagcttcaccataggcaaggccatctggctcctttggggcctcgtcttcaataacagcgtcccggtgcagaatccgaaaggtaccacaagtaagatcatggtttctgtctgggcctttttcgccgtaatttttttggcctcctacacagctaacctggccgcattcatgatccaagaggaatttgtggaccaggtgaccggattgagtgacaagaagtttcagagaccgcatgactacagcccccctttccggtttgggacagtgccaaacggctccaccgaaaggaatataaggaacaattacccatacatgcaccagtacatgactaaatttaatcagaagggtgtcgaggatgcgctggttagcttaaaaactggcaaactcgacgcttttatttacgatgcagccgtactgaattacaaggctggcagagatgagggttgtaagttagttacgatcggctccgggtatattttcgcaactacgggctatggcattgctctccagaaagggagcccctggaaaaggcagatagacctggccctacttcaattcgtgggcgatggagaaatggaggaattggaaactctatggttgacagggatttgtcacaacgaaaaaaacgaggtgatgtcttcgcagctcgacatcgacaatatggctggcgtgttctacatgctggccgccgctatggccttgagcttgatcacctttatttgggagcacctgttctattggaaactgcgattttgttttacaggtgtttgttccgaccgacccggccttcttttcagcatctctagaggaatatacagctgcattcatggagtgcacattgaagaaaagaagaagtcaccagactttaatctgacagggtcccagtcaaatatgttgaagttgctaaggagtgcgaagaatatttcctcaatgtcgaatatgaattcaagtcggatggatagccctaagcgggctgctgatttcatccaaagaggtagcctcatcatggatatggtctcagacaaaggaaatttgatgtactctgataatcggtcctttcagggtaaggaaagtatctttggggataatatgaacgaactgcagacctttgtagccaatcggcaaaaagacaatttgaacaattatgtgttccaggggcagcatcccctgacattaaacgagtctaatcccaacacagtcgaagtcgcagtgtccaccgagtccaaggctaattctaggccccggcaactgtggaaaaaaagcgtagacagtatccggcaggatagcttgagtcagaatccagttagtcagcgagacgaagccaccgccgaaaacagaacacattccctgaagagtcccaggtacctgcctgaagagatggcccattcagacatctctgaaacttctaaccgagctacatgccacagagaaccggataattctaagaatcataaaacaaaagacaattttaagagatctgtggcatctaaatatccaaaagactgttctgaggttgagcgtacctatctcaagacgaaatcttcttcgccacgggacaaaatttataccattgatggggagaaagaaccgggatttcacctggatccgcctcaatttgttgaaaatgtcactctgccagaaaatgtggatttccccgacccttaccaggatccttccgagaatttcaggaagggcgacagtacacttccgatgaaccgcaatcctctccataacgaggagggactaagtaataacgatcagtacaaactctattcgaagcattttacactgaaagataaaggctccccacacagcgaaacaagcgaaaggtatcgtcagaactcaacccattgccggtcctgcctttccaacatgccaacatacagtgggcacttcaccatgcggtccccgtttaaatgcgacgcctgtctgcgcatgggcaatctttacgacatcgacgaggatcagatgctgcaggaaactggtatgactaacgcctggctccttggcgacgctcccagaacactgaccaacactaggtgtcatcccagacgctag

SEQ ID NO: 118573 - DNA, 4455 bp, Artificial Sequence
  Description of Artificial Sequence: Synthetic coding sequence
atgaaacctagggccgaatgttgcagcccaaagttctggctagtgcttgctgtgctggccgtaagtggttcacgagcacgttcccagaaaagccctcccagcattggcatcgcagttatcctagttggcacctctgatgaagtcgccataaaggatgctcacgagaaggacgattttcaccacttgtcggttgtcccaagagtggaactggtcgccatgaatgagactgacccaaagtcaatcatcacccgcatctgtgatctgatgagtgacagaaaaatacaaggcgttgtttttgcagacgacaccgaccaggaagctatcgcccaaatcttggattttatttccgcccaaactctcacccctattctgggcattcatgggggaagttccatgataatggccgacaaggacgagagctcaatgttctttcaattcgggcccagcatcgagcaacaggcttccgtcatgctcaatattatggaagagtacgattggtatatcttttcaatagtgacaacctattttccggggtatcaggactttgtgaacaagattcgcagcaccatcgagaattcgtttgtgggttgggagctggaagaagtcctgttgctcgatatgagcctggacgacggcgatagcaagatccagaaccaactgaagaaattgcaatcacctatcattctcctctattgcactaaagaagaggccacctacatattcgaagtggcaaactcagtggggctcaccggttacggctatacctggatcgtgccgagccttgtcgcgggggatacagacaccgtgcctgcagaatttcccacaggcttgatatctgtgtcgtacgatgagtgggactacgggctgcccgctcgggtgagggacggcatagccattataaccaccgccgcaagtgatatgctgagcgagcactctttcatcccggaacctaaatcctcttgctataacactcacgaaaagaggatctaccagagcaacatgctgaatagatacctgatcaacgtaacgttcgagggccgtaacttaagcttcagtgaggacggctatcaaatgcaccctaagctcgtgatcattctacttaacaaagaaaggaaatgggaaagggttgggaagtggaaagacaagtctcttcagatgaagtactacgtgtggcccaggatgtgtcctgaaacagaagagcaggaggacgaccacctctccatcgtgactttggaggaggcccctttcgtgatcgtggagagtgtggatccactctccgggacttgcatgcgcaacacagtgccttgtcagaagaggatagtgacagaaaataaaacagatgaggaacctggatatataaaaaaatgttgcaaagggttctgtatcgacatcctcaaaaagattagtaaaagcgtcaagttcacctatgatctgtacctggtgactaacggcaagcacggaaagaagatcaacggaacctggaatgggatgatcggggaggtcgtcatgaagcgggcttatatggctgttggctccctgaccataaatgaagaaagatcagaagtggtggactttagcgtgcccttcatcgaaaccggaattagtgtcatggtcagccggtcgaacggtactgtctcaccatccgcattcctcgagccgttctcagccgatgtctgggtcatgatgttcgtcatgctgctgattgttagcgctgtagccgtgttcgtattcgaatattttagccctgtgggatacaaccggtgcctggcagacggacgggagcctggagggccaagctttaccatcggtaaggccatatggctgctgtggggcctggtttttaataacagtgtgcccgtccagaatccaaaagggacgacctccaagatcatggtatccgtctgggcattcttcgcagtgatctttctggcatcttatacagccaacctagctgcgtttatgatacaagaggaatacgtggaccaagtatccggactttcagataagaagttccagaggcctaatgattttagcccaccttttcggttcggcactgttccaaatgggtccactgagcgcaatataagaaataactacgccgagatgcatgcctacatggggaagttcaatcagcgaggggttgacgacgcacttctgtcactcaaaactgggaagttagatgcctttatatatgacgcagctgtcctcaactatatggctggaagggacgaagggtgtaaacttgtaaccataggttcgggaaaggtcttcgcctctaccggctacgggattgcgatacagaaggattctggttggaaacgtcaggtcgatctggccatactgcagttgttcggagatggcgagatggaagaactggaggcattgtggctgacaggaatctgccataatgaaaagaatgaggtgatgagcagtcagctggatatcgataatatggctggggtgttctatatgctcggggccgctatggcccttagtctgatcactttcatctgtgaacacctcttctactggcaatttagacactgctttatgggagtgtgctctgggaaacccggcatggtgtttagcattagtcgcggcatctatagctgcattcacggcgtggccatagaggagcgccagtctgttatgaactccccaacggccaccatgaacaacactcattcgaatattctgcggcttctccgcacagcgaagaatatggcaaacctgagcggcgtaaacgggtctccacagtcagccctcgacttcatcagaagagagagcagtgtgtacgacattagtgaacataggcgctctttcacccactcagattgtaaaagttataataaccccccctgcgaagaaaacttgtttagcgactatatctcagaggtagagcggacctttggcaatctccagctgaaagattctaatgtttatcaggatcattaccatcatcaccacagaccccatagcatagggagtgcaagctctatcgacggcctgtatgactgcgacaaccctccgttcaccactcagtctcggagcatatccaagaagcctcttgacattgggctgcccagcagcaagcactcacagctctctgatttatatggcaaattctccttcaaatcagacagatacagtggccatgacgatttaatccggtccgacgtcagcgatataagcactcataccgtaacttatggcaacatcgaagggaatgctgccaaacgccggaagcagcaatataaggatagcctcaagaagaggcctgcctccgccaaatcacgacgtgaatttgatgaaattgagctcgcgtatcgtagaaggccccccaggagcccggaccacaagaggtatttccgcgataaggaggggctgcgggatttctacctcgatcaattcagaactaaagagaactctccacactgggagcacgtggatttgacagatatctataaggaacggagtgatgacttcaagagagattccgtcagcggcggcggaccgtgtaccaacagatcacacatcaaacacggaacgggggacaagcatggggttgtttcaggagtccctgcaccgtgggaaaaaaatctcaccaacgtagagtgggaagaccgctccgggggaaacttttgtcgctcctgcccatcaaagttgcataactatagtactactgtcacaggacaaaattctggaagacaggcctgtatccggtgtgaggcctgcaaaaaagcggggaatctgtacgacatctccgaggacaatagtctgcaggagctggatcagccggcagcacccgtggcggtgacatccaatgcctctaccacgaaatacccccagagcccgacaaactcaaaagcccagaagaagaatcggaacaaactccggagacagcattcatatgatacctttgtggacctgcagaaggaagaagctgcattagcacctcgatcagttagcttgaaagataagggcagattcatggacggaagcccgtatgcccacatgtttgagatgagtgcaggggaatcaacattcgctaataataagtctagcgttccaaccgccggacaccatcatcacaataatccaggcggggggtacatgctcagtaagagtctttacccagaccgagttactcagaatccctttattcctacattcggcgatgaccagtgtcttcttcacggcagcaaatcatactttttcaggcagcctaccgtagctggcgcctcgaaagctcgaccagacttccgcgcattggtcactaataagccggtggtctcagctctacatggcgctgttcccgctcgatttcaaaaagacatctgcatcggtaatcagtcaaacccttgcgtacctaataacaaaaaccctagggcttttaatggtagctccaacgggcacgtgtatgagaagctatctagcatagagtcagacgtttag

SEQ ID NO: 118574 - DNA, 3702 bp, Artificial Sequence
  Description of Artificial Sequence: Synthetic coding sequence
atgggaggggccctcggccccgcattgctgctcacctccctgttcggcgcttgggctggcctgggacccggtcagggcgagcagggcatgacagtcgccgtggtctttagttcaagcggaccgcctcaggcgcaattccgcgctcggctgacccctcagagctttttggatctgccactagagatccaaccgctgacagtcggtgttaacaccaccaaccctagttctctgctgacccagatatgcggcttactcggcgctgcccacgtccacggaattgtcttcgaggataatgttgacacagaagctgtggcccagattttggacttcatttcatcccagactcatgttccaattctctcaatctctggtggctcagcagtagtgttgaccccaaaggagcccggcagcgccttcttacagctgggagtctctctggagcagcagttgcaagttctattcaaggtcctggaggagtacgattggtcggccttcgccgtgattacgtccctgcaccccggccatgcactttttctggagggggtccgggctgtggctgacgcttctcatgtcagctggcggctgctcgacgttgtaactttggagttaggccctggcgggccacgtgccagaacacagcggcttctgagacaactcgacgctcccgtgttcgtggcttattgcagcagggaggaagcagaggtcctgttcgctgaagcagcccaagctggactggtgggcccagggcatgtttggctggtgcccaacttggcgctcgggtcgacggacgccccccccgccacctttcccgtgggactgatcagcgttgttactgaatcatggaggttgtctctgagacagaaagttcgggatggggtagccattctagccttgggggcccatagctactggcggcagcacggtacccttccagccccggccggcgattgcagagtccaccccggccccgtgtccccggcccgagaagcattttacaggcaccttttgaacgttacctgggaaggtagagacttttcctttagccccggcggatatctcgtgcagcccactatggtggtaatcgctttgaatcgccaccggttatgggagatggtgggtaggtgggaacacggcgtgctgtacatgaagtaccctgtctggccaagatatagcgcttctttacagcccgtggtggatagccgccatctcactgtagccacccttgaagagcgcccattcgtgatcgtagagtccccggacccaggcacgggagggtgtgtgcctaataccgtaccgtgcaggcgccaaagcaaccacacattctcatccggcgacgtcgccccttacactaagctgtgctgcaagggtttttgtatcgatattcttaaaaagcttgctagggtcgtcaaattcagttacgatctatacttagttactaacggtaaacacggcaaacgtgtgcgaggagtttggaatggcatgatcggcgaggtgtattacaagcgggcagatatggctataggctccctgactattaacgaggagcggtctgagatcgtagacttcagcgtgccattcgtggagactgggatatccgtgatggtcgctaggagcaacggaaccgtgtcacctagcgctttccttgaaccctactccccagcagtgtgggtaatgatgttcgtgatgtgccttaccgtggttgctatcaccgtgttcatgttcgaatactttagtccggttagctataatcagaacctcacgagaggcaagaaatccggcgggcccgctttcacaattggtaaaagtgtgtggctcttgtgggcgctggtattcaataactccgtcccaatcgaaaatccaagaggtaccacctccaaaatcatggtactcgtatgggcgtttttcgccgttatcttcttggccagttacacagccaatctcgctgcctttatgattcaggagcagtacattgacacagtgtccgggttatccgataaaaaattccagcggcctcaggaccagtatcctccgtttcggtttggaactgtgcccaatggcagcaccgaacggaacatacggtccaattatcgggatatgcatacccacatggtgaagttcaaccagcgtagcgtggaggatgctctcacctccctcaaaatgggtaagttggacgccttcatatacgatgccgcagtactcaattacatggccggaaaggacgaaggctgtaagttggtaactatcggctcgggcaaagtgttcgcaaccaccgggtatggtatcgcgatgcaaaaggacagccattggaaacgagccattgacctggcactgctgcagttcttgggagacggggagactcagaagctggagacagtctggttaagtgggatctgccagaacgaaaagaacgaggttatgtctagtaaactggatatcgacaatatggccggcgtgttttatatgctgttggtagctatgggcctggctctgttggtgtttgcttgggagcacctcgtttattggaagttaagacactctgttccgaattcaagccagctggacttcctgttggccttctctcgggggatttactcatgtttctcaggtgtgcagtcactggccagcccaccccgtcaggcctcgccagatctcacggcttcatctgcacaggcctctgtactaaaaatgctgcaggccgctagggacatggtgactactgctggcgtgtccagttccctcgaccgagccaccagaactatagagaactggggaggagggcggcgtgcaccacctcccagcccatgtcccactccgcgctcaggaccgtctccttgcttgccaacacctgacccaccaccggaaccaagtcccacaggatgggggcctccggacgggggtcgggccgctctagtccggagagcgccacaaccacccgggcgcccccctaccccaggcccccctctgtcagatgtcagcagggtgtctagaagacccgcctgggaagccagatggcctgtgagaactggacattgcggaagacatctgagcgcctccgagaggcccttaagccctgcccggtgccactattcttccttccctcgggctgatcgtagcggccgcccattccttcccctttttccagaactggaggatctccccctcctgggccctgagcagctcgcacggcgggaggctctgttacatgctgcgtgggcccgtgggtctagacccaggcacgcaagcctcccatcctccgttgccgaggcctttgctaggccgtcatcactcccagcgggatgcactggcccagcgtgcgcacggcccgatggccacagcgcatgtcgccggctcgcccaggcacagagtatgtgtctccccatctaccgcgaagcttgccaggaaggcgagcaggccggtgccccagcatggcagcaccggcagcacgtgtgcctgcacgctcatgcccacctgccattctgttggggcgcggtatgtccacatctacctccttgcgctagtcatggctcatggctctctggggcctggggacccctgggacatcgcggtagaacgcttggactggggactggatatagggatagtggggggcttgatgagatcagcagagtggcccgcggaacccaggggtttcctggaccctgcacctggcgccgcatttcttcactggaatcagaggtgtag

SEQ ID NO: 118575 - DNA, 2724 bp, Artificial Sequence
  Description of Artificial Sequence: Synthetic coding sequence
aggggtcaaggaggcgacacacgatccaaaggaacccggcagcctgaaccccctggagctagcagagatcctgctagaagttgttgggaccctcctgtggacatgggcggagctctcgggccagcactcttgctgacctctttatttggcgcatgggccggccttggcccaggacagggcgagcaaggcatgacagtagccgtggtcttctccagctccggccctccccaagcgcagtttcgagcgcgtctgaccccgcagagtttcctggaccttccattggaaatacagccactgactgttggcgttaataccacaaatccctcaagtctgctgacgcagatttgcggcctcttaggggctgcccacgtacatgggatcgtatttgaagacaatgttgacacagaggcagtcgctcaaattctcgatttcatctctagccagactcacgtgcctattctgtccattagcggcggaagcgctgttgtccttacgcccaaggaacctgggagcgccttccttcagttaggagtgtcactggaacagcaactgcaggtcctgttcaaagtgcttgaggagtatgactggtcggctttcgcagtcataacgtccctgcaccccggccatgcgctgttcctggagggggtacgagcagtagctgacgccagtcacgtgagctggaggcttctggacgtagtcactctcgaattgggaccgggcggccctcgcgcccggacacagcgacttctgcggcagctggacgcacctgtctttgttgcatattgctcgagggaagaggccgaggttctgttcgctgaggctgcccaggcggggctggtggggccgggccatgtctggctcgtaccgaatctcgcccttggctcaacagacgctccacccgccacctttccagtcggcctaatctcggtcgtgaccgagagctggcggctgagcctgcgccagaaagtccgcgatggcgtggccatcctggctctaggggctcattcttactggaggcagcatggaacgcttcctgctcctgccggggactgccgggtacaccccgggccggtctcccccgcccgagaggcgttctaccgacacctgcttaatgttacatgggaaggtcgcgacttctcgttcagtcccggggggtatcttgtgcaacctacgatggtcgtgatcgccttgaaccggcaccggctatgggagatggtcgggcgttgggagcacggtgtgttgtacatgaaataccccgtgtggccacgatactccgcaagcctacagcctgtggtggattccagacacctcacagtcgcaactctagaggaacggccatttgtcatcgtggaatcaccagacccgggtacaggtggctgtgtgcccaatacggtgccttgtcggagacagtctaaccacaccttcagcagcggtgacgtcgcaccctacactaaactttgctgtaagggattctgtatagatattctcaagaagctggcccgtgtggtgaagtttagttacgatctgtatctcgttaccaacggtaaacatggtaaaagggtgcgtggtgtatggaatggtatgattggggaagtctattataagcgtgccgacatggccatagggagccttaccattaatgaggagaggagcgaaattgtggacttctctgtgcctttcgtagagactgggatcagcgttatggtggcccgttctaatgggacagtgagccccagcgcctttctcgaaccgtattcacccgctgtgtgggtgatgatgttcgtgatgtgtcttactgtcgtagccatcaccgtatttatgttcgaatacttctcacccgtctcttataaccagaatctaacacgtggtaagaaatccggaggccccgcctttaccatcgggaaaagcgtgtggctcctctgggccctggtgttcaataattccgtgcctatcgagaacccaagggggacaacatctaagatcatggtgctggtgtgggcttttttcgctgtgatattcctggcctcctacacagcaaatctcgccgccttcatgatccaggagcagtatattgacactgtgtctggtctgagcgataagaagtttcaacgcccacaggaccagtacccaccgttccgctttgggacagtccctaatgggagtaccgagaggaatattagatctaattaccgcgacatgcacacacacatggtgaaattcaaccagcggtctgtggaagatgcgttgacgtctctcaagatggggaagttggacgccttcatatacgacgcagccgtgctcaattacatggcgggcaaggatgaaggctgcaaactagtaacgattggtagcggaaaagtcttcgcaaccacaggctatggaatagccatgcagaaagattcacattggaagagggcaattgacctggcgctgcttcagtttttaggcgacggggagactcagaaactggaaacagtatggctcagcggcatctgccagaatgaaaagaacgaggttatgagttccaaactcgatattgataacatggccggagtgttttacatgttgctggtggcaatgggtctcgctttgctggtgttcgcctgggaacacctagtctattggaaactgagacacagcgtcccaaactcgtcacaactggattttttactggcttttagtcgtgttggcgctcatccaagcccacacaggccaaagttctag

SEQ ID NO: 118576 - DNA, 4011 bp, Artificial Sequence
  Description of Artificial Sequence: Synthetic coding sequence
atgagaggcgcaggcggacctaggggcccccggggcccagctaagatgctcctgcttctggctctggcttgtgcatcacctttccccgaagaagcaccaggtccagggggggcaggtgggccaggggggggcctggggggagctaggccgcttaatgtcgctctggtattttccggccctgcttacgccgcagaggctgccaggctgggacccgctgtcgctgctgccgttcggagtcccgggttggacgttagacccgtggccctggtcctgaatggcagtgatcctcgctctttagtgctgcagctgtgtgacttgctgtccggattaagagtgcacggtgtggtattcgaggacgattcgcgggccccggcagttgctcctatccttgatttccttagcgcccagacaagtctaccaattgtggccgtacatggaggagcagctttagttttgactcccaaggaaaaagggtcgacttttctccaattgggatcatcgactgagcaacagctccaggttatttttgaagtcctggaggagtatgattggactagctttgtggcagtcacaactagggccccaggccaccgagcctttttgtcgtacattgaggttctgactgatgggtcactcgttggatgggagcacagaggagccctaaccctggacccaggagcaggcgaagctgtgctctcagctcagctcaggagcgtgtcagctcagataagactccttttttgcgctcgagaagaggccgagccagtgttcagagccgctgaggaagccgggctcaccggcagcggctatgtatggttcatggttggtccacagctcgccggcggagggggtagcggagccccgggcgagccccctttgctgccaggaggtgcccctctgccagctgggctgttcgccgtccggagtgctggctggagagacgatctggccaggagggtggctgccggtgtggctgttgtcgcccgcggtgcccaggccttgctgagagactacggcttcctgcctgagttaggacacgactgtagggcccagaatcgtactcaccgcggggagtctctccaccgctatttcatgaacattacctgggataacagagactatagcttcaacgaggacggattcctggtcaacccctctcttgtagtgatttcactgacgcgcgaccggacatgggaagttgtgggatcttgggaacagcagactttgcgtctgaagtatcctctgtggtctcgttatggacggttcctgcaacccgtggatgatacacagcatctcaccgtcgcaacactcgaagaacgaccatttgtgatcgtggaacccgcggaccccataagtggcacctgcatcagagacagcgtaccctgccgatctcagctcaacagaactcactctccacccccagacgcacctcgtccggagaagaggtgttgtaagggattctgcattgatatcctgaaacggctcgcccataccatcgggttctcttacgatttgtacctggtgaccaatgggaagcacgggaagaaaatagatggcgtttggaatgggatgatcggggaggttttctaccagcgggcagatatggccatcggttccttgactatcaatgaagagagatcagagattgtcgacttttccgtgcccttcgtcgagacagggattagcgtgatggtggctagatctaatggaaccgtgtcccctagtgcgtttcttgaaccttattctccagcggtgtgggtgatgatgtttgttatgtgtttgacggttgtcgcggtgaccgtttttatcttcgaatatctctctccagtaggatacaaccgttcccttgcaactggtaaacggcctggcgggtcaacattcacgattggcaagtccatttggctgctatgggcgctcgtcttcaacaacagtgtcccagtggaaaatcctcggggaacaacaagcaagattatggtactagtatgggctttctttgctgtaatttttcttgcctcctataccgcaaatctggccgcctttatgattcaggaagaatacgtcgataccgtttctgggctttccgatagaaagttccaaaggccccaagagcagtacccccctcttaaatttggaacggtgcctaacggctcaacagagaagaacatacgatctaattaccccgatatgcattcctacatggtgcgatacaatcaacccagggttgaagaagctctcacccagctgaaagccggaaagcttgacgccttcatctacgacgctgccgttctgaattacatggcacgaaaggacgagggatgcaaactggtaaccatcggatcaggaaaagttttcgcgactactgggtacggaatagcactccataaaggatctcggtggaaacggcccatagatctggctctgctccagtttttaggggacgacgaaattgagatgctcgagcggctgtggttgtctgggatctgtcacaatgacaagattgaagtcatgagttctaagctggacatcgacaatatggctggagttttctatatgctgctggtggccatgggcttatccctgctcgtgtttgcatgggaacacctggtttattggcgacttcggcactgcttaggaccaacccaccgaatggacttcttgttggccttcagccggggaatgtattcttgttgctcggcagaagcagccccccctccggccaaaccccccccacccccacagcctctgccctctcctgcctaccccgcacctagacctgcaccaggccccgctcccttcgtccctcgcgagcgcgcttctgtggatcgttggcgccggaccaaaggtgccgggcccccgggtggggccggcctggccgatggattccatcgttactacgggcccatcgaaccccaggggttaggcctcggtctgggagaagccagagccgccccccgaggagcggcgggtaggcccctctccccacctgcagcccagcccccgcagaaacctcctcctagttacttcgccattgtgcgagataaggaaccggcggagccaccagcaggtgctttccccgggtttccctccccacctgccccccccgccgcagccgctaccgccgtgggtccacctctgtgcagactggctttcgaggatgaaagccctcctgctcctgcgcgatggcctcgttcggaccccgagagccagccactgctcgggcctggcgcagggggcgctgggggcacaggtggcgccggaggcggggcacctgcagccccacctccatgcagggcagctccaccgccctgcccttatctagatctcgagccctccccgtccgatagtgaggactccgagtcactcggcggcgcctcactggggggcctggagccctggtggtttgcggactttccttacccctatgccgagcgactgggtcccccacctgggcgctattggtcagtggataagcttgggggttggcgggccggctcctgggactacctgcctcccaggagtggacctgctgcgtggcactgtaggcattgtgcctccctggagcttctgccacctccccgacacctgtcctgttcccatgatggactggatgggggctggtgggcccccccccctcctccatgggcagcaggacctctacctcggcgaagggcgaggtgtggatgtccaaggtcgcatccgcacagaccccgggcgagtcacagaacgccagccgctgcagcaccccatcatcatcgccaccgccgggcggctggcgggtgggacctgcctccgccggcaccaacctcccggagcctcgaggacctctccagctgcccgcgcgcggcccccgctcggcggttaaccggaccctccagacacgccaggcgatgtccacacgccgcgcactggggaccgcctctgcctacggcgagccacagaagacacagaggaggcgacctcggaacccgacggggatccgctcacttctcttctctggagtcagaggtgtag

SEQ ID NO: 118577 - DNA, 1116 bp, Artificial Sequence
  Description of Artificial Sequence: Synthetic coding sequence
atgtcccatgaaaaatcctttctggtctcgggggacaattacccaccacctaaccctgggtaccctgggggcccccaacccccaatgcctccctatgctcagcctccgtaccccggagctccctacccccagcctccgttccaaccatcaccatacggccagcctggctatccgcatggaccctccccttacccacagggcggctacccacagggcccgtatccccagggtggttacccccagggcccctacccgcaggaaggctacccccagggcccatatccccagggggggtatccccaaggaccatatccgcagtccccctttcctcctaacccctacgggcagccccaggtgtttcccggacaggacccagattcaccacagcatgggaattaccaggaagaagggcccccttcttactatgacaatcaggattttccagccactaattgggacgataagtcaattaggcaggccttcataaggaaggtctttttggtgctgacactccagctgagcgttacactatctaccgtatccgtttttactttcgtagctgaggttaaaggcttcgtaagagaaaatgtttggacttattatgtgagttatgccgtattcttcatcagtttaatcgttctgtcttgctgcggagacttcagacgtaagcacccttggaatctcgtcgcgttgtcggtccttacggcttctctctcatatatggttgggatgattgcttccttttacaacaccgaggctgtgattatggcagtgggaatcacaacagctgtatgctttactgtcgtgatcttctctatgcagaccaggtatgactttacaagctgtatgggtgttttactggtgtccatggttgtgctctttatctttgccatcctatgtatctttatcaggaacaggatcctggaaattgtgtatgcgagtcttggtgcactgttattcacgtgttttctagccgtcgacactcaacttctgctcggtaataagcaactctccctctcgcctgaagaatacgtttttgcggctctcaacctgtataccgacataataaacatttttctctacatactgacgatcataggcagagctaaagaatag

SEQ ID NO: 118578 - DNA, 1116 bp, Artificial Sequence
  Description of Artificial Sequence: Synthetic coding sequence
atgagccacgagaaatctttccttgtgagtggggataactacccacctccgaatcccggctatcctggcgggccacaaccacccatgccaccatacgcgcagccaccctacccaggcgccccgtacccacagccgccctttcagcctagtccatacggccagccaggctatccccacggtcctagtccctatccacaagggggctatccccagggcccatatccccagggtgggtatccacaagggccctacccccaggaaggatacccacaaggaccctatccccagggcgggtatcctcaaggcccatatcctcaatcccctttccctccaaacccgtacggacagccccaggtatttcctggccaggatcccgacagccctcaacatggtaactaccaagaggaaggacctccttcatattacgacaatcaggattttccagctactaattgggatgacaaaagtattcggcaagcctttatcaggaaggtatttctggtcctgacactacagctctccgtaactctgagcacggtgagcgtgtttaccttcgtggcagaagtgaaaggattcgtgagggagaatgtctggacttattatgtttcttatgcggttttctttatcagcctgattgtgctgtcctgctgtggcgatttcagacgcaagcacccttggaatctcgtggccttgagtgttttgaccgcttccttatcatatatggtcggtatgatcgccagtttctacaacacagaggccgtgataatggcggttggcataacaacggccgtgtgctttaccgtggtgattttcagtatgcagaccagatacgacttcactagctgcatgggggtcctgctcgtctcaatggtcgtgctgttcatattcgccatcttgtgtatctttattcgcaaccggatcctggagatcgtctacgcttccctgggcgccctgctgttcacttgtttcttggctgtggatacacaactcttactgggcaataaacagttgagtttaagtcctgaagagtacgtcttcgcggccctaaatttatacaccgatataataaatatttttttatacatcctgacaatcatcggacgggcaaaggagtag

SEQ ID NO: 118579 - DNA, 825 bp, Artificial Sequence
  Description of Artificial Sequence: Synthetic coding sequence
atgtcccacgaaaagtcttttctcgttagcggcgataactaccccccacctaatcctggctacccaggaggtccgcaaccccccatgcctccttacgcccagccgccctatccaggagccccataccctcagccgcctttccagccaagcccatatggccagcccgggtaccctcacggaccgagtccctatccccaaggtggatatccccaggggccttacccacagggtgggtacccccagggaccttatccacaagagggttatccccaaggcccataccctcagggaggttatccgcagggaccgtacccgcagtccccattcccacctaatccttatgggcagccacaagtgtttcccggtcaggatccagactctcctcaacatgggaattaccaagaggagggtccaccaagctactatgataaccaggactttcccgctaccaactgggatgataaaagcattaggcaagcttttattcggaaagtgttcctggtgctcacactgcagctgtcagtgactctaagtacggtgagcgtgttcacatttgttgccgaggtgaagggtttcgtccgtgaaaacgtttggacttactacgtgagttatgccgttttttttatctcactaatcgtgcttagctgctgcggtgatttcagaagaaagcacccctggaacttagtggcacttagcgtgctgactgcctctctctcttacatggttggaatgatcgccagcttctataataccgaggcagtgatcatggccgtcggcatcaccacagccgtgtgcttcacggttgtcatattctccatgcagtag

SEQ ID NO: 118580 - DNA, 306 bp, Artificial Sequence
  Description of Artificial Sequence: Synthetic coding sequence
atgtcccacgagaaatcttttctggtatctggagacaactatcctcctcccaaccctggctaccccggcggaccgcagccgccaatgccaccttacgcccagcctccctatcccggggcgccttacccacagcctccctttcagccttccccgtatgggcagccggggtacccccacgggcctagcccgtatccccagggaggttatccccagggtccatatcctcagggcggatacccacagggaccttacccacaagaagggtacccccaaggtccatacccccagggcggttatccacagtag

SEQ ID NO: 118581 - DNA, 1059 bp, Artificial Sequence
  Description of Artificial Sequence: Synthetic coding sequence
atgagtcatgagaaaagctttctggtaagtggagataactatcctcctccctatccaggagcgccttacccacagccaccatttcagccttccccatatgggcagccgggatacccccacggcccatccccctatccccaggggggctatcctcaggggccctaccctcagggcggatatcctcagggcccatacccacaagaagggtatccacagggcccttatccccaagggggctacccacaggggccctatccacagagtcctttcccaccaaatccttacggacagccgcaggtattccccgggcaggatcccgactcaccacaacatgggaactaccaagaggaaggcccgccatcctactacgataatcaggactttccagccaccaattgggacgataaatctatacggcaggccttcatccgcaaagttttcttggtgctgacccttcagctcagtgtgaccctgtccactgtctctgtcttcacatttgtggcagaggtgaagggtttcgttagagaaaacgtgtggacatattacgtttcatatgccgtgttcttcatcagtctgatcgtactcagttgctgcggcgattttagaaggaaacatccctggaacctagtggccttaagcgtcctcactgcctcgctttcgtatatggtagggatgatcgcctcgttttataatacagaagctgttatcatggctgtgggaatcaccactgcagtgtgttttaccgtggttatattcagtatgcagaccagatacgattttactagctgcatgggggttctgctggtgtcaatggtggtgttatttatattcgccatcctctgcattttcattcgcaaccgcatcttggagatcgtctatgcctctctgggggccctccttttcacctgcttcctggcagttgacactcagttgctgctgggcaacaagcagctttccctgtccccagaagagtatgtgttcgctgcccttaacctgtataccgatataatcaacatattcttgtacatcctcaccatcattggacgggcaaaggaatag

SEQ ID NO: 118582 - DNA, 3348 bp, Artificial Sequence
  Description of Artificial Sequence: Synthetic coding sequence
atgaggcgcctctcactctggtggctgctcagcagggtctgccttctcctgcctccgccatgtgccttagtactggctggtgtaccatcttcctccagccacccccagccctgccagattctgaagcggatcggtcacgcagtgagagttggcgccgttcacctccagccttggacaacagcgccccgagcagcgtcacgcgcccccgatgactctcgggctggggcacagagggatgaacctgagccaggcacacggcgaagcccagcgccctcgccaggggcaaggtggctgggatccactttacatggacgcggacctcctggcagccgtaaaccaggtgaaggcgcccgggcggaagctctctggccacgcgatgcactgctgtttgcagtcgataacctgaaccgagtcgaaggtctcctcccatataaccttagcctggaagtagtgatggctatcgaagccggccttggcgatctccccctgctgcctttttccagtccttcctcaccatggagcagcgacccattcagctttctgcaatcagtctgccatacagtagtagtgcagggggtttccgccctcctcgctttcccccagagccagggcgagatgatggaactggacctggtgtcacttgtgcttcatattcccgtaatctcaatcgtgaggcatgaattcccgagggagagccagaacccgcttcatctccagctaagcctcgaaaacagcctgtcctccgatgcagatgtcacggtaagtatcctcacaatgaataactggtataacttcagccttctgctgtgccaagaagattggaatattaccgacttcttgcttcttacacagaacaattctaaatttcacctgggaagcatcatcaacatcacggcaaacctgccttctacacaggacctcttgagcttcctgcagattcagttagaatcaattaagaatagcaccccaaccgtggtgatgttcggctgcgatatggaatcaatcaggagaatcttcgagatcacaactcaattcggggtgatgcctcccgaactaagatgggttctgggcgactcacagaacgtggaggagctgagaacagagggactgcccctagggctgatcgcccacggcaagacgactcagtccgttttcgagcactatgtccaggacgccatggaactggtcgctcgggccgtggccacagctacaatgatacagcctgagctcgccttgatacccagcacgatgaactgtatggaggtggagacaaccaatctcacatctggacagtatctgagccgcttccttgcaaatactacctttaggggtctcagcggcagcatcagagtcaagggaagtacaattgtgagctcagagaacaacttttttatctggaacctccagcatgatccaatgggcaagccaatgtggacacggctcggcagctggcagggtgggaagattgttatggattatggcatatggccagaacaggcacagcgccataagacacattttcaacatcccagtaagttgcacctgagggtggtgactctaatcgaacatccatttgtctttaccagggaggtggacgatgagggattgtgccctgccggtcagctgtgtctagaccccatgaccaatgattcatctacgctggattccctcttttcctcactgcacagctccaatgacaccgtccctatcaagtttaagaagtgttgttacggatactgcatcgacctcctcgagaagattgctgaggatatgaattttgattttgatctttacattgtgggtgatggcaaatatggagcgtggaagaacggacactggacgggtttagtgggcgacctccttcgtgggacagcccacatggcagtgactagcttttccattaacaccgcaaggtcacaggtgatagattttacaagtcctttcttcagtacttctctgggaattcttgtcagaactagagatacagctgcgccaatcggagccttcatgtggccgcttcactggacaatgtggctgggcatcttcgtggcgctccatattacagcagtatttctcaccttgtatgaatggaagagtccctttggccttactccaaagggacgaaaccgatctaaggtattttcattctcctccgcactcaatatctgttacgcgctgttattcggtcgtactgtagcaattaaaccacctaagtgttggaccggtaggttccttatgaatctttgggcgattttctgtatgttttgcctgagtacatacactgccaacctggccgccgtaatggtgggggagaaaatctatgaagaactgagtggaattcatgatccaaagctgcatcatccatcccagggtttcaggttcggaacagttcgggaaagcagtgccgaagactatgtccgtcagtcctttcccgagatgcatgagtacatgaggagatataacgtgcctgcaactcctgatggggttgaataccttaaaaatgaccctgagaaactggatgcgttcattatggataaggcattgctcgattatgaggtatcaatcgacgcagattgcaaactactcacagtggggaagccattcgcaattgagggttatgggattggccttccacccaattctcccctgacagcgaacatcagcgaactgatctctcagtacaagagccatggctttatggacatgctgcacgacaaatggtaccgtgttgtcccatgcggaaagaggtcattcgccgtcaccgagacactgcagatgggaattaagcatttttccggtcttttcgtgctcctatgtattgggtttgggctctcaattctcacaaccatcggagagcatatcgtctacagactgctcttacctcgcattaaaaacaagagcaagcttcaatattggctgcatactagccagcggttacatagagccataaatacttctttcattgaggaaaagcagcagcacttcaagaccaagcgggttgaaaagcggtcaaacgtgggacctcggcaactcacagtgtggaacaccagcaatttaagccacgataaccggcggaaatacatattctctgatgaggaggggcagaaccagttgggtatacggattcaccaggatattccccttccccctaggagacgggagctgcctgcccttagaactaccaatggaaaagccgacagcctgaacgtttcaagaaactctgttatgcaggaactaagcgaactcgagaagcaaatccaggtaatccggcaggagctccagctggctgtttcccgcaaaacagaattggaggagtaccaacgcaccagcagaacctgtgagtcttag

SEQ ID NO: 118583 - DNA, 3585 bp, Artificial Sequence
  Description of Artificial Sequence: Synthetic coding sequence
atggtgggactgctcctgttcttctttcctgccatcttcctcgaggtgagcctgttgcctagaagcccaggaagaaaggtcctgcttgctggggcttcgtcccagagatcagtggcaagaatggacggagacgtcatcataggggccctgttttctgtgcaccaccaacctcctgccgaaaaagtgcctgaacgcaagtgtggagagattagagaacagtacgggattcagcgggtggaagcaatgttccacacgctcgacaagataaacgcagatcccgtgctgttgccgaatataaccctggggtccgagatcagagactcatgttggcattcgtccgtcgccctcgagcaatcaatagagttcattcgagattccctgatttcgatccgggacgaaaaagacggcataaatcgctgtctgccagatggtcagtcactgccacccggccggaccaaaaaacctattgcaggggtcatcggccctggaagttcttcagtagccatccaggttcaaaacctgttgcagctgtttgatattcctcagatagcgtacagtgccacttccatcgatttatccgataagactctgtacaagtattttctgagagtcgtccctagcgacaccctccaggcaagggcaatgttagatatcgtgaaacggtacaattggacctacgtgagtgctgtccatactgaaggtaactacggtgaaagcggcatggacgcctttaaggagctcgccgctcaagaaggcctgtgcattgctcactccgacaaaatttattccaacgcgggcgagaagagcttcgataggctgttaaggaaacttagagaacgtctccccaaagcacgtgtggttgtctgcttttgtgaaggtatgaccgtgagaggcctgctaagtgccatgcgtagactcggcgtggtgggggaattctcactaattggaagcgatgggtgggccgaccgtgacgaagtgatcgaggggtatgaggtcgaagcaaatggtggtatcactattaagctgcaatcccctgaagtgagaagctttgacgattactttctgaagttgagactcgacacaaatacgcgcaacccttggttcccagaattctggcagcaccggttccagtgtcgcctccctgggcaccttctcgagaaccctaattttaaaaggatttgcaccggtaacgagagtcttgaggaaaactatgtccaggactccaagatgggcttcgtgattaatgccatctacgctatggcgcatggcctccagaacatgcatcacgcgctgtgccctggccacgtgggcttgtgtgatgccatgaagcctatcgacgggtcgaagttgttggacttcctgatcaaatccagctttataggggtgagtggagaagaggtatggtttgatgaaaagggggacgcgccggggcggtacgatattatgaacctccagtacacagaagcaaataggtatgattatgtccacgtcggtacctggcacgaaggggtgctcaacatagacgactacaaaatccagatgaacaaaagtggagtggtaagaagcgtatgcagcgagccttgtctcaaaggccagataaaagtgattcggaaaggtgaagttagctgctgctggatctgtaccgcctgcaaggaaaatgagtatgtccaagatgagttcacatgcaaagcctgtgatctcggctggtggccaaatgctgacctcactggctgcgagcccattccggtaagatatcttgaatggtctaatatcgagtccattatcgcaattgcattctcttgccttggcatattggtgaccctcttcgtgaccctaatcttcgtactgtaccgggatacacccgtcgtgaagagcagctcacgtgagctttgttatatcatcctagccggtatcttccttggttacgtgtgcccattcactctcattgccaagcccaccaccactagttgttacctgcagcgtcttttggtggggttgtcatctgccatgtgttattctgccctggtgaccaaaaccaataggatagctcggattctggctggatcaaagaaaaaaatatgtactaggaaaccaaggtttatgtctgcttgggctcaggtgatcatagcttcgatcctgatcagtgtccagctgaccctcgtggtgacgctgatcattatggaaccacccatgccaattctaagctatccttctatcaaggaagtgtacttgatctgcaataccagcaatctgggcgtcgtggccccgctggggtataacggactgttgattatgagttgcacctactacgcatttaaaacacgcaatgtgccggcaaactttaacgaggctaagtatatcgccttcactatgtataccacctgcatcatttggctcgctttcgtgccgatctacttcgggagcaattataaaattatcactacctgctttgcggtaagcctgtccgtgactgtggcactaggctgtatgtttacacccaaaatgtatatcattatcgcgaaaccagagagaaacgttcgcagcgcctttacaactagcgacgtagtccgaatgcacgtgggagatggtaaactaccctgtagatctaataccttcctgaacattttcaggcggaaaaaggcaggggcagggaatgctaattctaatggcaagtccgttagttggagtgaacccgggggcgggcaagtccccaaaggacagcacatgtggcatcgtctcagcgtccacgttaagaccaatgaaacagcatgcaaccagacagcagtcataaaacccctgactaaaagttatcaaggcagcggtaaatccctcacattttccgacacatccacaaagacactctataacgttgaggaagaagaggacgcacagcctatccgcttttcaccgcccggctcacccagcatggtcgtgcatcgccgcgtgcccagcgccgccaccaccccacctctgccgtctcaccttacagcagaggagacacccctgtttctcgcagagcctgccctgcctaagggattgccacctcctctgcagcaacagcagcagcccccgccccagcagaagagtttgatggatcagctccaaggcgtcgtgagcaatttctccaccgccattccagacttccacgctgtgctggctggtcccggaggcccgggtaatggcttgcggagcttgtatccgcccccccccccacctcagcacctgcagatgcttcccctgcaactgtccaccttcggcgaggagttggtttctccgcctgcagatgacgacgatgattcagagaggtttaaactgctgcaggagtacgtgtacgagcatgagagagagggaaacacggaggaagatgagctagaggaggaggaggaagatctgcaggccgctagtaaactgacccccgacgatagcccagctttaacacctccctcaccattcagagactccgtggcctccgggtcgtccgtgccaagctccccagtcagcgagtccgtgttgtgcaccccacctaatgtgtcttatgcaagcgtcatacttagggactacaaacagtccagcagtactctctag

SEQ ID NO: 118584 - DNA, 3585 bp, Artificial Sequence
  Description of Artificial Sequence: Synthetic coding sequence
atggtaggacttctcctgtttttctttcctgccatatttctggaggttagtctcctgccgaggtcacccggccggaaggtgcttctggctggagcttcgtcacaaagatccgtcgcgcgaatggacggagatgttattattggagctctatttagcgtccatcatcagccccctgcggagaaggtccccgagcgaaaatgtggcgagattcgagagcagtatggaatacagagggtggaggccatgtttcataccctggacaaaatcaacgccgatcccgtattgttacctaacatcacactgggaagtgagattcgggacagttgttggcattcctcagtggcccttgaacaaagcatcgagtttatccgagactctctcatcagtatcagggacgagaaagatggtatcaatagatgtttaccagacggccagtctcttccacctggaaggactaagaaaccaatcgcgggcgtcataggccccgggtcttcatcggtggccattcaggttcagaacctccttcaattgttcgatattcctcagatcgcatatagcgccacaagcatcgacctgagtgataagacactttataaatatttcttgcgggtggtgccgtcggacactctgcaggcgcgcgcaatgctagacattgtgaagcggtacaattggacctacgtgagcgctgttcataccgaaggaaactatggagaatctggcatggatgcattcaaggaactcgctgcacaagagggcctgtgtatagcccattcggataagatctacagcaatgcaggcgaaaagtctttcgaccggctgctgcgaaaactgagggaaagactgcctaaagcccgggtcgtagtgtgcttttgtgagggaatgactgtgcggggccttctctcagctatgcggcgtctcggggtagtcggcgaattttctctgatcggtagcgacggctgggccgaccgggacgaggtcatagaaggctacgaagttgaggccaatgggggaataactattaaacttcagagtcccgaagttagaagcttcgacgactacttcctcaaattacgattggacactaacacaagaaacccctggtttcctgagttctggcagcaccgctttcagtgccgcttgccaggccacctgctagagaatcctaatttcaagcggatctgtaccggtaatgagagcttggaggagaactatgtccaagacagcaagatgggcttcgtgattaacgctatctacgccatggcacacggattgcagaacatgcaccacgctctgtgtcctggacacgtcgggctctgcgacgctatgaaacccattgatgggtcaaaactgcttgactttctcataaagtcaagcttcattggcgtctccggcgaggaggtttggttcgacgaaaagggcgatgcgcctggcaggtacgatataatgaacttacaatacacagaggctaataggtatgattacgtccacgttgggacatggcatgaaggagtgctgaatattgacgattacaagatccaaatgaataagtccggagtagtacggtccgtatgctccgagccctgtctgaaggggcagattaaggtcattagaaagggagaggtaagctgttgttggatctgtaccgcctgcaaggagaacgaatatgtacaggacgaatttacctgcaaagcttgcgacttaggttggtggcctaacgccgaccttacaggttgtgagcctattcctgtccgttacctggaatggagcaatatagaaagtattatcgcgatagctttctcctgcctgggcatcctcgtgacattatttgttactcttatatttgtgctctacagagacaccccagtggtaaaatccagctccagagaactatgctatatcattctcgcaggtatctttttaggctatgtgtgtccgtttacgctgatcgccaagcctacgactacttcttgctaccttcaaaggctgctggtgggcctgtccagcgccatgtgttacagtgctcttgttactaaaaccaaccgcattgctaggatcctcgctggctcgaaaaaaaaaatttgcacacggaagccaaggtttatgtctgcatgggcgcaggtaattatcgcgagtattttaatatctgtccagctcactttggtggtcaccttgattatcatggagccacctatgccaatcctcagctacccctccatcaaggaggtctatctgatttgtaatacttctaatctcggagttgtggcacctctcggctataacggcctgctgataatgtcatgcacatactatgcgttcaaaaccaggaacgtgcctgcaaatttcaatgaggcaaaatacatagctttcacaatgtatactacatgtattatctggcttgccttcgtccccatttactttggatccaactacaaaattatcacaacatgtttcgccgtgagcttgagtgtgaccgtggcactgggctgcatgttcacgcccaagatgtacataatcatagccaagcccgagcggaacgtacgcagtgcattcaccacgtcggatgtcgtcaggatgcatgtcggtgacggaaagttgccttgtagatctaatacattcctcaatatctttcggagaaaaaaagctggcgcgggaaatgcaaactctaacggtaaaagtgttagttggagcgagcctggtggcggtcaagtcccaaaaggacaacacatgtggcacaggctctcggtccatgtcaagactaatgaaacagcttgtaatcaaaccgccgttatcaaacctctaacaaagtcttatcaggggtctggaaagtctttgacattttccgatactagcactaaaacactgtacaatgtcgaggaggaagaagacgcccagcccatccgtttttcaccacctggctccccttccatggtggtgcatcggcgggtgccttctgccgccacaaccccaccactgcctagccatctgacagccgaggagaccccattattccttgccgagcccgctctacccaagggcttgccacccccacttcaacagcaacagcagcctcctcctcagcagaagtcactgatggaccagctccagggggtcgtttctaacttctccaccgccatccccgacttccatgcagtacttgctggaccaggcggaccgggcaacggactgaggtctctttacccccctcccccgccaccgcagcatcttcaaatgttgcccctccagctatcaacttttggagaagagttggtctctccaccggccgatgatgacgatgacagcgaacggttcaaactgctccaggaatatgtttatgagcatgaacgggaaggtaacaccgaggaggacgagctggaagaggaagaggaggacttgcaagcggcaagcaaactcacaccagacgattcccctgcacttactccgcctagccccttcagggacagtgtggcatccggaagctctgtgccttctagcccagtgtctgagtccgtcctgtgcactcctcccaacgtcagctacgcctcggtgatcctgcgcgattacaagcagtcctcgtcaactctgtag

SEQ ID NO: 118585 - DNA, 2721 bp, Artificial Sequence
  Description of Artificial Sequence: Synthetic coding sequence
atggtgggcctcctcctcttcttcttcccggcaatctttctggaggtttccttactgcctcggagccctggcagaaaggtgcttctggcgggggccagctcgcaacgaagcgtggcacgaatggacggagatgtcattatcggcgccctgtttagtgtacaccatcagccgcctgccgaaaaagtccccgagcgcaaatgcggtgagattcgggagcagtatgggattcaaagagtagaggctatgtttcataccttagataagataaacgctgatcccgtgctgctccctaacattacgctgggcagcgagattagggacagctgctggcattcttccgtggctctcgagcagtccatcgagtttatcagggactccctgatttccatccgtgatgagaaggacggcattaaccgctgtttgccagatgggcagagcctcccgcccgggcggactaagaagcccatcgcaggagtaataggacccggcagctcctctgtcgcaatccaggtccagaatttgctccagctgttcgatatcccccaaatagcttacagcgcaaccagcatagacctcagcgataaaacactctataaatactttctgagagtggtccccagcgataccctgcaggcgagagcaatgctggacattgtgaagaggtacaactggacctacgtttctgccgtgcacaccgaggggaactacggtgagtcgggaatggatgcctttaaagaattggcagcccaggaagggctgtgcattgcacacagcgataagatctacagcaacgccggtgaaaagagttttgaccgattgcttcgcaaactgcgagaaaggctgccgaaagcccgagtggtggtttgtttctgtgaggggatgaccgttagagggctgctctccgctatgcggagactgggcgtagtgggcgagttttccctcataggctctgacggatgggcagacagggacgaagttatcgagggatacgaggtggaagccaacggcggaatcaccataaaattgcagagtcctgaagtcaggtccttcgatgactattttctgaaactccggttagacactaatactagaaacccttggtttcccgagttctggcaacacaggtttcagtgtcgtctgccaggacacctgctggaaaatcctaacttcaagcggatttgtacaggcaacgaaagtttagaagagaactatgtgcaagatagtaaaatgggctttgttattaatgccatctacgcaatggcacatgggcttcagaatatgcaccatgctttgtgccccggacatgtgggtctgtgtgacgcaatgaagcccattgacggttcaaaactgcttgactttctgatcaaatctagcttcataggtgtgtcaggcgaagaagtgtggttcgatgagaagggcgacgcaccggggagatacgatattatgaatttgcaatacacagaggcaaacagatatgactacgtacacgtgggtacctggcatgagggagttctgaacatagacgactacaagatccagatgaacaaaagcggggtagtgcgctccgtgtgttccgagccatgcctcaaaggacagatcaaggtcatccgaaaaggcgaggtatcttgttgctggatttgcaccgcgtgtaaggagaatgagtacgtgcaggacgagttcacttgcaaggcatgtgacttgggatggtggccgaatgcagacctgactggctgtgagccgattcccgtcagatacctcgagtggtcaaatattgagtcaatcattgccatagcgttctcttgtctcggcatcttggtgacattattcgtgacacttatcttcgtgttgtatcgggacacgcctgtagttaaatccagctcacgggaactctgttacatcattctggcaggaatatttctgggctacgtgtgcccttttaccctgattgcaaaacccaccacgacttcttgttacctgcagcggcttctggtggggctatcttcagctatgtgttacagtgcactggtgactaaaaccaatcggatcgccaggatcctggcaggatctaaaaaaaagatttgcacacgcaagccccggtttatgagtgcttgggcgcaagtcataattgcctcaatactgatctcagttcagctcaccttggttgtgactttgattatcatggaacctcctatgcccatcttgtcctatccaagcatcaaagaggtatacctaatctgtaacacgagcaacctgggagttgtcgctcctctgggatataatggtctgctgattatgagctgcacatactatgccttcaagaccagaaacgtccccgccaacttcaacgaggccaaatatattgcatttactatgtatacaacctgtattatttggctggcattcgttccaatttacttcggctccaattacaaaataataactacctgcttcgccgtcagtctttccgtcaccgtcgccctgggatgcatgttcactcccaaaatgtatataattatcgctaagccagaaagaaatgtcagatccgcctttacaacctctgacgtggtccgaatgcacgttggtgatggaaaactgccctgccgttctaatacgtttctaaacattttccgccgcaagaaagctggagccggtaacgcaaagaagagacaacctgagtttagccccacctctcagtgccctagcgcccacgttcagctctag

SEQ ID NO: 118586 - DNA, 2721 bp, Artificial Sequence
  Description of Artificial Sequence: Synthetic coding sequence
atggtgggattgctgctgttctttttccctgcaatctttctggaggtaagtcttttgcctcggagtccaggaagaaaggtgcttttggctggagcgtcttcacagcggagcgtagcaaggatggatggggatgttattataggagcactcttctccgtacatcaccaaccacccgccgaaaaggtaccagagcgcaagtgcggagagattcgggagcagtacggcatccagagggtggaggctatgttccacacactggataagatcaatgcagatccagtgttgctgccaaacatcacattgggttccgaaattagggattcgtgttggcactcttctgttgcactagaacagtcaatcgagttcattcgggacagcttgattagcatcagagacgagaaggatggcatcaatcgctgtcttcccgatggccaatcgctgccccccggaaggacaaaaaagccaattgccggagtgattgggcccggctcttccagcgtggccatccaggtccagaacttactgcaactgtttgatatcccccagattgcctattcagctacctccatcgatctctcggacaaaactctttacaagtacttcctcagagtggttccttcagacactctgcaggcccgagcaatgcttgatatagtgaaacgctacaactggacttacgtgtcagctgtgcacaccgaaggtaattatggggagtcaggcatggatgctttcaaggagctcgccgcccaggaagggctgtgcatcgcgcactctgataagatttattcaaatgcgggggaaaagtcattcgaccgcctgctcaggaaactccgggagagactaccaaaagctcgggtggtcgtctgtttctgcgagggtatgaccgtgagaggcctgctcagcgccatgagacgactgggagtggtgggggagttttccctgattggttctgatggttgggctgaccgagatgaagtgatcgaaggctatgaagtcgaagccaatggagggataaccattaagctacaatctcccgaggtgagaagctttgatgattattttctgaagcttcggttggatacaaacacgcgaaacccctggttcccagagttctggcagcaccgtttccagtgcagactgccaggccatctgttggagaaccctaattttaaaaggatttgtacaggcaatgagtcactggaggaaaattacgtgcaagacagcaaaatggggtttgtgatcaatgccatttacgctatggcacacggtctccagaatatgcaccacgccctgtgccctggtcatgtgggactttgcgacgccatgaagccgatagacgggtctaagctgctagatttcctaatcaagagctccttcatcggtgtatcgggggaagaagtttggtttgatgagaagggcgacgctcctgggagatacgacatcatgaacctccagtacaccgaggccaacagatatgattacgtccacgtcgggacttggcacgaaggtgttctgaacattgacgactataaaatccaaatgaacaagtctggtgtagtgcgaagcgtatgtagcgagccttgtttaaaaggtcaaataaaagtcatccggaaaggcgaggtgtcctgctgctggatttgcacggcctgcaaagagaacgagtacgtccaagatgaatttacctgcaaagcttgtgacctgggttggtggcctaatgccgacctgactggatgcgaacctatcccggtgaggtatctggaatggtccaacattgaatcaattatagcgattgccttcagctgcttggggattctagtcaccctttttgttaccctgatctttgtgctatatcgcgatacgccggtggtgaaatcctcgagtagggagttatgctacatcatcttggcaggaatcttcctgggatatgtttgcccgtttaccttaatagctaagcctactactacttcttgttatctgcaacgccttctcgtggggctttcttctgccatgtgctactcagccctcgtgaccaaaaccaacaggatagctagaatcctcgctggttccaaaaaaaagatttgcactagaaagcccagattcatgagcgcttgggcccaggtgataattgcctccatcctcatctccgtccagctgactttggtggtaaccttgatcattatggaaccccccatgccaattctctcttacccatcaatcaaagaagtgtacttgatatgcaatacaagtaatttgggggtggtcgcaccgctggggtataacggcctgttgattatgagctgcacgtactatgccttcaagactcgcaacgttcctgccaattttaacgaagcgaagtacattgccttcacgatgtatactacctgtattatttggttagcttttgtgcccatctacttcggatccaactacaaaattattacaacgtgtttcgccgtcagcctgtctgtgactgttgcccttggctgtatgtttactccgaaaatgtatattattatcgccaagcccgagcggaatgtacggtctgcctttaccacgagcgacgtagtgcggatgcacgttggcgacggaaaacttccatgccgatctaataccttccttaacattttcaggcgaaagaaggcgggggcggggaatgctaaaaagcgccagccagaattctcacctacctctcagtgcccaagcgcacatgtgcagctttag

SEQ ID NO: 118587 - DNA, 2721 bp, Artificial Sequence
  Description of Artificial Sequence: Synthetic coding sequence
atggtgggactcctcctcttcttcttcccagctatcttcctcgaagtttcactgttgccgagaagccccggcagaaaggttcttcttgcgggagctagctcgcaacgatccgtcgcacgcatggatggcgacgtgattatcggagcactattcagtgtccaccaccagccccctgccgaaaaagtgccagaacgaaagtgtggcgaaattcgtgagcagtacggtattcagcgggtggaggctatgttccacactttggataagattaacgcagatcccgttctgttgcccaatatcacactcggctctgagatccgcgattcctgttggcattccagtgttgccctcgagcagagtatcgagttcattagagacagcctgatttccatcagggacgagaaagatggaataaaccggtgtctacctgacggacagtcactcccacccgggaggacaaagaagcccatcgcaggcgtcatcggccctggatccagttctgttgctatccaggtgcaaaaccttctgcagctttttgacatcccacagatcgcctactctgctacaagcatcgatctatccgacaaaacgctgtacaaatactttctgagggtggtaccctccgacactctccaggcccgggccatgctggacattgtgaagcgttataattggacatatgtgtctgctgttcacaccgaaggcaactacggagaatctggaatggacgcgtttaaggaactggcggcccaagaagggttgtgcatagcccacagtgataagatttattcaaatgccggggaaaagtcgtttgatcgcctgcttagaaaactgagggaacgccttccaaaggctcgggtagtcgtatgcttctgtgaaggaatgaccgtgcgcgggctcctgtcagccatgcggcggctgggcgtagtgggggaattctctctgatcggttcagacggttgggctgaccgggatgaggtgatcgagggctatgaggtcgaagcaaatggaggtattaccattaagctgcagtcaccagaggtcagatcgttcgatgattattttctgaaactcaggctggacacgaacacacgtaacccttggttccctgaattttggcagcacagatttcagtgtagactgccaggccatctgctggaaaatcccaattttaaacggatctgtacaggcaacgagtcgctggaagaaaactacgtccaggattcgaaaatgggattcgttatcaacgcaatttatgccatggctcatggcctgcagaacatgcaccatgctctctgtccgggccacgtgggtctgtgcgatgccatgaagcccatcgacggcagcaagctgcttgattttcttataaaatcctcttttataggcgtcagcggtgaagaggtttggtttgacgagaaaggcgacgcccccggccgctacgatatcatgaatctgcagtacactgaagcaaatcgctatgactacgtgcacgtgggtacctggcacgaaggcgtgctgaatattgacgactataaaatccagatgaacaaaagcggggtggttcgttctgtgtgttccgagccctgcctcaagggccaaattaaggtgatccgcaaaggtgaagttagttgttgttggatatgtaccgcctgtaaggaaaatgaatacgttcaggatgaattcacgtgtaaggcctgtgacctaggctggtggcctaatgcggatcttacaggatgcgaacctatccctgtgcggtatctcgagtggagcaatattgagagtattattgcaatcgcctttagttgtttgggcattcttgtgacgctctttgtcacactcattttcgtcctgtaccgggacacccccgttgtgaagagttctagcagagagctatgttacattatcctggctgggatctttttggggtatgtctgtccattcaccctcattgcgaaaccgaccacaacttcttgctatctacagaggctacttgtgggtctatcttcagccatgtgttatagtgcactcgtcacaaaaaccaacagaatcgctagaattctggcaggcagtaagaaaaaaatctgtactcgaaaacctaggttcatgagcgcctgggcccaggtgatcattgcatccattcttatcagtgtccaactaaccctggtggtgactcttatcattatggaacccccgatgcccatcctctcctacccaagtattaaggaggtttatctgatttgtaacactagcaacctcggcgtcgttgcgcccttgggttataatggcctgctcatcatgtcatgtacctactatgccttcaagacccgcaatgtgcctgcaaatttcaatgaggcaaagtacatcgcattcacgatgtatacgacctgcattatttggcttgctttcgtccccatatatttcggatccaattataaaattatcactacatgcttcgccgtgagcctctccgtaaccgttgctctcggctgcatgttcacccccaaaatgtacatcatcatcgcaaaacctgagaggaatgtacggtcagctttcaccaccagcgatgtggtccgcatgcacgttggggatggaaagctgccctgcaggtcaaacacctttctcaatatatttaggcgcaaaaaagccggcgccggcaacgccaagaagcggcagcctgaattttccccaacatcacagtgtccatcagctcacgttcagctgtag

SEQ ID NO: 118588 - DNA, 2619 bp, Artificial Sequence
  Description of Artificial Sequence: Synthetic coding sequence
atgggatctctgctcgccctgttagctctgctcttactgtggggcgccgtcgccgaagggccagccaagaaagttcttaccttagaaggggatctggtcctcgggggtctgttccctgtgcaccagaagggcggcccggcggaagactgcgggcccgtgaatgagcaccgcggcatacagcgcctggaagccatgctgtttgccctggataggatcaacagggatccccatttgctccccggagtgcgtcttggggctcacattctggactcttgcagcaaagacacgcacgccctggagcaggctctggattttgttagggcgagtttgtctcggggagcagacggctcaagacacatctgcccagacggaagctatgccacacacggagacgcccccacagcaatcaccggcgttatcgggggaagctactccgatgtctctatccaagtggctaatctcttacggctgtttcagatacctcagatctcctatgccagtacctcagccaaactcagcgataaatcacgctatgactattttgcacgaactgtcccccctgatttttttcaagccaaggccatggccgagattctgcgcttcttcaattggacttacgtgtccacggtcgcttccgagggcgactacggcgagaccggtatcgaggcattcgagctggaggctcgcgctcggaacatatgcgttgctactagcgaaaaagtgggccgagccatgagcagagcagccttcgaaggggtggtgcgtgctctgttgcagaagccttccgctagggtagctgtgttatttacacgctctgaagacgctcgggagctgttagccgcctcccaacgtctaaatgcttcctttacttgggtcgcaagcgatgggtggggagcccttgaatcagtagtagccgggtcagaaggggccgcggaaggggctataaccatcgagctggcctcctacccaatctcagacttcgcttcctattttcagagtctagacccctggaataattcaagaaacccttggttccgtgaattttgggaacagcgtttccgctgctcatttaggcagcgagactgcgccgcccattccctgcgggctgttccttttgagcaggaatctaagatcatgtttgtcgtgaacgccgtctacgcgatggctcacgccttgcacaacatgcatagagcactgtgccccaacacaacccgcctgtgtgacgccatgagacccgtgaacggtcgacgtctgtataaggactttgttctgaatgtgaagtttgatgcccctttccgcccagctgatacacacaacgaagtacggtttgacagatttggtgacggcatcggcagatacaatatatttacatacttaagggccggctcaggccgctaccgttaccagaaagtcgggtattgggctgaaggccttactctagacaccagtttgatcccttgggcaagcccttcagccggacctttgcccgcctcgcgttgctctgagccctgcttgcagaatgaggtgaaatccgtccagccgggcgaagtttgttgctggttgtgcattccttgccagccttatgagtacaggcttgacgaattcacttgtgcggattgcggattgggttattggcccaatgcatccctgactggatgtttcgagctaccgcaagagtacatccggtggggagatgcctgggctgtcggaccagtgaccattgcctgcttaggggccctcgcaaccctgttcgttctaggggttttcgtacggcataacgccacccctgtggttaaggcttcgggccgggagctttgttacatcctcctcggcggcgtgttcctgtgttactgtatgacatttatcttcatcgccaaacctagtacggctgtgtgcaccctcaggcggctaggactgggcacagcattttctgtatgttactctgcactgttaacaaaaaccaatcgcattgcccgcatcttcggaggtgccagagagggcgctcagcgcccccggtttatctcgcctgccagccaggtggctatttgcctggcattaatcagtgggcagctcctgattgtggttgcctggttggtggttgaggcaccagggaccggcaaagagacagctccagagagaagagaagtggtcacgctgcggtgcaaccatagagacgctagcatgttgggatcactcgcatacaacgtgcttcttattgccctgtgcacactctacgcttttaagactaggaaatgcccagaaaactttaatgaagccaaatttataggcttcactatgtacaccacctgcattatatggctcgctttcctgcccatcttttatgtgacaagtagtgattacagagtgcagacaacgactatgtgtgtgtcggtctccctatccggttcagttgtactcgggtgcttatttgcacctaagctgcatatcatactttttcagcctcaaaaaaacgtcgtcagtcatcgggctcctacatctcgctttgggtctgccgccgccagggcttcttcttcactaggtcagggatcaggctcccagttcgtgccaactgtgtgcaatggccgcgaagttgtcgatagcacgacttcttccctctag

SEQ ID NO: 118589 - DNA, 213 bp, Artificial Sequence
  Description of Artificial Sequence: Synthetic coding sequence
atgggctctcttctggcccttttagctctgttgctcctatggggcgctgtggcagagggacctgctaaaaaggtgctgacactggagggcgatctagttcttggaggactattcccggttcaccagaaaggaggtcccgcagaagactgtggccccgtgaacgaacataggggcattcagaggctggaagcaatgctgttcgcactggattag

SEQ ID NO: 118590 - DNA, 2640 bp, Artificial Sequence
  Description of Artificial Sequence: Synthetic coding sequence
atgaagatgctgacgaggctgcaggtcttaacattggctctgtttagcaagggatttttgctcagtctcggggaccataattttctgaggcgggaaatcaaaatcgaaggcgacctggtcctgggaggcctgttccccatcaacgagaaaggaaccggaacggaggaatgtggcaggattaacgaagaccggggaatccaaaggctcgaggccatgctgttcgccatcgatgaaattaacaaagacgattacctgctacccggcgttaaactgggtgtccatattctggatacttgcagccgagatacttatgccttggaacagagtctcgagtttgtgcgcgctagcctgaccaaggtcgacgaagccgagtacatgtgtcccgatggcagctatgcgattcaggaaaacattcctctgctgatcgctggagttatcggcgggagctactccagcgtgtctattcaggtcgcaaatcttttacggttatttcagatcccccaaatcagttatgcaagcactagcgccaagctgtccgataaaagtcggtatgactactttgctcggactgttcccccggacttctatcaagctaaagcaatggcggagattctgaggttctttaactggacctacgtgagtactgtggcgtccgagggcgattatggcgagacgggaatcgaagcatttgaacaggaggcacggttacgaaacatctgcattgcaactgccgagaaagtgggtaggtcaaatatccgcaagtcttacgactccgtgattcgcgagctcctccagaaaccaaatgcgagagtggtcgtcctgttcatgagatccgacgacagtcgagagcttatagcagccgccagccgtgcgaatgcctctttcacatgggtggcctccgatgggtggggcgcccaggaaagcattatcaaaggtagcgagcatgtggcctatggggccataaccctggaattggcgtcacaaccagtccggcaatttgatagatatttccaatctctaaatccatacaacaaccaccgaaacccatggtttagagacttctgggagcaaaagttccagtgcagcctacaaaataaacgaaatcatcgcagggtgtgcgataagcacttagcaattgactccagtaattatgaacaggagagcaagataatgtttgtagtaaacgccgtctacgctatggcccatgccttgcataagatgcagcgaaccctgtgtccaaacacgactaaactttgcgacgccatgaaaatactggacgggaaaaaactgtacaaggactacttactgaaaatcaactttacggcgccctttaatccaaacaaggacgctgactccattgttaagtttgatacattcggggacggcatggggcgctataacgtgtttaactttcagaatgtcggtggtaagtacagctacttgaaagtaggacattgggctgaaaccctgagcctggacgtgaattcaattcactggagcaggaactccgtaccaactagccagtgctctgacccctgcgcacccaatgagatgaaaaacatgcagcctggggatgtgtgctgttggatctgtattccttgcgagccgtacgaatacttggctgacgaatttacttgcatggattgtggatcagggcagtggcctacagccgatttaaccggatgttacgatctgcccgaggactacatcaggtgggaggacgcatgggctatcgggccagttactatcgcttgtttgggtttcatgtgtacctgtatggtcgtgactgtttttattaagcacaacaataccccattggtgaaagcctcaggcagagaactgtgctacatcctgctgtttggggttggtctgagctattgtatgacattttttttcatcgccaaaccaagtcccgtgatttgtgccctccgtagactcggcttaggctcttcatttgctatctgttacagtgccctcctgacgaagaccaattgtattgccaggatcttcgatggcgtcaagaacggtgcccagcgtccgaagtttatttctccaagctcacaggtatttatctgtttaggcttgatcctcgttcagattgttatggtatccgtatggttgattctagaagctccgggcactcgccggtacacactggctgagaaacgcgagaccgtcatactgaaatgtaatgttaaggattcttcaatgctcatcagtctgacatatgacgttatcttggtgatactgtgtactgtgtatgccttcaaaacccggaaatgcccggaaaattttaacgaggctaaatttataggatttaccatgtacacaacatgtatcatctggttagctttcctgccaattttttacgtgacatcttctgactatagggtgcaaaccacgacaatgtgcataagcgtgtccctctccggtttcgtggtcctgggctgtctgtttgctcctaaggtgcatataattctttttcagcctcagaaaaacgtcgtgacccaccgcctacacctcaaccgattctccgttagcggaactgggacaacttacagccagtccagcgcctccacttatgtcccgacggtgtgtaacggtcgagaggtgttggatagcaccaccagtagcctgtag

SEQ ID NO: 118591 - DNA, 1608 bp, Artificial Sequence
  Description of Artificial Sequence: Synthetic coding sequence
atgctgacccgcctacaggtcctcacactggcgttgttttcaaaagggttcctcctaagtctcggggaccacaactttctacgccgcgaaataaaaatagagggagacttagttctggggggactgtttcccatcaatgaaaagggtaccgggacggaagagtgtgggcggattaacgaggatagaggcattcagagactcgaggctatgctgttcgccatcgatgaaatcaacaaggatgactatttgctgcccggcgtgaaattgggtgtccacatcctcgatacctgttcccgcgacacatatgcattggagcagtctcttgagttcgtgagggcatccctgacaaaagtggatgaagctgagtacatgtgcccagacggcagctacgcgatacaggagaacatcccgttgcttatcgcgggcgtgatcggcggttcgtattcctctgtgagtatacaagtggccaacctgctcagactcttccagattccgcagatctcctacgccagcacttcagcgaaactgagcgacaagagccgttatgactacttcgctagaacagttccgcccgatttctaccaagccaaagccatggcagagatcttacggttcttcaactggacgtatgtgtctactgtcgccagcgaaggtgattacggagaaacgggaatcgaggcatttgagcaggaggcccggctccggaatatttgcattgcgacagcggaaaaagtgggcaggtctaatattcgcaagagttacgattcagttatcagggagctcttgcagaagcccaatgccagggttgtcgtattgtttatgagaagcgacgatagtagggagcttattgcagccgccagtcgcgccaacgccagcttcacctgggtggcatcagacgggtggggagcgcaggagagcatcattaagggtagcgaacacgtcgcctacggtgccatcaccttggagttggcaagccagcccgttcggcagttcgatagatactttcagagtcttaatccttacaataatcatcgcaatccctggttccgagacttttgggagcagaagttccagtgcagtttgcagaataagcgtaaccatagacgtgtttgcgacaaacatctggcaatcgacagctccaactatgagcaggagtcaaaaatcatgtttgttgtgaatgctgtgtatgccatggctcatgccctccataaaatgcagcgaacactttgccccaacactactaagctctgcgacgctatgaagatcctcgatggcaagaagctgtacaaagactatcttttaaagatcaacttcacaggagctgatgacaatcatgtccatctgtgccaacccgagtggctatgtggactgggcctctttgtgtgtacccagggcagccaccatccagtctctaccccggaggaatgttgtcatacccaaacggccccccagcaggtacaatgccagtggaactgggaccatatactctctgtcctttgtaaacatgtgtgtgccaacggtgttcaatgggccggaagtccgagactgcaccacttaatttctgtcattgttaattgcagcagcgtccttgtttttttggactgctag

SEQ ID NO: 118592 - DNA, 264 bp, Artificial Sequence
  Description of Artificial Sequence: Synthetic coding sequence
atgaaaatgcttacaaggctgcaagtactgaccctggccctcttctctaagggcttcctcctgtcgctaggtgatcacaatttcctgaggcgtgaaattaagatcgaaggcgacctggtcttgggcggcttgttccctattaatgagaagggaaccgggacagaagagtgtgggcgcatcaatgaggatcgcggtattcagcgccttgaagccatgctgtttgctattgacgaaatcaataaggatgattatctcctgccctag

SEQ ID NO: 118593 - DNA, 1614 bp, Artificial Sequence
  Description of Artificial Sequence: Synthetic coding sequence
atgaagatgttgacacgcctgcaggtgcttactttggccctcttcagcaagggtttccttctgagtctgggcgaccacaactttctgagacgagaaatcaaaatagagggcgaccttgtcctcggaggcttatttcctatcaatgagaaaggaacgggtaccgaggagtgtggcaggattaacgaggaccgcggtattcagaggttggaagccatgctcttcgctattgatgaaattaacaaagatgactatttactgccaggagtcaagcttggcgtgcacatcctggacacctgctcccgggacacatatgcactggaacagtccctggaattcgtgcgggcctccttaactaaggtagacgaggccgagtatatgtgccccgacggatcgtatgctatccaggagaatatacccctgctgatagctggggtcatcggcggttcatacagcagcgttagtatacaggtagccaacctcctgcggctttttcagatcccccagatttcatacgcaagtacctccgctaagcttagcgacaaaagccggtatgactatttcgctcggactgtgccaccagatttctaccaggcaaaggcaatggctgagatcctacgcttctttaactggacttatgtgtccacagtggcttcggaaggcgattacggcgagactggcatcgaagctttcgagcaggaggcacgcctgcgaaacatttgcattgccaccgcggaaaaggtcggtcgtagcaatataaggaaatcgtacgattcagtcatcagagagctgctgcaaaagcccaacgctcgagtcgtggtactttttatgcgttccgacgatagcagggaattgatcgctgctgctagccgggccaatgcctcgtttacctgggttgcctcagatggctggggggcccaggaatctatcattaaaggcagtgaacatgtggcttacggtgctatcacccttgagctagcctcacagcccgttagacagtttgacagatacttccagtcactgaacccctataacaaccaccgcaatccctggtttcgcgacttctgggaacagaaattccagtgctcccttcagaataagcggaaccatagacgggtttgcgacaaacatcttgccatagattctagcaactacgagcaggagtctaaaattatgtttgtcgtgaacgccgtgtacgctatggctcatgccctgcataagatgcagaggacactgtgtccgaatactaccaagctgtgcgacgccatgaagattttggatgggaagaaactgtataaggactatttactgaaaattaatttcacaggggcggacgacaaccacgtccatctctgccagcccgagtggctgtgcgggctgggcttgttcgtctgcacacaagggtctcatcacccagtgagcacacccgaagaatgctgtcatacccagaccgcaccccagcaagtacaatgtcagtggaattgggaccacatcctgtccgtcttgtgtaaacatgtatgcgcaaacggcgtgcagtgggcgggcagtccccgtctgcaccatttgatttcagtgattgtcaattgttcttccgtgctcgtgttcctcgattgttag

SEQ ID NO: 118594 - DNA, 246 bp, Artificial Sequence
  Description of Artificial Sequence: Synthetic coding sequence
atgaaaatgcttacaagactgcaagtgctcacactggcgctctttagcaaaggattcctgctgtcattgggagaccataatttcctgcggcgtgaaatcaaaatcgagggcgacctggttctcgggggtctgtttcctattaatgagaaaggcacaggaacagaagaatgcgggagaatcaacgaggatcgaggcatccagaggctcgaagctatgctgtttgctatcgatgagattaacaaatag

SEQ ID NO: 118595 - DNA, 2256 bp, Artificial Sequence
  Description of Artificial Sequence: Synthetic coding sequence
atgagccagtcacccggtgctggctcccctccccctctgccacccaggtctgcccctgtcccagcaagaagctgtcgatgcgaggtcgccaatttgttaagactattccagataccacagatcagctatgcctctacttccgccaaacttagtgacaaatcccgctatgattacttcgcccgaaccgtgcctccagacttttatcaggcaaaggctatggctgagatccttaggttcttcaattggacttatgtcagcaccgtggccagtgagggtgattacggggaaacaggcatcgaagctttcgagcaggaggctcggctacggaatatttgcatcgccacagccgaaaaggtcggccgttccaacatcaggaagtcgtacgattcagttatcagggaattgctgcagaagcctaacgcgcgggtggttgtgctatttatgcggtcagatgattcccgcgaactgatagctgcagcgtcgagagctaatgctagctttacttgggtggccagcgacggttggggcgctcaagaaagcattatcaagggctcggagcacgtggcctatggcgcgattaccctcgagctcgcctctcagcccgtgaggcaatttgatcgatactttcagtcactcaatccctataataatcaccggaatccttggtttcgcgacttttgggagcaaaagtttcagtgtagccttcaaaacaagagaaatcataggagggtgtgcgataagcacctggcaattgactcttcaaactacgagcaggagtccaaaatcatgttcgtagtcaatgctgtttatgcaatggcccatgcactgcacaaaatgcagcgtacgctgtgtcccaataccaccaagctgtgcgatgcaatgaaaattctggacgggaagaaattgtacaaggactacttgctgaagataaatttcacagcaccattcaatcctaataaagatgcggattccatcgtcaagttcgatactttcggagacggcatgggtcgctacaacgtgttcaacttccaaaatgtaggagggaaatactcttatttgaaagtggggcactgggcagaaactctgtccctggatgtgaacagcatacattggtcacgtaattccgtgcccacttcgcagtgctcagatccttgcgcccccaacgaaatgaagaatatgcagcccggagatgtgtgttgctggatctgtataccatgtgagccatacgagtacctggctgacgaattcacttgtatggactgcggaagtggccagtggcccaccgccgatctgactggttgctacgatctccctgaagactacatcaggtgggaagacgcttgggcaattggccctgtgactatcgcttgtttggggtttatgtgtacatgcatggttgtcacagtctttatcaagcacaacaatacccctctggtgaaggcttctggacgggagctatgttacatcttgttgttcggtgttgggctgtcttactgtatgacatttttttttatcgccaaaccatcacctgttatttgtgcactccgaagactggggctgggcagctcatttgcaatttgttactctgccctgctcacgaaaactaactgtattgcgcgtatatttgatggcgtcaagaatggagcccagaggccgaagttcatctccccctcctctcaggtattcatctgtcttggtctgatcctggtgcagattgtcatggtgtccgtctggttgattcttgaggcccccggtacaagaagatataccctggcggaaaaacgggagaccgttatcctcaaatgcaatgtgaaagactcctctatgctgatttccctaacatatgatgttatactggtgatcctgtgcactgtctacgcattcaaaactcggaagtgcccagaaaacttcaatgaggctaaatttatcggcttcacaatgtatacgacatgtatcatatggttggcgttccttccaatcttttacgtcacaagctccgattaccgggtgcagactacgaccatgtgcattagcgtatcactatccgggtttgtggtgttgggttgtctgtttgcccccaaggttcacattattctgtttcaaccacaaaaaaacgttgtcactcatagactccatctgaatcgcttcagcgtgtctggcactgggactacgtacagtcaaagctctgcctcgacttacgtccccaccgtgtgtaatggacgggaggtactggattctactacaagttctctgtag

SEQ ID NO: 118596 - DNA, 1416 bp, Artificial Sequence
  Description of Artificial Sequence: Synthetic coding sequence
atgaggcggaccaaccatgagcctgaaccggggtgccgcctcaccgctgcggccgccaccgctgtgagctcttcgtcctgccaggaactgagtgtaagggctcccttcaatcctaataaggatgccgactccatcgtcaaatttgacacgtttggcgatggaatgggccgctataacgtgttcaacttccagaatgttggcggtaaatattcttacttaaaagtaggccactgggcagagaccctctccctagacgtgaattcgattcactggtcacgcaattctgttcctacatcacagtgcagcgacccatgtgccccaaacgagatgaagaatatgcagcctggggatgtttgctgctggatttgcataccttgcgagccttacgagtatcttgccgacgagtttacatgcatggattgcgggtctggacaatggcctacagccgacttgaccgggtgctacgaccttcccgaggactatataagatgggaggacgcttgggccatcggcccagttactatcgcatgcctgggttttatgtgcacatgtatggtggtaacggtgtttatcaagcataataacacacccttagtcaaggccagcggaagggagctttgctacatattactattcggcgtggggctctcctactgtatgactttttttttcattgccaagccgagccctgtgatctgtgcacttcggcggctcggactgggcagcagctttgccatttgttattccgcacttttgaccaaaactaattgcatagcccgtatctttgacggtgtcaagaatggcgctcaacggcctaaatttatcagtccttcgtcacaagtgttcatttgcctcggtctgattctagtgcaaatcgtgatggtgtccgtctggctcattctggaagcccccggaacaagaagatacacgcttgctgaaaaaagggagacggtcattctgaagtgtaatgtaaaggacagtagcatgttgatcagcttaacgtacgacgttatacttgtgattttgtgtacagtatatgctttcaagacccgaaagtgcccagaaaacttcaatgaggcgaagttcatcggtttcacaatgtacaccacatgcataatatggctcgccttcttgcctattttctacgtcaccagtagcgactaccgggtccaaaccacgactatgtgcatcagcgtgtcactgagcggcttcgtggtgttgggatgtcttttcgcccccaaagtgcatataatcctgtttcagccccagaaaaatgtcgtgacccaccggctgcacctgaacaggttctcagtgtcaggtactgggaccacatacagtcagtcttccgctagcacatacgtgcccacagtttgcaacggtcgagaagtcttagattccactacttcaagtctgtag

SEQ ID NO: 118597 - DNA, 2391 bp, Artificial Sequence
  Description of Artificial Sequence: Synthetic coding sequence
atgccagcctgggagccaggcgtagccgcctcatgtgggtggcgtgcccctccttgcagcccgctcaggctgtgtattgcaccacatccctgtacgcccccaagttcccatcagggcaacttgacgtgccggctgccacccagatccttcggattctgccgatgtgtgtgggtgagaacccggggacccagtttacccggtgaacaggtgtcgcttgccgcccatgagagcgaaggcgccgctgctcagctcgggagcagtcctgagatagatccacgccggcccagatgcctgctgccagagtcagcacagattccccagatatcctatgcatcaaccgctcccgacctcagcgacaatagtcgctacgattttttctcgagagtcgtacccagcgacacctatcaagcacaggcaatggtggatatcgtcagagctttgaaatggaactatgtctcaaccgtggcctcggaagggtcctacggagagtcaggcgttgaggccttcatccagaagagcagagaggatggtggtgtgtgcatagcacagtccgtgaagattccccgcgagcccaaagctggagagttcgataagattattcgccgtttgttggagacgtctaatgctcgggctgtgattatttttgccaacgaagatgacattaggcgtgtgctggaggcagcaagaagagccaatcagactggacactttttctggatgggttcggattcttgggggagcaaaatcgctccggttctccatttggaagaagtggccgaaggggctgttaccatcttaccaaagcgtatgtcagtgagggatagggagcgtatcggtcaggactctgcttatgagcaggaaggtaaggtgcaatttgttatagacgctgtgtacgcaatgggtcatgccctacacgctatgcatagagatctgtgccccggacgagttggcctctgtcctcgaatggacccggtagacggaacccagttgctgaaatatattcgtaatgtgaatttcagcgggatcgccgggaatcccgttactttcaacgaaaacggcgacgcacctggacgctatgatatttatcagtaccagctccgcaacgatagcgctgaatacaaagtgatagggtcatggaccgatcacctacatctcagaatcgaacgcatgcactggcccggcagtgggcaacagctccctcgaagcatctgttcattgccttgtcagcccggagaaaggaaaaagactgtaaaggggatgccctgctgttggcattgcgaaccctgtaccggctaccagtaccaagtcgatagatacacctgcaaaacatgtccttatgacatgcggcctaccgaaaaccgaacaggatgccgtccaatcccaatcattaagctggagtggggcagtccgtgggccgtacttccactgtttctggcagttgtagggatcgctgccaccctgttcgtggtcatcacctttgtgcgatacaatgacactcccattgttaaggcttctggccgcgagctctcgtatgtgctgctggcgggcatcttcctctgctatgccactaccttcctgatgatcgctgaacccgatctggggacctgctcattgcgacgcatcttcctgggcctcggtatgtcaattagctacgctgctctgctcaccaagaccaaccgcatttaccgcatctttgaacaaggcaaaaggtccgtgtctgcccctcgcttcataagtcctgcgagccagctggctattacattcagtctgatatcactgcaactgttgggcatctgcgtatggttcgtggttgatccttcacattctgtcgttgactttcaggatcaacggacacttgacccaaggtttgcccgtggcgtgctgaaatgtgacatctccgacctctcacttatatgtctgctaggatattcaatgctactgatggtgacctgtactgtgtacgccattaagaccaggggagtccctgaaactttcaatgaagccaagcctattggcttcaccatgtataccacgtgtatcgtctggttagcttttattccaatattcttcggaaccagccagtcagccgacaagctgtacatacagactacaacacttacagtgagcgtgagcttgtccgcatctgtcagcttagggatgctgtacatgccaaaggtgtatattatcttatttcaccccgaacaaaatgtgccgaaaaggaagcgctccctgaaggcagtagtaaccgccgcaacaatgagcaataaattcacccagaaaggcaacttccgacccaatggtgaggcgaaaagcgaactgtgcgaaaacctggaagcgccggccctggcaaccaagcagacatatgttacgtacaccaaccatgccatttag

SEQ ID NO: 118598 - DNA, 2739 bp, Artificial Sequence
  Description of Artificial Sequence: Synthetic coding sequence
atgccagggaagcgcgggctgggctggtggtgggctcgccttcctctctgcctgctgttgagcctttacgggccgtggatgccatccagcctcggcaagcctaaaggacaccctcacatgaacagtattcgcatagatggagatatcactctcgggggccttttccccgttcatgggcggggctccgagggaaagccatgtggcgaacttaagaaggaaaagggcattcacaggctggaagctatgctattcgccctggaccgcatcaataatgatccagatctgttacccaatattactttaggggccaggatcctggacacctgctcacgggatacccacgctctggagcagtcactgactttcgtgcaagccctgatcgaaaaggacggaacggaggtcaggtgcggtagtggcggccctccgatcatcacaaagcccgagagagttgttggggtaatcggagcttcaggatcaagcgtatcaatcatggttgctaacatactgaggctgttcaaaatccctcagatcagttatgccagtacagcaccggatctgtcggataattccagatatgactttttcagtagggtggtgcctagtgatacctaccaggcccaggccatggttgacatcgtacgggctctgaagtggaactatgtgtctactgtcgcctccgaaggcagttatggtgagtctggcgtggaggcctttattcagaaatcccgggaggacggaggcgtgtgcatcgcacagtccgtaaaaattcctagggagccaaaggccggtgaattcgataaaattatcaggcgcctgctcgaaacttccaatgcacgagctgttattatttttgcgaacgaagatgacatccgtcgggtgctggaggcagctaggcgggcgaaccaaacagggcactttttctggatggggagcgatagttgggggtccaagatcgccccagttctacaccttgaggaggtggccgagggcgccgtgacaattctacccaagagaatgtctgtgcggggctttgaccgctactttagcagtcgcacattagataataaccggcgcaacatttggttcgcggagttctgggaggataactttcattgtaaactctcacgccacgcactcaaaaaaggatcccacgttaagaaatgcacaaaccgcgaacggatcggacaggattccgcatacgaacaggagggcaaagtgcaattcgttatcgatgccgtatacgcaatgggccacgccttgcacgctatgcatcgggacttatgtcctggccgcgtggggctttgtcccagaatggatcctgtcgatggaacccagctcctgaagtacatacgtaacgtcaattttagtggaatagcaggtaatcccgtgaccttcaatgaaaatggtgatgccccagggcggtatgatatttaccagtaccagctcagaaacgatagtgccgagtacaaggtgatcggcagctggaccgaccacctgcacctgcggatcgagagaatgcactggccaggatccggccagcagctgcctcggtccatttgctctcttccctgtcagcccggcgagagaaaaaagacggtcaaaggcatgccctgctgctggcattgtgaaccgtgtaccggttaccagtatcaagtggaccgatacacctgtaagacctgtccctacgacatgcgccccactgagaataggactggatgtcgtcccatcccaattatcaaactagagtgggggtccccttgggccgttctgccactctttctcgccgtggtgggtatagccgcgaccctgttcgtcgttattaccttcgtcaggtacaacgatacaccaatagtgaaggcatccggccgagagttatcctacgtactgttggctgggatctttttgtgctacgcaactacctttctgatgatagcagagcctgatttgggaacatgctccctgcgccgaatctttctaggcctgggcatgagcatctcctacgccgccctgctgactaagacgaaccgaatctaccgtatttttgagcagggtaaacggagcgtgtcagctccacgctttatttcccccgcctctcagctggccattaccttttctttgatttcactccagctactggggatttgcgtgtggttcgtggtggacccctcacatagcgtagtggattttcaggatcagcgaaccttggatcctcggtttgcccgaggggttctcaagtgtgacatctcggacctgagcttgatctgtctgcttggttacagtatgctgcttatggttacctgcacggtatatgccatcaaaacccgaggagtgccagaaacattcaacgaagcaaaaccaataggatttactatgtacaccacatgtatcgtttggctcgcattcatcccaatcttcttcggaacatcacaaagtgccgataaattgtatattcagactaccacactcacggtctcagtcagcctgagcgccagcgttagtctgggtatgttatatatgcccaaggtctacatcattttgtttcatcccgaacagaatgtccccaagaggaagcggtcactgaaggccgtggtcactgctgctactatgagtaacaaattcacccagaagggcaatttcagacccaacggcgaagccaagagcgagctgtgtgagaacctggaagctcccgcgttggccacgaagcagacgtacgtcacatataccaatcacgccatttag

SEQ ID NO: 118599 - DNA, 2319 bp, Artificial Sequence
  Description of Artificial Sequence: Synthetic coding sequence
atggttcagaccttgcccaagctgttcccacacgatggcgcgaagcggaaaaagcgaactctgcgaactagtggcccctgctttggcggggggggtcagatccctcagatctcctatgccagcaccgctcccgatctctctgacaacagccgctatgactttttctcacgggtggtacccagtgatacctatcaggcccaggccatggtggacatcgtccgcgcgctgaagtggaactatgtcagtaccgttgcttcggaggggtcctacggggagtctggcgttgaggcgtttatccagaagagccgggaggatggtggagtgtgtattgcccagagcgtgaaaattccccgagagcccaaagccggcgagttcgataaaattatccggcgtctactggaaacctccaatgcccgcgccgtcatcatcttcgcaaatgaagatgacatacggagagttctcgaagcagccagacgcgccaatcagacagggcatttcttttggatgggatcagattcttggggcagcaagatcgcgccggtgctgcatttagaggaggttgccgaaggcgccgtgactattctgcccaaaaggatgtccgtacgcggatttgatagatactttagcagccggaccctggacaacaaccggcggaacatctggttcgcagagttctgggaagacaatttccactgtaaactgtcaagacacgccctgaagaagggcagccacgtgaaaaaatgtacaaaccgtgagcgaatcggccaggactccgcctatgagcaagaaggaaaggtgcagttcgtcattgatgccgtgtacgcaatggggcacgccttacatgcaatgcatagagatctatgcccagggcgagtaggcctttgtccccgcatggatccagtagacgggacccaacttctgaaatacattaggaatgtcaattttagtggaatcgctggcaacccagtgactttcaacgagaatggcgacgccccgggcagatacgacatctaccagtaccagctgcgcaatgactccgctgagtacaaggtcatcgggtcttggactgatcacctgcatctgaggatcgaaagaatgcactggcctggcagcggccagcagctgccgcggtctatttgttcactgccatgccaaccaggagaacgtaagaagaccgtgaagggtatgccttgctgctggcattgtgagccgtgcaccggctaccagtatcaagtggaccggtatacgtgcaaaacctgcccctatgatatgcgccctactgagaacagaactgggtgcagaccaattccaataatcaagctcgaatggggctccccctgggccgtgctgccactttttttagctgtcgtgggaatagccgctaccctctttgtggtcattacctttgtacgatacaatgacaccccaatagttaaagcttcgggtagggaactgtcctacgtgctgctcgctgggatttttttgtgttatgccaccacattcctaatgattgcagaacccgacctcggaacttgctctctcagacggatctttctcgggctgggtatgagtatttcgtatgccgcactgttgaccaagacgaaccgtatctaccgcatcttcgaacaggggaagcggtctgtttccgctccccggttcatttctccagcttcacagttagccattactttctctctgatcagtctgcagcttttgggcatctgtgtgtggttcgtcgtcgatccgagtcacagcgtcgtggactttcaggatcagcgaaccttagacccaaggttcgcaaggggagtgctcaaatgcgacatttcggatctgtcactcatttgtcttttagggtactcaatgctgcttatggtgacgtgtactgtgtacgcaattaagactcggggcgtcccagagacctttaacgaagctaaaccaatagggttcactatgtacacgacctgtattgtgtggctcgcattcattcccattttctttgggaccagtcagtccgctgacaaactctacatacagactacaaccctgacggtaagcgtttcactgtccgcttcagtgtccttaggcatgctgtacatgcccaaagtttacattatcttattccaccccgagcaaaacgtccccaaaagaaagcgctcactgaaggccgttgttacagcagctactatgagtaataagtttactcagaagggcaattttcgacctaacggggaggccaagagcgagctatgcgagaatttggaagccccagccctcgccaccaagcagacttacgtgacttatacgaaccacgctatttag

SEQ ID NO: 118600 - DNA, 2340 bp, Artificial Sequence
  Description of Artificial Sequence: Synthetic coding sequence
atggccgtcccattgggagccccctgttgggcgagcgctctgcccgcatgggcaccacctggactaccccatagaagtctgctgacgagattgctgtcacagcacgttaagccagctaagattccccaaatttcctacgcctccacagccccagacttgagcgataattctaggtacgactttttctcacgcgtggttccctcagacacctaccaggctcaggcaatggtagacattgtccgcgctctcaaatggaattatgtaagtactgtggcaagcgagggttcctacggtgagtctggcgtcgaggcttttattcagaaatcaagggaggacggaggagtgtgcatcgctcaatccgtcaaaattccccgagaacccaaggccggagagttcgacaagataatccggcgtctgttggagacttctaacgcgcgggcagttattatctttgccaatgaggatgacatccggcgcgtacttgaggctgccaggagggctaatcagactggacactttttctggatgggatccgattcgtggggatccaaaatcgcgccagtcctacatctggaggaggttgccgaaggggccgtgacaatcctgcctaagcggatgtccgtgaggggctttgaccgttatttcagctctaggacgctggacaacaacagaaggaacatctggtttgctgagttttgggaagataacttccactgcaaactgtcacgtcatgccctcaaaaaaggcagccacgttaagaagtgcacaaatcgggaacgtatagggcaggactccgcctacgagcaagaaggaaaggtgcagtttgtcatcgatgccgtttatgccatgggccatgctctgcacgctatgcaccgcgacttatgccctggccgggtgggcctctgtcctcgaatggaccctgtggatgggacccaattgttaaaatatattcgaaacgttaacttctctggtatcgccgggaacccggtgacattcaacgagaatggcgatgcccccggccgatatgacatctatcagtaccagttgcgaaatgactccgcggagtataaggttattgggagttggactgatcacttgcacctgcgtatagaacggatgcattggccaggctcagggcagcagttgccaagaagtatctgcagcctgccgtgccaaccgggggagcgtaaaaagacggtgaaaggaatgccctgttgttggcactgcgagccctgtactggatatcagtaccaagttgatagatacacgtgtaagacctgtccctacgacatgaggcccacagaaaatagaacgggatgtcggcccattcccataattaagctggaatggggcagcccctgggctgtgctaccgctgttccttgccgtcgtcggaatcgccgcaaccctgtttgtcgtaattaccttcgtgcggtataacgatacacctattgtgaaagcgtctgggcgggaactcagttacgtactgttggccggcatatttttatgttacgccacaacattcctcatgatagcggagcccgacctcggtacatgctcattgagaaggatctttttaggactgggaatgagtatttcctatgctgcattactgactaaaactaataggatataccggatctttgaacaaggaaagagaagcgtgtctgcccccagattcatctctccagcctcccaactcgccattactttcagccttatttccctgcagctcctgggtatctgcgtgtggtttgtcgtggacccatctcacagcgtggtggatttccaggaccagcgtactctggatccacgctttgccaggggcgtgctcaaatgtgatatatccgatctttcgctcatatgcctgttaggttactcaatgctgctcatggtgacatgcactgtttacgccatcaaaacacggggagtccccgaaacattcaacgaggcgaaacccattggctttacaatgtacaccacttgcatagtgtggttagcctttatccccatttttttcggcacctcccagtccgcagacaaattgtatattcagaccacgactttgacagtgagtgtttccctcagtgcttctgtgtctctcggcatgctctatatgcccaaagtctatataattctctttcacccagagcaaaacgtccccaaaagaaaaagaagtctaaaagctgtagttactgcagccactatgtctaacaagttcacccaaaagggtaattttaggccaaacggcgaggccaagtctgaactgtgcgagaacctcgaggcccctgctctggccacaaaacaaacgtatgtcacttatactaatcatgccatttag

SEQ ID NO: 118601 - DNA, 2739 bp, Artificial Sequence
  Description of Artificial Sequence: Synthetic coding sequence
atgcccggcaaaaggggcctcggatggtggtgggcccgattgcccctctgtctgcttctgagtttatacgggccttggatgccctcctctctggggaagccaaagggacaccctcacatgaacagtataaggattgacggagacatcacattaggaggccttttccctgtgcacggtagaggtagcgagggtaaaccctgtggagaacttaaaaaggaaaaaggtatccaccgcctggaagccatgctctttgctctggacagaataaacaacgatcctgatctgcttcctaacattacgctgggggcacgtatcctcgacacctgcagtagggacactcacgccctcgagcagagtctcacattcgtccaggctctcatcgagaaggatggaacagaagttcgatgtgggagtggagggcctcccatcatcactaagcctgagcgcgttgtgggggtgatcggcgcatccggtagtagtgtgtctatcatggtagccaacatacttcggctcttcaaaattccccagatctcatatgcgtcaaccgctccagacctcagcgacaatagtagatacgacttcttctccagggtggttccctctgatacctatcaggcacaggccatggtggacatcgtacgggcacttaagtggaactacgtttctaccgtcgcgagcgaaggatcctacggtgaatccggagtggaggccttcatccagaagtcgcgggaggatggaggagtctgtattgcccagtcagtaaaaatcccacgggagcccaaggcaggcgaatttgacaagatcatccgtcggctcctggagacctcaaacgcacgagcagtgatcatctttgccaacgaggatgacattaggcgggtgctggaggctgctcgtagagcaaatcagactggacattttttctggatgggatctgactcttggggcagcaagatcgccccagtcttacacttggaagaggttgcggaaggggcggtgaccatcctgcctaagcgtatgtcggttcggggctttgaccgctactttagctcccgtactctagataataaccggcgtaacatttggttcgcagagttctgggaagataattttcattgcaagctgtctcgccatgccttgaaaaaaggatcccacgtcaaaaaatgtactaacagagagcgtatagggcaggacagcgcctacgagcaagaaggtaaggtccagtttgtcattgacgcagtgtacgccatgggccacgcacttcatgctatgcatagggatctgtgccccggcagggtgggcttatgcccccgcatggaccctgtggacggcacgcagctgctgaagtatatacggaacgtgaatttctcaggtatagccggcaatccagtcacctttaatgaaaacggcgatgctcccggaaggtacgatatctaccagtaccagctgagaaatgatagcgccgaatacaaagtgatcggcagttggacagaccatctgcaccttcgcatcgagcggatgcactggcctgggagcggccaacagcttcctcgctcaatatgcagccttccgtgccaaccaggagaacggaagaaaactgtgaaaggaatgccgtgttgttggcattgcgagccatgcaccggctatcagtatcaggttgaccggtacacgtgtaagacatgtccctatgacatgagacctacggagaacagaaccggttgtaggcccattccaatcatcaagctcgaatgggggagtccttgggcagtgctgcccttgttcctggccgtagtggggatcgccgcaaccctgtttgttgtaataacctttgtcagatacaatgacaccccaatcgttaaagcgagcgggagggagctgtcctacgtactgcttgccgggattttcctgtgctatgccaccaccttcttaatgattgctgagcccgacttggggacttgttccctccggcggattttcctggggctgggcatgtcaatttcttatgccgccctcctcactaagacaaaccggatctataggatcttcgagcagggcaagagatccgtgagcgcaccccgctttatcagccccgcatcacagctggcgatcactttctctctcattagccttcaactgctggggatttgcgtctggtttgtcgtcgacccatcacattcagttgtcgatttccaggatcagcgcacccttgatccaagatttgcacgcggggtgctgaaatgtgatataagcgatctgtctcttatctgcctccttggttattccatgctcctcatggtgacatgcactgtgtatgcaatcaagactcggggcgtcccagagactttcaacgaggcgaaacctatcgggttcactatgtacaccacatgcatcgtctggctcgcttttatccctatatttttcgggacatcccaaagcgcggataagctttacattcagacgactacactgaccgttagtgtgtctttatctgcttctgtcagtctcggcatgctttatatgcccaaggtgtatattatcttgttccaccctgagcaaaatgtgccaaagagaaaacgcagcctgaaagcagtagtgacagctgctaccatgtccaacaagttcactcagaaaggtaatttcagacctaatggagaggccaaatctgaactctgtgagaatctggaggctcctgcattggcaacaaagcaaacctacgtgacatataccaaccacgcgatctag

SEQ ID NO: 118602 - DNA, 2232 bp, Artificial Sequence
  Description of Artificial Sequence: Synthetic coding sequence
atgtcctgtaaaataccacagataagttacgcctccactgccccagaccttagcgataattctcgatacgatttcttcagtcgggtggttccgagcgatacctatcaggcccaggccatggtagacatagtacgggccctgaagtggaactatgtgtctacagtggcgtctgagggcagctacggcgagagcggggtcgaggcattcattcagaagtcccgggaagatggaggcgtctgcatcgcacagtccgtgaagataccaagggagcctaaggcgggagagttcgacaaaatcataagaaggctcttggaaacctccaatgctcgagccgttataatatttgcaaacgaggacgacatcagacgcgtgttggaagccgccagacgcgccaatcaaacaggacacttcttctggatgggctccgactcatggggctctaagatcgcacccgtgctgcaccttgaggaagtggcagaaggagctgtgaccattctacccaaacgcatgagcgttcgcggctttgacaggtatttcagcagtagaactctggataacaataggcgcaatatttggtttgccgaattctgggaggataattttcattgcaagctgtctcgtcacgctctgaagaaggggtcccacgtgaaaaagtgcaccaatcgagagcgtatcggccaggatagtgcatatgaacaggaaggtaaagtgcagttcgtgatagacgccgtgtacgctatgggtcatgctctgcatgccatgcatcgagatttgtgcccaggaagagtgggcctgtgcccccgaatggacccggtcgacggcacgcagctgttaaagtacatcagaaacgtgaacttttctggtattgcggggaacccagtcactttcaacgagaacggggatgccccaggcagatacgatatttatcagtaccagctcaggaatgactccgctgagtacaaagtaattggatcatggacagaccatctgcacctcagaatcgagcgaatgcactggcctggatcagggcaacagctgccccggagtatctgcagtctgccctgtcagccgggtgagagaaaaaagacggtcaagggaatgccatgctgctggcattgcgaaccgtgtacggggtaccagtaccaggttgacagatatacgtgtaagacctgcccttacgatatgagacctacggagaaccgaaccggttgtcgccccatcccaatcataaagcttgagtggggctcaccttgggccgtcctccctctcttcttagccgtggtagggattgcagcaacacttttcgtcgtgatcacgttcgtgaggtataacgacacccctatagtgaaggcctccgggagggagctaagctatgttctgttagctggtatatttctctgctatgctaccaccttcctcatgatcgccgagcctgatttaggaacctgcagtctgcgacgaatttttctcggattgggtatgtctatctcttacgccgccctgctgactaaaacaaaccggatctaccgaatattcgagcaaggcaagcggtcagtcagcgcgcccagatttatcagccctgccagtcagcttgctatcacctttagccttatttcactccagcttttaggtatatgtgtgtggttcgtggtggacccatcccactccgtcgttgacttccaggaccagcgcactctggatccacggtttgcaagaggcgtgctgaaatgcgacatttccgacctgtcactcatttgcctgctgggctactccatgctgctgatggttacttgcaccgtgtatgccattaagacgaggggggtacctgaaacttttaacgaggcaaaaccgatcggctttacaatgtatacaacgtgcatcgtgtggctagctttcattccgatcttctttggtaccagccagtctgctgacaagctgtatatccagaccacaactctaacggtgagtgtgtctctttccgcctccgtgagcttgggcatgctctacatgcccaaggtctatatcatcctctttcacccggagcagaacgttcctaaaaggaaaaggtcgctgaaagccgtggtgacagcggcgacaatgagcaacaaattcacgcagaagggcaacttcagacccaacggagaggccaagtctgagctatgtgagaacctcgaggcaccagcgctggcaaccaagcaaacttacgtgacctacacaaaccatgctatctag

SEQ ID NO: 118603 - DNA, 1776 bp, Artificial Sequence
  Description of Artificial Sequence: Synthetic coding sequence
atgggtagcgacagctggggtagcaagattgcgccggtcctgcacctggaagaggtggcagaaggcgccgtgacaattctccccaagcgaatgtccgtgcgcggctttgaccgctacttctcgagcaggacactggataataatcgccgcaatatatggttcgccgaattttgggaagataattttcactgcaagctctctcggcatgccctgaagaaaggcagccacgtaaaaaagtgtactaaccgagaaagaatcggccaggactcggcctatgaacaggaaggaaaggtacagtttgtcattgatgccgtttatgcgatgggccacgctcttcacgcaatgcaccgagacttatgcccaggaagagtgggactctgcccaaggatggatcccgtcgacggtacgcagctgctaaaatatattcggaacgtgaatttctcaggtattgccggaaaccccgttacatttaacgagaacggcgatgcgcctggacgctacgatatttaccagtaccaacttcgcaatgatagtgctgaatataaggtcatcggaagttggaccgatcaccttcacctgcgaatagagcgcatgcactggccaggatccggtcaacagctacccaggagcatttgcagtctaccgtgtcagccaggggaaaggaagaagactgtgaaaggtatgccatgttgctggcactgtgaaccttgtacagggtatcaatatcaggttgaccggtacacctgcaaaacctgcccctatgacatgcgacctaccgaaaaccggacagggtgcaggcccatcccaatcatcaagctggaatgggggagcccttgggctgtcttgcccctgttcctggctgtcgttgggatagcggccaccctgttcgtggtaatcacgtttgttcgatacaatgatacaccaattgtgaaggcaagtggtcgggaactctcatacgtgctactggccgggattttcttatgctacgccaccaccttcctaatgattgctgagcctgacttgggcacttgctccctgaggagaattttcctcgggctcggaatgtccatttcatacgccgccttactcaccaaaacgaatcgcatctatcgaatatttgagcagggcaaaaggtccgtttctgctccccgctttatctctccagcaagccagctcgcaatcacctttagtcttatatccctgcagctgctgggcatctgcgtgtggttcgttgtggaccccagtcactccgttgtggattttcaggatcagcgcacattggaccctaggttcgctcggggggtgctgaagtgtgatatctccgatttgagcctgatatgtctgctcggatacagtatgcttctgatggtgacctgcactgtttacgccattaagacaaggggcgtgcccgaaacattcaacgaggccaagcccatcgggttcacaatgtatacgacctgtattgtctggcttgcatttattcctattttctttggaacgagtcagtccgcagataagttgtatatccagactactactctgaccgttagtgtttcgctcagcgctagtgtttcactcggtatgctttacatgccaaaggtttatattattctgttccacccagagcagaatgtacctaaaagaaagcgctccctcaaggcagtggtcaccgccgccaccatgtccaataagttcacccagaaaggcaattttagacccaatggcgaagccaaaagcgagttatgcgagaatcttgaagcacctgggagctcatag

SEQ ID NO: 118604 - DNA, 2364 bp, Artificial Sequence
  Description of Artificial Sequence: Synthetic coding sequence
atggagcctgcgggtgaacgatttccagagcagaggcaagtgctgatcctgctgttgcttcttgaagtgacgctagcaggttgggagccacgccggtattccgtcatggaagagaccgagcggggctctttcgtggctaacctcgctaatgacctcgggctgggagtgggggaactggccgagcggggcgccagagttgtgagcgaggacaatgagcaaggcctccagctggatttgcagaccgggcagctgattttgaatgagaaactggatcgcgagaaactttgcggacctacagagccctgtattatgcactttcaggtcctgctcaagaaacctctggaagtatttagagcagagctgcttgtgactgatatcaacgaccactcccctgaatttcctgaacgggaaatgacgctcaagatccctgaaacgtcatccctgggcactgttttccctctgaaaaaggcccgggacctggacgttggcagtaataacgtgcagaattataacatttctccaaactcacactttcatgtatcaacccggacgagaggcgacggaagaaagtaccccgagttggttctggacaccgaattggatagagaggaacaggcggagctgcgactcactctgactgcagtggacggggggagtccacctcggtctggcacagtgcagatcctgattcttgtgctggacgctaacgacaacgctcccgagtttgtgcaggccctatatgaagttcaggtacccgaaaatagtcccgtgggctctttagttgtgaaagtgtccgcgagggacctggacaccgggacaaacggcgaaatttcgtactccctgtactatagcagccaagagattgacaagcctttcgaactgtctagcctgtctggcgaaatccgcctgattaaaaagttagatttcgagaccatgagctcctacgatctcgatatcgaggcatctgacggaggcggtctctccggtaagtgctctgttagcgtcaaggtgctggacgtaaacgacaattttcccgagctgtccatttcctctctaaccagtcccattcctgagaacagcccagagactgaagtggcgttattcaggatcagagaccgggacagcggtgaaaacggcaaaatgatttgctcaatccaagacgatgttccctttaagttgaaaccaagcgtagaaaacttttaccgcctggtgaccgagggcgcactggacagggagacccgcgccgagtacaatataactattactataactgatctaggaactccccgactcaaaaccgagcagagcattacagtcctggtttcggacgttaacgataatgcacctgcctttactcaaacttcttacacgctgtttgtgcgcgagaacaactctcctgctcttcacatcggcagcgtctcagccaccgaccgtgacagtggtacaaatgcgcaggtgacctattccttactgcccccgagggatcctcacctaccactgacctcactggtctccattaacacagataatgggcacctgttcgcgcttcagtcactcgattacgaagcccttcaggccttcgagttccgcgtgggcgcaacggaccgcgggtttccagccttgagttcagaggcacttgtccgcgtgctggtgctggacgccaatgataattcacctttcgtgttgtatccactacagaatgggagcgctccttgcacagaactagttcccagggctgctgagcctgggtatcttgtcacaaaggtcgttgcggtggatggggactccggccaaaacgcatggttaagttaccaactgctcaaagccacagagcctggtcttttcggagtgtgggcccacaatggcgaagtgcgcactgcccgcctactttctgaacgagacgtggcgaaacataggctggtcgtgctagtgaaagataatggcgagcctcctcgttctgcaacggcaaccctccaggtcttgcttgtcgatggattttcccagccgtacctgccactccctgaggctgccccagcccaggcccaagctgacagcctcacggtttatctcgtggtggcccttgcttctgtgagctcactgtttctgttctcagtgtttcttttcgtggcagtgcgactgtgtaggaggtctagagctgccagcgtcggcagatgcagcgtcccagaaggcccatttccgggccacctggtcgacgtctcaggcacaggtacattatcccagtcgtaccaatatgaagtgtgtctcaccggagggagcgaatctaatgatttcaagttcctgaagccgatctttccgaacatcgtgtctcaggacagccggcggaagagcgagttccttgaatag

SEQ ID NO: 118605 - DNA, 3276 bp, Artificial Sequence
  Description of Artificial Sequence: Synthetic coding sequence
atgcagctggatggtcttcaagccctatgttggggcagcctttttaggacacagctcgtccctgtctacgtggccgtgctgccctccccccaaccctgcatacccccaacatgtaccgcgttcactgagttttctggcccactcgcaaagcaccactcctttcagccgtttcaagtggctgccccagcaggaccacgcagtccacctcagccattccatcttccgtctgtgagtcaggtgcatgccacccacttactgtgtcctgtgcgggtgctgggcccaccctaccccccttctctggagctgctcacctcaattcactcaccagcggtcctgccagctccacagatccctcagatctcctatgctagcacagctccagaactcagcgacagcactaggtacgactttttctcccgtgtagtgcctccggactcataccaggctcaggccatggttgacattgtcagggcgctgggctggaactatgtcagtacactggctagtgagggaaactacggtgaaagcggcgtggaggcctttgtgcaaatcagcagggaggctggggagctgggcgccccacggcaccagggggtttatatcgtgtgggcgcgcggcccacagctcggccagaagcaaaaagacgggggacctcggagcatgctaggaagaggttgccttgcaggcgcaccttgtggtagggacctgtttgtcctggatgattctgcactgccacaagcctggcgaagagtgcaggctagattacacccttgtcggcctttttcccagccaacccagtcaagcgctgcggtcgctcgctggagcataaagatcccgcgggaaccaaagcctggagaattcagcaaagttatacgcaggctcatggagactcctaatgcaagaggaattattatatttgcgaacgaggacgatatctcgcctgcaccaaccagaagagttctagaagcagcacgacaagctaacctgacgggccattttctgtgggttggatccgattcctggggtgctaagacaagtcccatacttagcttggaagatgttgctgtgggcgcgattaccattctccccaagcgggccagtatcgacggttttgatcagtattttatgactagatcactggaaaataacaggaggaatatttggtttgcagagttttgggaagagaactttaactgtaaactgacatcatccggaacccagtctgatgatagtacccgaaagtgcacaggagagagttgccccggctggactggagaggagaggattggaagagacagtacttatgaacaggagggcaaagttcagtttgtgatcgacgccgtttacgccattgcacatgccctgcacagcatgcaccaggcactgtgtcctggacataccgggctgtgtcctgcgatggagccgactgatggaagaatgctcctgcagtacatccgttgtcctctgcagtggttgaatcgtattcctctgtgtgaatggccgcgccgtgtacggcctttcttttgtcagtggacgctgggattattatctagctgtggatacgtaaacaatgctgccgtcaacgtggccgttcaggcctttctcgctacactcctctcgtctctgtcatcaatctatccgggagtcgaactcctgggtcacgtctttaatctcctgcgcaggctacacaccgtcttctgctcgggttgctcactgtttcctccaaccgtccacaaaggatctgctggtactccagtgatgttcaatgaaaatggagatgcccccggccgatacgacatattccagtaccaggctactaacgggtcagctagtagcggtggctaccaagccgtgggacagtgggccgaaacactcagacttgatgtgtctgtacaaaccgagccacaggtgggaatgggccccgggagtaggcgccagacaccccaacctgtgttctgcgctagccaggtcgaggcgttgcagtggtctggagatccacacgaggtaccgtcatctctgtgctctcttccctgtggaccaggagagcgaaaaaagatggtgaaaggggtcccttgttgttggcattgcgaagcctgcgatggataccgatttcaggtcgatgaatttacttgtgaggcctgtcctggcgacatgcgcccaaccccaaatcatacaggttgtcggccaactcccgttgtccgcttgtcatggtcatcaccctgggctgcccccccattgctgctggcggtgctggggatcgtcgccacaaccacggtcgtggcgacgttcgttagatacaacaatactccaattgtacgcgcgtctggccgggaattaagttatgtccttctgacaggcatttttctgatctatgcgatcacttttttgatggtagcagagcccggagctgccgtctgcgctgcgagacgtctgtttctgggcctgggtacgacactcagctactctgccctgttaacaaagactaacaggatttatagaatcttcgaacagggaaaacggtccgtcacaccgccccccttcattagccccacaagccagctggtgatcacattctctctgacctctctgcaaatcaatgctgttttccgagttactctgttttactttggctcccttcaatggcactatctgtcttccctgcaggctctgcccagtggcgatctctctgtgcagcacttgtccgccagcgtgagtctgggaatgctatatagtaagagtaaaacaccagtggatttagaagtcggcagcgagccatggggctatcttggggatggtgtcctgcaggccgaacattggggagagggacgcggcgattggccccacgttaaagtaatggtggtggtctaccaatccagcttggtttattatatgaagcaagctcaggcaggaagggtgaaaaccgaactgctgaaggtcgcccatcatcaggtcgccaaatcagtacccgaggaatcacagattgtggtcttgcacctcgttaccgctgggtatgttgacatggccattaggacaacccgcgcaagcttgcacctgatgccgctaaccttggtgcccggcgctgcagctgaggtcaacgagacccaagtggcagctcggctgggaccaggtagcacagttggaacttaccaggttgtcgttgtgctcatgcgtagcctgcagattgataagactacgaatcaattatccctcgaaacctgcttctccggcattcagggctttctggctagtgtgaattcactggtcatggataaatag

SEQ ID NO: 118606 - DNA, 2634 bp, Artificial Sequence
  Description of Artificial Sequence: Synthetic coding sequence
atggccagaccccgtcgggcccgagaacccttactggtggcccttctgcccttggcatggctggcccaggccggcctggctagagccgccggaagtgtgcgcctagctgggggtctgactctgggcggcctgtttcccgttcatgcccggggagcagctggccgcgcatgcggccagctcaagaaagagcaaggcgttcatcggctggaggccatgctatacgccctggacagagtcaatgctgatcccgagctgctgccaggcgtgaggctgggggcgcggctactagatacctgttctcgcgatacatatgccttggaacaggccctgagcttcgtgcaggctctgattaggggccgaggagatggcgatgaagtaggtgtgcgatgccccggcggtgtccccccgcttcgcccggcaccaccagagcgtgttgtggccgttgtgggagcatctgcctcatctgtgtccataatggtcgccaacgttctaagactgtttgccatccctcaaatctcgtatgctagcactgctccagagctgagcgattccacacggtacgatttcttttcccgagtcgtccctcctgactcatatcaggcccaggccatggtcgatattgtgcgcgcccttggatggaattatgtaagtactctggcctcagagggcaattacggagaaagtggagtagaagcctttgttcagattagcagggaggcaggcggcgtgtgcattgctcagtctattaagatccctagggaacctaagcctggtgagttcagcaaagttatacgccggctcatggagacccctaatgctagaggcattattatcttcgcaaatgaagacgacattaggcgcgttctggaggcagcccgccaggctaacctgacagggcatttcctttgggtcgggtccgatagctggggggccaaaaccagccctatcctttccttagaggatgtggccgtcggagccattaccattttacccaaacgggcttctattgacggatttgaccagtacttcatgacccgtagtctcgagaacaacaggcggaatatttggtttgctgagttttgggaagagaatttcaactgcaagttaacctcttcaggtacacaatcagacgacagcaccaggaagtgtaccggggaggaacggatcggcagagacagtacttacgagcaggagggcaaggtacagtttgtgatagatgctgtatatgcaatcgctcacgctctacattctatgcatcaagccctgtgtcctggtcacacaggcctttgcccagcaatggagcccaccgacggacgcatgttgctgcagtatatcagagccgttcggttcaacggaagcgcagggacccccgtaatgttcaacgaaaatggtgacgctcctggccgttatgacatcttccaatatcaggccacaaacggctctgcttcgagcgggggatatcaggccgtgggccagtgggctgagaccttgcgcctggacgtggaggctcttcagtggtcaggagacccacacgaggtgccctcttcactctgctccctgccatgtggtcctggcgaaagaaagaaaatggtcaaaggtgttccatgttgctggcactgcgaggcgtgtgacggttatcgcttccaagtcgacgagttcacatgcgaagcttgcccaggagacatgcgaccgacccccaaccatacgggctgtaggccgacacccgtggtgaggctatcgtggtcgtccccttgggctgctcctcccctgctcctggctgttctgggcatcgttgctactacaactgtagtggctaccttcgttagatataacaacacaccaatcgtgagggcaagtggcagggagctatcgtatgtcctactaaccggtatcttcctgatttacgccatcacctttttgatggtcgccgagcccggagccgcagtgtgtgcagctcgcaggttatttctgggtctggggacaacactctcttacagcgccttactgacaaagactaacagaatctaccggatctttgagcagggcaagcgatcagtcactccgcctcctttcatatctccaacgtctcagttggtgatcacattttcgctgactagcctccaagtcgtaggcatgattgcctggctgggggcaaggcctccacactccgtcatagactacgaggaacagagaacagttgacccggaacaggctagaggggtgcttaaatgcgacatgagcgacctgagcctaattggctgtctggggtactctctcttgctaatggtgacttgcacggtctacgctatcaaggcgcgcggcgtccccgaaactttcaacgaagccaaacccattgggttcaccatgtacacaacgtgcattatctggctggccttcgtccctatcttttttgggacagcccaatctgcggagaagatttatatccagacaacaactttgactgtgagtctctcattgtcagcttccgtctcactgggaatgctgtacgtgccaaagacatacgtcattctgttccaccctgagcagaatgtgcagaaacgaaaaagatcccttaaggccacatcgactgtggctgccccacccaagggagaagacgccgaagcccataaatag

SEQ ID NO: 118607 - DNA, 2748 bp, Artificial Sequence
  Description of Artificial Sequence: Synthetic coding sequence
atggtgcagcttagaaagctgctgagagtcctgaccctaatgaagtttccatgttgtgtcttggaagtgctgctttgtgcactggcagcagcggcccgcggccaggagatgtacgccccccactccattaggattgagggtgacgtgaccctcggaggcctctttcctgtccacgccaagggccccagcggggtaccgtgtggtgacatcaagcgcgagaacgggattcacagacttgaggctatgttatacgccctggaccagattaattcggacccaaatctgctccccaacgtgaccttaggtgcgcgcattctggacacgtgcagcagggatacgtatgcgttagaacagagcctcacatttgtgcaggctctgatacagaaagataccagtgatgttcggtgtaccaacggcgagccgccagttttcgtgaagccagaaaaagttgtaggagtcataggggcctccgggtccagcgtctctatcatggttgctaatatcctgagactgttccagatcccccaaatcagctatgcttctaccgcacctgagctttcagatgaccgcagatatgacttctttagccgcgtcgtcccacctgattccttccaggcacaggccatggttgacattgtgaaggccctggggtggaactacgtttccactttggcctcggaggggagctacggcgaaaagggcgtcgagtcattcacccagatctctaaagaggccggaggactctgtatcgctcagagcgttaggatccctcaagagcggaaggacaggacaatcgacttcgaccggatcatcaagcagctacttgacacacctaatagcagagccgttgtgattttcgctaacgatgaggatattaaacagattctggctgcagctaagcgggccgatcaggtcgggcacttcctgtgggttggaagcgactcttggggatccaagatcaacccattgcaccaacatgaggacatcgctgagggcgcaattaccatccagcccaaaagagctactgtggaaggcttcgatgcgtattttacatctaggaccctcgagaacaaccgccgaaacgtctggttcgcagaatattgggaggaaaattttaattgcaaactgaccatctcagggagtaagaaggaggatacagataggaagtgcaccgggcaggagcgcatcggaaaagattccaattatgagcaggagggtaaagttcagtttgtaatcgatgccgtgtatgccatggcgcatgctctgcatcacatgaataaggatttgtgtgcggattacagaggcgtctgtcccgagatggaacaggctggggggaagaagttactgaaatacatccgcaatgtgaatttcaacggctcagcgggaacccccgtcatgttcaataaaaacggtgatgcccccggccggtacgatatcttccagtatcagacaacaaatacatcgaatccaggctatcggctgatcggccagtggactgacgagctgcagctgaacatcgaagacatgcagtgggggaagggcgttagggaaatccctgctagcgtttgtacgctgccatgtaaaccaggacagcggaagaagacgcagaaaggcacaccatgttgctggacttgtgaaccgtgcgatgggtaccagtaccagtttgatgaaatgacatgccagcactgcccatatgatcagcgcccaaatgagaatcgaactggttgccaggatattcctataattaagctggagtggcactccccctgggccgttatcccagttttccttgctatgcttggcatcattgccacaatcttcgtaatggcgacttttatccgctacaatgatacacctatagttagagcatcaggcagggaactgtcttacgttctgctgactgggatcttcctatgctatatcatcacattcttgatgatagcgaaacccgacgtcgctgtgtgctcttttcgacgtgtgttcttagggctgggcatgtgcatctcctatgctgcactgttgaccaaaacaaatcgcatatatcggatctttgaacagggcaaaaagtctgtcaccgccccacggctaattagccctacgtcacagctggctatcactagcagcctgatatccgtgcagctcctgggcgtatttatttggttcggcgtggatccccccaatataatcatcgattatgatgaacataaaaccatgaaccctgagcaggcccgcggggtgctcaagtgtgatattactgacctgcagattatctgttcacttggctactctattttgctgatggttacttgtaccgtgtatgccataaagacgcggggagtaccagagaactttaatgaggccaagcctatcgggttcacgatgtacactacttgtatcgtgtggctggcttttatccctattttttttggcaccgcccaatcagctgagaaactttacattcagaccacaaccttaacgatcagcatgaatctctctgctagtgtggctctggggatgctgtacatgccaaaggtttacattatcattttccatccggaactcaacgtacagaaacgcaagcgaagcttcaaggccgtggtgaccgctgcgacaatgtccagcagactcagccataagccctctgacagacccaacggcgaggcaaagacggagttatgtgagaacgtggaccccaacagccccgccgccaaaaagaaatacgtgagctataataacctggtgatatag

SEQ ID NO: 118608 - DNA, 2721 bp, Artificial Sequence
  Description of Artificial Sequence: Synthetic coding sequence
atggtgcaactgcgaaaacttttgagggtacttacgctgatgaagttcccttgttgcgtgctggaggtgctgctgtgtgcacttgctgctgcagctcgggggcaggaaatgtacgcccctcatagcattcgaattgagggcgacgtcaccctcggcggcctgtttccagttcacgctaagggcccaagtggagtcccctgcggagacataaagagagaaaatggtatccacagattagaagcaatgctatatgcactcgaccagatcaactcggacccgaacctgttaccgaatgtgacactgggagctagaatcctagatacttgctctcgcgacacttacgccttggagcaatccctgaccttcgtccaggctctgatccagaaggacacatctgatgtgcggtgcaccaacggcgagccaccagtctttgtaaaacccgaaaaagtggtgggagtaataggcgccagcgggagttctgtctccataatggttgccaacatcctccgacttttccagattcctcagatatcttatgccagcacagctccagaactgagcgatgatagacgatacgacttcttttcaagggttgtgccgcccgattcctttcaggcccaggcgatggttgacattgtgaaagctctgggttggaactatgtatctactctggcttctgaaggtagctacggggaaaagggtgtggaaagcttcacacagatttcgaaagaggctggaggcctgtgcattgcacagtctgtacgaataccacaggagagaaaggaccggaccatagacttcgatcggattataaagcagttgctggacaccccaaacagccgagccgtggtcatattcgccaatgatgaggatatcaagcaaatcctggccgcggccaaacgcgccgaccaggtaggtcattttctttgggttgggagtgactcttggggcagcaaaatcaaccctcttcatcagcacgaagacattgcagaaggtgctataaccatccagccaaagagagcgactgtagagggttttgacgcctacttcacatcaaggacactggaaaacaataggcgcaatgtatggttcgctgagtactgggaagaaaattttaattgtaaactaaccatcagcgggagtaagaaggaagataccgataggaaatgcactggacaagagaggattgggaaagattctaactacgaacaagaaggaaaggtgcagttcgtgattgacgctgtatatgcaatggcacatgccttgcatcatatgaataaggacctgtgcgccgattaccgaggagtctgtcccgagatggagcaggcaggcgggaagaagttgctgaagtatattaggaacgtgaacttcaatggaagtgctggcacccctgtgatgttcaacaaaaatggagatgcgccagggcgatacgacatttttcagtaccagactaccaatacatccaacccagggtataggctcataggacagtggaccgatgagctgcagcttaatattgaggatatgcagtggggaaaaggcgtgcgtgaaataccagcctcagtctgtactctcccctgcaaaccgggccagcgcaagaaaacgcaaaaggggacgccttgttgttggacttgtgagccctgtgatgggtaccagtaccagttcgacgaaatgacatgtcagcactgcccatacgaccaacggcccaatgagaatcgaactggctgccaagacatccccattatcaagctggagtggcattcgccctgggcagttatacccgtttttcttgcgatgctcggtatcatcgccacaatctttgtgatggccactttcattcggtataacgatacccccatcgtgcgcgccagcggtcgggaactgtcttacgtgctgttaactggaatatttctatgttatatcattacttttctaatgatcgcaaaaccagatgttgcagtatgttcgttcagacgagtctttctgggcctcggaatgtgcatttcgtatgccgcgttgctgaccaagactaataggatctacaggatattcgagcaaggtaaaaagtccgtgacggctccccgcctgatcagcccaacatctcagctcgctattacgtcaagtctcatctcagtgcagctcctgggcgtgtttatatggttcggcgtagacccaccgaacatcattatcgattacgacgaacacaaaaccatgaaccctgagcaggcaagaggagttctgaaatgcgatatcacagatctccagatcatctgctcactgggatattcaattctgttgatggtcacatgtacagtctacgcaattaaaacgcggggagtccctgaaaactttaatgaggccaaacctatcggctttactatgtatactacatgtatcgtgtggctggctttcatacctatattttttggcactgctcagtccgccgagaagctctacatacagaccacaactctgacaataagcatgaatctttctgcatctgttgccttgggaatgctttatatgccaaaagtgtacatcatcatattccacccagagctgaacgtacagaaaaggaagaggtctttcaaagccgtggtgaccgccgccactatgagttcacgcctgagtcataagccgtctgatagacccaatggagaagccaaaactgagctctgcgagaacgttgacccaaacagcgagaagtgtaactgctattag

SEQ ID NO: 118609 - DNA, 2769 bp, Artificial Sequence
  Description of Artificial Sequence: Synthetic coding sequence
atggtccagttgcgcaaattgctgcgcgtgctgaccctgatgaagtttccatgctgcgttctggaagtattactctgcgccctggcagccgcagcccgaggccaggaaatgtacgcccctcactcaatcagaatcgaaggagacgtcaccctagggggcctctttcctgtgcacgccaaaggaccatccggcgtgccctgtggggatatcaagcgggagaatggaatacatcggctggaggctatgctctacgccctggaccagattaatagcgatcccaacctgctgcccaatgtgacactaggcgctcgtatcctggatacctgcagtcgtgacacctacgctttggagcagtcgctgacctttgttcaggcactcattcagaaggacacctctgatgtgaggtgcactaacggagagccaccggtgtttgtgaagcccgaaaaggtcgtgggggtgataggcgcatccggatcttccgtctccatcatggttgcaaatattctaagactctttcaaatcccacagataagctacgcctctacggccccggaattgtcagatgatcgcagatatgattttttctccagagtcgtgcctcccgattcatttcaggcccaagccatggttgatattgtgaaggctctggggtggaattacgtatctacactcgcatccgaaggcagctatggagagaaaggagtggagtcctttacacagattagcaaagaggccggtggactttgtatcgcccagagtgtccgaatccctcaggaacggaaggaccgcactatcgacttcgaccgtataatcaaacagctgctggatactccaaactctagagcagtggtcattttcgccaacgacgaagacatcaagcaaattttggctgcggccaaacgagcggatcaggtggggcactttttatgggtcgggagcgattcttggggctccaagatcaaccctttacatcagcatgaggatatcgcagagggagcgattaccatacagccaaagcgcgccaccgtcgagggattcgacgcatacttcacctctcgaacactcgagaacaacaggcgcaacgtgtggttcgccgaatactgggaggaaaattttaattgtaagttaaccatttctggatcaaagaaggaggacaccgatagaaagtgtacgggacaagagagaatcggcaaggatagtaattacgaacaggaaggcaaggtgcaatttgtgatcgatgctgtgtatgccatggcacatgcacttcaccatatgaacaaggacttatgcgccgattaccgcggcgtgtgtcctgagatggagcaggccggagggaaaaaactcttaaagtatattagaaacgtcaattttaacggtagtgccggcaccccggtgatgttcaataagaatggagacgcacccgggaggtacgacattttccagtatcagactactaatacctccaaccccggctaccggctgataggacagtggaccgacgaactgcagctaaacattgaggatatgcagtgggggaaaggggtaagggaaattccagccagcgtgtgcaccctgccctgtaagcccggtcagagaaagaagacccagaaagggacaccttgttgctggacctgtgagccatgcgacgggtatcagtaccagtttgatgaaatgacctgtcagcactgcccgtacgaccagcgccctaatgaaaaccgcacgggatgccaggatatccctatcatcaaactggaatggcactctccctgggccgtaatccccgtctttctcgctatgctcggcattattgccactattttcgttatggctaccttcattagatataacgacaccccaatcgtaagagctagcggccgcgagctatcatacgtgctcttgactgggatcttcctttgttacatcattactttcctgatgatcgccaagccagatgtagcagtctgctcttttaggagggtgttcctgggcctgggtatgtgtatatcctacgcagccctgttgactaagaccaacaggatctacagaatctttgaacaggggaaaaaatcagtgaccgctcctagactcatctccccaactagccaattggctatcacctccagtttgatcagtgtccagctgctaggagtttttatttggtttggggttgatccacctaatattatcatcgattacgacgaacacaagacaatgaatcccgagcaggctcggggagtgctgaagtgcgacattaccgatctgcagatcatctgcagcctggggtattccatcctactgatggtgacttgtaccgtatacgcgattaagacccggggtgttcctgagaactttaatgaagcaaagccgattggatttaccatgtataccacatgcatcgtgtggctggctttcattcccatattttttgggacagcccagagtgcggagaagctatatatccagaccactacgttgacaattagtatgaatctgtcggcctccgtggccctgggcatgctgtacatgccaaaggtctacatcattatatttcatccggagctgaacgttcagaaaagaaaaagatccttcaaggcagtagtcacagccgcgacaatgagctccaggctgagccataagccttcagaccgccccaatggcgaagccaagactgaattgtgtgaaaacgtggatcctaacaactgcataccgcctgttcgcaagtcggtgcaaaaaagtgtgacatggtataccattcccccaacagtgtag

SEQ ID NO: 118610 - DNA, 2736 bp, Artificial Sequence
  Description of Artificial Sequence: Synthetic coding sequence
atggtacagctccgcaaactcctccgcgtgctgacactgatgaaatttccgtgttgcgtgttagaggtgctgctgtgcgcactggcagccgctgcccggggacaagagatgtatgccccgcattctatccgcatagagggggatgtgacacttggcgggttgttcccagtccacgcaaagggcccctccggcgtgccatgcggggacattaaaagggaaaacggtatacaccggctggaggcaatgctctatgcgctggatcagataaatagcgatcctaacctgctgccaaatgttactctcggcgctcgcattctcgatacatgttcacgtgacacttatgctctggagcaaagcttaactttcgttcaagccctgattcagaaggatacctcagacgtgaggtgcactaatggagaaccccctgtgttcgtgaaaccagagaaagttgtgggcgtaatcggtgcctccggatcgagcgtgtccattatggtggccaatatcctccggctatttcaaatccctcaaattagttatgccagcactgctccagagttgagtgatgaccgacggtatgacttcttcagcagagtagttcccccagattcatttcaggcacaagctatggtggatattgttaaggcccttggctggaactacgtctccaccctggcatccgagggatcctacggtgagaagggagtggagagctttacccagatcagcaaggaagcaggcgggctctgcatcgcgcagtccgttcggataccgcaagagcgtaaggaccgcacaatcgattttgacaggattatcaaacaactgctggatactcccaattcacgcgctgtggtaatctttgcaaatgacgaagatatcaaacagatacttgccgctgcgaagagagcagaccaggtcggacactttctgtgggttgggtccgatagctggggctccaagatcaatccacttcaccagcacgaggatatcgcagagggcgccattaccatacagccaaaaagagctaccgttgaggggttcgatgcctacttcacaagtcggacgctggagaataatcgtcgtaatgtgtggtttgctgagtactgggaggaaaacttcaactgtaaactgactattagcggctcaaaaaaggaagacactgataggaagtgtacggggcaggagcgtatcggcaaggactcaaattacgaacaggaaggcaaggtccagttcgttattgacgccgtttacgctatggctcacgcactgcaccatatgaataaagacttgtgtgcggattatcgaggtgtgtgcccagaaatggagcaggccggagggaagaaacttctgaagtatatccgcaatgtgaatttcaatggctccgccggcactcccgtgatgttcaataaaaacggggacgccccggggaggtatgacatctttcagtaccagaccacgaatacctctaatcccggttatcgcctcattggccaatggaccgacgagctccaactaaacatcgaggacatgcagtggggcaaaggcgtacgtgagattcccgcttcagtgtgtaccttgccttgtaaaccagggcaaagaaagaagactcagaaaggcaccccttgctgttggacttgcgagccgtgcgacggttaccagtatcaattcgatgaaatgacctgccagcactgtccttatgaccaacgccctaacgagaatagaacgggttgccaggacatcccgattataaagctagaatggcactcaccatgggcggtgatcccagtttttcttgctatgctgggaataatcgcgactattttcgtgatggccacgtttatccgatataatgatactccaatagtacgcgcctccggaagagagctgtcctatgtgctcttgactggcatctttctctgttatataatcacatttttgatgattgcaaagccagatgtggcggtgtgctctttcagacgggttttcctgggattgggaatgtgcattagttacgccgccctgctgacaaaaactaaccggatttatagaatttttgagcagggcaagaagtctgttactgctccaaggttgattagtcctacatcccaactagccatcacctcgagtctgatctccgtccaactcctgggggtttttatctggttcggtgtggatccacctaatataattattgactatgacgagcacaagacgatgaaccccgaacaggccagaggggtcctcaagtgtgacatcacggatctgcaaataatctgcagtctgggctacagcatcctgttgatggttacatgcaccgtatatgcgatcaaaacgcggggagtgccggagaacttcaatgaggctaagccgatcggtttcacgatgtacacaacctgtattgtctggctcgcctttatccctatcttcttcgggaccgcccagtccgccgaaaaactttacatccagactaccaccctcacaattagcatgaatctatctgcctctgttgcgctcggaatgctgtacatgcccaaggtatacatcatcatcttccatccggaacttaacgtccagaagagaaagcgctcctttaaggcagttgtgacagccgccaccatgtctagcagactgagtcacaagccatccgaccgcccaaacggagaggcaaaaacagagctgtgcgaaaacgtggaccctaacatcacctccgaagacctctccctgcataaggaggactag

SEQ ID NO: 118611 - DNA, 2475 bp, Artificial Sequence
  Description of Artificial Sequence: Synthetic coding sequence
atggtgcaactcaggaagttgctgcgcgtcttaactctcatgaagttcccatgctgcgtgctcgaggttctgctctgcgctctggcagcggcggcgcggggacaggagatgtacgctccccactctataaggatagagggcgacgtgacacttggtgggttgtttccagtacacgccaagggaccaagcggggttccttgtggcgatattaaacgcgagaacggaattcaccgactggaggcgatgctgtatgctttagaccagataaactcagatcccaacttgctaccaaatgtgacgcttggcgcgagaattctagacacatgttcaagggacacctacgctttggaacagtctttgacgtttgtgcaggccttaatacaaaaggacacctcggacgttaggtgcacaaacggagaacctcctgtgttcgtgaaacccgaaaaggtcgtgggtgtgatcggcgcctctggatcctccgtatccataatggtcgccaacatcctcagactcttccagatacctcaaatctcctatgccagtactgcgcccgaattgagtgacgacaggagatatgactttttctcacgggtggtcccccctgactcctttcaggctcaggccatggtggatatcgtgaaggcactaggctggaattatgtctcaaccctggcttctgagggctcttacggagagaagggggtggagtccttcacccagatctctaaggaggccggaggactttgcatagcccagagcgtgcgtatcccccaggagcgcaaggatcgcacaattgatttcgatcgcattataaagcagttgcttgacacgcccaacagcagggcagttgttattttcgcaaatgacgaggatattaaacagatactggctgccgcgaaacgcgctgatcaggtcgggcattttctatgggtcggaagcgattcttgggggagcaaaatcaatcccctgcatcagcacgaagacatcgccgagggtgctataaccattcagccgaaacgagccaccgtagaaggcttcgacgcatactttacatctcggaccctggaaaacaatagacgcaatgtttggttcgccgaatattgggaggagaatttcaattgtaagttaactatttcaggctccaaaaaagaagatacggaccggaaatgtacgggccaggagaggattggcaaagactcgaattatgagcaggaaggtaaagtgcaatttgtcattgatgcagtttatgccatggcacacgctctgcaccacatgaacaaagacctgtgcgccgactatcgcggcgtgtgccccgagatggagcaagcgggcggcaagaagcttctgaagtatatcagaaatgtgaacttcaatggcgatgcgggcaccccagtaatgttcaacaagaacggtgatgctcccgggagatatgatatttttcagtatcagaccacaaatacctccaacccaggttataggcttattggtcaatggactgacgagctccagctaaacattgaggacatgcagtggggtaaaggggtccgagagattcctgccagtgtctgtacactcccatgtaagcctggccaaagaaagaaaactcagaagggcacgccatgctgttggacctgcgaaccctgcgacgggtatcagtaccaattcgacgaaatgacatgccagcattgtccgtacgatcagaggcccaacgagaaccgcaccggctgccaagatattccaattatcaagctcgaatggcatagcccctgggccgttatcccagtgtttctcgctatgctcgggataattgccaccatcttcgtaatggctacatttatcagatacaacgatacacctatcgtacgggcatcaggcagggaactttcatatgtgctcctgacaggaatcttcctctgttacattattaccttcctgatgattgccaaacccgacgtggctgtgtgctccttcagaagggtgttcctcgggctgggtatgtgcattagttacgccgcgctcctcaccaagaccaataggatttataggatcttcgagcagggaaagaaaagtgtgacagccccccggctgatctctcccacatctcagctggccatcacatcctccctaattagtgtacaactactaggggtgttcatctggttcggggtcgatccccccaacatcatcattgattatgatgagcacaaaacaatgaatccggaacaagccaggggggttctgaagtgcgacataaccgaccttcagataatctgctcactgggatatagcatcttacttatggtaacttgcacagtgtacgcaatcaagaccaggggggtacccgagaatttcaacgaagctaaacccatcggattcaccatgtacacaacttgtatcgtctggttggcctttatccctatcttctttggaaccgcccagagcgcagaaaaggttatactgtgttgtatttcctag

SEQ ID NO: 118612 - DNA, 2775 bp, Artificial Sequence
  Description of Artificial Sequence: Synthetic coding sequence
atggtacagctgaggaagctgctcagggtgctaactttgatgaagtttccctgttgtgtccttgaggtgctgctctgcgccttagccgcagcggcccgaggccaggaaatgtacgcaccccatagtatccgcatcgagggcgatgtgactctcggaggcctctttccggtacacgccaagggccctagcggggtaccctgcggggacataaagcgggaaaacggcatccaccgattggaggccatgttgtatgcgttggaccaaatcaatagtgatccgaatctgttacctaacgttacgctgggcgcccgaatcctggacacctgtagtagggacacatatgccctcgaacagtctctgaccttcgtccaggccctgatccagaaagacacctctgatgttcgatgcactaatggggaacctcccgtgttcgttaagcctgaaaaggtcgtcggcgtgataggcgcctctggctctagtgtctccattatggtcgccaatatcctccggctcttccagattccccagatcagttatgcatcaaccgcacccgagttaagcgacgatagacgctacgactttttctccagagtggtcccgccagactcgtttcaagcccaagcaatggtcgacatagtcaaagcactcggctggaactacgtgtccactctcgcttcggaggggtcctacggtgagaaaggcgttgagagcttcacccagatatccaaagaagctggaggactgtgcatcgcccagagcgtacggattccacaggaacggaaggatcgcactattgatttcgatcgcatcataaagcagctactggatacaccaaattcccgagctgttgtcattttcgccaacgatgaagatatcaaacagattctggcagctgcaaagcgtgctgatcaagttgggcactttctgtgggtgggtagtgactcctgggggagcaaaatcaatcctttgcatcagcacgaagacattgctgagggcgccatcaccatccagcccaagagggctaccgtggagggttttgacgcctattttacatctcgcactttggaaaataaccggagaaatgtctggttcgccgaatattgggaggagaattttaattgcaagttaacaatctccgggagtaaaaaggaagacaccgaccggaagtgcacggggcaagaacggattggcaaggattctaattatgagcaggaagggaaggtacagttcgtcatcgacgccgtatacgctatggcacacgctctccaccacatgaataaggacctctgtgctgattacaggggggtgtgtcccgaaatggagcaggcaggcggaaagaagctgttgaagtacatacgaaatgtcaatttcaacggcagcgcaggcacccctgttatgttcaacaagaacggcgacgcccccggtaggtatgacattttccagtatcagacaaccaacactagcaatcccggctaccgcttgatcgggcagtggactgatgagttgcaactaaacatcgaagatatgcagtggggtaagggcgtacgtgagatccccgctagcgtgtgcacactgccatgcaagcccggccagcggaaaaaaactcaaaaaggcacaccctgttgttggacctgtgaaccgtgtgatggataccaatatcagtttgatgaaatgacctgtcagcactgcccatatgatcagcggccaaacgagaaccggacaggctgtcaggacatcccaattattaagctcgagtggcacagcccctgggccgtgatacctgtattcctcgccatgttaggaatcatcgccaccatcttcgtgatggcaacattcatcagatacaatgatactcccattgtgcgcgcatccgggcgggagttatcttatgtactgctcacaggtatcttcctatgctacatcattacttttctcatgatcgctaaaccggacgtggccgtttgcagctttaggagagtgtttctgggcctagggatgtgtatttcttacgccgcgcttctgacaaagaccaaccgaatttatcggatcttcgagcagggaaagaagagcgttactgctccacgtctaattagcccgacctcccaactggctattaccagctcacttatttccgtgcagttactcggggtgttcatttggtttggcgtggacccacccaacattattatagactacgacgaacataagaccatgaaccccgagcaggctagaggggtgctcaagtgcgatattacagacctgcagattatatgttcactgggttattcaatcctccttatggtcacctgtacagtgtatgctatcaagacccgcggcgtgcctgagaatttcaacgaagcaaagcctattggctttacaatgtatacaacttgcatcgtgtggcttgcttttatcccgatcttcttcggaaccgcccagtccgcagaaaaattgtacatacagactacaacactgacgatttctatgaacctcagcgcatccgtggctctggggatgctctatatgccgaaagtctatattatcatatttcacccagaactgaacgtgcagaaacgaaagaggtcctttaaagcggttgtgaccgcagccaccatgagtagccggctgagccataaaccatcggataggcccaatggcgaagcaaagaccgaactctgcgagaatgtggatccaaatatctttttctttggatgtaccgtcgagttgggcctccacttcaagctcacattctccaggaaccagtccaatttatag

SEQ ID NO: 118613 - DNA, 2727 bp, Artificial Sequence
  Description of Artificial Sequence: Synthetic coding sequence
atggtttgcgaagggaagcggagcgcaagttgtccatgtttctttctcttaactgctaaattctactggatcttgaccatgatgcagcgcacgcactcacaggaatatgcccactctatccgcgttgatggagatatcatactgggcggcttgttcccagttcacgccaagggtgaacggggcgtaccttgcggggaactgaaaaaggagaaggggattcacaggctagaggcaatgctgtacgccattgaccagattaataaggatccagacctgctgagcaatataaccctcggcgtgcggatccttgatacttgctcccgggacacctatgcccttgaacagtccctgactttcgttcaggctctcattgagaaagacgcttccgacgtgaagtgtgcaaacggtgacccacccatctttacgaagcccgacaagattagcggagttatcggcgctgctgcaagctcagtgagcataatggttgcgaatatcctcagactcttcaaaatcccccagattagctacgccagcactgctcctgaactgtctgataatacgcgctacgatttcttctcacgggtcgtgccgcctgactcgtatcaggcccaggccatggtggatatcgttaccgcgctaggctggaactacgtatccacattggcctccgagggcaattatggtgaaagcggtgtggaggcctttactcagattagtcgggagatcggaggggtgtgcatcgcccagtcccagaaaattccgcgcgagccgcgtccaggagagttcgaaaagatcatcaagcggttgctggagactcctaatgctagggccgttatcatgtttgctaatgaggacgatattaggagaattctagaggcagctaagaagctgaaccagagtggacattttctttggattggctccgattcctggggatccaaaatagcacccgtttaccaacaggaggaaatcgccgagggcgctgtcacaattctcccaaagcgcgcctcaatcgatggctttgaccgatatttccgttcacggactttagcaaataatcggcgcaatgtatggttcgccgaattctgggaggagaattttgggtgtaaactggggtcccatggcaaacggaattcccacataaaaaagtgcacgggattggagcggatcgcccgggactcctcatacgagcaagaggggaaggtacagtttgttattgatgcagtgtacagtatggcatatgcgctgcacaatatgcataaagatctatgcccaggctatatcggtttgtgccctagaatgtcaactatcgacgggaaggaattgctgggttacattcgggccgtgaatttcaatggatcggctgggactccagttaccttcaatgagaatggggatgcccccggcagatacgacattttccagtatcagatcacaaacaaatcaaccgaatataaagtgatcggacattggaccaatcaacttcacctcaaagtggaggatatgcaatgggctcatcgggagcacactcatcctgcctccgtgtgttctctgccttgtaagccgggagagcgcaagaaaacggtgaaaggagtcccatgttgttggcattgcgagcgctgcgaaggatacaactatcaggtggatgaattgagttgcgagttatgtccactcgaccagagacctaacatgaatcggaccggctgtcagctgatccccatcataaaactcgagtggcacagtccatgggccgtagttcctgtttttgtcgcaatcctgggcattatagctactacctttgtgattgtcacttttgtaagatataatgacacacctatagtcagggcttctgggcgcgagctttcgtacgtgctcctaactggtatcttcctctgctattcaatcacattcctgatgatcgctgccccagacacaataatatgtagctttcgccgagtgttcctcggtctgggtatgtgcttctcatatgctgcactccttactaaaactaaccggatccaccgtattttcgaacagggaaagaaaagtgtaacagctcccaaattcatcagccctgcttctcagctagtaataacgttttctctgattagcgtgcagctgctgggagtatttgtttggttcgtggttgatcctcctcacattataatcgactacggtgagcagcgtacgctggatcccgaaaaagcccggggcgttctgaaatgcgatataagcgacctgagcttaatatgttctttagggtactcaatcttgctgatggtgacctgcactgtctatgcgattaaaaccaggggcgttcctgagacctttaatgaagcaaagccgataggttttacaatgtacacaacgtgcatcatctggctcgcattcatccctatcttttttggcaccgcacaatccgccgagaagatgtatattcaaactacaaccctgaccgtatctatgtctctcagcgctagcgttagtctagggatgctgtacatgcctaaggtctacatcatcattttccatccagaacaaaacgttcagaagaggaagcgcagttttaaagcagtggtcacagccgctactatgcaatctaaactgatccagaagggcaatgaccgtcctaatggggaggttaagagcgagctctgtgagagtcttgagactaacaccagctcaaccaaaacgacctacatttcttacagcaatcactctatatag

SEQ ID NO: 118614 - DNA, 2727 bp, Artificial Sequence
  Description of Artificial Sequence: Synthetic coding sequence
atggtgtgcgagggaaagcgctcagcatcttgtccttgctttttcctgctgaccgccaaattctattggatcctgactatgatgcagcggacccatagccaggaatacgcacactccatccgggttgacggggatattatcctgggggggctgtttccagttcacgcaaaaggggagcgaggtgtaccttgtggtgaattgaagaaggagaagggtattcatcggctcgaggctatgctgtacgcgatcgatcaaatcaataaggatcccgatttgctttccaatattactctaggagtgcgcatcctagacacctgttctcgggacacctatgcgctggaacaaagtctgactttcgtacaggcactcatcgaaaaggacgcttctgatgtgaagtgcgctaacggggatccacccatctttacaaagcctgataaaatatcgggggtgatcggggccgcagcttcatcagtgtccatcatggtggccaatatacttcggctgtttaaaatcccacagatttcctacgcctccaccgcccccgaactaagcgacaacacacgctatgattttttcagcagggtggtgcctcctgactcctaccaggcccaggcaatggtggatatagtaaccgctctcggctggaactatgtgtctacactggcctctgaggggaattatggcgagtcaggggtcgaggcttttacccagatttctcgggaaatcggaggggtgtgtattgcccaaagccagaagatccctagggagcccagacccggcgaattcgagaaaatcatcaagcgactgttagaaactccaaacgcgcgcgctgtgatcatgtttgccaatgaggatgacatacgaagaattttagaagccgcaaaaaaactcaatcagagcggacacttcctgtggatcggctcagactcatggggaagcaaaatagcacccgtgtatcagcaggaggagatcgccgagggagcagtcactatattgcccaagcgggcttccatcgacggttttgataggtacttccggagtcgcacactcgcaaataacaggagaaatgtttggtttgccgaattttgggaagagaatttcggctgcaagttagggagccacggaaagaggaacagccatattaagaagtgcactggcctagagaggattgctagggacagtagctatgaacaagaaggcaaggtgcagttcgttattgatgcggtctattctatggcttatgccttacataatatgcacaaggacctatgtccaggctatatcggcctgtgtccaagaatgtcgaccatagatggaaaagagcttctaggctacataagggcggtcaattttaacggatctgccggcaccccagtcacttttaatgagaacggcgatgcccccggcaggtatgacatttttcagtatcaaatcaccaataagtccaccgagtacaaagtaatcggacactggaccaatcagctgcacctgaaagtggaggatatgcagtgggcacacagggaacacacacaccctgcatccgtgtgttcactgccatgcaagcccggtgagcgcaagaagactgtcaaaggggtgccctgttgttggcattgtgaacgatgcgaggggtataattatcaggtggatgagctgagttgcgagctctgcccgctcgatcagagacctaacatgaataggactgggtgccaacttatacccataattaaactggagtggcattcaccatgggctgtggtgcccgtcttcgtggctattctgggtattatcgcgacaacatttgtgatagtgacatttgtgcggtacaacgatacacctatagtcagggctagcggcagggagctgtcatatgtcctgctgacaggcattttcctatgctattctattacctttctgatgatagctgcacccgataccattatctgctccttccgccgtgttttcctcggccttgggatgtgcttttcctatgcagctctgttgaccaagacgaataggatccacagaatcttcgaacagggcaagaaatcagttaccgctcccaagtttatcagccctgcttctcagctggttatcaccttctctctgatctccgtgcaactgctgggcgttttcgtatggtttgtcgtggatccaccccacattattatcgactacggcgagcagcgaacgctcgatcctgagaaagctcggggggtcttaaagtgtgacatttccgatctttctctgatttgttcgctcggctacagtatacttctaatggtcacctgtactgtatacgccataaagactcggggcgtcccagagactttcaacgaggcaaagcccatcggctttactatgtacactacgtgcatcatctggctcgccttcattcctatctttttcggtaccgctcagagcgccgaaaagatgtatatccagactacaactctcacagttagtatgtccctttctgcatccgtttcactcggtatgctgtacatgccaaaggtgtatattatcatctttcatcctgagcaaaacgtacaaaagagaaaaaggagctttaaagcggttgttactgcagccaccatgcagtccaaattgatccagaagggaaatgaccgtccaaatggcgaagtcaagagcgagctttgcgaatcacttgagacaaattctaagtcctccgtagaatttccgatggtgaagtcaggcagtacttcttag

SEQ ID NO: 118615 - DNA, 1506 bp, Artificial Sequence
  Description of Artificial Sequence: Synthetic coding sequence
atggtgtgcgaagggaagagatcggcaagctgcccatgcttctttctactgaccgctaaattctattggattctgaccatgatgcagagaacccattcccaggaatacgcccattcaattagggtggatggggacatcatactgggtggactcttccctgtgcacgccaagggagaacggggtgtgccttgtggagagctgaaaaaggagaagggaattcacaggctggaagcaatgctatacgccattgatcagatcaacaaggaccctgatctactgtccaatatcaccttaggtgtaaggattctggatacctgctctagggacacgtatgcattggagcaatcactgacctttgtccaagcattaatagagaaagacgcatcggatgttaaatgcgctaatggggacccccccatattcacaaaacccgacaaaatctccggcgtcattggggccgcagcctcctccgtctctataatggtggccaatattctgagactgtttaaaattcctcagatctcatatgcttctaccgccccagagttgtccgacaacaccagatacgattttttttctagggtggtcccacccgactcctatcaggctcaagcgatggtggatatagtgacagcattgggctggaactatgtgagcacacttgcgtcagagggcaattacggcgaatccggagtggaggcctttacccagatctcacgagaaatcggcggcgtgtgtatcgcacaatcccagaagatcccccgagagcctaggccaggcgaatttgaaaagatcatcaagcgacttctggaaaccccaaatgctcgagctgtgattatgttcgccaatgaggacgacattcgaaggattctggaagcagccaaaaagttgaaccagtctggacactttctgtggatcgggagcgactcgtggggatctaaaatcgcccctgtgtatcaacaggaggagatcgccgaaggtgcggttaccatccttccaaaaagagctagcatcgacggattcgacaggtatttcaggtctagaacattggctaataacagacgtaatgtttggttcgcagaattctgggaggagaacttcggctgcaagctcggatctcacggaaagcggaattcacatatcaagaagtgcaccggcctggagagaatcgcaagggactcaagttacgagcaggaagggaaagttcagttcgtcatagatgcagtttacagtatggcctatgcactgcacaatatgcacaaggacctttgccctgggtacattggtctgtgccctcgaatgtccaccattgatggcaaagaactccttggctacatccgggccgtcaactttaatggctgccgaagaggtatccagatgtcactgccatggccaacacttttcacacccagcttctccagctcatgggccgtactggcactactgtcattgttgatgaagacggaaatgctgctggacgtgatgatctctagctccatcaagtag

SEQ ID NO: 118616 - DNA, 63 bp, Artificial Sequence
  Description of Artificial Sequence: Synthetic coding sequence
atggtttgtgagggcaagcgaagcgcatcttgcccttgtttcttccttctcaccgccaagtag

SEQ ID NO: 118617 - DNA, 2727 bp, Artificial Sequence
  Description of Artificial Sequence: Synthetic coding sequence
atggtgtgtgaagggaaaagaagcgctagttgcccatgtttctttctgctaacagccaagttttattggattcttaccatgatgcagcgcacacactctcaggaatatgcccactccatccgcgtcgatggggatatcatcctagggggtctgttcccagttcatgccaagggagagcggggcgtgccttgcggagaactgaagaaggaaaaaggaattcataggctagaggcaatgttgtatgctattgaccagatcaataaggaccctgatctgctgtccaatatcacgctgggagttaggatcttagacacatgtagtagagatacatacgccctggagcagtctctcaccttcgtacaggctctcattgagaaggatgccagcgatgtcaaatgcgcaaacggcgaccccccaatcttcacaaagccagataagatttctggggttattggtgccgctgcctctagcgttagtataatggtggccaacatcctcagactgttcaaaataccacagatctcgtacgcatcaacagctcccgaactttcagataatactcggtatgattttttctctcgcgtggtgcctcccgatagctatcaggcccaggcaatggtggacattgtgacagccctaggctggaactacgtgtctaccctggcctctgaaggtaattacggtgagtccggcgtcgaggccttcacacagattagcagggaaatcggaggcgtgtgcatcgcacagagtcagaagatcccacgcgagcccagacctggggaattcgaaaaaattattaagaggctgcttgagactcctaacgctagggctgtcatcatgttcgcgaatgaggacgacattcgacgcatactcgaggccgcaaaaaagctgaatcagtccggccatttcttgtggatcgggtctgactcttggggaagtaaaatcgcacctgtatatcagcaggaagaaatcgcagagggcgccgtgaccattcttcctaaacgtgctagtatcgacggattcgatcggtacttccggagtcggactctcgcgaataatcgacgtaacgtgtggttcgcagaattctgggaggagaactttggttgcaaactaggatcccacggtaagaggaacagccacattaaaaagtgcacggggctggaaagaatcgcacgggatagctcctacgaacaggaggggaaggtgcagtttgtaattgatgctgtgtattctatggcgtatgccctgcataacatgcataaggacctgtgtccaggctatatcggtctttgccctcggatgtcgaccattgacggaaaggaattgcttggttatatacgtgcagtgaactttaacggatccgcgggtaccccagtgacgttcaacgagaacggggatgcaccggggcgatacgatatttttcagtaccagattaccaataagtcaactgaatataaagtaatcgggcattggactaatcagcttcacctaaaggtggaggacatgcagtgggcacaccgggaacacacccatcccgcctcagtgtgctcactgccatgcaaacccggcgaacgaaaaaagaccgtgaagggtgtcccctgttgttggcattgtgaacgctgcgaaggttataactatcaggtcgatgagcttagctgcgagctctgcccactagaccagcgccccaacatgaaccgcacggggtgtcagctgattcccattatcaagctcgagtggcacagcccatgggcagtcgtgcctgtttttgtcgccatacttgggatcatcgcaaccacattcgtcatcgttacttttgttcgctacaatgatacgcctatcgttcgtgcaagcggtcgggagctctcgtatgtgcttctcactggcatctttctgtgctacagtattaccttcttgatgatagctgctccagacacaattatatgctcctttcggcgggttttcttgggcctgggcatgtgcttttcctacgccgcactcctgaccaaaacgaacagaatccataggatctttgaacaaggtaagaaatccgttaccgcccccaagtttatctcacctgcttcccagcttgtgattaccttcagtctgatcagcgtacaactcctgggagtgtttgtgtggtttgtggtcgaccctccacatatcatcattgattatggcgaacagcgtacactggaccccgaaaaagcacggggagtcctgaaatgcgatatatccgacctctccctcatttgctctttgggatactccatcctgttaatggtcacctgtacggtgtatgcaattaagacccggggagtcccagagacctttaacgaggccaagccaatagggtttaccatgtataccacctgcattatctggctggcctttatccccatctttttcggaacagcacagtctgccgaaaagatgtacatccaaacaacaaccttgactgtgagcatgtctctgtcagccagcgtgtctctcgggatgctgtatatgccaaaggtctacataattatctttcatcccgagcagaatgtccagaaaagaaagagatccttcaaagcagtggtaaccgctgcaacgatgcaatccaaactgattcagaaagggaatgatagacccaacggcgaggtgaagagcgaactgtgcgagtccttagagacaaatacctcatctaccaagaccacctacattagctacagcaaccacagtatatag

SEQ ID NO: 118618 - DNA, 885 bp, Artificial Sequence
  Description of Artificial Sequence: Synthetic coding sequence
atggtctgtgagggaaagaggagcgcatcttgcccgtgtttctttcttctaacagctaagttttattggatcttaacaatgatgcagcgtacacactcccaggagtatgcccacagcatcagggttgatggcgatattattctgggaggtttgttcccagttcacgccaagggcgaaagaggggtcccatgcggtgaactaaagaaagagaaaggcatccacagactggaggccatgctgtatgccatcgaccagattaataaagatccagacctactaagcaacataactctgggcgtgcgaatcttagatacctgtagcagagatacctacgccttagagcagtccctgacctttgtgcaggcacttattgaaaaagacgcatccgacgtaaagtgcgctaatggcgatccacctatattcacaaaaccggacaaaatctctggcgtgataggcgctgccgcctctagcgttagcatcatggtcgccaacattctccgactctttaagattcctcagatttcatatgccagcacagccccggagctcagtgacaatactagatacgactttttctctcgggttgtaccaccagattcgtaccaggcccaggcaatggttgacatcgtcacagccttaggctggaattatgtcagcaccctcgcctctgagggcaattatggcgagagtggcgtagaagcattcacacaaatctcacgtgaaattgggggtgtgtgcatcgctcagagccaaaagatcccaagggagccgcggccaggtgaatttgagaaaatcattaaacgtctcctcgaaaccccgaacgccagggccgtgatcatgttcgccaacgaagatgatattcgcagaattctggaggcagcttag

SEQ ID NO: 118619 - DNA, 1122 bp, Artificial Sequence
  Description of Artificial Sequence: Synthetic coding sequence
atgactacgtccgcatcatcgcatctgaataagggtatcaagcaggtgtacatgagcctcccccagggagaaaaggttcaggcaatgtacatttggattgatgggaccggagaggggctaaggtgcaaaaccagaaccctggattcagaacctaagtgtgtggaagaactgccagagtggaatttcgacggcagctccacactgcagagcgaggggtcgaattctgacatgtaccttgttcctgcagctatgtttagggaccctttccggaaagatcccaataagctggtgctatgtgaggtgttcaaatataacaggcgaccagccgaaaccaacctccgccatacgtgtaagcggatcatggacatggttagtaatcagcatccctggttcggaatggaacaagagtatacattaatgggcacagacggacatccattcggatggcctagcaacggattccctggtccacaagggccctattactgcggtgtgggtgctgaccgggcctacggaagagatatcgtggaggctcattatcgggcttgcctttatgccggcgtcaagatcgctggaacaaatgcggaagtaatgccagcgcagtgggaattccaaattggaccatgtgaagggatttcgatgggggatcacctctgggtagctcgcttcattttacaccgggtctgcgaagacttcggagtcattgccacctttgacccaaagcctatccccggaaattggaacggagcgggatgccacacgaacttcagcaccaaggctatgagagaggaaaacgggctgaagtatattgaagaagccatcgaaaaactgagcaaaagacaccagtaccatatccgcgcctatgatccaaaaggggggctggacaatgcccgaagactcacagggtttcacgagacatccaacataaatgatttttctgccggggtggccaaccggtcggcaagcatcagaattccccggactgtcgggcaggagaaaaagggttatttcgaagatcgccgcccttccgccaattgtgaccctttctcagtgacggaagcactgatacggacgtgtctactgaatgaaaccggggacgagccattccagtacaaaaactag

SEQ ID NO: 118620 - DNA, 1122 bp, Artificial Sequence
  Description of Artificial Sequence: Synthetic coding sequence
atgacaacttccgcttcctcccatttgaataagggtataaagcaggtgtatatgtcactgccccagggcgagaaggttcaggcaatgtacatctggatcgatggtacaggcgaaggattgagatgtaagacacgcacacttgactctgagccaaaatgtgttgaagaactccctgaatggaatttcgacggctcgagcacactgcagtccgaggggagcaactcggacatgtacctagtccccgccgctatgtttcgggacccctttcgaaaggatcccaataaactggtactgtgcgaagtgtttaagtataacagaagacccgctgagaccaacctgcgtcacacgtgtaaaaggatcatggatatggtgagtaaccagcacccatggtttgggatggaacaggaatacacacttatgggcacagacggccacccatttgggtggccatccaacgggttcccgggacctcaggggccttattactgcggcgtcggagccgatagagcctatggacgagacatcgtcgaagcacactatcgcgcttgtttatacgcgggtgtaaaaatcgccgggaccaacgcagaggttatgcctgcacagtgggagttccagattggcccctgtgaaggcatcagcatgggcgatcacttatgggtggcacggtttatactccacagagtttgcgaggacttcggggtgatcgcaacgtttgatcctaaacccattcccgggaattggaatggagcaggttgccatactaactttagcaccaaggctatgcgggaagaaaacggactgaaatatatagaggaggcaatcgaaaagctgtccaaaagacaccagtaccatattcgtgcttatgatccaaagggaggcctggacaacgccagaagattgacggggtttcatgagacttctaatattaatgatttctccgccggggtggccaatcgctccgccagcattcgtatccccagaaccgtgggccaggaaaagaaaggctatttcgaggaccgccggccctccgccaactgcgatccattttctgttactgaggccctcataagaacctgcctgttaaatgagaccggggacgaaccattccagtacaagaactag

SEQ ID NO: 118621 - DNA, 1122 bp, Artificial Sequence
  Description of Artificial Sequence: Synthetic coding sequence
atgactacgtctgctagctctcaccttaacaagggcattaagcaagtctacatgagcctcccgcaaggcgaaaaggtgcaggccatgtacatctggatcgacggaacaggcgaaggcctcaggtgtaagacacgaacactcgactcagaaccgaagtgtgtggaggagctgcctgagtggaacttcgacggatcatccacgttgcaaagcgaaggcagcaactccgacatgtatttggttccggcagctatgtttcgcgaccctttccgcaaggacccaaataagttagtcctttgtgaggtgttcaagtacaaccggcggcccgctgaaaccaatctgcgacatacatgcaagaggatcatggacatggtttccaaccagcatccatggttcggtatggaacaagaatacaccttaatggggaccgacggacatcctttcggttggccgtctaacggctttccaggccctcagggtccttattactgtggagtcggtgccgatagagcctatggccgtgacattgtggaagcccattatcgcgcttgcctatatgcgggggttaaaattgctggaacaaatgccgaggtgatgcccgctcaatgggaatttcagatcgggccatgcgagggaatctcaatgggtgaccatctgtgggtggccagatttatactccatagggtttgtgaggactttggtgtgatcgcaacgttcgacccaaagcctatccccgggaattggaatggagctggctgccacacaaacttcagcacaaaggcgatgcgagaggagaacggtcttaagtacatagaagaagccattgagaagctgagcaaacggcatcaatatcatattagggcctacgaccccaagggaggacttgataacgcgcggagactgacgggcttccacgagacaagcaacattaatgactttagcgctggggtggccaaccggagtgcttcaatacgtatccctcgcacagtcggtcaggagaagaagggatatttcgaagaccgcagaccttctgcaaactgtgatcccttctcagtgaccgaggcccttattcggacttgtctgcttaatgaaaccggggacgaaccttttcaatacaagaattag

SEQ ID NO: 118622 - DNA, 1122 bp, Artificial Sequence
  Description of Artificial Sequence: Synthetic coding sequence
atgactacctctgcgtccagccacctcaataaagggattaagcaggtgtacatgagcctgccgcagggtgagaaggtgcaagctatgtatatatggatagacggcactggagagggactgcgctgtaagacccggacgctcgacagcgaacccaaatgcgtggaagaattgcctgaatggaacttcgacgggagctctacactgcaatccgaaggctccaactctgacatgtatcttgtccctgcagccatgtttcgggaccccttcaggaaggaccccaacaaactggttctctgtgaggtgttcaagtacaacaggcgaccggcagaaactaatctgaggcatacctgcaagagaatcatggacatggtaagtaaccagcatccctggttcgggatggaacaggagtataccctgatgggcactgatggacaccccttcgggtggccctcaaatgggttcccaggccctcaaggaccctactactgtggggtcggcgccgacagagcatacggacgcgacattgtcgaggcacactatagggcctgtctgtatgcaggagtgaagattgccggtaccaacgccgaggttatgcccgctcaatgggagtttcaaattggaccctgcgaaggcatttcgatgggagaccacctctgggttgcacggttcatactgcaccgcgtgtgcgaagacttcggcgttatcgccacctttgaccccaagccaatccccggaaattggaacggcgctggctgtcacactaatttctctacaaaggcaatgcgcgaggagaatggtctgaaatatatcgaagaggcgatcgaaaaattaagtaagaggcatcagtaccatatccgggcctacgaccccaagggcggcctcgataacgcaagacggctgaccggcttccacgaaacttctaacatcaacgacttttcggcaggtgtggcaaaccgctccgcttccattcgaattccccgcaccgtggggcaggaaaagaagggatacttcgaagacaggaggccaagtgccaattgcgatccgtttagcgttactgaggcacttattaggacctgtctgctcaatgagacgggtgacgaaccctttcagtataagaattag

SEQ ID NO: 118623 - DNA, 702 bp, Artificial Sequence
  Description of Artificial Sequence: Synthetic coding sequence
atgacaacaagcgcatcaagccatctaaacaaaggcattaagcaggtctacatgtcgttgcctcaaggcgagaaggttcaggctatgtacatttggattgacggtacgggggaaggtcttcggtgcaagacaaggaccctggacagcgagcccaaatgcgttgaggaactccctgagtggaattttgatgggtcgtccacactgcagtctgaggggagtaacagcgacatgtacctcgttcccgccgctatgtttcgcgatcctttccgcaaggacccgaataagctggtgctttgcgaggtgttcaaatataaccgcaggcccgcagaaaccaacctccgccacacatgtaagaggattatggatatggtttctaaccaacatccctggttcggcatggaacaggagtacacccttatgggtacagatggacatccctttggctggccctcaaatggctttcagggtcccagggtccacattacggtggtctgggagcagacggaacccatggcaggcacgtcttggagacctatcacaggccccgcatgcatgctggagagcagactgcgcggtttaatgcctcgctcttgtctgccatcaggcaacttcaggctcgacctggtcaaggagtcggcgtgggagatcatttcaggatggcccgttagttcctgcattgtttgtgttaagacacttgagtag

SEQ ID NO: 118624 - DNA, 678 bp, Artificial Sequence
  Description of Artificial Sequence: Synthetic coding sequence
atggaccagcaggctatctatgctgagcttaacctcccaaccgactccggccctgagagctcgtccccatcaagtctgcccagagacgtttgtcagggcagcccatggcaccagttcgcacttaaactgtcttgcgccggcatcatcctgctggtgctggtggtgactgggttgtcggtgtccgtcacatcactgatccagaagtcatccatcgagaaatgtagcgtggatatacagcagtctcgtaacaaaacaacagagcgtcctggactgctcaactgtcctatctactggcagcagctgcgagagaaatgcctactttttagccacaccgtgaacccgtggaacaacagtctggcagactgttcaacaaaagagagttcactgctgctgatacgtgacaaggacgagctaatccacacacagaatttaataagggacaaggctatactgttctggattggtctgaacttttctctctcagaaaaaaactggaagtggattaacggatctttcttgaactccaatgaccttgagatcagaggcgatgcaaaggagaacagctgtatttcaatttcccagacaagtgtctactctgagtattgctcaacggaaatccggtggatttgccaaaaggaactcacccccgtgcgtaataaagtgtaccccgactcctag

SEQ ID NO: 118625 - DNA, 825 bp, Artificial Sequence
  Description of Artificial Sequence: Synthetic coding sequence
atggggactgatagtagagcagccaaggctcttctcgccagagctcgtacactgcacctgcagaccggaaatcttcttaactgggggcggctcaggaagaagtgcccttcaacacacagtgaggagctccatgattgcatccagaagaccctaaacgaatggagtagtcagattaatcccgacctggttagagagttccctgatgtcttagaatgtacggtgtctcatgccgttgaaaagataaaccccgatgagcgcgaggagatgaaggtgagcgcaaagctgtttattgttgagtctaactcttcatctagcactcgctcagccgtcgatatggcttgttcggttctgggcgtcgcacagctcgattcagttatcattgcctctccccccatcgaggatggtgtcaacctgtctcttgagcacctgcaaccatactgggaggagcttgagaacctggtgcagtctaagaaaatcgttgctatagggaccagcgacctcgacaagacacagctggagcaattgtatcagtgggcccaggtgaagcccaactcaaaccaggtcaatctggcatcctgttgcgtcatgcctcccgatctgaccgcatttgccaagcaatttgacattcagctgctgactcataacgaccctaaagaattgctctcggaagcatcgttccaagaagccctgcaggaaagcatccccgacatccaagcacatgaatgggtgcccctgtggcttctccggtacagcgttattgtgaagagtagaggtatcatcaagagcaagggatacatcctgcaggctaaaaggcgagggtcctag

SEQ ID NO: 118626 - DNA, 1341 bp, Artificial Sequence
  Description of Artificial Sequence: Synthetic coding sequence
atggcagcacggaaaggacggcgaaggacctgtgaaacgggcgaaccaatggaggcagagagcggtgatacttcaagtgaagggccagcgcaagtctacctcccaggtaggggccccccactcagagagggcgaggagctggttatggatgaagaagcttatgtcctgtaccacagagcccagactggagccccatgtctcagcttcgatattgttagagatcacttaggagacaatcggaccgaattgcccctcactttgtacctgtgcgctggcacccaggctgaaagcgcacagtccaatcgcctgatgatgctcaggatgcataacttgcatggcactaagcctccaccctcggagggcagcgacgaggaggaggaagaagaggacgaggaagacgaggaggagagaaagccccaactcgaactagctatggtgccccactacggaggaatcaacagggtacgcgtgtcttggctcggagaagaaccagtagcgggcgtctggagcgagaaaggacaggtggaggttttcgctctaaggcggcttctccaggttgtggaagaacctcaggctctcgccgcctttctgcgagacgaacaagcacaaatgaagcccatcttctcctttgccggacacatgggagaaggtttcgccttagattggtcaccgcgcgtgaccggacggctgctcacgggcgattgccagaaaaatatccatttgtggacacccacagacgggggcagttggcacgtggaccaaagacccttcgtcggccatacacgttctgtcgaggacctacaatggtcaccaaccgaaaataccgtcttcgctagctgcagcgcagacgctagtataaggatttgggacatccgggcagccccatctaaagcttgcatgcttactacagctacggcccatgacggggacgttaacgttataagctggtctagaagggagcccttcctgctgtcaggcggtgacgatggagccctgaaaatatgggatctgaggcagtttaagtcagggtctcccgtagccacttttaagcagcacgtcgcacctgttacgtcggtcgaatggcacccccaagattcaggagtattcgcagcaagcggtgccgaccatcagatcactcagtgggatctggctgtcgagagagacccggaggccggcgatgtcgaagctgatcctggcctggccgacctgccccagcagctgttgttcgtgcatcagggcgagacagagctgaaggagctgcattggcatccgcagtgccccgggcttctcgtctctaccgcccttagcggatttaccatatttcggaccatctccgtgtag

SEQ ID NO: 118627 - DNA, 1572 bp, Artificial Sequence
  Description of Artificial Sequence: Synthetic coding sequence
atgcagcgtgccgctgctttagtccggagaggctgcggcccccgaactccttccagctgggggagaagtcagtcctctgccgctgccgaggccagcgctgtgctcaaagtgagaccggagcggagccgcagagagcggatcttaactctggaatcgatgaatccccaggttaaagcggtcgaatatgccgtgcgcggtccaatcgtgttgaaggcaggagagatagaattagagctgcaaaggggtatcaagaaaccattcaccgaagtaattagggctaatattggagacgcacaagccatgggtcagcagccaatcaccttccttcgccaggtgatggccctgtgtacctatcccaatcttcttgatagtccctcatttcctgaggatgctaaaaaacgagcgagacgcatcttgcaggcatgcggcggaaactccctgggatcatactccgcatcccagggagttaactgtattagggaagatgtggccgcatacattacccggagggatggcggcgtgccggcagatcccgataacatctatctgactacaggcgcctctgacggaatttctacaatactgaaaatactggtgagcggcggagggaagtccagaacaggagttatgatacccatacctcaatacccgctgtattctgccgtaatcagtgaacttgacgccattcaggtgaattactatctcgacgaggaaaattgctgggctctcaatgtgaacgagctgcgacgcgctgtacaggaagctaaagatcactgtgaccctaaggtgctgtgtatcatcaatcccggtaatccaaccggacaggttcaaagccgcaaatgtatcgaagatgtcatccatttcgcctgggaggaaaaactgttcctcctcgcggacgaagtgtatcaagacaatgtgtattcccccgattgtagatttcacagttttaaaaaagtattatatgagatgggacctgagtactcctcaaacgtcgagctggcctcatttcatagcacctccaagggatacatgggcgagtgtgggtataggggaggttatatggaagtgattaatctccatccagagattaaaggccagctggtgaagctgctcagcgtgcgcctatgcccacctgtgtctggccaagcagccatggacatagttgtaaacccaccagtggcaggagaggaatcttttgagcagttctccagggagaaggaaagtgtactgggcaacctggctaaaaaagctaagctgaccgaggatttatttaatcaggtgcccggcattcattgtaacccactgcagggggccatgtacgcttttcctagaattttcatccctgccaaggcggtcgaggctgcccaagcacaccaaatggcacccgatatgttctactgtatgaagttgctggaggaaaccggcatctgcgtcgtgcccgggtctggatttgggcagcgagaagggacctatcatttcagaatgacgattttgccgcccgtcgaaaagttgaagaccgttttgcagaaggtgaaggatttccacatcaacttcctggaaaagtacgcatag

SEQ ID NO: 118628 - DNA, 1272 bp, Artificial Sequence
  Description of Artificial Sequence: Synthetic coding sequence
atggggcagcagcctatcacattcctccggcaggtaatggcgctctgcacgtaccccaatctgcttgattccccttcttttccagaggacgctaagaaaagagcgcgcaggatccttcaggcatgtgggggaaacagcctgggaagctactccgcatcccagggcgtcaactgtatccgcgaggacgttgccgcctacatcacaaggagagatggcggcgtgcctgccgatccagacaatatctatctgaccactggggctagcgacgggattagtaccattcttaagattctggtttctggcggcggtaaatctcgcacgggagtgatgattcctatcccccagtacccactgtactcagcggtgatctcggagctggacgccatccaggtcaactattatcttgatgaagaaaattgctgggctctgaacgtcaacgaactgaggcgcgcagtgcaagaagctaaggaccattgtgaccccaaggttttatgtattataaatccggggaaccccaccggacaggttcaatctcgtaagtgtattgaagacgtgatccattttgcatgggaggaaaaactgttcctcttggccgacgaggtgtatcaagataatgtatatagtcctgattgtcgattccactcctttaaaaaagtcctgtacgaaatgggcccagaatattctagcaatgttgaactcgccagtttccactccacgagtaaagggtacatgggcgagtgtggataccggggcggctatatggaagttattaatctgcatcccgaaattaagggtcagctcgtgaaactattaagcgtaaggctgtgcccccccgtgtcaggacaggcggcaatggacattgtggtgaacccgcccgtagccggtgaggaatcatttgagcaattctccagggaaaaggaatccgttttggggaatcttgccaagaaagcaaaactgacagaggacctcttcaatcaggtgcctgggatccattgtaacccgttgcagggcgccatgtacgcatttccccggattttcataccagcaaaagccgtggaggctgcgcaggctcatcaaatggccccagacatgttttattgtatgaaactactagaggaaactgggatttgcgtcgtgccagggtctgggttcgggcagcgggaaggtacgtatcatttcaggatgaccattctgcctccagtcgaaaagctaaaaaccgttttacaaaaagttaaagatttccatatcaattttctggaaaagtacgcgtag

SEQ ID NO: 118629 - DNA, 1242 bp, Artificial Sequence
  Description of Artificial Sequence: Synthetic coding sequence
atggcccctccgtccgtctttgctgaggtcccacaggctcagcccgttctggtatttaaactgacggcagatttcagagaggacccagaccctcgaaaggtgaatttaggcgtaggcgcttaccggaccgacgactgccatccgtgggtgctgccggttgttaaaaaggttgaacagaagatagcgaatgataattcattaaaccacgaatatctgccgatccttggtctggccgaatttaggtcatgtgccagtcggctggctctgggcgatgactcacccgccctcaaagaaaaacgggtcgggggagtgcagtcccttggaggcacgggcgccttacggatcggggccgattttctagctcgatggtataacggcaccaacaataagaatacgcctgtgtacgtgtcttctccaacctgggagaatcacaacgccgtattctcggcagctggctttaaggacattagatcctaccgttactgggatgcagagaaaaggggattggatctgcagggcttcttgaacgacctggagaacgcacctgagttcagcattgtggtgctacatgcttgcgcccataaccctaccggtattgatcccacccccgaacaatggaaacagattgcctctgtgatgaagcatagattcctgtttcctttcttcgattcagcctaccaggggttcgcctcaggtaatcttgaaagagacgcctgggcaattcgatacttcgtctccgagggctttgagtttttttgtgctcagagctttagcaagaactttggcttgtacaatgaaagagtcggcaacctgaccgtcgtgggtaaggaacctgaatctatacttcaagtgttgtcccaaatggagaagatcgtgagaatcacctggtccaaccctcctgcccaaggggcaagaatagtcgcgtctacgctcagcaatcctgagctttttgaagagtggactggaaatgtaaagacaatggcggatcgtatactgaccatgagatctgaacttagggcgaggttggaggcactgaaaacccctggtacgtggaatcacatcactgaccagataggtatgttttccttcactggactgaaccccaagcaagtggaatacctggtaaacgagaagcacatctatctgctcccgagcggaagaataaatgtctccggtttaacaacgaagaatctggactacgttgccacttccatccacgaggctgttactaaaatccagtag

SEQ ID NO: 118630 - DNA, 1101 bp, Artificial Sequence
  Description of Artificial Sequence: Synthetic coding sequence
atggctcctccgtcagtcttcgcagaggtgccgcaggcacagccagtactggtttttaagctaactgctgattttcgcgaggaccccgacccgcgcaaggtgaacttgggcgtaggcgcttacaggacagacgacagccctgcacttaaggaaaagagggtgggaggtgtgcaatccctgggaggtacaggggcactgcgcataggagcagatttcctcgccagatggtataacggaaccaataacaagaatacgcccgtgtatgtcagttctccgacatgggagaaccacaatgcagtgttttcagctgccgggtttaaggatattcgttcttacagatattgggatgctgagaagcgcgggttggatttgcagggcttccttaacgatctcgagaacgcaccagagtttagcattgtggtgctgcacgcgtgcgctcataatccgaccggcatcgatccgaccccagaacagtggaaacagatcgcatccgtaatgaagcaccggtttctttttccgttcttcgacagcgcctaccaaggtttcgccagcggtaacctggagcgggacgcctgggccatccgatactttgtttctgagggctttgaattcttctgtgcccagtccttctctaaaaattttggcctctataacgaaagggtgggtaacttaaccgtggtgggtaaggaacctgaatccatcctgcaagtgcttagtcagatggagaagatcgtccgaattacttggagcaatccacccgctcaaggcgccaggatcgtggccagcactttaagtaaccccgaactcttcgaagaatggacgggaaatgtcaagactatggcagaccggatactgactatgagaagcgaactgagagcccggttagaggccctgaaaaccccaggcacctggaaccatattacggatcagattggaatgttcagcttcactggcctgaatccaaaacaggtggaatacctggtgaatgagaaacacatctatctgctcccgtccggccgtatcaacgtatcaggattgaccaccaagaacctggattacgtggcgacgagtattcatgaggccgtgacgaagatccaatag

SEQ ID NO: 118631 - DNA, 1179 bp, Artificial Sequence
  Description of Artificial Sequence: Synthetic coding sequence
atgcaggtctggtcaccttggaaaggagctatgtgcccgcgcccacacaaacccgcatatcgtaccgacgactgccatccttgggttcttcccgtcgtgaaaaaggtagaacagaaaatcgccaacgataactctctcaatcacgaatacctgcccatcctgggactggccgaattccgctcttgcgcctcacgactggctttaggggacgattcacccgccttgaaagagaagcgagtggggggcgttcagagcctcgggggcacgggagccctccggattggagcggatttcctggctcgctggtataacgggactaataataagaatacgcctgtgtacgtgagttccccaacatgggagaatcacaatgccgtgttctctgcagctggttttaaggatatacggagctaccgatattgggatgccgaaaagaggggactcgacctgcagggatttctcaacgacttggaaaacgctcccgagttctctatagtggttctacatgcatgcgctcacaatccaactggtatcgatccgactccagaacagtggaagcagattgcctcagtcatgaaacacaggtttctctttcctttttttgactcagcgtatcagggttttgcctctgggaatctcgagagggatgcctgggctatccggtattttgtttctgagggattcgaattcttctgcgcacagtctttctccaagaattttggcctgtacaacgaaagagtgggaaacctgaccgtggttggaaaggaacccgaatccatcctgcaggtcttgtcccaaatggagaagattgtgcggattacgtggtcaaatccccccgcacagggcgcacgtattgtggctagcacgctctctaatcctgagcttttcgaagagtggactggcaacgttaagaccatggccgaccgaattctgactatgcgttcagagctgagggcacggctcgaagcactgaaaactcctggcacatggaaccatatcacagatcagattggtatgttttcgttcacaggccttaacccaaagcaggtcgaataccttgtgaacgaaaaacatatctacctcttgcctagcggaaggattaatgtcagcggccttactacaaagaacctggattacgtggccacctcaatccatgaagcagtgaccaagatccagtag

SEQ ID NO: 118632 - DNA, 1293 bp, Artificial Sequence
  Description of Artificial Sequence: Synthetic coding sequence
atggctctcctgcacagtggacgcgtgcttccagggatagcagccgcgttccatccaggcctggcagccgcggcctctgccagagcctctagttggtggactcacgtcgagatgggccctccagatccaatactgggcgtcaccgaggcctttaaacgagatacaaattcgaagaagatgaacctgggggttggggcatacagagatgataatggcaaaccatacgttctccccagtgtccgtaaggcagaggcccagatcgccgcgaaaaacttagataaagagtacctgccaatcggagggttggccgagttctgtaaggccagcgccgagttagcgttgggcgaaaactcagaagtacttaaatccggccggtttgtgactgtccagaccatctccgggactggcgctctgcgtataggggcttccttcctgcagaggttttttaagtttagccgtgatgtgttcctgccgaaacctacatgggggaaccatacgcccattttcagggatgccggcatgcagctgcagggttacagatactacgaccctaaaacttgtgggttcgattttaccggagctgtcgaggacatcagtaaaatcccggagcagtctgtacttctcctgcatgcatgtgcacacaatcccactggagtcgacccaaggcctgagcagtggaaggagatcgcaaccgttgtcaaaaaacgaaatctgtttgcattctttgacatggcgtaccagggcttcgcctccggcgacggggacaaagatgcctgggctgtgcgccacttcattgagcagggaattaatgtctgtctgtgtcagagctacgccaaaaatatgggactgtatggggagagagtgggagcttttactatggtgtgtaaagacgctgatgaggcaaaacgggtggagtcccaactgaagattcttatccggcccatgtactctaacccgccattgaatggcgctcgtatcgccgccgcgatcctgaataccccagatttgaggaaacagtggctccaagaagtgaaagtcatggcagaccgaattatcgggatgcgcacccagctcgtgtcaaaccttaagaaagagggctctacccacaattggcagcatattactgatcaaattgggatgttctgtttcacgggactgaaaccagaacaggtggagagactgataaaggaattcagcatttatatgaccaaggatgggcgtatctccgtcgcaggtgtgacaagctccaatgttgggtacctggcccacgccattcatcaggtgaccaagtag

SEQ ID NO: 118633 - DNA, 570 bp, Artificial Sequence
  Description of Artificial Sequence: Synthetic coding sequence
atggcgctcctgcacagtggacgggtgctccccggaatcgccgcagccttccatccagggcttgccgccgctgcctcggccagggcctcctcctggtggacccatgtggagatgggaccccctgaccctattctgggagtcactgaagccttcaagcgcgacacaaactctaaaaagatgaacctgggggtgggggcatatcgggacgataacggcaagccatacgtgctgcccagtgtacgaaaagccgaagctcagatcgccgctaagaatttggataaggagtatctcccgataggtggccttgcagaattctgtaaggacttcttgagctctgctgaaatgtcattttgccctaatcagcctggtgagaccacacatcctagttctggtatgctcgcttgtagttataaagtaatcggcatcatgacgccccgtttggctgttctcactagccaggcactgtggaggatcttccagaagtatcagagtcgggtcttcttcttctgtatgccagctcccaccattccaagggaatggactcgggtgagaaattctggtcgcaagtag

SEQ ID NO: 118634 - DNA, 1164 bp, Artificial Sequence
  Description of Artificial Sequence: Synthetic coding sequence
atggcccttttgcacagcggtagagtcctgccgggcatcgccgccgcgtttcaccccggactggcagccgcggcttcggcaagggcatcttcatggtggactcacgtcgaaatgggtccacctgacccgatactcggcgttacggaggcttttaagagagatactaatagcaagaagatgaaccttggggtcggcgcttatcgagacgacaacggaaagccctacgtcctcccctccgtccgcaagtttgtgacagtccaaaccatctccggaaccggagctctgagaataggggccagtttcctccagaggttttttaaatttagtagggacgttttccttcccaaaccaacttggggaaatcatacaccaatcttccgagacgctggaatgcaactgcaagggtacaggtattatgacccgaagacatgtggatttgattttacaggggccgtcgaggatatcagcaaaatccccgagcaatccgttctgcttctgcacgcgtgcgctcacaaccccacaggagtagaccccaggcctgagcagtggaaagagatagctaccgtagtcaaaaagagaaacttatttgcattctttgatatggcataccagggattcgcttcaggcgacggggataaggacgcctgggctgtccggcacttcattgaacaaggaattaatgtctgcctctgccagtcctatgccaaaaacatgggcttgtacggtgaacgagttggagctttcacaatggtctgtaaagacgcagatgaggccaagcgggttgagtctcagcttaagattctgatcagacccatgtatagcaacccccccttgaatggtgccagaatagccgccgcgatcctaaatacacctgatctgcgaaaacagtggctccaggaagtgaaggtcatggcagaccggatcattgggatgcgcactcaacttgtgtctaacctgaaaaaggagggtagcacccataactggcagcacatcacagaccagattggcatgttttgtttcacaggccttaagcctgagcaggtggaacgcctcattaaggagttctccatatatatgacaaaggatggccgcatcagcgtagcgggcgtgacgagcagtaatgtcgggtacctagctcacgccatacatcaggtcacaaagtag

SEQ ID NO: 118635 - DNA, 1491 bp, Artificial Sequence
  Description of Artificial Sequence: Synthetic coding sequence
atggccagttctacgggcgatagatctcaggcggttcgccatggattgcgcgctaaggtgctcacactggatggaatgaatccccgggtgcggagggtggaatacgcagtgcgaggcccaattgtacagcgcgctctcgagctcgagcaggagcttaggcagggcgtgaaaaaacccttcaccgaggtcattcgagccaacatcggagacgctcaggctatgggccaaagaccgatcacgttcctgcggcaggtcttggctctctgcgttaatcccgatctgctgagttcacccaatttcccagacgatgcaaagaagcgagctgaaaggattctccaagcctgtggaggtcacagtcttggtgcatattccgtatctagtgggatccagctgattagagaggatgtagcccgctacatcgaaagacgagacggtggcattccagcggaccccaacaacgtgttcctgagcaccggcgcatctgatgcaatagtaacggtgttaaagctgttggtggctggggaggggcatacgcgaacaggagtcctcataccaatcccccagtacccgttatactccgccactttagccgaacttggcgctgttcaagtggactactacctggatgaggagcgggcctgggccctggacgtagcagagctgcacagggctttgggacaggctcgggatcactgtcgccctagggcattgtgcgtgatcaatcccggtaaccctaccggtcaggtgcagactagggaatgcatcgaggccgtgatcagatttgcttttgaggagcgactgttcctgctggctgacgaagtgtatcaggacaatgtgtatgccgcaggttctcagttccactcctttaagaaggtgttaatggagatggggcctccatatgccggccagcaggaacttgccagcttccatagtaccagtaaggggtacatgggagaatgcgggttcagggggggttatgttgaagtggtgaatatggacgctgcagtgcagcagcagatgctgaagctcatgtctgtaaggctgtgccctcctgttcctggacaggcactgctagatctggtcgtttcgccacctgcaccgaccgatcccagcttcgcacaattccaggcagagaaacaggcagtgctagcggaactggctgcaaaggccaaacttacagagcaagtgtttaacgaggcacctgggatctcctgcaacccagttcagggtgccatgtattctttccctcgggtgcagctccctccccgggcggttgagcgggcacaggaactcgggctggcgcctgacatgttcttttgcctacgtttattggaggagaccggaatctgcgtcgtgcctggctccggattcggccagagggaggggacttaccactttcgaatgactatcttgccccccctggagaagctgcggctcctgttggaaaagctgagcagattccacgctaagtttaccctggagtactcctag

SEQ ID NO: 118636 - DNA, 1491 bp, Artificial Sequence
  Description of Artificial Sequence: Synthetic coding sequence
atggcaagtagtaccggtgaccgttctcaggccgtaaggcatgggctacgagctaaggtcctcacactcgatgggatgaacccacgggttcgaagagttgagtacgctgtgagaggccctatcgtccagcgggcacttgagttagaacaggaacttaggcagggggtcaagaagcccttcaccgaggtgattcgtgctaacatcggagacgcgcaagccatggggcagaggccaatcacctttcttcgacaggtactcgctctatgtgtgaatccagacctgctgagctctccgaatttccccgatgatgccaaaaagcgcgcagaacgtatcctgcaggcatgcggcggccattccctgggtgcctacagtgtgtcgtctgggatccagctgatcagggaagatgttgcccggtatatcgaacgtcgcgatggaggcattccagcagacccaaacaacgtgttcttaagcaccggggcctccgatgcgatcgttacagtactgaaactgctggtagcaggtgagggccacactcgcacaggggtcctaatccccattcctcagtacccattgtacagtgccaccctggccgaactaggagccgttcaggtcgattactacctagatgaagaacgagcctgggcccttgacgtggcagagctgcaccgcgccctggggcaggctagggaccactgcagacccagggccctgtgcgtcatcaatccgggaaaccccactggccaagtccaaacccgcgaatgcatagaggctgtaattcgcttcgcattcgaggaacggctctttcttctggctgacgaggtgtatcaggacaatgtctatgcagccggttcccagttccacagtttcaaaaaagtgctgatggaaatgggcccaccttatgccggtcagcaggaactcgcttcatttcacagcactagtaaagggtatatgggggagtgcggcttccggggtggatacgtcgaggttgtaaacatggacgcagctgtacagcaacagatgctcaaactgatgtctgttaggttgtgtccccccgtaccaggccaggcattactcgacttagtggtatcgccacctgcccctacagacccatcattcgcccaatttcaggccgaaaagcaggctgttctcgccgaactcgcagcgaaggcgaagctcacggaacaggtgtttaatgaagcgccgggtatatcatgcaatcctgtgcagggcgccatgtatagttttcccagagtacagctccctccacgggccgtggaaagagcccaggagctgggcctagcgcctgacatgtttttttgcctccggctactggaggagactgggatttgcgtcgtgccgggaagcggtttcggccagcgcgaaggaacctaccatttccggatgactattctgcctcctttggaaaagttgagactcctgttagagaaattatcccggtttcacgccaagttcactctggagtactcctag

SEQ ID NO: 118637 - DNA, 2010 bp, Artificial Sequence
  Description of Artificial Sequence: Synthetic coding sequence
atgatgagactgcggggttcggggatgctgagggacttgctcctgcgaagccctgctggagtcagcgcaacgctccgcagggcccagccactggttaccctgtgcaggcgccctagaggcggcggaaggcccgccgcaggaccggctgccgcagctcggcttcacccgtggtgggggggaggagggtggcccgctgagcctctcgctcggggtttgtcctcgtcccccagcgaaatccttcaggagctgggtaagggctctactcacccgcagcccggcgtgagcccccccgcagctcctgctgcacctggaccaaaggacgggcctggtgagactgacgcctttggaaactcggaagggaaagaacttgttgccagcggggagaataagattaagcagggactattgccttcgcttgaggacctgcttttctacacaatcgccgagggacaggaaaagattcctgtgcataagtttattacagctctcaaatcaaccgggctaaggaccagtgatcctcggcttaaggagtgcatggatatgcttagactcaccctacagaccacatcggacggggtgatgcttgataaagacctgtttaagaagtgcgtccagtctaatatcgtcttgcttacacaagcctttcggagaaagttcgttatccccgacttcatgagcttcacaagtcatattgatgagttatacgagagcgccaagaaacagagcggtggtaaagttgccgattacatcccacagcttgcgaagttttcccctgacttatggggagtaagtgtctgcacagttgacgggcagcgccacagcactggcgacactaaggtccccttctgtttgcaatcgtgcgtgaagcccctgaagtacgccattgccgtgaacgatctgggtactgaatacgtgcatcggtacgttggcaaggagccatccggcctaaggttcaataaactgtttctgaacgaggatgacaagccccataacccgatggtaaatgcaggggcaatcgtggtcacatctctcatcaaacagggggttaacaatgccgagaaattcgactacgtgatgcagtttttaaataaaatggcagggaacgagtatgtgggcttttcgaacgccacgttccagtctgaaagagagtccggcgaccggaatttcgctattggttactacctgaaggagaagaaatgcttccccgagggaaccgacatggttggaatactggatttttatttccaactctgctcaattgaagtgacatgcgaatctgcttcggtcatggccgcgaccctggcgaacggagggttctgtccaatcaccggggagcgcgtactgtcaccagaagcagtaaggaacaccctcagcctgatgcactcctgcgggatgtacgatttttccggccagtttgcctttcatgtaggactcccagcgaaatcaggggtggcaggcggcattttgctcgtcgtgcccaacgtgatggggatgatgtgttggagccccccactcgacaagatgggaaactccgtgaagggcatccacttctgccacgatctggtctccttgtgcaatttccacaactacgacaacttacgccatttcgctaagaaactcgatccacggcgcgagggtggcgatcaacgcgtcaagtccgtcatcaacctgcttttcgctgcctatacgggtgacgtgtccgccctccgtcgctttgcgttgtctgccatggatatggagcagagagattacgactcccgaactgccctgcacgtggctgccgccgagggccatgttgaggtagtaaaattcctgctggaagcctgcaaggtgaacccatttcctaaagaccgctggaacaacaccccaatggatgaagccctgcattttggtcaccatgatgttttcaagatccttcaggagtatcaagtgcagtatacaccacaaggcgacagtgacaacggcaaagaaaatcagacagttcacaaaaacctggatgggctgctatag

SEQ ID NO: 118638 - DNA, 1797 bp, Artificial Sequence
  Description of Artificial Sequence: Synthetic coding sequence
atgatgaggctacgaggaagcggtatgcttagggacctgctgctccgcagcccggctggtgttagcgccacactgcgtagggctcaacccctggttacgctttgtagaaggccgcggggcggcggacggccagcagccggccctgccgccgcagcgcggttgcatccctggtggggaggcggcggctggcctgccgagccacttgccagaggcctctcaagttccccttctgagatcctgcaggagcttggcaagggatctacccatcctcaaccgggagtttctccgcccgccgcccctgccgccccaggacccaaagatggaccgggtgagactgacgcttttggcaacagtgaaggcaaagagctggtggcaagtggcgaaaataaaatcaaacaggggctactgccgtctttagaggatctgctgttttacaccatcgctgagggacaggaaaagatccccgttcacaaattcatcacggccctgaaaagtacaggtctccgcacttctgatccaaggttaaaggagtgtatggatatgctgcggctaacactacagactactagtgatggggtgatgctggacaaagatttgttcaaaaagtgcgtacagtctaacattgtgttactgacccaggcctttcgccgaaagtttgtgatccccgacttcatgtcatttaccagccacatagacgagctgtacgaatctgccaagaaacagagtggcggcaaggtcgcagattatattccacagctggccaagtttagcccagacctgtggggagtaagtgtatgcactgtcgacggccaacggcattcaactggcgacacaaaggtacccttttgtctgcagtcttgcgtcaaacctcttaagtacgccattgccgtgaacgacctggggacagaatatgttcaccggtacgtgggaaaagaaccatcaggtctgaggtttaataagctctttttgaacgaagacgataaaccacacaaccctatggttaatgccggggcaattgtggtcacttctttgataaaacaaggggtgaacaacgccgaaaagttcgattatgtgatgcagttcctcaacaagatggctggtaacgaatacgttggctttagtaatgcaaccttccagagcgagagagagtcgggcgatcggaacttcgccatcggttactacttgaaggaaaaaaagtgttttcctgagggaaccgacatggtcggaatcctagatttttattttcagctctgttctatcgaggtaacttgcgaaagcgcaagtgttatggccgcgacactcgctaacggaggattctgtcctatcaccggcgaaagagtcctgtctcccgaagccgttcgcaacaccctatccttgatgcactcatgcggtatgtatgatttttcgggacagttcgctttccacgtcggactgccagctaagagcggagttgccggggggatcctgctggtcgtgcccaatgtgatgggcatgatgtgttggtcacctcctctcgacaagatgggcaactcggtgaaggggatccatttttgtcatgatttggtgtctctgtgcaattttcacaactacgacaatttgagacacttcgccaagaagctggatccccggcgggaagggggcgatcaaaggcactcattcggtcccttggattacgaatccttgcagcaggagcttgctttgaaagagacagtatggaagaaagtgtcccctgagagcaacgaggacatctccaccacagtagtttaccgtatggaatccctgggggagaaatcttag

SEQ ID NO: 118639 - DNA, 525 bp, Artificial Sequence
  Description of Artificial Sequence: Synthetic coding sequence
atggggatgatgtgttggagtccacccttggataaaatgggcaattcagtaaaaggtatccacttctgccatgacttagtgagcctgtgtaactttcacaactacgataacttacgtcatttcgcgaaaaagctggatcccagaagggagggcggcgatcagagggtgaaatccgtcattaatctgctgtttgccgcatacacgggagatgttagcgccctgcggaggtttgccctttctgcgatggatatggaacagcgggactacgattctcgaacggctcttcacgttgctgctgccgagggccacgtggaggtcgtgaaattcctgctggaggcttgcaaggtgaatccgttccccaaagaccgttggaacaacacccctatggatgaggctctgcatttcgggcaccatgatgtcttcaagattttacaggagtaccaggtccagtacacgccccagggggactctgacaacggaaaggaaaatcagacagtgcacaagaatcttgacggcttgctgtag

SEQ ID NO: 118640 - DNA, 1809 bp, Artificial Sequence
  Description of Artificial Sequence: Synthetic coding sequence
atgagaagtatgaaagctttgcagaaagctctgagccgggcgggcagtcattgcggaagaggaggctgggggcaccctagcagaagccccctcttgggtggtggcgtgcgccaccaccttagcgaggcggcagcccaaggacgtgaaacgccccactctcatcagccccaacatcaggatcatgactcttcagaatcggggatgttgagtcgactcggcgatctgctattttataccattgcagaagggcaggaaaggatacctattcacaaattcacaacagctctcaaggctaccggccttcagacctccgacccacgcctcagagattgcatgtcagaaatgcaccgagtggtgcaagagagttcctctggcggattacttgatcgcgatctgtttagaaagtgtgttagctcgaacattgtcctgctgacccaggccttccgaaagaaatttgtgatcccagatttcgaggagtttaccgggcacgtggaccggatcttcgaggacgtgaaagaattgacaggagggaaggtagcggcttacattccacagctggccaagtcaaacccagacttgtggggtgtctcactctgcaccgtcgatggacaacggcacagcgtgggccatacaaagatacctttttgtctgcagagttgcgtaaagcccctgacctatgcgataagcatctcgacgctgggaaccgactacgtgcacaaatttgtcggaaaagaacctagcggactgagatacaacaaattaagccttaacgaggaggggatccctcacaacccaatggtcaatgccggggccatcgtcgtgagctctctgattaagatggattgtaacaaagccgagaaattcgattttgttttgcaatatttaaacaaaatggctggaaacgaatatatgggatttagcaatgcaacattccagagtgaaaaggaaactggagatcgcaattatgccataggttactaccttaaagagaaaaagtgtttccccaaaggggtcgacatgatggccgccttggatctttattttcaactctgcagcgtggaagtgacttgcgagagcggttccgtgatggctgcgaccctagctaatggaggcatctgcccgatcacaggcgaatctgttttgtccgccgaggccgtccggaacaccctgagcctcatgcacagctgtgggatgtatgacttcagcgggcagtttgcttttcacgtgggtcttccagccaagagtgccgtgagcggggctattctgctcgtggtgccaaacgtgatggggatgatgtgcttaagcccccctctggacaagctgggtaatagtcaccggggaacttctttttgccagaagttggtctcactgtttaattttcacaattatgacaatctgaggcactgcgctagaaaactcgatcctcggcgggagggagccgagatccgcaataagaccgtagtgaaccttctctttgccgcgtatagcggcgacgtctctgccctgagaaggttcgcactgtctgcaatggatatggagcagaaggactacgattcgcggacagcactgcatgtagcggccgctgaagggcatatagaagtagtgaagtttctgatcgaggcgtgtaaggtgaacccttttgcaaaggataggtgggggaacataccacttgatgacgccgtgcaattcaatcacctagaagtggtgaagctgttgcaggattaccaggactcatacactcttagcgagactcaagctgaggctgcagctgaagcccttagtaaagaaaatctcgaaagcatggtctag

SEQ ID NO: 118641 - DNA, 534 bp, Artificial Sequence
  Description of Artificial Sequence: Synthetic coding sequence
atgagaagcatgaaggcccttcagaaagcactgagcagagcaggttcacattgtggtcggggaggatgggggcatccttcacgtagccccctgctaggaggcggagtgcgtcatcacctgagcgaggccgccgcccaagggagagagacaccacactctcatcagccacaacatcaggaccacgactcttccgaatccggtatgctctcccgcctcggggaccttttgttttacaccattgccgaaggtcaagagaggatacccatccacaaattcacgacagcactgaaagcaacgggcctgcagactagcgatcctaggttaagagattgcatgtccgagatgcaccgggtggtccaggagagctcttccggggggctgctggatagagacctgttcaggaaatggcagccaacatctctcagctggccctcacaaacacagacgtgtggagtgagcccttgcgctctatggatggtgaacggaaccctgtgggctacacagaggagtccttctgcatgctctccggtgtag

SEQ ID NO: 118642 - DNA, 2049 bp, Artificial Sequence
  Description of Artificial Sequence: Synthetic coding sequence
atgtgcgggatcttcgcctatatgaattaccgagtgcctcgcacacggaaggaaatatttgagactttaatcaagggcctgcaaagactggagtaccgtggttatgatagtgcgggggtcgccatcgacggaaacaaccacgaagttaaggagagacatatccagctagtgaagaagagaggaaaggtgaaggccctggacgaagagctctataaacaagattctatggatctcaaagtagagtttgaaacccattttggtattgcccacaccagatgggctacccacggcgtgccatcggccgttaattcacatcctcaaaggtcagataaggggaacgagttcgtggttattcacaacggcatcatcacaaattacaaagatttgaggaaattcctcgagagtaaggggtacgagtttgaaagcgaaactgacaccgagacaatcgccaagctgataaaatacgtgtttgataacagggagactgaggatattaccttttcaacgctggtggaacgcgtgatccagcagttagaaggggcctttgcgctggtatttaagagtgttcattacccaggggaggcggtcgccacacggaggggatccccgctgttaattggcgttcgaagtaagtataaactgagtaccgaacaaattcctatcctgtaccggacctgtacactcgagaatgtgaagaatatttgtaagacacgcatgaagcggctggacagctcggcctgtctgcacgctgtgggtgacaaggccgtggagttcttcttcgcatcagatgcctccgccattatcgaacatactaatcgggtaatcttcttggaggacgatgacatcgccgcagtggcagatggcaagctcagcatccatcgagtgaagcgcagtgcctcggatgacccatcccgggcaattcagacccttcagatggaactgcagcaaataatgaagggcaatttcagcgcctttatgcaaaaagagatttttgagcagcccgagtccgttttcaataccatgcgcggacgcgtgaactttgagacgaatacagtgctcttgggcgggctaaaggatcatctaaaagagattcgtcgctgccggcgccttatcgtgattggctgtggcacgtcctatcatgcagcggtagcaacgagacaagtgttggaagagcttacagagctcccggtgatggttgaattggcatccgattttttagaccgcaatacacctgtttttcgcgacgacgtttgcttcttcatctcccagagcggtgagacagccgatactctgctggccctgagatactgcaaggatcgaggtgcccttaccgtcggagtgacgaacactgtaggttcttctatcagccgagagacagattgcggagtgcatatcaatgctggcccagagattggcgtcgcaagcaccaaggcatacacgagccaattcatctcacttgtgatgttcggactcatgatgtctgaagatcgcatttcgcttcaaaaccggaggcaggaaattataagggggttgcgcagcctacctgaacttatcaaggaggttctctcacttgaggaaaagattcacgatctggccctggaactctacactcagaggagcttgctggttatgggtaggggatacaattacgcaacttgcctcgagggggcgttgaaaattaaggaaataacatatatgcactcggagggaatactagccggcgaactcaaacacgggccactagccctgattgacaaacagatgccagtaattatggtgattatgaaggatccctgcttcgctaaatgtcagaatgcgttacagcaagtgaccgcccggcagggtaggccaattattctgtgctccaaggatgacacagaatcatctaagttcgcttacaaaacgatcgagctgccacacaccgtcgactgccttcagggaatccttagcgtgatccccctacagctgctgtcctttcatttggccgtcctgaggggatacgatgtggactttccaagaaatttagccaagtcggtcaccgtagagtag

SEQ ID NO: 118643 - DNA, 1086 bp, Artificial Sequence
  Description of Artificial Sequence: Synthetic coding sequence
atggccggcggtcgccataggagagtggtgggaaccctccacctattattgctggtcgctgcactcccttgggccagtcggggcgtatcccccagcgcctctgcctggcccgaagaaaagaattaccaccaacccgcaatcctgaattcatctgcccttagacagattgcagaggggacctcgatctcagagatgtggcaaaatgatctgcagccacttctgattgaacggtatcccggcagtccaggctcctatgccgcccggcagcacattatgcagaggattcaacgcctgcaggcagattgggtgttggaaattgacacctttctgtcacaaaccccatatggataccggtcattttccaacatcatatcaacactcaaccccactgcaaagagacacctggtgctagcctgccactatgacagcaagtacttctctcattggaacaaccgcgtctttgtgggggctactgactctgccgtgccctgcgctatgatgcttgagctggctcgcgccctcgacaagaagctgctgtcactgaaaacagtttctgacagcaaaccagatctgtccctccagcttattttttttgatggcgaagaggctttcttgcattggtctccccaggactctttgtacgggagtcgacacttggcggccaagatggcatcaaccccccatcctcctggcgctcgcggcacctcccagctgcatggcatggacttgctcgtactgctggacctgataggggccccaaatcccaccttccccaatttcttcccaaatagcgcccggtggttcgaaaggctgcaggctatcgaacacgaactacacgagctcgggcttcttaaagatcactctctggaaggcaggtacttccagaactattcatacggaggcgtcatccaagacgatcacatccctttccttcgccggggcgtccccgtattacatcttatcccttcaccctttcctgaggtgtggcatactatggacgacaacgaggagaacttggacgagtctacgattgataaccttaataaaattttacaggtcttcgtgctggaatacctgcatttatag

SEQ ID NO: 118644 - DNA, 939 bp, Artificial Sequence
  Description of Artificial Sequence: Synthetic coding sequence
atggccggcggccgacaccgcagagtagttggcaccctgcacctactgctactcgtggcagcgcttccatgggcaagtagaggggtgtcacctagtgcttctgcatggcccgaggagaagcacatcatgcagagaattcagcggttgcaggccgattgggtgttagagatcgatactttcttatcccaaactccctatggctacagaagcttctctaacataatctccacacttaaccccaccgcaaagcgacacctggtgttagcctgtcattacgactcaaagtacttttcacactggaacaatagagtgtttgtgggggcgaccgacagcgccgtgccctgcgccatgatgctagagctcgctcgagctctcgacaaaaagcttctgtcactgaagactgtgagcgacagcaagccagatctgtcgttacagctaatcttctttgacggtgaagaggcttttctacattggtcccctcaggactctctctatgggtcgaggcatctggcggcaaagatggcaagtacaccccacccccctggggcacggggtaccagccagcttcacggcatggacctcctggtgttgctcgaccttatcggcgctccgaatccaaccttccccaattttttccctaattccgcgcggtggttcgagcggctacaggcgattgaacacgagctgcatgagctggggctgctcaaggaccactctctcgagggccgttactttcaaaactattcttacggcggagtcatccaagatgaccatattccctttctccggcggggagtgccagttctccatctgattccctctcccttccccgaagtctggcatactatggatgataacgaggaaaatctggacgagagtactattgacaacctcaataagatcctccaggtgtttgtgctcgagtacctgcatctctag

SEQ ID NO: 118645 - DNA, 2328 bp, Artificial Sequence
  Description of Artificial Sequence: Synthetic coding sequence
atggcagcactggactcgctatccctgttcacaagcctgggtttgagcgagcagaaagcaagagaaactctgaagaattcagcactctcagcccagcttagggaggctgctacgcaggcacagcagacgctgggatcgacgatcgacaaggccacaggaatcctgctctatggtttggcgtctagactgcgagacacacgccgcctgtccttcctcgtttcgtatatcgctagcaaaaagattcacactgagcctcagttgtccgctgctttagaatatgtccgttctcacccgctggatccgatagacaccgttgacttcgagagagaatgtggcgtaggggtgattgtgactcccgagcagatcgaagaagcggtggaggccgctatcaacaggcataggccccaactgctcgtggagcgctatcacttcaacatgggcctcctcatgggcgaggcaagggccgtcctgaagtgggccgacgggaagatgattaagaacgaagtcgatatgcaggtgttgcatctgctcgggcccaaattggaagccgatctcgaaaagaaattcaaggtggccaaggctagactagaggagacggacagaagaactgccaaagatgtggtggaaaatggcgaaacagccgaccagacattgtcgctcatggagcaattgcgtggagaggccctgaaattccataaacccggcgagaactataagacacccgggtacgtcgttactcctcacaccatgaatctgctcaagcagcatctggaaataaccggcggacaagtgaggacacgctttcccccagaacctaacggcatcctccacattgggcatgctaaggccatcaattttaactttggttatgccaaagccaataacgggatctgcttcctgcgtttcgacgacactaatccggagaaggaagaggcaaaatttttcacggctatctgtgatatggttgcgtggcttggctataccccttacaaagtgacctacgctagtgactacttcgatcaattgtacgcctgggccgtggagctgatcaggagagggctggcgtacgtttgccatcagagaggggaagagctaaaggggcataatacgttgccatccccatggcgcgaccgtccgatggaggagtccctgctgctctttgaggccatgcggaagggaaaattttccgagggcgaggccacactgcgaatgaagctggttatggaggatggaaagatggaccctgtggcttaccgtgtaaagtacaccccacatcaccgcacaggggataaatggtgcatatatcctacctacgactacacccactgcctttgcgacagtatagagcacatcacacattcactgtgcaccaaggagtttcaggctcgacggtcgagctatttctggctttgcaatgcgctggacgtctattgtcctgttcagtgggagtacggccggctgaacctccactatgcagtcgtatccaagcgaaagattctgcagttggtggccaccggggcagtgcgggattgggatgaccctcgcctgtttaccctcaccgctctccgaaggcggggtttccctcccgaggctatcaataacttctgtgctcgagttggcgtcactgtggctcaaacaactatggaaccccatctcctcgaagcatgcgttagagatgtgctgaacgacaccgccccccgcgccatggcagttttagaatccctgcgggtcattataacaaactttcctgccgctaaaagtctagacatccaggtgcctaacttccccgccgatgaaactaaaggcttccatcaggttcctttcgcgcctatcgttttcattgagcgcactgatttcaaggaagagccagaacctggctttaaacgcctggcatggggccagcccgttggactacgccatacggggtatgtcatagagctccaacacgttgtgaaaggaccaagtggttgtgtggagtcgcttgaagttacttgccgccgagcagatgccggggaaaagcctaaggccttcattcactgggtgagccagcctttgatgtgtgaagttcggctatacgagcgcctattccagcataagaatcctgaggacccgaccgaggtccccggaggatttctaagcgatcttaaccttgcctccctgcacgtggttgatgcagctctagttgattgctccgtggctcttgctaaaccgtttgacaaatttcaattcgagcgacttgggtacttctcagtggacccagacagccatcaaggaaaattggtcttcaatcgcaccgtaaccctgaaggaggaccccggcaaggtgtag

SEQ ID NO: 118646 - DNA, 2295 bp, Artificial Sequence
  Description of Artificial Sequence: Synthetic coding sequence
atggccgccttggacagccttagcctgtttacttccctcgggctcagtgagcagaaggccagagagactctcaagaatagcgccctgtctgctcagctccgggaggccgcaacccaggcacaacaaacacttggcagcaccatcgacaaagctacaggcatcctgctgtatggacttgctagtcggctccgcgatactaggagactgtcattcctcgtctcttatatcgccacggccctcgaatacgtgcgttcccatcctctcgatccgatcgacactgtcgattttgagcgggagtgtggggtgggagtgatcgtcactcctgagcaaatcgaagaggccgtggaggccgccataaaccgccaccggccgcagttgctggtggagcgatatcattttaatatggggctcctcatgggagaggctcgggctgtcctgaagtgggccgacggaaagatgattaagaacgaggtggacatgcaggtgctgcacctcctggggccaaagttagaggctgatctggagaaaaaattcaaagtcgcaaaggctcgattagaagagactgacaggcggacagcaaaagatgtggttgaaaacggggagaccgccgaccaaactctctccctaatggaacaactgcggggcgaagccctcaaatttcataaaccaggcgagaactacaaaacacctggatacgtggttacgccccacacaatgaatctgctaaaacagcacctggaaataacaggggggcaagtaaggacccggtttccccccgaacccaatgggatcctgcatattggccatgccaaggcgattaactttaatttcggatacgccaaagcaaacaacggcatctgcttcttgcgtttcgatgatacaaaccccgagaaagaggaagccaagtttttcacagccatatgcgacatggtcgcctggctaggttacacaccctacaaagttacatatgcgtccgattattttgatcagctgtatgcgtgggccgtggaactgattagaaggggattagcctatgtgtgccatcaacgtggggaggagcttaaaggccataacacacttccaagtccctggcgtgacaggcccatggaagaaagcttgctcttattcgaagctatgcggaagggtaaattcagcgagggcgaagccacactcaggatgaaattggtgatggaggatggcaaaatggacccagtcgcctatagggtgaaatacacgccgcatcacaggactggcgataaatggtgcatttacccaacatacgattacacacactgtctatgtgatagcattgaacatattacgcattctctgtgcaccaaagagttccaagcacgccgctcctcttacttttggctatgtaatgctctggacgtgtactgcccagttcagtgggagtacgggcgactgaacttgcactatgccgtggtcagtaaaaggaaaatcctgcagctcgtagcgactggggctgtacgcgactgggatgacccgaggctgttcacactcacagcactccgtaggagaggatttcctcccgaagccataaacaacttctgcgccagggtaggagtcaccgtggctcaaacaacaatggagccccacctgctggaggcctgtgtgcgggatgtgttgaacgacaccgcgccacgggctatggccgtgctggagtccttgagagtcattattactaatttccccgctgcgaagagtctggacatacaggtcccaaactttccggcagacgaaaccaagggttttcaccaggtaccttttgcccccatcgttttcatcgagaggaccgactttaaggaagaacctgagcctggattcaagagattagcctggggccagcctgttgggctccgtcatacgggttatgtaattgaacttcagcacgtggtgaaaggaccctctggctgtgtggagagtcttgaggttacatgtagaagggccgatgccggcgagaaaccgaaggcgtttatccactgggtctcccagcctctgatgtgcgaggtgcgtctgtatgagaggctctttcagcacaaaaaccccgaggaccctaccgaagtcccagggggctttttgagtgatctgaatctggcatcacttcatgtggtggatgccgccctggtcgactgctcagttgctctggcaaagccttttgataaattccaatttgagaggctgggatatttttctgttgacccagattcccaccaggggaaactcgtgttcaacaggaccgtcaccctgaaagaggatccaggcaaagtgtag

SEQ ID NO: 118647 - DNA, 849 bp, Artificial Sequence
  Description of Artificial Sequence: Synthetic coding sequence
atgcccacatgccgcctggggcccaagtttctcttggtctccggggtcagtgctatggccgccttggattccctttcgctttttacttctctagggttaagcgaacagaaggctagagaaaccctgaaaaattccgctctcagcgctcaattgcgagaagctgccacgcaagctcagcaaactttgggctctacaatcgacaaagctactggcatcctgctctatggcctagcctcgagactaagagacacccgccggttatcattccttgtttcctatattgcatctaagaaaatccacactgaaccacagttgagcgcagcccttgagtacgtgcgttctcatccccttgacccaatcgatactgtagacttcgagagagagtgcggcgtaggggtcattgtgacaccagaacagatcgaggaggccgtggaagccgcgatcaaccgacacagaccacagttactcgtggaaaggtaccattttaatatgggcctgctgatgggtgaagcgagggccgtactcaagtgggcagatggtaaaatgatcaagaacgaagtggatatgcaggttctgcatctcctcggcccaaaacttgaagccgacctcgaaaaaaaatttaaagtcgccaaggccaggcttgaggagacggacaggcgtaccgctaaggatgtagttgagaacggcgagacggctgatcagacactgagtctcatggagcagttaagaggcgaagcgttaaagttccacaaaccaggcacttaccccgtacccgccaggacacagtggaacccagcttattggacatgccaatcacaccagttccaactgtggttatgccaagtgtag

SEQ ID NO: 118648 - DNA, 2874 bp, Artificial Sequence
  Description of Artificial Sequence: Synthetic coding sequence
atgaatttcgccgaacgagagggcagcaagcggtattgcattcagactaagcatgtggctattctttgtgctgttgtggtgggcgttggtctcatcgttggcctggctgtcggcctcactaggtcttgtgactcctcaggagacggtggaccaggtaccgctcctgctccatctcacctgcccagctccaccgccagcccgagcgggccccccgcccaggatcaggatatctgccccgccagcgaggatgagagcggacaatggaaaaactttcgccttccagactttgtgaatcctgtgcactatgacctgcacgtcaagccgttgttggaggaggacacttatactggcacagtcagcatctccatcaatctctctgccccaacccgctacctgtggctgcatcttagagaaactagaatcaccagactccccgagctgaaacgcccatcaggcgaccaagttcaggtgcgccggtgctttgagtacaagaaacaggagtatgtagtagtggaggcagaagaggagcttaccccctccagcggtgacggactctatctgctgaccatggagtttgcaggctggttgaatggatcactggtgggcttctaccgcacaacatacaccgagaatggccaagtgaagagtatagtggccaccgaccacgaaccaactgatgcccgcaagtcttttccctgtttcgatgagcccaacaaaaaagccacctatactatttctatcacacacccaaaagaatatggtgctctgagcaacatgcccgtggctaaagaggagtccgtcgacgacaagtggacccgtaccacctttgaaaaaagcgtgcccatgagtacataccttgtatgttttgccgtgcaccagtttgactcagtgaagcggatctcgaactctgggaaacctctgactatatacgtgcagccagaacagaagcacaccgctgagtacgctgccaacattacaaaatccgtcttcgactacttcgaggagtatttcgcgatgaactatagtctacctaagctggataagatcgccatccctgatttcggaacgggagccatggagaattggggattaatcacctaccgtgaaacaaatctgctttatgaccccaaggagtccgcgtcaagtaatcaacaacgggtggctaccgtggttgcacacgaattagtgcaccagtggttcggcaacatcgtgactatggactggtgggaagatctatggctgaacgaaggctttgctagtttctttgagttcctgggcgttaaccatgccgagaccgattggcagatgcgcgatcagatgctgctggaagatgtactacccgtgcaggaggatgactccctgatgagttctcacccaattatcgtaaccgttactactcccgacgagattacaagcgtcttcgatggcattagctactcaaaagggtcttctattctccgtatgctagaagattggattaagcccgaaaactttcagaagggatgtcagatgtatctggaaaagtaccagtttaagaatgcaaaaacatctgatttttgggcggcactggaggaggcgtcacgcttgccggtgaaggaggttatggacacctggaccagacaaatggggtacccggtgcttaatgtaaacggtgtgaagaatataacccagaagcggttcttgcttgacccccgcgcaaacccctcacagccccctagcgacctcggctatacatggaatatccctgttaagtggaccgaggataatatcacgagctctgtcttgttcaacaggtcagaaaaggagggcatcaccttgaacagtagtaatccatcaggcaacgcgttcttgaagataaatccagatcacatcggattctatcgcgtgaattacgaggtcgcgacatgggattcaatagccacagccctgagcttgaatcacaagactttctcttccgccgatcgtgcctcactaattgacgatgcttttgcactggcaagggcccaattactcgattataaggtggccttaaacctcacaaagtacctcaagagggaggaaaactttttgccctggcagcgagtaatttccgccgtgacgtacatcattagcatgtttgaagacgataaagagttataccccatgatagaagaatattttcagggccaggtgaaacccattgccgacagtctgggttggaatgatgccggggatcatgtgaccaaactgctgagatcatcagttctgggctttgcctgtaagatgggtgacagggaagctttaaacaatgcatcaagcttatttgagcaatggctgaacggcaccgtgagtttacccgtgaatctgaggctactcgtgtacagatatggcatgcagaactctggaaatgaaatcagttggaactacaccctagaacagtatcaaaaaaccagcctcgcacaagaaaaggaaaaactgctgtacgggctggcgagcgttaaaaacgtgacgctcctgtccagatatctggacctgcttaaggacactaatcttataaagacacaagacgtttttacagttattcgctatatatcttacaactcttacggaaagaatatggcatggaattggattcagctgaattgggattatctggtgaatcgttatacattgaacaaccggaacctcgggcggatagtaaccattgccgagcccttcaacaccgagctccagctgtggcagatggagagtttcttcgctaagtatccccaggcaggcgcaggtgagaagccgagagaacaagtgctggagactgtgaaaaataatattgagtggctcaagcaacacagaaacaccattcgtgagtggttcttcaatttattggagtctggctag

SEQ ID NO: 118649 - DNA, 4539 bp, Artificial Sequence
  Description of Artificial Sequence: Synthetic coding sequence
atggcgacactaagtttgaccgtgaattccggggatcccccattgggggcattgctggctgtggaacacgtgaaggacgacgtttccatttctgtggaagagggaaaggagaatatccttcacgtctctgagaacgtaatctttacagacgtgaattctattctccggtacttggccagggtggccactacagccggtctttacggcagcaatttgatggaacacacagagatcgaccactggttggagttttccgctactaaattatcatcttgcgattcattcacatcaaccattaacgagctgaaccattgcctttccctaagaacctatctggtcggaaattctctgagtctggcagatctctgcgtatgggcgactctgaagggcaatgcagcctggcaagagcagctgaagcaaaaaaaagctccggtgcatgtcaaacgctggttcggcttcctggaagcacagcaggcttttcagtccgttgggacaaaatgggacgtatccaccaccaaggccagagttgcgccagagaagaagcaggacgtgggcaagtttgttgagttgcctggcgccgaaatgggcaaggtgaccgtgcgcttcccccccgaggcaagcggttacttacacattggccacgccaaggccgccctcctcaaccagcattatcaagtgaattttaaagggaaattgataatgaggtttgacgacacaaatcccgagaaggagaaagaagattttgagaaagtgattctcgaggatgtcgctatgttacacattaagcctgatcagtttacttacaccagcgaccacttcgagaccattatgaaatacgccgagaagctgattcaagagggaaaggcatatgtggatgacactcctgccgaacagatgaaggctgagagggagcaaaggatcgactcaaagcacaggaaaaatcctatagagaagaatcttcaaatgtgggaggagatgaagaagggcagccagttcgggcagagctgctgtttgcgggcaaagatcgatatgagctcaaataatggatgtatgagagatccgacactttaccgctgtaagatccagccacacccgaggactggtaacaaatacaacgtgtacccaacttatgactttgcctgtcccatagtggatagcattgaaggtgttactcatgccctaagaacaacagagtaccatgacagagacgagcaattttattggattattgaagctctaggtatccgcaaaccctatatctgggaatatagccggctcaacctgaataacactgtactttcgaagcgtaaactgacctggtttgtgaatgagggtctcgtggatggctgggatgatccaagatttcctaccgtgaggggtgtgctaagaagaggtatgaccgtcgaaggcctgaagcagtttatagccgcccaggggtcttcccgttctgtcgtcaatatggagtgggataagatatgggccttcaataaaaaagtgatagaccccgtcgccccacgctatgtggcacttctgaagaaagaagttatccccgtgaacgtccccgaagcccaggaggaaatgaaagaggtggccaaacaccccaaaaatcctgaggtaggtctgaagccagtctggtacagccctaaggtcttcatcgagggcgccgatgcagagacatttagcgagggcgagatggtcacattcattaactggggaaacttgaatatcaccaaaatccacaagaacgcggatgggaaaatcatttcgcttgatgccaaattgaatcttgagaacaaggactacaagaaaacaaccaaggtgacttggctcgccgaaacaacccacgccctaccaataccagtgatctgcgtgacctacgagcacctgattaccaaaccagtgcttgggaaggatgaagacttcaagcaatatgtcaataagaactctaaacacgaggagctgatgctcggcgatccatgtctgaaagatctgaagaagggcgatattattcagctgcagcgcaggggattttttatttgtgatcagccttacgaaccagtatccccctattcttgtaaagaagctccgtgtgtgctgatatatatcccagacgggcatacgaaggaaatgcccactagcgggtctaaggaaaagaccaaggttgaggctacaaagaacgagaccagcgcaccctttaaggaaagaccaacacccagcctaaacaataactgtacaacctccgaagactcacttgtgctttataacagagttgccgtgcaaggagacgtagtgagggaacttaaagcaaaaaaggctccaaaagaggatgtcgatgctgcggtcaagcagcttctgtcactcaaggccgagtacaaggagaaaactgggcaagagtataaacccggcaaccctccagcagaaatcggacaaaacattagttcaaactcatccgctagcattctcgagagtaagagcctttacgacgaggttgctgcacaaggcgaggtcgtgcgtaagctcaaagccgagaagtcacccaaggccaaaattaatgaagccgtagaatgtctgctctcactgaaggcccagtacaaggagaagacaggcaaagagtacattccaggccaaccacctctgtctcagagcagcgattccagccccacgaggaactctgaaccagccggtctggaaaccccagaggcaaaggtgttgttcgacaaagtagcctcacaaggggaggtggtccgcaaactcaagacagaaaaagcaccaaaagaccaggtcgatatcgccgtccaagaattacttcagctcaaggcacagtataagagcttgatcggggtcgagtataagccggtcagcgccactggagctgaggacaaagacaagaagaaaaaggaaaaggagaataaatccgaaaaacagaataagccacagaagcagaatgatgggcaaaggaaagacccctccaagaatcagggaggtggcttatcttcgagcggagccggagagggccaaggtccaaagaagcagacacgtctgggcctggaggccaagaaggaagaaaaccttgctgattggtacagccaggtcataacgaagtcagagatgatcgagtaccacgatattagtggctgttatatcctccggccttgggcctatgctatctgggaggctatcaaagacttcttcgatgcagaaatcaagaagctcggcgtggagaattgctacttccccatgtttgtgagccagagcgctctggagaaggagaagacccacgtcgccgatttcgcccccgaggtggcctgggtaactagatccggcaagaccgagttggcagaacccattgcaatccgacccacctccgaaacagtaatgtatcctgcttacgccaaatgggtgcagtcccatagggatctgcccatcaagttgaatcagtggtgtaacgtggtccgctgggaatttaaacacccgcagccgtttttgcggacccgagagttcctgtggcaggagggccattctgcttttgccaccatggaagaagccgctgaagaagttctccagatccttgacctctacgctcaggtatatgaggagttattagcaattccggtggtcaaaggaagaaagacagagaaggaaaaattcgctggtggggattacacaacaaccatcgaagcgtttataagtgccagtggacgcgctatacaggggggaacttcccatcatctgggacagaacttttctaaaatgttcgaaatagtcttcgaggatcccaagatcccaggagagaaacagttcgcctaccagaactcctgggggctcactactaggacgattggtgtcatgacaatggtgcatggagacaacatgggcctggtgcttccacccagggttgcttgtgtgcaggtggtgattataccttgcggcattacgaacgccttgtctgaggaagacaaggaagccctgattgccaaatgcaacgattataggagacgcctcttgtcagtgaacatccgggttcgggcggacctgagggacaactactcccccgggtggaagttcaatcactgggaactcaagggggtccccatcaggctcgaggtgggacctcgagatatgaagtcttgccagttcgtcgcagtgcgtcgcgataccggcgagaagctcacagtcgcagagaacgaggccgaaaccaagctgcaggctatcctggaggacattcaggtgacactgttcactagggcctccgaagaccttaaaactcatatggtggtggcaaataccatggaagactttcaaaaaatattagatagcgggaagatcgtccagatacccttctgtggcgagatcgactgcgaggactggataaaaaaaaccacagcacgcgaccaggacttggaacctggcgcaccgtcgatgggcgccaaatctctgtgtattccatttaaacctctctgcgagctgcagcctggtgccaaatgtgtatgcggtaagaaccctgccaaatattatacactcttcggcagaagctactag

SEQ ID NO: 118650 - DNA, 2964 bp, Artificial Sequence
  Description of Artificial Sequence: Synthetic coding sequence
atggccacactgtcactgactgtgaatagcggggatcctccccttggcgccttgctggcggtcgaacacgtcaaggacgacgtctccatcagtgtggaggagggtaaggagaacattctgcacgtcagtgagaacgtgattttcactgatgtcaactcaatattgagatacctggctcgcgtcgcaaccaccgccggcctgtacgggagtaatttgatggaacatacagagattgaccattggctcgagttttctgctacaaagttgagttcctgcgattcatttacctctaccatcaacgagcttaatcactgcctttccctgcggacttatctcgtaggaaactcccttagcttagccgacctatgtgtctgggcaaccctaaagggaaacgctgcctggcaggagcagctgaaacaaaagaaggcaccagttcacgtaaagcgatggtttggcttcctcgaagcccagcaggcttttcagtcagttggcaccaaatgggacgtgtccaccaccaaggcgcgtgtggccccagagaaaaaacaagacgtgggcaaattcgtggagctgcctggagcggagatgggtaaggtcacagtgaggttccccccagaagctagtgggtatctgcacatcggccatgctaaagccgctctgttgaaccagcactaccaagttaacttcaagggaaagctcatcatgcggtttgacgacaccaaccctgagaaagaaaaggaggatttcgagaaagtgattaagagtgtcgtgatgacgctgtgccagaagtcaatcaaggtgacggggctgccgaacacattcatggtgattttagaggatgtcgccatgcttcacattaagccagaccagttcacctatacgagtgatcacttcgagacaattatgaagtacgcggagaagctcatccaagaggggaaggcatacgtcgatgatacacccgccgagcagatgaaggcagagcgggagcagaggattgatagcaaacatagaaagaaccctatagaaaagaatctgcagatgtgggaggagatgaaaaaagggtcccagttcggacaatcttgttgcctgcgcgctaaaatcgacatgtcttcgaacaacggctgtatgagagacccaactctgtatcgctgcaagatacaacctcatccacgcactggaaataaatacaacgtgtacccgacgtacgacttcgcatgtcctatcgtagattccatcgagggcgtgacccatgccctgcggacaacagagtaccacgaccgcgacgaacagttttactggatcatagaagcccttgggatccgcaagccgtacatttgggagtatagtcgcttaaacctgaacaataccgtcctttccaagcgcaagctaacttggttcgtaaacgaggggctcgtggacgggtgggacgatcctcggttccctactgttaggggagtcctaagacgtgggatgactgttgaagggctcaagcagttcattgctgcacagggctcatctagaagcgtcgtaaatatggaatgggacaagatttgggctttcaacaagaaagtgatcgatccagtggcacctaggtacgtggcattgcttaaaaaggaagtcattcctgtaaatgtgccagaagcacaggaagagatgaaggaggtggctaagcatccgaagaaccccgaggtaggcctaaagcctgtctggtactcgccaaaggtgtttatcgaaggcgctgatgccgaaacattctcggagggggaaatggtcacttttatcaattggggcaacctgaatattactaagattcacaaaaatgctgacgggaagatcatcagtctggatgccaagcttaatctcgagaacaaggactacaaaaagactacaaaagtaacctggctcgctgaaacaacacatgccctgcccatcccggtaatttgcgtgacttacgaacacctcataacaaagcctgtgctcgggaaagatgaagatttcaaacaatacgtcaacaagaatagtaaacacgaagaactgatgctgggcgatccatgcttgaaagacctaaagaaaggtgatatcattcagctccaacggaggggctttttcatatgtgaccagccctacgagcccgtctccccatactcatgcaaggaagctccgtgtgtgctgatctacattcccgatggacacaccaaggagatgccgacatccggctcaaaggaaaaaaccaaggtcgaagcaaccaaaaacgagacatctgcccccttcaaagagcggccaacaccttctctaaataacaactgcactacaagtgaggattccttggtgttgtataaccgcgtggccgttcagggagatgttgtgcgcgaactgaaggcaaaaaaagctcccaaagaggacgtcgatgcggcagtaaagcagctgctctctctcaaggcagaatataaggagaagactggacaggagtacaaacccggaaaccctcctgctgaaatcgggcagaacatatcctccaactccagcgcgtctatcctggagtctaagtccctgtacgacgaagtggctgcccagggagaggtggtacgtaagctcaaagcagagaaatcaccgaaagccaaaatcaatgaggcagtagaatgccttctgtctctgaaagcccagtacaaagaaaagactgggaaggaatacattccgggacagccaccattaagccaaagtagcgactccagccccactcgtaacagcgagccggctggcctagaaacgccagaggcaaaggtactattcgataaagtggcctcccagggcgaagtcgtacgcaaactgaagaccgagaaggcacccaaggaccaagtggacatcgcagtgcaagagttgttgcaactgaaggcccaatataaaagcctcataggggtggagtataaacctgtcagcgccaccggtgcagaagacaaggataaatag

SEQ ID NO: 118651 - DNA, 2928 bp, Artificial Sequence
  Description of Artificial Sequence: Synthetic coding sequence
atggctactctctctctgacagtgaatagcggcgacccgcctcttggggcactgttagccgtggagcatgttaaggacgacgtgtctatttctgtggaggagggaaaagaaaatattttgcacgtttcggagaacgtgattttcacagacgtgaactcgattctgaggtacctcgctcgagtggccaccaccgctggtctctatgggtcgaatctaatggagcataccgagatcgaccattggctagagttttccgccactaaactctctagctgtgactcctttaccagcactatcaacgaactcaatcactgtctctccctgcggacatacctggtagggaacagcctttcacttgctgacctctgtgtttgggccaccctgaaagggaatgccgcatggcaggaacagctgaaacagaaaaaggcccccgtacacgtgaagcgatggtttgggttcttagaagcacaacaggcctttcaaagtgtagggacgaagtgggacgtatcgacaacaaaggcacgagtcgcccccgagaaaaagcaagacgtgggcaagtttgtggagttgccaggcgccgagatgggaaaagtgaccgtcaggttccctcctgaagcatcaggttacctgcacataggacacgccaaagcggcactcctcaatcagcattatcaggtaaatttcaagggcaaattaatcatgagattcgacgatacgaacccagaaaaagagaaggaggatttcgagaaggttattctggaggacgtcgctatgctgcacatcaagccagaccagtttacatatacctctgatcactttgaaaccattatgaagtacgccgaaaagctcatacaggagggtaaagcatatgtcgacgatacccctgcggagcaaatgaaggccgagagggagcaacgcatcgattcgaaacatcgcaagaaccctattgaaaaaaacctccagatgtgggaggagatgaaaaagggctcccaatttggacaatcttgctgcttgagggcgaagattgatatgagttccaataacggatgtatgagggacccaactctctacagatgcaaaatccagcctcacccgcgtaccgggaataaatacaacgtctacccaacctatgactttgcatgtccaattgtggactcgattgagggagtgacacacgctctgcggacaaccgaataccacgaccgggacgagcagttttattggatcatcgaagccctgggtatccgaaagccttatatctgggaatatagccggctgaacttgaataatacagtgctgtcaaaacggaaactgacatggttcgtgaatgaaggactggttgatggatgggatgaccctagattccccacagtccggggtgttctgagacgcggcatgacagtcgaagggctaaagcagtttattgccgcccagggcagttccaggagtgtggtcaacatggagtgggacaaaatttgggcttttaacaagaaattacgcgccctctgtaaaaaggtcatcgaccctgtcgccccgcgttatgtcgctctgcttaaaaaagaggtcatcccagtgaacgtcccagaggcccaggaagaaatgaaggaagttgctaagcatcccaaaaaccctgaggtcgggctgaaacccgtgtggtactcacctaaagtctttatcgaaggggcggacgccgaaacattctccgagggggaaatggtgacatttattaactggggaaacctgaatattaccaagatccacaagaatgccgacggcaagatcatctccctggatgccaagctcaatctggaaaataaggattacaaaaaaactaccaaggtcacctggctggcagagaccactcatgctttaccgatcccagtcatatgcgttacttatgagcacttgatcacaaagcccgtgctgggcaaggacgaggactttaagcaatacgtgaacaagaatagcaaacatgaggagctgatgctgggggatccttgtctgaaagacctaaagaagggagacatcattcagttgcagaggcggggcttctttatttgcgaccagccttatgagcccgtgagtccctattcttgcaaagaggcaccgtgtgtgttaatttacattcccgacgggcacaccaaagagatgccaaccagcggctctaaagagaaaacaaaggtggaagcaacaaaaaacgagacctccgcaccgttcaaggagaggcccactcctagtctgaacaataattgtacgacctcagaagattccctggtcctctacaacagagttgccgtccagggcgacgtggtcagggaattaaaggctaagaaagccccgaaagaagacgtagatgcagccgtgaaacagttgctttccctgaaagcagaatataaggagaaaacgggccaagagtacaaacccggtaatcctcctgccgagattgggcaaaatatatcctctaatagcagcgcctctatattggagtctaagtctttgtacgacgaggtggccgcacagggcgaagttgtccgcaagctgaaagccgagaagtcccccaaagcaaagattaacgaagctgttgagtgtctgttgagccttaaggcccagtataaggaaaagaccgggaaggagtacatacccggtcaaccacctctttcacagtcttctgattcatcccctacccgaaactctgaaccagcgggccttgagactcccgaggccaaagtgttgtttgataaggtggcttcacaaggtgaagtcgtaagaaagctgaaaaccgaaaaggcacctaaagaccaggtggacatcgcggtccaggagctgctgcagttgaaagcacagtacaagtccttaattggggtcgagtacaaacccgtcagtgcgacaggagccgaggacaaggataaaaagaagaaagagaaatag

SEQ ID NO: 118652 - DNA, 1572 bp, Artificial Sequence
  Description of Artificial Sequence: Synthetic coding sequence
atggccgctctgctgagacgtttgctacaaagggaacggccaagcgccgccagcggcaggcccgtaggcagacgcgaggcaaatctcggaacagatgccggcgtggcagtgcgcgtgaggttcgcaccttcgccgacaggattcctgcatctagggggactgagaaccgcgctgtataactacatattcgcaaaaaagtaccagggatcgttcattttgcgcctggaagacaccgaccaaacgagggtcgtgcctggggctgccgagaacattgaagacatgcttgagtgggcagggatacctcccgacgaatcccctcgccgtggcgggccagccggaccctaccagcagtcacagcgcttggagctttacgcccaggccacagaagcactgctgaagactggggcggcgtatccgtgcttctgttcaccccaaagactcgaattgttgaagaaggaggctctgaggaatcaccagacccctcgctacgacaaccgctgtaggaacatgtctcaggaacaagtcgcccaaaagcttgccaaggatcccaagcctgccatcagattccgcctggaacaggtggtccccgccttccaagaccttgtttatggatggaatcgccatgaagtggccagcgttgaaggagaccccgtaataatgaagtctgacgggttccccacataccatcttgcatgcgtggtggatgaccatcatatgggcatctcccatgtcctccgcggcagcgaatggctcgtttccacagctaagcacctactgctgtaccaagctctgggttggcagccccctcactttgcccacctgccccttcttctcaaccgcgacggatccaagctatccaagaggcagggtgacgtcttcctcgagcattttgcggctgacggcttccttccagactccttattggacatcatcacgaattgtgggagcgggttcgcagagaatcagatgggacgaaccctgcctgagctgatcacacagtttaatttaacacaggtaacctgccactctgctctgctggatctcgagaagctgcccgagtttaacaggttgcatctgcagcgcctcgtgtccaatgagagtcagcggcggcagctggttggaaaattacaggtcctcgtggaggaagcatttggttgtcagttacagaaccgggacgtgttgaatccagtttacgtggaacgtatccttctgttgaggcagggacacatttgccgtctgcaggacctggtgtcgcccgtatattcgtacctgtggacccggcccgccgtcggccgagcccaattggatgcaatatccgagaaggtggacgttatcgccaagcgagtgctcgggctgctggagcgttcaagcatgagtctgactcaagacatgctgaacggagagctgaagaaactaagtgaggggttggaggggacgaagtatagtaacgtaatgaaactcctccggatggctctatccgggcagcagcaaggcccacctgtcgcagaaatgatgcttgccctgggaccaaaggaagttcgggagcggattcaaaaggtcgtgtccagttag

SEQ ID NO: 118653 - DNA, 1572 bp, Artificial Sequence
  Description of Artificial Sequence: Synthetic coding sequence
atggccgcccttctcagacggctgctgcagcgagaaagaccatctgcagccagcgggagacctgtgggccgacgtgaggctaacttgggcacagatgctggcgtggccgtgagggtccgttttgcccccagtcccacaggtttcctacatctgggaggcctccgaaccgctttatataactacatcttcgccaagaagtatcaaggttccttcatccttcggctcgaggatacagatcagactcgagtggttccaggggcagctgaaaacattgaagacatgctggaatgggcaggaatcccccctgatgagagcccccggaggggcgggccagccgggccttaccaacagtctcaacggctcgagctgtacgcacaagcaacagaagccctgctgaagactggagccgcctacccctgcttctgcagcccgcagaggcttgaactcctcaaaaaagaagcgttgcgtaatcatcaaactccccggtacgataataggtgccggaacatgtcccaggaacaggtagctcagaaactggctaaagacccaaagcctgccatcagatttagactggagcaagtggtccccgctttccaggaccttgtctacggttggaatcgccacgaggttgccagcgtcgaaggggaccctgtcatcatgaagtccgacggcttccccacctatcatctggcctgtgtagttgacgaccatcacatgggtatctctcatgtgttaaggggctccgagtggctagtgtccaccgcaaagcatctccttctttaccaggccctcggctggcagccccctcattttgcacatttgcccctactattgaacagagacggtagtaaacttagcaagagacagggggatgtgttcctggagcacttcgctgcagacgggttcctccctgattcacttctggatatcatcacaaattgtggaagcggatttgcggagaaccaaatgggcagaactttgcccgagttgatcacacagttcaatctcactcaggtgacttgccactcagctctccttgatttagagaaattgcccgaattcaatcggctccatctgcagcgactcgttagcaacgagtcacaacggagacagttggtggggaaacttcaggttctagtggaggaagccttcggttgccagctccagaaccgagacgttctgaatcccgtgtatgtggaaagaattctgctcctgagacaggggcacatttgccggctacaggacctagtttcaccagtttactcttatctgtggaccaggccagccgtaggccgagcccaacttgatgcgatttctgagaaggttgatgtgatcgctaaaagggtcctgggactcctcgagaggtcatctatgtcactgacgcaggacatgcttaacggtgagcttaagaaactgtcagagggccttgagggaactaaatacagcaatgtgatgaagctcctgagaatggcactgagcgggcagcagcagggccctccagttgcagagatgatgctggctctcggaccaaaagaagtgagagaacggattcagaaggtggtgtcttcttag

SEQ ID NO: 118654 - DNA, 321 bp, Artificial Sequence
  Description of Artificial Sequence: Synthetic coding sequence
atggctcaggagtttgtcaattgcaagatccaacccggaaaggtcgtcgtgttcatcaagcctacctgcccatattgcaggcgagctcaggagattctgagtcagttacctatcaaacaaggactgctggaattcgtggatattaccgccactaatcataccaacgagatccaagattatctgcaacaactgacgggggctcgcactgtacccagggttttcatcgggaaagattgtattggggggtgcagtgacttggtgtccctgcagcagagcggtgagctgctgacccgcctgaagcagatcggtgccctgcagtag

SEQ ID NO: 118655 - DNA, 321 bp, Artificial Sequence
  Description of Artificial Sequence: Synthetic coding sequence
atggcccaagaatttgtcaattgcaaaatacagccaggtaaggtggtggttttcatcaaacccacttgcccatactgtagaagggcacaggaaatcctgtcccagctacccattaagcagggcctgctggaatttgtggatattacagctaccaaccacaccaatgagattcaggactatctgcagcagctgacaggggcccgtacagtacctagagtttttattggtaaggattgtatcggcggctgctccgacctggtctctttacagcaaagcggtgaattactgactcgcctaaagcaaatcggagccctgcagtag

SEQ ID NO: 118656 - DNA, 321 bp, Artificial Sequence
  Description of Artificial Sequence: Synthetic coding sequence
atggcacaagagtttgtgaactgcaagatccagcctggtaaggtggtagtgtttatcaagccgacttgcccctattgcagaagagcacaggaaatcctaagtcagcttcccatcaagcaaggcctgctcgaatttgtggacatcaccgctaccaatcacacaaatgagatacaggactatctgcagcagctgaccggggctcgcactgtcccacgcgtgtttatagggaaggattgtatcggtggctgctctgacctagttagcttgcaacagtccggtgaactcctcacaaggctgaagcaaataggtgccctccaatag

SEQ ID NO: 118657 - DNA, 321 bp, Artificial Sequence
  Description of Artificial Sequence: Synthetic coding sequence
atggcgcaggaatttgttaattgcaaaatccagccaggtaaggtcgtggtgttcataaagccaacctgtccatactgtaggcgcgctcaagaaatcctatcccagctcccaatcaaacagggtctcctggagttcgtggatatcacagccacaaaccacaccaatgagattcaggactacctgcagcaattgaccggagcccgcaccgtgccaagggtctttattggtaaggactgcattggaggatgttcggatctggtctccctgcagcagagcggagaactactgacccgcctgaagcagataggtgccctccagtag

SEQ ID NO: 118658 - DNA, 321 bp, Artificial Sequence
  Description of Artificial Sequence: Synthetic coding sequence
atggctcaagagtttgtcaattgtaaaatccagccaggcaaagtggtggttttcataaaaccaacctgtccttattgtagacgggcgcaagaaatacttagccagctgccaatcaagcagggactgctggagttcgtcgatatcactgccaccaatcatactaatgagatacaggactacttacagcaactgacaggggcaaggaccgtaccccgtgtcttcattgggaaggattgcatcggcggctgtagcgacttggtatcgctgcagcagtccggggaactcctcacacgccttaagcagatcggcgctttgcagtag

SEQ ID NO: 118659 - DNA, 495 bp, Artificial Sequence
  Description of Artificial Sequence: Synthetic coding sequence
atgatctggagacgagccgcgttggcaggcaccaggctagtgtggagtcgctctggtagcgcggggtggctcgaccgcgccgctggagctgcaggggcagcagccgcagccgcaagcggcatggagagtaacacatctagttctctggagaacttggctacggcacccgtcaatcagatccaagaaacgatttcagacaactgcgtcgttattttttcaaagacctcttgcagctactgtaccatggccaagaagctgtttcatgatatgaacgttaactacaaggtggtagagctcgacctgctcgagtatggcaatcagtttcaggacgccctgtacaagatgactggcgaaagaaccgttcctcgaatatttgtgaatggaacctttattggtggagctaccgatacccaccgcctccacaaagaggggaaacttctcccactggttcaccagtgctacctcaaaaagtcaaagcgaaaagaattccagtag

SEQ ID NO: 118660 - DNA, 498 bp, Artificial Sequence
  Description of Artificial Sequence: Synthetic coding sequence
atgaacccgcgggataagcaagtaagccggttttcgccactgaaagatgtgtacacctgggtggcacttgccggtatccagagatccggctctccggggcggacgcgctcagccgcccgccgcatggagagtaatacctctagtagtctggaaaatttggctaccgctcccgtgaatcaaatccaagagactatctcggacaactgtgtcgtcatcttctccaagacttcgtgttcatattgtacgatggccaaaaaacttttccacgacatgaatgtgaactataaagttgttgaactggatctgcttgaatacggaaatcaattccaagacgctctgtataagatgacaggtgaacggaccgttccccgcatctttgtgaacggaacattcatcggcggggccactgacacgcatcgattgcataaagagggaaaacttctgcccctcgtgcatcaatgctaccttaaaaagagcaaacgaaaagaatttcagtag

SEQ ID NO: 118661 - DNA, 1008 bp, Artificial Sequence
  Description of Artificial Sequence: Synthetic coding sequence
atggctgcaggtgcagctgaggcagccgtggcggctgtcgaagaggtcggcagtgcaggccaatttgaagaactgttaaggctgaaggctaagtctcttttggtggtccatttttgggctccgtgggcgccccagtgcgcccagatgaatgaagtgatggccgaactggctaaggaactcccacaggtatcttttgtgaaattggaggccgagggagttcccgaagtctctgagaagtatgaaatatcatcagtgcccacgttcctgttctttaaaaacagccagaaaatcgaccggctcgatggtgctcacgccccagaactaacaaagaaagttcaacgccatgcaagctcaggatcgtttctgccttccgccaatgaacatcttaaagaagatcttaacctccggctcaaaaagctcactcatgccgcaccatgtatgttattcatgaagggcacccctcaagaacctcgctgtggatttagtaaacagatggtggagatcctccataagcataatattcagttctcttcctttgatatatttagcgacgaggaagtgaggcagggactgaaggcatactcctcatggcccacatatccccaattgtatgtctccggcgaactaatcggaggattagacatcatcaaggagctcgaggcaagcgaggagcttgacaccatatgcccaaaagcacctaagttggaagaaagactgaaggtcctgactaacaaggcctccgtgatgttgtttatgaaaggcaataaacaggaggctaagtgcggcttttcaaaacagatactggaaattctcaactctaccggcgtggaatacgagaccttcgatatcctggaggatgaagaggtccggcaggggctgaaagcctactccaactggcctacttatccgcagctgtacgtgaagggcgagctggtaggcggcctcgacatagtgaaagagctgaaagagaacggcgaactactcccaattctccgaggggagaattag

SEQ ID NO: 118662 - DNA, 1008 bp, Artificial Sequence
  Description of Artificial Sequence: Synthetic coding sequence
atggcagctggcgccgcggaagctgctgtcgccgcagttgaggaggtgggctcagccggccagtttgaagagttgctgaggttgaaggccaagtccctcctcgtagtgcacttttgggctccgtgggctcctcagtgcgcccagatgaatgaggtgatggcagaactcgccaaagagttgccacaggtgtcgttcgtaaagctggaagctgagggagtgcccgaggtgagcgagaaatatgaaatctccagcgttcccaccttcctcttctttaagaactcccagaaaatcgatcgcctcgacggagcacatgcccctgagctgactaaaaaggtccagcgccatgcctcttccggtagttttttacccagtgcaaatgaacacctgaaggaggatctcaatctacgtcttaagaagctgactcacgctgctccgtgcatgctttttatgaaaggcacaccacaggaacccagatgtggctttagcaagcaaatggttgagatcctccacaagcataacattcagttctcttcattcgatatcttttcagatgaggaggtgaggcaggggctgaaggcgtactcctcctggccaacctatccccaattatatgtgagcggagaactcattggtggattggatataatcaaggaactggaggccagcgaggaactggacaccatctgtcctaaagcccctaagttggaggagagactcaaagtgctgacaaacaaagcttcagtaatgttgtttatgaaggggaacaagcaagaggcaaagtgcgggttttcaaaacagatactggagatattaaattctaccggagtagaatatgagacattcgatatcctggaagacgaagaggtaaggcaagggctgaaagcttacagtaactggcccacatacccacagctgtatgtcaaaggtgagctcgttggaggcctggatattgtaaaagaattaaaagagaatggagagttgctgcccatcctgcggggggagaattag

SEQ ID NO: 118663 - DNA, 1008 bp, Artificial Sequence
  Description of Artificial Sequence: Synthetic coding sequence
atggcagcgggggctgcagaagctgccgttgctgccgtggaagaggttgggtccgcgggccagtttgaggaactcctgcgcctcaaggcaaaatccctgttggttgtgcacttctgggccccctgggccccccagtgtgcacaaatgaacgaagttatggcagagctagccaaggagttgcctcaagtgagcttcgtcaaactcgaggccgagggtgtacctgaagtgtctgaaaagtatgagattagcagtgtgcccacattcctcttttttaagaatagtcaaaaaattgataggctggatggggcgcatgcacccgaattgacaaaaaaggtgcagcgacacgcctcctccggttctttcctacctagtgccaacgaacatttgaaagaggacctgaatttacgattgaagaagctcacccacgctgccccatgcatgctctttatgaaaggtacaccccaggagcctcgatgtggctttagcaagcagatggtggaaatccttcacaagcataatatccagttttcaagcttcgacatattctcagacgaagaagttcgccaaggactgaaggcctattcgtcctggccaacatatccacagctctacgtaagcggggagctgattgggggcctcgatattattaaggagctggaggccagcgaggagctcgacaccatctgcccaaaagctcctaagctagaggagaggctaaaggtcctgactaacaaagctagcgtgatgcttttcatgaagggtaacaaacaggaggccaaatgtggattctcaaagcagatcctggagatcctcaacagcaccggggtggagtacgagacattcgacatcctggaggacgaggaagttagacagggcctgaaggcctactcgaattggcctacatacccacagctgtacgtgaagggggagctggtaggaggcctggacatcgttaaggaattgaaggaaaacggcgagctgctccccattttgaggggcgaaaattag

SEQ ID NO: 118664 - DNA, 474 bp, Artificial Sequence
  Description of Artificial Sequence: Synthetic coding sequence
atgagtggaagtctggggcgggccgctgccgccctcttaagatggggtcgtggtgctggtggcggtggactctggggccccggggtccgcgccgccggtagcggtgctggggggggcggctcagcagaacagctcgacgctctggttaaaaaggacaaggttgtggtttttctgaaagggactccagagcagccccaatgcggcttctccaacgcagttgtgcagatattacggttgcacggggtgcgggactacgccgcttataatgtgctggatgatcccgagcttcggcagggtattaaagactattccaactggcctacaatcccacaggtgtatctgaacggagaattcgtgggaggctgcgacatcttgctccagatgcaccagaatggagatctggtggaggagctgaaaaagttgggaatccattcagcgctgttggacgaaaagaaagaccaggattccaaatag

SEQ ID NO: 118665 - DNA, 873 bp, Artificial Sequence
  Description of Artificial Sequence: Synthetic coding sequence
atgcttaagagggaaatgaagcccgaatctgatcgaccgagaaaagtgcggttcaggatcgcttcctcccatagcggccgtgtgttaaaggaagtgtatgaagacggccagcccagtggatccctagacagcgagtgcgctagcatctgcggaatagatggcctcggcgatagcgatggacagcagaatgggcatatagagagcgagggagatgagaacgagaacgaccaagacagcctcctcgtccttgctcgcgctgctagtgaaaaaggcttcggtactagaagagtcaatattttgagcaagaacggcacagtgcggggtgtgaagtacaaggtaagcgctgggcaggcgctcttcaacaacctgactaaggtgctgcagcagccctctactgatctcgagtttgaccgcgtagtaatctacacgacgtgtctgagggtcgtgagaactacattcgagcggtgcgaactggtccggaagattttccaaaatcacagggtgaagttcgaggaaaaaaatatagccttgaatggcgagtatggaaaggaactggacgaacggtgccgacgcgtgagtgaggccccatcgcttcctgttgtctttatcgatggacactacttggggggggccgaaaagatcctgagtatgaatgaatctggggagctgcaggacatcctgactaagatagagcgcgtacaacacccacatgaatgcccgagttgcggagggttcggatttttgccgtgcagcgtgtgtcacggcagtaaaatgagtatgttccggaattgtttcactgatagctttaaagccctgaaatgtacagcctgcaacgagaatggcctccagagatgcaaaaactgcgcaggttag

SEQ ID NO: 118666 - DNA, 828 bp, Artificial Sequence
  Description of Artificial Sequence: Synthetic coding sequence
atgagccactgctcctcccgcgctctgaccctcctgagctccgtgtttggtgcttgcgggctgcttctggtggggatcgctgtctccactgattattggctttatatggaagagggaactgtgctgccacagaatcagactaccgaagtcaagatggctctgcatgctggactgtggcgggtctgctttttcgctggacgcgaaaaagggcgctgcgtcgcttctgaatactttctggaacctgagatcaacctagtgaccgaaaataccgagaacattctcaagaccgtacggaccgcaacacccttcccaatggtctccctcttcctggtgttcactgccttcgtcatctcgaatattggacatatacggccccagaggactattctcgcttttgtgtccggcatcttttttattctttctggcctgtctctggtcgtgggtctggtgctgtatatcagcagtatcaacgatgaggtgatgaaccgcccttctagctccgagcagtacttccactaccgatatggctggagttttgcttttgccgcttcctctttcctcctcaaagagggcgcaggtgttatgagtgtctatctctttacaaagagatacgccgaggaggaaatgtataggcctcaccctgccttctaccggcctcgcctgagtgattgttcagattattctgggcagtttctgcagccagaggcctggcgcagaggccggtctcccagcgatatttcctctgatgtttctatacagatgacacaaaattaccctccagcgatcaagtaccctgatcaccttcacatttcaacctccccctgctag

SEQ ID NO: 118667 - DNA, 987 bp, Artificial Sequence
  Description of Artificial Sequence: Synthetic coding sequence
atggccctccggggcgttagcgtgcgtctgttgtcgagagggcccggactgcatgtactgcggacatgggtaagcagcgccgcccagactgcctctagacccgagttcgattggcaagatcctttggtgctggaggagcaattgactacagatgagatattgatcagagacacctttaggacttactgccaggaacgcctcatgccccgcattctcttggcgaaccggaatgaggggtatggttgcgcgggggtgagctccgtcgcctatgggcttttagctcgagagttggaacgcgttgactccggctacaggagcgctatgagtgtccagtcttccctcgttatgcaccccatctatgcttatggaagtgaggaacagaggcagaaatatctgccacagttggccaaaggggagttgttaggatgctttggactcacagagcctaacagcggtagcgatccgtcaagcatggagactcgtgcacattataactcgagcaacaaatcatacaccctgaatggcaccaagacctggatcaccaatagccctatggcggacctatttgtcgtgtgggctcggtgcgaggacggttgtataagagggtttctgctggagaaaggcatgaggggccttagtgccccccggatccagggaaagttcagtcttagagcctcggccaccggcatgatcataatggacggagtggaggtgccagaagaaaacgtcctccctggcgccagcagccttggtggtccctttggctgtcttaataacgcgcgctacgggatcgcatggggcgttctgggtgcttccgagttctgcctgcacaccgcacgccagtatgccttggacagaatgcagttcggcgtccccctcgcgcgaaaccagctgattcagaaaaagcttgccgatatgttgacggagattacactcggcctgcacgcgtgtctccagttggggcggcttaaagaccaagataaatag

SEQ ID NO: 118668 - DNA, 1185 bp, Artificial Sequence
  Description of Artificial Sequence: Synthetic coding sequence
atgagatctagcagcgggaccccctctgccccgactgcccgccgcgactcatgcctggctagctgttggcccatcgcgactaagagcctcgcactgttgccgcggttggaatgctcaggtaccattttagcccactgcaagttttgtctgccaggatcgtcagactccccagcttcaacccccctcgttgccggaatcactggatacgggtgcgccggagtgagtagtgtggcctatggtctgcttgcaagggagctagagagagtagactccggttaccgcagcgccatgtccgtacaatctagtctggtgatgcatcctatatacgcctatgggtcagaggagcagcggcagaagtatctcccgcagctggctaaaggagaactcctgggatgtttcggtctgacggaacctaacagcgggtctgatcctagttccatggagacacgggcacattataacagctctaacaaatcatacacactgaacggtacaaagacatggataacgaactctcctatggccgatcttttcgtagtgtgggcacggtgtgaggacggctgcattcgagggttccttctcgagaaaggaatgaggggattgtctgcccccaggattcaaggtaaattctcactgagggcgagcgcgaccgggatgataatcatggatggtgtggaagtgcccgaggagaacgtcctcccaggcgcttcttctctaggcggtcccttcggttgtctgaataatgcccggtacggtatagcttggggtgtcttaggcgcttccgagttctgtctgcacacggctaggcagtatgccttggaccgcatgcagttcggcgtgcccctagcacggaatcagttgatccagaaaaagttagccgacatgctgactgagattaccttgggcctgcacgcctgtctgcagctggggcggctgaaggaccaagacaaagcagcacccgaaatggtcagcctgctcaagcgcaacaattgcggaaaagcactcgacatcgctagacaggcgagagacatgctgggcggaaatgggattagtgacgagtatcatgttattcgccatgcgatgaacctcgaggcagtcaatacatacgaaggaacacatgacatacacgctctgattctgggcagggctattacaggcatccaggcattcacggcttctaagtag

SEQ ID NO: 118669 - DNA, 1287 bp, Artificial Sequence
  Description of Artificial Sequence: Synthetic coding sequence
atggctttgcgtggagtgtccgtccgcctgctgtcccggggacctggcctgcatgtattgagaacatgggtctcatccgcagctcagacagagaaaggagggcggacacaaagtcagctggccaagagctccagacctgagtttgattggcaggatcctctggtgttagaagagcaacttactactgatgaaatcttaattagggacaccttccgcacgtattgtcaggagcgtttgatgccgagaatcctgcttgctaaccgaaacgaagtgtttcaccgggaaatcatctctgagatgggcgaattgggagttctgggtcctacaataaaaggctatggctgtgcaggggtctcctctgtggcttacgggcttctcgcgcgcgaattagagagagtggactccggttatcggagtgccatgagcgtgcagtctagtttggtgatgcatccgatctacgcatacggatccgaggagcaaaggcaaaaatacctaccccagctggccaagggcgaactgctgggatgtttcgggctaactgaaccaaatagcggcagcgacccatccagcatggagacccgcgcacactacaactctagcaacaagagctatacactaaacggcacaaaaacctggataactaactcgccaatggctgatctgttcgttgtttgggcaaggtgcgaggacgggtgcatccgagggtttctactcgagaaagggatgagggggctgagtgctccccgtatccaggggaagttttccctgcgggcatcagccacaggtatgattatcatggatggggtggaggtgcccgaagagaacgtgctgccgggagcctcatctctcggcggccctttcggttgcctaaataacgcaagatacggcattgcatggggagttctcggggctagcgagttctgtttacacaccgccaggcaatacgcactggaccgcatgcagtttggggtgcctctggccaggaatcagttgatccagaagaagctggctgacatgctgaccgagataactttggggctgcacgcctgcctgcaattgggaagactcaaagatcaggataaggctgcacctgaaatggtcagcctgctcaagagaaataactgcggtaaagccctggacattgctcgccaagctcgggatatgctcgggggtaatgggatatcagatgaatatcacgttatacgccatgcgatgaatctggaagctgtgaatacatatgaagtggtgcagatgtgttccctgaagcggaggtggaatagcttgtag

SEQ ID NO: 118670 - DNA, 297 bp, Artificial Sequence
  Description of Artificial Sequence: Synthetic coding sequence
  Description of Combined DNA/RNA Molecule: Synthetic coding sequence
atgtgcgcggctcgtctagctgcagctgcagcagcagcacagagcgtttatgcattttccgcgagacctctggccggtggcgagcccgtgtcccttgggagcttacgaggtaaagtgcttttaatcgaaaacgttgcctcactgugaggtacgacggtgcgggattacactcagatgaatgaattgcaacgcagacttggtccaaggggactggtggtgctgggttttccttgtaaccaattcggccatcaggtccgcagggccgagagaggaggcgctggagcagacgtacagtag

SEQ ID NO: 118671 - DNA, 612 bp, Artificial Sequence
  Description of Artificial Sequence: Synthetic coding sequence
  Description of Combined DNA/RNA Molecule: Synthetic coding sequence
atgtgcgcagccagactggccgcagccgccgccgccgctcagtctgtatatgctttcagcgcccggcccctggcaggaggagagcccgtctctctgggctcattgcgcgggaaggtccttctgatagaaaatgttgcatcacttugaggcactaccgttcgggactacacacaaatgaacgagctgcagcggaggctcgggccgcggggcctggtagtgttgggttttccctgcaaccaattcggccatcaggaaaacgctaagaatgaagaaattttaaatagccttaagtatgttcgtcccggaggcggcttcgagcccaacttcatgctctttgagaaatgcgaggtcaacggagccggtgcgcacccgcttttcgctttccttagagaagctctcccagcgccttcagacgacgcgaccgcactgatgacagatcccaagctgattacatggtcacccgtctgccgcaatgatgtcgcctggaactttgaaaagttcttggtcggccctgacggtgtaccgcttaggagatactccaggagattccagactattgacattgaaccagatattgaggctctgctgtctcagggcccctcttgcgcctag

SEQ ID NO: 118672 - DNA, 573 bp, Artificial Sequence
  Description of Artificial Sequence: Synthetic coding sequence
  Description of Combined DNA/RNA Molecule: Synthetic coding sequence
atggccttcatcgctaaaagtttttatgatttaagcgcaataagcctggacggagagaaagtcgactttaacacctttaggggcagggccgttctgatcgagaatgtggcctccttaugagggacgaccacaagagacttcacacaactgaacgaactgcagtgccgcttccctaggcgacttgtggtcctaggattcccctgcaaccagtttgggcatcaggagaattgccagaatgaggaaatccttaattctcttaagtatgtgcgacccggcggaggataccagccaacctttaccctcgtgcagaagtgtgaggtgaacggccagaatgaacatcccgtgtttgcgtatcttaaggataagctaccctatccatacgatgacccattctccctgatgactgatcctaaactcattatctggtcccctgtgagacgaagcgatgtggcttggaactttgagaagtttctcatcggacctgagggtgaaccatttcgtaggtattcaaggactttcccgactattaacatcgagccggacatcaaacggctcctaaaggttgctatctag

SEQ ID NO: 118673 - DNA, 594 bp, Artificial Sequence
  Description of Artificial Sequence: Synthetic coding sequence
  Description of Combined DNA/RNA Molecule: Synthetic coding sequence
atgagcctgggacggctctgcaggctgctcaaacccgcccttctgtgtggggccctcgcagcccctgggctcgccggtaccatgtgcgccagtcgcgatgactggcgatgtgcacggagtatgcacgagttcagcgcgaaagacatcgacggccacatggtgaatctggataaataccgggggttcgtgtgcatcgtcacaaacgtcgcgtctcagugaggtaagacggaggtgaattacactcagttggtggacttgcacgctcgctacgctgagtgcggcttaagaattcttgccttcccctgcaatcagttcggaaagcaggagcctggctccaatgaggagatcaaggagtttgcagccgggtacaatgtcaagtttgacatgttttctaagatttgcgtgaacggcgatgacgcccatcccctgtggaagtggatgaagatacagcccaagggtaagggcattctcgggaacgcaatcaagtggaacttcacgaaatttctcatcgataagaacggctgcgtcgtgaaacggtacggcccaatggaagagcctctagtgatcgaaaaagacctcccacactacttctag

SEQ ID NO: 118674 - DNA, 666 bp, Artificial Sequence
  Description of Artificial Sequence: Synthetic coding sequence
atgactacccagttgcgggtggtgcatctcctccctctcctcctggcgtgcttcgttcagacctcacctaagcaggaaaagatgaagatggattgtcataaggacgaaaagggtactatatatgattatgaggctatcgccctgaataaaaatgaatatgtctcttttaagcagtacgtaggtaagcacatcttgttcgtcaatgtcgctacatattgtgggctgaccgcacagtacccagagctcaatgcgttacaggaggagcttaagccatatggccttgtggttctcggctttccgtgtaatcagttcgggaagcaagaacctggagataacaaggaaatcttacccgggctgaaatacgttagacctggcgggggcttcgtgcctagcttccagctgtttgagaaaggcgatgtaaacggagagaaggagcagaaagtcttttcttttctgaaacattcatgcccacatcctagtgaaattcttggtaccttcaaatcaatcagctgggatcctgtgaaggtgcatgacattagatggaacttcgagaaatttttggttggccccgatggcatcccagttatgaggtggtcacaccgtgccaccgtatctagtgtgaagacagatattttggcttacctcaaacagttcaaaactaaatag

SEQ ID NO: 118675 - DNA, 303 bp, Artificial Sequence
  Description of Artificial Sequence: Synthetic coding sequence
atgaccacgcagctgcgcgtggtgcacttgctgcctctcttactggcatgtttcgtccagacatcacctaaacaggagaagatgaaaatggattgccacaaggacgagaaaggaacaatttatgactacgaggctattgcgctgaacaaaaatgaatacgtttccttcaaacagtatgttgggaaacacatattattcgtgaatgtggccacttattgtggcctcactgcacagtaccccggaatgagcgttcagggcgaggatctgtacctagtgtcatcttttcttaggaaggggatgtag

SEQ ID NO: 118676 - DNA, 573 bp, Artificial Sequence
  Description of Artificial Sequence: Synthetic coding sequence
atggctgagaagacccagaaatctgtaaagattgccccgggcgcagtggtgtgcgttgaatcggaaatcaggggtgacgtaaccatagggccacgcacggtcatccaccccaaggctaggataatcgccgaagcggggcctatcgtcatcggagagggtaatttgattgaggagcaagccctgattattaatgcctatccggacaacatcactcccgatacagaagatccggagcctaagcccatgattattggcacaaataacgtgtttgaggttggatgctattcgcaggccatgaaaatgggagataataacgtcatcgaaagcaaggcttatgtgggccgtaatgttatactaacttccggatgcatcattggggcctgctgcaatctgaatacgttcgaagtcattcctgagaacacagtcatttacggggccgattgcctccggagggtccagacagagagaccccagccacaaactctgcaactggacttcctgatgaagatcctccctaattaccatcatctaaaaaaaaccatgaaggggtcatccacgccagttaaaaattag

SEQ ID NO: 118677 - DNA, 1440 bp, Artificial Sequence
  Description of Artificial Sequence: Synthetic coding sequence
atggcttgccgccaggaaccccaacctcagggaccaccccctgccgctggagccgttgcctcgtatgactatctggtcatcgggggcgggtccggcggactggccagcgctcgccgggctgcagaattgggagccagggccgccgtcgttgagagccacaaactgggcggcacgtgcgtaaacgtcggttgcgttcccaagaaggttatgtggaacacagcagtccattccgaattcatgcatgaccacgccgactacggctttccaagttgtgagggcaagtttaattggagagttattaaggaaaagagggatgcatatgttagcaggctcaatgcgatctatcagaacaacttaaccaagtctcacattgagattattagggggcacgccgcctttactagcgatcccaaaccaaccatcgaggtgtcaggtaaaaaatacaccgctccccacattctgatcgccaccggaggcatgccctcaactcctcacgaatcccagatcccaggggcaagtttgggcattacatccgacgggtttttccagttggaagagctgcccgggcgctctgtgattgtaggcgcaggttacattgctgttgaaatggcagggatactcagcgccttgggatcaaagacctctttgatgatccggcatgataaggtcttgcgctctttcgacagtatgatttcgaccaattgtaccgaggagttggagaacgcaggtgttgaagtcctcaaattcagccaagtgaaagaggtgaagaagaccctgagcggtttggaagtttccatggttaccgccgtgccagggcgcctgcctgtgatgactatgattcccgacgtggattgcctgttatgggccattggccgggtgcctaacaccaaggacctgagtttgaataaactgggtattcagacagacgacaaagggcacatcatcgtcgatgagtttcagaataccaatgtgaagggaatctacgcagttggtgatgtatgcggaaaggccctgctaacgcctgtggccatcgctgccggtagaaagctggcacaccggcttttcgagtacaaggaagatagtaagctggattataacaatattcccacagtggtcttctcccacccccccattggcactgtcggactaactgaggatgaagccatccacaagtacggtatagagaatgtcaaaacctacagtacttcgtttacaccaatgtatcatgctgttaccaaacggaaaactaaatgtgtcatgaagatggtttgtgcaaacaaagaggaaaaagtggtcgggatacacatgcagggactcggctgtgacgaaatgctgcaaggctttgctgtcgcggtcaagatgggggccaccaaagctgatttcgataataccgtggcaattcatcctacctcttctgaggagctagtgacactccgctag

SEQ ID NO: 118678 - DNA, 1323 bp, Artificial Sequence
  Description of Artificial Sequence: Synthetic coding sequence
atggctctcctgcctcgcgccctctccgctggagccggtccatcatggaggcgggccgcgcgggctttcagagggttcctgctgctcctgcccgaacccgcagccctgacgagggcgctgtctagggctatggcctgccggcaagaacctcagccccagggacctcctcctgcagctggcgctgtcgcaagctacgactaccttgtaataggtggaggttctggggggctggccagcgcccgaagggccgctgaactgggcgccagggcagccgttgtggagagccataagctcgggggcacctgcgttaacgtgggctgcgtgccgaaaaaggtgatgtggaatacagctgtccactctgagtttatgcatgatcatgctgattacggatttccttcatgtgaaggaaaattcaattggagagtgatcaaagagaaacgggatgcttatgtgtcccggctcaatgccatttaccagaacaatctgaccaaatcccatatagaaattatacgaggacacgctgcattcaccagcgatcctaagcctacaatagaagtatctggcaagaagtataccgcccctcacatcctgatcgcgaccggtggtatgccttctacgcctcacgagtcccagattcccggcgccagtcttggaataacgtctgatggtttctttcagcttgaggaacttcccggacgctctgtaatagtgggggccggttatatcgctgttgaaatggcaggcattcttagcgcccttggctccaagacctccctgatgattaggcatgataagggcattcagacagacgacaagggccacattatcgtggacgaattccagaacaccaacgtaaagggaatttacgctgtgggggacgtctgcggtaaggctttgcttaccccagtggctatagccgcgggtagaaagttggctcatcggctctttgagtacaaggaggacagcaagttggactacaataacattcccacggtagttttcagccaccctcccatcggtaccgttggactgacggaagatgaggcaatacataaatatgggatagaaaacgttaaaacctactctacgtcctttaccccaatgtaccatgccgtcaccaagaggaaaactaaatgtgtcatgaaaatggtgtgcgccaataaggaagagaaggtagttggcattcacatgcagggccttggttgtgacgaaatgctccaggggtttgccgtcgcagtgaagatgggcgcgacaaaagctgactttgataacaccgtcgccatacaccctacaagctcagaagagctggtcacgttaagatag

SEQ ID NO: 118679 - DNA, 1410 bp, Artificial Sequence
  Description of Artificial Sequence: Synthetic coding sequence
atggcactgctacctcgagccctttccgctggggctggcccatcatggcggagagcggcccgggcctttagggggtttctccttctgctgccggagcctgctgccctgacacgcgccttaagccgggcaatggcttgcagacaggaaccccagccacaaggacctccgccagccgccggggcagtggccagctatgattacctcgttatcgggggaggaagcggaggactcgcaagcgcgcgacgggcagctgagctgggagctcgtgccgccgtggttgagtctcacaaactcggaggcacttgtgtcaacgtcgggtgcgttcctaagaaggtgatgtggaacacagctgtgcactctgaatttatgcacgatcatgccgactatgggtttccaagttgcgaggggaagttcaactggcgcgttatcaaggaaaaacgggatgcctacgtcagtcggttgaacgccatctaccagaacaacctcacaaaaagtcatattgagatcattcgcggccatgccgccttcacaagcgaccctaaacccacgatcgaggtgtctggcaagaagtacacagctccacatatcttgatcgcgactggcggtatgccatcgaccccccatgaaagccagattccaggtgccagtctcggcataactagtgatggattctttcagctggaggagttgcctgggaggagcgtgatagttggcgccgggtatattgccgtcgaaatggcagggatcctctcagctctgggctcaaagactagtctgatgattaggcatgataaagttctccgttcctttgattccatgatctccactaattgtaccgaagagctggagaacgccggtgtagaggtgcttaagttctcacaagggatccagacggatgacaaagggcatattattgttgacgaatttcagaatactaatgtgaaaggcatctatgccgttggggatgtttgcggcaaggccctccttacccccgtcgccatcgccgccgggcgcaagctcgcccataggctgtttgagtacaaagaggattccaagctcgattacaacaatatccctactgtggtcttctcccatcctcctataggaacggtgggtttgacagaagatgaggccatccacaagtacggcattgaaaatgtgaagacttacagtaccagcttcacacctatgtaccacgcagtgacaaagcggaagacaaagtgcgtcatgaagatggtatgtgccaacaaggaggagaaggttgtaggcattcacatgcagggccttgggtgcgatgaaatgctgcaagggtttgctgtggccgtcaagatgggtgcaaccaaggccgacttcgataatactgtggctattcacccaacatcttcagaagaactcgtcacccttagatag

SEQ ID NO: 118680 - DNA, 1482 bp, Artificial Sequence
  Description of Artificial Sequence: Synthetic coding sequence
atggcgttattaccacgggctttgtcagctggggccggtcctagctggcgccgagcagctcgggcctttcggggttttctcctgctgctcccagagcccgccgccctgactagagctctttccagagcaatggcctgtagacaggaaccccagccgcaaggccccccacctgctgccggcgccgtggcctcttatgactacctggtaatcggaggcggctccggcggccttgcatcggcgaggcgcgctgccgagctgggcgctagagccgccgtggtagaatcccataaactcggtgggacctgcgtcaacgttgggtgtgtgcccaaaaaggttatgtggaacactgccgtgcactctgagtttatgcacgaccatgccgactatggatttccgagctgcgaaggtaaatttaattggagagtcattaaggagaagcgcgatgcctacgttagccggctgaacgcaatctaccagaacaaccttaccaagtctcacatagagattatacgcggacatgcagccttcacttccgacccaaagcccacaatcgaagtgtctgggaagaaatacactgcaccacatatcctcattgcgaccggaggaatgccgtctacaccacacgagagtcagattcccggtgcatctctcggcatcacctccgatgggttttttcagctggaagagctccccggcagatcggttatcgtgggggccgggtacatcgctgtggaaatggccgggattctgtctgcgctgggcagcaaaacaagtcttatgattcgccatgacaaggtgaaagaagtgaaaaagactctgtctggactggaggtttccatggtaacggcggtgcctggaagattacccgtgatgacgatgatcccagacgtcgattgtctgctctgggcgatcggccgtgtgccaaacacaaaggacctctccctcaacaagctaggtatacagacagatgacaagggacacatcatcgtggacgaattccaaaatacgaacgtgaaggggatttatgcagtgggagacgtgtgcggaaaggctttgttaacccctgtcgcaattgctgcagggaggaaactggctcatcggctcttcgagtataaggaagactccaagttggattacaacaacataccgaccgtcgtcttcagccaccccccaattgggacagttggcctgaccgaagacgaggctatccacaagtacggaattgaaaacgtaaagacttatagcacatccttcacgcccatgtaccatgcagtaacaaaacgcaagactaagtgcgtgatgaagatggtgtgcgcaaacaaggaagagaaggttgtggggattcacatgcaggggctcggatgcgatgagatgttgcagggtttcgccgtcgcagtgaagatgggcgcaaccaaggcggactttgataatacagtggctatccatcctaccagcagcgaggagctcgtaacactaagatag

SEQ ID NO: 118681 - DNA, 669 bp, Artificial Sequence
  Description of Artificial Sequence: Synthetic coding sequence
atggccgagaagcctaagttacattacttcaacgcaagaggtagaatggagtcaactcgctggctgctagctgccgctggtgtcgagttcgaggagaagttcattaagtccgcggaggatctggacaagctgcgcaacgacggctaccttatgttccaacaagtgcctatggtggaaatcgatgggatgaagcttgttcaaacccgcgctatcctcaattacatcgcatcaaaatataacctctacgggaaagacataaaagaacgcgcattaattgacatgtacatagaaggaatcgctgacctgggagaaatgattctgttgctgccggtttgtccccccgaggagaaggacgccaaattagccctgatcaaagaaaagataaaaaaccgctatttccctgcctttgagaaggtgctcaaatcacacggccaggattacttggtggggaataaactgtccagagccgacatccacctagtagaactgctttactacgtggaggagctggacagcagtctcatttcatctttccctttactgaaggccctgaagactcgaatttccaacctgcccacagtgaagaagttcttgcagcctggatctcctaggaagcctcccatggatgaaaagtcactcgaggaggctcgaaaaatcttcagattttag

SEQ ID NO: 118682 - DNA, 669 bp, Artificial Sequence
  Description of Artificial Sequence: Synthetic coding sequence
atggccgagaaacctaagctgcattacagtaacatccgaggtagaatggaaagcatccgttggctccttgccgccgctggagttgagttcgaggaaaagtttataaaaagcgccgaagatctggataagctcaggaatgatggctatctaatgtttcaacaagtgcctatggttgaaatagacggcatgaagctggtacagactagagcgattctgaactacatcgctagcaagtataacctatacggaaaggatatcaaagagaaggccttaatcgatatgtatatcgagggaatcgccgacctgggagaaatgatcctgttgctccccttctcccaaccggaagaacaggatgcaaagctggccttgatccaggagaaaacaaaaaacagatacttcccagcctttgaaaaagtgctcaagtcacatggacaggattatttggtaggtaacaaattgtcccgtgcagatatccatcttgtcgagctattgtattacgtggaggagctggattcatctctcatatctagcttcccactcttgaaagcccttaaaaccagaataagtaaccttcccactgtgaaaaagtttctgcagcccggatccccacgcaagccgccaatggacgagaagtcactggaagagtcaagaaagatattcagattttag

SEQ ID NO: 118683 - DNA, 729 bp, Artificial Sequence
  Description of Artificial Sequence: Synthetic coding sequence
atgttgttactggccccccaaatgcttagtttgttgctgcttgcccttccagtgctcgcttcgccagcttacgtcgcccctgctccaggacaggccttgcagcagacaggcatcgtgggtggacaggaggccccgcgatcgaaatggccctggcaagtgtctcttagggtacgcggaccgtattggatgcatttctgtggtggatctttgatccatcctcagtgggtgctgacagccgcccactgcgtggagcctgatatcaaggacctcgcggccctgagggtgcagctgagggagcagcatctgtactatcaggatcagttactgccagtgagcagaataatcgtgcacccccagttttatattatccaaacaggtgcagacattgccttgctcgagctggaagagcccgtcaatatatccagccacatccatacagtgacacttccgccagcatctgaaacgttccccccaggcatgccttgctgggtaaccggctggggcgatgtcgataacaacgtccacctacctccaccatatccgttgaaggaggtagaggtcccagtcgtagagaatcacctgtgcaacgccgagtaccatacaggcctgcacacaggccactcgtttcagatagtgagagatgacatgctgtgtgcagggtccgaaaaccacgacagttgccaaggtgattccggcggacccctcgtgtgtaaagtcaatggaacttag

SEQ ID NO: 118684 - DNA, 519 bp, Artificial Sequence
  Description of Artificial Sequence: Synthetic coding sequence
atgttccaacaggtgccaatggtggagatcgacggcatgaagctcgtacagacccgagccattctgaattatattgccagcaagtataacttgtatggtaaggacatcaaggaacgcgccttgattgacatgtacaccgaaggtatggccgacttaaatgagatgatactgctcttaccactatgtcgacctgaagaaaaagatgccaagatcgccctgatcaaagaaaagactaagtcccgatatttccctgccttcgagaaagtgttgcagtctcatggccaggactatctggttggaaacaagctcagccgtgccgatatttctctggtggagctgctctactacgtcgaagagctggatagttctctgatcagtaattttccactgctaaaagctctcaaaacacgaatatccaatctgcctacagtgaaaaagttcttgcagcctggcagccccagaaagccacccgctgatgctaaggccctggaagaagcacgtaagattttccgattctag

SEQ ID NO: 118685 - DNA, 327 bp, Artificial Sequence
  Description of Artificial Sequence: Synthetic coding sequence
atgttccagcaagttcctatggtggaaattgacggaatgaaattggtgcaaaccagggctatcctcaattatatcgcctcaaagtataacctttacggaaaagacatcaaggaacgcgccctaatcgatatgtacactgagggaatggcagatctgaatgagatgatccttctgctgccgctgtgcaggcctgaagagaaggacgctaagatcgcactcataaaggaaaaaacaaaaagtaggtactttcctgcctttgaggccgacatctctctggtggagctgctgtattatgtggaggaactcgactcaagtttgatttcatag

SEQ ID NO: 118686 - DNA, 669 bp, Artificial Sequence
  Description of Artificial Sequence: Synthetic coding sequence
atggccgccaggcccaagttgcattacccaaacggacggggccgcatggagtcggtgcgatgggtgctggccgctgcgggagtcgaatttgacgaagagttcctcgaaacaaaagaacaactgtataagcttcaggacggaaaccacctactgttccaacaggttccaatggtcgagattgacggtatgaaactggtgcagacacggtccatcctgcattatatagccgataagcacaacttgtttggcaagaatctgaaggagaggaccctcattgacatgtacgtggaaggaaccctggacttgttggagctcttgatcatgcacccattccttaaaccggacgaccagcagaaggaagtagtgaacatggcccaaaaggccatcattagatacttcccagtcttcgaaaaaatactgaggggccacgggcagagttttctggtgggcaatcaactgagcctcgccgatgtaatcctcctccagaccatcctggcactcgaagagaagattcccaacattttgtctgcatttcctttcttacaagagtatactgtgaagctatccaacatacccacgatcaaacgtttcctggagcccgggagcaaaaaaaaacctccacctgatgagatatatgtgaggactgtgtacaatatcttccgcccttag

SEQ ID NO: 118687 - DNA, 390 bp, Artificial Sequence
  Description of Artificial Sequence: Synthetic coding sequence
atgtatgtggaaggcaccctggacctgttggagctgctgatcatgcatccttttctcaaacccgatgaccaacagaaagaagttgtgaacatggcccaaaaagccattatccgatacttccctgtgttcgaaaagatacttagagggcacggccagagttttctcgtgggcaaccaattatccctggctgatgtgattctgctgcaaaccatcctggcattggaggaaaagattcccaatatcctgtctgcttttccattcctgcaggaatacacagtgaaactgagcaacatccccaccataaaaaggtttcttgagcctggatctaaaaagaagcctccacccgatgagatttacgtccgcacagtctacaacatttttagaccttag

SEQ ID NO: 118688 - DNA, 669 bp, Artificial Sequence
  Description of Artificial Sequence: Synthetic coding sequence
atggctgcgcgtccaaaactgcattatcccaacggtcgtggccgcatggaatcggttaggtgggtcctggcggccgctggcgtcgagttcgacgaggaattcctggagacaaaagagcagctttacaaactccaggacgggaaccatctcctgttccagcaagtaccaatggtggagattgatggtatgaagctagttcaaacgaggagtatactgcattatattgcagataaacacaacctgttcggaaaaaacctgaaagagagaacgctgattgatatgtatgtggaaggcacattggatttactggagctgctgattatgcatcctttcctgaaacccgatgatcaacagaaggaagtggtgaacatggctcagaaggctatcatccgttacttccctgtcttcgagaagatactcagagggcacggccagtcatttctggtggggaatcaactttccttagctgatgttatcttactccaaaccatattagcattggaagagaagatccctaacattctcagcgcctttcccttcttgcaggagtacactgtaaagctcagcaacatccccaccataaagaggtttctggaaccgggatccaaaaagaaacctccaccggacgaaatctacgtgcgcaccgtgtacaacatctttaggccttag

SEQ ID NO: 118689 - DNA, 270 bp, Artificial Sequence
  Description of Artificial Sequence: Synthetic coding sequence
atgtatgtcgagggcacgctggatctcctcgagcttctaatcatgcacccctttctcaaacccgacgaccagcaaaaggaagtggtgaacatggcacagaaggccatcatcaggtacttcccggtgtttgagaaaattttacggggtcatggccagtcttttcttgtgggaaaccagctgtcgctcgctgatgtgatactgctgcagactatcctggctttggaagaaaaaattccgaacattctgagtgccttcccgttccttcagtag

SEQ ID NO: 118690 - DNA, 390 bp, Artificial Sequence
  Description of Artificial Sequence: Synthetic coding sequence
atgtacgtagaggggaccctggatttgttggagctgctgatcatgcatccctttcttaaacccgatgaccaacagaaggaggtggtcaacatggcacaaaaggctattatacgatatttccctgtcttcgaaaagattctgcgggggcacggccagtcatttttagtcggtaatcagttgagcttggccgatgttatcctgctgcagacaatcttggccttggaggaaaaaattcctaacattctgtccgcttttccgttcttgcaagaatacacagtgaagctgtctaacattcctaccatcaaacggttcttagaacctggcagtaaaaaaaagcctcccccagacgagatttatgttcgaaccgtatacaacattttcaggccctag

SEQ ID NO: 118691 - DNA, 669 bp, Artificial Sequence
  Description of Artificial Sequence: Synthetic coding sequence
atggcagaaaaaccaaaactacactactcaaacgcccgcggatccatggaatctattaggtggctgttggccgcagctggggttgagctggaagagaagtttctggagtccgccgaagatctggacaagctgcgtaatgacggctctcttctcttccagcaagtacctatggttgagatcgatgggatgaagctggtgcagactcgcgctatcctgaactacatagcctccaagtacaacctatatggaaaagacatgaaggaacgcgccctgatagacatgtataccgagggcattgtggatttgacggagatgatcctgttgttgctgatctgccagccagaggaacgggatgccaagacagctcttgtgaaagaaaaaatcaaaaaccgctatttccctgcctttgaaaaagtgttgaagtcgcacagacaggattatctagtcggaaacaagctctcttgggccgacattcacctggtggaactattctactacgtggaggagctggattcatctttgatcagctcttttcctctacttaaggctctgaagaccaggataagcaacctcccaaccgtaaagaaattcctacaaccagggtcccagcgaaagccaccaatggacgagaagtccctcgaagaggcgcggaaaatatttcggttttag

SEQ ID NO: 118692 - DNA, 669 bp, Artificial Sequence
  Description of Artificial Sequence: Synthetic coding sequence
atggcagagaagcccaaactgcattactcaaatgcacggggctcgatggaaagcattcggtggctcttagcagcagccggcgtggaacttgaagagaagttcctggagtcggcggaggacttggacaaactcaggaatgacggcagccttctatttcagcaagtgccaatggtggagattgacgggatgaaacttgtacagacgcgcgccatcctcaattacatcgccagtaaatataacctttacggtaaagatatgaaagaaagggcgctcatagacatgtatactgaagggatcgttgaccttaccgagatgatcctgctgttgctcatttgtcagcctgaggagagggacgccaaaaccgccctcgtaaaagagaagatcaaaaatagatactttcctgcctttgaaaaggttctaaagtctcatcggcaggactacctggtgggcaataagttgtcttgggcggacatccaccttgtggagcttttctattacgtggaagagctcgactcttccctgatctcatcttttcccctcctcaaagccctgaagacaaggatctcgaatctgccgaccgtgaaaaaatttctgcagccgggctctcagaggaaacctcctatggacgaaaagtccctagaagaggcacgtaagatctttaggttctag

SEQ ID NO: 118693 - DNA, 657 bp, Artificial Sequence
  Description of Artificial Sequence: Synthetic coding sequence
atgccaatgatactagggtactgggacatacggggtctagctcacgcaattagacttctactcgagtataccgatagctcatacgaagagaagaagtacaccatgggtgatgcgcctgattacgacagaagtcagtggctgaacgaaaagtttaagctgggtttagattttcccaacctcccttatttgatagatggggctcacaagattacgcagtctaacgccatactgtgttacattgcgcggaaacacaatttatgcggagaaaccgaagaggaaaagattcgtgtagatatcctagagaaccaaaccatggacaatcatatgcagctaggaatgatttgctacaatcccgagttcgaaaagcttaaacccaagtatctggaagaacttcctgaaaaactcaaactgtactcagagtttctcggcaagagaccttggttcgctggcaacaaaatcacgttcgtggactttctggtgtatgacgtgcttgacctccaccggatatttgagccaaagtgcctagacgcattccctaatttaaaagacttcatctcccgctttgaaggtttggagaaaatttccgcgtacatgaagagctccaggttcctcccgaggcctgtcttctccaaaatggcagtgtggggcaacaaatag

SEQ ID NO: 118694 - DNA, 546 bp, Artificial Sequence
  Description of Artificial Sequence: Synthetic coding sequence
atgcctatgatactgggctactgggacataagagggttggcgcacgctatccgcctgcttctcgagtacaccgatagctcttacgaggaaaagaaatatacaatgggcgatgcccccgattacgatcggagccagtggctaaacgaaaagtttaagcttggcctggactttcctaacctgccatatttgatcgacggcgcacataagattacccagagcaatgcaattctgtgctacatcgcccgcaagcacaacctgtgtggtgagaccgaagaagaaaagatcagagtggatatcttagaaaaccagactatggacaatcatatgcagttaggcatgatatgttacaatcccgagttcgaaaaattgaagcccaagtaccttgaagagctgcccgaaaaactgaagttgtacagcgaattcttagggaagcgaccttggtttgccggaaacaaaggccttgaaaagattagcgcatatatgaagtcctctaggtttcttccaaggcccgttttttcaaagatggcagtgtggggaaacaaatag

SEQ ID NO: 118695 - DNA, 450 bp, Artificial Sequence
  Description of Artificial Sequence: Synthetic coding sequence
atgccgatgatcctaggatactgggacatccgcggactggcccatgccattcggctgcttctggagtatactgactcaagctatgaggagaagaagtatactatgggcgatgcccctgattacgatagatctcagtggctgaacgagaagtttaagctgggcctggatttccctaacctgccttacctgatcgacggcgcgcacaagattacccagagcaatgccatcttgtgttacatcgcacgaaagcataatctgtgcggagagacagaagaggagaagatccgggtggatatcttggaaaatcaaactatggataaccatatgcagttaggtatgatctgctacaatcccgagtttggtctcgagaaaatttccgcttatatgaagtctagtcgcttccttccgcgccctgtgttcagtaagatggcagtgtggggtaataaatag

SEQ ID NO: 118696 - DNA, 714 bp, Artificial Sequence
  Description of Artificial Sequence: Synthetic coding sequence
atgccaatgattctcgggtattgggacatccggggccttgctcacgccataaggctgctgctagaatacaccgactctagctatgaggagaagaaatataccatgggcgatgcgccagactatgataggtcacagtggctcaatgagaagttcaaactggggcttgatttcccgaacgggatgctgggcagcctcgtggctcagttatcatttgctggcttcccttccattcagctaccatatctgatcgatggagctcataagatcacacagtccaatgcgatcctatgttatatagcccgtaagcacaacttgtgcggtgaaacggaagaagagaagatccgtgttgatattcttgagaatcagaccatggacaaccatatgcagttggggatgatctgttataatcctgagtttgagaaactcaagccaaagtatctggaggaattgcccgaaaaactaaagctttactccgagttcctcgggaagagaccctggtttgccggaaacaagataacttttgtggactttctcgtctacgacgttctggaccttcataggatatttgaacctaaatgcctggacgcatttccaaatctgaaggattttatctcacgatttgaggggttagagaaaatcagcgcctacatgaaatcaagtcgtttcctgccgagacctgtgttcagtaagatggctgtatggggcaacaaatag

SEQ ID NO: 118697 - DNA, 657 bp, Artificial Sequence
  Description of Artificial Sequence: Synthetic coding sequence
atgcctatgactttggggtactggaacattcgcggcctcgcgcattctattaggctgctgctcgagtacactgactcttcttacgaggagaagaagtacaccatgggcgatgcgcccgactatgatagatcacaatggctaaacgagaaatttaagctggggctagacttccctaacctgccctacttaatcgacggaacccataaaattactcagtccaacgcaatcctaagatacatcgcgaggaagcacaacctgtgcggggagtccgagaaggaacaaattagagaagacatcctggaaaaccagtttatggattccagaatgcagcttgctaaactctgttatgatccagattttgagaaattgaaacccgagtatttacaggctttgccggagatgcttaaactctattctcagttcctgggcaaacagccgtggttcctgggcgacaagatcactttcgtagactttatcgcctacgatgttcttgagcgaaatcaagtctttgagccaagctgccttgatgcctttcccaacctcaaagacttcatcagcaggttcgaaggcttggagaaaatctcggcatacatgaagtcctcccgttttcttcctaggcctgtgttcactaagatggccgtgtgggggaataaatag

SEQ ID NO: 118698 - DNA, 540 bp, Artificial Sequence
  Description of Artificial Sequence: Synthetic coding sequence
atgaccctgggatattggaacatacgtggattggcccactcaatccgacttctgttagagtatactgacagctcgtatgaagaaaaaaaatacacaatgggtgatgcaccagactacgaccgcagccagtggctgaacgagaagtttaaactgggtttggatttccccaacctgccttacctaattgatggtacgcataagatcacacagtctaacgcgatcctaaggtatattgctcggaagcacaacctctgcggagagagcgaaaaggaacagataagggaagatatcctggagaatcagtttatggattcccgcatgcagctggctaagctgtgctatgatccggactttgaaaagcttaaaccagagtatctgcaggcacttccagagatgctaaagctgtattcacagtttctgggcaagcaaccttggttccttggagataaaggactcgagaagatctcagcatacatgaagtcaagtcggtttctgccgcggccggttttcacaaagatggctgtttggggaaacaagtag

SEQ ID NO: 118699 - DNA, 264 bp, Artificial Sequence
  Description of Artificial Sequence: Synthetic coding sequence
atggattcccgcatgcagctggcaaaactttgctatgacccagatttcgaaaaactgaagcctgaatacctacaggctctacctgaaatgttgaaactctactcccagttccttggaaagcagccttggttcctgggcgacaaaataactttcgtggattttatagcctacgacgtgctggaacgcaatcaggtgttcgaaccaagctgtttggatgctttccctaatctcaaggacttcatctctcggttcgaacatagctag

SEQ ID NO: 118700 - DNA, 576 bp, Artificial Sequence
  Description of Artificial Sequence: Synthetic coding sequence
atgccaatgaccctgggatactggaatatacgaggtctggctcacagtatcaggctgctgttagagtacaccgatagcagctatgaggaaaagaaatacacgatgggggacgctccagattacgataggagccagtggctgaatgaaaagttcaagctgggccttgacttccccaatttgccttatctcattgatgggacccacaaaataactcagtctaatgccattttaagatacattgctcgcaaacacaatctgtgcggtgagtccgaaaaagaacaaatacgagaggatatccttgaaaatcagttcatggacagccggatgcagctggcgaaactgtgctacgatcctgacttcgaaaagctgaagcccgaatatttgcaggctctacctgagatgctgaaactttattcgcagttccttgggaagcagccctggtttctgggcgacaaaataacttttgtggacttcatcgcctacgatgtgttggagcgtaaccaggtgtttgaaccgtcatgtttagatgccttcccgaacctgaaagatttcataagtagatttgagcattcctag

SEQ ID NO: 118701 - DNA, 576 bp, Artificial Sequence
  Description of Artificial Sequence: Synthetic coding sequence
atgccaatgactctgggctattggaatatcagagggctagcccacagtattagattacttcttgagtacactgactcgtcttacgaagagaagaaatataccatgggagacgcgcccgattacgataggagtcagtggctcaatgagaagttcaaacttggtttggatttccccaatctgccttacctgatcgatggcacacacaaaatcacccagtccaatgcgatcctgaggtacattgcgcgaaagcacaacctctgtggcgagagcgagaaggaacaaatacgagaggacattctggagaaccagttcatggactctcggatgcagcttgccaaactatgctacgacccagactttgagaaattgaagcccgagtaccttcaagccttgcccgaaatgctcaaactctactcacaattcctgggcaagcagccatggttcctgggagacaagataactttcgtggattttatagcttatgacgttctggagcgcaatcaggtttttgaacccagctgtttggacgcctttcctaatctaaaagacttcatatctcggttcgagcacagctag

SEQ ID NO: 118702 - DNA, 678 bp, Artificial Sequence
  Description of Artificial Sequence: Synthetic coding sequence
atgtcttgcgagtctagcatggtcctggggtactgggacatcaggggcttagcacacgctattagactgctgttagagttcacggacacctcatacgaggagaaacgctacacttgtggcgaggctccagattatgatagatctcagtggctggacgtgaagtttaaattggatctagatttccccaacttgccttacctgctggatggcaagaacaagattacacagtccaatgctatactccggtatattgcccggaagcataatatgtgcggagagactgaagaagagaaaattcgtgtggatattatagaaaaccaggtgatggattttcgtacgcagctgattcgcctgtgttattcttcagaccatgaaaagctgaaacctcagtacctagaggagctgccaggtcagcttaagcaattcagtatgtttcttgggaagttcagttggttcgcaggggaaaagctcactttcgtggattttctgacttacgacatcctggaccaaaataggatcttcgaccctaagtgtctcgatgagtttcccaacttgaaagctttcatgtgccggttcgaggctcttgagaaaatcgcggcctacttgcagagtgaccagttttgtaagatgcccatcaacaacaagatggctcagtggggcaataagcccgtttgttag

SEQ ID NO: 118703 - DNA, 678 bp, Artificial Sequence
  Description of Artificial Sequence: Synthetic coding sequence
atgtcttgtgagtcttctatggtgctcggctattgggatatcagggggctggcccacgcgatcaggctcctcttagagtttacggacacctcatatgaggagaaaaggtacacatgtggagaggcccctgactatgaccgcagccaatggcttgatgttaagtttaaactagatctggactttccgaatctaccttatttgttggacggaaagaataagatcacgcagtctaatgcaatcctcagatatattgccaggaagcacaatatgtgtggcgagaccgaggaggagaaaatccgggttgacatcattgagaatcaagtgatggactttcgcacgcagctgatccgcctttgctacagcagtgaccacgaaaagctaaagccccagtacttggaggagctgcctggccagctgaagcagtttagcatgttcctgggcaagttcagttggttcgccggggaaaaactgacattcgtagacttcctgacctacgatattctggaccagaatcgaatttttgatcccaaatgcctggacgagttccccaatcttaaagcattcatgtgtagattcgaggctcttgaaaaaattgctgcatatctgcagtctgaccagttctgcaagatgcctatcaacaacaaaatggcacagtgggggaataaacctgtctgctag

SEQ ID NO: 118704 - DNA, 678 bp, Artificial Sequence
  Description of Artificial Sequence: Synthetic coding sequence
atgagttgtgaatcttccatggtgttaggctactgggatattcgaggactggcccatgccattcgattgctgcttgagttcaccgatacatcgtatgaggaaaaaagatatacatgtggcgaggcgcctgattacgatcgttcccaatggctggatgtgaagtttaaattggatttggacttccccaacctgccctacctcctcgatggcaaaaacaagatcacacagtcaaacgcaattttgcggtatattgctaggaagcataacatgtgcggggagacggaagaagaaaagatcagggtcgatatcattgaaaatcaagtaatggactttagaacgcaactcattaggctctgctactcttccgaccatgaaaagctgaagccccagtacctcgaggagctgcccggccaactgaaacaattctcaatgtttttgggcaagttttcatggtttgcgggcgagaagttgactttcgtagattttctcacatacgatattctcgatcagaatcgtatttttgaccccaagtgtctggacgagtttccaaacctgaaagcattcatgtgcaggttcgaggccctggagaagatcgcagcctacctgcagagtgatcagttctgtaaaatgccaatcaacaataagatggcccagtgggggaataagcccgtctgttag

SEQ ID NO: 118705 - DNA, 588 bp, Artificial Sequence
  Description of Artificial Sequence: Synthetic coding sequence
atgagcatgacactcggatactgggatatccgcggcctcgcacacgccataagactgttgctggagtacacagacagcagctacgaggagaaaaaatatactatgggtgatgcgccagattatgacagaagccagtggctgaacgaaaaatttaagctaggcctcgacttccccaatctgccatatctcattgacggcgcccacaaaatcacacagtctaacgctattctgtgttacatcgcacgaaagcacaatctatgcggggagacggaggaagagaaaatccgcgtggacatccttgaaaatcaagccatggatgtttctaatcagttggcccgcgtctgctatagccccgacttcgaaaagctaaagcccgagtatctggaagaactgcctaccatgatgcaacacttctctcaatttcttgggaagaggccatggttcgtgggagacaagatcacttttgtggatttcctcgcatatgacgttttagatttgcaccggatatttgagcctaactgcttagacgcctttcctaacctgaaggacttcatctctagattcgaagtaagttgcggcataatgtag

SEQ ID NO: 118706 - DNA, 474 bp, Artificial Sequence
  Description of Artificial Sequence: Synthetic coding sequence
atgagtatgaccctgggatactgggacattcgtgggctcgcccacgctataagattgctgttagaatacaccgatagttcatatgaggaaaagaaatacaccatgggcgatgcccctgactatgacaggagccagtggctgaatgaaaaatttaagttggggctggattttcccaatgagaagctgaagcctgagtacctggaggagcttcccacaatgatgcagcacttttctcagtttctgggcaagcggccatggttcgtcggagacaagatcacattcgtggactttctggcctacgacgtcttagacttgcaccgcatttttgaacctaactgtctcgacgcattccctaatttaaaagattttatctctcgatttgaagggctggagaagattagtgcatatatgaaatctagcagatttcttcccaagcctctctatactcgggtggctgtgtggggaaacaaatag

SEQ ID NO: 118707 - DNA, 609 bp, Artificial Sequence
  Description of Artificial Sequence: Synthetic coding sequence
atgctaggtagccttttggcccaattgtctttcccaggatttccgtccattcagctgccttatctcatcgatggcgcccacaagatcacacagtctaatgccatactttgttacattgcccggaaacataacctatgtggtgagactgaggaggagaagatcagggtggacatcctcgagaaccaggcgatggacgtttctaatcaactagctcgcgtgtgttacagcccagatttcgagaagctcaaacccgagtaccttgaagaacttcctacaatgatgcagcatttctctcagtttctggggaagcggccatggttcgtgggggataagatcacgtttgttgacttcctggcttacgacgttctagatctccaccggatttttgagcctaattgcctcgatgcctttcccaatttgaaggacttcatatcgcgctttgaggtcatgcccccctcttcgttcctcttcgacgcaccatgttccgtcacctcctttcagatgctgagccaatcctggagctacataaagaataatctgcacttgctcagcgcaggatttatgcctggtaccttgcctagtacactgtacctgtcctgtggcatttag

SEQ ID NO: 118708 - DNA, 657 bp, Artificial Sequence
  Description of Artificial Sequence: Synthetic coding sequence
atgtcaatgactctgggctactgggatatccgcggactcgcacacgcaatcagactcctgcttgagtataccgatagctcttacgaagagaaaaagtatacaatgggagacgccccggactatgatcgcagccaatggctcaatgagaaattcaagctggggttggatttccccaatcttccgtatctgatagacggcgctcataaaatcactcaaagcaacgccattttgtgttacattgcccgaaaacataatttgtgtggcgagacagaggaagagaagatcagagtggatatactggaaaatcaagcgatggatgtgagcaatcagttagctagagtttgttactctcctgactttgagaagctgaagcctgagtacctggaggagttacctacgatgatgcagcacttcagccagttcttaggaaagcggccgtggttcgtgggggacaagataactttcgtcgatttcttggcgtacgacgttcttgatttgcaccggatcttcgaaccgaactgtctggatgcctttcctaacttgaaagatttcatttcccggtttgaagggctcgagaaaatctccgcatacatgaaaagttcccggttcctgcccaaacccctctacacgcgagtggcggtctggggcaacaagtag

SEQ ID NO: 118709 - DNA, 657 bp, Artificial Sequence
  Description of Artificial Sequence: Synthetic coding sequence
atgccaatgacactcggctactgggacatccgcggcctggcccatgctattcgcctcttgctggaatatacagactcttcttatgtggagaagaaatataccttaggggatgcacctgattacgatagaagccagtggctcaacgagaagttcaaactcgggctcgatttccccaatctgccctacttgattgatggcgctcataaaattactcaatcgaatgcaattctcaggtacattgctaggaagcacaacctctgtggagagaccgaggaggagaaaatacgagtcgacatccttgagaatcaagtcatggacaatcacatggagctggtaaggttgtgttatgatccagattttgagaaattaaagccgaaatatctcgaggaattgccggagaaactgaaattatatagcgagttcctgggcaagagaccttggtttgcgggggacaagatcactttcgtggacttccttgcctacgacgtactcgacatgaagaggatctttgagcccaagtgtctggacgcatttctgaatctcaaggacttcatttcacgatttgaaggcctaaagaagatctctgcatacatgaagtcctcgcagtttctacgtgggctgctgttcgggaagtccgctacctggaattcaaagtag

SEQ ID NO: 118710 - DNA, 714 bp, Artificial Sequence
  Description of Artificial Sequence: Synthetic coding sequence
atgccgatgaccctggggtattgggacataaggggcctcgcacacgccattcggctactgctggaatacaccgactcttcctacgtggaaaagaaatacacgctgggcgatgccccagactatgatcgatcccagtggctgaacgagaagttcaagcttgggctggattttcctaatgggatgctgggaagtcttgtggcgcagctttcatttccgggatttccgtccattcagctcccttatctcattgatggagcgcataaaattacccaatctaacgcaatactgcgttatatcgcccgtaagcataatctgtgtggagaaaccgaagaagaaaagattcgggtggatatcctggagaatcaagtgatggataaccacatggagttggtgcgcctgtgctatgacccggattttgagaagctcaaacccaagtacctggaagagctgccagaaaaactgaagctctactctgagtttctggggaagcggccctggttcgccggggataagataacctttgttgatttcctcgcatatgacgtgctcgacatgaaaaggatcttcgagcccaaatgcctcgatgcgttcttgaacctgaaggactttatatcaaggttcgaagggctgaagaagatttcagcgtatatgaaaagcagccagttcctccgtggactactgttcggaaagtccgccacatggaacagcaagtag

SEQ ID NO: 118711 - DNA, 609 bp, Artificial Sequence
  Description of Artificial Sequence: Synthetic coding sequence
atgctcgggtccctagtggcccagctctccttccccggtttcccctcaattcagctgccctatctgattgatggagcccacaaaataactcagagcaacgctatactgaggtacatcgcccgcaaacacaatttatgcggcgagaccgaagaggagaaaattagagtagacattctagaaaaccaagtgatggacaatcatatggagttggtgcgcctgtgctatgacccagactttgaaaaactgaagccaaagtatttggaagaattacccgagaagctgaaactgtatagcgagttcctggggaagagaccgtggtttgcgggggataagataacgtttgtggattttctggcctatgatgtcttagatatgaagagaatttttgaacccaaatgccttgacgccttcctgaatctcaaagatttcatatctaggttcgaggtcatgccacccagttctttcttgttcgatgcaccgtgttcctttctatccttccagatgctgagtcagtcctggtcctatactaaaaataattcctacgtgctgagtaccggctttatgccaggaatcatgccgtctactctgtacctgagctgcagaatttag

SEQ ID NO: 118712 - DNA, 627 bp, Artificial Sequence
  Description of Artificial Sequence: Synthetic coding sequence
atgtcaggggaatccgccaggtcacttggtaaggggtcggctcctccaggcccagtcccagagggatctattagaatctactccatgcggttttgcccgttcgccgagcgaacgagacttgtgctgaaagcaaaggggataaggcatgaagtcatcaatattaacctcaagaataagccagagtggttcttcaagaagaatccttttggactcgttccagtgctggagaatagtcagggacagctgatctacgagagtgctataacctgcgaatacctggacgaggcttacccgggaaaaaagctgctcccggatgacccttatgaaaaggcctgccagaaaatgatcctcgagctctttagtaaggtgctgaccaataaaaagacaaccttcttcggaggcaattcaatatctatgatcgactatcttatatggccttggtttgagcggctggaagccatgaagctgaatgaatgcgtggaccatacccctaaactgaagctttggatggctgccatgaaggaagatcctacagtgtctgctctactgacttctgaaaaggattggcagggatttctggagttgtatcttcagaattctccggaggcatgcgattacggcttgtag

SEQ ID NO: 118713 - DNA, 726 bp, Artificial Sequence
  Description of Artificial Sequence: Synthetic coding sequence
atgtcaggggagtccgccagaagcctcggcaaggggtcagctccgcctggacccgtgccggagggaagtattcggatatacagtatgagattctgtcccttcgcggaacgaactcggctggtgctcaaggcgaaggggatacggcacgaagtaatcaatatcaacctgaagaacaagcccgaatggttttttaagaaaaacccttttggcctggtgcctgtcctggagaactctcagggccagctaatatacgagagcgcgatcacctgtgagtaccttgacgaagcctaccccgggaaaaagctgctccctgacgacccgtacgaaaaggcatgtcagaagatgatcctggaactgttctcaaaggtaccatctttggtggggtcattcattaggtctcagaacaaagaagactatgctggcttgaaggaggagttccgcaaagagttcactaaacttgaagaggtgctaacaaataagaagactacattttttggaggtaatagtatctccatgatcgactatctcatttggccctggtttgagcggttagaggccatgaagttaaacgaatgtgttgaccacacccccaagcttaaattgtggatggcagccatgaaagaagacccaaccgtgagcgcattgcttaccagcgagaaggattggcaaggcttcctcgaactgtacctccaaaactctcctgaggcctgcgattacggactgtag

SEQ ID NO: 118714 - DNA, 543 bp, Artificial Sequence
  Description of Artificial Sequence: Synthetic coding sequence
atgagattctgtccttttgccgagagaaccaggctggtgcttaaggcaaagggcattcggcacgaggtcatcaatattaacctcaagaacaaaccagaatggttctttaagaagaaccctttcggcctcgtgcctgtgttggaaaacagccaagggcagctgatttacgaaagtgccattacgtgtgagtatctggacgaggcttaccctggcaaaaaactcttgccagacgatccctatgagaaagcttgccagaagatgattcttgaactgttctccaaggtactcaccaataagaaaacaaccttttttgggggaaatagtattagcatgatagattacctcatttggccttggtttgaaaggctcgaggccatgaagcttaacgagtgtgtggaccacacgcccaagctgaagctctggatggctgcgatgaaggaagatccaacagttagcgctttgcttacttctgagaaagattggcagggattcctagaattgtacctgcagaattcaccagaggcttgcgattatggcctgtag

SEQ ID NO: 118715 - DNA, 603 bp, Artificial Sequence
  Description of Artificial Sequence: Synthetic coding sequence
atgaggttctgtcccttcgcagaacgtacccggctggttctgaaagcaaaagggatccggcacgaggttatcaatatcaatctgaagaacaagcccgagtggttttttaaaaagaacccattcggacttgtacccgtcttggaaaattctcaagggcagcttatttatgaaagcgccatcacttgtgagtatttagatgaggcgtacccgggtaagaaactccttcccgacgatccatatgaaaaagcttgtcaaaaaatgatcctcgagctgttcagcaaggtgccgtctctcgtcggctcttttattagatcccaaaacaaggaagactatgctggactcaaggaggaattcagaaaagagttcaccaagctagaagaagtcctgacaaataagaagacaacctttttcggagggaacagcatttctatgatagattatcttatttggccctggttcgaacgtctcgaggccatgaagctgaatgaatgtgtggatcacacccccaagcttaagctatggatggctgccatgaaagaggatcctacagtgtcggctctcctgacatcggagaaagattggcaagggtttttagagctgtag

SEQ ID NO: 118716 - DNA, 642 bp, Artificial Sequence
  Description of Artificial Sequence: Synthetic coding sequence
atgcggttttgccctttcgccgagcgcacccggctcgtgctaaaggccaaagggatccgtcacgaggttatcaacattaacctaaagaataaacctgagtggtttttcaaaaagaaccctttcggccttgtccccgtattggaaaacagccagggccagctcatctatgagtctgccatcacttgcgagtacctcgacgaagcatacccagggaaaaaactgctgccggatgacccatacgagaaagcttgccaaaagatgattttagaactattctctaaagtcccctcactcgttgggagctttatacggagccaaaacaaagaggattatgcaggcctcaaagaagaatttcgtaaggagttcactaaactggaagaggtgctcacaaacaagaagacaaccttcttcggtggaaacagcatctctatgattgattacctgatatggccctggttcgaaagactcgaagctatgaagttgaacgaatgcgttgatcacacaccaaaactgaagctctggatggccgcgatgaaagaagatcctacggtctcagcattgctgacttccgagaaagattggcaaggatttctggaattatatctccagaattctccagaggcctgtgactatggactatag

SEQ ID NO: 118717 - DNA, 732 bp, Artificial Sequence
  Description of Artificial Sequence: Synthetic coding sequence
atgagtggcgacgctacaaggacccttggcaaaggtagccaacctcctggtcccgtacccgaaggcctgattagaatttattcgatgaggttttgtccttatagtcacagaaccagacttgttctgaaagctaaagatatcagacatgaagtagttaacattaatctgagaaacaaaccagagtggtattatacgaagcacccatttggccacattccagtcctggaaacttcccagtgccagctcatctatgagtccgtgatagcatgcgaatatctagacgatgcctatccgggtcgaaagctttttccttatgacccttatgagcgggcacgccagaaaatgctgcttgagctgttttgcaaggtgccacacctcacaaaagaatgtctggtagctttgcgatgtggaagagagtgtacaaacctgaaagccgcattacggcaagagttttcgaaccttgaggaaatcctcgaataccaaaatactactttcttcggaggaacatgcatctccatgatcgattatttgctatggccatggtttgagcggctcgacgtttatggcattttggactgtgtgagccatacgcctgccctgcggctgtggatttctgcaatgaagtgggatccaaccgtttgtgcactgttgatggacaaaagcatcttccaaggttttttaaatctttacttccagaacaaccccaacgcatttgactttggactgtgttag

SEQ ID NO: 118718 - DNA, 648 bp, Artificial Sequence
  Description of Artificial Sequence: Synthetic coding sequence
atgcgcttttgcccgtatagtcacagaactagacttgtgctcaaagcgaaagacattcgacacgaagtcgtgaacataaatctccgtaacaagccagagtggtactacaccaagcatccatttgggcacattccggtgttagaaacctcccagtgtcagttaatctacgagagtgtaatcgcatgcgagtatttggatgatgcatatccgggccgtaagctctttccatacgatccttacgagcgagccagacaaaagatgctgctcgagcttttctgcaaagtgccccacctgacgaaagaatgcctggtggcattgcgttgtgggcgggagtgcactaacctgaaggccgccctgagacaggagttctccaacctagaagagattttagagtatcagaatactaccttcttcggcgggacctgcatctcaatgatcgactacttattatggccttggttcgagcgacttgacgtctacggaatcctggactgtgtgtctcatacccccgccctgcgcctatggatatccgcgatgaaatgggatccaacagtgtgcgcactcctgatggataaatctatattccagggatttttgaatttgtacttccagaataatcctaacgcttttgacttcggcctttgctag

SEQ ID NO: 118719 - DNA, 732 bp, Artificial Sequence
  Description of Artificial Sequence: Synthetic coding sequence
atgagcggcgatgctaccaggacactgggaaagggtagccagcctcccggaccggtgcccgagggccttatccgaatctatagtatgagattttgcccctactcccacaggacccgcctggtccttaaagctaaggacattcgtcacgaggtcgtgaatatcaatcttcgaaataagcctgagtggtactacaccaaacatccatttggacacattcctgtgcttgagacaagtcaatgtcaactgatctacgagtctgtcatcgcttgcgaatatttggacgacgcataccctggcagaaaactatttccgtacgacccatatgaaagggctcggcaaaaaatgctcttggagctattttgtaaagtcccacacctgaccaaagaatgtctggttgccttgagatgcggccgggagtgtacgaaccttaaagccgccctacgccaggagttctcgaaccttgaagaaatcttggagtatcagaacactaccttttttggggggacttgcatttctatgatcgactacctgttgtggccctggtttgagcgcctggatgtttacggaattcttgattgtgtgtctcacactccggccctgcgtctctggatcagcgcgatgaagtgggaccccactgtttgcgctctcctgatggataagtccatcttccagggctttctcaacctgtacttccaaaacaacccaaatgcgttcgattttggcctctgctag

SEQ ID NO: 118720 - DNA, 501 bp, Artificial Sequence
  Description of Artificial Sequence: Synthetic coding sequence
atgagtggcgacgctactaggaccctgggcaagggcagtcaaccacccggcccagtgcctgagggcttgatccggatctattcgatgcgattctgcccctattcacataggacacgcttggtcctcaaagccaaggacatacgtcacgaagttgtgaacataaacctcaggaataagccagagtggtactatactaagcacccatttggacatatacccgtgctggagaccagtcaatgccagctcatttatgagagtgttattgcctgtgaatatcttgacgacgcgtaccctggaaggaagctattcccatatgacccctatgaacgcgcccgtcagaaaatgctgctggaactgttctgcaaggttccacacctaacaaaggaatgtttggtcgcgcttcgatgcgggagagaatgtaccaatctgaaggctgcactccggcaggaattctccaatctagaggaagataggaagaagagaaagttcatacccggatag

SEQ ID NO: 118721 - DNA, 366 bp, Artificial Sequence
  Description of Artificial Sequence: Synthetic coding sequence
atgcggttttgtccatactcccatagaacccgccttgtacttaaggccaaagatatccggcatgaggttgtgaatattaacctgcgtaacaaaccagagtggtactatactaagcatccatttggtcacatcccagttcttgaaacctctcagtgtcaactcatttatgagagcgtgatcgcctgtgagtatctagacgatgcttaccctggtaggaagctgtttccttacgatccctacgaaagagcccggcaaaagatgctgctggaactgttttgcaaattgtgcgaaccacacgcgagccctgccgctctggatattagccacgaagttgggccccacagtctctgcagctcacatggctag

SEQ ID NO: 118722 - DNA, 630 bp, Artificial Sequence
  Description of Artificial Sequence: Synthetic coding sequence
atgtctggcgatgcaactagaacactgggtaagggatcccagccccccgggccggtgcctgagggattaattcgtatctattcaatgaggttctgtccctatagtcaccgaactagattggtcctgaaagccaaagatattaggcacgaggtagtgaatataaacttgcgaaataagccagagtggtattatacaaaacacccttttggacacatacctgtcctggagaccagccagtgtcagttgatctacgaaagtgtaatcgcctgtgagtatctcgacgatgcttacccgggaaggaaactgtttccctacgacccctacgagagagctaggcagaaaatgctccttgagctgttctgcaaaatcctggaatatcagaatacaacattctttggcgggacctgcatctccatgattgattatttgctgtggccatggttcgagcggctggacgtatacggaatactggattgcgtatctcacactcctgccctaaggctgtggattagcgccatgaaatgggatccaaccgtctgcgcccttctgatggacaagtcaattttccaggggtttcttaatttgtactttcaaaacaatccaaatgcctttgattttggcctttgctag

SEQ ID NO: 118723 - DNA, 723 bp, Artificial Sequence
  Description of Artificial Sequence: Synthetic coding sequence
atgggcctggaactgtacctcgaccttctgtcacagccgtgccgggccgtttacatctttgccaagaaaaatgacatcccatttgagctgcgaatcgttgacctaataaaaggccaacacctgtctgacgcgttcgctcaggtcaatccgctgaaaaaagtgccagcattaaaggatggagactttacattaactgaatccgtggcaatactactttaccttaccagaaagtacaaggttcctgactattggtacccccaagatcttcaggcccgggcacgcgtcgacgaatacctggcctggcaacatactacattacgccgcagctgcctccgagccctgtggcacaaagtgatgtttccggtcttcttgggggagcccgttagcccacagacactcgcagccactctcgccgagctcgacgtcacactgcagctcctggaagacaagtttttgcaaaataaggcctttctcaccgggccccacatttctctggccgacctggtggccattaccgaactcatgcaccccgtgggggctggctgccaagtgttcgaaggtcgcccgaagctggccacttggaggcaaagagtagaggccgccgtaggcgaggacctatttcaagaagcccatgaggttatcttgaaggctaaagatttcccccctgctgatcccaccataaagcagaaactgatgccctgggtcttggccatgattcggtag

SEQ ID NO: 118724 - DNA, 486 bp, Artificial Sequence
  Description of Artificial Sequence: Synthetic coding sequence
atgggacttgagctgtacctggatcttttatcacaaccctgcagagccgtgtacatcttcgccaagaaaaacgacatccctttcgagcttcgcatagttgacctcatcaagggcgtgatgttccctgtgtttcttggagagcctgttagcccacagactttagccgcaaccttggctgagctggatgtcaccctccaactgctggaagacaaattcctgcaaaataaggcctttttaactggaccccacatctcgcttgcagacttagtcgctataactgagttaatgcacccagtcggggccggttgccaggtgtttgagggccggcccaagctagcgacgtggcgacagcgggtcgaagctgcggttggtgaagatctgtttcaagaggctcacgaagtaattctgaaggcgaaagacttcccaccagctgatcctacaatcaagcagaagcttatgccctgggtgttggcaatgattcggtag

SEQ ID NO: 118725 - DNA, 369 bp, Artificial Sequence
  Description of Artificial Sequence: Synthetic coding sequence
atgttcccagtgttcctgggggagcctgtcagtccacagaccctggcagccacactggcagagttagacgtgaccttgcagctgctagaagacaagttcctgcagaataaggcctttctaacgggtccacatatttcacttgctgatctcgtcgctatcacagagcttatgcatcccgtgggcgccggatgtcaagtcttcgaaggcaggcctaagctcgccacgtggagacagcgcgtagaagcggccgtgggagaagatttattccaagaagcccatgaagtaattctgaaggctaaagactttccacccgcagatcccacaatcaagcaaaaactgatgccgtgggtgcttgctatgattcggtag

SEQ ID NO: 118726 - DNA, 198 bp, Artificial Sequence
  Description of Artificial Sequence: Synthetic coding sequence
atgggcctcgaactctacctggatctgttgtcgcagccctgcagggccgtttatattttcgccaagaaaaacgacatcccatttgagctccggattgtcgacctcattaagggtcaacacctgagtgacgccttcgctcaagtcaatcccctgaaaaaggtgccggccctgaaggatggtgatttcacacttacatag

SEQ ID NO: 118727 - DNA, 219 bp, Artificial Sequence
  Description of Artificial Sequence: Synthetic coding sequence
atggggctggagctttatctagatctgttgagccagccttgtagagcggtgtacatctttgccaaaaaaaatgatattcccttcgagcttaggattgtcgacctcatcaaggcccgagggtgttggcttccttctttaaggcgtcccacccaggccgggcacatggcagctgcgcgagggggttcgtctggaggaggaccactgccgggtgggccctag

SEQ ID NO: 118728 - DNA, 405 bp, Artificial Sequence
  Description of Artificial Sequence: Synthetic coding sequence
atgccctttctcgagttagacaccaatctcccagccaatcgcgtgcctgccggcctggaaaagagactatgcgctgccgcagcctctattctgggcaaacctgccgatcgcgtgaacgtgacagttagaccggggctggcaatggccttgagcggcagtacagagccttgtgcccagttatccatttcctctatcggcgttgtcggcactgccgaggataaccggtcccattctgcccacttcttcgagttcctgaccaaggagctggcactgggccaggacaggtttccaactgtcctgtccacttcccccgcagctcacggcggccctagatgtcctggagagattatagaagggaagaagtcatgcttaaatgaagaagctttgttcatctactttatctag

SEQ ID NO: 118729 - DNA, 831 bp, Artificial Sequence
  Description of Artificial Sequence: Synthetic coding sequence
atgcccgtgcctgcctcatggccacaccctcccggccctttcctgctccttaccctgctcctgggcttaaccgaagtcgctggcgaagaggagctacagatgatccagcctgagaagctgcttttggtgaccgtgggaaaaaccgccacactgcactgtacagtgacctccctgttgccagtagggcccgtcttgtggttcagaggcgtcggaccggggagagagctcatctacaaccagaaagaaggtcacttccctagagtgactaccgtctcagacctcaccaagaggaataacatggactttagcatacggatcagcagtatcaccccagctgacgtcggaacctattattgcgtgaaattcaggaagggctctcctgaaaatgtggagttcaagtctggtcctggcacggaaatggctctcggcgctaagcccagtgcccccgtcgtcttagggccagcggcccggacaacaccggaacacacagtgagctttacttgcgagagccatggttttagtcccagggacatcactctgaagtggttcaaaaatggaaacgagctatccgactttcagaccaacgtggatcctaccggccagagcgtcgcctatagcatccgatctaccgctagggttgtgctagacccttgggacgtccggtctcaggtgatctgcgaggttgcacacgtgacactgcagggtgatcctttacgaggaacggcaaatctgtcagaggccatccgcggccctgcctcttccttgacagctctgctgctcattgccgtcctcctgggcccaatttacgttccctggaagcagaaaacctag
